United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 88

SEQ ID NO: 3143037 - RNA, 21 nt, Mycobacterium bovis subsp bovis AF2122/97
cgacggcgcccgcccgagccg

SEQ ID NO: 3143038 - RNA, 13 nt, Mycobacterium bovis subsp bovis AF2122/97
cgacggcgcccuu

SEQ ID NO: 3143039 - RNA, 14 nt, Mycobacterium bovis subsp bovis AF2122/97
cgacggcgcggugc

SEQ ID NO: 3143040 - RNA, 16 nt, Mycobacterium bovis subsp bovis AF2122/97
cgacggcgcggugcgc

SEQ ID NO: 3143041 - RNA, 17 nt, Mycobacterium bovis subsp bovis AF2122/97
cgacggcgcuguggcgg

SEQ ID NO: 3143042 - RNA, 19 nt, Mycobacterium bovis subsp bovis AF2122/97
cgacggcggagucgcgcag

SEQ ID NO: 3143043 - RNA, 18 nt, Mycobacterium bovis subsp bovis AF2122/97
cgacggcggauaaccggc

SEQ ID NO: 3143044 - RNA, 13 nt, Mycobacterium bovis subsp bovis AF2122/97
cgacggcggcacg

SEQ ID NO: 3143045 - RNA, 17 nt, Mycobacterium bovis subsp bovis AF2122/97
cgacggcggcacgggcg

SEQ ID NO: 3143046 - RNA, 12 nt, Mycobacterium bovis subsp bovis AF2122/97
cgacggcggcca

SEQ ID NO: 3143047 - RNA, 13 nt, Mycobacterium bovis subsp bovis AF2122/97
cgacggcggccaa

SEQ ID NO: 3143048 - RNA, 17 nt, Mycobacterium bovis subsp bovis AF2122/97
cgacggcggccgccacu

SEQ ID NO: 3143049 - RNA, 23 nt, Mycobacterium bovis subsp bovis AF2122/97
cgacggcggccgccacuccgugc

SEQ ID NO: 3143050 - RNA, 16 nt, Mycobacterium bovis subsp bovis AF2122/97
cgacggcggccgcgau

SEQ ID NO: 3143051 - RNA, 14 nt, Mycobacterium bovis subsp bovis AF2122/97
cgacggcggcgucg

SEQ ID NO: 3143052 - RNA, 13 nt, Mycobacterium bovis subsp bovis AF2122/97
cgacggcgucacc

SEQ ID NO: 3143053 - RNA, 16 nt, Mycobacterium bovis subsp bovis AF2122/97
cgacggcgucacccgc

SEQ ID NO: 3143054 - RNA, 13 nt, Mycobacterium bovis subsp bovis AF2122/97
cgacggcgucgac

SEQ ID NO: 3143055 - RNA, 13 nt, Mycobacterium bovis subsp bovis AF2122/97
cgacggcgucgau

SEQ ID NO: 3143056 - RNA, 17 nt, Mycobacterium bovis subsp bovis AF2122/97
cgacggcucuaccgguc

SEQ ID NO: 3143057 - RNA, 16 nt, Mycobacterium bovis subsp bovis AF2122/97
cgacggcugaccuucu

SEQ ID NO: 3143058 - RNA, 15 nt, Mycobacterium bovis subsp bovis AF2122/97
cgacggcugcgccga

SEQ ID NO: 3143059 - RNA, 16 nt, Mycobacterium bovis subsp bovis AF2122/97
cgacggcugcgccgaa

SEQ ID NO: 3143060 - RNA, 17 nt, Mycobacterium bovis subsp bovis AF2122/97
cgacggcugcgccgaac

SEQ ID NO: 3143061 - RNA, 14 nt, Mycobacterium bovis subsp bovis AF2122/97
cgacgggaaccagc

SEQ ID NO: 3143062 - RNA, 20 nt, Mycobacterium bovis subsp bovis AF2122/97
cgacgggaaccagcggucgg

SEQ ID NO: 3143063 - RNA, 15 nt, Mycobacterium bovis subsp bovis AF2122/97
cgacgggaaccucga

SEQ ID NO: 3143064 - RNA, 16 nt, Mycobacterium bovis subsp bovis AF2122/97
cgacgggaaccucgac

SEQ ID NO: 3143065 - RNA, 14 nt, Mycobacterium bovis subsp bovis AF2122/97
cgacgggacaaccc

SEQ ID NO: 3143066 - RNA, 16 nt, Mycobacterium bovis subsp bovis AF2122/97
cgacgggacaacccgu

SEQ ID NO: 3143067 - RNA, 17 nt, Mycobacterium bovis subsp bovis AF2122/97
cgacgggagcgacgucg

SEQ ID NO: 3143068 - RNA, 18 nt, Mycobacterium bovis subsp bovis AF2122/97
cgacgggcacccgagccg

SEQ ID NO: 3143069 - RNA, 19 nt, Mycobacterium bovis subsp bovis AF2122/97
cgacgggcacccgagccgc

SEQ ID NO: 3143070 - RNA, 11 nt, Mycobacterium bovis subsp bovis AF2122/97
cgacgggccgc

SEQ ID NO: 3143071 - RNA, 14 nt, Mycobacterium bovis subsp bovis AF2122/97
cgacgggccgcgaa

SEQ ID NO: 3143072 - RNA, 14 nt, Mycobacterium bovis subsp bovis AF2122/97
cgacgggccgucgc

SEQ ID NO: 3143073 - RNA, 20 nt, Mycobacterium bovis subsp bovis AF2122/97
cgacgggcgcaacgaccuau

SEQ ID NO: 3143074 - RNA, 12 nt, Mycobacterium bovis subsp bovis AF2122/97
cgacgggcgcca

SEQ ID NO: 3143075 - RNA, 21 nt, Mycobacterium bovis subsp bovis AF2122/97
cgacggggaacguccgcgccg

SEQ ID NO: 3143076 - RNA, 22 nt, Mycobacterium bovis subsp bovis AF2122/97
cgacggggaacguccgcgccga

SEQ ID NO: 3143077 - RNA, 18 nt, Mycobacterium bovis subsp bovis AF2122/97
cgacgucggcuucaccuu

SEQ ID NO: 3143078 - RNA, 19 nt, Mycobacterium bovis subsp bovis AF2122/97
cgacgucgggcauggcggc

SEQ ID NO: 3143079 - RNA, 14 nt, Mycobacterium bovis subsp bovis AF2122/97
cgacgucggugacc

SEQ ID NO: 3143080 - RNA, 22 nt, Mycobacterium bovis subsp bovis AF2122/97
cgacgucguagaccuccagugc

SEQ ID NO: 3143081 - RNA, 17 nt, Mycobacterium bovis subsp bovis AF2122/97
cgacgucgucgccgccg

SEQ ID NO: 3143082 - RNA, 18 nt, Mycobacterium bovis subsp bovis AF2122/97
cgacgucgucgccgccga

SEQ ID NO: 3143083 - RNA, 19 nt, Mycobacterium bovis subsp bovis AF2122/97
cgacgucgucgccgccgaa

SEQ ID NO: 3143084 - RNA, 15 nt, Mycobacterium bovis subsp bovis AF2122/97
cgacgucgucgucga

SEQ ID NO: 3143085 - RNA, 14 nt, Mycobacterium bovis subsp bovis AF2122/97
cgacgucguuacug

SEQ ID NO: 3143086 - RNA, 16 nt, Mycobacterium bovis subsp bovis AF2122/97
cgacgucuaggccaaa

SEQ ID NO: 3143087 - RNA, 20 nt, Mycobacterium bovis subsp bovis AF2122/97
cgacgucuaggccaaacccc

SEQ ID NO: 3143088 - RNA, 20 nt, Mycobacterium bovis subsp bovis AF2122/97
cgacgucucgcaugcucacg

SEQ ID NO: 3143089 - RNA, 15 nt, Mycobacterium bovis subsp bovis AF2122/97
cgacgucugccaggc

SEQ ID NO: 3143090 - RNA, 20 nt, Mycobacterium bovis subsp bovis AF2122/97
cgacgucugccaggcgcagc

SEQ ID NO: 3143091 - RNA, 22 nt, Mycobacterium bovis subsp bovis AF2122/97
cgacgucugccaggcgcagcug

SEQ ID NO: 3143092 - RNA, 14 nt, Mycobacterium bovis subsp bovis AF2122/97
cgacgucugccauc

SEQ ID NO: 3143093 - RNA, 15 nt, Mycobacterium bovis subsp bovis AF2122/97
cgacgucugguuggc

SEQ ID NO: 3143094 - RNA, 17 nt, Mycobacterium bovis subsp bovis AF2122/97
cgacgucuuugacgaac

SEQ ID NO: 3143095 - RNA, 13 nt, Mycobacterium bovis subsp bovis AF2122/97
cgacgugaagaug

SEQ ID NO: 3143096 - RNA, 19 nt, Mycobacterium bovis subsp bovis AF2122/97
cgacgugacaacugcgccg

SEQ ID NO: 3143097 - RNA, 14 nt, Mycobacterium bovis subsp bovis AF2122/97
cgacgugaccagcu

SEQ ID NO: 3143098 - RNA, 23 nt, Mycobacterium bovis subsp bovis AF2122/97
cgacgugaccagcuucggcuggc

SEQ ID NO: 3143099 - RNA, 15 nt, Mycobacterium bovis subsp bovis AF2122/97
cgacgugaccggcaa

SEQ ID NO: 3143100 - RNA, 18 nt, Mycobacterium bovis subsp bovis AF2122/97
cgacgugaccggcaaugc

SEQ ID NO: 3143101 - RNA, 17 nt, Mycobacterium bovis subsp bovis AF2122/97
cgacgugaucgcggucc

SEQ ID NO: 3143102 - RNA, 15 nt, Mycobacterium bovis subsp bovis AF2122/97
cgacgugauggugac

SEQ ID NO: 3143103 - RNA, 22 nt, Mycobacterium bovis subsp bovis AF2122/97
cgacgugauggugacuucggug

SEQ ID NO: 3143104 - RNA, 23 nt, Mycobacterium bovis subsp bovis AF2122/97
cgacgugauggugacuucggugg

SEQ ID NO: 3143105 - RNA, 19 nt, Mycobacterium bovis subsp bovis AF2122/97
cgacgugcaggaacaccca

SEQ ID NO: 3143106 - RNA, 13 nt, Mycobacterium bovis subsp bovis AF2122/97
cgacgugcgcggc

SEQ ID NO: 3143107 - RNA, 14 nt, Mycobacterium bovis subsp bovis AF2122/97
cgacgugcggcggc

SEQ ID NO: 3143108 - RNA, 13 nt, Mycobacterium bovis subsp bovis AF2122/97
cgacgugcgucgg

SEQ ID NO: 3143109 - RNA, 15 nt, Mycobacterium bovis subsp bovis AF2122/97
cgacgugcgucggcc

SEQ ID NO: 3143110 - RNA, 18 nt, Mycobacterium bovis subsp bovis AF2122/97
cgacgugcgucggcccgg

SEQ ID NO: 3143111 - RNA, 20 nt, Mycobacterium bovis subsp bovis AF2122/97
cgacguggaacugcagcggc

SEQ ID NO: 3143112 - RNA, 15 nt, Mycobacterium bovis subsp bovis AF2122/97
cgacguggauggugg

SEQ ID NO: 3143113 - RNA, 19 nt, Mycobacterium bovis subsp bovis AF2122/97
cgacguggccagcccgccc

SEQ ID NO: 3143114 - RNA, 13 nt, Mycobacterium bovis subsp bovis AF2122/97
cgacguggcgccg

SEQ ID NO: 3143115 - RNA, 20 nt, Mycobacterium bovis subsp bovis AF2122/97
cgacguggcgccgacaggug

SEQ ID NO: 3143116 - RNA, 23 nt, Mycobacterium bovis subsp bovis AF2122/97
cgacguggcugcguucgccggaa

SEQ ID NO: 3143117 - RNA, 19 nt, Mycobacterium bovis subsp bovis AF2122/97
cgacguguugcacguacgg

SEQ ID NO: 3143118 - RNA, 19 nt, Mycobacterium bovis subsp bovis AF2122/97
cgacguuaaugacgccauu

SEQ ID NO: 3143119 - RNA, 15 nt, Mycobacterium bovis subsp bovis AF2122/97
cgacguuccgcucga

SEQ ID NO: 3143120 - RNA, 17 nt, Mycobacterium bovis subsp bovis AF2122/97
cgacguuccgcucgagg

SEQ ID NO: 3143121 - RNA, 16 nt, Mycobacterium bovis subsp bovis AF2122/97
cgacguucgacgacag

SEQ ID NO: 3143122 - RNA, 16 nt, Mycobacterium bovis subsp bovis AF2122/97
cgacguucgggucgag

SEQ ID NO: 3143123 - RNA, 14 nt, Mycobacterium bovis subsp bovis AF2122/97
cgacguucguaccg

SEQ ID NO: 3143124 - RNA, 17 nt, Mycobacterium bovis subsp bovis AF2122/97
cgacguugaacucgagu

SEQ ID NO: 3143125 - RNA, 16 nt, Mycobacterium bovis subsp bovis AF2122/97
cgacguugaagccgcc

SEQ ID NO: 3143126 - RNA, 17 nt, Mycobacterium bovis subsp bovis AF2122/97
cgacguugaagccgccg

SEQ ID NO: 3143127 - RNA, 14 nt, Mycobacterium bovis subsp bovis AF2122/97
cgacguugaucgcc

SEQ ID NO: 3143128 - RNA, 22 nt, Mycobacterium bovis subsp bovis AF2122/97
cgacguugaucgccaugguguc

SEQ ID NO: 3143129 - RNA, 20 nt, Mycobacterium bovis subsp bovis AF2122/97
cgacguugcgaggccgcacg

SEQ ID NO: 3143130 - RNA, 16 nt, Mycobacterium bovis subsp bovis AF2122/97
cgacguugcguagcag

SEQ ID NO: 3143131 - RNA, 21 nt, Mycobacterium bovis subsp bovis AF2122/97
cgacguugcuggcuggguggc

SEQ ID NO: 3143132 - RNA, 11 nt, Mycobacterium bovis subsp bovis AF2122/97
cgacguuggcg

SEQ ID NO: 3143133 - RNA, 20 nt, Mycobacterium bovis subsp bovis AF2122/97
cgacuacacauucauccacc

SEQ ID NO: 3143134 - RNA, 18 nt, Mycobacterium bovis subsp bovis AF2122/97
cgacuaccaucgccgccc

SEQ ID NO: 3143135 - RNA, 22 nt, Mycobacterium bovis subsp bovis AF2122/97
cgacuagacgccgccgcugccg

SEQ ID NO: 3143136 - RNA, 18 nt, Mycobacterium bovis subsp bovis AF2122/97
cgacuaucggccgccgga

SEQ ID NO: 3143137 - RNA, 13 nt, Mycobacterium bovis subsp bovis AF2122/97
cgacucacacacc

SEQ ID NO: 3143138 - RNA, 14 nt, Mycobacterium bovis subsp bovis AF2122/97
cgacucagcccggc

SEQ ID NO: 3143139 - RNA, 17 nt, Mycobacterium bovis subsp bovis AF2122/97
cgacucagcccggcacu

SEQ ID NO: 3143140 - RNA, 22 nt, Mycobacterium bovis subsp bovis AF2122/97
cgacucagcccggcacugaccg

SEQ ID NO: 3143141 - RNA, 23 nt, Mycobacterium bovis subsp bovis AF2122/97
cgacucaggucggugcggucauc

SEQ ID NO: 3143142 - RNA, 17 nt, Mycobacterium bovis subsp bovis AF2122/97
cgacucaguucugcaca

SEQ ID NO: 3143143 - RNA, 21 nt, Mycobacterium bovis subsp bovis AF2122/97
cgacucaucggccgcggucgg

SEQ ID NO: 3143144 - RNA, 23 nt, Mycobacterium bovis subsp bovis AF2122/97
cgacucaucggccgcggucggcc

SEQ ID NO: 3143145 - RNA, 18 nt, Mycobacterium bovis subsp bovis AF2122/97
cgacuccaccccacccag

SEQ ID NO: 3143146 - RNA, 21 nt, Mycobacterium bovis subsp bovis AF2122/97
cgacuccagcaccagcacggc

SEQ ID NO: 3143147 - RNA, 23 nt, Mycobacterium bovis subsp bovis AF2122/97
cgacuccagcaccagcacggcaa

SEQ ID NO: 3143148 - RNA, 16 nt, Mycobacterium bovis subsp bovis AF2122/97
cgacuccagcgcccgg

SEQ ID NO: 3143149 - RNA, 17 nt, Mycobacterium bovis subsp bovis AF2122/97
cgacuccagcgcccggu

SEQ ID NO: 3143150 - RNA, 16 nt, Mycobacterium bovis subsp bovis AF2122/97
cgacucccccggcucc

SEQ ID NO: 3143151 - RNA, 15 nt, Mycobacterium bovis subsp bovis AF2122/97
cgacucccccucuac

SEQ ID NO: 3143152 - RNA, 19 nt, Mycobacterium bovis subsp bovis AF2122/97
cgacuccggcaagcacacc

SEQ ID NO: 3143153 - RNA, 19 nt, Mycobacterium bovis subsp bovis AF2122/97
cgacuccggcaggcccgac

SEQ ID NO: 3143154 - RNA, 20 nt, Mycobacterium bovis subsp bovis AF2122/97
cgacucgagagggaucacgc

SEQ ID NO: 3143155 - RNA, 20 nt, Mycobacterium bovis subsp bovis AF2122/97
cgacucgauauaacccggcu

SEQ ID NO: 3143156 - RNA, 19 nt, Mycobacterium bovis subsp bovis AF2122/97
cgacucgccacauuucacc

SEQ ID NO: 3143157 - RNA, 13 nt, Mycobacterium bovis subsp bovis AF2122/97
cgacucgccggcg

SEQ ID NO: 3143158 - RNA, 14 nt, Mycobacterium bovis subsp bovis AF2122/97
cgacucgccggcga

SEQ ID NO: 3143159 - RNA, 16 nt, Mycobacterium bovis subsp bovis AF2122/97
cgacucggcaccgcgg

SEQ ID NO: 3143160 - RNA, 12 nt, Mycobacterium bovis subsp bovis AF2122/97
cgacucggccag

SEQ ID NO: 3143161 - RNA, 13 nt, Mycobacterium bovis subsp bovis AF2122/97
cgacucggccagg

SEQ ID NO: 3143162 - RNA, 18 nt, Mycobacterium bovis subsp bovis AF2122/97
cgacucggccgugaccga

SEQ ID NO: 3143163 - RNA, 18 nt, Mycobacterium bovis subsp bovis AF2122/97
cgagaccgccgcugccgc

SEQ ID NO: 3143164 - RNA, 18 nt, Mycobacterium bovis subsp bovis AF2122/97
cgagaccgcgagcagcac

SEQ ID NO: 3143165 - RNA, 17 nt, Mycobacterium bovis subsp bovis AF2122/97
cgagaccgcgugcucga

SEQ ID NO: 3143166 - RNA, 19 nt, Mycobacterium bovis subsp bovis AF2122/97
cgagaccgggcaacggcgg

SEQ ID NO: 3143167 - RNA, 23 nt, Mycobacterium bovis subsp bovis AF2122/97
cgagaccucucugcgccaggcgg

SEQ ID NO: 3143168 - RNA, 22 nt, Mycobacterium bovis subsp bovis AF2122/97
cgagacgaccuccucgaugacc

SEQ ID NO: 3143169 - RNA, 15 nt, Mycobacterium bovis subsp bovis AF2122/97
cgagacgcaaaaucg

SEQ ID NO: 3143170 - RNA, 16 nt, Mycobacterium bovis subsp bovis AF2122/97
cgagacgcacggccac

SEQ ID NO: 3143171 - RNA, 23 nt, Mycobacterium bovis subsp bovis AF2122/97
cgagacgcacggccaccgcgcaa

SEQ ID NO: 3143172 - RNA, 20 nt, Mycobacterium bovis subsp bovis AF2122/97
cgagacgcaugucgggccag

SEQ ID NO: 3143173 - RNA, 12 nt, Mycobacterium bovis subsp bovis AF2122/97
cgagacgcucca

SEQ ID NO: 3143174 - RNA, 18 nt, Mycobacterium bovis subsp bovis AF2122/97
cgagacgcuuuccgccgc

SEQ ID NO: 3143175 - RNA, 14 nt, Mycobacterium bovis subsp bovis AF2122/97
cgagacggccacgu

SEQ ID NO: 3143176 - RNA, 13 nt, Mycobacterium bovis subsp bovis AF2122/97
cgagacgucggcg

SEQ ID NO: 3143177 - RNA, 14 nt, Mycobacterium bovis subsp bovis AF2122/97
cgagacgucggcgu

SEQ ID NO: 3143178 - RNA, 23 nt, Mycobacterium bovis subsp bovis AF2122/97
cgagacuccgccuugcagcgcgu

SEQ ID NO: 3143179 - RNA, 14 nt, Mycobacterium bovis subsp bovis AF2122/97
cgagacuucgacgc

SEQ ID NO: 3143180 - RNA, 22 nt, Mycobacterium bovis subsp bovis AF2122/97
cgagacuucgacgcggcgaccg

SEQ ID NO: 3143181 - RNA, 19 nt, Mycobacterium bovis subsp bovis AF2122/97
cgagacuugcuggcccgca

SEQ ID NO: 3143182 - RNA, 24 nt, Mycobacterium bovis subsp bovis AF2122/97
cgagacuugcuggcccgcacgaac

SEQ ID NO: 3143183 - RNA, 19 nt, Mycobacterium bovis subsp bovis AF2122/97
cgagacuuggugauccgag

SEQ ID NO: 3143184 - RNA, 22 nt, Mycobacterium bovis subsp bovis AF2122/97
cgagagaguuagugacguagac

SEQ ID NO: 3143185 - RNA, 14 nt, Mycobacterium bovis subsp bovis AF2122/97
cgagagaguucgca

SEQ ID NO: 3143186 - RNA, 18 nt, Mycobacterium bovis subsp bovis AF2122/97
cgagagaguucgcaugcu

SEQ ID NO: 3143187 - RNA, 16 nt, Mycobacterium bovis subsp bovis AF2122/97
cgagagcagccagcca

SEQ ID NO: 3143188 - RNA, 19 nt, Mycobacterium bovis subsp bovis AF2122/97
cgagagcagccagccaccg

SEQ ID NO: 3143189 - RNA, 18 nt, Mycobacterium bovis subsp bovis AF2122/97
cgagagcaugguccagca

SEQ ID NO: 3143190 - RNA, 19 nt, Mycobacterium bovis subsp bovis AF2122/97
cgagagccccgaccagcag

SEQ ID NO: 3143191 - RNA, 20 nt, Mycobacterium bovis subsp bovis AF2122/97
cgagagccccgaccagcaga

SEQ ID NO: 3143192 - RNA, 22 nt, Mycobacterium bovis subsp bovis AF2122/97
cgagagccccgaccagcagacc

SEQ ID NO: 3143193 - RNA, 15 nt, Mycobacterium bovis subsp bovis AF2122/97
cgagagccgaccggg

SEQ ID NO: 3143194 - RNA, 21 nt, Mycobacterium bovis subsp bovis AF2122/97
cgagagccgaccggguaaagc

SEQ ID NO: 3143195 - RNA, 17 nt, Mycobacterium bovis subsp bovis AF2122/97
cgagagccggcggcgac

SEQ ID NO: 3143196 - RNA, 18 nt, Mycobacterium bovis subsp bovis AF2122/97
cgagagccuccauggccu

SEQ ID NO: 3143197 - RNA, 16 nt, Mycobacterium bovis subsp bovis AF2122/97
cgagagccucggccau

SEQ ID NO: 3143198 - RNA, 19 nt, Mycobacterium bovis subsp bovis AF2122/97
cgagagcgcugucccgaac

SEQ ID NO: 3143199 - RNA, 20 nt, Mycobacterium bovis subsp bovis AF2122/97
cgagagcggcuccgggacgg

SEQ ID NO: 3143200 - RNA, 21 nt, Mycobacterium bovis subsp bovis AF2122/97
cgagagcgucaaccacggccg

SEQ ID NO: 3143201 - RNA, 22 nt, Mycobacterium bovis subsp bovis AF2122/97
cgagagggcggggcagaagucg

SEQ ID NO: 3143202 - RNA, 19 nt, Mycobacterium bovis subsp bovis AF2122/97
cgagaggugcugcaccugg

SEQ ID NO: 3143203 - RNA, 17 nt, Mycobacterium bovis subsp bovis AF2122/97
cgagagguucgccgucg

SEQ ID NO: 3143204 - RNA, 18 nt, Mycobacterium bovis subsp bovis AF2122/97
cgagagguucgccgucgg

SEQ ID NO: 3143205 - RNA, 15 nt, Mycobacterium bovis subsp bovis AF2122/97
cgagauaaccaccau

SEQ ID NO: 3143206 - RNA, 16 nt, Mycobacterium bovis subsp bovis AF2122/97
cgagauaaccaccauc

SEQ ID NO: 3143207 - RNA, 13 nt, Mycobacterium bovis subsp bovis AF2122/97
cgagauacggcca

SEQ ID NO: 3143208 - RNA, 15 nt, Mycobacterium bovis subsp bovis AF2122/97
cgagauacggccacc

SEQ ID NO: 3143209 - RNA, 18 nt, Mycobacterium bovis subsp bovis AF2122/97
cgagauacggccaccagg

SEQ ID NO: 3143210 - RNA, 20 nt, Mycobacterium bovis subsp bovis AF2122/97
cgagauagccgacgucgccg

SEQ ID NO: 3143211 - RNA, 14 nt, Mycobacterium bovis subsp bovis AF2122/97
cgagauagucggcc

SEQ ID NO: 3143212 - RNA, 16 nt, Mycobacterium bovis subsp bovis AF2122/97
cgagauagucggccgg

SEQ ID NO: 3143213 - RNA, 18 nt, Mycobacterium bovis subsp bovis AF2122/97
cgagaucaaaaacguccg

SEQ ID NO: 3143214 - RNA, 14 nt, Mycobacterium bovis subsp bovis AF2122/97
cgagaucaccgcca

SEQ ID NO: 3143215 - RNA, 16 nt, Mycobacterium bovis subsp bovis AF2122/97
cgagaucaccgccacc

SEQ ID NO: 3143216 - RNA, 20 nt, Mycobacterium bovis subsp bovis AF2122/97
cgagaucaccgccaccacca

SEQ ID NO: 3143217 - RNA, 13 nt, Mycobacterium bovis subsp bovis AF2122/97
cgagaucaccggu

SEQ ID NO: 3143218 - RNA, 17 nt, Mycobacterium bovis subsp bovis AF2122/97
cgagaucaccgguacgc

SEQ ID NO: 3143219 - RNA, 16 nt, Mycobacterium bovis subsp bovis AF2122/97
cgagaucagccggcag

SEQ ID NO: 3143220 - RNA, 16 nt, Mycobacterium bovis subsp bovis AF2122/97
cgagaucagccucgcg

SEQ ID NO: 3143221 - RNA, 22 nt, Mycobacterium bovis subsp bovis AF2122/97
cgagaucagccucgcgggcagg

SEQ ID NO: 3143222 - RNA, 23 nt, Mycobacterium bovis subsp bovis AF2122/97
cgagaucagccucgcgggcaggg

SEQ ID NO: 3143223 - RNA, 16 nt, Mycobacterium bovis subsp bovis AF2122/97
cgagaucaugccggcg

SEQ ID NO: 3143224 - RNA, 16 nt, Mycobacterium bovis subsp bovis AF2122/97
cgagaucccagcggga

SEQ ID NO: 3143225 - RNA, 19 nt, Mycobacterium bovis subsp bovis AF2122/97
cgagauccuucgcguuggc

SEQ ID NO: 3143226 - RNA, 14 nt, Mycobacterium bovis subsp bovis AF2122/97
cgagaucgccgagc

SEQ ID NO: 3143227 - RNA, 16 nt, Mycobacterium bovis subsp bovis AF2122/97
cgagaucgccgagcag

SEQ ID NO: 3143228 - RNA, 19 nt, Mycobacterium bovis subsp bovis AF2122/97
cgagaucgcggcgacccgg

SEQ ID NO: 3143229 - RNA, 20 nt, Mycobacterium bovis subsp bovis AF2122/97
cgagaucgcggcgacccggu

SEQ ID NO: 3143230 - RNA, 20 nt, Mycobacterium bovis subsp bovis AF2122/97
cgagaucgcgugcgacgaua

SEQ ID NO: 3143231 - RNA, 23 nt, Mycobacterium bovis subsp bovis AF2122/97
cgagaucggacagguaacgcggu

SEQ ID NO: 3143232 - RNA, 17 nt, Mycobacterium bovis subsp bovis AF2122/97
cgagaucgggccggccg

SEQ ID NO: 3143233 - RNA, 13 nt, Mycobacterium bovis subsp bovis AF2122/97
cgagaucgucgcg

SEQ ID NO: 3143234 - RNA, 21 nt, Mycobacterium bovis subsp bovis AF2122/97
cgagaucucacgugcccgcgc

SEQ ID NO: 3143235 - RNA, 23 nt, Mycobacterium bovis subsp bovis AF2122/97
cgagaucuuuucaccaccucggu

SEQ ID NO: 3143236 - RNA, 13 nt, Mycobacterium bovis subsp bovis AF2122/97
cgagaugccgcga

SEQ ID NO: 3143237 - RNA, 18 nt, Mycobacterium bovis subsp bovis AF2122/97
cgagaugcggaccacacc

SEQ ID NO: 3143238 - RNA, 19 nt, Mycobacterium bovis subsp bovis AF2122/97
cgagaugcggaccacaccg

SEQ ID NO: 3143239 - RNA, 12 nt, Mycobacterium bovis subsp bovis AF2122/97
cgagaugcugca

SEQ ID NO: 3143240 - RNA, 16 nt, Mycobacterium bovis subsp bovis AF2122/97
cgagauggcgaucaug

SEQ ID NO: 3143241 - RNA, 18 nt, Mycobacterium bovis subsp bovis AF2122/97
cgagauugccgggccgcc

SEQ ID NO: 3143242 - RNA, 19 nt, Mycobacterium bovis subsp bovis AF2122/97
cgagauugccgggccgccg

SEQ ID NO: 3143243 - RNA, 13 nt, Mycobacterium bovis subsp bovis AF2122/97
cgagauuggugca

SEQ ID NO: 3143244 - RNA, 16 nt, Mycobacterium bovis subsp bovis AF2122/97
cgagauuggugcagac

SEQ ID NO: 3143245 - RNA, 20 nt, Mycobacterium bovis subsp bovis AF2122/97
cgagcaaacacgccucgccg

SEQ ID NO: 3143246 - RNA, 21 nt, Mycobacterium bovis subsp bovis AF2122/97
cgagcaaacauccacccgcgg

SEQ ID NO: 3143247 - RNA, 22 nt, Mycobacterium bovis subsp bovis AF2122/97
cgagcaaaccagauugccgagc

SEQ ID NO: 3143248 - RNA, 23 nt, Mycobacterium bovis subsp bovis AF2122/97
cgagcaaaccagauugccgagcc

SEQ ID NO: 3143249 - RNA, 22 nt, Mycobacterium bovis subsp bovis AF2122/97
cgagcagacgcauaagcccccg

SEQ ID NO: 3143250 - RNA, 14 nt, Mycobacterium bovis subsp bovis AF2122/97
cgagcagacgccgc

SEQ ID NO: 3143251 - RNA, 14 nt, Mycobacterium bovis subsp bovis AF2122/97
cgagcagacgcgga

SEQ ID NO: 3143252 - RNA, 20 nt, Mycobacterium bovis subsp bovis AF2122/97
cgagcagacgcggaaucgca

SEQ ID NO: 3143253 - RNA, 19 nt, Mycobacterium bovis subsp bovis AF2122/97
cgagcagacgcuaaagccc

SEQ ID NO: 3143254 - RNA, 20 nt, Mycobacterium bovis subsp bovis AF2122/97
cgagcagacgcuaaagcccc

SEQ ID NO: 3143255 - RNA, 21 nt, Mycobacterium bovis subsp bovis AF2122/97
cgagcagagaacuccgccacc

SEQ ID NO: 3143256 - RNA, 22 nt, Mycobacterium bovis subsp bovis AF2122/97
cgagcagagaacuccgccacca

SEQ ID NO: 3143257 - RNA, 18 nt, Mycobacterium bovis subsp bovis AF2122/97
cgagcagauacuuguuga

SEQ ID NO: 3143258 - RNA, 16 nt, Mycobacterium bovis subsp bovis AF2122/97
cgagcagaucagcacg

SEQ ID NO: 3143259 - RNA, 10 nt, Mycobacterium bovis subsp bovis AF2122/97
cgagcagcaa

SEQ ID NO: 3143260 - RNA, 18 nt, Mycobacterium bovis subsp bovis AF2122/97
cgagcagcaccacccgca

SEQ ID NO: 3143261 - RNA, 14 nt, Mycobacterium bovis subsp bovis AF2122/97
cgagcagcccggcg

SEQ ID NO: 3143262 - RNA, 15 nt, Mycobacterium bovis subsp bovis AF2122/97
cgagcagcccggcga

SEQ ID NO: 3143263 - RNA, 13 nt, Mycobacterium bovis subsp bovis AF2122/97
cgagcagcccggg

SEQ ID NO: 3143264 - RNA, 22 nt, Mycobacterium bovis subsp bovis AF2122/97
cgagcagccgaugcugcgggcg

SEQ ID NO: 3143265 - RNA, 17 nt, Mycobacterium bovis subsp bovis AF2122/97
cgagcagcgccacccgc

SEQ ID NO: 3143266 - RNA, 22 nt, Mycobacterium bovis subsp bovis AF2122/97
cgagcagcgccacccgcgucag

SEQ ID NO: 3143267 - RNA, 13 nt, Mycobacterium bovis subsp bovis AF2122/97
cgagcagcgcgcc

SEQ ID NO: 3143268 - RNA, 16 nt, Mycobacterium bovis subsp bovis AF2122/97
cgagcagcgcgccguu

SEQ ID NO: 3143269 - RNA, 13 nt, Mycobacterium bovis subsp bovis AF2122/97
cgagcagcuacag

SEQ ID NO: 3143270 - RNA, 14 nt, Mycobacterium bovis subsp bovis AF2122/97
cgagcagcuagccc

SEQ ID NO: 3143271 - RNA, 21 nt, Mycobacterium bovis subsp bovis AF2122/97
cgagcagcuagcccggcagca

SEQ ID NO: 3143272 - RNA, 19 nt, Mycobacterium bovis subsp bovis AF2122/97
cgagcagcucaaugucgaa

SEQ ID NO: 3143273 - RNA, 22 nt, Mycobacterium bovis subsp bovis AF2122/97
cgagcagcuccuugaggucacc

SEQ ID NO: 3143274 - RNA, 18 nt, Mycobacterium bovis subsp bovis AF2122/97
cgagcagcuucucggcga

SEQ ID NO: 3143275 - RNA, 20 nt, Mycobacterium bovis subsp bovis AF2122/97
cgagcaggauaaacccggcg

SEQ ID NO: 3143276 - RNA, 21 nt, Mycobacterium bovis subsp bovis AF2122/97
cgagcaggauaaacccggcga

SEQ ID NO: 3143277 - RNA, 23 nt, Mycobacterium bovis subsp bovis AF2122/97
cgagcaggauaaacccggcgagg

SEQ ID NO: 3143278 - RNA, 18 nt, Mycobacterium bovis subsp bovis AF2122/97
cgagcaggcccaacgcga

SEQ ID NO: 3143279 - RNA, 16 nt, Mycobacterium bovis subsp bovis AF2122/97
cgagcaggccgcccag

SEQ ID NO: 3143280 - RNA, 17 nt, Mycobacterium bovis subsp bovis AF2122/97
cgagcaggccgcccagc

SEQ ID NO: 3143281 - RNA, 20 nt, Mycobacterium bovis subsp bovis AF2122/97
cgagcaggcgcaccaggcgg

SEQ ID NO: 3143282 - RNA, 23 nt, Mycobacterium bovis subsp bovis AF2122/97
cgagcaggcgcaccaggcggccg

SEQ ID NO: 3143283 - RNA, 18 nt, Mycobacterium bovis subsp bovis AF2122/97
cgagcaggcuggcugcca

SEQ ID NO: 3143284 - RNA, 21 nt, Mycobacterium bovis subsp bovis AF2122/97
cgagcaggcuggcugccacga

SEQ ID NO: 3143285 - RNA, 17 nt, Mycobacterium bovis subsp bovis AF2122/97
cgagcagggccggcacc

SEQ ID NO: 3143286 - RNA, 19 nt, Mycobacterium bovis subsp bovis AF2122/97
cgagcagggccggcaccgc

SEQ ID NO: 3143287 - RNA, 15 nt, Mycobacterium bovis subsp bovis AF2122/97
cgagcagggcgucga

SEQ ID NO: 3143288 - RNA, 21 nt, Mycobacterium bovis subsp bovis AF2122/97
cgagcagggcgucgaccgcgg

SEQ ID NO: 3143289 - RNA, 15 nt, Mycobacterium bovis subsp bovis AF2122/97
cgagcagggugacca

SEQ ID NO: 3143290 - RNA, 19 nt, Mycobacterium bovis subsp bovis AF2122/97
cgagcagggugaccaggau

SEQ ID NO: 3143291 - RNA, 15 nt, Mycobacterium bovis subsp bovis AF2122/97
cgagcaggucggaga

SEQ ID NO: 3143292 - RNA, 15 nt, Mycobacterium bovis subsp bovis AF2122/97
cgagcaggucggcaa

SEQ ID NO: 3143293 - RNA, 17 nt, Mycobacterium bovis subsp bovis AF2122/97
cgagcagguuccgcacg

SEQ ID NO: 3143294 - RNA, 22 nt, Mycobacterium bovis subsp bovis AF2122/97
cgagcagguuccgcacgaucgg

SEQ ID NO: 3143295 - RNA, 20 nt, Mycobacterium bovis subsp bovis AF2122/97
cgagcagucgcaaaagcccc

SEQ ID NO: 3143296 - RNA, 21 nt, Mycobacterium bovis subsp bovis AF2122/97
cgagcagucgcaaaagccccc

SEQ ID NO: 3143297 - RNA, 16 nt, Mycobacterium bovis subsp bovis AF2122/97
cgagcagugccgugcg

SEQ ID NO: 3143298 - RNA, 17 nt, Mycobacterium bovis subsp bovis AF2122/97
cgagcagugccucggcg

SEQ ID NO: 3143299 - RNA, 18 nt, Mycobacterium bovis subsp bovis AF2122/97
cgagcagugccucggcga

SEQ ID NO: 3143300 - RNA, 15 nt, Mycobacterium bovis subsp bovis AF2122/97
cgagcaguggccgcc

SEQ ID NO: 3143301 - RNA, 17 nt, Mycobacterium bovis subsp bovis AF2122/97
cgagcaguggccgccgg

SEQ ID NO: 3143302 - RNA, 20 nt, Mycobacterium bovis subsp bovis AF2122/97
cgagcaguggccgccgggca

SEQ ID NO: 3143303 - RNA, 20 nt, Mycobacterium bovis subsp bovis AF2122/97
cgagcaguuccagcucgcgg

SEQ ID NO: 3143304 - RNA, 23 nt, Mycobacterium bovis subsp bovis AF2122/97
cgagcaguuccagcucgcggugg

SEQ ID NO: 3143305 - RNA, 17 nt, Mycobacterium bovis subsp bovis AF2122/97
cgagcauaccgccgcug

SEQ ID NO: 3143306 - RNA, 19 nt, Mycobacterium bovis subsp bovis AF2122/97
cgagcauaccgccgcugcc

SEQ ID NO: 3143307 - RNA, 22 nt, Mycobacterium bovis subsp bovis AF2122/97
cgagcaucaacgaaccagcuug

SEQ ID NO: 3143308 - RNA, 20 nt, Mycobacterium bovis subsp bovis AF2122/97
cgagcaucaauugaguagau

SEQ ID NO: 3143309 - RNA, 23 nt, Mycobacterium bovis subsp bovis AF2122/97
cgagcaucagauucgcgcuggcc

SEQ ID NO: 3143310 - RNA, 15 nt, Mycobacterium bovis subsp bovis AF2122/97
cgagcaucgacgaac

SEQ ID NO: 3143311 - RNA, 17 nt, Mycobacterium bovis subsp bovis AF2122/97
cgagcaucucgacaucg

SEQ ID NO: 3143312 - RNA, 15 nt, Mycobacterium bovis subsp bovis AF2122/97
cgagcaucucgucgg

SEQ ID NO: 3143313 - RNA, 16 nt, Mycobacterium bovis subsp bovis AF2122/97
cgagcaucucgucggu

SEQ ID NO: 3143314 - RNA, 17 nt, Mycobacterium bovis subsp bovis AF2122/97
cgagcaucuucgcgcag

SEQ ID NO: 3143315 - RNA, 18 nt, Mycobacterium bovis subsp bovis AF2122/97
cgagcaucuucgcgcagc

SEQ ID NO: 3143316 - RNA, 22 nt, Mycobacterium bovis subsp bovis AF2122/97
cgagcaucuucgcgcagccgcc

SEQ ID NO: 3143317 - RNA, 14 nt, Mycobacterium bovis subsp bovis AF2122/97
cgagcaugcccagc

SEQ ID NO: 3143318 - RNA, 17 nt, Mycobacterium bovis subsp bovis AF2122/97
cgagcaugcccagcgaa

SEQ ID NO: 3143319 - RNA, 14 nt, Mycobacterium bovis subsp bovis AF2122/97
cgagcaugccguug

SEQ ID NO: 3143320 - RNA, 19 nt, Mycobacterium bovis subsp bovis AF2122/97
cgagcaugccguugacaac

SEQ ID NO: 3143321 - RNA, 17 nt, Mycobacterium bovis subsp bovis AF2122/97
cgagccaacaagucgau

SEQ ID NO: 3143322 - RNA, 21 nt, Mycobacterium bovis subsp bovis AF2122/97
cgagccaacuccacccaacgc

SEQ ID NO: 3143323 - RNA, 19 nt, Mycobacterium bovis subsp bovis AF2122/97
cgagccaccaccgccgacc

SEQ ID NO: 3143324 - RNA, 15 nt, Mycobacterium bovis subsp bovis AF2122/97
cgagccacccaccga

SEQ ID NO: 3143325 - RNA, 15 nt, Mycobacterium bovis subsp bovis AF2122/97
cgagccacgacccag

SEQ ID NO: 3143326 - RNA, 14 nt, Mycobacterium bovis subsp bovis AF2122/97
cgagccacgccagc

SEQ ID NO: 3143327 - RNA, 19 nt, Mycobacterium bovis subsp bovis AF2122/97
cgagccacgccagcgucga

SEQ ID NO: 3143328 - RNA, 21 nt, Mycobacterium bovis subsp bovis AF2122/97
cgagccagcacccgcagccgc

SEQ ID NO: 3143329 - RNA, 12 nt, Mycobacterium bovis subsp bovis AF2122/97
cgagccagcgga

SEQ ID NO: 3143330 - RNA, 13 nt, Mycobacterium bovis subsp bovis AF2122/97
cgagccagcggag

SEQ ID NO: 3143331 - RNA, 19 nt, Mycobacterium bovis subsp bovis AF2122/97
cgagccagcuucccgcugg

SEQ ID NO: 3143332 - RNA, 22 nt, Mycobacterium bovis subsp bovis AF2122/97
cgagccagcuucccgcuggugg

SEQ ID NO: 3143333 - RNA, 18 nt, Mycobacterium bovis subsp bovis AF2122/97
cgagccaguccuccacuu

SEQ ID NO: 3143334 - RNA, 16 nt, Mycobacterium bovis subsp bovis AF2122/97
cgagccaucaccgcaa

SEQ ID NO: 3143335 - RNA, 16 nt, Mycobacterium bovis subsp bovis AF2122/97
cgagcgcacuggggag

SEQ ID NO: 3143336 - RNA, 14 nt, Mycobacterium bovis subsp bovis AF2122/97
cgagcgcaucaggg

SEQ ID NO: 3143337 - RNA, 15 nt, Mycobacterium bovis subsp bovis AF2122/97
cgagcgcaucagggu

SEQ ID NO: 3143338 - RNA, 19 nt, Mycobacterium bovis subsp bovis AF2122/97
cgagcgcaucagggugggc

SEQ ID NO: 3143339 - RNA, 18 nt, Mycobacterium bovis subsp bovis AF2122/97
cgagcgcaucgauggccg

SEQ ID NO: 3143340 - RNA, 21 nt, Mycobacterium bovis subsp bovis AF2122/97
cgagcgcaucgauggccgcga

SEQ ID NO: 3143341 - RNA, 15 nt, Mycobacterium bovis subsp bovis AF2122/97
cgagcgcaucggcca

SEQ ID NO: 3143342 - RNA, 16 nt, Mycobacterium bovis subsp bovis AF2122/97
cgagcgcaucggccaa

SEQ ID NO: 3143343 - RNA, 13 nt, Mycobacterium bovis subsp bovis AF2122/97
cgagcgcccuggc

SEQ ID NO: 3143344 - RNA, 14 nt, Mycobacterium bovis subsp bovis AF2122/97
cgagcgccgcggac

SEQ ID NO: 3143345 - RNA, 12 nt, Mycobacterium bovis subsp bovis AF2122/97
cgagcgccggcu

SEQ ID NO: 3143346 - RNA, 20 nt, Mycobacterium bovis subsp bovis AF2122/97
cgagcgccucaagcucgccg

SEQ ID NO: 3143347 - RNA, 22 nt, Mycobacterium bovis subsp bovis AF2122/97
cgagcgccucgggaggcagcgc

SEQ ID NO: 3143348 - RNA, 20 nt, Mycobacterium bovis subsp bovis AF2122/97
cgagcgccuugucgaucucg

SEQ ID NO: 3143349 - RNA, 21 nt, Mycobacterium bovis subsp bovis AF2122/97
cgagcgccuugucgaucucgu

SEQ ID NO: 3143350 - RNA, 17 nt, Mycobacterium bovis subsp bovis AF2122/97
cgagcgccuuuggcggu

SEQ ID NO: 3143351 - RNA, 22 nt, Mycobacterium bovis subsp bovis AF2122/97
cgagcgccuuuggcggugaugg

SEQ ID NO: 3143352 - RNA, 24 nt, Mycobacterium bovis subsp bovis AF2122/97
cgagcgcgaucgggccggcgcggu

SEQ ID NO: 3143353 - RNA, 11 nt, Mycobacterium bovis subsp bovis AF2122/97
cgagcgcgcca

SEQ ID NO: 3143354 - RNA, 20 nt, Mycobacterium bovis subsp bovis AF2122/97
cgagcgcgccgaaggccgcc

SEQ ID NO: 3143355 - RNA, 14 nt, Mycobacterium bovis subsp bovis AF2122/97
cgagcgcgccgcgc

SEQ ID NO: 3143356 - RNA, 17 nt, Mycobacterium bovis subsp bovis AF2122/97
cgagcgcgccguugccg

SEQ ID NO: 3143357 - RNA, 16 nt, Mycobacterium bovis subsp bovis AF2122/97
cgagcgcgcgcuguug

SEQ ID NO: 3143358 - RNA, 16 nt, Mycobacterium bovis subsp bovis AF2122/97
cgagcgcgcguagcgg

SEQ ID NO: 3143359 - RNA, 13 nt, Mycobacterium bovis subsp bovis AF2122/97
cgagcgcggccug

SEQ ID NO: 3143360 - RNA, 13 nt, Mycobacterium bovis subsp bovis AF2122/97
cgagcgcggcgau

SEQ ID NO: 3143361 - RNA, 16 nt, Mycobacterium bovis subsp bovis AF2122/97
cgagcgcggcgaucga

SEQ ID NO: 3143362 - RNA, 13 nt, Mycobacterium bovis subsp bovis AF2122/97
cgagcgcggcggc

SEQ ID NO: 3143363 - RNA, 18 nt, Mycobacterium bovis subsp bovis AF2122/97
cgagcgcggugccgccac

SEQ ID NO: 3143364 - RNA, 21 nt, Mycobacterium bovis subsp bovis AF2122/97
cgagcgcggugccgccaccgg

SEQ ID NO: 3143365 - RNA, 15 nt, Mycobacterium bovis subsp bovis AF2122/97
cgagcgcgucgguca

SEQ ID NO: 3143366 - RNA, 16 nt, Mycobacterium bovis subsp bovis AF2122/97
cgagcgcuaucaccgc

SEQ ID NO: 3143367 - RNA, 14 nt, Mycobacterium bovis subsp bovis AF2122/97
cgagcgcucgauca

SEQ ID NO: 3143368 - RNA, 13 nt, Mycobacterium bovis subsp bovis AF2122/97
cgagcgcuucguc

SEQ ID NO: 3143369 - RNA, 20 nt, Mycobacterium bovis subsp bovis AF2122/97
cgagcgcuucgucgccgaac

SEQ ID NO: 3143370 - RNA, 19 nt, Mycobacterium bovis subsp bovis AF2122/97
cgagcgcuugaccccgccg

SEQ ID NO: 3143371 - RNA, 20 nt, Mycobacterium bovis subsp bovis AF2122/97
cgagcgcuugaccccgccga

SEQ ID NO: 3143372 - RNA, 22 nt, Mycobacterium bovis subsp bovis AF2122/97
cgagcgcuugaccccgccgaac

SEQ ID NO: 3143373 - RNA, 21 nt, Mycobacterium bovis subsp bovis AF2122/97
cgagcggaauggaggccgccg

SEQ ID NO: 3143374 - RNA, 22 nt, Mycobacterium bovis subsp bovis AF2122/97
cgagcggacacauaagcccccg

SEQ ID NO: 3143375 - RNA, 16 nt, Mycobacterium bovis subsp bovis AF2122/97
cgagcggaccaccgcu

SEQ ID NO: 3143376 - RNA, 16 nt, Mycobacterium bovis subsp bovis AF2122/97
cgagcggagccgccga

SEQ ID NO: 3143377 - RNA, 22 nt, Mycobacterium bovis subsp bovis AF2122/97
cgagcggagccgccgacucggc

SEQ ID NO: 3143378 - RNA, 12 nt, Mycobacterium bovis subsp bovis AF2122/97
cgagcggcaucg

SEQ ID NO: 3143379 - RNA, 19 nt, Mycobacterium bovis subsp bovis AF2122/97
cgagcggcaucggucaccg

SEQ ID NO: 3143380 - RNA, 23 nt, Mycobacterium bovis subsp bovis AF2122/97
cgagcggcaucggucaccgcggc

SEQ ID NO: 3143381 - RNA, 16 nt, Mycobacterium bovis subsp bovis AF2122/97
cgagcggcccuucacc

SEQ ID NO: 3143382 - RNA, 19 nt, Mycobacterium bovis subsp bovis AF2122/97
cgagcggcccuucaccagc

SEQ ID NO: 3143383 - RNA, 20 nt, Mycobacterium bovis subsp bovis AF2122/97
cgagcggcccuucaccagcc

SEQ ID NO: 3143384 - RNA, 19 nt, Mycobacterium bovis subsp bovis AF2122/97
cgagcggccuccagcaccc

SEQ ID NO: 3143385 - RNA, 13 nt, Mycobacterium bovis subsp bovis AF2122/97
cgagcggcugagc

SEQ ID NO: 3143386 - RNA, 17 nt, Mycobacterium bovis subsp bovis AF2122/97
cgagcggcugagccgca

SEQ ID NO: 3143387 - RNA, 16 nt, Mycobacterium bovis subsp bovis AF2122/97
cgagcgggaucgggcc

SEQ ID NO: 3143388 - RNA, 18 nt, Mycobacterium bovis subsp bovis AF2122/97
cgagcgggaucgggcccu

SEQ ID NO: 3143389 - RNA, 17 nt, Mycobacterium bovis subsp bovis AF2122/97
cgagcggucgcgguagc

SEQ ID NO: 3143390 - RNA, 14 nt, Mycobacterium bovis subsp bovis AF2122/97
cgagcggugccggc

SEQ ID NO: 3143391 - RNA, 15 nt, Mycobacterium bovis subsp bovis AF2122/97
cgagcggugccggcg

SEQ ID NO: 3143392 - RNA, 19 nt, Mycobacterium bovis subsp bovis AF2122/97
cgagcgguggcgucgucgg

SEQ ID NO: 3143393 - RNA, 17 nt, Mycobacterium bovis subsp bovis AF2122/97
cgagcguaacgguaacc

SEQ ID NO: 3143394 - RNA, 23 nt, Mycobacterium bovis subsp bovis AF2122/97
cgagcguaacgguaaccggcccg

SEQ ID NO: 3143395 - RNA, 19 nt, Mycobacterium bovis subsp bovis AF2122/97
cgagcguaaugcugcugca

SEQ ID NO: 3143396 - RNA, 19 nt, Mycobacterium bovis subsp bovis AF2122/97
cgagcgucagauccggccg

SEQ ID NO: 3143397 - RNA, 14 nt, Mycobacterium bovis subsp bovis AF2122/97
cgagcguccggugg

SEQ ID NO: 3143398 - RNA, 20 nt, Mycobacterium bovis subsp bovis AF2122/97
cgagcgugaagucacggcgg

SEQ ID NO: 3143399 - RNA, 18 nt, Mycobacterium bovis subsp bovis AF2122/97
cgagcgugcgcacggcgc

SEQ ID NO: 3143400 - RNA, 21 nt, Mycobacterium bovis subsp bovis AF2122/97
cgagcgugcgcugguggcggc

SEQ ID NO: 3143401 - RNA, 23 nt, Mycobacterium bovis subsp bovis AF2122/97
cgagcgugcgcugguggcggcga

SEQ ID NO: 3143402 - RNA, 14 nt, Mycobacterium bovis subsp bovis AF2122/97
cgagcguggcaacg

SEQ ID NO: 3143403 - RNA, 16 nt, Mycobacterium bovis subsp bovis AF2122/97
cgagcguggcguuggc

SEQ ID NO: 3143404 - RNA, 18 nt, Mycobacterium bovis subsp bovis AF2122/97
cgagcguuggcuucuucg

SEQ ID NO: 3143405 - RNA, 19 nt, Mycobacterium bovis subsp bovis AF2122/97
cgagcguuuggacgggcgu

SEQ ID NO: 3143406 - RNA, 23 nt, Mycobacterium bovis subsp bovis AF2122/97
cgagcucaacgacggcugaccuu

SEQ ID NO: 3143407 - RNA, 17 nt, Mycobacterium bovis subsp bovis AF2122/97
cgagcucaccaaggucg

SEQ ID NO: 3143408 - RNA, 23 nt, Mycobacterium bovis subsp bovis AF2122/97
cgagcucaccgcacaccugcgcg

SEQ ID NO: 3143409 - RNA, 21 nt, Mycobacterium bovis subsp bovis AF2122/97
cgagcucacuucacgccgccc

SEQ ID NO: 3143410 - RNA, 21 nt, Mycobacterium bovis subsp bovis AF2122/97
cgagcucaggucgacaggugc

SEQ ID NO: 3143411 - RNA, 14 nt, Mycobacterium bovis subsp bovis AF2122/97
cgagcuccgaugcc

SEQ ID NO: 3143412 - RNA, 17 nt, Mycobacterium bovis subsp bovis AF2122/97
cgagcuccgaugccgac

SEQ ID NO: 3143413 - RNA, 23 nt, Mycobacterium bovis subsp bovis AF2122/97
cgagcuccgcggcgagcuccgau

SEQ ID NO: 3143414 - RNA, 15 nt, Mycobacterium bovis subsp bovis AF2122/97
cgagcuccuccacca

SEQ ID NO: 3143415 - RNA, 18 nt, Mycobacterium bovis subsp bovis AF2122/97
cgagcuccuccaccaacu

SEQ ID NO: 3143416 - RNA, 22 nt, Mycobacterium bovis subsp bovis AF2122/97
cgagcuccuccaccaacucgac

SEQ ID NO: 3143417 - RNA, 15 nt, Mycobacterium bovis subsp bovis AF2122/97
cgagcucgaagcccg

SEQ ID NO: 3143418 - RNA, 16 nt, Mycobacterium bovis subsp bovis AF2122/97
cgagcucgaagcccgg

SEQ ID NO: 3143419 - RNA, 18 nt, Mycobacterium bovis subsp bovis AF2122/97
cgagcucgaagcccggac

SEQ ID NO: 3143420 - RNA, 16 nt, Mycobacterium bovis subsp bovis AF2122/97
cgagcucgccgcagcg

SEQ ID NO: 3143421 - RNA, 16 nt, Mycobacterium bovis subsp bovis AF2122/97
cgaggcaaccgacacu

SEQ ID NO: 3143422 - RNA, 18 nt, Mycobacterium bovis subsp bovis AF2122/97
cgaggcaaugcgagcacc

SEQ ID NO: 3143423 - RNA, 19 nt, Mycobacterium bovis subsp bovis AF2122/97
cgaggcacaaucaccgccg

SEQ ID NO: 3143424 - RNA, 20 nt, Mycobacterium bovis subsp bovis AF2122/97
cgaggcacaaucaccgccgc

SEQ ID NO: 3143425 - RNA, 18 nt, Mycobacterium bovis subsp bovis AF2122/97
cgaggcaccgacaucguc

SEQ ID NO: 3143426 - RNA, 22 nt, Mycobacterium bovis subsp bovis AF2122/97
cgaggcagacacgagucgccag

SEQ ID NO: 3143427 - RNA, 15 nt, Mycobacterium bovis subsp bovis AF2122/97
cgaggcagcacccgc

SEQ ID NO: 3143428 - RNA, 19 nt, Mycobacterium bovis subsp bovis AF2122/97
cgaggcagcacccgcacgg

SEQ ID NO: 3143429 - RNA, 14 nt, Mycobacterium bovis subsp bovis AF2122/97
cgaggcagcgucgu

SEQ ID NO: 3143430 - RNA, 21 nt, Mycobacterium bovis subsp bovis AF2122/97
cgaggcagcgucgucgacgac

SEQ ID NO: 3143431 - RNA, 14 nt, Mycobacterium bovis subsp bovis AF2122/97
cgaggccaaacgcc

SEQ ID NO: 3143432 - RNA, 16 nt, Mycobacterium bovis subsp bovis AF2122/97
cgaggccaaacgccau

SEQ ID NO: 3143433 - RNA, 18 nt, Mycobacterium bovis subsp bovis AF2122/97
cgaggccaaguugcagcg

SEQ ID NO: 3143434 - RNA, 23 nt, Mycobacterium bovis subsp bovis AF2122/97
cgaggccaaguugcagcgggcca

SEQ ID NO: 3143435 - RNA, 15 nt, Mycobacterium bovis subsp bovis AF2122/97
cgaggccacgccagc

SEQ ID NO: 3143436 - RNA, 12 nt, Mycobacterium bovis subsp bovis AF2122/97
cgaggccagcgg

SEQ ID NO: 3143437 - RNA, 15 nt, Mycobacterium bovis subsp bovis AF2122/97
cgaggccgcacgucg

SEQ ID NO: 3143438 - RNA, 22 nt, Mycobacterium bovis subsp bovis AF2122/97
cgaggccgcacgucgaccucgg

SEQ ID NO: 3143439 - RNA, 23 nt, Mycobacterium bovis subsp bovis AF2122/97
cgaggccgcacgucgaccucggc

SEQ ID NO: 3143440 - RNA, 17 nt, Mycobacterium bovis subsp bovis AF2122/97
cgaggccgccaucgccg

SEQ ID NO: 3143441 - RNA, 20 nt, Mycobacterium bovis subsp bovis AF2122/97
cgaggccgccaucgccgcca

SEQ ID NO: 3143442 - RNA, 22 nt, Mycobacterium bovis subsp bovis AF2122/97
cgaggccgccaucgccgccaac

SEQ ID NO: 3143443 - RNA, 20 nt, Mycobacterium bovis subsp bovis AF2122/97
cgaggccgccgagaugaugc

SEQ ID NO: 3143444 - RNA, 17 nt, Mycobacterium bovis subsp bovis AF2122/97
cgaggccgcugccaggg

SEQ ID NO: 3143445 - RNA, 23 nt, Mycobacterium bovis subsp bovis AF2122/97
cgaggccgcugccagggugcgcc

SEQ ID NO: 3143446 - RNA, 15 nt, Mycobacterium bovis subsp bovis AF2122/97
cgaggccuaccaggc

SEQ ID NO: 3143447 - RNA, 17 nt, Mycobacterium bovis subsp bovis AF2122/97
cgaggccuaccaggcgc

SEQ ID NO: 3143448 - RNA, 18 nt, Mycobacterium bovis subsp bovis AF2122/97
cgaggccuaccaggcgcg

SEQ ID NO: 3143449 - RNA, 23 nt, Mycobacterium bovis subsp bovis AF2122/97
cgaggccuaccaggcgcggccca

SEQ ID NO: 3143450 - RNA, 17 nt, Mycobacterium bovis subsp bovis AF2122/97
cgaggccucggccagcg

SEQ ID NO: 3143451 - RNA, 20 nt, Mycobacterium bovis subsp bovis AF2122/97
cgaggccucggccagcguca

SEQ ID NO: 3143452 - RNA, 19 nt, Mycobacterium bovis subsp bovis AF2122/97
cgaggccucggcggccgug

SEQ ID NO: 3143453 - RNA, 17 nt, Mycobacterium bovis subsp bovis AF2122/97
cgaggccucgucccaca

SEQ ID NO: 3143454 - RNA, 18 nt, Mycobacterium bovis subsp bovis AF2122/97
cgaggccucgucccacaa

SEQ ID NO: 3143455 - RNA, 21 nt, Mycobacterium bovis subsp bovis AF2122/97
cgaggcgacgucguucuuugu

SEQ ID NO: 3143456 - RNA, 21 nt, Mycobacterium bovis subsp bovis AF2122/97
cgaggcgagacgcuccagugg

SEQ ID NO: 3143457 - RNA, 15 nt, Mycobacterium bovis subsp bovis AF2122/97
cgaggcgagcggcca

SEQ ID NO: 3143458 - RNA, 21 nt, Mycobacterium bovis subsp bovis AF2122/97
cgaggcgagcggccaguccgg

SEQ ID NO: 3143459 - RNA, 22 nt, Mycobacterium bovis subsp bovis AF2122/97
cgaggcgaguucgcgcacgucg

SEQ ID NO: 3143460 - RNA, 16 nt, Mycobacterium bovis subsp bovis AF2122/97
cgaggcgaucaccgcg

SEQ ID NO: 3143461 - RNA, 17 nt, Mycobacterium bovis subsp bovis AF2122/97
cgaggcgaucaccgcgc

SEQ ID NO: 3143462 - RNA, 14 nt, Mycobacterium bovis subsp bovis AF2122/97
cgaggcgcagguca

SEQ ID NO: 3143463 - RNA, 19 nt, Mycobacterium bovis subsp bovis AF2122/97
cgaggcgcccaacaggcgg

SEQ ID NO: 3143464 - RNA, 19 nt, Mycobacterium bovis subsp bovis AF2122/97
cgaggcgcccagcgacaac

SEQ ID NO: 3143465 - RNA, 12 nt, Mycobacterium bovis subsp bovis AF2122/97
cgaggcggcggu

SEQ ID NO: 3143466 - RNA, 19 nt, Mycobacterium bovis subsp bovis AF2122/97
cgaggcggucuuguccagg

SEQ ID NO: 3143467 - RNA, 22 nt, Mycobacterium bovis subsp bovis AF2122/97
cgaggcguaaucaagcagcgug

SEQ ID NO: 3143468 - RNA, 17 nt, Mycobacterium bovis subsp bovis AF2122/97
cgaggcgucaccccggu

SEQ ID NO: 3143469 - RNA, 23 nt, Mycobacterium bovis subsp bovis AF2122/97
cgaggcgucaccccggucccgcc

SEQ ID NO: 3143470 - RNA, 13 nt, Mycobacterium bovis subsp bovis AF2122/97
cgaggcguucacc

SEQ ID NO: 3143471 - RNA, 14 nt, Mycobacterium bovis subsp bovis AF2122/97
cgaggcguucacca

SEQ ID NO: 3143472 - RNA, 18 nt, Mycobacterium bovis subsp bovis AF2122/97
cgaggcguucaccacgau

SEQ ID NO: 3143473 - RNA, 19 nt, Mycobacterium bovis subsp bovis AF2122/97
cgaggcucgcguggccgcc

SEQ ID NO: 3143474 - RNA, 16 nt, Mycobacterium bovis subsp bovis AF2122/97
cgaggcucgggccgca

SEQ ID NO: 3143475 - RNA, 15 nt, Mycobacterium bovis subsp bovis AF2122/97
cgaggcucguggcga

SEQ ID NO: 3143476 - RNA, 22 nt, Mycobacterium bovis subsp bovis AF2122/97
cgaggcugaccguggcgccggu

SEQ ID NO: 3143477 - RNA, 14 nt, Mycobacterium bovis subsp bovis AF2122/97
cgaggcuggcaucc

SEQ ID NO: 3143478 - RNA, 19 nt, Mycobacterium bovis subsp bovis AF2122/97
cgaggcuggcaucccgggc

SEQ ID NO: 3143479 - RNA, 22 nt, Mycobacterium bovis subsp bovis AF2122/97
cgaggcuggcaucccgggcagu

SEQ ID NO: 3143480 - RNA, 15 nt, Mycobacterium bovis subsp bovis AF2122/97
cgaggcuugcggcac

SEQ ID NO: 3143481 - RNA, 17 nt, Mycobacterium bovis subsp bovis AF2122/97
cgaggcuugcggcacaa

SEQ ID NO: 3143482 - RNA, 16 nt, Mycobacterium bovis subsp bovis AF2122/97
cgagggcaacggcacu

SEQ ID NO: 3143483 - RNA, 19 nt, Mycobacterium bovis subsp bovis AF2122/97
cgagggcaacggcacuagc

SEQ ID NO: 3143484 - RNA, 21 nt, Mycobacterium bovis subsp bovis AF2122/97
cgagggcaaggacaagccgcu

SEQ ID NO: 3143485 - RNA, 13 nt, Mycobacterium bovis subsp bovis AF2122/97
cgagggcacgcgc

SEQ ID NO: 3143486 - RNA, 15 nt, Mycobacterium bovis subsp bovis AF2122/97
cgagggcacggcggu

SEQ ID NO: 3143487 - RNA, 18 nt, Mycobacterium bovis subsp bovis AF2122/97
cgagggcacggcggugug

SEQ ID NO: 3143488 - RNA, 15 nt, Mycobacterium bovis subsp bovis AF2122/97
cgagggcauccgagc

SEQ ID NO: 3143489 - RNA, 18 nt, Mycobacterium bovis subsp bovis AF2122/97
cgagggccacggcugcgg

SEQ ID NO: 3143490 - RNA, 19 nt, Mycobacterium bovis subsp bovis AF2122/97
cgagggccacguagcagca

SEQ ID NO: 3143491 - RNA, 14 nt, Mycobacterium bovis subsp bovis AF2122/97
cgagggccagcagc

SEQ ID NO: 3143492 - RNA, 15 nt, Mycobacterium bovis subsp bovis AF2122/97
cgagggccagcagcc

SEQ ID NO: 3143493 - RNA, 19 nt, Mycobacterium bovis subsp bovis AF2122/97
cgagggccagcagccgcga

SEQ ID NO: 3143494 - RNA, 14 nt, Mycobacterium bovis subsp bovis AF2122/97
cgagggccgucaca

SEQ ID NO: 3143495 - RNA, 22 nt, Mycobacterium bovis subsp bovis AF2122/97
cgagggccugccgcacugggcg

SEQ ID NO: 3143496 - RNA, 13 nt, Mycobacterium bovis subsp bovis AF2122/97
cgagggcgccggg

SEQ ID NO: 3143497 - RNA, 14 nt, Mycobacterium bovis subsp bovis AF2122/97
cgagggcgccgggg

SEQ ID NO: 3143498 - RNA, 23 nt, Mycobacterium bovis subsp bovis AF2122/97
cgagggcgccgggggcgccgccg

SEQ ID NO: 3143499 - RNA, 23 nt, Mycobacterium bovis subsp bovis AF2122/97
cgagggcgcgagcagacgcagaa

SEQ ID NO: 3143500 - RNA, 12 nt, Mycobacterium bovis subsp bovis AF2122/97
cgagggcgcgug

SEQ ID NO: 3143501 - RNA, 15 nt, Mycobacterium bovis subsp bovis AF2122/97
cgagggcgggacccg

SEQ ID NO: 3143502 - RNA, 16 nt, Mycobacterium bovis subsp bovis AF2122/97
cgagggcgggacccgu

SEQ ID NO: 3143503 - RNA, 13 nt, Mycobacterium bovis subsp bovis AF2122/97
cgagggcgucgcc

SEQ ID NO: 3143504 - RNA, 17 nt, Mycobacterium bovis subsp bovis AF2122/97
cgagggcgucgccgccg

SEQ ID NO: 3143505 - RNA, 20 nt, Mycobacterium bovis subsp bovis AF2122/97
cgagggcgucgccgccguug

SEQ ID NO: 3143506 - RNA, 19 nt, Mycobacterium bovis subsp bovis AF2122/97
cgagggcuaccggcgccgc

SEQ ID NO: 3143507 - RNA, 22 nt, Mycobacterium bovis subsp bovis AF2122/97
cgaguagaagauggcaccgccc

SEQ ID NO: 3143508 - RNA, 19 nt, Mycobacterium bovis subsp bovis AF2122/97
cgaguagauggucgacggg

SEQ ID NO: 3143509 - RNA, 14 nt, Mycobacterium bovis subsp bovis AF2122/97
cgaguagccggucg

SEQ ID NO: 3143510 - RNA, 15 nt, Mycobacterium bovis subsp bovis AF2122/97
cgaguagccggucgg

SEQ ID NO: 3143511 - RNA, 23 nt, Mycobacterium bovis subsp bovis AF2122/97
cgaguagccguagccgccgugga

SEQ ID NO: 3143512 - RNA, 16 nt, Mycobacterium bovis subsp bovis AF2122/97
cgaguagcugacccgc

SEQ ID NO: 3143513 - RNA, 17 nt, Mycobacterium bovis subsp bovis AF2122/97
cgaguagcugacccgcg

SEQ ID NO: 3143514 - RNA, 22 nt, Mycobacterium bovis subsp bovis AF2122/97
cgaguagcugacccgcgguagc

SEQ ID NO: 3143515 - RNA, 16 nt, Mycobacterium bovis subsp bovis AF2122/97
cgaguagcugaccgag

SEQ ID NO: 3143516 - RNA, 17 nt, Mycobacterium bovis subsp bovis AF2122/97
cgaguaggcggcuccga

SEQ ID NO: 3143517 - RNA, 18 nt, Mycobacterium bovis subsp bovis AF2122/97
cgaguaggcgugggucca

SEQ ID NO: 3143518 - RNA, 16 nt, Mycobacterium bovis subsp bovis AF2122/97
cgaguagugcaggugc

SEQ ID NO: 3143519 - RNA, 21 nt, Mycobacterium bovis subsp bovis AF2122/97
cgaguaguucgucgacgucgg

SEQ ID NO: 3143520 - RNA, 15 nt, Mycobacterium bovis subsp bovis AF2122/97
cgaguauuuuucgac

SEQ ID NO: 3143521 - RNA, 19 nt, Mycobacterium bovis subsp bovis AF2122/97
cgaguauuuuucgaccagc

SEQ ID NO: 3143522 - RNA, 17 nt, Mycobacterium bovis subsp bovis AF2122/97
cgaguccaacucggcca

SEQ ID NO: 3143523 - RNA, 23 nt, Mycobacterium bovis subsp bovis AF2122/97
cgaguccaacucggccaacgacg

SEQ ID NO: 3143524 - RNA, 14 nt, Mycobacterium bovis subsp bovis AF2122/97
cgaguccaccaccu

SEQ ID NO: 3143525 - RNA, 14 nt, Mycobacterium bovis subsp bovis AF2122/97
cgaguccaggcagc

SEQ ID NO: 3143526 - RNA, 16 nt, Mycobacterium bovis subsp bovis AF2122/97
cgaguccaggcagcuu

SEQ ID NO: 3143527 - RNA, 17 nt, Mycobacterium bovis subsp bovis AF2122/97
cgaguccaggcagcuug

SEQ ID NO: 3143528 - RNA, 16 nt, Mycobacterium bovis subsp bovis AF2122/97
cgagucccggcgguug

SEQ ID NO: 3143529 - RNA, 11 nt, Mycobacterium bovis subsp bovis AF2122/97
cgaguccgcgg

SEQ ID NO: 3143530 - RNA, 12 nt, Mycobacterium bovis subsp bovis AF2122/97
cgaguccggcaa

SEQ ID NO: 3143531 - RNA, 19 nt, Mycobacterium bovis subsp bovis AF2122/97
cgaguccguacuugccacc

SEQ ID NO: 3143532 - RNA, 21 nt, Mycobacterium bovis subsp bovis AF2122/97
cgaguccguacuugccaccca

SEQ ID NO: 3143533 - RNA, 21 nt, Mycobacterium bovis subsp bovis AF2122/97
cgaguccucgagugccgccgu

SEQ ID NO: 3143534 - RNA, 23 nt, Mycobacterium bovis subsp bovis AF2122/97
cgaguccucgagugccgccgucg

SEQ ID NO: 3143535 - RNA, 16 nt, Mycobacterium bovis subsp bovis AF2122/97
cgagucgaaaccgccc

SEQ ID NO: 3143536 - RNA, 18 nt, Mycobacterium bovis subsp bovis AF2122/97
cgagucgaaaccgcccgu

SEQ ID NO: 3143537 - RNA, 16 nt, Mycobacterium bovis subsp bovis AF2122/97
cgagucgaacccgcga

SEQ ID NO: 3143538 - RNA, 14 nt, Mycobacterium bovis subsp bovis AF2122/97
cgagucgaucacgu

SEQ ID NO: 3143539 - RNA, 17 nt, Mycobacterium bovis subsp bovis AF2122/97
cgagucgaucucggcag

SEQ ID NO: 3143540 - RNA, 13 nt, Mycobacterium bovis subsp bovis AF2122/97
cgagucgaugacc

SEQ ID NO: 3143541 - RNA, 16 nt, Mycobacterium bovis subsp bovis AF2122/97
cgagucgaugaccccg

SEQ ID NO: 3143542 - RNA, 14 nt, Mycobacterium bovis subsp bovis AF2122/97
cgagucgcacgugg

SEQ ID NO: 3143543 - RNA, 15 nt, Mycobacterium bovis subsp bovis AF2122/97
cgagucgccagaccg

SEQ ID NO: 3143544 - RNA, 20 nt, Mycobacterium bovis subsp bovis AF2122/97
cgagucgccgcgggcagcga

SEQ ID NO: 3143545 - RNA, 23 nt, Mycobacterium bovis subsp bovis AF2122/97
cgagucgcgaacucaugcccgac

SEQ ID NO: 3143546 - RNA, 15 nt, Mycobacterium bovis subsp bovis AF2122/97
cgagucggcgggcga

SEQ ID NO: 3143547 - RNA, 15 nt, Mycobacterium bovis subsp bovis AF2122/97
cgagucggcggggcg

SEQ ID NO: 3143548 - RNA, 16 nt, Mycobacterium bovis subsp bovis AF2122/97
cgagucgggggccgcg

SEQ ID NO: 3143549 - RNA, 17 nt, Mycobacterium bovis subsp bovis AF2122/97
cgagucgggggccgcgu

SEQ ID NO: 3143550 - RNA, 16 nt, Mycobacterium bovis subsp bovis AF2122/97
cgagucgguugucggg

SEQ ID NO: 3143551 - RNA, 13 nt, Mycobacterium bovis subsp bovis AF2122/97
cgagucgugcguu

SEQ ID NO: 3143552 - RNA, 24 nt, Mycobacterium bovis subsp bovis AF2122/97
cgagugaaguuguuggccagaccg

SEQ ID NO: 3143553 - RNA, 13 nt, Mycobacterium bovis subsp bovis AF2122/97
cgagugaccaggg

SEQ ID NO: 3143554 - RNA, 14 nt, Mycobacterium bovis subsp bovis AF2122/97
cgagugccaguccg

SEQ ID NO: 3143555 - RNA, 16 nt, Mycobacterium bovis subsp bovis AF2122/97
cgagugccgccaccgc

SEQ ID NO: 3143556 - RNA, 12 nt, Mycobacterium bovis subsp bovis AF2122/97
cgagugccgccg

SEQ ID NO: 3143557 - RNA, 24 nt, Mycobacterium bovis subsp bovis AF2122/97
cgagugccgccgucgccacgccca

SEQ ID NO: 3143558 - RNA, 15 nt, Mycobacterium bovis subsp bovis AF2122/97
cgagugcgacggcga

SEQ ID NO: 3143559 - RNA, 23 nt, Mycobacterium bovis subsp bovis AF2122/97
cgagugcggcacgaucgccaacg

SEQ ID NO: 3143560 - RNA, 17 nt, Mycobacterium bovis subsp bovis AF2122/97
cgagugcggcgaccagg

SEQ ID NO: 3143561 - RNA, 23 nt, Mycobacterium bovis subsp bovis AF2122/97
cgagugcggugugugcaagccga

SEQ ID NO: 3143562 - RNA, 19 nt, Mycobacterium bovis subsp bovis AF2122/97
cgagugcugucgucuuggc

SEQ ID NO: 3143563 - RNA, 20 nt, Mycobacterium bovis subsp bovis AF2122/97
cgaguggaucauguucggcc

SEQ ID NO: 3143564 - RNA, 21 nt, Mycobacterium bovis subsp bovis AF2122/97
cgaguggaucauguucggcca

SEQ ID NO: 3143565 - RNA, 14 nt, Mycobacterium bovis subsp bovis AF2122/97
cgaguggccgugga

SEQ ID NO: 3143566 - RNA, 15 nt, Mycobacterium bovis subsp bovis AF2122/97
cgaguggccguggau

SEQ ID NO: 3143567 - RNA, 22 nt, Mycobacterium bovis subsp bovis AF2122/97
cgagugggauucugacgaccgg

SEQ ID NO: 3143568 - RNA, 21 nt, Mycobacterium bovis subsp bovis AF2122/97
cgagugggugaggccaaccac

SEQ ID NO: 3143569 - RNA, 14 nt, Mycobacterium bovis subsp bovis AF2122/97
cgagugguccagcc

SEQ ID NO: 3143570 - RNA, 15 nt, Mycobacterium bovis subsp bovis AF2122/97
cgagugguccggcgg

SEQ ID NO: 3143571 - RNA, 18 nt, Mycobacterium bovis subsp bovis AF2122/97
cgagugucuuagccagca

SEQ ID NO: 3143572 - RNA, 19 nt, Mycobacterium bovis subsp bovis AF2122/97
cgagugucuuagccagcag

SEQ ID NO: 3143573 - RNA, 14 nt, Mycobacterium bovis subsp bovis AF2122/97
cgaguuaccggugg

SEQ ID NO: 3143574 - RNA, 13 nt, Mycobacterium bovis subsp bovis AF2122/97
cgaguuccggccg

SEQ ID NO: 3143575 - RNA, 19 nt, Mycobacterium bovis subsp bovis AF2122/97
cgaguucgcagucgaugag

SEQ ID NO: 3143576 - RNA, 14 nt, Mycobacterium bovis subsp bovis AF2122/97
cgaguucggccgcg

SEQ ID NO: 3143577 - RNA, 19 nt, Mycobacterium bovis subsp bovis AF2122/97
cgaguucggccgcggugua

SEQ ID NO: 3143578 - RNA, 18 nt, Mycobacterium bovis subsp bovis AF2122/97
cgaguucgucagcggcca

SEQ ID NO: 3143579 - RNA, 23 nt, Mycobacterium bovis subsp bovis AF2122/97
cgaguugaacaauccgguguuga

SEQ ID NO: 3143580 - RNA, 12 nt, Mycobacterium bovis subsp bovis AF2122/97
cgaguugaagaa

SEQ ID NO: 3143581 - RNA, 12 nt, Mycobacterium bovis subsp bovis AF2122/97
cgaguugagcau

SEQ ID NO: 3143582 - RNA, 20 nt, Mycobacterium bovis subsp bovis AF2122/97
cgaguugaugcaagcgggca

SEQ ID NO: 3143583 - RNA, 20 nt, Mycobacterium bovis subsp bovis AF2122/97
cgaguugcccgggucggccg

SEQ ID NO: 3143584 - RNA, 15 nt, Mycobacterium bovis subsp bovis AF2122/97
cgaguugcucggccg

SEQ ID NO: 3143585 - RNA, 15 nt, Mycobacterium bovis subsp bovis AF2122/97
cgaguuggccguggc

SEQ ID NO: 3143586 - RNA, 17 nt, Mycobacterium bovis subsp bovis AF2122/97
cgaguuggcgaagcccg

SEQ ID NO: 3143587 - RNA, 16 nt, Mycobacterium bovis subsp bovis AF2122/97
cgaguuucugcucgac

SEQ ID NO: 3143588 - RNA, 17 nt, Mycobacterium bovis subsp bovis AF2122/97
cgaguuucugcucgacc

SEQ ID NO: 3143589 - RNA, 17 nt, Mycobacterium bovis subsp bovis AF2122/97
cgauaaauggccgauga

SEQ ID NO: 3143590 - RNA, 16 nt, Mycobacterium bovis subsp bovis AF2122/97
cgauaacaaggccgcc

SEQ ID NO: 3143591 - RNA, 18 nt, Mycobacterium bovis subsp bovis AF2122/97
cgauaacaaggccgccgc

SEQ ID NO: 3143592 - RNA, 20 nt, Mycobacterium bovis subsp bovis AF2122/97
cgauaacaaggccgccgccg

SEQ ID NO: 3143593 - RNA, 16 nt, Mycobacterium bovis subsp bovis AF2122/97
cgauaacacccgggcc

SEQ ID NO: 3143594 - RNA, 21 nt, Mycobacterium bovis subsp bovis AF2122/97
cgaucacccccuggacuucgg

SEQ ID NO: 3143595 - RNA, 12 nt, Mycobacterium bovis subsp bovis AF2122/97
cgaucaccccgc

SEQ ID NO: 3143596 - RNA, 14 nt, Mycobacterium bovis subsp bovis AF2122/97
cgaucaccccgcca

SEQ ID NO: 3143597 - RNA, 23 nt, Mycobacterium bovis subsp bovis AF2122/97
cgaucaccccgccaugcggcgcg

SEQ ID NO: 3143598 - RNA, 19 nt, Mycobacterium bovis subsp bovis AF2122/97
cgaucaccccggucggccc

SEQ ID NO: 3143599 - RNA, 22 nt, Mycobacterium bovis subsp bovis AF2122/97
cgaucaccccggucggcccgcg

SEQ ID NO: 3143600 - RNA, 15 nt, Mycobacterium bovis subsp bovis AF2122/97
cgaucaccgcaucgg

SEQ ID NO: 3143601 - RNA, 13 nt, Mycobacterium bovis subsp bovis AF2122/97
cgaucaccgccgg

SEQ ID NO: 3143602 - RNA, 16 nt, Mycobacterium bovis subsp bovis AF2122/97
cgaucaccgcgccgga

SEQ ID NO: 3143603 - RNA, 18 nt, Mycobacterium bovis subsp bovis AF2122/97
cgaucaccgcuugcuggc

SEQ ID NO: 3143604 - RNA, 19 nt, Mycobacterium bovis subsp bovis AF2122/97
cgaucaccuccgcgacggc

SEQ ID NO: 3143605 - RNA, 16 nt, Mycobacterium bovis subsp bovis AF2122/97
cgaucaccucgcgggu

SEQ ID NO: 3143606 - RNA, 15 nt, Mycobacterium bovis subsp bovis AF2122/97
cgaucaccugcagca

SEQ ID NO: 3143607 - RNA, 16 nt, Mycobacterium bovis subsp bovis AF2122/97
cgaucaccugccagug

SEQ ID NO: 3143608 - RNA, 15 nt, Mycobacterium bovis subsp bovis AF2122/97
cgaucacgccggccu

SEQ ID NO: 3143609 - RNA, 15 nt, Mycobacterium bovis subsp bovis AF2122/97
cgaucacggcaccga

SEQ ID NO: 3143610 - RNA, 14 nt, Mycobacterium bovis subsp bovis AF2122/97
cgaucacggccguc

SEQ ID NO: 3143611 - RNA, 16 nt, Mycobacterium bovis subsp bovis AF2122/97
cgaucacggccgucga

SEQ ID NO: 3143612 - RNA, 14 nt, Mycobacterium bovis subsp bovis AF2122/97
cgaucacggcggcc

SEQ ID NO: 3143613 - RNA, 16 nt, Mycobacterium bovis subsp bovis AF2122/97
cgaucacggcggcccc

SEQ ID NO: 3143614 - RNA, 20 nt, Mycobacterium bovis subsp bovis AF2122/97
cgaucacggcggccccggca

SEQ ID NO: 3143615 - RNA, 24 nt, Mycobacterium bovis subsp bovis AF2122/97
cgaucacggcgggaugcagcugcc

SEQ ID NO: 3143616 - RNA, 19 nt, Mycobacterium bovis subsp bovis AF2122/97
cgaucacguacgccgccga

SEQ ID NO: 3143617 - RNA, 12 nt, Mycobacterium bovis subsp bovis AF2122/97
cgaucacgucgu

SEQ ID NO: 3143618 - RNA, 23 nt, Mycobacterium bovis subsp bovis AF2122/97
cgaucacgugguccaaccgggcc

SEQ ID NO: 3143619 - RNA, 14 nt, Mycobacterium bovis subsp bovis AF2122/97
cgaucacuagcgcc

SEQ ID NO: 3143620 - RNA, 20 nt, Mycobacterium bovis subsp bovis AF2122/97
cgaucacuagcgccccuggc

SEQ ID NO: 3143621 - RNA, 23 nt, Mycobacterium bovis subsp bovis AF2122/97
cgaucacuagucguagacggcga

SEQ ID NO: 3143622 - RNA, 15 nt, Mycobacterium bovis subsp bovis AF2122/97
cgaucagacgcucga

SEQ ID NO: 3143623 - RNA, 16 nt, Mycobacterium bovis subsp bovis AF2122/97
cgaucagacgcucgac

SEQ ID NO: 3143624 - RNA, 17 nt, Mycobacterium bovis subsp bovis AF2122/97
cgaucagacgcucgacc

SEQ ID NO: 3143625 - RNA, 16 nt, Mycobacterium bovis subsp bovis AF2122/97
cgaucagauaguccgg

SEQ ID NO: 3143626 - RNA, 20 nt, Mycobacterium bovis subsp bovis AF2122/97
cgaucagauaguccggcuug

SEQ ID NO: 3143627 - RNA, 18 nt, Mycobacterium bovis subsp bovis AF2122/97
cgaucagaugcggcccgg

SEQ ID NO: 3143628 - RNA, 22 nt, Mycobacterium bovis subsp bovis AF2122/97
cgaucagaugcggcccgggcuc

SEQ ID NO: 3143629 - RNA, 15 nt, Mycobacterium bovis subsp bovis AF2122/97
cgaucagcaacucgg

SEQ ID NO: 3143630 - RNA, 23 nt, Mycobacterium bovis subsp bovis AF2122/97
cgaucagcaacucggccacggcg

SEQ ID NO: 3143631 - RNA, 17 nt, Mycobacterium bovis subsp bovis AF2122/97
cgaucagcagccgccga

SEQ ID NO: 3143632 - RNA, 16 nt, Mycobacterium bovis subsp bovis AF2122/97
cgaucagcagcgucgg

SEQ ID NO: 3143633 - RNA, 14 nt, Mycobacterium bovis subsp bovis AF2122/97
cgaucagcccggcc

SEQ ID NO: 3143634 - RNA, 20 nt, Mycobacterium bovis subsp bovis AF2122/97
cgaucagccgggugcgcacc

SEQ ID NO: 3143635 - RNA, 21 nt, Mycobacterium bovis subsp bovis AF2122/97
cgaucagccgggugcgcaccc

SEQ ID NO: 3143636 - RNA, 23 nt, Mycobacterium bovis subsp bovis AF2122/97
cgaucagccgggugcgcacccgg

SEQ ID NO: 3143637 - RNA, 21 nt, Mycobacterium bovis subsp bovis AF2122/97
cgaucagccguggcagucgca

SEQ ID NO: 3143638 - RNA, 19 nt, Mycobacterium bovis subsp bovis AF2122/97
cgaucagcgaaccaccggc

SEQ ID NO: 3143639 - RNA, 23 nt, Mycobacterium bovis subsp bovis AF2122/97
cgaucagcgccggauccacaccg

SEQ ID NO: 3143640 - RNA, 15 nt, Mycobacterium bovis subsp bovis AF2122/97
cgaucagcgcgacgg

SEQ ID NO: 3143641 - RNA, 13 nt, Mycobacterium bovis subsp bovis AF2122/97
cgaucagcgcgca

SEQ ID NO: 3143642 - RNA, 20 nt, Mycobacterium bovis subsp bovis AF2122/97
cgaucagcgcgcacacggcu

SEQ ID NO: 3143643 - RNA, 15 nt, Mycobacterium bovis subsp bovis AF2122/97
cgaucagcgcggcgc

SEQ ID NO: 3143644 - RNA, 18 nt, Mycobacterium bovis subsp bovis AF2122/97
cgaucagcgcggcgcccu

SEQ ID NO: 3143645 - RNA, 21 nt, Mycobacterium bovis subsp bovis AF2122/97
cgaucagcuccuguaacugcu

SEQ ID NO: 3143646 - RNA, 13 nt, Mycobacterium bovis subsp bovis AF2122/97
cgaucagcugggc

SEQ ID NO: 3143647 - RNA, 20 nt, Mycobacterium bovis subsp bovis AF2122/97
cgaucagcuugggcagcagc

SEQ ID NO: 3143648 - RNA, 21 nt, Mycobacterium bovis subsp bovis AF2122/97
cgaucagcuugggcagcagcg

SEQ ID NO: 3143649 - RNA, 17 nt, Mycobacterium bovis subsp bovis AF2122/97
cgaucaggccgacgucg

SEQ ID NO: 3143650 - RNA, 15 nt, Mycobacterium bovis subsp bovis AF2122/97
cgaucaggccgucgc

SEQ ID NO: 3143651 - RNA, 16 nt, Mycobacterium bovis subsp bovis AF2122/97
cgaucaggccgucgcc

SEQ ID NO: 3143652 - RNA, 18 nt, Mycobacterium bovis subsp bovis AF2122/97
cgaucaggccgucgccgg

SEQ ID NO: 3143653 - RNA, 14 nt, Mycobacterium bovis subsp bovis AF2122/97
cgaucaggccuugg

SEQ ID NO: 3143654 - RNA, 18 nt, Mycobacterium bovis subsp bovis AF2122/97
cgaucaggcugccgcugc

SEQ ID NO: 3143655 - RNA, 23 nt, Mycobacterium bovis subsp bovis AF2122/97
cgaucaggggcccacccgaauca

SEQ ID NO: 3143656 - RNA, 22 nt, Mycobacterium bovis subsp bovis AF2122/97
cgaucagggugucgaagagcag

SEQ ID NO: 3143657 - RNA, 18 nt, Mycobacterium bovis subsp bovis AF2122/97
cgaucagguaccggcgga

SEQ ID NO: 3143658 - RNA, 16 nt, Mycobacterium bovis subsp bovis AF2122/97
cgaucagguacgccag

SEQ ID NO: 3143659 - RNA, 20 nt, Mycobacterium bovis subsp bovis AF2122/97
cgaucagguucgucaggucc

SEQ ID NO: 3143660 - RNA, 18 nt, Mycobacterium bovis subsp bovis AF2122/97
cgaucagguuggcggcug

SEQ ID NO: 3143661 - RNA, 22 nt, Mycobacterium bovis subsp bovis AF2122/97
cgaucaguccgauuggugucgg

SEQ ID NO: 3143662 - RNA, 17 nt, Mycobacterium bovis subsp bovis AF2122/97
cgaucaguccggcguuc

SEQ ID NO: 3143663 - RNA, 18 nt, Mycobacterium bovis subsp bovis AF2122/97
cgaucagucgucuugaug

SEQ ID NO: 3143664 - RNA, 18 nt, Mycobacterium bovis subsp bovis AF2122/97
cgaucagugcaagaccgc

SEQ ID NO: 3143665 - RNA, 19 nt, Mycobacterium bovis subsp bovis AF2122/97
cgaucagugcaagaccgca

SEQ ID NO: 3143666 - RNA, 15 nt, Mycobacterium bovis subsp bovis AF2122/97
cgaucaucaccggca

SEQ ID NO: 3143667 - RNA, 16 nt, Mycobacterium bovis subsp bovis AF2122/97
cgaucaucaccggcau

SEQ ID NO: 3143668 - RNA, 17 nt, Mycobacterium bovis subsp bovis AF2122/97
cgaucaucaggugcgcc

SEQ ID NO: 3143669 - RNA, 22 nt, Mycobacterium bovis subsp bovis AF2122/97
cgaucaucauauccgccccagc

SEQ ID NO: 3143670 - RNA, 15 nt, Mycobacterium bovis subsp bovis AF2122/97
cgaucaucaugucgg

SEQ ID NO: 3143671 - RNA, 13 nt, Mycobacterium bovis subsp bovis AF2122/97
cgaucaucucguc

SEQ ID NO: 3143672 - RNA, 23 nt, Mycobacterium bovis subsp bovis AF2122/97
cgaucaucucgucgucgcggccg

SEQ ID NO: 3143673 - RNA, 18 nt, Mycobacterium bovis subsp bovis AF2122/97
cgaucaugagcagcacgu

SEQ ID NO: 3143674 - RNA, 16 nt, Mycobacterium bovis subsp bovis AF2122/97
cgaucauggcggcagc

SEQ ID NO: 3143675 - RNA, 15 nt, Mycobacterium bovis subsp bovis AF2122/97
cgaucaugucggccg

SEQ ID NO: 3143676 - RNA, 15 nt, Mycobacterium bovis subsp bovis AF2122/97
cgaucauugcaccca

SEQ ID NO: 3143677 - RNA, 20 nt, Mycobacterium bovis subsp bovis AF2122/97
cgaucauugcacccaccccg

SEQ ID NO: 3143678 - RNA, 13 nt, Mycobacterium bovis subsp bovis AF2122/97
cgauccacaggcu

SEQ ID NO: 3143679 - RNA, 21 nt, Mycobacterium bovis subsp bovis AF2122/97
cgauccacaggcugaagacga

SEQ ID NO: 3143680 - RNA, 21 nt, Mycobacterium bovis subsp bovis AF2122/97
cgaucgcagugggcaauccgg

SEQ ID NO: 3143681 - RNA, 18 nt, Mycobacterium bovis subsp bovis AF2122/97
cgaucgcauccgcgguug

SEQ ID NO: 3143682 - RNA, 20 nt, Mycobacterium bovis subsp bovis AF2122/97
cgaucgcauccgcgguuggc

SEQ ID NO: 3143683 - RNA, 21 nt, Mycobacterium bovis subsp bovis AF2122/97
cgaucgcauccgcgguuggca

SEQ ID NO: 3143684 - RNA, 21 nt, Mycobacterium bovis subsp bovis AF2122/97
cgaucgcauggucuucgcgga

SEQ ID NO: 3143685 - RNA, 16 nt, Mycobacterium bovis subsp bovis AF2122/97
cgaucgccaacgacuc

SEQ ID NO: 3143686 - RNA, 14 nt, Mycobacterium bovis subsp bovis AF2122/97
cgaucgccaggccg

SEQ ID NO: 3143687 - RNA, 15 nt, Mycobacterium bovis subsp bovis AF2122/97
cgaucgccaggccga

SEQ ID NO: 3143688 - RNA, 15 nt, Mycobacterium bovis subsp bovis AF2122/97
cgaucgcccggcccc

SEQ ID NO: 3143689 - RNA, 19 nt, Mycobacterium bovis subsp bovis AF2122/97
cgaucgcccgugagcgccg

SEQ ID NO: 3143690 - RNA, 12 nt, Mycobacterium bovis subsp bovis AF2122/97
cgaucgccgacg

SEQ ID NO: 3143691 - RNA, 23 nt, Mycobacterium bovis subsp bovis AF2122/97
cgaucgccgcgaagcgcucggca

SEQ ID NO: 3143692 - RNA, 15 nt, Mycobacterium bovis subsp bovis AF2122/97
cgaucgccgcgaugg

SEQ ID NO: 3143693 - RNA, 17 nt, Mycobacterium bovis subsp bovis AF2122/97
cgaucgccgcgccguag

SEQ ID NO: 3143694 - RNA, 18 nt, Mycobacterium bovis subsp bovis AF2122/97
cgaucgccgcgcuggucg

SEQ ID NO: 3143695 - RNA, 13 nt, Mycobacterium bovis subsp bovis AF2122/97
cgaucgccggccg

SEQ ID NO: 3143696 - RNA, 14 nt, Mycobacterium bovis subsp bovis AF2122/97
cgaucgccggccgc

SEQ ID NO: 3143697 - RNA, 15 nt, Mycobacterium bovis subsp bovis AF2122/97
cgaucgccggccgcg

SEQ ID NO: 3143698 - RNA, 16 nt, Mycobacterium bovis subsp bovis AF2122/97
cgaucgccggccgcgu

SEQ ID NO: 3143699 - RNA, 19 nt, Mycobacterium bovis subsp bovis AF2122/97
cgaucgcgacacggccauc

SEQ ID NO: 3143700 - RNA, 14 nt, Mycobacterium bovis subsp bovis AF2122/97
cgaucgcgagccca

SEQ ID NO: 3143701 - RNA, 23 nt, Mycobacterium bovis subsp bovis AF2122/97
cgaucgcgagcgagccaacucca

SEQ ID NO: 3143702 - RNA, 13 nt, Mycobacterium bovis subsp bovis AF2122/97
cgaucgcgccguc

SEQ ID NO: 3143703 - RNA, 15 nt, Mycobacterium bovis subsp bovis AF2122/97
cgaucgcgccgucgg

SEQ ID NO: 3143704 - RNA, 16 nt, Mycobacterium bovis subsp bovis AF2122/97
cgaucgcgccgucggc

SEQ ID NO: 3143705 - RNA, 17 nt, Mycobacterium bovis subsp bovis AF2122/97
cgaucgcgccugugcgc

SEQ ID NO: 3143706 - RNA, 22 nt, Mycobacterium bovis subsp bovis AF2122/97
cgaucgcgccugugcgcaaggc

SEQ ID NO: 3143707 - RNA, 15 nt, Mycobacterium bovis subsp bovis AF2122/97
cgaucgcgcgagcga

SEQ ID NO: 3143708 - RNA, 21 nt, Mycobacterium bovis subsp bovis AF2122/97
cgaucgcgcgagcgaugggau

SEQ ID NO: 3143709 - RNA, 15 nt, Mycobacterium bovis subsp bovis AF2122/97
cgaucgcgcuggcgc

SEQ ID NO: 3143710 - RNA, 22 nt, Mycobacterium bovis subsp bovis AF2122/97
cgaucgcggcaaugaggccguc

SEQ ID NO: 3143711 - RNA, 13 nt, Mycobacterium bovis subsp bovis AF2122/97
cgaucgcggcauc

SEQ ID NO: 3143712 - RNA, 14 nt, Mycobacterium bovis subsp bovis AF2122/97
cgaucgcggcccgg

SEQ ID NO: 3143713 - RNA, 15 nt, Mycobacterium bovis subsp bovis AF2122/97
cgaucgcggcccggc

SEQ ID NO: 3143714 - RNA, 21 nt, Mycobacterium bovis subsp bovis AF2122/97
cgaucgcggcccggcccuccg

SEQ ID NO: 3143715 - RNA, 15 nt, Mycobacterium bovis subsp bovis AF2122/97
cgaucgcggcgagca

SEQ ID NO: 3143716 - RNA, 21 nt, Mycobacterium bovis subsp bovis AF2122/97
cgaucgcggcgagcaccaccc

SEQ ID NO: 3143717 - RNA, 12 nt, Mycobacterium bovis subsp bovis AF2122/97
cgaucgcggcgg

SEQ ID NO: 3143718 - RNA, 14 nt, Mycobacterium bovis subsp bovis AF2122/97
cgaucgcggcggcc

SEQ ID NO: 3143719 - RNA, 22 nt, Mycobacterium bovis subsp bovis AF2122/97
cgaucgcggcggccuccaccac

SEQ ID NO: 3143720 - RNA, 14 nt, Mycobacterium bovis subsp bovis AF2122/97
cgaucgcggcgggc

SEQ ID NO: 3143721 - RNA, 24 nt, Mycobacterium bovis subsp bovis AF2122/97
cgaucgcggucaaauccagcagcc

SEQ ID NO: 3143722 - RNA, 22 nt, Mycobacterium bovis subsp bovis AF2122/97
cgaucgcggugaccggcucggc

SEQ ID NO: 3143723 - RNA, 15 nt, Mycobacterium bovis subsp bovis AF2122/97
cgaucgcguccgcgc

SEQ ID NO: 3143724 - RNA, 16 nt, Mycobacterium bovis subsp bovis AF2122/97
cgaucgcguccgcgcu

SEQ ID NO: 3143725 - RNA, 21 nt, Mycobacterium bovis subsp bovis AF2122/97
cgaucgcguccgcgcucaacc

SEQ ID NO: 3143726 - RNA, 12 nt, Mycobacterium bovis subsp bovis AF2122/97
cgaucgcgucgg

SEQ ID NO: 3143727 - RNA, 22 nt, Mycobacterium bovis subsp bovis AF2122/97
cgaucgcgugcggugccguggu

SEQ ID NO: 3143728 - RNA, 19 nt, Mycobacterium bovis subsp bovis AF2122/97
cgaucgcguucugcaccag

SEQ ID NO: 3143729 - RNA, 15 nt, Mycobacterium bovis subsp bovis AF2122/97
cgaucgcuccgcggc

SEQ ID NO: 3143730 - RNA, 23 nt, Mycobacterium bovis subsp bovis AF2122/97
cgaucgcuccggcccugccgccg

SEQ ID NO: 3143731 - RNA, 16 nt, Mycobacterium bovis subsp bovis AF2122/97
cgaucgcuugccccgc

SEQ ID NO: 3143732 - RNA, 14 nt, Mycobacterium bovis subsp bovis AF2122/97
cgaucggaccacca

SEQ ID NO: 3143733 - RNA, 23 nt, Mycobacterium bovis subsp bovis AF2122/97
cgaucggaccaccaggguaucga

SEQ ID NO: 3143734 - RNA, 13 nt, Mycobacterium bovis subsp bovis AF2122/97
cgaucggacgucg

SEQ ID NO: 3143735 - RNA, 14 nt, Mycobacterium bovis subsp bovis AF2122/97
cgaucggcaaucga

SEQ ID NO: 3143736 - RNA, 19 nt, Mycobacterium bovis subsp bovis AF2122/97
cgaucggcacuagcgagcc

SEQ ID NO: 3143737 - RNA, 20 nt, Mycobacterium bovis subsp bovis AF2122/97
cgaucggcacuagcgagccg

SEQ ID NO: 3143738 - RNA, 15 nt, Mycobacterium bovis subsp bovis AF2122/97
cgaucggcaggccgc

SEQ ID NO: 3143739 - RNA, 20 nt, Mycobacterium bovis subsp bovis AF2122/97
cgaucggcagucccagcgcc

SEQ ID NO: 3143740 - RNA, 23 nt, Mycobacterium bovis subsp bovis AF2122/97
cgaucggcagucccagcgccgca

SEQ ID NO: 3143741 - RNA, 20 nt, Mycobacterium bovis subsp bovis AF2122/97
cgaucggcauguucagcccg

SEQ ID NO: 3143742 - RNA, 21 nt, Mycobacterium bovis subsp bovis AF2122/97
cgaucggcauguucagcccga

SEQ ID NO: 3143743 - RNA, 22 nt, Mycobacterium bovis subsp bovis AF2122/97
cgaucggccaacagguccaccg

SEQ ID NO: 3143744 - RNA, 13 nt, Mycobacterium bovis subsp bovis AF2122/97
cgaucggcccagc

SEQ ID NO: 3143745 - RNA, 15 nt, Mycobacterium bovis subsp bovis AF2122/97
cgaucggcccagccc

SEQ ID NO: 3143746 - RNA, 14 nt, Mycobacterium bovis subsp bovis AF2122/97
cgaucggccgccga

SEQ ID NO: 3143747 - RNA, 16 nt, Mycobacterium bovis subsp bovis AF2122/97
cgaucggcgcgccgau

SEQ ID NO: 3143748 - RNA, 12 nt, Mycobacterium bovis subsp bovis AF2122/97
cgaucggcggcg

SEQ ID NO: 3143749 - RNA, 13 nt, Mycobacterium bovis subsp bovis AF2122/97
cgaucggcggcgc

SEQ ID NO: 3143750 - RNA, 14 nt, Mycobacterium bovis subsp bovis AF2122/97
cgaucggcggcgcg

SEQ ID NO: 3143751 - RNA, 16 nt, Mycobacterium bovis subsp bovis AF2122/97
cgaucggcggcgcgcc

SEQ ID NO: 3143752 - RNA, 17 nt, Mycobacterium bovis subsp bovis AF2122/97
cgaucggcggcgcgccg

SEQ ID NO: 3143753 - RNA, 19 nt, Mycobacterium bovis subsp bovis AF2122/97
cgaucggcggcgcgccgau

SEQ ID NO: 3143754 - RNA, 17 nt, Mycobacterium bovis subsp bovis AF2122/97
cgaucggcggcggcgcc

SEQ ID NO: 3143755 - RNA, 16 nt, Mycobacterium bovis subsp bovis AF2122/97
cgaucggcucacgacu

SEQ ID NO: 3143756 - RNA, 20 nt, Mycobacterium bovis subsp bovis AF2122/97
cgaucggcuugccugcgccg

SEQ ID NO: 3143757 - RNA, 21 nt, Mycobacterium bovis subsp bovis AF2122/97
cgaucgggcccaccgcugcgg

SEQ ID NO: 3143758 - RNA, 17 nt, Mycobacterium bovis subsp bovis AF2122/97
cgaucgggcccagcagc

SEQ ID NO: 3143759 - RNA, 20 nt, Mycobacterium bovis subsp bovis AF2122/97
cgaucgggcccagcagcgca

SEQ ID NO: 3143760 - RNA, 16 nt, Mycobacterium bovis subsp bovis AF2122/97
cgaucgggccggcgcg

SEQ ID NO: 3143761 - RNA, 21 nt, Mycobacterium bovis subsp bovis AF2122/97
cgaucgggccggcgcggucuc

SEQ ID NO: 3143762 - RNA, 14 nt, Mycobacterium bovis subsp bovis AF2122/97
cgaucgggcgucag

SEQ ID NO: 3143763 - RNA, 18 nt, Mycobacterium bovis subsp bovis AF2122/97
cgaucgggcuucggccag

SEQ ID NO: 3143764 - RNA, 19 nt, Mycobacterium bovis subsp bovis AF2122/97
cgaucgggcuucggccaga

SEQ ID NO: 3143765 - RNA, 23 nt, Mycobacterium bovis subsp bovis AF2122/97
cgaucggggaagccugcgggccg

SEQ ID NO: 3143766 - RNA, 16 nt, Mycobacterium bovis subsp bovis AF2122/97
cgaucggucguccgga

SEQ ID NO: 3143767 - RNA, 17 nt, Mycobacterium bovis subsp bovis AF2122/97
cgaucuuggccaccgcc

SEQ ID NO: 3143768 - RNA, 14 nt, Mycobacterium bovis subsp bovis AF2122/97
cgaucuuggcgaca

SEQ ID NO: 3143769 - RNA, 16 nt, Mycobacterium bovis subsp bovis AF2122/97
cgaucuugggccacgc

SEQ ID NO: 3143770 - RNA, 17 nt, Mycobacterium bovis subsp bovis AF2122/97
cgaucuugguggccuca

SEQ ID NO: 3143771 - RNA, 20 nt, Mycobacterium bovis subsp bovis AF2122/97
cgaugaaccaaucgcacgcc

SEQ ID NO: 3143772 - RNA, 16 nt, Mycobacterium bovis subsp bovis AF2122/97
cgaugaaccgggcagc

SEQ ID NO: 3143773 - RNA, 14 nt, Mycobacterium bovis subsp bovis AF2122/97
cgaugaacgcguag

SEQ ID NO: 3143774 - RNA, 19 nt, Mycobacterium bovis subsp bovis AF2122/97
cgaugaacgcguagucgcg

SEQ ID NO: 3143775 - RNA, 21 nt, Mycobacterium bovis subsp bovis AF2122/97
cgaugaacgggaucgacccgc

SEQ ID NO: 3143776 - RNA, 16 nt, Mycobacterium bovis subsp bovis AF2122/97
cgaugaagcgucguug

SEQ ID NO: 3143777 - RNA, 20 nt, Mycobacterium bovis subsp bovis AF2122/97
cgaugaaggccggcgaccgg

SEQ ID NO: 3143778 - RNA, 21 nt, Mycobacterium bovis subsp bovis AF2122/97
cgaugaauucuuuggggcgcg

SEQ ID NO: 3143779 - RNA, 16 nt, Mycobacterium bovis subsp bovis AF2122/97
cgaugaauuucauaaa

SEQ ID NO: 3143780 - RNA, 18 nt, Mycobacterium bovis subsp bovis AF2122/97
cgaugacagacaucgcga

SEQ ID NO: 3143781 - RNA, 21 nt, Mycobacterium bovis subsp bovis AF2122/97
cgaugacagacaucgcgacga

SEQ ID NO: 3143782 - RNA, 16 nt, Mycobacterium bovis subsp bovis AF2122/97
cgaugacaggcuuggc

SEQ ID NO: 3143783 - RNA, 16 nt, Mycobacterium bovis subsp bovis AF2122/97
cgaugacauaugacgg

SEQ ID NO: 3143784 - RNA, 17 nt, Mycobacterium bovis subsp bovis AF2122/97
cgaugacaucaccgacc

SEQ ID NO: 3143785 - RNA, 22 nt, Mycobacterium bovis subsp bovis AF2122/97
cgaugacaucaccgaccaacgc

SEQ ID NO: 3143786 - RNA, 16 nt, Mycobacterium bovis subsp bovis AF2122/97
cgaugacaucggucag

SEQ ID NO: 3143787 - RNA, 17 nt, Mycobacterium bovis subsp bovis AF2122/97
cgaugaccacgccgacg

SEQ ID NO: 3143788 - RNA, 18 nt, Mycobacterium bovis subsp bovis AF2122/97
cgaugaccacgccgacga

SEQ ID NO: 3143789 - RNA, 19 nt, Mycobacterium bovis subsp bovis AF2122/97
cgaugaccagggucugcuc

SEQ ID NO: 3143790 - RNA, 20 nt, Mycobacterium bovis subsp bovis AF2122/97
cgaugaccagggucugcuca

SEQ ID NO: 3143791 - RNA, 19 nt, Mycobacterium bovis subsp bovis AF2122/97
cgaugaccgaagagcgcgc

SEQ ID NO: 3143792 - RNA, 14 nt, Mycobacterium bovis subsp bovis AF2122/97
cgaugaccgcaacc

SEQ ID NO: 3143793 - RNA, 12 nt, Mycobacterium bovis subsp bovis AF2122/97
cgaugaccgcac

SEQ ID NO: 3143794 - RNA, 15 nt, Mycobacterium bovis subsp bovis AF2122/97
cgaugaccgcaccga

SEQ ID NO: 3143795 - RNA, 20 nt, Mycobacterium bovis subsp bovis AF2122/97
cgaugaccgcaccgaccuga

SEQ ID NO: 3143796 - RNA, 15 nt, Mycobacterium bovis subsp bovis AF2122/97
cgaugaccgccugcu

SEQ ID NO: 3143797 - RNA, 12 nt, Mycobacterium bovis subsp bovis AF2122/97
cgaugaccgcgc

SEQ ID NO: 3143798 - RNA, 19 nt, Mycobacterium bovis subsp bovis AF2122/97
cgaugaccgcgcggcccgc

SEQ ID NO: 3143799 - RNA, 13 nt, Mycobacterium bovis subsp bovis AF2122/97
cgaugaccggcga

SEQ ID NO: 3143800 - RNA, 18 nt, Mycobacterium bovis subsp bovis AF2122/97
cgaugaccgucgcacccu

SEQ ID NO: 3143801 - RNA, 17 nt, Mycobacterium bovis subsp bovis AF2122/97
cgaugaccucggcgaug

SEQ ID NO: 3143802 - RNA, 19 nt, Mycobacterium bovis subsp bovis AF2122/97
cgaugaccucggcgauguc

SEQ ID NO: 3143803 - RNA, 18 nt, Mycobacterium bovis subsp bovis AF2122/97
cgaugaccucgucaaggu

SEQ ID NO: 3143804 - RNA, 23 nt, Mycobacterium bovis subsp bovis AF2122/97
cgaugaccugcccgucccgcucg

SEQ ID NO: 3143805 - RNA, 16 nt, Mycobacterium bovis subsp bovis AF2122/97
cgaugaccuugcccac

SEQ ID NO: 3143806 - RNA, 20 nt, Mycobacterium bovis subsp bovis AF2122/97
cgaugaccuugggaccaccg

SEQ ID NO: 3143807 - RNA, 18 nt, Mycobacterium bovis subsp bovis AF2122/97
cgaugacgacgccgucgg

SEQ ID NO: 3143808 - RNA, 23 nt, Mycobacterium bovis subsp bovis AF2122/97
cgaugacgaucgcguccgcgcuc

SEQ ID NO: 3143809 - RNA, 16 nt, Mycobacterium bovis subsp bovis AF2122/97
cgaugacgaucggcgg

SEQ ID NO: 3143810 - RNA, 22 nt, Mycobacterium bovis subsp bovis AF2122/97
cgaugacgaucggcggcgcgcc

SEQ ID NO: 3143811 - RNA, 14 nt, Mycobacterium bovis subsp bovis AF2122/97
cgaugacgaugccg

SEQ ID NO: 3143812 - RNA, 17 nt, Mycobacterium bovis subsp bovis AF2122/97
cgaugacgaugccgccg

SEQ ID NO: 3143813 - RNA, 13 nt, Mycobacterium bovis subsp bovis AF2122/97
cgaugacgauggc

SEQ ID NO: 3143814 - RNA, 17 nt, Mycobacterium bovis subsp bovis AF2122/97
cgaugacgauggccgcc

SEQ ID NO: 3143815 - RNA, 19 nt, Mycobacterium bovis subsp bovis AF2122/97
cgaugacgauggccgccgc

SEQ ID NO: 3143816 - RNA, 21 nt, Mycobacterium bovis subsp bovis AF2122/97
cgaugacgauggccgccgcga

SEQ ID NO: 3143817 - RNA, 14 nt, Mycobacterium bovis subsp bovis AF2122/97
cgaugacgauggug

SEQ ID NO: 3143818 - RNA, 13 nt, Mycobacterium bovis subsp bovis AF2122/97
cgaugacgauguc

SEQ ID NO: 3143819 - RNA, 13 nt, Mycobacterium bovis subsp bovis AF2122/97
cgaugacgccauc

SEQ ID NO: 3143820 - RNA, 19 nt, Mycobacterium bovis subsp bovis AF2122/97
cgaugacgccaucgaucga

SEQ ID NO: 3143821 - RNA, 13 nt, Mycobacterium bovis subsp bovis AF2122/97
cgaugacgccguc

SEQ ID NO: 3143822 - RNA, 18 nt, Mycobacterium bovis subsp bovis AF2122/97
cgaugacgccgucagcgg

SEQ ID NO: 3143823 - RNA, 22 nt, Mycobacterium bovis subsp bovis AF2122/97
cgaugacgccgucagcggccaa

SEQ ID NO: 3143824 - RNA, 15 nt, Mycobacterium bovis subsp bovis AF2122/97
cgaugacgccgugcu

SEQ ID NO: 3143825 - RNA, 19 nt, Mycobacterium bovis subsp bovis AF2122/97
cgaugacgguggggucgcc

SEQ ID NO: 3143826 - RNA, 18 nt, Mycobacterium bovis subsp bovis AF2122/97
cgaugacguugacgucgg

SEQ ID NO: 3143827 - RNA, 21 nt, Mycobacterium bovis subsp bovis AF2122/97
cgaugacuacuccugagauga

SEQ ID NO: 3143828 - RNA, 19 nt, Mycobacterium bovis subsp bovis AF2122/97
cgaugacugaaucgaccgg

SEQ ID NO: 3143829 - RNA, 20 nt, Mycobacterium bovis subsp bovis AF2122/97
cgaugacugaaucgaccgga

SEQ ID NO: 3143830 - RNA, 16 nt, Mycobacterium bovis subsp bovis AF2122/97
cgaugagcacucccug

SEQ ID NO: 3143831 - RNA, 20 nt, Mycobacterium bovis subsp bovis AF2122/97
cgaugagcaugcccagcgca

SEQ ID NO: 3143832 - RNA, 15 nt, Mycobacterium bovis subsp bovis AF2122/97
cgaugagcccagccg

SEQ ID NO: 3143833 - RNA, 20 nt, Mycobacterium bovis subsp bovis AF2122/97
cgaugagcccagccgcgggc

SEQ ID NO: 3143834 - RNA, 23 nt, Mycobacterium bovis subsp bovis AF2122/97
cgaugagcccagccgcgggccgc

SEQ ID NO: 3143835 - RNA, 21 nt, Mycobacterium bovis subsp bovis AF2122/97
cgaugagcgguaccccccagc

SEQ ID NO: 3143836 - RNA, 23 nt, Mycobacterium bovis subsp bovis AF2122/97
cgaugagcgugccgcagcggcgg

SEQ ID NO: 3143837 - RNA, 15 nt, Mycobacterium bovis subsp bovis AF2122/97
cgaugaggcgcagcg

SEQ ID NO: 3143838 - RNA, 16 nt, Mycobacterium bovis subsp bovis AF2122/97
cgaugaggcgcagcgc

SEQ ID NO: 3143839 - RNA, 17 nt, Mycobacterium bovis subsp bovis AF2122/97
cgaugaggcgcagcgcc

SEQ ID NO: 3143840 - RNA, 21 nt, Mycobacterium bovis subsp bovis AF2122/97
cgaugagggcuuguggugagc

SEQ ID NO: 3143841 - RNA, 22 nt, Mycobacterium bovis subsp bovis AF2122/97
cgaugagguucaucgccggcgc

SEQ ID NO: 3143842 - RNA, 15 nt, Mycobacterium bovis subsp bovis AF2122/97
cgaugaucaccaguc

SEQ ID NO: 3143843 - RNA, 17 nt, Mycobacterium bovis subsp bovis AF2122/97
cgaugaucccgccaccg

SEQ ID NO: 3143844 - RNA, 18 nt, Mycobacterium bovis subsp bovis AF2122/97
cgaugaucgaacacggca

SEQ ID NO: 3143845 - RNA, 15 nt, Mycobacterium bovis subsp bovis AF2122/97
cgaugaucgcaucga

SEQ ID NO: 3143846 - RNA, 19 nt, Mycobacterium bovis subsp bovis AF2122/97
cgaugaucgccuucuuguu

SEQ ID NO: 3143847 - RNA, 18 nt, Mycobacterium bovis subsp bovis AF2122/97
cgaugaucucacccagcu

SEQ ID NO: 3143848 - RNA, 21 nt, Mycobacterium bovis subsp bovis AF2122/97
cgaugaucucacccagcucgc

SEQ ID NO: 3143849 - RNA, 23 nt, Mycobacterium bovis subsp bovis AF2122/97
cgaugaucugcuugccaccgccg

SEQ ID NO: 3143850 - RNA, 17 nt, Mycobacterium bovis subsp bovis AF2122/97
cgaugaucuugccgcgg

SEQ ID NO: 3143851 - RNA, 21 nt, Mycobacterium bovis subsp bovis AF2122/97
cgaugaucuugccgcggcgca

SEQ ID NO: 3143852 - RNA, 17 nt, Mycobacterium bovis subsp bovis AF2122/97
cgaugaugccggacagc

SEQ ID NO: 3143853 - RNA, 15 nt, Mycobacterium bovis subsp bovis AF2122/97
cgaugcucgccguug

SEQ ID NO: 3143854 - RNA, 22 nt, Mycobacterium bovis subsp bovis AF2122/97
cgaugcucgucccagaaccggc

SEQ ID NO: 3143855 - RNA, 14 nt, Mycobacterium bovis subsp bovis AF2122/97
cgaugcugaacacg

SEQ ID NO: 3143856 - RNA, 15 nt, Mycobacterium bovis subsp bovis AF2122/97
cgaugcugaacacgc

SEQ ID NO: 3143857 - RNA, 13 nt, Mycobacterium bovis subsp bovis AF2122/97
cgaugcugaucac

SEQ ID NO: 3143858 - RNA, 15 nt, Mycobacterium bovis subsp bovis AF2122/97
cgaugcugccagcca

SEQ ID NO: 3143859 - RNA, 12 nt, Mycobacterium bovis subsp bovis AF2122/97
cgaugcugccgc

SEQ ID NO: 3143860 - RNA, 13 nt, Mycobacterium bovis subsp bovis AF2122/97
cgaugcugccgcc

SEQ ID NO: 3143861 - RNA, 20 nt, Mycobacterium bovis subsp bovis AF2122/97
cgaugcuggcaaaguaucgc

SEQ ID NO: 3143862 - RNA, 21 nt, Mycobacterium bovis subsp bovis AF2122/97
cgaugcuggcgaacucgaggu

SEQ ID NO: 3143863 - RNA, 17 nt, Mycobacterium bovis subsp bovis AF2122/97
cgaugcuggcggccucg

SEQ ID NO: 3143864 - RNA, 13 nt, Mycobacterium bovis subsp bovis AF2122/97
cgauggaccgcac

SEQ ID NO: 3143865 - RNA, 21 nt, Mycobacterium bovis subsp bovis AF2122/97
cgauggaguucucaucgccaa

SEQ ID NO: 3143866 - RNA, 22 nt, Mycobacterium bovis subsp bovis AF2122/97
cgauggaugggcugcgcgucga

SEQ ID NO: 3143867 - RNA, 17 nt, Mycobacterium bovis subsp bovis AF2122/97
cgauggauuggcgucag

SEQ ID NO: 3143868 - RNA, 22 nt, Mycobacterium bovis subsp bovis AF2122/97
cgauggauuggcgucagcagca

SEQ ID NO: 3143869 - RNA, 18 nt, Mycobacterium bovis subsp bovis AF2122/97
cgauggcaaacgcaccca

SEQ ID NO: 3143870 - RNA, 15 nt, Mycobacterium bovis subsp bovis AF2122/97
cgauggcaccacuac

SEQ ID NO: 3143871 - RNA, 21 nt, Mycobacterium bovis subsp bovis AF2122/97
cgauggcaccacuacaucgau

SEQ ID NO: 3143872 - RNA, 16 nt, Mycobacterium bovis subsp bovis AF2122/97
cgauggcaccggcgug

SEQ ID NO: 3143873 - RNA, 13 nt, Mycobacterium bovis subsp bovis AF2122/97
cgauggcaggggc

SEQ ID NO: 3143874 - RNA, 15 nt, Mycobacterium bovis subsp bovis AF2122/97
cgauggcaucucgau

SEQ ID NO: 3143875 - RNA, 13 nt, Mycobacterium bovis subsp bovis AF2122/97
cgauggcaugggc

SEQ ID NO: 3143876 - RNA, 18 nt, Mycobacterium bovis subsp bovis AF2122/97
cgauggccacccgguggc

SEQ ID NO: 3143877 - RNA, 20 nt, Mycobacterium bovis subsp bovis AF2122/97
cgauggccagcacgguguug

SEQ ID NO: 3143878 - RNA, 16 nt, Mycobacterium bovis subsp bovis AF2122/97
cgauggccaggcuggc

SEQ ID NO: 3143879 - RNA, 19 nt, Mycobacterium bovis subsp bovis AF2122/97
cgauggccaucaucgacgg

SEQ ID NO: 3143880 - RNA, 18 nt, Mycobacterium bovis subsp bovis AF2122/97
cgauggcccuuccggccg

SEQ ID NO: 3143881 - RNA, 19 nt, Mycobacterium bovis subsp bovis AF2122/97
cgauggcccuuccggccga

SEQ ID NO: 3143882 - RNA, 13 nt, Mycobacterium bovis subsp bovis AF2122/97
cgauggccgccgc

SEQ ID NO: 3143883 - RNA, 21 nt, Mycobacterium bovis subsp bovis AF2122/97
cgauggcgauacgcgcgucgg

SEQ ID NO: 3143884 - RNA, 21 nt, Mycobacterium bovis subsp bovis AF2122/97
cgauggcgaugagguggccgc

SEQ ID NO: 3143885 - RNA, 15 nt, Mycobacterium bovis subsp bovis AF2122/97
cgauggcgcaccggc

SEQ ID NO: 3143886 - RNA, 16 nt, Mycobacterium bovis subsp bovis AF2122/97
cgauggcgcaccggcg

SEQ ID NO: 3143887 - RNA, 17 nt, Mycobacterium bovis subsp bovis AF2122/97
cgauggcgcaccggcgu

SEQ ID NO: 3143888 - RNA, 15 nt, Mycobacterium bovis subsp bovis AF2122/97
cgauggcgcgugguc

SEQ ID NO: 3143889 - RNA, 12 nt, Mycobacterium bovis subsp bovis AF2122/97
cgauggcggcca

SEQ ID NO: 3143890 - RNA, 15 nt, Mycobacterium bovis subsp bovis AF2122/97
cgauggcggccacca

SEQ ID NO: 3143891 - RNA, 17 nt, Mycobacterium bovis subsp bovis AF2122/97
cgauggcggccaccagc

SEQ ID NO: 3143892 - RNA, 21 nt, Mycobacterium bovis subsp bovis AF2122/97
cgauggcggccaccgucagcg

SEQ ID NO: 3143893 - RNA, 21 nt, Mycobacterium bovis subsp bovis AF2122/97
cgauggcggcgcguucgucgu

SEQ ID NO: 3143894 - RNA, 19 nt, Mycobacterium bovis subsp bovis AF2122/97
cgauggcgguccaccggcc

SEQ ID NO: 3143895 - RNA, 17 nt, Mycobacterium bovis subsp bovis AF2122/97
cgauggcgguggcgagg

SEQ ID NO: 3143896 - RNA, 13 nt, Mycobacterium bovis subsp bovis AF2122/97
cgauggcgguggg

SEQ ID NO: 3143897 - RNA, 15 nt, Mycobacterium bovis subsp bovis AF2122/97
cgauggcgguggggc

SEQ ID NO: 3143898 - RNA, 17 nt, Mycobacterium bovis subsp bovis AF2122/97
cgauggcgguggggcug

SEQ ID NO: 3143899 - RNA, 18 nt, Mycobacterium bovis subsp bovis AF2122/97
cgauggcgguggggcugu

SEQ ID NO: 3143900 - RNA, 21 nt, Mycobacterium bovis subsp bovis AF2122/97
cgauggcgguggugccgcggc

SEQ ID NO: 3143901 - RNA, 22 nt, Mycobacterium bovis subsp bovis AF2122/97
cgauggcgguggugccgcggcc

SEQ ID NO: 3143902 - RNA, 15 nt, Mycobacterium bovis subsp bovis AF2122/97
cgauggcguacagca

SEQ ID NO: 3143903 - RNA, 16 nt, Mycobacterium bovis subsp bovis AF2122/97
cgauggcgucgccggc

SEQ ID NO: 3143904 - RNA, 23 nt, Mycobacterium bovis subsp bovis AF2122/97
cgauggcgucgccggccccgccg

SEQ ID NO: 3143905 - RNA, 18 nt, Mycobacterium bovis subsp bovis AF2122/97
cgauggcgucggccagga

SEQ ID NO: 3143906 - RNA, 15 nt, Mycobacterium bovis subsp bovis AF2122/97
cgauggcuaccccag

SEQ ID NO: 3143907 - RNA, 16 nt, Mycobacterium bovis subsp bovis AF2122/97
cgauggcuaccccagg

SEQ ID NO: 3143908 - RNA, 17 nt, Mycobacterium bovis subsp bovis AF2122/97
cgauggcuaccccaggg

SEQ ID NO: 3143909 - RNA, 23 nt, Mycobacterium bovis subsp bovis AF2122/97
cgauggcuaccccagggagugcc

SEQ ID NO: 3143910 - RNA, 22 nt, Mycobacterium bovis subsp bovis AF2122/97
cgauggcuaccuuggacucggc

SEQ ID NO: 3143911 - RNA, 13 nt, Mycobacterium bovis subsp bovis AF2122/97
cgauggcucacau

SEQ ID NO: 3143912 - RNA, 18 nt, Mycobacterium bovis subsp bovis AF2122/97
cgauggcucacaugcccg

SEQ ID NO: 3143913 - RNA, 20 nt, Mycobacterium bovis subsp bovis AF2122/97
cgauggcucacaugcccgca

SEQ ID NO: 3143914 - RNA, 22 nt, Mycobacterium bovis subsp bovis AF2122/97
cgauggcucaccagcuccucgu

SEQ ID NO: 3143915 - RNA, 18 nt, Mycobacterium bovis subsp bovis AF2122/97
cgauggcuuggugcccaa

SEQ ID NO: 3143916 - RNA, 22 nt, Mycobacterium bovis subsp bovis AF2122/97
cgaugggaaccgaaucggcacc

SEQ ID NO: 3143917 - RNA, 19 nt, Mycobacterium bovis subsp bovis AF2122/97
cgaugggaaucagugaaga

SEQ ID NO: 3143918 - RNA, 16 nt, Mycobacterium bovis subsp bovis AF2122/97
cgaugggagcccggcg

SEQ ID NO: 3143919 - RNA, 19 nt, Mycobacterium bovis subsp bovis AF2122/97
cgaugggagcccggcggcc

SEQ ID NO: 3143920 - RNA, 21 nt, Mycobacterium bovis subsp bovis AF2122/97
cgaugggagcccggcggcccg

SEQ ID NO: 3143921 - RNA, 20 nt, Mycobacterium bovis subsp bovis AF2122/97
cgaugggccgguccggggca

SEQ ID NO: 3143922 - RNA, 20 nt, Mycobacterium bovis subsp bovis AF2122/97
cgauggggacggcggcgagg

SEQ ID NO: 3143923 - RNA, 15 nt, Mycobacterium bovis subsp bovis AF2122/97
cgaugggugacggug

SEQ ID NO: 3143924 - RNA, 14 nt, Mycobacterium bovis subsp bovis AF2122/97
cgaugggugcaccg

SEQ ID NO: 3143925 - RNA, 15 nt, Mycobacterium bovis subsp bovis AF2122/97
cgaugggugcaccga

SEQ ID NO: 3143926 - RNA, 19 nt, Mycobacterium bovis subsp bovis AF2122/97
cgaugguacccgcgccgcg

SEQ ID NO: 3143927 - RNA, 21 nt, Mycobacterium bovis subsp bovis AF2122/97
cgaugguacccgcgccgcgca

SEQ ID NO: 3143928 - RNA, 22 nt, Mycobacterium bovis subsp bovis AF2122/97
cgaugguagucgcgaccgcggg

SEQ ID NO: 3143929 - RNA, 17 nt, Mycobacterium bovis subsp bovis AF2122/97
cgaugguaucgccgcua

SEQ ID NO: 3143930 - RNA, 20 nt, Mycobacterium bovis subsp bovis AF2122/97
cgaugguaugcccgccguag

SEQ ID NO: 3143931 - RNA, 22 nt, Mycobacterium bovis subsp bovis AF2122/97
cgaugguaugcccgccguagac

SEQ ID NO: 3143932 - RNA, 19 nt, Mycobacterium bovis subsp bovis AF2122/97
cgauggucaaugcgcuggc

SEQ ID NO: 3143933 - RNA, 23 nt, Mycobacterium bovis subsp bovis AF2122/97
cgauggucaaugcgcuggcgccg

SEQ ID NO: 3143934 - RNA, 16 nt, Mycobacterium bovis subsp bovis AF2122/97
cgauggucagcagauc

SEQ ID NO: 3143935 - RNA, 17 nt, Mycobacterium bovis subsp bovis AF2122/97
cgauggucuccggacgc

SEQ ID NO: 3143936 - RNA, 22 nt, Mycobacterium bovis subsp bovis AF2122/97
cgauggucuccucggucaccga

SEQ ID NO: 3143937 - RNA, 14 nt, Mycobacterium bovis subsp bovis AF2122/97
cgauggugaugggg

SEQ ID NO: 3143938 - RNA, 21 nt, Mycobacterium bovis subsp bovis AF2122/97
cgauggugaugggggagccgg

SEQ ID NO: 3143939 - RNA, 15 nt, Mycobacterium bovis subsp bovis AF2122/97
cgauucgugucggug

SEQ ID NO: 3143940 - RNA, 15 nt, Mycobacterium bovis subsp bovis AF2122/97
cgauucucgaucugg

SEQ ID NO: 3143941 - RNA, 21 nt, Mycobacterium bovis subsp bovis AF2122/97
cgauucugcguccugcucgcg

SEQ ID NO: 3143942 - RNA, 19 nt, Mycobacterium bovis subsp bovis AF2122/97
cgauucugcgucugcucgc

SEQ ID NO: 3143943 - RNA, 20 nt, Mycobacterium bovis subsp bovis AF2122/97
cgauucugcgucugcucgcc

SEQ ID NO: 3143944 - RNA, 13 nt, Mycobacterium bovis subsp bovis AF2122/97
cgauucuggccgg

SEQ ID NO: 3143945 - RNA, 14 nt, Mycobacterium bovis subsp bovis AF2122/97
cgauucuggccgga

SEQ ID NO: 3143946 - RNA, 15 nt, Mycobacterium bovis subsp bovis AF2122/97
cgauucuggccggau

SEQ ID NO: 3143947 - RNA, 21 nt, Mycobacterium bovis subsp bovis AF2122/97
cgauucuggccggaugccacg

SEQ ID NO: 3143948 - RNA, 23 nt, Mycobacterium bovis subsp bovis AF2122/97
cgauucugggcuucaucggcgau

SEQ ID NO: 3143949 - RNA, 16 nt, Mycobacterium bovis subsp bovis AF2122/97
cgauucugugucugcu

SEQ ID NO: 3143950 - RNA, 19 nt, Mycobacterium bovis subsp bovis AF2122/97
cgauucugugucugcucgg

SEQ ID NO: 3143951 - RNA, 18 nt, Mycobacterium bovis subsp bovis AF2122/97
cgauugaguucggcggcc

SEQ ID NO: 3143952 - RNA, 14 nt, Mycobacterium bovis subsp bovis AF2122/97
cgauugcagcuucg

SEQ ID NO: 3143953 - RNA, 19 nt, Mycobacterium bovis subsp bovis AF2122/97
cgauugcagcuucggccag

SEQ ID NO: 3143954 - RNA, 12 nt, Mycobacterium bovis subsp bovis AF2122/97
cgauugccacca

SEQ ID NO: 3143955 - RNA, 19 nt, Mycobacterium bovis subsp bovis AF2122/97
cgauugccaccaaugguga

SEQ ID NO: 3143956 - RNA, 13 nt, Mycobacterium bovis subsp bovis AF2122/97
cgauugccaccga

SEQ ID NO: 3143957 - RNA, 13 nt, Mycobacterium bovis subsp bovis AF2122/97
cgauugcccgcgc

SEQ ID NO: 3143958 - RNA, 18 nt, Mycobacterium bovis subsp bovis AF2122/97
cgauugcguagcggguca

SEQ ID NO: 3143959 - RNA, 17 nt, Mycobacterium bovis subsp bovis AF2122/97
cgauugcucggggagga

SEQ ID NO: 3143960 - RNA, 23 nt, Mycobacterium bovis subsp bovis AF2122/97
cgauuggcaggcaaugcccgacc

SEQ ID NO: 3143961 - RNA, 22 nt, Mycobacterium bovis subsp bovis AF2122/97
cgauuggccaaccccauggcca

SEQ ID NO: 3143962 - RNA, 13 nt, Mycobacterium bovis subsp bovis AF2122/97
cgauuggcucgcc

SEQ ID NO: 3143963 - RNA, 17 nt, Mycobacterium bovis subsp bovis AF2122/97
cgauuggcucgccgaac

SEQ ID NO: 3143964 - RNA, 17 nt, Mycobacterium bovis subsp bovis AF2122/97
cgauuggugucggugca

SEQ ID NO: 3143965 - RNA, 17 nt, Mycobacterium bovis subsp bovis AF2122/97
cgauugucgccgcgcuc

SEQ ID NO: 3143966 - RNA, 23 nt, Mycobacterium bovis subsp bovis AF2122/97
cgauugucggcaacgacccgccg

SEQ ID NO: 3143967 - RNA, 21 nt, Mycobacterium bovis subsp bovis AF2122/97
cgauugucggggccgcaggcc

SEQ ID NO: 3143968 - RNA, 16 nt, Mycobacterium bovis subsp bovis AF2122/97
cgauuguggccagcgc

SEQ ID NO: 3143969 - RNA, 17 nt, Mycobacterium bovis subsp bovis AF2122/97
cgauuguggccagcgcu

SEQ ID NO: 3143970 - RNA, 20 nt, Mycobacterium bovis subsp bovis AF2122/97
cgauuucgagcgcugcuccc

SEQ ID NO: 3143971 - RNA, 14 nt, Mycobacterium bovis subsp bovis AF2122/97
cgauuucgaucaca

SEQ ID NO: 3143972 - RNA, 12 nt, Mycobacterium bovis subsp bovis AF2122/97
cgauuucggcgc

SEQ ID NO: 3143973 - RNA, 13 nt, Mycobacterium bovis subsp bovis AF2122/97
cgauuucggcgcc

SEQ ID NO: 3143974 - RNA, 18 nt, Mycobacterium bovis subsp bovis AF2122/97
cgauuucggcgccggcgu

SEQ ID NO: 3143975 - RNA, 20 nt, Mycobacterium bovis subsp bovis AF2122/97
cgauuuugcgucucgcgcag

SEQ ID NO: 3143976 - RNA, 20 nt, Mycobacterium bovis subsp bovis AF2122/97
cgauuuugcgucugcucgcc

SEQ ID NO: 3143977 - RNA, 19 nt, Mycobacterium bovis subsp bovis AF2122/97
cgauuuugcgucugcucgg

SEQ ID NO: 3143978 - RNA, 20 nt, Mycobacterium bovis subsp bovis AF2122/97
cgauuuugugucugcucgcc

SEQ ID NO: 3143979 - RNA, 22 nt, Mycobacterium bovis subsp bovis AF2122/97
cgcaaaagaacccgauucuggu

SEQ ID NO: 3143980 - RNA, 15 nt, Mycobacterium bovis subsp bovis AF2122/97
cgcaaaagccaccgc

SEQ ID NO: 3143981 - RNA, 15 nt, Mycobacterium bovis subsp bovis AF2122/97
cgcaaaaucaccggu

SEQ ID NO: 3143982 - RNA, 17 nt, Mycobacterium bovis subsp bovis AF2122/97
cgcaaaaucgcacgguu

SEQ ID NO: 3143983 - RNA, 14 nt, Mycobacterium bovis subsp bovis AF2122/97
cgcaaaccacccgc

SEQ ID NO: 3143984 - RNA, 19 nt, Mycobacterium bovis subsp bovis AF2122/97
cgcaaaccacccgcaacac

SEQ ID NO: 3143985 - RNA, 14 nt, Mycobacterium bovis subsp bovis AF2122/97
cgcaaacccgccga

SEQ ID NO: 3143986 - RNA, 16 nt, Mycobacterium bovis subsp bovis AF2122/97
cgcaaagacagcgcgg

SEQ ID NO: 3143987 - RNA, 17 nt, Mycobacterium bovis subsp bovis AF2122/97
cgcaaaggccccgguga

SEQ ID NO: 3143988 - RNA, 16 nt, Mycobacterium bovis subsp bovis AF2122/97
cgcaacaaccgguugg

SEQ ID NO: 3143989 - RNA, 21 nt, Mycobacterium bovis subsp bovis AF2122/97
cgcaacaaccgguuggcgauc

SEQ ID NO: 3143990 - RNA, 19 nt, Mycobacterium bovis subsp bovis AF2122/97
cgcaacaccaucagcgaca

SEQ ID NO: 3143991 - RNA, 18 nt, Mycobacterium bovis subsp bovis AF2122/97
cgcaacaccccccgucca

SEQ ID NO: 3143992 - RNA, 21 nt, Mycobacterium bovis subsp bovis AF2122/97
cgcaacaccccccguccaccg

SEQ ID NO: 3143993 - RNA, 14 nt, Mycobacterium bovis subsp bovis AF2122/97
cgcaacaccgccaa

SEQ ID NO: 3143994 - RNA, 19 nt, Mycobacterium bovis subsp bovis AF2122/97
cgcaacaccgccaacuccu

SEQ ID NO: 3143995 - RNA, 23 nt, Mycobacterium bovis subsp bovis AF2122/97
cgcaacaccggugucggccagca

SEQ ID NO: 3143996 - RNA, 14 nt, Mycobacterium bovis subsp bovis AF2122/97
cgcaacaccgugca

SEQ ID NO: 3143997 - RNA, 16 nt, Mycobacterium bovis subsp bovis AF2122/97
cgcaacaccucaccgc

SEQ ID NO: 3143998 - RNA, 17 nt, Mycobacterium bovis subsp bovis AF2122/97
cgcaacacugaguucgg

SEQ ID NO: 3143999 - RNA, 22 nt, Mycobacterium bovis subsp bovis AF2122/97
cgcaacaugggugaugcaacgc

SEQ ID NO: 3144000 - RNA, 16 nt, Mycobacterium bovis subsp bovis AF2122/97
cgcaaccaaagcgacg

SEQ ID NO: 3144001 - RNA, 22 nt, Mycobacterium bovis subsp bovis AF2122/97
cgcaaccaaagcgacgagcagc

SEQ ID NO: 3144002 - RNA, 16 nt, Mycobacterium bovis subsp bovis AF2122/97
cgcaaccaaccgucgg

SEQ ID NO: 3144003 - RNA, 17 nt, Mycobacterium bovis subsp bovis AF2122/97
cgcaaccauguuaacgc

SEQ ID NO: 3144004 - RNA, 21 nt, Mycobacterium bovis subsp bovis AF2122/97
cgcaaccauguuaacgcgcgu

SEQ ID NO: 3144005 - RNA, 23 nt, Mycobacterium bovis subsp bovis AF2122/97
cgcaaccauguuaacgcgcgucc

SEQ ID NO: 3144006 - RNA, 15 nt, Mycobacterium bovis subsp bovis AF2122/97
cgcaacccagccgcg

SEQ ID NO: 3144007 - RNA, 20 nt, Mycobacterium bovis subsp bovis AF2122/97
cgcaacccagccgcgccagc

SEQ ID NO: 3144008 - RNA, 13 nt, Mycobacterium bovis subsp bovis AF2122/97
cgcaacccggacg

SEQ ID NO: 3144009 - RNA, 12 nt, Mycobacterium bovis subsp bovis AF2122/97
cgcaaccgagcg

SEQ ID NO: 3144010 - RNA, 19 nt, Mycobacterium bovis subsp bovis AF2122/97
cgcaaccgagcggucgauc

SEQ ID NO: 3144011 - RNA, 20 nt, Mycobacterium bovis subsp bovis AF2122/97
cgcaaccgagggcauuccga

SEQ ID NO: 3144012 - RNA, 14 nt, Mycobacterium bovis subsp bovis AF2122/97
cgcaaccgccgcca

SEQ ID NO: 3144013 - RNA, 17 nt, Mycobacterium bovis subsp bovis AF2122/97
cgcaaccgccgcgucau

SEQ ID NO: 3144014 - RNA, 13 nt, Mycobacterium bovis subsp bovis AF2122/97
cgcaaccggcgug

SEQ ID NO: 3144015 - RNA, 19 nt, Mycobacterium bovis subsp bovis AF2122/97
cgcaaccgggccucaugcu

SEQ ID NO: 3144016 - RNA, 17 nt, Mycobacterium bovis subsp bovis AF2122/97
cgcaaccgguggaugaa

SEQ ID NO: 3144017 - RNA, 23 nt, Mycobacterium bovis subsp bovis AF2122/97
cgcaaccgguggaugaacaccuc

SEQ ID NO: 3144018 - RNA, 20 nt, Mycobacterium bovis subsp bovis AF2122/97
cgcaaccuaaauugccgggc

SEQ ID NO: 3144019 - RNA, 17 nt, Mycobacterium bovis subsp bovis AF2122/97
cgcaaccucgccgucgu

SEQ ID NO: 3144020 - RNA, 21 nt, Mycobacterium bovis subsp bovis AF2122/97
cgcaacgacugaucaagugcc

SEQ ID NO: 3144021 - RNA, 21 nt, Mycobacterium bovis subsp bovis AF2122/97
cgcaacgccaacacgcguugg

SEQ ID NO: 3144022 - RNA, 15 nt, Mycobacterium bovis subsp bovis AF2122/97
cgcaacgccgauggc

SEQ ID NO: 3144023 - RNA, 13 nt, Mycobacterium bovis subsp bovis AF2122/97
cgcaacgcuucgg

SEQ ID NO: 3144024 - RNA, 21 nt, Mycobacterium bovis subsp bovis AF2122/97
cgcaacgcuucggcagcuccc

SEQ ID NO: 3144025 - RNA, 12 nt, Mycobacterium bovis subsp bovis AF2122/97
cgcaccaccgcg

SEQ ID NO: 3144026 - RNA, 13 nt, Mycobacterium bovis subsp bovis AF2122/97
cgcaccaccgcgg

SEQ ID NO: 3144027 - RNA, 16 nt, Mycobacterium bovis subsp bovis AF2122/97
cgcaccaccgcggcgg

SEQ ID NO: 3144028 - RNA, 16 nt, Mycobacterium bovis subsp bovis AF2122/97
cgcaccaccggcccca

SEQ ID NO: 3144029 - RNA, 22 nt, Mycobacterium bovis subsp bovis AF2122/97
cgcaccaccggccccaccggca

SEQ ID NO: 3144030 - RNA, 15 nt, Mycobacterium bovis subsp bovis AF2122/97
cgcaccaccgucucg

SEQ ID NO: 3144031 - RNA, 20 nt, Mycobacterium bovis subsp bovis AF2122/97
cgcaccaccgucucgccgcg

SEQ ID NO: 3144032 - RNA, 14 nt, Mycobacterium bovis subsp bovis AF2122/97
cgcaccaccugggc

SEQ ID NO: 3144033 - RNA, 15 nt, Mycobacterium bovis subsp bovis AF2122/97
cgcaccaccugggcg

SEQ ID NO: 3144034 - RNA, 16 nt, Mycobacterium bovis subsp bovis AF2122/97
cgcaccaccugggcgg

SEQ ID NO: 3144035 - RNA, 15 nt, Mycobacterium bovis subsp bovis AF2122/97
cgcaccacgagcagc

SEQ ID NO: 3144036 - RNA, 17 nt, Mycobacterium bovis subsp bovis AF2122/97
cgcaccacgagcagccg

SEQ ID NO: 3144037 - RNA, 12 nt, Mycobacterium bovis subsp bovis AF2122/97
cgcaccagcaca

SEQ ID NO: 3144038 - RNA, 15 nt, Mycobacterium bovis subsp bovis AF2122/97
cgcaccagcaccugc

SEQ ID NO: 3144039 - RNA, 21 nt, Mycobacterium bovis subsp bovis AF2122/97
cgcaccagcugucgggcagcu

SEQ ID NO: 3144040 - RNA, 12 nt, Mycobacterium bovis subsp bovis AF2122/97
cgcaccaggguu

SEQ ID NO: 3144041 - RNA, 16 nt, Mycobacterium bovis subsp bovis AF2122/97
cgcaccaguggcgccc

SEQ ID NO: 3144042 - RNA, 17 nt, Mycobacterium bovis subsp bovis AF2122/97
cgcaccaguggcgccca

SEQ ID NO: 3144043 - RNA, 22 nt, Mycobacterium bovis subsp bovis AF2122/97
cgcaccaguggcgcccauggcc

SEQ ID NO: 3144044 - RNA, 18 nt, Mycobacterium bovis subsp bovis AF2122/97
cgcaccaucggcgaggcc

SEQ ID NO: 3144045 - RNA, 23 nt, Mycobacterium bovis subsp bovis AF2122/97
cgcaccaucggcgaggccucggc

SEQ ID NO: 3144046 - RNA, 15 nt, Mycobacterium bovis subsp bovis AF2122/97
cgcaccaugucggug

SEQ ID NO: 3144047 - RNA, 16 nt, Mycobacterium bovis subsp bovis AF2122/97
cgcaccaugucgguga

SEQ ID NO: 3144048 - RNA, 18 nt, Mycobacterium bovis subsp bovis AF2122/97
cgcacccaacuccaucag

SEQ ID NO: 3144049 - RNA, 22 nt, Mycobacterium bovis subsp bovis AF2122/97
cgcacccaacuccaucagcgcg

SEQ ID NO: 3144050 - RNA, 14 nt, Mycobacterium bovis subsp bovis AF2122/97
cgcacccagggcgu

SEQ ID NO: 3144051 - RNA, 21 nt, Mycobacterium bovis subsp bovis AF2122/97
cgcacccagggcguuggcggc

SEQ ID NO: 3144052 - RNA, 22 nt, Mycobacterium bovis subsp bovis AF2122/97
cgcacccauuuaaacgggccgg

SEQ ID NO: 3144053 - RNA, 19 nt, Mycobacterium bovis subsp bovis AF2122/97
cgcaccccauacucggcgg

SEQ ID NO: 3144054 - RNA, 21 nt, Mycobacterium bovis subsp bovis AF2122/97
cgcaccccauacucggcggcu

SEQ ID NO: 3144055 - RNA, 14 nt, Mycobacterium bovis subsp bovis AF2122/97
cgcacccccgucga

SEQ ID NO: 3144056 - RNA, 20 nt, Mycobacterium bovis subsp bovis AF2122/97
cgcacccccgucgaucagcg

SEQ ID NO: 3144057 - RNA, 17 nt, Mycobacterium bovis subsp bovis AF2122/97
cgcacccccuccgcgau

SEQ ID NO: 3144058 - RNA, 20 nt, Mycobacterium bovis subsp bovis AF2122/97
cgcacccccuccgcgaugcc

SEQ ID NO: 3144059 - RNA, 14 nt, Mycobacterium bovis subsp bovis AF2122/97
cgcaccccgcccga

SEQ ID NO: 3144060 - RNA, 12 nt, Mycobacterium bovis subsp bovis AF2122/97
cgcaccccgcuu

SEQ ID NO: 3144061 - RNA, 19 nt, Mycobacterium bovis subsp bovis AF2122/97
cgcaccccgcuugcgcggc

SEQ ID NO: 3144062 - RNA, 15 nt, Mycobacterium bovis subsp bovis AF2122/97
cgcaccccggccgcg

SEQ ID NO: 3144063 - RNA, 14 nt, Mycobacterium bovis subsp bovis AF2122/97
cgcaccccggcggc

SEQ ID NO: 3144064 - RNA, 19 nt, Mycobacterium bovis subsp bovis AF2122/97
cgcaccccggcggcgucca

SEQ ID NO: 3144065 - RNA, 22 nt, Mycobacterium bovis subsp bovis AF2122/97
cgcaccccggcggcguccaucg

SEQ ID NO: 3144066 - RNA, 19 nt, Mycobacterium bovis subsp bovis AF2122/97
cgcacccgaaacaccgucu

SEQ ID NO: 3144067 - RNA, 20 nt, Mycobacterium bovis subsp bovis AF2122/97
cgcacccgaaacaccgucug

SEQ ID NO: 3144068 - RNA, 13 nt, Mycobacterium bovis subsp bovis AF2122/97
cgcacccgcgggu

SEQ ID NO: 3144069 - RNA, 21 nt, Mycobacterium bovis subsp bovis AF2122/97
cgcacccgcgggucguccggc

SEQ ID NO: 3144070 - RNA, 22 nt, Mycobacterium bovis subsp bovis AF2122/97
cgcacccgcgggucguccggcg

SEQ ID NO: 3144071 - RNA, 12 nt, Mycobacterium bovis subsp bovis AF2122/97
cgcacccgcucg

SEQ ID NO: 3144072 - RNA, 15 nt, Mycobacterium bovis subsp bovis AF2122/97
cgcacccgcucggcg

SEQ ID NO: 3144073 - RNA, 15 nt, Mycobacterium bovis subsp bovis AF2122/97
cgcacccgcucgucg

SEQ ID NO: 3144074 - RNA, 17 nt, Mycobacterium bovis subsp bovis AF2122/97
cgcacccggccgcgcac

SEQ ID NO: 3144075 - RNA, 13 nt, Mycobacterium bovis subsp bovis AF2122/97
cgcacccggcgca

SEQ ID NO: 3144076 - RNA, 15 nt, Mycobacterium bovis subsp bovis AF2122/97
cgcacccggucgagc

SEQ ID NO: 3144077 - RNA, 16 nt, Mycobacterium bovis subsp bovis AF2122/97
cgcacccggucggcgg

SEQ ID NO: 3144078 - RNA, 15 nt, Mycobacterium bovis subsp bovis AF2122/97
cgcacccguccgccg

SEQ ID NO: 3144079 - RNA, 16 nt, Mycobacterium bovis subsp bovis AF2122/97
cgcacccguccgccgc

SEQ ID NO: 3144080 - RNA, 14 nt, Mycobacterium bovis subsp bovis AF2122/97
cgcacccguccggc

SEQ ID NO: 3144081 - RNA, 17 nt, Mycobacterium bovis subsp bovis AF2122/97
cgcacccguucgugagc

SEQ ID NO: 3144082 - RNA, 19 nt, Mycobacterium bovis subsp bovis AF2122/97
cgcacccguugcgacaccu

SEQ ID NO: 3144083 - RNA, 21 nt, Mycobacterium bovis subsp bovis AF2122/97
cgcacccguugcgacaccucc

SEQ ID NO: 3144084 - RNA, 17 nt, Mycobacterium bovis subsp bovis AF2122/97
cgcacccugcgugcggc

SEQ ID NO: 3144085 - RNA, 21 nt, Mycobacterium bovis subsp bovis AF2122/97
cgcacccuggguauccaccgc

SEQ ID NO: 3144086 - RNA, 22 nt, Mycobacterium bovis subsp bovis AF2122/97
cgcaccgaaaccaugccgccga

SEQ ID NO: 3144087 - RNA, 18 nt, Mycobacterium bovis subsp bovis AF2122/97
cgcaccgaaacgccgacc

SEQ ID NO: 3144088 - RNA, 19 nt, Mycobacterium bovis subsp bovis AF2122/97
cgcaccgaaacgccgaccu

SEQ ID NO: 3144089 - RNA, 16 nt, Mycobacterium bovis subsp bovis AF2122/97
cgcaccgagcgagacc

SEQ ID NO: 3144090 - RNA, 18 nt, Mycobacterium bovis subsp bovis AF2122/97
cgcaccgagcgagaccac

SEQ ID NO: 3144091 - RNA, 14 nt, Mycobacterium bovis subsp bovis AF2122/97
cgcaccgaggccgc

SEQ ID NO: 3144092 - RNA, 15 nt, Mycobacterium bovis subsp bovis AF2122/97
cgcaccgaggccgcc

SEQ ID NO: 3144093 - RNA, 21 nt, Mycobacterium bovis subsp bovis AF2122/97
cgcaccgaggccgccgagaug

SEQ ID NO: 3144094 - RNA, 21 nt, Mycobacterium bovis subsp bovis AF2122/97
cgcaccgcaaacucgguauau

SEQ ID NO: 3144095 - RNA, 21 nt, Mycobacterium bovis subsp bovis AF2122/97
cgcaccgcaggguccacacca

SEQ ID NO: 3144096 - RNA, 15 nt, Mycobacterium bovis subsp bovis AF2122/97
cgcaccgccacccug

SEQ ID NO: 3144097 - RNA, 17 nt, Mycobacterium bovis subsp bovis AF2122/97
cgcaccgccacccugac

SEQ ID NO: 3144098 - RNA, 19 nt, Mycobacterium bovis subsp bovis AF2122/97
cgcaccgccacccugacca

SEQ ID NO: 3144099 - RNA, 18 nt, Mycobacterium bovis subsp bovis AF2122/97
cgcaccgccaguuccggu

SEQ ID NO: 3144100 - RNA, 13 nt, Mycobacterium bovis subsp bovis AF2122/97
cgcaccgccccgc

SEQ ID NO: 3144101 - RNA, 13 nt, Mycobacterium bovis subsp bovis AF2122/97
cgcaccgcccgcc

SEQ ID NO: 3144102 - RNA, 15 nt, Mycobacterium bovis subsp bovis AF2122/97
cgcaccgcccgccga

SEQ ID NO: 3144103 - RNA, 14 nt, Mycobacterium bovis subsp bovis AF2122/97
cgcaccgccggccu

SEQ ID NO: 3144104 - RNA, 17 nt, Mycobacterium bovis subsp bovis AF2122/97
cgcaccgccugcucggc

SEQ ID NO: 3144105 - RNA, 17 nt, Mycobacterium bovis subsp bovis AF2122/97
cgcaccgcgguacgccg

SEQ ID NO: 3144106 - RNA, 18 nt, Mycobacterium bovis subsp bovis AF2122/97
cgcaccgcgguacgccgg

SEQ ID NO: 3144107 - RNA, 13 nt, Mycobacterium bovis subsp bovis AF2122/97
cgcaccgcggugg

SEQ ID NO: 3144108 - RNA, 21 nt, Mycobacterium bovis subsp bovis AF2122/97
cgcaccgcguugaugaccgcc

SEQ ID NO: 3144109 - RNA, 13 nt, Mycobacterium bovis subsp bovis AF2122/97
cgcaccgcugacc

SEQ ID NO: 3144110 - RNA, 20 nt, Mycobacterium bovis subsp bovis AF2122/97
cgcaccgcugaccccggcag

SEQ ID NO: 3144111 - RNA, 14 nt, Mycobacterium bovis subsp bovis AF2122/97
cgcaccgcugaccg

SEQ ID NO: 3144112 - RNA, 14 nt, Mycobacterium bovis subsp bovis AF2122/97
cgcacgcucggcac

SEQ ID NO: 3144113 - RNA, 14 nt, Mycobacterium bovis subsp bovis AF2122/97
cgcacgcucggcgu

SEQ ID NO: 3144114 - RNA, 18 nt, Mycobacterium bovis subsp bovis AF2122/97
cgcacgcuggcgggcacu

SEQ ID NO: 3144115 - RNA, 21 nt, Mycobacterium bovis subsp bovis AF2122/97
cgcacggaaggcccggcgcgg

SEQ ID NO: 3144116 - RNA, 23 nt, Mycobacterium bovis subsp bovis AF2122/97
cgcacggaaggcccggcgcggcc

SEQ ID NO: 3144117 - RNA, 22 nt, Mycobacterium bovis subsp bovis AF2122/97
cgcacggaccaucgccaggccc

SEQ ID NO: 3144118 - RNA, 19 nt, Mycobacterium bovis subsp bovis AF2122/97
cgcacggaggcggaccagg

SEQ ID NO: 3144119 - RNA, 22 nt, Mycobacterium bovis subsp bovis AF2122/97
cgcacggauucaucacgggacg

SEQ ID NO: 3144120 - RNA, 18 nt, Mycobacterium bovis subsp bovis AF2122/97
cgcacggcagacacgcug

SEQ ID NO: 3144121 - RNA, 19 nt, Mycobacterium bovis subsp bovis AF2122/97
cgcacggcagacacgcugc

SEQ ID NO: 3144122 - RNA, 21 nt, Mycobacterium bovis subsp bovis AF2122/97
cgcacggcagacacgcugcag

SEQ ID NO: 3144123 - RNA, 15 nt, Mycobacterium bovis subsp bovis AF2122/97
cgcacggccgggucg

SEQ ID NO: 3144124 - RNA, 15 nt, Mycobacterium bovis subsp bovis AF2122/97
cgcacggcgacgcca

SEQ ID NO: 3144125 - RNA, 12 nt, Mycobacterium bovis subsp bovis AF2122/97
cgcacggcgccg

SEQ ID NO: 3144126 - RNA, 16 nt, Mycobacterium bovis subsp bovis AF2122/97
cgcacggcgccgaccc

SEQ ID NO: 3144127 - RNA, 21 nt, Mycobacterium bovis subsp bovis AF2122/97
cgcacggcgccgacccgauca

SEQ ID NO: 3144128 - RNA, 13 nt, Mycobacterium bovis subsp bovis AF2122/97
cgcacggcgucgg

SEQ ID NO: 3144129 - RNA, 14 nt, Mycobacterium bovis subsp bovis AF2122/97
cgcacggcgucggc

SEQ ID NO: 3144130 - RNA, 19 nt, Mycobacterium bovis subsp bovis AF2122/97
cgcacggcgucggccaccg

SEQ ID NO: 3144131 - RNA, 21 nt, Mycobacterium bovis subsp bovis AF2122/97
cgcacggcgucggccaccgcc

SEQ ID NO: 3144132 - RNA, 22 nt, Mycobacterium bovis subsp bovis AF2122/97
cgcacggcgucggccaccgccu

SEQ ID NO: 3144133 - RNA, 19 nt, Mycobacterium bovis subsp bovis AF2122/97
cgcacggcuagcgccguga

SEQ ID NO: 3144134 - RNA, 17 nt, Mycobacterium bovis subsp bovis AF2122/97
cgcacgggccaccagcg

SEQ ID NO: 3144135 - RNA, 18 nt, Mycobacterium bovis subsp bovis AF2122/97
cgcacggugaccacgccg

SEQ ID NO: 3144136 - RNA, 20 nt, Mycobacterium bovis subsp bovis AF2122/97
cgcacggugaccacgccgug

SEQ ID NO: 3144137 - RNA, 14 nt, Mycobacterium bovis subsp bovis AF2122/97
cgcacggugccgcc

SEQ ID NO: 3144138 - RNA, 18 nt, Mycobacterium bovis subsp bovis AF2122/97
cgcacggugccgccgucg

SEQ ID NO: 3144139 - RNA, 18 nt, Mycobacterium bovis subsp bovis AF2122/97
cgcacggugcugaucggu

SEQ ID NO: 3144140 - RNA, 15 nt, Mycobacterium bovis subsp bovis AF2122/97
cgcacgguucgggug

SEQ ID NO: 3144141 - RNA, 16 nt, Mycobacterium bovis subsp bovis AF2122/97
cgcacgguucgggugg

SEQ ID NO: 3144142 - RNA, 22 nt, Mycobacterium bovis subsp bovis AF2122/97
cgcacgguucuuggcgucuugg

SEQ ID NO: 3144143 - RNA, 21 nt, Mycobacterium bovis subsp bovis AF2122/97
cgcacgguugccgucaggguc

SEQ ID NO: 3144144 - RNA, 13 nt, Mycobacterium bovis subsp bovis AF2122/97
cgcacgguuggcg

SEQ ID NO: 3144145 - RNA, 21 nt, Mycobacterium bovis subsp bovis AF2122/97
cgcacguauccacggucgacc

SEQ ID NO: 3144146 - RNA, 23 nt, Mycobacterium bovis subsp bovis AF2122/97
cgcacguauccacggucgaccag

SEQ ID NO: 3144147 - RNA, 18 nt, Mycobacterium bovis subsp bovis AF2122/97
cgcacgucgggcccgaug

SEQ ID NO: 3144148 - RNA, 19 nt, Mycobacterium bovis subsp bovis AF2122/97
cgcacgugaugcccugggg

SEQ ID NO: 3144149 - RNA, 14 nt, Mycobacterium bovis subsp bovis AF2122/97
cgcacguucggcga

SEQ ID NO: 3144150 - RNA, 19 nt, Mycobacterium bovis subsp bovis AF2122/97
cgcacguucggcgaugauc

SEQ ID NO: 3144151 - RNA, 14 nt, Mycobacterium bovis subsp bovis AF2122/97
cgcacguuggcggc

SEQ ID NO: 3144152 - RNA, 16 nt, Mycobacterium bovis subsp bovis AF2122/97
cgcacguuggcggcca

SEQ ID NO: 3144153 - RNA, 14 nt, Mycobacterium bovis subsp bovis AF2122/97
cgcacuaccgccuu

SEQ ID NO: 3144154 - RNA, 17 nt, Mycobacterium bovis subsp bovis AF2122/97
cgcacuaccgccuuugc

SEQ ID NO: 3144155 - RNA, 19 nt, Mycobacterium bovis subsp bovis AF2122/97
cgcacuacucgaacaaccc

SEQ ID NO: 3144156 - RNA, 18 nt, Mycobacterium bovis subsp bovis AF2122/97
cgcacucaccuugucaaa

SEQ ID NO: 3144157 - RNA, 21 nt, Mycobacterium bovis subsp bovis AF2122/97
cgcacucauagaacucgccgc

SEQ ID NO: 3144158 - RNA, 22 nt, Mycobacterium bovis subsp bovis AF2122/97
cgcacucauagaacucgccgcu

SEQ ID NO: 3144159 - RNA, 22 nt, Mycobacterium bovis subsp bovis AF2122/97
cgcacuccaagucacagcucac

SEQ ID NO: 3144160 - RNA, 14 nt, Mycobacterium bovis subsp bovis AF2122/97
cgcacuccacgauc

SEQ ID NO: 3144161 - RNA, 17 nt, Mycobacterium bovis subsp bovis AF2122/97
cgcacuccacgaucggc

SEQ ID NO: 3144162 - RNA, 14 nt, Mycobacterium bovis subsp bovis AF2122/97
cgcacucccgagcc

SEQ ID NO: 3144163 - RNA, 23 nt, Mycobacterium bovis subsp bovis AF2122/97
cgcacucccgagccacaaaggcg

SEQ ID NO: 3144164 - RNA, 18 nt, Mycobacterium bovis subsp bovis AF2122/97
cgcacucccggcucggcc

SEQ ID NO: 3144165 - RNA, 21 nt, Mycobacterium bovis subsp bovis AF2122/97
cgcacucccggcucggccagc

SEQ ID NO: 3144166 - RNA, 22 nt, Mycobacterium bovis subsp bovis AF2122/97
cgcacucgacggucaucgcugu

SEQ ID NO: 3144167 - RNA, 20 nt, Mycobacterium bovis subsp bovis AF2122/97
cgcacucgcgucccgaaccg

SEQ ID NO: 3144168 - RNA, 16 nt, Mycobacterium bovis subsp bovis AF2122/97
cgcacucggcgguucc

SEQ ID NO: 3144169 - RNA, 19 nt, Mycobacterium bovis subsp bovis AF2122/97
cgcacucggcgguuccggc

SEQ ID NO: 3144170 - RNA, 20 nt, Mycobacterium bovis subsp bovis AF2122/97
cgcacucguugccgaccaug

SEQ ID NO: 3144171 - RNA, 17 nt, Mycobacterium bovis subsp bovis AF2122/97
cgcacucuagccgggug

SEQ ID NO: 3144172 - RNA, 18 nt, Mycobacterium bovis subsp bovis AF2122/97
cgcacucugaugucggga

SEQ ID NO: 3144173 - RNA, 18 nt, Mycobacterium bovis subsp bovis AF2122/97
cgcacucuuuccuuccgc

SEQ ID NO: 3144174 - RNA, 17 nt, Mycobacterium bovis subsp bovis AF2122/97
cgcacugaggcucaggu

SEQ ID NO: 3144175 - RNA, 13 nt, Mycobacterium bovis subsp bovis AF2122/97
cgcacugccccgc

SEQ ID NO: 3144176 - RNA, 13 nt, Mycobacterium bovis subsp bovis AF2122/97
cgcacugcccggg

SEQ ID NO: 3144177 - RNA, 12 nt, Mycobacterium bovis subsp bovis AF2122/97
cgcacugccgcc

SEQ ID NO: 3144178 - RNA, 14 nt, Mycobacterium bovis subsp bovis AF2122/97
cgcacugccgggug

SEQ ID NO: 3144179 - RNA, 20 nt, Mycobacterium bovis subsp bovis AF2122/97
cgcacugcgccggccggcgc

SEQ ID NO: 3144180 - RNA, 15 nt, Mycobacterium bovis subsp bovis AF2122/97
cgcacugggcgauga

SEQ ID NO: 3144181 - RNA, 16 nt, Mycobacterium bovis subsp bovis AF2122/97
cgcacugggugcgucg

SEQ ID NO: 3144182 - RNA, 19 nt, Mycobacterium bovis subsp bovis AF2122/97
cgcacugggugcgucgacc

SEQ ID NO: 3144183 - RNA, 19 nt, Mycobacterium bovis subsp bovis AF2122/97
cgcacuggucaacacgacu

SEQ ID NO: 3144184 - RNA, 20 nt, Mycobacterium bovis subsp bovis AF2122/97
cgcacugguugggcgagacc

SEQ ID NO: 3144185 - RNA, 23 nt, Mycobacterium bovis subsp bovis AF2122/97
cgcacuucuuucgaaaugagguc

SEQ ID NO: 3144186 - RNA, 15 nt, Mycobacterium bovis subsp bovis AF2122/97
cgcacuugcguggcg

SEQ ID NO: 3144187 - RNA, 14 nt, Mycobacterium bovis subsp bovis AF2122/97
cgcacuuggcugcg

SEQ ID NO: 3144188 - RNA, 23 nt, Mycobacterium bovis subsp bovis AF2122/97
cgcacuuggcugcgagagcaccg

SEQ ID NO: 3144189 - RNA, 14 nt, Mycobacterium bovis subsp bovis AF2122/97
cgcacuuucuuccu

SEQ ID NO: 3144190 - RNA, 22 nt, Mycobacterium bovis subsp bovis AF2122/97
cgcacuuucuuccucggggcuc

SEQ ID NO: 3144191 - RNA, 19 nt, Mycobacterium bovis subsp bovis AF2122/97
cgcagaaaccauucggcga

SEQ ID NO: 3144192 - RNA, 15 nt, Mycobacterium bovis subsp bovis AF2122/97
cgcagaaagucgcgc

SEQ ID NO: 3144193 - RNA, 16 nt, Mycobacterium bovis subsp bovis AF2122/97
cgcagaaagucgcgcg

SEQ ID NO: 3144194 - RNA, 21 nt, Mycobacterium bovis subsp bovis AF2122/97
cgcagaaagucgcgcgcgaac

SEQ ID NO: 3144195 - RNA, 15 nt, Mycobacterium bovis subsp bovis AF2122/97
cgcagaacaccaccg

SEQ ID NO: 3144196 - RNA, 16 nt, Mycobacterium bovis subsp bovis AF2122/97
cgcagaacaccaccgc

SEQ ID NO: 3144197 - RNA, 19 nt, Mycobacterium bovis subsp bovis AF2122/97
cgcagaacaccaccgccag

SEQ ID NO: 3144198 - RNA, 19 nt, Mycobacterium bovis subsp bovis AF2122/97
cgcagcauggugcggcggc

SEQ ID NO: 3144199 - RNA, 18 nt, Mycobacterium bovis subsp bovis AF2122/97
cgcagcauguccgcagcg

SEQ ID NO: 3144200 - RNA, 22 nt, Mycobacterium bovis subsp bovis AF2122/97
cgcagcauguccgcagcggugc

SEQ ID NO: 3144201 - RNA, 18 nt, Mycobacterium bovis subsp bovis AF2122/97
cgcagcauguggccgccg

SEQ ID NO: 3144202 - RNA, 20 nt, Mycobacterium bovis subsp bovis AF2122/97
cgcagcauguggccgccguc

SEQ ID NO: 3144203 - RNA, 13 nt, Mycobacterium bovis subsp bovis AF2122/97
cgcagccacgucu

SEQ ID NO: 3144204 - RNA, 15 nt, Mycobacterium bovis subsp bovis AF2122/97
cgcagccacgucucg

SEQ ID NO: 3144205 - RNA, 22 nt, Mycobacterium bovis subsp bovis AF2122/97
cgcagccacguuacgcucgcgg

SEQ ID NO: 3144206 - RNA, 20 nt, Mycobacterium bovis subsp bovis AF2122/97
cgcagccagaucuccccgac

SEQ ID NO: 3144207 - RNA, 14 nt, Mycobacterium bovis subsp bovis AF2122/97
cgcagccagcaagu

SEQ ID NO: 3144208 - RNA, 22 nt, Mycobacterium bovis subsp bovis AF2122/97
cgcagccagcaagucugcccga

SEQ ID NO: 3144209 - RNA, 12 nt, Mycobacterium bovis subsp bovis AF2122/97
cgcagccagcgc

SEQ ID NO: 3144210 - RNA, 14 nt, Mycobacterium bovis subsp bovis AF2122/97
cgcagccagcgcca

SEQ ID NO: 3144211 - RNA, 14 nt, Mycobacterium bovis subsp bovis AF2122/97
cgcagccagcggua

SEQ ID NO: 3144212 - RNA, 19 nt, Mycobacterium bovis subsp bovis AF2122/97
cgcagccaggugucgucga

SEQ ID NO: 3144213 - RNA, 22 nt, Mycobacterium bovis subsp bovis AF2122/97
cgcagccaggugucgucgaucg

SEQ ID NO: 3144214 - RNA, 13 nt, Mycobacterium bovis subsp bovis AF2122/97
cgcagcccgcgag

SEQ ID NO: 3144215 - RNA, 13 nt, Mycobacterium bovis subsp bovis AF2122/97
cgcagcccgucgg

SEQ ID NO: 3144216 - RNA, 16 nt, Mycobacterium bovis subsp bovis AF2122/97
cgcagcccgucggugg

SEQ ID NO: 3144217 - RNA, 12 nt, Mycobacterium bovis subsp bovis AF2122/97
cgcagcccguga

SEQ ID NO: 3144218 - RNA, 19 nt, Mycobacterium bovis subsp bovis AF2122/97
cgcagcccgugacugguga

SEQ ID NO: 3144219 - RNA, 21 nt, Mycobacterium bovis subsp bovis AF2122/97
cgcagccgaucgucucggcca

SEQ ID NO: 3144220 - RNA, 22 nt, Mycobacterium bovis subsp bovis AF2122/97
cgcagccgaucgucucggccac

SEQ ID NO: 3144221 - RNA, 17 nt, Mycobacterium bovis subsp bovis AF2122/97
cgcagccgaugucgcgc

SEQ ID NO: 3144222 - RNA, 15 nt, Mycobacterium bovis subsp bovis AF2122/97
cgcagccgcaccggg

SEQ ID NO: 3144223 - RNA, 14 nt, Mycobacterium bovis subsp bovis AF2122/97
cgcagccgcagccg

SEQ ID NO: 3144224 - RNA, 14 nt, Mycobacterium bovis subsp bovis AF2122/97
cgcagccgcaggcc

SEQ ID NO: 3144225 - RNA, 15 nt, Mycobacterium bovis subsp bovis AF2122/97
cgcagccgccgcgcc

SEQ ID NO: 3144226 - RNA, 14 nt, Mycobacterium bovis subsp bovis AF2122/97
cgcagccgccucaa

SEQ ID NO: 3144227 - RNA, 23 nt, Mycobacterium bovis subsp bovis AF2122/97
cgcagccgccucaaugaccaccg

SEQ ID NO: 3144228 - RNA, 16 nt, Mycobacterium bovis subsp bovis AF2122/97
cgcagccgcucgacgg

SEQ ID NO: 3144229 - RNA, 19 nt, Mycobacterium bovis subsp bovis AF2122/97
cgcagccgcucgacggccc

SEQ ID NO: 3144230 - RNA, 23 nt, Mycobacterium bovis subsp bovis AF2122/97
cgcagccgcucgacggcccgccg

SEQ ID NO: 3144231 - RNA, 20 nt, Mycobacterium bovis subsp bovis AF2122/97
cgcagccgggcaccacccuu

SEQ ID NO: 3144232 - RNA, 20 nt, Mycobacterium bovis subsp bovis AF2122/97
cgcagccgggccaaccgguc

SEQ ID NO: 3144233 - RNA, 13 nt, Mycobacterium bovis subsp bovis AF2122/97
cgcagccggucag

SEQ ID NO: 3144234 - RNA, 21 nt, Mycobacterium bovis subsp bovis AF2122/97
cgcagccuggucgcgcagcuc

SEQ ID NO: 3144235 - RNA, 17 nt, Mycobacterium bovis subsp bovis AF2122/97
cgcagcgaaaacccggu

SEQ ID NO: 3144236 - RNA, 22 nt, Mycobacterium bovis subsp bovis AF2122/97
cgcagcgaaaacccggucggcg

SEQ ID NO: 3144237 - RNA, 16 nt, Mycobacterium bovis subsp bovis AF2122/97
cgcagcgaaucuccaa

SEQ ID NO: 3144238 - RNA, 14 nt, Mycobacterium bovis subsp bovis AF2122/97
cgcagcgaccaccg

SEQ ID NO: 3144239 - RNA, 14 nt, Mycobacterium bovis subsp bovis AF2122/97
cgcagcgaggagcc

SEQ ID NO: 3144240 - RNA, 15 nt, Mycobacterium bovis subsp bovis AF2122/97
cgcagcgaggagccc

SEQ ID NO: 3144241 - RNA, 17 nt, Mycobacterium bovis subsp bovis AF2122/97
cgcagcgauucgccuag

SEQ ID NO: 3144242 - RNA, 23 nt, Mycobacterium bovis subsp bovis AF2122/97
cgcagcgcaaacaucuugucgau

SEQ ID NO: 3144243 - RNA, 13 nt, Mycobacterium bovis subsp bovis AF2122/97
cgcagcgccaccc

SEQ ID NO: 3144244 - RNA, 15 nt, Mycobacterium bovis subsp bovis AF2122/97
cgcagcgccacccga

SEQ ID NO: 3144245 - RNA, 22 nt, Mycobacterium bovis subsp bovis AF2122/97
cgcagcgccacccgaucgggcg

SEQ ID NO: 3144246 - RNA, 14 nt, Mycobacterium bovis subsp bovis AF2122/97
cgcagcgccagcgg

SEQ ID NO: 3144247 - RNA, 15 nt, Mycobacterium bovis subsp bovis AF2122/97
cgcagcgccagcggg

SEQ ID NO: 3144248 - RNA, 20 nt, Mycobacterium bovis subsp bovis AF2122/97
cgcagcgccauuccaagacg

SEQ ID NO: 3144249 - RNA, 15 nt, Mycobacterium bovis subsp bovis AF2122/97
cgcagcgccgccacc

SEQ ID NO: 3144250 - RNA, 22 nt, Mycobacterium bovis subsp bovis AF2122/97
cgcagcgccgccaccccgcgcg

SEQ ID NO: 3144251 - RNA, 22 nt, Mycobacterium bovis subsp bovis AF2122/97
cgcagcgccuccucgaucuccg

SEQ ID NO: 3144252 - RNA, 18 nt, Mycobacterium bovis subsp bovis AF2122/97
cgcagcgccugcggcagc

SEQ ID NO: 3144253 - RNA, 22 nt, Mycobacterium bovis subsp bovis AF2122/97
cgcagcgccugcggcagcaccc

SEQ ID NO: 3144254 - RNA, 22 nt, Mycobacterium bovis subsp bovis AF2122/97
cgcagcgcgaaggucagcgacu

SEQ ID NO: 3144255 - RNA, 16 nt, Mycobacterium bovis subsp bovis AF2122/97
cgcagcgcgaucgcgg

SEQ ID NO: 3144256 - RNA, 12 nt, Mycobacterium bovis subsp bovis AF2122/97
cgcagcgcggcu

SEQ ID NO: 3144257 - RNA, 20 nt, Mycobacterium bovis subsp bovis AF2122/97
cgcagcggaacugggccccc

SEQ ID NO: 3144258 - RNA, 21 nt, Mycobacterium bovis subsp bovis AF2122/97
cgcagcggaacugggccccca

SEQ ID NO: 3144259 - RNA, 11 nt, Mycobacterium bovis subsp bovis AF2122/97
cgcagcggcca

SEQ ID NO: 3144260 - RNA, 13 nt, Mycobacterium bovis subsp bovis AF2122/97
cgcagcggccagc

SEQ ID NO: 3144261 - RNA, 19 nt, Mycobacterium bovis subsp bovis AF2122/97
cgcagcggccagcccagcc

SEQ ID NO: 3144262 - RNA, 14 nt, Mycobacterium bovis subsp bovis AF2122/97
cgcagcggcggcaa

SEQ ID NO: 3144263 - RNA, 23 nt, Mycobacterium bovis subsp bovis AF2122/97
cgcagcgggcggugucgucaucg

SEQ ID NO: 3144264 - RNA, 16 nt, Mycobacterium bovis subsp bovis AF2122/97
cgcagcgguccgccgc

SEQ ID NO: 3144265 - RNA, 13 nt, Mycobacterium bovis subsp bovis AF2122/97
cgcagcggugagg

SEQ ID NO: 3144266 - RNA, 20 nt, Mycobacterium bovis subsp bovis AF2122/97
cgcagcggugaggugaccaa

SEQ ID NO: 3144267 - RNA, 22 nt, Mycobacterium bovis subsp bovis AF2122/97
cgcagcggugaggugaccaacg

SEQ ID NO: 3144268 - RNA, 16 nt, Mycobacterium bovis subsp bovis AF2122/97
cgcagcggugcgcggu

SEQ ID NO: 3144269 - RNA, 18 nt, Mycobacterium bovis subsp bovis AF2122/97
cgcagcggugcgcgguug

SEQ ID NO: 3144270 - RNA, 18 nt, Mycobacterium bovis subsp bovis AF2122/97
cgcagcgguggucggcgc

SEQ ID NO: 3144271 - RNA, 22 nt, Mycobacterium bovis subsp bovis AF2122/97
cgcagcgguggucggcgcgccg

SEQ ID NO: 3144272 - RNA, 16 nt, Mycobacterium bovis subsp bovis AF2122/97
cgcagcgucaucgcgu

SEQ ID NO: 3144273 - RNA, 17 nt, Mycobacterium bovis subsp bovis AF2122/97
cgcagcgugagugcagc

SEQ ID NO: 3144274 - RNA, 18 nt, Mycobacterium bovis subsp bovis AF2122/97
cgcagcgugagugcagca

SEQ ID NO: 3144275 - RNA, 18 nt, Mycobacterium bovis subsp bovis AF2122/97
cgcagcguguugcguucg

SEQ ID NO: 3144276 - RNA, 15 nt, Mycobacterium bovis subsp bovis AF2122/97
cgcagcuaacccgcc

SEQ ID NO: 3144277 - RNA, 16 nt, Mycobacterium bovis subsp bovis AF2122/97
cgcagcuaacccgcca

SEQ ID NO: 3144278 - RNA, 19 nt, Mycobacterium bovis subsp bovis AF2122/97
cgcagcuacuaccugcccg

SEQ ID NO: 3144279 - RNA, 17 nt, Mycobacterium bovis subsp bovis AF2122/97
cgcagcuauuucgcgac

SEQ ID NO: 3144280 - RNA, 16 nt, Mycobacterium bovis subsp bovis AF2122/97
cgcagcucagcauccc

SEQ ID NO: 3144281 - RNA, 19 nt, Mycobacterium bovis subsp bovis AF2122/97
cgcagcucagcaucccggc

SEQ ID NO: 3144282 - RNA, 22 nt, Mycobacterium bovis subsp bovis AF2122/97
cgcagcuccaccgugacggcca

SEQ ID NO: 3144283 - RNA, 17 nt, Mycobacterium bovis subsp bovis AF2122/97
cgcagcuccccgaccga

SEQ ID NO: 3144284 - RNA, 14 nt, Mycobacterium bovis subsp bovis AF2122/97
cgcagugcgacucu

SEQ ID NO: 3144285 - RNA, 19 nt, Mycobacterium bovis subsp bovis AF2122/97
cgcaguggcguuacgcucg

SEQ ID NO: 3144286 - RNA, 23 nt, Mycobacterium bovis subsp bovis AF2122/97
cgcagugggcaauccggucagcg

SEQ ID NO: 3144287 - RNA, 16 nt, Mycobacterium bovis subsp bovis AF2122/97
cgcaguucaucgggca

SEQ ID NO: 3144288 - RNA, 22 nt, Mycobacterium bovis subsp bovis AF2122/97
cgcaguucaucgggcaccaacc

SEQ ID NO: 3144289 - RNA, 19 nt, Mycobacterium bovis subsp bovis AF2122/97
cgcaguucggucagcgccu

SEQ ID NO: 3144290 - RNA, 16 nt, Mycobacterium bovis subsp bovis AF2122/97
cgcaguucgucgugga

SEQ ID NO: 3144291 - RNA, 20 nt, Mycobacterium bovis subsp bovis AF2122/97
cgcaguugagggugugaggu

SEQ ID NO: 3144292 - RNA, 13 nt, Mycobacterium bovis subsp bovis AF2122/97
cgcaguuggcacc

SEQ ID NO: 3144293 - RNA, 18 nt, Mycobacterium bovis subsp bovis AF2122/97
cgcaguuggcaccagccg

SEQ ID NO: 3144294 - RNA, 16 nt, Mycobacterium bovis subsp bovis AF2122/97
cgcaguuuggcggcgc

SEQ ID NO: 3144295 - RNA, 14 nt, Mycobacterium bovis subsp bovis AF2122/97
cgcauaaaucgggg

SEQ ID NO: 3144296 - RNA, 13 nt, Mycobacterium bovis subsp bovis AF2122/97
cgcauaaccggcg

SEQ ID NO: 3144297 - RNA, 18 nt, Mycobacterium bovis subsp bovis AF2122/97
cgcauaaccggcgcgccc

SEQ ID NO: 3144298 - RNA, 14 nt, Mycobacterium bovis subsp bovis AF2122/97
cgcauaacgccagu

SEQ ID NO: 3144299 - RNA, 19 nt, Mycobacterium bovis subsp bovis AF2122/97
cgcauaacgccagucccgg

SEQ ID NO: 3144300 - RNA, 19 nt, Mycobacterium bovis subsp bovis AF2122/97
cgcauaagcccccgacacg

SEQ ID NO: 3144301 - RNA, 18 nt, Mycobacterium bovis subsp bovis AF2122/97
cgcauaagcccccgcacg

SEQ ID NO: 3144302 - RNA, 15 nt, Mycobacterium bovis subsp bovis AF2122/97
cgcauacagcgcccg

SEQ ID NO: 3144303 - RNA, 21 nt, Mycobacterium bovis subsp bovis AF2122/97
cgcauaccuuccagaucgcgg

SEQ ID NO: 3144304 - RNA, 17 nt, Mycobacterium bovis subsp bovis AF2122/97
cgcauaggccccgccag

SEQ ID NO: 3144305 - RNA, 18 nt, Mycobacterium bovis subsp bovis AF2122/97
cgcauaggccccgccagc

SEQ ID NO: 3144306 - RNA, 14 nt, Mycobacterium bovis subsp bovis AF2122/97
cgcauaggcggcca

SEQ ID NO: 3144307 - RNA, 22 nt, Mycobacterium bovis subsp bovis AF2122/97
cgcauaggcggccaucgacgac

SEQ ID NO: 3144308 - RNA, 21 nt, Mycobacterium bovis subsp bovis AF2122/97
cgcauaggcuuccggcgcgac

SEQ ID NO: 3144309 - RNA, 16 nt, Mycobacterium bovis subsp bovis AF2122/97
cgcauagggccaccgc

SEQ ID NO: 3144310 - RNA, 17 nt, Mycobacterium bovis subsp bovis AF2122/97
cgcauagggccaccgcc

SEQ ID NO: 3144311 - RNA, 18 nt, Mycobacterium bovis subsp bovis AF2122/97
cgcauagggccaccgccg

SEQ ID NO: 3144312 - RNA, 21 nt, Mycobacterium bovis subsp bovis AF2122/97
cgcauagggccaccgccgccu

SEQ ID NO: 3144313 - RNA, 18 nt, Mycobacterium bovis subsp bovis AF2122/97
cgcauagugcggcugcaa

SEQ ID NO: 3144314 - RNA, 15 nt, Mycobacterium bovis subsp bovis AF2122/97
cgcaucaccacccga

SEQ ID NO: 3144315 - RNA, 14 nt, Mycobacterium bovis subsp bovis AF2122/97
cgcaucaccacugg

SEQ ID NO: 3144316 - RNA, 13 nt, Mycobacterium bovis subsp bovis AF2122/97
cgcaucacccggg

SEQ ID NO: 3144317 - RNA, 23 nt, Mycobacterium bovis subsp bovis AF2122/97
cgcaucagcuuuugcaccggacc

SEQ ID NO: 3144318 - RNA, 16 nt, Mycobacterium bovis subsp bovis AF2122/97
cgcaucaggucggugg

SEQ ID NO: 3144319 - RNA, 19 nt, Mycobacterium bovis subsp bovis AF2122/97
cgcaucauagacagggccg

SEQ ID NO: 3144320 - RNA, 17 nt, Mycobacterium bovis subsp bovis AF2122/97
cgcaucaucgcccaccg

SEQ ID NO: 3144321 - RNA, 22 nt, Mycobacterium bovis subsp bovis AF2122/97
cgcaucaugucgaagaaccggc

SEQ ID NO: 3144322 - RNA, 15 nt, Mycobacterium bovis subsp bovis AF2122/97
cgcauccaauaucgc

SEQ ID NO: 3144323 - RNA, 21 nt, Mycobacterium bovis subsp bovis AF2122/97
cgcauccaauccacgguugcc

SEQ ID NO: 3144324 - RNA, 19 nt, Mycobacterium bovis subsp bovis AF2122/97
cgcauccacgucgcccagg

SEQ ID NO: 3144325 - RNA, 18 nt, Mycobacterium bovis subsp bovis AF2122/97
cgcauccacuuccgggcg

SEQ ID NO: 3144326 - RNA, 19 nt, Mycobacterium bovis subsp bovis AF2122/97
cgcauccagccgugcggcg

SEQ ID NO: 3144327 - RNA, 20 nt, Mycobacterium bovis subsp bovis AF2122/97
cgcauccagccgugcggcgg

SEQ ID NO: 3144328 - RNA, 16 nt, Mycobacterium bovis subsp bovis AF2122/97
cgcauccccagcacaa

SEQ ID NO: 3144329 - RNA, 20 nt, Mycobacterium bovis subsp bovis AF2122/97
cgcaucccgaauggccgauc

SEQ ID NO: 3144330 - RNA, 16 nt, Mycobacterium bovis subsp bovis AF2122/97
cgcauccgcgguuggc

SEQ ID NO: 3144331 - RNA, 22 nt, Mycobacterium bovis subsp bovis AF2122/97
cgcauccgcgguuggcaguggc

SEQ ID NO: 3144332 - RNA, 20 nt, Mycobacterium bovis subsp bovis AF2122/97
cgcauccggucucggccgag

SEQ ID NO: 3144333 - RNA, 17 nt, Mycobacterium bovis subsp bovis AF2122/97
cgcaucgagcaccucca

SEQ ID NO: 3144334 - RNA, 13 nt, Mycobacterium bovis subsp bovis AF2122/97
cgcaucgaguccg

SEQ ID NO: 3144335 - RNA, 22 nt, Mycobacterium bovis subsp bovis AF2122/97
cgcaucgccaaugcccaggugu

SEQ ID NO: 3144336 - RNA, 23 nt, Mycobacterium bovis subsp bovis AF2122/97
cgcaucgcccaacaacgcuucgg

SEQ ID NO: 3144337 - RNA, 14 nt, Mycobacterium bovis subsp bovis AF2122/97
cgcaucgccgcugg

SEQ ID NO: 3144338 - RNA, 15 nt, Mycobacterium bovis subsp bovis AF2122/97
cgcaucgccucacca

SEQ ID NO: 3144339 - RNA, 17 nt, Mycobacterium bovis subsp bovis AF2122/97
cgcaucgccucaccacg

SEQ ID NO: 3144340 - RNA, 20 nt, Mycobacterium bovis subsp bovis AF2122/97
cgcaucgccucaccacgucg

SEQ ID NO: 3144341 - RNA, 21 nt, Mycobacterium bovis subsp bovis AF2122/97
cgcaucgccucaccacgucga

SEQ ID NO: 3144342 - RNA, 15 nt, Mycobacterium bovis subsp bovis AF2122/97
cgcaucgccuccucg

SEQ ID NO: 3144343 - RNA, 18 nt, Mycobacterium bovis subsp bovis AF2122/97
cgcaucgccuccucgacg

SEQ ID NO: 3144344 - RNA, 14 nt, Mycobacterium bovis subsp bovis AF2122/97
cgcaucggcaaggc

SEQ ID NO: 3144345 - RNA, 13 nt, Mycobacterium bovis subsp bovis AF2122/97
cgcaucggccagc

SEQ ID NO: 3144346 - RNA, 14 nt, Mycobacterium bovis subsp bovis AF2122/97
cgcaucggccagca

SEQ ID NO: 3144347 - RNA, 20 nt, Mycobacterium bovis subsp bovis AF2122/97
cgcaucggccagcagcgacu

SEQ ID NO: 3144348 - RNA, 23 nt, Mycobacterium bovis subsp bovis AF2122/97
cgcaucggccagcagcgacucca

SEQ ID NO: 3144349 - RNA, 15 nt, Mycobacterium bovis subsp bovis AF2122/97
cgcaucggcggggcc

SEQ ID NO: 3144350 - RNA, 21 nt, Mycobacterium bovis subsp bovis AF2122/97
cgcaucggcggggcccacacg

SEQ ID NO: 3144351 - RNA, 23 nt, Mycobacterium bovis subsp bovis AF2122/97
cgcaucggcgggucugggucagg

SEQ ID NO: 3144352 - RNA, 19 nt, Mycobacterium bovis subsp bovis AF2122/97
cgcaucggucccacugccg

SEQ ID NO: 3144353 - RNA, 15 nt, Mycobacterium bovis subsp bovis AF2122/97
cgcaucgguggcacg

SEQ ID NO: 3144354 - RNA, 12 nt, Mycobacterium bovis subsp bovis AF2122/97
cgcaucgguguc

SEQ ID NO: 3144355 - RNA, 22 nt, Mycobacterium bovis subsp bovis AF2122/97
cgcaucucgagcaugcccagcg

SEQ ID NO: 3144356 - RNA, 20 nt, Mycobacterium bovis subsp bovis AF2122/97
cgcaucuugucgagcaccuc

SEQ ID NO: 3144357 - RNA, 14 nt, Mycobacterium bovis subsp bovis AF2122/97
cgcaucuuugaacg

SEQ ID NO: 3144358 - RNA, 17 nt, Mycobacterium bovis subsp bovis AF2122/97
cgcaugagggcaucgag

SEQ ID NO: 3144359 - RNA, 21 nt, Mycobacterium bovis subsp bovis AF2122/97
cgcaugcaagucaaacgccgu

SEQ ID NO: 3144360 - RNA, 20 nt, Mycobacterium bovis subsp bovis AF2122/97
cgcaugcacgucaucggcug

SEQ ID NO: 3144361 - RNA, 22 nt, Mycobacterium bovis subsp bovis AF2122/97
cgcaugcacgucaucggcuggc

SEQ ID NO: 3144362 - RNA, 17 nt, Mycobacterium bovis subsp bovis AF2122/97
cgcaugccacggcaagc

SEQ ID NO: 3144363 - RNA, 16 nt, Mycobacterium bovis subsp bovis AF2122/97
cgcaugccccgaccgc

SEQ ID NO: 3144364 - RNA, 15 nt, Mycobacterium bovis subsp bovis AF2122/97
cgcaugcccuggacc

SEQ ID NO: 3144365 - RNA, 18 nt, Mycobacterium bovis subsp bovis AF2122/97
cgcaugcgagaacgucga

SEQ ID NO: 3144366 - RNA, 16 nt, Mycobacterium bovis subsp bovis AF2122/97
cgcaugcgcuccggcg

SEQ ID NO: 3144367 - RNA, 18 nt, Mycobacterium bovis subsp bovis AF2122/97
cgcaugcgcuccggcgcg

SEQ ID NO: 3144368 - RNA, 17 nt, Mycobacterium bovis subsp bovis AF2122/97
cgcaugcgugacccgac

SEQ ID NO: 3144369 - RNA, 21 nt, Mycobacterium bovis subsp bovis AF2122/97
cgcaugcuugaaacccaggcc

SEQ ID NO: 3144370 - RNA, 19 nt, Mycobacterium bovis subsp bovis AF2122/97
cgccaaguacgcgaccgcg

SEQ ID NO: 3144371 - RNA, 22 nt, Mycobacterium bovis subsp bovis AF2122/97
cgccaauacgugauguagcugc

SEQ ID NO: 3144372 - RNA, 20 nt, Mycobacterium bovis subsp bovis AF2122/97
cgccaaucauggugcguagc

SEQ ID NO: 3144373 - RNA, 16 nt, Mycobacterium bovis subsp bovis AF2122/97
cgccaauccaccggug

SEQ ID NO: 3144374 - RNA, 17 nt, Mycobacterium bovis subsp bovis AF2122/97
cgccaauccaccggugc

SEQ ID NO: 3144375 - RNA, 23 nt, Mycobacterium bovis subsp bovis AF2122/97
cgccaaucgaguagcugaccgag

SEQ ID NO: 3144376 - RNA, 15 nt, Mycobacterium bovis subsp bovis AF2122/97
cgccaaugcccaggu

SEQ ID NO: 3144377 - RNA, 16 nt, Mycobacterium bovis subsp bovis AF2122/97
cgccaaugcccaggug

SEQ ID NO: 3144378 - RNA, 17 nt, Mycobacterium bovis subsp bovis AF2122/97
cgccaaugccgcggagg

SEQ ID NO: 3144379 - RNA, 23 nt, Mycobacterium bovis subsp bovis AF2122/97
cgccaaugccgcggaggcggcca

SEQ ID NO: 3144380 - RNA, 14 nt, Mycobacterium bovis subsp bovis AF2122/97
cgccaaugcgggaa

SEQ ID NO: 3144381 - RNA, 15 nt, Mycobacterium bovis subsp bovis AF2122/97
cgccaauucagcggc

SEQ ID NO: 3144382 - RNA, 17 nt, Mycobacterium bovis subsp bovis AF2122/97
cgccaauucagcggcaa

SEQ ID NO: 3144383 - RNA, 18 nt, Mycobacterium bovis subsp bovis AF2122/97
cgccaauucagcggcaac

SEQ ID NO: 3144384 - RNA, 16 nt, Mycobacterium bovis subsp bovis AF2122/97
cgccacaaacccgaug

SEQ ID NO: 3144385 - RNA, 12 nt, Mycobacterium bovis subsp bovis AF2122/97
cgccacaaagaa

SEQ ID NO: 3144386 - RNA, 16 nt, Mycobacterium bovis subsp bovis AF2122/97
cgccacaacggcggcg

SEQ ID NO: 3144387 - RNA, 18 nt, Mycobacterium bovis subsp bovis AF2122/97
cgccacaacggcggcgca

SEQ ID NO: 3144388 - RNA, 16 nt, Mycobacterium bovis subsp bovis AF2122/97
cgccacaccaacgucg

SEQ ID NO: 3144389 - RNA, 20 nt, Mycobacterium bovis subsp bovis AF2122/97
cgccacacccaaaccggccc

SEQ ID NO: 3144390 - RNA, 13 nt, Mycobacterium bovis subsp bovis AF2122/97
cgccacacccgcg

SEQ ID NO: 3144391 - RNA, 14 nt, Mycobacterium bovis subsp bovis AF2122/97
cgccacacccgcga

SEQ ID NO: 3144392 - RNA, 20 nt, Mycobacterium bovis subsp bovis AF2122/97
cgccacacccggcacacccu

SEQ ID NO: 3144393 - RNA, 13 nt, Mycobacterium bovis subsp bovis AF2122/97
cgccacacccgug

SEQ ID NO: 3144394 - RNA, 14 nt, Mycobacterium bovis subsp bovis AF2122/97
cgccacaccgccgc

SEQ ID NO: 3144395 - RNA, 16 nt, Mycobacterium bovis subsp bovis AF2122/97
cgccacaccgccgcca

SEQ ID NO: 3144396 - RNA, 19 nt, Mycobacterium bovis subsp bovis AF2122/97
cgccacaccggggcggccg

SEQ ID NO: 3144397 - RNA, 21 nt, Mycobacterium bovis subsp bovis AF2122/97
cgccacaccggggcggccgac

SEQ ID NO: 3144398 - RNA, 16 nt, Mycobacterium bovis subsp bovis AF2122/97
cgccacacggggccgc

SEQ ID NO: 3144399 - RNA, 13 nt, Mycobacterium bovis subsp bovis AF2122/97
cgccacagcaccc

SEQ ID NO: 3144400 - RNA, 17 nt, Mycobacterium bovis subsp bovis AF2122/97
cgccacagcacccacgc

SEQ ID NO: 3144401 - RNA, 23 nt, Mycobacterium bovis subsp bovis AF2122/97
cgccacagcacccacgccggugg

SEQ ID NO: 3144402 - RNA, 17 nt, Mycobacterium bovis subsp bovis AF2122/97
cgccacauacaccggcc

SEQ ID NO: 3144403 - RNA, 21 nt, Mycobacterium bovis subsp bovis AF2122/97
cgccacauacaccggccgguc

SEQ ID NO: 3144404 - RNA, 13 nt, Mycobacterium bovis subsp bovis AF2122/97
cgccacaucgugg

SEQ ID NO: 3144405 - RNA, 23 nt, Mycobacterium bovis subsp bovis AF2122/97
cgccacauguugucgacggucgg

SEQ ID NO: 3144406 - RNA, 18 nt, Mycobacterium bovis subsp bovis AF2122/97
cgccacauuucaccaccg

SEQ ID NO: 3144407 - RNA, 21 nt, Mycobacterium bovis subsp bovis AF2122/97
cgccaccaaauccgcaaggac

SEQ ID NO: 3144408 - RNA, 22 nt, Mycobacterium bovis subsp bovis AF2122/97
cgccaccaaauccgcaaggacc

SEQ ID NO: 3144409 - RNA, 14 nt, Mycobacterium bovis subsp bovis AF2122/97
cgccaccaccaggg

SEQ ID NO: 3144410 - RNA, 16 nt, Mycobacterium bovis subsp bovis AF2122/97
cgccaccacccaacag

SEQ ID NO: 3144411 - RNA, 15 nt, Mycobacterium bovis subsp bovis AF2122/97
cgccaccacccaggc

SEQ ID NO: 3144412 - RNA, 13 nt, Mycobacterium bovis subsp bovis AF2122/97
cgccaccaccccg

SEQ ID NO: 3144413 - RNA, 15 nt, Mycobacterium bovis subsp bovis AF2122/97
cgccaccacccggcg

SEQ ID NO: 3144414 - RNA, 11 nt, Mycobacterium bovis subsp bovis AF2122/97
cgccaccaccg

SEQ ID NO: 3144415 - RNA, 21 nt, Mycobacterium bovis subsp bovis AF2122/97
cgccaccaccgcugccggcgc

SEQ ID NO: 3144416 - RNA, 13 nt, Mycobacterium bovis subsp bovis AF2122/97
cgccaccaccucc

SEQ ID NO: 3144417 - RNA, 19 nt, Mycobacterium bovis subsp bovis AF2122/97
cgccaccaccuccgcgucg

SEQ ID NO: 3144418 - RNA, 20 nt, Mycobacterium bovis subsp bovis AF2122/97
cgccaccaccuccgcgucgg

SEQ ID NO: 3144419 - RNA, 21 nt, Mycobacterium bovis subsp bovis AF2122/97
cgccaccaccuccgcgucgga

SEQ ID NO: 3144420 - RNA, 18 nt, Mycobacterium bovis subsp bovis AF2122/97
cgccaccagcaccgccgc

SEQ ID NO: 3144421 - RNA, 21 nt, Mycobacterium bovis subsp bovis AF2122/97
cgccaccagcaccgccgcugc

SEQ ID NO: 3144422 - RNA, 15 nt, Mycobacterium bovis subsp bovis AF2122/97
cgccaccagcgcacg

SEQ ID NO: 3144423 - RNA, 14 nt, Mycobacterium bovis subsp bovis AF2122/97
cgccaccagcgcga

SEQ ID NO: 3144424 - RNA, 19 nt, Mycobacterium bovis subsp bovis AF2122/97
cgccaccagggcggccucc

SEQ ID NO: 3144425 - RNA, 22 nt, Mycobacterium bovis subsp bovis AF2122/97
cgccaccagggcggccuccccg

SEQ ID NO: 3144426 - RNA, 16 nt, Mycobacterium bovis subsp bovis AF2122/97
cgccaccaucaccgcc

SEQ ID NO: 3144427 - RNA, 18 nt, Mycobacterium bovis subsp bovis AF2122/97
cgccaccaucaccgccuu

SEQ ID NO: 3144428 - RNA, 19 nt, Mycobacterium bovis subsp bovis AF2122/97
cgccaccauccccggcaac

SEQ ID NO: 3144429 - RNA, 21 nt, Mycobacterium bovis subsp bovis AF2122/97
cgccaccaucguugccggugc

SEQ ID NO: 3144430 - RNA, 15 nt, Mycobacterium bovis subsp bovis AF2122/97
cgccacccccaccgu

SEQ ID NO: 3144431 - RNA, 20 nt, Mycobacterium bovis subsp bovis AF2122/97
cgccaccccgcguaugccag

SEQ ID NO: 3144432 - RNA, 22 nt, Mycobacterium bovis subsp bovis AF2122/97
cgccaccccgcguaugccagga

SEQ ID NO: 3144433 - RNA, 19 nt, Mycobacterium bovis subsp bovis AF2122/97
cgccacccgacaugcgccg

SEQ ID NO: 3144434 - RNA, 22 nt, Mycobacterium bovis subsp bovis AF2122/97
cgccacccgacaugcgccgaga

SEQ ID NO: 3144435 - RNA, 15 nt, Mycobacterium bovis subsp bovis AF2122/97
cgccacccgcaacua

SEQ ID NO: 3144436 - RNA, 14 nt, Mycobacterium bovis subsp bovis AF2122/97
cgccacccgccaac

SEQ ID NO: 3144437 - RNA, 16 nt, Mycobacterium bovis subsp bovis AF2122/97
cgccacccgccaacgc

SEQ ID NO: 3144438 - RNA, 13 nt, Mycobacterium bovis subsp bovis AF2122/97
cgccacccgcgcc

SEQ ID NO: 3144439 - RNA, 16 nt, Mycobacterium bovis subsp bovis AF2122/97
cgccacccgcgccgcc

SEQ ID NO: 3144440 - RNA, 15 nt, Mycobacterium bovis subsp bovis AF2122/97
cgccacccgcggugc

SEQ ID NO: 3144441 - RNA, 16 nt, Mycobacterium bovis subsp bovis AF2122/97
cgccacccggcgggcg

SEQ ID NO: 3144442 - RNA, 18 nt, Mycobacterium bovis subsp bovis AF2122/97
cgccacccggcgggcggu

SEQ ID NO: 3144443 - RNA, 18 nt, Mycobacterium bovis subsp bovis AF2122/97
cgccacccgguccggccc

SEQ ID NO: 3144444 - RNA, 20 nt, Mycobacterium bovis subsp bovis AF2122/97
cgccacccuuggcccggugc

SEQ ID NO: 3144445 - RNA, 13 nt, Mycobacterium bovis subsp bovis AF2122/97
cgccaccgaacgc

SEQ ID NO: 3144446 - RNA, 13 nt, Mycobacterium bovis subsp bovis AF2122/97
cgccaccgaagcc

SEQ ID NO: 3144447 - RNA, 16 nt, Mycobacterium bovis subsp bovis AF2122/97
cgccaccgaagccgcc

SEQ ID NO: 3144448 - RNA, 18 nt, Mycobacterium bovis subsp bovis AF2122/97
cgccaccgaagccgccgg

SEQ ID NO: 3144449 - RNA, 19 nt, Mycobacterium bovis subsp bovis AF2122/97
cgccaccgagcccuccagg

SEQ ID NO: 3144450 - RNA, 23 nt, Mycobacterium bovis subsp bovis AF2122/97
cgccaccgauaccgucagcgccg

SEQ ID NO: 3144451 - RNA, 19 nt, Mycobacterium bovis subsp bovis AF2122/97
cgccaccgcacgcacgcca

SEQ ID NO: 3144452 - RNA, 15 nt, Mycobacterium bovis subsp bovis AF2122/97
cgccaccgccagcgu

SEQ ID NO: 3144453 - RNA, 15 nt, Mycobacterium bovis subsp bovis AF2122/97
cgccaccgccgcugc

SEQ ID NO: 3144454 - RNA, 12 nt, Mycobacterium bovis subsp bovis AF2122/97
cgccaccgccgg

SEQ ID NO: 3144455 - RNA, 14 nt, Mycobacterium bovis subsp bovis AF2122/97
cgccaccgccggca

SEQ ID NO: 3144456 - RNA, 19 nt, Mycobacterium bovis subsp bovis AF2122/97
cgccaccgcgacaccccgg

SEQ ID NO: 3144457 - RNA, 14 nt, Mycobacterium bovis subsp bovis AF2122/97
cgccacucagcccg

SEQ ID NO: 3144458 - RNA, 19 nt, Mycobacterium bovis subsp bovis AF2122/97
cgccacugccagccgugca

SEQ ID NO: 3144459 - RNA, 16 nt, Mycobacterium bovis subsp bovis AF2122/97
cgccacugccggcagc

SEQ ID NO: 3144460 - RNA, 20 nt, Mycobacterium bovis subsp bovis AF2122/97
cgccacugccggcagcgccc

SEQ ID NO: 3144461 - RNA, 12 nt, Mycobacterium bovis subsp bovis AF2122/97
cgccacugcugg

SEQ ID NO: 3144462 - RNA, 21 nt, Mycobacterium bovis subsp bovis AF2122/97
cgccacugcugggcuucgagu

SEQ ID NO: 3144463 - RNA, 18 nt, Mycobacterium bovis subsp bovis AF2122/97
cgccacugcuuccggaac

SEQ ID NO: 3144464 - RNA, 23 nt, Mycobacterium bovis subsp bovis AF2122/97
cgccacuggacucuucagcuacc

SEQ ID NO: 3144465 - RNA, 22 nt, Mycobacterium bovis subsp bovis AF2122/97
cgccacuggcgccggugccgcc

SEQ ID NO: 3144466 - RNA, 13 nt, Mycobacterium bovis subsp bovis AF2122/97
cgccacuggcgcu

SEQ ID NO: 3144467 - RNA, 15 nt, Mycobacterium bovis subsp bovis AF2122/97
cgccacuucccccgg

SEQ ID NO: 3144468 - RNA, 15 nt, Mycobacterium bovis subsp bovis AF2122/97
cgccacuugaugccg

SEQ ID NO: 3144469 - RNA, 19 nt, Mycobacterium bovis subsp bovis AF2122/97
cgccacuugaugccgcacc

SEQ ID NO: 3144470 - RNA, 14 nt, Mycobacterium bovis subsp bovis AF2122/97
cgccagaaagccca

SEQ ID NO: 3144471 - RNA, 17 nt, Mycobacterium bovis subsp bovis AF2122/97
cgccagaacgacaccgc

SEQ ID NO: 3144472 - RNA, 13 nt, Mycobacterium bovis subsp bovis AF2122/97
cgccagaacggcg

SEQ ID NO: 3144473 - RNA, 14 nt, Mycobacterium bovis subsp bovis AF2122/97
cgccagaccgcggc

SEQ ID NO: 3144474 - RNA, 15 nt, Mycobacterium bovis subsp bovis AF2122/97
cgccagaccgcggcg

SEQ ID NO: 3144475 - RNA, 18 nt, Mycobacterium bovis subsp bovis AF2122/97
cgccagaccgcggcggcc

SEQ ID NO: 3144476 - RNA, 19 nt, Mycobacterium bovis subsp bovis AF2122/97
cgccagaccgcggcggccg

SEQ ID NO: 3144477 - RNA, 21 nt, Mycobacterium bovis subsp bovis AF2122/97
cgccagagucggagacccguc

SEQ ID NO: 3144478 - RNA, 16 nt, Mycobacterium bovis subsp bovis AF2122/97
cgccagaucgacgcca

SEQ ID NO: 3144479 - RNA, 13 nt, Mycobacterium bovis subsp bovis AF2122/97
cgccagaucucgc

SEQ ID NO: 3144480 - RNA, 16 nt, Mycobacterium bovis subsp bovis AF2122/97
cgccagaucucgcgcg

SEQ ID NO: 3144481 - RNA, 20 nt, Mycobacterium bovis subsp bovis AF2122/97
cgccagaucucgcgcgcggc

SEQ ID NO: 3144482 - RNA, 19 nt, Mycobacterium bovis subsp bovis AF2122/97
cgccagcaacccugcggug

SEQ ID NO: 3144483 - RNA, 20 nt, Mycobacterium bovis subsp bovis AF2122/97
cgccagcaacccugcggugc

SEQ ID NO: 3144484 - RNA, 15 nt, Mycobacterium bovis subsp bovis AF2122/97
cgccagcaacgucgg

SEQ ID NO: 3144485 - RNA, 16 nt, Mycobacterium bovis subsp bovis AF2122/97
cgccagcaaugcccgc

SEQ ID NO: 3144486 - RNA, 17 nt, Mycobacterium bovis subsp bovis AF2122/97
cgccagcaaugcccgca

SEQ ID NO: 3144487 - RNA, 21 nt, Mycobacterium bovis subsp bovis AF2122/97
cgccagcaaugcccgcaccgc

SEQ ID NO: 3144488 - RNA, 14 nt, Mycobacterium bovis subsp bovis AF2122/97
cgccagcaccaccg

SEQ ID NO: 3144489 - RNA, 15 nt, Mycobacterium bovis subsp bovis AF2122/97
cgccagcaccaccgg

SEQ ID NO: 3144490 - RNA, 19 nt, Mycobacterium bovis subsp bovis AF2122/97
cgccagcaccaccggcucc

SEQ ID NO: 3144491 - RNA, 23 nt, Mycobacterium bovis subsp bovis AF2122/97
cgccagcaccaccggcucccggg

SEQ ID NO: 3144492 - RNA, 14 nt, Mycobacterium bovis subsp bovis AF2122/97
cgccagcaccagcg

SEQ ID NO: 3144493 - RNA, 17 nt, Mycobacterium bovis subsp bovis AF2122/97
cgccagcaccagcgucg

SEQ ID NO: 3144494 - RNA, 21 nt, Mycobacterium bovis subsp bovis AF2122/97
cgccagcagaucuccggggcu

SEQ ID NO: 3144495 - RNA, 23 nt, Mycobacterium bovis subsp bovis AF2122/97
cgccagcagcuucucguucgucg

SEQ ID NO: 3144496 - RNA, 18 nt, Mycobacterium bovis subsp bovis AF2122/97
cgccagcagggccagacc

SEQ ID NO: 3144497 - RNA, 17 nt, Mycobacterium bovis subsp bovis AF2122/97
cgccagcaucagcccgg

SEQ ID NO: 3144498 - RNA, 19 nt, Mycobacterium bovis subsp bovis AF2122/97
cgccagcaucagcccggcg

SEQ ID NO: 3144499 - RNA, 18 nt, Mycobacterium bovis subsp bovis AF2122/97
cgccagcaugacaccggc

SEQ ID NO: 3144500 - RNA, 19 nt, Mycobacterium bovis subsp bovis AF2122/97
cgccagcaugacaccggcc

SEQ ID NO: 3144501 - RNA, 22 nt, Mycobacterium bovis subsp bovis AF2122/97
cgccagcaugacaccggccacc

SEQ ID NO: 3144502 - RNA, 21 nt, Mycobacterium bovis subsp bovis AF2122/97
cgccagcauugaagaagcccg

SEQ ID NO: 3144503 - RNA, 22 nt, Mycobacterium bovis subsp bovis AF2122/97
cgccagcauugaagaagcccga

SEQ ID NO: 3144504 - RNA, 23 nt, Mycobacterium bovis subsp bovis AF2122/97
cgccagcauugaagaagcccgaa

SEQ ID NO: 3144505 - RNA, 15 nt, Mycobacterium bovis subsp bovis AF2122/97
cgccagccaaccguc

SEQ ID NO: 3144506 - RNA, 13 nt, Mycobacterium bovis subsp bovis AF2122/97
cgccagccaccac

SEQ ID NO: 3144507 - RNA, 14 nt, Mycobacterium bovis subsp bovis AF2122/97
cgccagccaccaca

SEQ ID NO: 3144508 - RNA, 20 nt, Mycobacterium bovis subsp bovis AF2122/97
cgccagccaccacaucgcgg

SEQ ID NO: 3144509 - RNA, 14 nt, Mycobacterium bovis subsp bovis AF2122/97
cgccagccaggcga

SEQ ID NO: 3144510 - RNA, 14 nt, Mycobacterium bovis subsp bovis AF2122/97
cgccagcccagcac

SEQ ID NO: 3144511 - RNA, 14 nt, Mycobacterium bovis subsp bovis AF2122/97
cgccagcccagccc

SEQ ID NO: 3144512 - RNA, 18 nt, Mycobacterium bovis subsp bovis AF2122/97
cgccagccccagcguucc

SEQ ID NO: 3144513 - RNA, 16 nt, Mycobacterium bovis subsp bovis AF2122/97
cgccagccccgcgccc

SEQ ID NO: 3144514 - RNA, 17 nt, Mycobacterium bovis subsp bovis AF2122/97
cgccagccccgcgccca

SEQ ID NO: 3144515 - RNA, 20 nt, Mycobacterium bovis subsp bovis AF2122/97
cgccagccccgcgcccaccc

SEQ ID NO: 3144516 - RNA, 21 nt, Mycobacterium bovis subsp bovis AF2122/97
cgccagccccgcgcccacccc

SEQ ID NO: 3144517 - RNA, 22 nt, Mycobacterium bovis subsp bovis AF2122/97
cgccagccccgcgcccaccccg

SEQ ID NO: 3144518 - RNA, 14 nt, Mycobacterium bovis subsp bovis AF2122/97
cgccagcccgguga

SEQ ID NO: 3144519 - RNA, 15 nt, Mycobacterium bovis subsp bovis AF2122/97
cgccagcccggugau

SEQ ID NO: 3144520 - RNA, 15 nt, Mycobacterium bovis subsp bovis AF2122/97
cgccagcccguccgg

SEQ ID NO: 3144521 - RNA, 22 nt, Mycobacterium bovis subsp bovis AF2122/97
cgccagcccguccggcccccga

SEQ ID NO: 3144522 - RNA, 13 nt, Mycobacterium bovis subsp bovis AF2122/97
cgccagccgaccg

SEQ ID NO: 3144523 - RNA, 14 nt, Mycobacterium bovis subsp bovis AF2122/97
cgccagccgaccga

SEQ ID NO: 3144524 - RNA, 13 nt, Mycobacterium bovis subsp bovis AF2122/97
cgccagccgcgag

SEQ ID NO: 3144525 - RNA, 17 nt, Mycobacterium bovis subsp bovis AF2122/97
cgccagccgcgagccgg

SEQ ID NO: 3144526 - RNA, 13 nt, Mycobacterium bovis subsp bovis AF2122/97
cgccagccgcgcu

SEQ ID NO: 3144527 - RNA, 22 nt, Mycobacterium bovis subsp bovis AF2122/97
cgccagccgcgcuagcucggcc

SEQ ID NO: 3144528 - RNA, 14 nt, Mycobacterium bovis subsp bovis AF2122/97
cgccagccggagcg

SEQ ID NO: 3144529 - RNA, 14 nt, Mycobacterium bovis subsp bovis AF2122/97
cgccagccggccgc

SEQ ID NO: 3144530 - RNA, 15 nt, Mycobacterium bovis subsp bovis AF2122/97
cgccagccggccgcg

SEQ ID NO: 3144531 - RNA, 16 nt, Mycobacterium bovis subsp bovis AF2122/97
cgccagccggccgcga

SEQ ID NO: 3144532 - RNA, 21 nt, Mycobacterium bovis subsp bovis AF2122/97
cgccagccggcgcacucccgg

SEQ ID NO: 3144533 - RNA, 22 nt, Mycobacterium bovis subsp bovis AF2122/97
cgccagccggcgcacucccgga

SEQ ID NO: 3144534 - RNA, 14 nt, Mycobacterium bovis subsp bovis AF2122/97
cgccagccgguugg

SEQ ID NO: 3144535 - RNA, 24 nt, Mycobacterium bovis subsp bovis AF2122/97
cgccagccguuuuccugaucgcgc

SEQ ID NO: 3144536 - RNA, 13 nt, Mycobacterium bovis subsp bovis AF2122/97
cgccagccuccac

SEQ ID NO: 3144537 - RNA, 19 nt, Mycobacterium bovis subsp bovis AF2122/97
cgccagccuccaccagguc

SEQ ID NO: 3144538 - RNA, 20 nt, Mycobacterium bovis subsp bovis AF2122/97
cgccagcgauaucggcggcu

SEQ ID NO: 3144539 - RNA, 15 nt, Mycobacterium bovis subsp bovis AF2122/97
cgccagcgccaccgu

SEQ ID NO: 3144540 - RNA, 14 nt, Mycobacterium bovis subsp bovis AF2122/97
cgccagcgccacug

SEQ ID NO: 3144541 - RNA, 14 nt, Mycobacterium bovis subsp bovis AF2122/97
cgccagcgccgcca

SEQ ID NO: 3144542 - RNA, 14 nt, Mycobacterium bovis subsp bovis AF2122/97
cgccagcgccgccg

SEQ ID NO: 3144543 - RNA, 15 nt, Mycobacterium bovis subsp bovis AF2122/97
cgccagcgccgccgc

SEQ ID NO: 3144544 - RNA, 19 nt, Mycobacterium bovis subsp bovis AF2122/97
cgccagucccacugggccg

SEQ ID NO: 3144545 - RNA, 23 nt, Mycobacterium bovis subsp bovis AF2122/97
cgccagucccacugggccggugc

SEQ ID NO: 3144546 - RNA, 14 nt, Mycobacterium bovis subsp bovis AF2122/97
cgccagucccggcg

SEQ ID NO: 3144547 - RNA, 16 nt, Mycobacterium bovis subsp bovis AF2122/97
cgccagucccggcgca

SEQ ID NO: 3144548 - RNA, 22 nt, Mycobacterium bovis subsp bovis AF2122/97
cgccagucccggcgcacaaaca

SEQ ID NO: 3144549 - RNA, 17 nt, Mycobacterium bovis subsp bovis AF2122/97
cgccaguccgaucgccg

SEQ ID NO: 3144550 - RNA, 20 nt, Mycobacterium bovis subsp bovis AF2122/97
cgccaguccgaucgccgagg

SEQ ID NO: 3144551 - RNA, 16 nt, Mycobacterium bovis subsp bovis AF2122/97
cgccaguccggacggc

SEQ ID NO: 3144552 - RNA, 16 nt, Mycobacterium bovis subsp bovis AF2122/97
cgccagucgauucggc

SEQ ID NO: 3144553 - RNA, 20 nt, Mycobacterium bovis subsp bovis AF2122/97
cgccagucgcaggaucggcg

SEQ ID NO: 3144554 - RNA, 15 nt, Mycobacterium bovis subsp bovis AF2122/97
cgccagugcccgcac

SEQ ID NO: 3144555 - RNA, 18 nt, Mycobacterium bovis subsp bovis AF2122/97
cgccagugcccgcacugc

SEQ ID NO: 3144556 - RNA, 21 nt, Mycobacterium bovis subsp bovis AF2122/97
cgccagugcccgcacugccgc

SEQ ID NO: 3144557 - RNA, 21 nt, Mycobacterium bovis subsp bovis AF2122/97
cgccagugccucgcggggucu

SEQ ID NO: 3144558 - RNA, 21 nt, Mycobacterium bovis subsp bovis AF2122/97
cgccagugcuccaaaucggca

SEQ ID NO: 3144559 - RNA, 15 nt, Mycobacterium bovis subsp bovis AF2122/97
cgccaguggccacca

SEQ ID NO: 3144560 - RNA, 18 nt, Mycobacterium bovis subsp bovis AF2122/97
cgccaguguugcgcugcg

SEQ ID NO: 3144561 - RNA, 20 nt, Mycobacterium bovis subsp bovis AF2122/97
cgccaguguugcgcugcggc

SEQ ID NO: 3144562 - RNA, 22 nt, Mycobacterium bovis subsp bovis AF2122/97
cgccaguguugcgcugcggcca

SEQ ID NO: 3144563 - RNA, 15 nt, Mycobacterium bovis subsp bovis AF2122/97
cgccaguucgcgcca

SEQ ID NO: 3144564 - RNA, 21 nt, Mycobacterium bovis subsp bovis AF2122/97
cgccauaaagagauggguagc

SEQ ID NO: 3144565 - RNA, 17 nt, Mycobacterium bovis subsp bovis AF2122/97
cgccauaccggccgcca

SEQ ID NO: 3144566 - RNA, 18 nt, Mycobacterium bovis subsp bovis AF2122/97
cgccauaccggccgccau

SEQ ID NO: 3144567 - RNA, 19 nt, Mycobacterium bovis subsp bovis AF2122/97
cgccauaccggccgccauc

SEQ ID NO: 3144568 - RNA, 22 nt, Mycobacterium bovis subsp bovis AF2122/97
cgccauaccggcuggccaggug

SEQ ID NO: 3144569 - RNA, 15 nt, Mycobacterium bovis subsp bovis AF2122/97
cgccauagccgcgac

SEQ ID NO: 3144570 - RNA, 21 nt, Mycobacterium bovis subsp bovis AF2122/97
cgccaucaacaaggggcagca

SEQ ID NO: 3144571 - RNA, 15 nt, Mycobacterium bovis subsp bovis AF2122/97
cgccaucaccgccgu

SEQ ID NO: 3144572 - RNA, 13 nt, Mycobacterium bovis subsp bovis AF2122/97
cgccaucagcccu

SEQ ID NO: 3144573 - RNA, 13 nt, Mycobacterium bovis subsp bovis AF2122/97
cgccaucauggcc

SEQ ID NO: 3144574 - RNA, 16 nt, Mycobacterium bovis subsp bovis AF2122/97
cgccaucauggccgug

SEQ ID NO: 3144575 - RNA, 14 nt, Mycobacterium bovis subsp bovis AF2122/97
cgccaucauggcgg

SEQ ID NO: 3144576 - RNA, 17 nt, Mycobacterium bovis subsp bovis AF2122/97
cgccaucauggcggccc

SEQ ID NO: 3144577 - RNA, 21 nt, Mycobacterium bovis subsp bovis AF2122/97
cgccaucauggcggcccgguc

SEQ ID NO: 3144578 - RNA, 14 nt, Mycobacterium bovis subsp bovis AF2122/97
cgccauccaugaug

SEQ ID NO: 3144579 - RNA, 16 nt, Mycobacterium bovis subsp bovis AF2122/97
cgccauccccgccggc

SEQ ID NO: 3144580 - RNA, 20 nt, Mycobacterium bovis subsp bovis AF2122/97
cgccauccccgccggcgcca

SEQ ID NO: 3144581 - RNA, 20 nt, Mycobacterium bovis subsp bovis AF2122/97
cgccauccccuggccagcag

SEQ ID NO: 3144582 - RNA, 17 nt, Mycobacterium bovis subsp bovis AF2122/97
cgccaucgccaacacca

SEQ ID NO: 3144583 - RNA, 14 nt, Mycobacterium bovis subsp bovis AF2122/97
cgccaucgccgcca

SEQ ID NO: 3144584 - RNA, 19 nt, Mycobacterium bovis subsp bovis AF2122/97
cgccaucgccgccggugcc

SEQ ID NO: 3144585 - RNA, 18 nt, Mycobacterium bovis subsp bovis AF2122/97
cgccaucgccuccagccg

SEQ ID NO: 3144586 - RNA, 22 nt, Mycobacterium bovis subsp bovis AF2122/97
cgccaucgguugacccggcagc

SEQ ID NO: 3144587 - RNA, 20 nt, Mycobacterium bovis subsp bovis AF2122/97
cgccaucgucgaagaccuca

SEQ ID NO: 3144588 - RNA, 14 nt, Mycobacterium bovis subsp bovis AF2122/97
cgccaucgucgcgc

SEQ ID NO: 3144589 - RNA, 16 nt, Mycobacterium bovis subsp bovis AF2122/97
cgccaucgucgcgccg

SEQ ID NO: 3144590 - RNA, 18 nt, Mycobacterium bovis subsp bovis AF2122/97
cgccaucguuucacccgg

SEQ ID NO: 3144591 - RNA, 17 nt, Mycobacterium bovis subsp bovis AF2122/97
cgccaucucguaggggu

SEQ ID NO: 3144592 - RNA, 18 nt, Mycobacterium bovis subsp bovis AF2122/97
cgccaucugcuggcuggg

SEQ ID NO: 3144593 - RNA, 18 nt, Mycobacterium bovis subsp bovis AF2122/97
cgccaucuucgggccgac

SEQ ID NO: 3144594 - RNA, 14 nt, Mycobacterium bovis subsp bovis AF2122/97
cgccaugaagccgg

SEQ ID NO: 3144595 - RNA, 17 nt, Mycobacterium bovis subsp bovis AF2122/97
cgccaugaagccgggcg

SEQ ID NO: 3144596 - RNA, 21 nt, Mycobacterium bovis subsp bovis AF2122/97
cgccaugagcgcgcccaaccu

SEQ ID NO: 3144597 - RNA, 22 nt, Mycobacterium bovis subsp bovis AF2122/97
cgccaugagcgcgcccaaccug

SEQ ID NO: 3144598 - RNA, 22 nt, Mycobacterium bovis subsp bovis AF2122/97
cgccaugauggacagcugcggg

SEQ ID NO: 3144599 - RNA, 20 nt, Mycobacterium bovis subsp bovis AF2122/97
cgccaugcccgcacgcucgg

SEQ ID NO: 3144600 - RNA, 20 nt, Mycobacterium bovis subsp bovis AF2122/97
cgccaugcccucggcgccga

SEQ ID NO: 3144601 - RNA, 16 nt, Mycobacterium bovis subsp bovis AF2122/97
cgccaugccgggaacc

SEQ ID NO: 3144602 - RNA, 12 nt, Mycobacterium bovis subsp bovis AF2122/97
cgccaugcgcac

SEQ ID NO: 3144603 - RNA, 14 nt, Mycobacterium bovis subsp bovis AF2122/97
cgccaugcgcacca

SEQ ID NO: 3144604 - RNA, 19 nt, Mycobacterium bovis subsp bovis AF2122/97
cgccaugcgccaacccggc

SEQ ID NO: 3144605 - RNA, 13 nt, Mycobacterium bovis subsp bovis AF2122/97
cgccaugcggcgc

SEQ ID NO: 3144606 - RNA, 19 nt, Mycobacterium bovis subsp bovis AF2122/97
cgccaugcggcgcgucgcg

SEQ ID NO: 3144607 - RNA, 13 nt, Mycobacterium bovis subsp bovis AF2122/97
cgccaugcugucg

SEQ ID NO: 3144608 - RNA, 14 nt, Mycobacterium bovis subsp bovis AF2122/97
cgccauggcguucu

SEQ ID NO: 3144609 - RNA, 17 nt, Mycobacterium bovis subsp bovis AF2122/97
cgccauggucgcugcgu

SEQ ID NO: 3144610 - RNA, 16 nt, Mycobacterium bovis subsp bovis AF2122/97
cgccaugucggccagg

SEQ ID NO: 3144611 - RNA, 15 nt, Mycobacterium bovis subsp bovis AF2122/97
cgccauucaucggca

SEQ ID NO: 3144612 - RNA, 14 nt, Mycobacterium bovis subsp bovis AF2122/97
cgccauuccagccg

SEQ ID NO: 3144613 - RNA, 22 nt, Mycobacterium bovis subsp bovis AF2122/97
cgccauuccagccggugccgcc

SEQ ID NO: 3144614 - RNA, 21 nt, Mycobacterium bovis subsp bovis AF2122/97
cgccauuccaucgcgcaccgc

SEQ ID NO: 3144615 - RNA, 15 nt, Mycobacterium bovis subsp bovis AF2122/97
cgccauucccggugg

SEQ ID NO: 3144616 - RNA, 14 nt, Mycobacterium bovis subsp bovis AF2122/97
cgccauugacgccg

SEQ ID NO: 3144617 - RNA, 18 nt, Mycobacterium bovis subsp bovis AF2122/97
cgccauugacgccguugc

SEQ ID NO: 3144618 - RNA, 22 nt, Mycobacterium bovis subsp bovis AF2122/97
cgccauugacgccguugccgcc

SEQ ID NO: 3144619 - RNA, 17 nt, Mycobacterium bovis subsp bovis AF2122/97
cgccauugagcucccgc

SEQ ID NO: 3144620 - RNA, 21 nt, Mycobacterium bovis subsp bovis AF2122/97
cgccauugaggaagccguugg

SEQ ID NO: 3144621 - RNA, 23 nt, Mycobacterium bovis subsp bovis AF2122/97
cgccauugaggaagccguuggcg

SEQ ID NO: 3144622 - RNA, 23 nt, Mycobacterium bovis subsp bovis AF2122/97
cgccauugccauacagcaccccg

SEQ ID NO: 3144623 - RNA, 18 nt, Mycobacterium bovis subsp bovis AF2122/97
cgccauugccgccggcgc

SEQ ID NO: 3144624 - RNA, 18 nt, Mycobacterium bovis subsp bovis AF2122/97
cgccauugccgccggugc

SEQ ID NO: 3144625 - RNA, 19 nt, Mycobacterium bovis subsp bovis AF2122/97
cgccauugccgccggugcc

SEQ ID NO: 3144626 - RNA, 15 nt, Mycobacterium bovis subsp bovis AF2122/97
cgccauugccgccgu

SEQ ID NO: 3144627 - RNA, 17 nt, Mycobacterium bovis subsp bovis AF2122/97
cgccauuggcgccguca

SEQ ID NO: 3144628 - RNA, 22 nt, Mycobacterium bovis subsp bovis AF2122/97
cgccauuucgagggcaacggca

SEQ ID NO: 3144629 - RNA, 22 nt, Mycobacterium bovis subsp bovis AF2122/97
cgccauuucgcccgaggcaacg

SEQ ID NO: 3144630 - RNA, 16 nt, Mycobacterium bovis subsp bovis AF2122/97
cgcccaggcgaccgcu

SEQ ID NO: 3144631 - RNA, 19 nt, Mycobacterium bovis subsp bovis AF2122/97
cgcccaggcgaccgcugag

SEQ ID NO: 3144632 - RNA, 15 nt, Mycobacterium bovis subsp bovis AF2122/97
cgcccaggcgcgacg

SEQ ID NO: 3144633 - RNA, 16 nt, Mycobacterium bovis subsp bovis AF2122/97
cgcccaggcgcgacgu

SEQ ID NO: 3144634 - RNA, 15 nt, Mycobacterium bovis subsp bovis AF2122/97
cgcccagggugucug

SEQ ID NO: 3144635 - RNA, 18 nt, Mycobacterium bovis subsp bovis AF2122/97
cgcccaggugaucgcgag

SEQ ID NO: 3144636 - RNA, 18 nt, Mycobacterium bovis subsp bovis AF2122/97
cgcccagugaaucggacc

SEQ ID NO: 3144637 - RNA, 19 nt, Mycobacterium bovis subsp bovis AF2122/97
cgcccagugcgcaacccag

SEQ ID NO: 3144638 - RNA, 21 nt, Mycobacterium bovis subsp bovis AF2122/97
cgcccagugcgcaacccagcc

SEQ ID NO: 3144639 - RNA, 16 nt, Mycobacterium bovis subsp bovis AF2122/97
cgcccagugugcgccg

SEQ ID NO: 3144640 - RNA, 20 nt, Mycobacterium bovis subsp bovis AF2122/97
cgcccauagcugccggccca

SEQ ID NO: 3144641 - RNA, 14 nt, Mycobacterium bovis subsp bovis AF2122/97
cgcccaucaccccg

SEQ ID NO: 3144642 - RNA, 17 nt, Mycobacterium bovis subsp bovis AF2122/97
cgcccaucgcaagcugg

SEQ ID NO: 3144643 - RNA, 17 nt, Mycobacterium bovis subsp bovis AF2122/97
cgcccaucgcgacggcc

SEQ ID NO: 3144644 - RNA, 23 nt, Mycobacterium bovis subsp bovis AF2122/97
cgcccaugcugacacgacaugac

SEQ ID NO: 3144645 - RNA, 17 nt, Mycobacterium bovis subsp bovis AF2122/97
cgcccauggccaccagg

SEQ ID NO: 3144646 - RNA, 22 nt, Mycobacterium bovis subsp bovis AF2122/97
cgcccauggcgucgaaccaguc

SEQ ID NO: 3144647 - RNA, 17 nt, Mycobacterium bovis subsp bovis AF2122/97
cgcccauucccagaggc

SEQ ID NO: 3144648 - RNA, 21 nt, Mycobacterium bovis subsp bovis AF2122/97
cgcccauucccagaggcccgc

SEQ ID NO: 3144649 - RNA, 21 nt, Mycobacterium bovis subsp bovis AF2122/97
cgcccauugacguagaccguc

SEQ ID NO: 3144650 - RNA, 24 nt, Mycobacterium bovis subsp bovis AF2122/97
cgcccauugacguagaccgucgau

SEQ ID NO: 3144651 - RNA, 15 nt, Mycobacterium bovis subsp bovis AF2122/97
cgcccauuggccagg

SEQ ID NO: 3144652 - RNA, 20 nt, Mycobacterium bovis subsp bovis AF2122/97
cgcccauuggguaaccagcg

SEQ ID NO: 3144653 - RNA, 23 nt, Mycobacterium bovis subsp bovis AF2122/97
cgcccauuggguaaccagcgcca

SEQ ID NO: 3144654 - RNA, 15 nt, Mycobacterium bovis subsp bovis AF2122/97
cgccccaccgcgccg

SEQ ID NO: 3144655 - RNA, 17 nt, Mycobacterium bovis subsp bovis AF2122/97
cgccccaccgcgccgag

SEQ ID NO: 3144656 - RNA, 18 nt, Mycobacterium bovis subsp bovis AF2122/97
cgccccaccgcgccgagc

SEQ ID NO: 3144657 - RNA, 13 nt, Mycobacterium bovis subsp bovis AF2122/97
cgccccaccggcc

SEQ ID NO: 3144658 - RNA, 17 nt, Mycobacterium bovis subsp bovis AF2122/97
cgccccaccggcccggg

SEQ ID NO: 3144659 - RNA, 15 nt, Mycobacterium bovis subsp bovis AF2122/97
cgccccaccggccga

SEQ ID NO: 3144660 - RNA, 17 nt, Mycobacterium bovis subsp bovis AF2122/97
cgccccacuugccgggc

SEQ ID NO: 3144661 - RNA, 12 nt, Mycobacterium bovis subsp bovis AF2122/97
cgccccagcugc

SEQ ID NO: 3144662 - RNA, 18 nt, Mycobacterium bovis subsp bovis AF2122/97
cgccccagcugcggucgc

SEQ ID NO: 3144663 - RNA, 21 nt, Mycobacterium bovis subsp bovis AF2122/97
cgccccagggggcgugccgcc

SEQ ID NO: 3144664 - RNA, 22 nt, Mycobacterium bovis subsp bovis AF2122/97
cgccccagggggcgugccgccg

SEQ ID NO: 3144665 - RNA, 23 nt, Mycobacterium bovis subsp bovis AF2122/97
cgccccagggggcgugccgccgc

SEQ ID NO: 3144666 - RNA, 22 nt, Mycobacterium bovis subsp bovis AF2122/97
cgccccaguucgacggcgucaa

SEQ ID NO: 3144667 - RNA, 21 nt, Mycobacterium bovis subsp bovis AF2122/97
cgccccauacuugcgccgacu

SEQ ID NO: 3144668 - RNA, 15 nt, Mycobacterium bovis subsp bovis AF2122/97
cgccccaugcaacac

SEQ ID NO: 3144669 - RNA, 17 nt, Mycobacterium bovis subsp bovis AF2122/97
cgccccaugcaacacac

SEQ ID NO: 3144670 - RNA, 18 nt, Mycobacterium bovis subsp bovis AF2122/97
cgccccaugcaacacacc

SEQ ID NO: 3144671 - RNA, 21 nt, Mycobacterium bovis subsp bovis AF2122/97
cgccccaugcaacacaccgcg

SEQ ID NO: 3144672 - RNA, 19 nt, Mycobacterium bovis subsp bovis AF2122/97
cgccccccacggcccguug

SEQ ID NO: 3144673 - RNA, 18 nt, Mycobacterium bovis subsp bovis AF2122/97
cgcccccgccauugccgc

SEQ ID NO: 3144674 - RNA, 12 nt, Mycobacterium bovis subsp bovis AF2122/97
cgcccccgcccg

SEQ ID NO: 3144675 - RNA, 13 nt, Mycobacterium bovis subsp bovis AF2122/97
cgcccccgcccgu

SEQ ID NO: 3144676 - RNA, 14 nt, Mycobacterium bovis subsp bovis AF2122/97
cgcccccgccggcc

SEQ ID NO: 3144677 - RNA, 17 nt, Mycobacterium bovis subsp bovis AF2122/97
cgcccccgccggccgcg

SEQ ID NO: 3144678 - RNA, 18 nt, Mycobacterium bovis subsp bovis AF2122/97
cgcccccggugccguugg

SEQ ID NO: 3144679 - RNA, 19 nt, Mycobacterium bovis subsp bovis AF2122/97
cgcccccguuuacggcccg

SEQ ID NO: 3144680 - RNA, 18 nt, Mycobacterium bovis subsp bovis AF2122/97
cgcccccucuagcgccuc

SEQ ID NO: 3144681 - RNA, 14 nt, Mycobacterium bovis subsp bovis AF2122/97
cgccccgaggaugc

SEQ ID NO: 3144682 - RNA, 14 nt, Mycobacterium bovis subsp bovis AF2122/97
cgccccgaucggug

SEQ ID NO: 3144683 - RNA, 19 nt, Mycobacterium bovis subsp bovis AF2122/97
cgccccgaugaccgccuug

SEQ ID NO: 3144684 - RNA, 12 nt, Mycobacterium bovis subsp bovis AF2122/97
cgccccgcccgc

SEQ ID NO: 3144685 - RNA, 14 nt, Mycobacterium bovis subsp bovis AF2122/97
cgccccgcgcccaa

SEQ ID NO: 3144686 - RNA, 19 nt, Mycobacterium bovis subsp bovis AF2122/97
cgccccgcgcccaacgcgg

SEQ ID NO: 3144687 - RNA, 23 nt, Mycobacterium bovis subsp bovis AF2122/97
cgccccgcgcccaacgcgggugc

SEQ ID NO: 3144688 - RNA, 14 nt, Mycobacterium bovis subsp bovis AF2122/97
cgccccgcgccuug

SEQ ID NO: 3144689 - RNA, 12 nt, Mycobacterium bovis subsp bovis AF2122/97
cgccccgcgguc

SEQ ID NO: 3144690 - RNA, 13 nt, Mycobacterium bovis subsp bovis AF2122/97
cgccccgcguguc

SEQ ID NO: 3144691 - RNA, 13 nt, Mycobacterium bovis subsp bovis AF2122/97
cgccccgcguugg

SEQ ID NO: 3144692 - RNA, 17 nt, Mycobacterium bovis subsp bovis AF2122/97
cgccccgcguuggacaa

SEQ ID NO: 3144693 - RNA, 12 nt, Mycobacterium bovis subsp bovis AF2122/97
cgccccggccgc

SEQ ID NO: 3144694 - RNA, 21 nt, Mycobacterium bovis subsp bovis AF2122/97
cgccccggccgcuggcguuga

SEQ ID NO: 3144695 - RNA, 16 nt, Mycobacterium bovis subsp bovis AF2122/97
cgccccggcgcggcca

SEQ ID NO: 3144696 - RNA, 14 nt, Mycobacterium bovis subsp bovis AF2122/97
cgccccggcgcguu

SEQ ID NO: 3144697 - RNA, 14 nt, Mycobacterium bovis subsp bovis AF2122/97
cgccccggcggcgg

SEQ ID NO: 3144698 - RNA, 20 nt, Mycobacterium bovis subsp bovis AF2122/97
cgccccggcggcggcggccc

SEQ ID NO: 3144699 - RNA, 18 nt, Mycobacterium bovis subsp bovis AF2122/97
cgccccggggguccaccu

SEQ ID NO: 3144700 - RNA, 14 nt, Mycobacterium bovis subsp bovis AF2122/97
cgccccgugggccu

SEQ ID NO: 3144701 - RNA, 21 nt, Mycobacterium bovis subsp bovis AF2122/97
cgccccguugugucaccggcg

SEQ ID NO: 3144702 - RNA, 20 nt, Mycobacterium bovis subsp bovis AF2122/97
cgccccucacguggacugac

SEQ ID NO: 3144703 - RNA, 22 nt, Mycobacterium bovis subsp bovis AF2122/97
cgccccucacguggacugaccu

SEQ ID NO: 3144704 - RNA, 20 nt, Mycobacterium bovis subsp bovis AF2122/97
cgccccugcgcggccaccuc

SEQ ID NO: 3144705 - RNA, 14 nt, Mycobacterium bovis subsp bovis AF2122/97
cgccccuggcaccu

SEQ ID NO: 3144706 - RNA, 16 nt, Mycobacterium bovis subsp bovis AF2122/97
cgccccuggcaccucg

SEQ ID NO: 3144707 - RNA, 16 nt, Mycobacterium bovis subsp bovis AF2122/97
cgccccugguccaccc

SEQ ID NO: 3144708 - RNA, 19 nt, Mycobacterium bovis subsp bovis AF2122/97
cgccccugguccacccgug

SEQ ID NO: 3144709 - RNA, 17 nt, Mycobacterium bovis subsp bovis AF2122/97
cgcccgaaaaacgaccc

SEQ ID NO: 3144710 - RNA, 23 nt, Mycobacterium bovis subsp bovis AF2122/97
cgcccgaaaaacgaccccucacc

SEQ ID NO: 3144711 - RNA, 21 nt, Mycobacterium bovis subsp bovis AF2122/97
cgcccgaagaaugggauggca

SEQ ID NO: 3144712 - RNA, 14 nt, Mycobacterium bovis subsp bovis AF2122/97
cgcccgaagccggg

SEQ ID NO: 3144713 - RNA, 17 nt, Mycobacterium bovis subsp bovis AF2122/97
cgcccgaagccgggccc

SEQ ID NO: 3144714 - RNA, 14 nt, Mycobacterium bovis subsp bovis AF2122/97
cgcccgacacccgu

SEQ ID NO: 3144715 - RNA, 16 nt, Mycobacterium bovis subsp bovis AF2122/97
cgcccgacccaucacc

SEQ ID NO: 3144716 - RNA, 21 nt, Mycobacterium bovis subsp bovis AF2122/97
cgcccgacgaacagcggucca

SEQ ID NO: 3144717 - RNA, 13 nt, Mycobacterium bovis subsp bovis AF2122/97
cgcccgcugcaga

SEQ ID NO: 3144718 - RNA, 16 nt, Mycobacterium bovis subsp bovis AF2122/97
cgcccgcugccgucgg

SEQ ID NO: 3144719 - RNA, 17 nt, Mycobacterium bovis subsp bovis AF2122/97
cgcccgcugccgucgga

SEQ ID NO: 3144720 - RNA, 19 nt, Mycobacterium bovis subsp bovis AF2122/97
cgcccgcugggcucgcugc

SEQ ID NO: 3144721 - RNA, 19 nt, Mycobacterium bovis subsp bovis AF2122/97
cgcccggaaccggcgugca

SEQ ID NO: 3144722 - RNA, 21 nt, Mycobacterium bovis subsp bovis AF2122/97
cgcccggaaccggcgugcagc

SEQ ID NO: 3144723 - RNA, 22 nt, Mycobacterium bovis subsp bovis AF2122/97
cgcccggaaccggcgugcagca

SEQ ID NO: 3144724 - RNA, 20 nt, Mycobacterium bovis subsp bovis AF2122/97
cgcccggacgcaacacccgg

SEQ ID NO: 3144725 - RNA, 21 nt, Mycobacterium bovis subsp bovis AF2122/97
cgcccggacgcaacacccggg

SEQ ID NO: 3144726 - RNA, 18 nt, Mycobacterium bovis subsp bovis AF2122/97
cgcccggauguccgccga

SEQ ID NO: 3144727 - RNA, 20 nt, Mycobacterium bovis subsp bovis AF2122/97
cgcccggauguccgccgacg

SEQ ID NO: 3144728 - RNA, 15 nt, Mycobacterium bovis subsp bovis AF2122/97
cgcccggcacacggc

SEQ ID NO: 3144729 - RNA, 17 nt, Mycobacterium bovis subsp bovis AF2122/97
cgcccggcacacggccu

SEQ ID NO: 3144730 - RNA, 14 nt, Mycobacterium bovis subsp bovis AF2122/97
cgcccggcaccccu

SEQ ID NO: 3144731 - RNA, 13 nt, Mycobacterium bovis subsp bovis AF2122/97
cgcccggcaguuc

SEQ ID NO: 3144732 - RNA, 20 nt, Mycobacterium bovis subsp bovis AF2122/97
cgcccggcaguucgcggcca

SEQ ID NO: 3144733 - RNA, 14 nt, Mycobacterium bovis subsp bovis AF2122/97
cgcccggccagguc

SEQ ID NO: 3144734 - RNA, 19 nt, Mycobacterium bovis subsp bovis AF2122/97
cgcccggccaggucgacac

SEQ ID NO: 3144735 - RNA, 13 nt, Mycobacterium bovis subsp bovis AF2122/97
cgcccggccccgc

SEQ ID NO: 3144736 - RNA, 21 nt, Mycobacterium bovis subsp bovis AF2122/97
cgcccggccccgcaagcggau

SEQ ID NO: 3144737 - RNA, 22 nt, Mycobacterium bovis subsp bovis AF2122/97
cgcccggcccugagcugccgag

SEQ ID NO: 3144738 - RNA, 21 nt, Mycobacterium bovis subsp bovis AF2122/97
cgcccggccugcuggucacca

SEQ ID NO: 3144739 - RNA, 20 nt, Mycobacterium bovis subsp bovis AF2122/97
cgcccggcgcaagcgccgcg

SEQ ID NO: 3144740 - RNA, 22 nt, Mycobacterium bovis subsp bovis AF2122/97
cgcccggcgcaagcgccgcgcu

SEQ ID NO: 3144741 - RNA, 17 nt, Mycobacterium bovis subsp bovis AF2122/97
cgcccggcgcaccaucg

SEQ ID NO: 3144742 - RNA, 13 nt, Mycobacterium bovis subsp bovis AF2122/97
cgcccggcggauc

SEQ ID NO: 3144743 - RNA, 17 nt, Mycobacterium bovis subsp bovis AF2122/97
cgcccggcguggugagc

SEQ ID NO: 3144744 - RNA, 20 nt, Mycobacterium bovis subsp bovis AF2122/97
cgcccggcgugucgccgcca

SEQ ID NO: 3144745 - RNA, 22 nt, Mycobacterium bovis subsp bovis AF2122/97
cgcccgggauaguuuucggccg

SEQ ID NO: 3144746 - RNA, 21 nt, Mycobacterium bovis subsp bovis AF2122/97
cgcccgggcaccggccggugg

SEQ ID NO: 3144747 - RNA, 13 nt, Mycobacterium bovis subsp bovis AF2122/97
cgcccgggcccac

SEQ ID NO: 3144748 - RNA, 21 nt, Mycobacterium bovis subsp bovis AF2122/97
cgcccgggcgaauccggcggg

SEQ ID NO: 3144749 - RNA, 12 nt, Mycobacterium bovis subsp bovis AF2122/97
cgcccgggcggc

SEQ ID NO: 3144750 - RNA, 13 nt, Mycobacterium bovis subsp bovis AF2122/97
cgcccgggcggcg

SEQ ID NO: 3144751 - RNA, 13 nt, Mycobacterium bovis subsp bovis AF2122/97
cgcccgggcguug

SEQ ID NO: 3144752 - RNA, 24 nt, Mycobacterium bovis subsp bovis AF2122/97
cgcccgggcguugggaucgcgcag

SEQ ID NO: 3144753 - RNA, 15 nt, Mycobacterium bovis subsp bovis AF2122/97
cgcccggggcgcaca

SEQ ID NO: 3144754 - RNA, 22 nt, Mycobacterium bovis subsp bovis AF2122/97
cgcccggggcggugggcgcuuc

SEQ ID NO: 3144755 - RNA, 20 nt, Mycobacterium bovis subsp bovis AF2122/97
cgcccgggucccggcagcug

SEQ ID NO: 3144756 - RNA, 13 nt, Mycobacterium bovis subsp bovis AF2122/97
cgcccggucacgc

SEQ ID NO: 3144757 - RNA, 15 nt, Mycobacterium bovis subsp bovis AF2122/97
cgcccggucacgcug

SEQ ID NO: 3144758 - RNA, 21 nt, Mycobacterium bovis subsp bovis AF2122/97
cgcccggucacgcugugcggu

SEQ ID NO: 3144759 - RNA, 13 nt, Mycobacterium bovis subsp bovis AF2122/97
cgcccggucgagc

SEQ ID NO: 3144760 - RNA, 18 nt, Mycobacterium bovis subsp bovis AF2122/97
cgcccggucgagccagcg

SEQ ID NO: 3144761 - RNA, 15 nt, Mycobacterium bovis subsp bovis AF2122/97
cgcccggucucgacg

SEQ ID NO: 3144762 - RNA, 20 nt, Mycobacterium bovis subsp bovis AF2122/97
cgcccggucucgacggcggc

SEQ ID NO: 3144763 - RNA, 23 nt, Mycobacterium bovis subsp bovis AF2122/97
cgcccggucucgacggcggccgc

SEQ ID NO: 3144764 - RNA, 21 nt, Mycobacterium bovis subsp bovis AF2122/97
cgcccggugcgucgugguggc

SEQ ID NO: 3144765 - RNA, 17 nt, Mycobacterium bovis subsp bovis AF2122/97
cgcccgguguguucggc

SEQ ID NO: 3144766 - RNA, 21 nt, Mycobacterium bovis subsp bovis AF2122/97
cgcccgguguguucggcccgc

SEQ ID NO: 3144767 - RNA, 20 nt, Mycobacterium bovis subsp bovis AF2122/97
cgcccgguucagcgcuggca

SEQ ID NO: 3144768 - RNA, 22 nt, Mycobacterium bovis subsp bovis AF2122/97
cgcccguagacccacagucgcc

SEQ ID NO: 3144769 - RNA, 23 nt, Mycobacterium bovis subsp bovis AF2122/97
cgcccguagacccacagucgccg

SEQ ID NO: 3144770 - RNA, 17 nt, Mycobacterium bovis subsp bovis AF2122/97
cgcccguaucggcuucg

SEQ ID NO: 3144771 - RNA, 19 nt, Mycobacterium bovis subsp bovis AF2122/97
cgcccguaucggcuucguc

SEQ ID NO: 3144772 - RNA, 15 nt, Mycobacterium bovis subsp bovis AF2122/97
cgcccguauugaugc

SEQ ID NO: 3144773 - RNA, 16 nt, Mycobacterium bovis subsp bovis AF2122/97
cgcccgucccacugac

SEQ ID NO: 3144774 - RNA, 14 nt, Mycobacterium bovis subsp bovis AF2122/97
cgcccguccgcgcg

SEQ ID NO: 3144775 - RNA, 20 nt, Mycobacterium bovis subsp bovis AF2122/97
cgcccguccgcgcgccgacc

SEQ ID NO: 3144776 - RNA, 16 nt, Mycobacterium bovis subsp bovis AF2122/97
cgcccgucgcugggag

SEQ ID NO: 3144777 - RNA, 17 nt, Mycobacterium bovis subsp bovis AF2122/97
cgcccgucguagguggc

SEQ ID NO: 3144778 - RNA, 19 nt, Mycobacterium bovis subsp bovis AF2122/97
cgcccgucuuccagccagg

SEQ ID NO: 3144779 - RNA, 20 nt, Mycobacterium bovis subsp bovis AF2122/97
cgcccgucuuccagccaggc

SEQ ID NO: 3144780 - RNA, 13 nt, Mycobacterium bovis subsp bovis AF2122/97
cgcccgugccgcc

SEQ ID NO: 3144781 - RNA, 14 nt, Mycobacterium bovis subsp bovis AF2122/97
cgcccgugccgccc

SEQ ID NO: 3144782 - RNA, 15 nt, Mycobacterium bovis subsp bovis AF2122/97
cgcccgugccgcccg

SEQ ID NO: 3144783 - RNA, 16 nt, Mycobacterium bovis subsp bovis AF2122/97
cgcccgugccgcccgc

SEQ ID NO: 3144784 - RNA, 18 nt, Mycobacterium bovis subsp bovis AF2122/97
cgcccgugccgcccgcgc

SEQ ID NO: 3144785 - RNA, 19 nt, Mycobacterium bovis subsp bovis AF2122/97
cgcccgugccgcccgcgcc

SEQ ID NO: 3144786 - RNA, 22 nt, Mycobacterium bovis subsp bovis AF2122/97
cgcccgugccgcccgcgccgcc

SEQ ID NO: 3144787 - RNA, 15 nt, Mycobacterium bovis subsp bovis AF2122/97
cgcccgugccgcccu

SEQ ID NO: 3144788 - RNA, 15 nt, Mycobacterium bovis subsp bovis AF2122/97
cgcccgugcggcucg

SEQ ID NO: 3144789 - RNA, 17 nt, Mycobacterium bovis subsp bovis AF2122/97
cgcccgugcggcucgcc

SEQ ID NO: 3144790 - RNA, 19 nt, Mycobacterium bovis subsp bovis AF2122/97
cgcccgugcggcucgccgg

SEQ ID NO: 3144791 - RNA, 23 nt, Mycobacterium bovis subsp bovis AF2122/97
cgcccgugcggcucgccggcggc

SEQ ID NO: 3144792 - RNA, 23 nt, Mycobacterium bovis subsp bovis AF2122/97
cgcccguguugaagaagcccgag

SEQ ID NO: 3144793 - RNA, 17 nt, Mycobacterium bovis subsp bovis AF2122/97
cgcccuaacccugcccu

SEQ ID NO: 3144794 - RNA, 16 nt, Mycobacterium bovis subsp bovis AF2122/97
cgcccuagcgagcggc

SEQ ID NO: 3144795 - RNA, 21 nt, Mycobacterium bovis subsp bovis AF2122/97
cgcccuagcuggugcgcccga

SEQ ID NO: 3144796 - RNA, 23 nt, Mycobacterium bovis subsp bovis AF2122/97
cgcccuagcuggugcgcccgacg

SEQ ID NO: 3144797 - RNA, 21 nt, Mycobacterium bovis subsp bovis AF2122/97
cgcccuauacgcaacaggcca

SEQ ID NO: 3144798 - RNA, 14 nt, Mycobacterium bovis subsp bovis AF2122/97
cgcccucaccgccu

SEQ ID NO: 3144799 - RNA, 15 nt, Mycobacterium bovis subsp bovis AF2122/97
cgcccucagccgcgg

SEQ ID NO: 3144800 - RNA, 18 nt, Mycobacterium bovis subsp bovis AF2122/97
cgcccucagccgcggcca

SEQ ID NO: 3144801 - RNA, 20 nt, Mycobacterium bovis subsp bovis AF2122/97
cgcccucagccgcggccaca

SEQ ID NO: 3144802 - RNA, 19 nt, Mycobacterium bovis subsp bovis AF2122/97
cgcccucaguucacgcucg

SEQ ID NO: 3144803 - RNA, 21 nt, Mycobacterium bovis subsp bovis AF2122/97
cgccgaacgugcaaccacggc

SEQ ID NO: 3144804 - RNA, 22 nt, Mycobacterium bovis subsp bovis AF2122/97
cgccgaacgugcaaccacggcg

SEQ ID NO: 3144805 - RNA, 20 nt, Mycobacterium bovis subsp bovis AF2122/97
cgccgaacgugcaaccaugg

SEQ ID NO: 3144806 - RNA, 15 nt, Mycobacterium bovis subsp bovis AF2122/97
cgccgaacgugcggu

SEQ ID NO: 3144807 - RNA, 14 nt, Mycobacterium bovis subsp bovis AF2122/97
cgccgaagaaggug

SEQ ID NO: 3144808 - RNA, 13 nt, Mycobacterium bovis subsp bovis AF2122/97
cgccgaagccgac

SEQ ID NO: 3144809 - RNA, 14 nt, Mycobacterium bovis subsp bovis AF2122/97
cgccgaagccgacg

SEQ ID NO: 3144810 - RNA, 13 nt, Mycobacterium bovis subsp bovis AF2122/97
cgccgaagccgcg

SEQ ID NO: 3144811 - RNA, 15 nt, Mycobacterium bovis subsp bovis AF2122/97
cgccgaagccggacc

SEQ ID NO: 3144812 - RNA, 16 nt, Mycobacterium bovis subsp bovis AF2122/97
cgccgaagccggaccg

SEQ ID NO: 3144813 - RNA, 18 nt, Mycobacterium bovis subsp bovis AF2122/97
cgccgaagcgaugccgug

SEQ ID NO: 3144814 - RNA, 22 nt, Mycobacterium bovis subsp bovis AF2122/97
cgccgaagcgaugccgugcugg

SEQ ID NO: 3144815 - RNA, 13 nt, Mycobacterium bovis subsp bovis AF2122/97
cgccgaagcgccg

SEQ ID NO: 3144816 - RNA, 20 nt, Mycobacterium bovis subsp bovis AF2122/97
cgccgaagcgccgcuuggcg

SEQ ID NO: 3144817 - RNA, 20 nt, Mycobacterium bovis subsp bovis AF2122/97
cgccgaagcucaucgccgcu

SEQ ID NO: 3144818 - RNA, 21 nt, Mycobacterium bovis subsp bovis AF2122/97
cgccgaagcucaucgccgcua

SEQ ID NO: 3144819 - RNA, 22 nt, Mycobacterium bovis subsp bovis AF2122/97
cgccgaagcucaucgccgcuac

SEQ ID NO: 3144820 - RNA, 17 nt, Mycobacterium bovis subsp bovis AF2122/97
cgccgaagcugcggguc

SEQ ID NO: 3144821 - RNA, 14 nt, Mycobacterium bovis subsp bovis AF2122/97
cgccgaaggccgcc

SEQ ID NO: 3144822 - RNA, 19 nt, Mycobacterium bovis subsp bovis AF2122/97
cgccgaaggccgccacaaa

SEQ ID NO: 3144823 - RNA, 20 nt, Mycobacterium bovis subsp bovis AF2122/97
cgccgaaggcgggggagccc

SEQ ID NO: 3144824 - RNA, 11 nt, Mycobacterium bovis subsp bovis AF2122/97
cgccgaaguag

SEQ ID NO: 3144825 - RNA, 18 nt, Mycobacterium bovis subsp bovis AF2122/97
cgccgaaguagacggugg

SEQ ID NO: 3144826 - RNA, 19 nt, Mycobacterium bovis subsp bovis AF2122/97
cgccgaaguagacgguggu

SEQ ID NO: 3144827 - RNA, 21 nt, Mycobacterium bovis subsp bovis AF2122/97
cgccgaaguagccgaccggca

SEQ ID NO: 3144828 - RNA, 20 nt, Mycobacterium bovis subsp bovis AF2122/97
cgccgaaguuccagccgacg

SEQ ID NO: 3144829 - RNA, 15 nt, Mycobacterium bovis subsp bovis AF2122/97
cgccgaauccgacgu

SEQ ID NO: 3144830 - RNA, 21 nt, Mycobacterium bovis subsp bovis AF2122/97
cgccgaauccgacgucgacga

SEQ ID NO: 3144831 - RNA, 16 nt, Mycobacterium bovis subsp bovis AF2122/97
cgccgaaucggcaguu

SEQ ID NO: 3144832 - RNA, 17 nt, Mycobacterium bovis subsp bovis AF2122/97
cgccgaaugccaccucg

SEQ ID NO: 3144833 - RNA, 19 nt, Mycobacterium bovis subsp bovis AF2122/97
cgccgaaugccaccucgac

SEQ ID NO: 3144834 - RNA, 20 nt, Mycobacterium bovis subsp bovis AF2122/97
cgccgaaugccaccucgacg

SEQ ID NO: 3144835 - RNA, 15 nt, Mycobacterium bovis subsp bovis AF2122/97
cgccgaauggcggug

SEQ ID NO: 3144836 - RNA, 20 nt, Mycobacterium bovis subsp bovis AF2122/97
cgccgaauucauccgggcuc

SEQ ID NO: 3144837 - RNA, 21 nt, Mycobacterium bovis subsp bovis AF2122/97
cgccgacaaaagccagggccg

SEQ ID NO: 3144838 - RNA, 19 nt, Mycobacterium bovis subsp bovis AF2122/97
cgccgacaaccccgccagg

SEQ ID NO: 3144839 - RNA, 15 nt, Mycobacterium bovis subsp bovis AF2122/97
cgccgacaccaccgg

SEQ ID NO: 3144840 - RNA, 16 nt, Mycobacterium bovis subsp bovis AF2122/97
cgccgacaccaccggc

SEQ ID NO: 3144841 - RNA, 18 nt, Mycobacterium bovis subsp bovis AF2122/97
cgccgacaccaccggcgc

SEQ ID NO: 3144842 - RNA, 19 nt, Mycobacterium bovis subsp bovis AF2122/97
cgccgacaccaccggcgcc

SEQ ID NO: 3144843 - RNA, 22 nt, Mycobacterium bovis subsp bovis AF2122/97
cgccgacaccaccggcgccgcc

SEQ ID NO: 3144844 - RNA, 14 nt, Mycobacterium bovis subsp bovis AF2122/97
cgccgacaccggcu

SEQ ID NO: 3144845 - RNA, 15 nt, Mycobacterium bovis subsp bovis AF2122/97
cgccgacaccggcug

SEQ ID NO: 3144846 - RNA, 18 nt, Mycobacterium bovis subsp bovis AF2122/97
cgccgacaccggcugacc

SEQ ID NO: 3144847 - RNA, 21 nt, Mycobacterium bovis subsp bovis AF2122/97
cgccgacaccggcugaccgac

SEQ ID NO: 3144848 - RNA, 22 nt, Mycobacterium bovis subsp bovis AF2122/97
cgccgacagccgauccgaucgc

SEQ ID NO: 3144849 - RNA, 15 nt, Mycobacterium bovis subsp bovis AF2122/97
cgccgacaggccggc

SEQ ID NO: 3144850 - RNA, 16 nt, Mycobacterium bovis subsp bovis AF2122/97
cgccgacaggccggcc

SEQ ID NO: 3144851 - RNA, 22 nt, Mycobacterium bovis subsp bovis AF2122/97
cgccgacaggccggccaccagu

SEQ ID NO: 3144852 - RNA, 19 nt, Mycobacterium bovis subsp bovis AF2122/97
cgccgacaggugaaggugc

SEQ ID NO: 3144853 - RNA, 16 nt, Mycobacterium bovis subsp bovis AF2122/97
cgccgacauggcggug

SEQ ID NO: 3144854 - RNA, 21 nt, Mycobacterium bovis subsp bovis AF2122/97
cgccgacauggcggugcgcag

SEQ ID NO: 3144855 - RNA, 13 nt, Mycobacterium bovis subsp bovis AF2122/97
cgccgaccacccg

SEQ ID NO: 3144856 - RNA, 13 nt, Mycobacterium bovis subsp bovis AF2122/97
cgccgaccaccgc

SEQ ID NO: 3144857 - RNA, 12 nt, Mycobacterium bovis subsp bovis AF2122/97
cgccgaccagaa

SEQ ID NO: 3144858 - RNA, 13 nt, Mycobacterium bovis subsp bovis AF2122/97
cgccgaccagcac

SEQ ID NO: 3144859 - RNA, 15 nt, Mycobacterium bovis subsp bovis AF2122/97
cgccgaccagcaccc

SEQ ID NO: 3144860 - RNA, 22 nt, Mycobacterium bovis subsp bovis AF2122/97
cgccgaccagcuugaccgacca

SEQ ID NO: 3144861 - RNA, 17 nt, Mycobacterium bovis subsp bovis AF2122/97
cgccgacccaacccgau

SEQ ID NO: 3144862 - RNA, 12 nt, Mycobacterium bovis subsp bovis AF2122/97
cgccgacccgcc

SEQ ID NO: 3144863 - RNA, 17 nt, Mycobacterium bovis subsp bovis AF2122/97
cgccgacccgccgcgga

SEQ ID NO: 3144864 - RNA, 17 nt, Mycobacterium bovis subsp bovis AF2122/97
cgccgacccgcgcgccg

SEQ ID NO: 3144865 - RNA, 14 nt, Mycobacterium bovis subsp bovis AF2122/97
cgccgacccggggg

SEQ ID NO: 3144866 - RNA, 22 nt, Mycobacterium bovis subsp bovis AF2122/97
cgccgacccgggggcgcccggg

SEQ ID NO: 3144867 - RNA, 18 nt, Mycobacterium bovis subsp bovis AF2122/97
cgccgacccguaccagcc

SEQ ID NO: 3144868 - RNA, 23 nt, Mycobacterium bovis subsp bovis AF2122/97
cgccgacccuagauaugcacccg

SEQ ID NO: 3144869 - RNA, 12 nt, Mycobacterium bovis subsp bovis AF2122/97
cgccgaccgaca

SEQ ID NO: 3144870 - RNA, 20 nt, Mycobacterium bovis subsp bovis AF2122/97
cgccgaccgacaccaccagg

SEQ ID NO: 3144871 - RNA, 13 nt, Mycobacterium bovis subsp bovis AF2122/97
cgccgaccgcgcc

SEQ ID NO: 3144872 - RNA, 14 nt, Mycobacterium bovis subsp bovis AF2122/97
cgccgaccgcgccg

SEQ ID NO: 3144873 - RNA, 15 nt, Mycobacterium bovis subsp bovis AF2122/97
cgccgaccgcgccgc

SEQ ID NO: 3144874 - RNA, 20 nt, Mycobacterium bovis subsp bovis AF2122/97
cgccgaccgcgccgcaucau

SEQ ID NO: 3144875 - RNA, 17 nt, Mycobacterium bovis subsp bovis AF2122/97
cgccgaccggccacgac

SEQ ID NO: 3144876 - RNA, 16 nt, Mycobacterium bovis subsp bovis AF2122/97
cgccgaccggcccgca

SEQ ID NO: 3144877 - RNA, 22 nt, Mycobacterium bovis subsp bovis AF2122/97
cgccgaccggcccgcauccgca

SEQ ID NO: 3144878 - RNA, 13 nt, Mycobacterium bovis subsp bovis AF2122/97
cgccgaccggugg

SEQ ID NO: 3144879 - RNA, 15 nt, Mycobacterium bovis subsp bovis AF2122/97
cgccgaccgguggca

SEQ ID NO: 3144880 - RNA, 21 nt, Mycobacterium bovis subsp bovis AF2122/97
cgccgaccgguggcaccggcg

SEQ ID NO: 3144881 - RNA, 23 nt, Mycobacterium bovis subsp bovis AF2122/97
cgccgaccgguggcaccggcggc

SEQ ID NO: 3144882 - RNA, 14 nt, Mycobacterium bovis subsp bovis AF2122/97
cgccgaccuaguca

SEQ ID NO: 3144883 - RNA, 17 nt, Mycobacterium bovis subsp bovis AF2122/97
cgccgaccuagucaccu

SEQ ID NO: 3144884 - RNA, 20 nt, Mycobacterium bovis subsp bovis AF2122/97
cgccgaccucaucggcaccg

SEQ ID NO: 3144885 - RNA, 22 nt, Mycobacterium bovis subsp bovis AF2122/97
cgccgaccucaucggcaccguc

SEQ ID NO: 3144886 - RNA, 12 nt, Mycobacterium bovis subsp bovis AF2122/97
cgccgaccugga

SEQ ID NO: 3144887 - RNA, 15 nt, Mycobacterium bovis subsp bovis AF2122/97
cgccgaccuggacaa

SEQ ID NO: 3144888 - RNA, 19 nt, Mycobacterium bovis subsp bovis AF2122/97
cgccgacgaaggcgacggu

SEQ ID NO: 3144889 - RNA, 22 nt, Mycobacterium bovis subsp bovis AF2122/97
cgccgacgacuccggcaagcac

SEQ ID NO: 3144890 - RNA, 20 nt, Mycobacterium bovis subsp bovis AF2122/97
cgccgaggccucggccagcg

SEQ ID NO: 3144891 - RNA, 22 nt, Mycobacterium bovis subsp bovis AF2122/97
cgccgaggccucggccagcguc

SEQ ID NO: 3144892 - RNA, 14 nt, Mycobacterium bovis subsp bovis AF2122/97
cgccgaggcguucg

SEQ ID NO: 3144893 - RNA, 17 nt, Mycobacterium bovis subsp bovis AF2122/97
cgccgagggcgccgggg

SEQ ID NO: 3144894 - RNA, 17 nt, Mycobacterium bovis subsp bovis AF2122/97
cgccgagguagauggcg

SEQ ID NO: 3144895 - RNA, 20 nt, Mycobacterium bovis subsp bovis AF2122/97
cgccgaggucgaaccgccgg

SEQ ID NO: 3144896 - RNA, 18 nt, Mycobacterium bovis subsp bovis AF2122/97
cgccgaggucgguucggc

SEQ ID NO: 3144897 - RNA, 21 nt, Mycobacterium bovis subsp bovis AF2122/97
cgccgaggucgguucggccgg

SEQ ID NO: 3144898 - RNA, 22 nt, Mycobacterium bovis subsp bovis AF2122/97
cgccgaggucgguucggccgga

SEQ ID NO: 3144899 - RNA, 18 nt, Mycobacterium bovis subsp bovis AF2122/97
cgccgaggucuccggugc

SEQ ID NO: 3144900 - RNA, 19 nt, Mycobacterium bovis subsp bovis AF2122/97
cgccgaguaccggccagcc

SEQ ID NO: 3144901 - RNA, 19 nt, Mycobacterium bovis subsp bovis AF2122/97
cgccgaguauuggucggug

SEQ ID NO: 3144902 - RNA, 22 nt, Mycobacterium bovis subsp bovis AF2122/97
cgccgagucaaacaaccgugaa

SEQ ID NO: 3144903 - RNA, 16 nt, Mycobacterium bovis subsp bovis AF2122/97
cgccgaguucugcugg

SEQ ID NO: 3144904 - RNA, 15 nt, Mycobacterium bovis subsp bovis AF2122/97
cgccgaguugaccgc

SEQ ID NO: 3144905 - RNA, 16 nt, Mycobacterium bovis subsp bovis AF2122/97
cgccgaguugaccgcc

SEQ ID NO: 3144906 - RNA, 20 nt, Mycobacterium bovis subsp bovis AF2122/97
cgccgaguugaccgccgugg

SEQ ID NO: 3144907 - RNA, 15 nt, Mycobacterium bovis subsp bovis AF2122/97
cgccgauacccagcg

SEQ ID NO: 3144908 - RNA, 17 nt, Mycobacterium bovis subsp bovis AF2122/97
cgccgauacccagcggg

SEQ ID NO: 3144909 - RNA, 23 nt, Mycobacterium bovis subsp bovis AF2122/97
cgccgauacccagcgggucgcgg

SEQ ID NO: 3144910 - RNA, 14 nt, Mycobacterium bovis subsp bovis AF2122/97
cgccgauaccgccg

SEQ ID NO: 3144911 - RNA, 16 nt, Mycobacterium bovis subsp bovis AF2122/97
cgccgauaccgccggc

SEQ ID NO: 3144912 - RNA, 20 nt, Mycobacterium bovis subsp bovis AF2122/97
cgccgauaccgccggcccca

SEQ ID NO: 3144913 - RNA, 16 nt, Mycobacterium bovis subsp bovis AF2122/97
cgccgauaccggcggc

SEQ ID NO: 3144914 - RNA, 18 nt, Mycobacterium bovis subsp bovis AF2122/97
cgccgauaccggcggcga

SEQ ID NO: 3144915 - RNA, 14 nt, Mycobacterium bovis subsp bovis AF2122/97
cgccgauaucggug

SEQ ID NO: 3144916 - RNA, 15 nt, Mycobacterium bovis subsp bovis AF2122/97
cgccgauaucgguga

SEQ ID NO: 3144917 - RNA, 16 nt, Mycobacterium bovis subsp bovis AF2122/97
cgccgauaucggugac

SEQ ID NO: 3144918 - RNA, 20 nt, Mycobacterium bovis subsp bovis AF2122/97
cgccgauaucugccacguug

SEQ ID NO: 3144919 - RNA, 17 nt, Mycobacterium bovis subsp bovis AF2122/97
cgccgaucaacaugccg

SEQ ID NO: 3144920 - RNA, 15 nt, Mycobacterium bovis subsp bovis AF2122/97
cgccgaucaccaccg

SEQ ID NO: 3144921 - RNA, 18 nt, Mycobacterium bovis subsp bovis AF2122/97
cgccgaucaccaccggca

SEQ ID NO: 3144922 - RNA, 13 nt, Mycobacterium bovis subsp bovis AF2122/97
cgccgaucaccgc

SEQ ID NO: 3144923 - RNA, 22 nt, Mycobacterium bovis subsp bovis AF2122/97
cgccgaucaccgcaucggugcc

SEQ ID NO: 3144924 - RNA, 14 nt, Mycobacterium bovis subsp bovis AF2122/97
cgccgaucaccgcu

SEQ ID NO: 3144925 - RNA, 20 nt, Mycobacterium bovis subsp bovis AF2122/97
cgccgaucacggugggcgcc

SEQ ID NO: 3144926 - RNA, 19 nt, Mycobacterium bovis subsp bovis AF2122/97
cgccgaucacugucgggua

SEQ ID NO: 3144927 - RNA, 17 nt, Mycobacterium bovis subsp bovis AF2122/97
cgccgaucagcugcgca

SEQ ID NO: 3144928 - RNA, 23 nt, Mycobacterium bovis subsp bovis AF2122/97
cgccgaucaugaccaucugcugu

SEQ ID NO: 3144929 - RNA, 15 nt, Mycobacterium bovis subsp bovis AF2122/97
cgccgaucccgccca

SEQ ID NO: 3144930 - RNA, 16 nt, Mycobacterium bovis subsp bovis AF2122/97
cgccgaucccggcggu

SEQ ID NO: 3144931 - RNA, 13 nt, Mycobacterium bovis subsp bovis AF2122/97
cgccgaucccguc

SEQ ID NO: 3144932 - RNA, 14 nt, Mycobacterium bovis subsp bovis AF2122/97
cgccgauccggugg

SEQ ID NO: 3144933 - RNA, 20 nt, Mycobacterium bovis subsp bovis AF2122/97
cgccgauccgguggcuggcc

SEQ ID NO: 3144934 - RNA, 13 nt, Mycobacterium bovis subsp bovis AF2122/97
cgccgaucgaacc

SEQ ID NO: 3144935 - RNA, 22 nt, Mycobacterium bovis subsp bovis AF2122/97
cgccgaucgacacccgcucggc

SEQ ID NO: 3144936 - RNA, 18 nt, Mycobacterium bovis subsp bovis AF2122/97
cgccgaucgcggcggccu

SEQ ID NO: 3144937 - RNA, 18 nt, Mycobacterium bovis subsp bovis AF2122/97
cgccgaucggcaccgugu

SEQ ID NO: 3144938 - RNA, 19 nt, Mycobacterium bovis subsp bovis AF2122/97
cgccgaucggcaccguguc

SEQ ID NO: 3144939 - RNA, 24 nt, Mycobacterium bovis subsp bovis AF2122/97
cgccgaucggcaccgugucgacgg

SEQ ID NO: 3144940 - RNA, 16 nt, Mycobacterium bovis subsp bovis AF2122/97
cgccgaucuucgcgcg

SEQ ID NO: 3144941 - RNA, 19 nt, Mycobacterium bovis subsp bovis AF2122/97
cgccgaucuucgcgcgcuc

SEQ ID NO: 3144942 - RNA, 18 nt, Mycobacterium bovis subsp bovis AF2122/97
cgccgaugaacguggcga

SEQ ID NO: 3144943 - RNA, 16 nt, Mycobacterium bovis subsp bovis AF2122/97
cgccgaugaccgcaac

SEQ ID NO: 3144944 - RNA, 19 nt, Mycobacterium bovis subsp bovis AF2122/97
cgccgaugaccgcaaccgg

SEQ ID NO: 3144945 - RNA, 15 nt, Mycobacterium bovis subsp bovis AF2122/97
cgccgaugacggugu

SEQ ID NO: 3144946 - RNA, 16 nt, Mycobacterium bovis subsp bovis AF2122/97
cgccgaugacggugua

SEQ ID NO: 3144947 - RNA, 17 nt, Mycobacterium bovis subsp bovis AF2122/97
cgccgaugaugcggcgc

SEQ ID NO: 3144948 - RNA, 20 nt, Mycobacterium bovis subsp bovis AF2122/97
cgccgaugauggacaccagc

SEQ ID NO: 3144949 - RNA, 21 nt, Mycobacterium bovis subsp bovis AF2122/97
cgccgaugauggacaccagcc

SEQ ID NO: 3144950 - RNA, 13 nt, Mycobacterium bovis subsp bovis AF2122/97
cgccgaugccacc

SEQ ID NO: 3144951 - RNA, 15 nt, Mycobacterium bovis subsp bovis AF2122/97
cgccgaugccaccgc

SEQ ID NO: 3144952 - RNA, 17 nt, Mycobacterium bovis subsp bovis AF2122/97
cgccgaugccaccgcuu

SEQ ID NO: 3144953 - RNA, 19 nt, Mycobacterium bovis subsp bovis AF2122/97
cgccgaugcccgacaccgc

SEQ ID NO: 3144954 - RNA, 14 nt, Mycobacterium bovis subsp bovis AF2122/97
cgccgaugccgaac

SEQ ID NO: 3144955 - RNA, 13 nt, Mycobacterium bovis subsp bovis AF2122/97
cgccgaugccgcc

SEQ ID NO: 3144956 - RNA, 18 nt, Mycobacterium bovis subsp bovis AF2122/97
cgccgaugccgccggccc

SEQ ID NO: 3144957 - RNA, 15 nt, Mycobacterium bovis subsp bovis AF2122/97
cgccgaugccggcca

SEQ ID NO: 3144958 - RNA, 13 nt, Mycobacterium bovis subsp bovis AF2122/97
cgccgaugcggug

SEQ ID NO: 3144959 - RNA, 14 nt, Mycobacterium bovis subsp bovis AF2122/97
cgccgaugcggugc

SEQ ID NO: 3144960 - RNA, 14 nt, Mycobacterium bovis subsp bovis AF2122/97
cgccgauggccgca

SEQ ID NO: 3144961 - RNA, 20 nt, Mycobacterium bovis subsp bovis AF2122/97
cgccgauggcuuggugccca

SEQ ID NO: 3144962 - RNA, 23 nt, Mycobacterium bovis subsp bovis AF2122/97
cgccgaugggaaccgaaucggca

SEQ ID NO: 3144963 - RNA, 14 nt, Mycobacterium bovis subsp bovis AF2122/97
cgccgauguggccg

SEQ ID NO: 3144964 - RNA, 18 nt, Mycobacterium bovis subsp bovis AF2122/97
cgccgauguggccggcga

SEQ ID NO: 3144965 - RNA, 22 nt, Mycobacterium bovis subsp bovis AF2122/97
cgccgauguggccggcgauggc

SEQ ID NO: 3144966 - RNA, 15 nt, Mycobacterium bovis subsp bovis AF2122/97
cgccgauguggucgg

SEQ ID NO: 3144967 - RNA, 18 nt, Mycobacterium bovis subsp bovis AF2122/97
cgccgauguggucggcug

SEQ ID NO: 3144968 - RNA, 19 nt, Mycobacterium bovis subsp bovis AF2122/97
cgccgauguuggcagggcc

SEQ ID NO: 3144969 - RNA, 20 nt, Mycobacterium bovis subsp bovis AF2122/97
cgccgauguuggcagggcca

SEQ ID NO: 3144970 - RNA, 15 nt, Mycobacterium bovis subsp bovis AF2122/97
cgccgauuccaccgc

SEQ ID NO: 3144971 - RNA, 16 nt, Mycobacterium bovis subsp bovis AF2122/97
cgccgauuccaccgcc

SEQ ID NO: 3144972 - RNA, 19 nt, Mycobacterium bovis subsp bovis AF2122/97
cgccgauuccaccgccgac

SEQ ID NO: 3144973 - RNA, 20 nt, Mycobacterium bovis subsp bovis AF2122/97
cgccgauuccaccgccgacg

SEQ ID NO: 3144974 - RNA, 22 nt, Mycobacterium bovis subsp bovis AF2122/97
cgccgauuggcaggcaaugccc

SEQ ID NO: 3144975 - RNA, 21 nt, Mycobacterium bovis subsp bovis AF2122/97
cgccgauuuugggaucgugcc

SEQ ID NO: 3144976 - RNA, 23 nt, Mycobacterium bovis subsp bovis AF2122/97
cgccgccagguccgccggugccg

SEQ ID NO: 3144977 - RNA, 19 nt, Mycobacterium bovis subsp bovis AF2122/97
cgccgccagguugcccggu

SEQ ID NO: 3144978 - RNA, 12 nt, Mycobacterium bovis subsp bovis AF2122/97
cgccgccagucg

SEQ ID NO: 3144979 - RNA, 13 nt, Mycobacterium bovis subsp bovis AF2122/97
cgccgccagucgu

SEQ ID NO: 3144980 - RNA, 19 nt, Mycobacterium bovis subsp bovis AF2122/97
cgccgccauaccucggcga

SEQ ID NO: 3144981 - RNA, 15 nt, Mycobacterium bovis subsp bovis AF2122/97
cgccgccaucagccc

SEQ ID NO: 3144982 - RNA, 14 nt, Mycobacterium bovis subsp bovis AF2122/97
cgccgccaucgccg

SEQ ID NO: 3144983 - RNA, 21 nt, Mycobacterium bovis subsp bovis AF2122/97
cgccgccauuaggcgcggugc

SEQ ID NO: 3144984 - RNA, 13 nt, Mycobacterium bovis subsp bovis AF2122/97
cgccgccauugcc

SEQ ID NO: 3144985 - RNA, 15 nt, Mycobacterium bovis subsp bovis AF2122/97
cgccgccauugccgc

SEQ ID NO: 3144986 - RNA, 18 nt, Mycobacterium bovis subsp bovis AF2122/97
cgccgccauugccgccgg

SEQ ID NO: 3144987 - RNA, 21 nt, Mycobacterium bovis subsp bovis AF2122/97
cgccgccauuggacagcgcga

SEQ ID NO: 3144988 - RNA, 15 nt, Mycobacterium bovis subsp bovis AF2122/97
cgccgccauuggcuu

SEQ ID NO: 3144989 - RNA, 19 nt, Mycobacterium bovis subsp bovis AF2122/97
cgccgcccaauccaccgaa

SEQ ID NO: 3144990 - RNA, 23 nt, Mycobacterium bovis subsp bovis AF2122/97
cgccgcccaauccaccgaagccc

SEQ ID NO: 3144991 - RNA, 21 nt, Mycobacterium bovis subsp bovis AF2122/97
cgccgcccagcaucucggcgg

SEQ ID NO: 3144992 - RNA, 21 nt, Mycobacterium bovis subsp bovis AF2122/97
cgccgccccauacuugcgccg

SEQ ID NO: 3144993 - RNA, 24 nt, Mycobacterium bovis subsp bovis AF2122/97
cgccgccccauacuugcgccgacu

SEQ ID NO: 3144994 - RNA, 13 nt, Mycobacterium bovis subsp bovis AF2122/97
cgccgcccccgcc

SEQ ID NO: 3144995 - RNA, 23 nt, Mycobacterium bovis subsp bovis AF2122/97
cgccgcccccgcccguugcaggu

SEQ ID NO: 3144996 - RNA, 16 nt, Mycobacterium bovis subsp bovis AF2122/97
cgccgcccccgccggc

SEQ ID NO: 3144997 - RNA, 18 nt, Mycobacterium bovis subsp bovis AF2122/97
cgccgcccccgccggccg

SEQ ID NO: 3144998 - RNA, 20 nt, Mycobacterium bovis subsp bovis AF2122/97
cgccgcccccgccggccgcg

SEQ ID NO: 3144999 - RNA, 22 nt, Mycobacterium bovis subsp bovis AF2122/97
cgccgcccccguuuacggcccg

SEQ ID NO: 3145000 - RNA, 15 nt, Mycobacterium bovis subsp bovis AF2122/97
cgccgccccggcgcu

SEQ ID NO: 3145001 - RNA, 17 nt, Mycobacterium bovis subsp bovis AF2122/97
cgccgccccugcgcggc

SEQ ID NO: 3145002 - RNA, 21 nt, Mycobacterium bovis subsp bovis AF2122/97
cgccgccccugcgcggccacc

SEQ ID NO: 3145003 - RNA, 19 nt, Mycobacterium bovis subsp bovis AF2122/97
cgccgcccgagcaccccag

SEQ ID NO: 3145004 - RNA, 12 nt, Mycobacterium bovis subsp bovis AF2122/97
cgccgcccgccg

SEQ ID NO: 3145005 - RNA, 18 nt, Mycobacterium bovis subsp bovis AF2122/97
cgccgcccgcgccaccga

SEQ ID NO: 3145006 - RNA, 19 nt, Mycobacterium bovis subsp bovis AF2122/97
cgccgcccgcgccaccgau

SEQ ID NO: 3145007 - RNA, 21 nt, Mycobacterium bovis subsp bovis AF2122/97
cgccgcccgcgcccccggugc

SEQ ID NO: 3145008 - RNA, 16 nt, Mycobacterium bovis subsp bovis AF2122/97
cgccgcccgcgccgcc

SEQ ID NO: 3145009 - RNA, 17 nt, Mycobacterium bovis subsp bovis AF2122/97
cgccgcccgcgccgccg

SEQ ID NO: 3145010 - RNA, 20 nt, Mycobacterium bovis subsp bovis AF2122/97
cgccgcccgcgccgccgcca

SEQ ID NO: 3145011 - RNA, 18 nt, Mycobacterium bovis subsp bovis AF2122/97
cgccgcccgcuccuccgg

SEQ ID NO: 3145012 - RNA, 20 nt, Mycobacterium bovis subsp bovis AF2122/97
cgccgcccucucacggcggu

SEQ ID NO: 3145013 - RNA, 16 nt, Mycobacterium bovis subsp bovis AF2122/97
cgccgcccuggccgcc

SEQ ID NO: 3145014 - RNA, 17 nt, Mycobacterium bovis subsp bovis AF2122/97
cgccgcccuggccgccg

SEQ ID NO: 3145015 - RNA, 18 nt, Mycobacterium bovis subsp bovis AF2122/97
cgccgcccuggccgccgg

SEQ ID NO: 3145016 - RNA, 22 nt, Mycobacterium bovis subsp bovis AF2122/97
cgccgcccuggccgccggcccc

SEQ ID NO: 3145017 - RNA, 17 nt, Mycobacterium bovis subsp bovis AF2122/97
cgccgcccuugccgccg

SEQ ID NO: 3145018 - RNA, 18 nt, Mycobacterium bovis subsp bovis AF2122/97
cgccgcccuugccgccgg

SEQ ID NO: 3145019 - RNA, 21 nt, Mycobacterium bovis subsp bovis AF2122/97
cgccgcccuugccgccggccc

SEQ ID NO: 3145020 - RNA, 22 nt, Mycobacterium bovis subsp bovis AF2122/97
cgccgcccuugccgccggcccc

SEQ ID NO: 3145021 - RNA, 14 nt, Mycobacterium bovis subsp bovis AF2122/97
cgccgccgaaaacc

SEQ ID NO: 3145022 - RNA, 22 nt, Mycobacterium bovis subsp bovis AF2122/97
cgccgccgaagcgaugccgugc

SEQ ID NO: 3145023 - RNA, 15 nt, Mycobacterium bovis subsp bovis AF2122/97
cgccgccgacgccgc

SEQ ID NO: 3145024 - RNA, 18 nt, Mycobacterium bovis subsp bovis AF2122/97
cgccgccgacgccgccgg

SEQ ID NO: 3145025 - RNA, 21 nt, Mycobacterium bovis subsp bovis AF2122/97
cgccgccgacgccgccggcgc

SEQ ID NO: 3145026 - RNA, 12 nt, Mycobacterium bovis subsp bovis AF2122/97
cgccgccgacgg

SEQ ID NO: 3145027 - RNA, 14 nt, Mycobacterium bovis subsp bovis AF2122/97
cgccgccgacggau

SEQ ID NO: 3145028 - RNA, 14 nt, Mycobacterium bovis subsp bovis AF2122/97
cgccgccgacguga

SEQ ID NO: 3145029 - RNA, 16 nt, Mycobacterium bovis subsp bovis AF2122/97
cgccgccgaucaccag

SEQ ID NO: 3145030 - RNA, 13 nt, Mycobacterium bovis subsp bovis AF2122/97
cgccgccgccacc

SEQ ID NO: 3145031 - RNA, 15 nt, Mycobacterium bovis subsp bovis AF2122/97
cgccgccgccaccac

SEQ ID NO: 3145032 - RNA, 16 nt, Mycobacterium bovis subsp bovis AF2122/97
cgccgccgccaccacc

SEQ ID NO: 3145033 - RNA, 16 nt, Mycobacterium bovis subsp bovis AF2122/97
cgccgccgccaccggc

SEQ ID NO: 3145034 - RNA, 15 nt, Mycobacterium bovis subsp bovis AF2122/97
cgccgccgccacggc

SEQ ID NO: 3145035 - RNA, 15 nt, Mycobacterium bovis subsp bovis AF2122/97
cgccgccgccaucgc

SEQ ID NO: 3145036 - RNA, 13 nt, Mycobacterium bovis subsp bovis AF2122/97
cgccgccgcccgg

SEQ ID NO: 3145037 - RNA, 12 nt, Mycobacterium bovis subsp bovis AF2122/97
cgccgccgccga

SEQ ID NO: 3145038 - RNA, 14 nt, Mycobacterium bovis subsp bovis AF2122/97
cgccgccgccgacg

SEQ ID NO: 3145039 - RNA, 15 nt, Mycobacterium bovis subsp bovis AF2122/97
cgccgccgccgacgc

SEQ ID NO: 3145040 - RNA, 16 nt, Mycobacterium bovis subsp bovis AF2122/97
cgccgccgccgccauc

SEQ ID NO: 3145041 - RNA, 14 nt, Mycobacterium bovis subsp bovis AF2122/97
cgccgccgccgggu

SEQ ID NO: 3145042 - RNA, 15 nt, Mycobacterium bovis subsp bovis AF2122/97
cgccgccgccggguc

SEQ ID NO: 3145043 - RNA, 15 nt, Mycobacterium bovis subsp bovis AF2122/97
cgccgccgcgacgca

SEQ ID NO: 3145044 - RNA, 23 nt, Mycobacterium bovis subsp bovis AF2122/97
cgccgccgcgacgcacugccccg

SEQ ID NO: 3145045 - RNA, 12 nt, Mycobacterium bovis subsp bovis AF2122/97
cgccgccgcgcg

SEQ ID NO: 3145046 - RNA, 13 nt, Mycobacterium bovis subsp bovis AF2122/97
cgccgccgcgcgu

SEQ ID NO: 3145047 - RNA, 12 nt, Mycobacterium bovis subsp bovis AF2122/97
cgccgccgcggg

SEQ ID NO: 3145048 - RNA, 16 nt, Mycobacterium bovis subsp bovis AF2122/97
cgccgccgcgggcgcc

SEQ ID NO: 3145049 - RNA, 13 nt, Mycobacterium bovis subsp bovis AF2122/97
cgccgccgcguuc

SEQ ID NO: 3145050 - RNA, 14 nt, Mycobacterium bovis subsp bovis AF2122/97
cgccgccgcguuca

SEQ ID NO: 3145051 - RNA, 18 nt, Mycobacterium bovis subsp bovis AF2122/97
cgccgccgcuaccgccgg

SEQ ID NO: 3145052 - RNA, 15 nt, Mycobacterium bovis subsp bovis AF2122/97
cgccgccgcugccgc

SEQ ID NO: 3145053 - RNA, 17 nt, Mycobacterium bovis subsp bovis AF2122/97
cgccgccgcugccgccc

SEQ ID NO: 3145054 - RNA, 22 nt, Mycobacterium bovis subsp bovis AF2122/97
cgccgccggaagcgccggccga

SEQ ID NO: 3145055 - RNA, 16 nt, Mycobacterium bovis subsp bovis AF2122/97
cgccgccggaucgccg

SEQ ID NO: 3145056 - RNA, 17 nt, Mycobacterium bovis subsp bovis AF2122/97
cgccgccggaucgccgg

SEQ ID NO: 3145057 - RNA, 13 nt, Mycobacterium bovis subsp bovis AF2122/97
cgccgccggcaac

SEQ ID NO: 3145058 - RNA, 13 nt, Mycobacterium bovis subsp bovis AF2122/97
cgccgccggcacc

SEQ ID NO: 3145059 - RNA, 16 nt, Mycobacterium bovis subsp bovis AF2122/97
cgccgccggcaccgcc

SEQ ID NO: 3145060 - RNA, 19 nt, Mycobacterium bovis subsp bovis AF2122/97
cgccgccggcaccgccggc

SEQ ID NO: 3145061 - RNA, 23 nt, Mycobacterium bovis subsp bovis AF2122/97
cgccgccggcaccggggcugccc

SEQ ID NO: 3145062 - RNA, 14 nt, Mycobacterium bovis subsp bovis AF2122/97
cgccgccggccccg

SEQ ID NO: 3145063 - RNA, 23 nt, Mycobacterium bovis subsp bovis AF2122/97
cgccgcggucggaccacccggcg

SEQ ID NO: 3145064 - RNA, 21 nt, Mycobacterium bovis subsp bovis AF2122/97
cgccgcggucgugaucagcag

SEQ ID NO: 3145065 - RNA, 18 nt, Mycobacterium bovis subsp bovis AF2122/97
cgccgcgguuaucgccga

SEQ ID NO: 3145066 - RNA, 20 nt, Mycobacterium bovis subsp bovis AF2122/97
cgccgcgguuuucgccggau

SEQ ID NO: 3145067 - RNA, 22 nt, Mycobacterium bovis subsp bovis AF2122/97
cgccgcguaccaauucccgcgc

SEQ ID NO: 3145068 - RNA, 23 nt, Mycobacterium bovis subsp bovis AF2122/97
cgccgcguccucgcccuggccgc

SEQ ID NO: 3145069 - RNA, 16 nt, Mycobacterium bovis subsp bovis AF2122/97
cgccgcgucuaccaac

SEQ ID NO: 3145070 - RNA, 20 nt, Mycobacterium bovis subsp bovis AF2122/97
cgccgcgugccgcaacgacu

SEQ ID NO: 3145071 - RNA, 19 nt, Mycobacterium bovis subsp bovis AF2122/97
cgccgcgugcugcggcugg

SEQ ID NO: 3145072 - RNA, 20 nt, Mycobacterium bovis subsp bovis AF2122/97
cgccgcguuuauaccucgcc

SEQ ID NO: 3145073 - RNA, 19 nt, Mycobacterium bovis subsp bovis AF2122/97
cgccgcguuucggucguug

SEQ ID NO: 3145074 - RNA, 20 nt, Mycobacterium bovis subsp bovis AF2122/97
cgccgcguuucggucguugg

SEQ ID NO: 3145075 - RNA, 18 nt, Mycobacterium bovis subsp bovis AF2122/97
cgccgcuaacgcaccugc

SEQ ID NO: 3145076 - RNA, 20 nt, Mycobacterium bovis subsp bovis AF2122/97
cgccgcuaacgcaccugcgc

SEQ ID NO: 3145077 - RNA, 19 nt, Mycobacterium bovis subsp bovis AF2122/97
cgccgcuaccccagccggc

SEQ ID NO: 3145078 - RNA, 20 nt, Mycobacterium bovis subsp bovis AF2122/97
cgccgcuaccccagccggca

SEQ ID NO: 3145079 - RNA, 16 nt, Mycobacterium bovis subsp bovis AF2122/97
cgccgcuacccccgau

SEQ ID NO: 3145080 - RNA, 23 nt, Mycobacterium bovis subsp bovis AF2122/97
cgccgcuacccggacagggcggc

SEQ ID NO: 3145081 - RNA, 23 nt, Mycobacterium bovis subsp bovis AF2122/97
cgccgcuaccgcccgcgccaccg

SEQ ID NO: 3145082 - RNA, 14 nt, Mycobacterium bovis subsp bovis AF2122/97
cgccgcuaccgccg

SEQ ID NO: 3145083 - RNA, 13 nt, Mycobacterium bovis subsp bovis AF2122/97
cgccgcuacgccg

SEQ ID NO: 3145084 - RNA, 14 nt, Mycobacterium bovis subsp bovis AF2122/97
cgccgcuacgccgg

SEQ ID NO: 3145085 - RNA, 15 nt, Mycobacterium bovis subsp bovis AF2122/97
cgccgcuacgccggc

SEQ ID NO: 3145086 - RNA, 24 nt, Mycobacterium bovis subsp bovis AF2122/97
cgccgcuaugaggcagucguugau

SEQ ID NO: 3145087 - RNA, 17 nt, Mycobacterium bovis subsp bovis AF2122/97
cgccgcucauccagcgc

SEQ ID NO: 3145088 - RNA, 21 nt, Mycobacterium bovis subsp bovis AF2122/97
cgccgcucauccagcgcgugg

SEQ ID NO: 3145089 - RNA, 21 nt, Mycobacterium bovis subsp bovis AF2122/97
cgccgcucccucuacacccgg

SEQ ID NO: 3145090 - RNA, 16 nt, Mycobacterium bovis subsp bovis AF2122/97
cgccgcucgguccccg

SEQ ID NO: 3145091 - RNA, 20 nt, Mycobacterium bovis subsp bovis AF2122/97
cgccgcucgguccccgcagc

SEQ ID NO: 3145092 - RNA, 19 nt, Mycobacterium bovis subsp bovis AF2122/97
cgccgcugacuccugcggc

SEQ ID NO: 3145093 - RNA, 22 nt, Mycobacterium bovis subsp bovis AF2122/97
cgccgcugacuccugcggcacc

SEQ ID NO: 3145094 - RNA, 14 nt, Mycobacterium bovis subsp bovis AF2122/97
cgccgcugccgauc

SEQ ID NO: 3145095 - RNA, 12 nt, Mycobacterium bovis subsp bovis AF2122/97
cgccgcugccgc

SEQ ID NO: 3145096 - RNA, 13 nt, Mycobacterium bovis subsp bovis AF2122/97
cgccgcugccgcc

SEQ ID NO: 3145097 - RNA, 14 nt, Mycobacterium bovis subsp bovis AF2122/97
cgccgcugccgccc

SEQ ID NO: 3145098 - RNA, 18 nt, Mycobacterium bovis subsp bovis AF2122/97
cgccgcugccgccgagcu

SEQ ID NO: 3145099 - RNA, 19 nt, Mycobacterium bovis subsp bovis AF2122/97
cgccgcugccgccggugcc

SEQ ID NO: 3145100 - RNA, 17 nt, Mycobacterium bovis subsp bovis AF2122/97
cgccgcugccgcgcggc

SEQ ID NO: 3145101 - RNA, 21 nt, Mycobacterium bovis subsp bovis AF2122/97
cgccgcugccgguagcacagc

SEQ ID NO: 3145102 - RNA, 14 nt, Mycobacterium bovis subsp bovis AF2122/97
cgccgcugccggug

SEQ ID NO: 3145103 - RNA, 20 nt, Mycobacterium bovis subsp bovis AF2122/97
cgccgcugccgguggcggcg

SEQ ID NO: 3145104 - RNA, 21 nt, Mycobacterium bovis subsp bovis AF2122/97
cgccgcuggagaucacgccga

SEQ ID NO: 3145105 - RNA, 16 nt, Mycobacterium bovis subsp bovis AF2122/97
cgccgcuggccagcac

SEQ ID NO: 3145106 - RNA, 23 nt, Mycobacterium bovis subsp bovis AF2122/97
cgccgcuggccagcacaccgucg

SEQ ID NO: 3145107 - RNA, 13 nt, Mycobacterium bovis subsp bovis AF2122/97
cgccgcuggguga

SEQ ID NO: 3145108 - RNA, 19 nt, Mycobacterium bovis subsp bovis AF2122/97
cgccgcugggugaccagga

SEQ ID NO: 3145109 - RNA, 20 nt, Mycobacterium bovis subsp bovis AF2122/97
cgccgcugggugaccaggaa

SEQ ID NO: 3145110 - RNA, 21 nt, Mycobacterium bovis subsp bovis AF2122/97
cgccgcuguugaucgacaccg

SEQ ID NO: 3145111 - RNA, 14 nt, Mycobacterium bovis subsp bovis AF2122/97
cgccgcuucacccc

SEQ ID NO: 3145112 - RNA, 17 nt, Mycobacterium bovis subsp bovis AF2122/97
cgccgcuugacgcagcu

SEQ ID NO: 3145113 - RNA, 16 nt, Mycobacterium bovis subsp bovis AF2122/97
cgccgcuuggcccggc

SEQ ID NO: 3145114 - RNA, 22 nt, Mycobacterium bovis subsp bovis AF2122/97
cgccgcuuucuuggcgggcgcc

SEQ ID NO: 3145115 - RNA, 16 nt, Mycobacterium bovis subsp bovis AF2122/97
cgccggaaagcccguc

SEQ ID NO: 3145116 - RNA, 21 nt, Mycobacterium bovis subsp bovis AF2122/97
cgccggaaagcccgucgucgg

SEQ ID NO: 3145117 - RNA, 16 nt, Mycobacterium bovis subsp bovis AF2122/97
cgccggaacgagcggc

SEQ ID NO: 3145118 - RNA, 18 nt, Mycobacterium bovis subsp bovis AF2122/97
cgccggaacgagcggccg

SEQ ID NO: 3145119 - RNA, 20 nt, Mycobacterium bovis subsp bovis AF2122/97
cgccggaacgagcggccgcg

SEQ ID NO: 3145120 - RNA, 22 nt, Mycobacterium bovis subsp bovis AF2122/97
cgccggaacgagcggccgcgcg

SEQ ID NO: 3145121 - RNA, 15 nt, Mycobacterium bovis subsp bovis AF2122/97
cgccggaacugcgca

SEQ ID NO: 3145122 - RNA, 14 nt, Mycobacterium bovis subsp bovis AF2122/97
cgccggaagcgccg

SEQ ID NO: 3145123 - RNA, 18 nt, Mycobacterium bovis subsp bovis AF2122/97
cgccggaagcgccggccg

SEQ ID NO: 3145124 - RNA, 18 nt, Mycobacterium bovis subsp bovis AF2122/97
cgccggacagcgcaucca

SEQ ID NO: 3145125 - RNA, 14 nt, Mycobacterium bovis subsp bovis AF2122/97
cgccggaccagagc

SEQ ID NO: 3145126 - RNA, 19 nt, Mycobacterium bovis subsp bovis AF2122/97
cgccggaccagcuccugca

SEQ ID NO: 3145127 - RNA, 16 nt, Mycobacterium bovis subsp bovis AF2122/97
cgccggacccaccguc

SEQ ID NO: 3145128 - RNA, 18 nt, Mycobacterium bovis subsp bovis AF2122/97
cgccggacccaccgucac

SEQ ID NO: 3145129 - RNA, 20 nt, Mycobacterium bovis subsp bovis AF2122/97
cgccggacccgcccuugccg

SEQ ID NO: 3145130 - RNA, 23 nt, Mycobacterium bovis subsp bovis AF2122/97
cgccggacccgcccuugccgccg

SEQ ID NO: 3145131 - RNA, 20 nt, Mycobacterium bovis subsp bovis AF2122/97
cgccggacccgccggguccg

SEQ ID NO: 3145132 - RNA, 21 nt, Mycobacterium bovis subsp bovis AF2122/97
cgccggacccgccggguccgc

SEQ ID NO: 3145133 - RNA, 14 nt, Mycobacterium bovis subsp bovis AF2122/97
cgccggacccgucg

SEQ ID NO: 3145134 - RNA, 19 nt, Mycobacterium bovis subsp bovis AF2122/97
cgccggacccgucgagcag

SEQ ID NO: 3145135 - RNA, 20 nt, Mycobacterium bovis subsp bovis AF2122/97
cgccggacccgucgagcagc

SEQ ID NO: 3145136 - RNA, 19 nt, Mycobacterium bovis subsp bovis AF2122/97
cgccggaccgguguggcgc

SEQ ID NO: 3145137 - RNA, 23 nt, Mycobacterium bovis subsp bovis AF2122/97
cgccggacugcggcccgacccgg

SEQ ID NO: 3145138 - RNA, 23 nt, Mycobacterium bovis subsp bovis AF2122/97
cgccggagacccgggugcuguga

SEQ ID NO: 3145139 - RNA, 20 nt, Mycobacterium bovis subsp bovis AF2122/97
cgccggagaucgucgcguag

SEQ ID NO: 3145140 - RNA, 16 nt, Mycobacterium bovis subsp bovis AF2122/97
cgccggagccaacggc

SEQ ID NO: 3145141 - RNA, 20 nt, Mycobacterium bovis subsp bovis AF2122/97
cgccggagccaacggccaag

SEQ ID NO: 3145142 - RNA, 14 nt, Mycobacterium bovis subsp bovis AF2122/97
cgccggagccgccc

SEQ ID NO: 3145143 - RNA, 16 nt, Mycobacterium bovis subsp bovis AF2122/97
cgccggagccgcccaa

SEQ ID NO: 3145144 - RNA, 14 nt, Mycobacterium bovis subsp bovis AF2122/97
cgccggaggcaagc

SEQ ID NO: 3145145 - RNA, 16 nt, Mycobacterium bovis subsp bovis AF2122/97
cgccggaggcaagcaa

SEQ ID NO: 3145146 - RNA, 13 nt, Mycobacterium bovis subsp bovis AF2122/97
cgccggaggcggc

SEQ ID NO: 3145147 - RNA, 14 nt, Mycobacterium bovis subsp bovis AF2122/97
cgccggaggcggcg

SEQ ID NO: 3145148 - RNA, 21 nt, Mycobacterium bovis subsp bovis AF2122/97
cgccggagucgaacaucaccg

SEQ ID NO: 3145149 - RNA, 19 nt, Mycobacterium bovis subsp bovis AF2122/97
cgccggccccgccagcgcc

SEQ ID NO: 3145150 - RNA, 21 nt, Mycobacterium bovis subsp bovis AF2122/97
cgccggccccgccagcgccgc

SEQ ID NO: 3145151 - RNA, 22 nt, Mycobacterium bovis subsp bovis AF2122/97
cgccggccccgccagcgccgcc

SEQ ID NO: 3145152 - RNA, 23 nt, Mycobacterium bovis subsp bovis AF2122/97
cgccggccccgccagcgccgccg

SEQ ID NO: 3145153 - RNA, 15 nt, Mycobacterium bovis subsp bovis AF2122/97
cgccggccccgccga

SEQ ID NO: 3145154 - RNA, 17 nt, Mycobacterium bovis subsp bovis AF2122/97
cgccggccccgccgaug

SEQ ID NO: 3145155 - RNA, 21 nt, Mycobacterium bovis subsp bovis AF2122/97
cgccggccccgccgaugccgc

SEQ ID NO: 3145156 - RNA, 16 nt, Mycobacterium bovis subsp bovis AF2122/97
cgccggccccgccgcu

SEQ ID NO: 3145157 - RNA, 17 nt, Mycobacterium bovis subsp bovis AF2122/97
cgccggccccgccgcua

SEQ ID NO: 3145158 - RNA, 15 nt, Mycobacterium bovis subsp bovis AF2122/97
cgccggccccgccgg

SEQ ID NO: 3145159 - RNA, 18 nt, Mycobacterium bovis subsp bovis AF2122/97
cgccggccccgccggccc

SEQ ID NO: 3145160 - RNA, 20 nt, Mycobacterium bovis subsp bovis AF2122/97
cgccggccccgccggcgccg

SEQ ID NO: 3145161 - RNA, 20 nt, Mycobacterium bovis subsp bovis AF2122/97
cgccggccccgccgucaccg

SEQ ID NO: 3145162 - RNA, 17 nt, Mycobacterium bovis subsp bovis AF2122/97
cgccggccccgccgucg

SEQ ID NO: 3145163 - RNA, 18 nt, Mycobacterium bovis subsp bovis AF2122/97
cgccggccccgccgucgc

SEQ ID NO: 3145164 - RNA, 22 nt, Mycobacterium bovis subsp bovis AF2122/97
cgccggccccgccguuaccgcc

SEQ ID NO: 3145165 - RNA, 13 nt, Mycobacterium bovis subsp bovis AF2122/97
cgccggcccgacg

SEQ ID NO: 3145166 - RNA, 14 nt, Mycobacterium bovis subsp bovis AF2122/97
cgccggcccgcggg

SEQ ID NO: 3145167 - RNA, 17 nt, Mycobacterium bovis subsp bovis AF2122/97
cgccggccgaucggccg

SEQ ID NO: 3145168 - RNA, 17 nt, Mycobacterium bovis subsp bovis AF2122/97
cgccggccgcacgccgg

SEQ ID NO: 3145169 - RNA, 20 nt, Mycobacterium bovis subsp bovis AF2122/97
cgccggccgcacgccggcca

SEQ ID NO: 3145170 - RNA, 22 nt, Mycobacterium bovis subsp bovis AF2122/97
cgccggccgcacgccggccagc

SEQ ID NO: 3145171 - RNA, 13 nt, Mycobacterium bovis subsp bovis AF2122/97
cgccggccgccag

SEQ ID NO: 3145172 - RNA, 15 nt, Mycobacterium bovis subsp bovis AF2122/97
cgccggccgccagcg

SEQ ID NO: 3145173 - RNA, 15 nt, Mycobacterium bovis subsp bovis AF2122/97
cgccggccgcgcaga

SEQ ID NO: 3145174 - RNA, 13 nt, Mycobacterium bovis subsp bovis AF2122/97
cgccggccgcgcc

SEQ ID NO: 3145175 - RNA, 18 nt, Mycobacterium bovis subsp bovis AF2122/97
cgccggccgcgccggccc

SEQ ID NO: 3145176 - RNA, 13 nt, Mycobacterium bovis subsp bovis AF2122/97
cgccggccgcgcu

SEQ ID NO: 3145177 - RNA, 16 nt, Mycobacterium bovis subsp bovis AF2122/97
cgccggccgcggcggc

SEQ ID NO: 3145178 - RNA, 13 nt, Mycobacterium bovis subsp bovis AF2122/97
cgccggccgcggg

SEQ ID NO: 3145179 - RNA, 19 nt, Mycobacterium bovis subsp bovis AF2122/97
cgccggccgcgggcgcgca

SEQ ID NO: 3145180 - RNA, 20 nt, Mycobacterium bovis subsp bovis AF2122/97
cgccggccgcgggcgcgcag

SEQ ID NO: 3145181 - RNA, 18 nt, Mycobacterium bovis subsp bovis AF2122/97
cgccggccgcgugacgua

SEQ ID NO: 3145182 - RNA, 15 nt, Mycobacterium bovis subsp bovis AF2122/97
cgccggccgcugccu

SEQ ID NO: 3145183 - RNA, 12 nt, Mycobacterium bovis subsp bovis AF2122/97
cgccggccggca

SEQ ID NO: 3145184 - RNA, 14 nt, Mycobacterium bovis subsp bovis AF2122/97
cgccggccggcccg

SEQ ID NO: 3145185 - RNA, 13 nt, Mycobacterium bovis subsp bovis AF2122/97
cgccggccggcgc

SEQ ID NO: 3145186 - RNA, 14 nt, Mycobacterium bovis subsp bovis AF2122/97
cgccggccggcgca

SEQ ID NO: 3145187 - RNA, 18 nt, Mycobacterium bovis subsp bovis AF2122/97
cgccggccggcgcagugc

SEQ ID NO: 3145188 - RNA, 16 nt, Mycobacterium bovis subsp bovis AF2122/97
cgccggccggcgcggu

SEQ ID NO: 3145189 - RNA, 18 nt, Mycobacterium bovis subsp bovis AF2122/97
cgccggccgucgaucuuc

SEQ ID NO: 3145190 - RNA, 16 nt, Mycobacterium bovis subsp bovis AF2122/97
cgccggccgucggccg

SEQ ID NO: 3145191 - RNA, 14 nt, Mycobacterium bovis subsp bovis AF2122/97
cgccggccucgccg

SEQ ID NO: 3145192 - RNA, 18 nt, Mycobacterium bovis subsp bovis AF2122/97
cgccggccucgccggggc

SEQ ID NO: 3145193 - RNA, 19 nt, Mycobacterium bovis subsp bovis AF2122/97
cgccggccucgccggggca

SEQ ID NO: 3145194 - RNA, 17 nt, Mycobacterium bovis subsp bovis AF2122/97
cgccggccugcucggcg

SEQ ID NO: 3145195 - RNA, 14 nt, Mycobacterium bovis subsp bovis AF2122/97
cgccggccuggccg

SEQ ID NO: 3145196 - RNA, 19 nt, Mycobacterium bovis subsp bovis AF2122/97
cgccggccuggccgccaga

SEQ ID NO: 3145197 - RNA, 15 nt, Mycobacterium bovis subsp bovis AF2122/97
cgccggcgaacugau

SEQ ID NO: 3145198 - RNA, 20 nt, Mycobacterium bovis subsp bovis AF2122/97
cgccggcgaagcgugcgccg

SEQ ID NO: 3145199 - RNA, 22 nt, Mycobacterium bovis subsp bovis AF2122/97
cgccggcgaauccgcacagguc

SEQ ID NO: 3145200 - RNA, 12 nt, Mycobacterium bovis subsp bovis AF2122/97
cgccggcgaccc

SEQ ID NO: 3145201 - RNA, 15 nt, Mycobacterium bovis subsp bovis AF2122/97
cgccggcgacccggg

SEQ ID NO: 3145202 - RNA, 14 nt, Mycobacterium bovis subsp bovis AF2122/97
cgccggcgacggcg

SEQ ID NO: 3145203 - RNA, 14 nt, Mycobacterium bovis subsp bovis AF2122/97
cgccggcgacgggu

SEQ ID NO: 3145204 - RNA, 17 nt, Mycobacterium bovis subsp bovis AF2122/97
cgccggcgacgggucgg

SEQ ID NO: 3145205 - RNA, 16 nt, Mycobacterium bovis subsp bovis AF2122/97
cgccggcgacugcagc

SEQ ID NO: 3145206 - RNA, 19 nt, Mycobacterium bovis subsp bovis AF2122/97
cgccggcgccaagucucgg

SEQ ID NO: 3145207 - RNA, 15 nt, Mycobacterium bovis subsp bovis AF2122/97
cgccggcgccacccg

SEQ ID NO: 3145208 - RNA, 16 nt, Mycobacterium bovis subsp bovis AF2122/97
cgccggcgccacccgc

SEQ ID NO: 3145209 - RNA, 17 nt, Mycobacterium bovis subsp bovis AF2122/97
cgccggcgccacccgcg

SEQ ID NO: 3145210 - RNA, 18 nt, Mycobacterium bovis subsp bovis AF2122/97
cgccggcgccacccgcgc

SEQ ID NO: 3145211 - RNA, 22 nt, Mycobacterium bovis subsp bovis AF2122/97
cgccggcgccacccgcgccgcc

SEQ ID NO: 3145212 - RNA, 23 nt, Mycobacterium bovis subsp bovis AF2122/97
cgccggcgccacccgcgccgccc

SEQ ID NO: 3145213 - RNA, 14 nt, Mycobacterium bovis subsp bovis AF2122/97
cgccggcgccaccg

SEQ ID NO: 3145214 - RNA, 15 nt, Mycobacterium bovis subsp bovis AF2122/97
cgccggcgccaccgu

SEQ ID NO: 3145215 - RNA, 17 nt, Mycobacterium bovis subsp bovis AF2122/97
cgccggcgccaccgucg

SEQ ID NO: 3145216 - RNA, 20 nt, Mycobacterium bovis subsp bovis AF2122/97
cgccggcgccaccgucgccg

SEQ ID NO: 3145217 - RNA, 15 nt, Mycobacterium bovis subsp bovis AF2122/97
cgccggcgccagcag

SEQ ID NO: 3145218 - RNA, 16 nt, Mycobacterium bovis subsp bovis AF2122/97
cgccggcgccagcaga

SEQ ID NO: 3145219 - RNA, 16 nt, Mycobacterium bovis subsp bovis AF2122/97
cgccggcgccagcgcc

SEQ ID NO: 3145220 - RNA, 19 nt, Mycobacterium bovis subsp bovis AF2122/97
cgccggcgccagcgccgcc

SEQ ID NO: 3145221 - RNA, 22 nt, Mycobacterium bovis subsp bovis AF2122/97
cgccggcgccagcgccgccacc

SEQ ID NO: 3145222 - RNA, 15 nt, Mycobacterium bovis subsp bovis AF2122/97
cgccggcgcccaggc

SEQ ID NO: 3145223 - RNA, 18 nt, Mycobacterium bovis subsp bovis AF2122/97
cgccggcgcccaggccga

SEQ ID NO: 3145224 - RNA, 12 nt, Mycobacterium bovis subsp bovis AF2122/97
cgccggcgcccg

SEQ ID NO: 3145225 - RNA, 19 nt, Mycobacterium bovis subsp bovis AF2122/97
cgccggcgcccggggcggu

SEQ ID NO: 3145226 - RNA, 22 nt, Mycobacterium bovis subsp bovis AF2122/97
cgccggcgcccggggcgguggg

SEQ ID NO: 3145227 - RNA, 14 nt, Mycobacterium bovis subsp bovis AF2122/97
cgccggcgccgcca

SEQ ID NO: 3145228 - RNA, 15 nt, Mycobacterium bovis subsp bovis AF2122/97
cgccggcgccgccau

SEQ ID NO: 3145229 - RNA, 15 nt, Mycobacterium bovis subsp bovis AF2122/97
cgccggcgccgccca

SEQ ID NO: 3145230 - RNA, 14 nt, Mycobacterium bovis subsp bovis AF2122/97
cgccggcgccgccg

SEQ ID NO: 3145231 - RNA, 19 nt, Mycobacterium bovis subsp bovis AF2122/97
cgccggcgccgccgaugcc

SEQ ID NO: 3145232 - RNA, 16 nt, Mycobacterium bovis subsp bovis AF2122/97
cgccggcgccgccggc

SEQ ID NO: 3145233 - RNA, 22 nt, Mycobacterium bovis subsp bovis AF2122/97
cgccggcgccgccggcgccgcc

SEQ ID NO: 3145234 - RNA, 19 nt, Mycobacterium bovis subsp bovis AF2122/97
cgccggcgccgccggugcc

SEQ ID NO: 3145235 - RNA, 19 nt, Mycobacterium bovis subsp bovis AF2122/97
cgccggcgccgccguuccc

SEQ ID NO: 3145236 - RNA, 19 nt, Mycobacterium bovis subsp bovis AF2122/97
cgccggggcaaacgggguc

SEQ ID NO: 3145237 - RNA, 20 nt, Mycobacterium bovis subsp bovis AF2122/97
cgccggggccgccgaugcca

SEQ ID NO: 3145238 - RNA, 19 nt, Mycobacterium bovis subsp bovis AF2122/97
cgccggggccgcuggcggu

SEQ ID NO: 3145239 - RNA, 15 nt, Mycobacterium bovis subsp bovis AF2122/97
cgccgggggcgccgc

SEQ ID NO: 3145240 - RNA, 17 nt, Mycobacterium bovis subsp bovis AF2122/97
cgccgggggcgccgccg

SEQ ID NO: 3145241 - RNA, 13 nt, Mycobacterium bovis subsp bovis AF2122/97
cgccggggggcug

SEQ ID NO: 3145242 - RNA, 16 nt, Mycobacterium bovis subsp bovis AF2122/97
cgccgggguagacgcc

SEQ ID NO: 3145243 - RNA, 17 nt, Mycobacterium bovis subsp bovis AF2122/97
cgccgggguagacgccc

SEQ ID NO: 3145244 - RNA, 12 nt, Mycobacterium bovis subsp bovis AF2122/97
cgccgggucacg

SEQ ID NO: 3145245 - RNA, 14 nt, Mycobacterium bovis subsp bovis AF2122/97
cgccgggucagccc

SEQ ID NO: 3145246 - RNA, 15 nt, Mycobacterium bovis subsp bovis AF2122/97
cgccgggucagcccg

SEQ ID NO: 3145247 - RNA, 16 nt, Mycobacterium bovis subsp bovis AF2122/97
cgccgggucagcccgg

SEQ ID NO: 3145248 - RNA, 13 nt, Mycobacterium bovis subsp bovis AF2122/97
cgccggguccgcc

SEQ ID NO: 3145249 - RNA, 18 nt, Mycobacterium bovis subsp bovis AF2122/97
cgccggguccgccgggcc

SEQ ID NO: 3145250 - RNA, 21 nt, Mycobacterium bovis subsp bovis AF2122/97
cgccgggugaggcggugacga

SEQ ID NO: 3145251 - RNA, 14 nt, Mycobacterium bovis subsp bovis AF2122/97
cgccgggugcaggc

SEQ ID NO: 3145252 - RNA, 19 nt, Mycobacterium bovis subsp bovis AF2122/97
cgccgggugccgccacgug

SEQ ID NO: 3145253 - RNA, 15 nt, Mycobacterium bovis subsp bovis AF2122/97
cgccgggugcgccgu

SEQ ID NO: 3145254 - RNA, 18 nt, Mycobacterium bovis subsp bovis AF2122/97
cgccgggugcgccguugc

SEQ ID NO: 3145255 - RNA, 15 nt, Mycobacterium bovis subsp bovis AF2122/97
cgccgggugucggug

SEQ ID NO: 3145256 - RNA, 16 nt, Mycobacterium bovis subsp bovis AF2122/97
cgccgggugucggugg

SEQ ID NO: 3145257 - RNA, 16 nt, Mycobacterium bovis subsp bovis AF2122/97
cgccggguuggcgccg

SEQ ID NO: 3145258 - RNA, 20 nt, Mycobacterium bovis subsp bovis AF2122/97
cgccggguuggcgccggcca

SEQ ID NO: 3145259 - RNA, 22 nt, Mycobacterium bovis subsp bovis AF2122/97
cgccggguuggcgccggccagu

SEQ ID NO: 3145260 - RNA, 22 nt, Mycobacterium bovis subsp bovis AF2122/97
cgccggguuuauccagucgauc

SEQ ID NO: 3145261 - RNA, 20 nt, Mycobacterium bovis subsp bovis AF2122/97
cgccgguaacuguccgcccg

SEQ ID NO: 3145262 - RNA, 21 nt, Mycobacterium bovis subsp bovis AF2122/97
cgccgguaacuguccgcccgg

SEQ ID NO: 3145263 - RNA, 16 nt, Mycobacterium bovis subsp bovis AF2122/97
cgccgguaggcggcca

SEQ ID NO: 3145264 - RNA, 18 nt, Mycobacterium bovis subsp bovis AF2122/97
cgccgguaggcggccagc

SEQ ID NO: 3145265 - RNA, 20 nt, Mycobacterium bovis subsp bovis AF2122/97
cgccgguaggcggccagcgc

SEQ ID NO: 3145266 - RNA, 19 nt, Mycobacterium bovis subsp bovis AF2122/97
cgccgguaugccgaacggu

SEQ ID NO: 3145267 - RNA, 18 nt, Mycobacterium bovis subsp bovis AF2122/97
cgccggucaaacugccau

SEQ ID NO: 3145268 - RNA, 19 nt, Mycobacterium bovis subsp bovis AF2122/97
cgccggucaaacugccauc

SEQ ID NO: 3145269 - RNA, 17 nt, Mycobacterium bovis subsp bovis AF2122/97
cgccggucacgacgucc

SEQ ID NO: 3145270 - RNA, 22 nt, Mycobacterium bovis subsp bovis AF2122/97
cgccggucagcaauacggcggc

SEQ ID NO: 3145271 - RNA, 14 nt, Mycobacterium bovis subsp bovis AF2122/97
cgccggucagcgug

SEQ ID NO: 3145272 - RNA, 15 nt, Mycobacterium bovis subsp bovis AF2122/97
cgccggucaggccgc

SEQ ID NO: 3145273 - RNA, 18 nt, Mycobacterium bovis subsp bovis AF2122/97
cgccggucaggccgccgc

SEQ ID NO: 3145274 - RNA, 21 nt, Mycobacterium bovis subsp bovis AF2122/97
cgccggucaggccgccgcggc

SEQ ID NO: 3145275 - RNA, 14 nt, Mycobacterium bovis subsp bovis AF2122/97
cgccggucauccca

SEQ ID NO: 3145276 - RNA, 16 nt, Mycobacterium bovis subsp bovis AF2122/97
cgccggucaucccaag

SEQ ID NO: 3145277 - RNA, 17 nt, Mycobacterium bovis subsp bovis AF2122/97
cgccgguccccgccggc

SEQ ID NO: 3145278 - RNA, 18 nt, Mycobacterium bovis subsp bovis AF2122/97
cgccgguccccgccggcg

SEQ ID NO: 3145279 - RNA, 19 nt, Mycobacterium bovis subsp bovis AF2122/97
cgccgguccccgccggcgg

SEQ ID NO: 3145280 - RNA, 19 nt, Mycobacterium bovis subsp bovis AF2122/97
cgccgguccccucggugcc

SEQ ID NO: 3145281 - RNA, 15 nt, Mycobacterium bovis subsp bovis AF2122/97
cgccgguccucgucg

SEQ ID NO: 3145282 - RNA, 16 nt, Mycobacterium bovis subsp bovis AF2122/97
cgccgguccucgucgg

SEQ ID NO: 3145283 - RNA, 15 nt, Mycobacterium bovis subsp bovis AF2122/97
cgccggucgccgacg

SEQ ID NO: 3145284 - RNA, 16 nt, Mycobacterium bovis subsp bovis AF2122/97
cgccggucgccggcug

SEQ ID NO: 3145285 - RNA, 17 nt, Mycobacterium bovis subsp bovis AF2122/97
cgccggucgccggcugg

SEQ ID NO: 3145286 - RNA, 16 nt, Mycobacterium bovis subsp bovis AF2122/97
cgccggucggugcgga

SEQ ID NO: 3145287 - RNA, 13 nt, Mycobacterium bovis subsp bovis AF2122/97
cgccggucgucag

SEQ ID NO: 3145288 - RNA, 14 nt, Mycobacterium bovis subsp bovis AF2122/97
cgccggugacgacg

SEQ ID NO: 3145289 - RNA, 23 nt, Mycobacterium bovis subsp bovis AF2122/97
cgccggugacgggguugaccgcc

SEQ ID NO: 3145290 - RNA, 14 nt, Mycobacterium bovis subsp bovis AF2122/97
cgccggugaggcga

SEQ ID NO: 3145291 - RNA, 15 nt, Mycobacterium bovis subsp bovis AF2122/97
cgccggugaucggcg

SEQ ID NO: 3145292 - RNA, 16 nt, Mycobacterium bovis subsp bovis AF2122/97
cgccggugaucggcgg

SEQ ID NO: 3145293 - RNA, 18 nt, Mycobacterium bovis subsp bovis AF2122/97
cgccggugaucggcggca

SEQ ID NO: 3145294 - RNA, 23 nt, Mycobacterium bovis subsp bovis AF2122/97
cgccggugccacccuugccgccg

SEQ ID NO: 3145295 - RNA, 16 nt, Mycobacterium bovis subsp bovis AF2122/97
cgccggugccaccgac

SEQ ID NO: 3145296 - RNA, 17 nt, Mycobacterium bovis subsp bovis AF2122/97
cgccggugccaccgacg

SEQ ID NO: 3145297 - RNA, 19 nt, Mycobacterium bovis subsp bovis AF2122/97
cgccggugccaccgacgcc

SEQ ID NO: 3145298 - RNA, 18 nt, Mycobacterium bovis subsp bovis AF2122/97
cgccggugccaccggcug

SEQ ID NO: 3145299 - RNA, 19 nt, Mycobacterium bovis subsp bovis AF2122/97
cgccggugccaccggcugg

SEQ ID NO: 3145300 - RNA, 13 nt, Mycobacterium bovis subsp bovis AF2122/97
cgccggugccgau

SEQ ID NO: 3145301 - RNA, 15 nt, Mycobacterium bovis subsp bovis AF2122/97
cgccggugccgauga

SEQ ID NO: 3145302 - RNA, 19 nt, Mycobacterium bovis subsp bovis AF2122/97
cgccggugccgaugaccga

SEQ ID NO: 3145303 - RNA, 15 nt, Mycobacterium bovis subsp bovis AF2122/97
cgccggugccgccau

SEQ ID NO: 3145304 - RNA, 14 nt, Mycobacterium bovis subsp bovis AF2122/97
cgccggugccgccg

SEQ ID NO: 3145305 - RNA, 22 nt, Mycobacterium bovis subsp bovis AF2122/97
cgccggugccgccgauaccgcc

SEQ ID NO: 3145306 - RNA, 15 nt, Mycobacterium bovis subsp bovis AF2122/97
cgccggugccgccgc

SEQ ID NO: 3145307 - RNA, 21 nt, Mycobacterium bovis subsp bovis AF2122/97
cgccggugccgccggugccgc

SEQ ID NO: 3145308 - RNA, 23 nt, Mycobacterium bovis subsp bovis AF2122/97
cgccggugccgccggugccgcca

SEQ ID NO: 3145309 - RNA, 15 nt, Mycobacterium bovis subsp bovis AF2122/97
cgccggugccgccgu

SEQ ID NO: 3145310 - RNA, 19 nt, Mycobacterium bovis subsp bovis AF2122/97
cgccggugccgccgucgcc

SEQ ID NO: 3145311 - RNA, 22 nt, Mycobacterium bovis subsp bovis AF2122/97
cgccggugccgccugcgccgcc

SEQ ID NO: 3145312 - RNA, 23 nt, Mycobacterium bovis subsp bovis AF2122/97
cgccggugccgccugcgccgcca

SEQ ID NO: 3145313 - RNA, 14 nt, Mycobacterium bovis subsp bovis AF2122/97
cgccggugccggcc

SEQ ID NO: 3145314 - RNA, 22 nt, Mycobacterium bovis subsp bovis AF2122/97
cgccggugccggccagacucgc

SEQ ID NO: 3145315 - RNA, 21 nt, Mycobacterium bovis subsp bovis AF2122/97
cgccggugcgcaacuucgacu

SEQ ID NO: 3145316 - RNA, 21 nt, Mycobacterium bovis subsp bovis AF2122/97
cgccggugcggacuucgaugu

SEQ ID NO: 3145317 - RNA, 22 nt, Mycobacterium bovis subsp bovis AF2122/97
cgccggugcggccaaugacguc

SEQ ID NO: 3145318 - RNA, 13 nt, Mycobacterium bovis subsp bovis AF2122/97
cgccgguggcacg

SEQ ID NO: 3145319 - RNA, 17 nt, Mycobacterium bovis subsp bovis AF2122/97
cgccgguggcacggccc

SEQ ID NO: 3145320 - RNA, 19 nt, Mycobacterium bovis subsp bovis AF2122/97
cgccgguggcacggccccu

SEQ ID NO: 3145321 - RNA, 16 nt, Mycobacterium bovis subsp bovis AF2122/97
cgccgguggccgcgcu

SEQ ID NO: 3145322 - RNA, 14 nt, Mycobacterium bovis subsp bovis AF2122/97
cgccgucgacgucg

SEQ ID NO: 3145323 - RNA, 18 nt, Mycobacterium bovis subsp bovis AF2122/97
cgccgucgagcacgguga

SEQ ID NO: 3145324 - RNA, 13 nt, Mycobacterium bovis subsp bovis AF2122/97
cgccgucgccacc

SEQ ID NO: 3145325 - RNA, 14 nt, Mycobacterium bovis subsp bovis AF2122/97
cgccgucgccaccg

SEQ ID NO: 3145326 - RNA, 15 nt, Mycobacterium bovis subsp bovis AF2122/97
cgccgucgccaccgg

SEQ ID NO: 3145327 - RNA, 16 nt, Mycobacterium bovis subsp bovis AF2122/97
cgccgucgccaccggu

SEQ ID NO: 3145328 - RNA, 20 nt, Mycobacterium bovis subsp bovis AF2122/97
cgccgucgccaccgguaccg

SEQ ID NO: 3145329 - RNA, 13 nt, Mycobacterium bovis subsp bovis AF2122/97
cgccgucgccgcc

SEQ ID NO: 3145330 - RNA, 15 nt, Mycobacterium bovis subsp bovis AF2122/97
cgccgucgccgccgg

SEQ ID NO: 3145331 - RNA, 16 nt, Mycobacterium bovis subsp bovis AF2122/97
cgccgucgccgccggc

SEQ ID NO: 3145332 - RNA, 17 nt, Mycobacterium bovis subsp bovis AF2122/97
cgccgucgccgccggcg

SEQ ID NO: 3145333 - RNA, 23 nt, Mycobacterium bovis subsp bovis AF2122/97
cgccgucgcuagggugagcccgg

SEQ ID NO: 3145334 - RNA, 15 nt, Mycobacterium bovis subsp bovis AF2122/97
cgccgucggacaccg

SEQ ID NO: 3145335 - RNA, 22 nt, Mycobacterium bovis subsp bovis AF2122/97
cgccgucggagccggccaccuc

SEQ ID NO: 3145336 - RNA, 13 nt, Mycobacterium bovis subsp bovis AF2122/97
cgccgucggcgac

SEQ ID NO: 3145337 - RNA, 20 nt, Mycobacterium bovis subsp bovis AF2122/97
cgccgucggcgacuccucuc

SEQ ID NO: 3145338 - RNA, 15 nt, Mycobacterium bovis subsp bovis AF2122/97
cgccgucggcgauga

SEQ ID NO: 3145339 - RNA, 12 nt, Mycobacterium bovis subsp bovis AF2122/97
cgccgucggcgc

SEQ ID NO: 3145340 - RNA, 13 nt, Mycobacterium bovis subsp bovis AF2122/97
cgccgucggcgcc

SEQ ID NO: 3145341 - RNA, 16 nt, Mycobacterium bovis subsp bovis AF2122/97
cgccgucggcgcgcac

SEQ ID NO: 3145342 - RNA, 17 nt, Mycobacterium bovis subsp bovis AF2122/97
cgccgucggcggugagc

SEQ ID NO: 3145343 - RNA, 16 nt, Mycobacterium bovis subsp bovis AF2122/97
cgccgucggugccgcc

SEQ ID NO: 3145344 - RNA, 22 nt, Mycobacterium bovis subsp bovis AF2122/97
cgccgucggugggugccagccg

SEQ ID NO: 3145345 - RNA, 14 nt, Mycobacterium bovis subsp bovis AF2122/97
cgccgucgucagcg

SEQ ID NO: 3145346 - RNA, 19 nt, Mycobacterium bovis subsp bovis AF2122/97
cgccgucgucgaccacgac

SEQ ID NO: 3145347 - RNA, 20 nt, Mycobacterium bovis subsp bovis AF2122/97
cgccgucgucgaccacgacg

SEQ ID NO: 3145348 - RNA, 14 nt, Mycobacterium bovis subsp bovis AF2122/97
cgccgucgucgcgc

SEQ ID NO: 3145349 - RNA, 16 nt, Mycobacterium bovis subsp bovis AF2122/97
cgccgucgucgcgcag

SEQ ID NO: 3145350 - RNA, 17 nt, Mycobacterium bovis subsp bovis AF2122/97
cgccgucgugccaccgu

SEQ ID NO: 3145351 - RNA, 22 nt, Mycobacterium bovis subsp bovis AF2122/97
cgccgucguugcccgacccgcc

SEQ ID NO: 3145352 - RNA, 20 nt, Mycobacterium bovis subsp bovis AF2122/97
cgccgucguugugccggucg

SEQ ID NO: 3145353 - RNA, 21 nt, Mycobacterium bovis subsp bovis AF2122/97
cgccgucguugugccggucga

SEQ ID NO: 3145354 - RNA, 20 nt, Mycobacterium bovis subsp bovis AF2122/97
cgccgucuagcacacgcuug

SEQ ID NO: 3145355 - RNA, 15 nt, Mycobacterium bovis subsp bovis AF2122/97
cgccgucucgaagcu

SEQ ID NO: 3145356 - RNA, 14 nt, Mycobacterium bovis subsp bovis AF2122/97
cgccgucucgaucg

SEQ ID NO: 3145357 - RNA, 15 nt, Mycobacterium bovis subsp bovis AF2122/97
cgccgucucgaucgc

SEQ ID NO: 3145358 - RNA, 15 nt, Mycobacterium bovis subsp bovis AF2122/97
cgccgucucgcggug

SEQ ID NO: 3145359 - RNA, 16 nt, Mycobacterium bovis subsp bovis AF2122/97
cgccgucucgcggugc

SEQ ID NO: 3145360 - RNA, 17 nt, Mycobacterium bovis subsp bovis AF2122/97
cgccgucucgcggugcg

SEQ ID NO: 3145361 - RNA, 21 nt, Mycobacterium bovis subsp bovis AF2122/97
cgccgucucgcggugcggcaa

SEQ ID NO: 3145362 - RNA, 16 nt, Mycobacterium bovis subsp bovis AF2122/97
cgccgucucugccacg

SEQ ID NO: 3145363 - RNA, 18 nt, Mycobacterium bovis subsp bovis AF2122/97
cgccgucucugccacgcg

SEQ ID NO: 3145364 - RNA, 19 nt, Mycobacterium bovis subsp bovis AF2122/97
cgccgucuuggcccggucc

SEQ ID NO: 3145365 - RNA, 22 nt, Mycobacterium bovis subsp bovis AF2122/97
cgccgucuuggcccgguccgcc

SEQ ID NO: 3145366 - RNA, 23 nt, Mycobacterium bovis subsp bovis AF2122/97
cgccgucuuggcccgguccgcca

SEQ ID NO: 3145367 - RNA, 17 nt, Mycobacterium bovis subsp bovis AF2122/97
cgccgugaccaggugcc

SEQ ID NO: 3145368 - RNA, 20 nt, Mycobacterium bovis subsp bovis AF2122/97
cgccgugaccaggugccagg

SEQ ID NO: 3145369 - RNA, 22 nt, Mycobacterium bovis subsp bovis AF2122/97
cgccgugacccauucucggccg

SEQ ID NO: 3145370 - RNA, 23 nt, Mycobacterium bovis subsp bovis AF2122/97
cgccgugaguagguccacguucg

SEQ ID NO: 3145371 - RNA, 19 nt, Mycobacterium bovis subsp bovis AF2122/97
cgccgugaguucacguucg

SEQ ID NO: 3145372 - RNA, 22 nt, Mycobacterium bovis subsp bovis AF2122/97
cgccgugaguucacguucggcg

SEQ ID NO: 3145373 - RNA, 17 nt, Mycobacterium bovis subsp bovis AF2122/97
cgccgugaucagcucgc

SEQ ID NO: 3145374 - RNA, 18 nt, Mycobacterium bovis subsp bovis AF2122/97
cgccgugaucagcucgcg

SEQ ID NO: 3145375 - RNA, 20 nt, Mycobacterium bovis subsp bovis AF2122/97
cgccgugaucagcucgcgca

SEQ ID NO: 3145376 - RNA, 21 nt, Mycobacterium bovis subsp bovis AF2122/97
cgccgugaucagcucgcgcac

SEQ ID NO: 3145377 - RNA, 16 nt, Mycobacterium bovis subsp bovis AF2122/97
cgccgugccgcggcga

SEQ ID NO: 3145378 - RNA, 20 nt, Mycobacterium bovis subsp bovis AF2122/97
cgccgugccguacgcccagg

SEQ ID NO: 3145379 - RNA, 20 nt, Mycobacterium bovis subsp bovis AF2122/97
cgccgugcgccgugcgaucg

SEQ ID NO: 3145380 - RNA, 13 nt, Mycobacterium bovis subsp bovis AF2122/97
cgccgugcggguu

SEQ ID NO: 3145381 - RNA, 17 nt, Mycobacterium bovis subsp bovis AF2122/97
cgccguggauacgcacg

SEQ ID NO: 3145382 - RNA, 18 nt, Mycobacterium bovis subsp bovis AF2122/97
cgccguggaucaucccga

SEQ ID NO: 3145383 - RNA, 20 nt, Mycobacterium bovis subsp bovis AF2122/97
cgccguggcaucgccuccag

SEQ ID NO: 3145384 - RNA, 13 nt, Mycobacterium bovis subsp bovis AF2122/97
cgccguggcccgc

SEQ ID NO: 3145385 - RNA, 14 nt, Mycobacterium bovis subsp bovis AF2122/97
cgccguggcccgcu

SEQ ID NO: 3145386 - RNA, 20 nt, Mycobacterium bovis subsp bovis AF2122/97
cgccguggcccgcucccugc

SEQ ID NO: 3145387 - RNA, 14 nt, Mycobacterium bovis subsp bovis AF2122/97
cgccguggccugaa

SEQ ID NO: 3145388 - RNA, 16 nt, Mycobacterium bovis subsp bovis AF2122/97
cgccguggcgucggug

SEQ ID NO: 3145389 - RNA, 17 nt, Mycobacterium bovis subsp bovis AF2122/97
cgccguggcgucggugg

SEQ ID NO: 3145390 - RNA, 21 nt, Mycobacterium bovis subsp bovis AF2122/97
cgccgugggccuguugcugcc

SEQ ID NO: 3145391 - RNA, 15 nt, Mycobacterium bovis subsp bovis AF2122/97
cgccguggguguuga

SEQ ID NO: 3145392 - RNA, 20 nt, Mycobacterium bovis subsp bovis AF2122/97
cgccgugguugcacguucgg

SEQ ID NO: 3145393 - RNA, 22 nt, Mycobacterium bovis subsp bovis AF2122/97
cgccgugguugcacguucggcg

SEQ ID NO: 3145394 - RNA, 17 nt, Mycobacterium bovis subsp bovis AF2122/97
cgccgugugcaucggcg

SEQ ID NO: 3145395 - RNA, 16 nt, Mycobacterium bovis subsp bovis AF2122/97
cgccguuaccgccgcu

SEQ ID NO: 3145396 - RNA, 15 nt, Mycobacterium bovis subsp bovis AF2122/97
cgccguuaccgccgu

SEQ ID NO: 3145397 - RNA, 18 nt, Mycobacterium bovis subsp bovis AF2122/97
cgccguuaccgccguugc

SEQ ID NO: 3145398 - RNA, 22 nt, Mycobacterium bovis subsp bovis AF2122/97
cgccguuacggagggcacgggu

SEQ ID NO: 3145399 - RNA, 15 nt, Mycobacterium bovis subsp bovis AF2122/97
cgccguucacccugg

SEQ ID NO: 3145400 - RNA, 18 nt, Mycobacterium bovis subsp bovis AF2122/97
cgccguucccaccaccac

SEQ ID NO: 3145401 - RNA, 20 nt, Mycobacterium bovis subsp bovis AF2122/97
cgccguucccaccaccaccg

SEQ ID NO: 3145402 - RNA, 17 nt, Mycobacterium bovis subsp bovis AF2122/97
cgccguucccacccacg

SEQ ID NO: 3145403 - RNA, 18 nt, Mycobacterium bovis subsp bovis AF2122/97
cgccguucccacccacgc

SEQ ID NO: 3145404 - RNA, 18 nt, Mycobacterium bovis subsp bovis AF2122/97
cgccguucccgccggcgc

SEQ ID NO: 3145405 - RNA, 20 nt, Mycobacterium bovis subsp bovis AF2122/97
cgccguucccgccggcgccg

SEQ ID NO: 3145406 - RNA, 22 nt, Mycobacterium bovis subsp bovis AF2122/97
cgccguucgcucccccgcuacg

SEQ ID NO: 3145407 - RNA, 15 nt, Mycobacterium bovis subsp bovis AF2122/97
cgccguucgggaugc

SEQ ID NO: 3145408 - RNA, 13 nt, Mycobacterium bovis subsp bovis AF2122/97
cgccuccucgacg

SEQ ID NO: 3145409 - RNA, 14 nt, Mycobacterium bovis subsp bovis AF2122/97
cgccuccucgacgu

SEQ ID NO: 3145410 - RNA, 16 nt, Mycobacterium bovis subsp bovis AF2122/97
cgccuccucgacgucg

SEQ ID NO: 3145411 - RNA, 13 nt, Mycobacterium bovis subsp bovis AF2122/97
cgccuccucgaua

SEQ ID NO: 3145412 - RNA, 22 nt, Mycobacterium bovis subsp bovis AF2122/97
cgccuccucgugcaggaccagc

SEQ ID NO: 3145413 - RNA, 16 nt, Mycobacterium bovis subsp bovis AF2122/97
cgccuccugccgccgc

SEQ ID NO: 3145414 - RNA, 17 nt, Mycobacterium bovis subsp bovis AF2122/97
cgccuccugccgccgcu

SEQ ID NO: 3145415 - RNA, 20 nt, Mycobacterium bovis subsp bovis AF2122/97
cgccuccugcggguagaugu

SEQ ID NO: 3145416 - RNA, 20 nt, Mycobacterium bovis subsp bovis AF2122/97
cgccucgaauugguaaugca

SEQ ID NO: 3145417 - RNA, 15 nt, Mycobacterium bovis subsp bovis AF2122/97
cgccucgacacccag

SEQ ID NO: 3145418 - RNA, 17 nt, Mycobacterium bovis subsp bovis AF2122/97
cgccucgacacccagcc

SEQ ID NO: 3145419 - RNA, 19 nt, Mycobacterium bovis subsp bovis AF2122/97
cgccucgacacccagccgc

SEQ ID NO: 3145420 - RNA, 16 nt, Mycobacterium bovis subsp bovis AF2122/97
cgccucgaccgccagc

SEQ ID NO: 3145421 - RNA, 14 nt, Mycobacterium bovis subsp bovis AF2122/97
cgccucgagcaacg

SEQ ID NO: 3145422 - RNA, 19 nt, Mycobacterium bovis subsp bovis AF2122/97
cgccucgagcaacggacga

SEQ ID NO: 3145423 - RNA, 17 nt, Mycobacterium bovis subsp bovis AF2122/97
cgccucgaggaccacca

SEQ ID NO: 3145424 - RNA, 19 nt, Mycobacterium bovis subsp bovis AF2122/97
cgccucgaggaccaccacu

SEQ ID NO: 3145425 - RNA, 23 nt, Mycobacterium bovis subsp bovis AF2122/97
cgccucgagguauucgcgcagca

SEQ ID NO: 3145426 - RNA, 17 nt, Mycobacterium bovis subsp bovis AF2122/97
cgccucgauggcggugg

SEQ ID NO: 3145427 - RNA, 20 nt, Mycobacterium bovis subsp bovis AF2122/97
cgccucgauggcgguggcga

SEQ ID NO: 3145428 - RNA, 23 nt, Mycobacterium bovis subsp bovis AF2122/97
cgccucgauggcgguggcgaggu

SEQ ID NO: 3145429 - RNA, 23 nt, Mycobacterium bovis subsp bovis AF2122/97
cgccucgaugguuuucucgaagu

SEQ ID NO: 3145430 - RNA, 13 nt, Mycobacterium bovis subsp bovis AF2122/97
cgccucgcccagc

SEQ ID NO: 3145431 - RNA, 17 nt, Mycobacterium bovis subsp bovis AF2122/97
cgccucgcccagcaagg

SEQ ID NO: 3145432 - RNA, 20 nt, Mycobacterium bovis subsp bovis AF2122/97
cgccucgcccagcaaggccc

SEQ ID NO: 3145433 - RNA, 13 nt, Mycobacterium bovis subsp bovis AF2122/97
cgccucgccgaag

SEQ ID NO: 3145434 - RNA, 13 nt, Mycobacterium bovis subsp bovis AF2122/97
cgccucgccggcc

SEQ ID NO: 3145435 - RNA, 15 nt, Mycobacterium bovis subsp bovis AF2122/97
cgccucgccggccac

SEQ ID NO: 3145436 - RNA, 16 nt, Mycobacterium bovis subsp bovis AF2122/97
cgccucgccggccacc

SEQ ID NO: 3145437 - RNA, 19 nt, Mycobacterium bovis subsp bovis AF2122/97
cgccucgccggccaccagc

SEQ ID NO: 3145438 - RNA, 19 nt, Mycobacterium bovis subsp bovis AF2122/97
cgccucgccggccacccgc

SEQ ID NO: 3145439 - RNA, 23 nt, Mycobacterium bovis subsp bovis AF2122/97
cgccucgccggccacccgcgcga

SEQ ID NO: 3145440 - RNA, 19 nt, Mycobacterium bovis subsp bovis AF2122/97
cgccucggacacggcagcc

SEQ ID NO: 3145441 - RNA, 17 nt, Mycobacterium bovis subsp bovis AF2122/97
cgccucggaccagaccc

SEQ ID NO: 3145442 - RNA, 19 nt, Mycobacterium bovis subsp bovis AF2122/97
cgccucggcaucgccgcgg

SEQ ID NO: 3145443 - RNA, 20 nt, Mycobacterium bovis subsp bovis AF2122/97
cgccucggcaucgccgcggg

SEQ ID NO: 3145444 - RNA, 21 nt, Mycobacterium bovis subsp bovis AF2122/97
cgccucggcgcugcgcaccgc

SEQ ID NO: 3145445 - RNA, 14 nt, Mycobacterium bovis subsp bovis AF2122/97
cgccucggcggcca

SEQ ID NO: 3145446 - RNA, 17 nt, Mycobacterium bovis subsp bovis AF2122/97
cgccucggcggccagcu

SEQ ID NO: 3145447 - RNA, 19 nt, Mycobacterium bovis subsp bovis AF2122/97
cgccucggcggccagcucg

SEQ ID NO: 3145448 - RNA, 17 nt, Mycobacterium bovis subsp bovis AF2122/97
cgccucggcguaggcga

SEQ ID NO: 3145449 - RNA, 22 nt, Mycobacterium bovis subsp bovis AF2122/97
cgccucgggaggcagcgcgagg

SEQ ID NO: 3145450 - RNA, 14 nt, Mycobacterium bovis subsp bovis AF2122/97
cgccucgggcaccu

SEQ ID NO: 3145451 - RNA, 13 nt, Mycobacterium bovis subsp bovis AF2122/97
cgccucgggccgg

SEQ ID NO: 3145452 - RNA, 16 nt, Mycobacterium bovis subsp bovis AF2122/97
cgccucgggccggcgu

SEQ ID NO: 3145453 - RNA, 17 nt, Mycobacterium bovis subsp bovis AF2122/97
cgccucgggugcauucu

SEQ ID NO: 3145454 - RNA, 23 nt, Mycobacterium bovis subsp bovis AF2122/97
cgccucgguggucuuggcccggc

SEQ ID NO: 3145455 - RNA, 12 nt, Mycobacterium bovis subsp bovis AF2122/97
cgccucgugcgu

SEQ ID NO: 3145456 - RNA, 16 nt, Mycobacterium bovis subsp bovis AF2122/97
cgccucucgguccaca

SEQ ID NO: 3145457 - RNA, 16 nt, Mycobacterium bovis subsp bovis AF2122/97
cgccucugcgaucagu

SEQ ID NO: 3145458 - RNA, 16 nt, Mycobacterium bovis subsp bovis AF2122/97
cgccucugcucagccg

SEQ ID NO: 3145459 - RNA, 14 nt, Mycobacterium bovis subsp bovis AF2122/97
cgccucuuccuggc

SEQ ID NO: 3145460 - RNA, 21 nt, Mycobacterium bovis subsp bovis AF2122/97
cgccugaaacgauugcugcgg

SEQ ID NO: 3145461 - RNA, 16 nt, Mycobacterium bovis subsp bovis AF2122/97
cgccugaacgacccgc

SEQ ID NO: 3145462 - RNA, 22 nt, Mycobacterium bovis subsp bovis AF2122/97
cgccugaauaggucgguccgca

SEQ ID NO: 3145463 - RNA, 14 nt, Mycobacterium bovis subsp bovis AF2122/97
cgccugaccgccac

SEQ ID NO: 3145464 - RNA, 21 nt, Mycobacterium bovis subsp bovis AF2122/97
cgccugacgaaguccaccacg

SEQ ID NO: 3145465 - RNA, 20 nt, Mycobacterium bovis subsp bovis AF2122/97
cgccugacgguaaaugucga

SEQ ID NO: 3145466 - RNA, 14 nt, Mycobacterium bovis subsp bovis AF2122/97
cgccugagccacca

SEQ ID NO: 3145467 - RNA, 15 nt, Mycobacterium bovis subsp bovis AF2122/97
cgccugagccaccaa

SEQ ID NO: 3145468 - RNA, 19 nt, Mycobacterium bovis subsp bovis AF2122/97
cgccugagccaccaacacc

SEQ ID NO: 3145469 - RNA, 13 nt, Mycobacterium bovis subsp bovis AF2122/97
cgccugagcgcuc

SEQ ID NO: 3145470 - RNA, 20 nt, Mycobacterium bovis subsp bovis AF2122/97
cgccugagcggccucgggac

SEQ ID NO: 3145471 - RNA, 16 nt, Mycobacterium bovis subsp bovis AF2122/97
cgccugauaggccuga

SEQ ID NO: 3145472 - RNA, 22 nt, Mycobacterium bovis subsp bovis AF2122/97
cgccugauaugacuugcgcgcg

SEQ ID NO: 3145473 - RNA, 15 nt, Mycobacterium bovis subsp bovis AF2122/97
cgccugaugcggccg

SEQ ID NO: 3145474 - RNA, 16 nt, Mycobacterium bovis subsp bovis AF2122/97
cgccugaugcggccgg

SEQ ID NO: 3145475 - RNA, 18 nt, Mycobacterium bovis subsp bovis AF2122/97
cgccugaugcggccggcg

SEQ ID NO: 3145476 - RNA, 19 nt, Mycobacterium bovis subsp bovis AF2122/97
cgccugcaacauccccaug

SEQ ID NO: 3145477 - RNA, 21 nt, Mycobacterium bovis subsp bovis AF2122/97
cgccugcaagcuaagcgccug

SEQ ID NO: 3145478 - RNA, 13 nt, Mycobacterium bovis subsp bovis AF2122/97
cgccugcacccgg

SEQ ID NO: 3145479 - RNA, 14 nt, Mycobacterium bovis subsp bovis AF2122/97
cgccugcacccggc

SEQ ID NO: 3145480 - RNA, 14 nt, Mycobacterium bovis subsp bovis AF2122/97
cgccugcaccgccg

SEQ ID NO: 3145481 - RNA, 15 nt, Mycobacterium bovis subsp bovis AF2122/97
cgccugcaccgccgc

SEQ ID NO: 3145482 - RNA, 17 nt, Mycobacterium bovis subsp bovis AF2122/97
cgccugcaccgccgccg

SEQ ID NO: 3145483 - RNA, 18 nt, Mycobacterium bovis subsp bovis AF2122/97
cgccugcaccgccgccgc

SEQ ID NO: 3145484 - RNA, 21 nt, Mycobacterium bovis subsp bovis AF2122/97
cgccugcaccgccgccgcccg

SEQ ID NO: 3145485 - RNA, 22 nt, Mycobacterium bovis subsp bovis AF2122/97
cgccugcaccgccgccgcccgu

SEQ ID NO: 3145486 - RNA, 22 nt, Mycobacterium bovis subsp bovis AF2122/97
cgccugcagguuuccggccugc

SEQ ID NO: 3145487 - RNA, 23 nt, Mycobacterium bovis subsp bovis AF2122/97
cgccugcagguuuccggccugca

SEQ ID NO: 3145488 - RNA, 12 nt, Mycobacterium bovis subsp bovis AF2122/97
cgccugccaccg

SEQ ID NO: 3145489 - RNA, 15 nt, Mycobacterium bovis subsp bovis AF2122/97
cgccugccaccggcg

SEQ ID NO: 3145490 - RNA, 16 nt, Mycobacterium bovis subsp bovis AF2122/97
cgccugccaccggcgc

SEQ ID NO: 3145491 - RNA, 19 nt, Mycobacterium bovis subsp bovis AF2122/97
cgccugccaucacgcgcuc

SEQ ID NO: 3145492 - RNA, 23 nt, Mycobacterium bovis subsp bovis AF2122/97
cgccugccaucacgcgcucaccg

SEQ ID NO: 3145493 - RNA, 21 nt, Mycobacterium bovis subsp bovis AF2122/97
cgccugcccccgcgcgcacgg

SEQ ID NO: 3145494 - RNA, 17 nt, Mycobacterium bovis subsp bovis AF2122/97
cgccuuggucgccgcuu

SEQ ID NO: 3145495 - RNA, 21 nt, Mycobacterium bovis subsp bovis AF2122/97
cgccuuggucgccgcuuucuu

SEQ ID NO: 3145496 - RNA, 18 nt, Mycobacterium bovis subsp bovis AF2122/97
cgccuuggucgccggcgu

SEQ ID NO: 3145497 - RNA, 13 nt, Mycobacterium bovis subsp bovis AF2122/97
cgccuuggucgcg

SEQ ID NO: 3145498 - RNA, 14 nt, Mycobacterium bovis subsp bovis AF2122/97
cgccuugucgaucu

SEQ ID NO: 3145499 - RNA, 14 nt, Mycobacterium bovis subsp bovis AF2122/97
cgccuugucggcga

SEQ ID NO: 3145500 - RNA, 16 nt, Mycobacterium bovis subsp bovis AF2122/97
cgccuugucggcgaug

SEQ ID NO: 3145501 - RNA, 22 nt, Mycobacterium bovis subsp bovis AF2122/97
cgccuugucggcgugucgcguc

SEQ ID NO: 3145502 - RNA, 19 nt, Mycobacterium bovis subsp bovis AF2122/97
cgccuuguggcacacccgc

SEQ ID NO: 3145503 - RNA, 22 nt, Mycobacterium bovis subsp bovis AF2122/97
cgccuuguggcacacccgcacc

SEQ ID NO: 3145504 - RNA, 15 nt, Mycobacterium bovis subsp bovis AF2122/97
cgccuuugcccgccg

SEQ ID NO: 3145505 - RNA, 16 nt, Mycobacterium bovis subsp bovis AF2122/97
cgccuuugcccgccgc

SEQ ID NO: 3145506 - RNA, 14 nt, Mycobacterium bovis subsp bovis AF2122/97
cgccuuugccgccg

SEQ ID NO: 3145507 - RNA, 15 nt, Mycobacterium bovis subsp bovis AF2122/97
cgccuuugccgccgg

SEQ ID NO: 3145508 - RNA, 22 nt, Mycobacterium bovis subsp bovis AF2122/97
cgccuuugccgccggcaccgcc

SEQ ID NO: 3145509 - RNA, 15 nt, Mycobacterium bovis subsp bovis AF2122/97
cgccuuuggcguucu

SEQ ID NO: 3145510 - RNA, 18 nt, Mycobacterium bovis subsp bovis AF2122/97
cgccuuuuuucgccgccu

SEQ ID NO: 3145511 - RNA, 20 nt, Mycobacterium bovis subsp bovis AF2122/97
cgcgaaaauucgucgcgucg

SEQ ID NO: 3145512 - RNA, 18 nt, Mycobacterium bovis subsp bovis AF2122/97
cgcgaaaccaguccaucg

SEQ ID NO: 3145513 - RNA, 14 nt, Mycobacterium bovis subsp bovis AF2122/97
cgcgaaaccgccgu

SEQ ID NO: 3145514 - RNA, 20 nt, Mycobacterium bovis subsp bovis AF2122/97
cgcgaaaccguggguucacg

SEQ ID NO: 3145515 - RNA, 15 nt, Mycobacterium bovis subsp bovis AF2122/97
cgcgaaacgccgcaa

SEQ ID NO: 3145516 - RNA, 16 nt, Mycobacterium bovis subsp bovis AF2122/97
cgcgaaagcgccgaaa

SEQ ID NO: 3145517 - RNA, 15 nt, Mycobacterium bovis subsp bovis AF2122/97
cgcgaaaggccacga

SEQ ID NO: 3145518 - RNA, 22 nt, Mycobacterium bovis subsp bovis AF2122/97
cgcgaaauaacggagcggccua

SEQ ID NO: 3145519 - RNA, 21 nt, Mycobacterium bovis subsp bovis AF2122/97
cgcgaaauuacuucggccaca

SEQ ID NO: 3145520 - RNA, 22 nt, Mycobacterium bovis subsp bovis AF2122/97
cgcgaaauuacuucggccacaa

SEQ ID NO: 3145521 - RNA, 15 nt, Mycobacterium bovis subsp bovis AF2122/97
cgcgaacaaccugcc

SEQ ID NO: 3145522 - RNA, 12 nt, Mycobacterium bovis subsp bovis AF2122/97
cgcgaacacccg

SEQ ID NO: 3145523 - RNA, 13 nt, Mycobacterium bovis subsp bovis AF2122/97
cgcgaacagcggg

SEQ ID NO: 3145524 - RNA, 20 nt, Mycobacterium bovis subsp bovis AF2122/97
cgcgaacagcgggggcagcg

SEQ ID NO: 3145525 - RNA, 14 nt, Mycobacterium bovis subsp bovis AF2122/97
cgcgaacaucgcca

SEQ ID NO: 3145526 - RNA, 16 nt, Mycobacterium bovis subsp bovis AF2122/97
cgcgaacaucgccagc

SEQ ID NO: 3145527 - RNA, 18 nt, Mycobacterium bovis subsp bovis AF2122/97
cgcgaacccgaucgucga

SEQ ID NO: 3145528 - RNA, 20 nt, Mycobacterium bovis subsp bovis AF2122/97
cgcgaacccgaucgucgagc

SEQ ID NO: 3145529 - RNA, 16 nt, Mycobacterium bovis subsp bovis AF2122/97
cgcgaacccgcgaggu

SEQ ID NO: 3145530 - RNA, 17 nt, Mycobacterium bovis subsp bovis AF2122/97
cgcgaacccgcgagguu

SEQ ID NO: 3145531 - RNA, 15 nt, Mycobacterium bovis subsp bovis AF2122/97
cgcgaaccgcggauc

SEQ ID NO: 3145532 - RNA, 16 nt, Mycobacterium bovis subsp bovis AF2122/97
cgcgaaccggccaucg

SEQ ID NO: 3145533 - RNA, 19 nt, Mycobacterium bovis subsp bovis AF2122/97
cgcgaaccggccaucgacc

SEQ ID NO: 3145534 - RNA, 19 nt, Mycobacterium bovis subsp bovis AF2122/97
cgcgaaccugcucggcgcg

SEQ ID NO: 3145535 - RNA, 21 nt, Mycobacterium bovis subsp bovis AF2122/97
cgcgaaccugcucggcgcgcc

SEQ ID NO: 3145536 - RNA, 18 nt, Mycobacterium bovis subsp bovis AF2122/97
cgcgaacgaagucgacga

SEQ ID NO: 3145537 - RNA, 15 nt, Mycobacterium bovis subsp bovis AF2122/97
cgcgaacgauuucgg

SEQ ID NO: 3145538 - RNA, 19 nt, Mycobacterium bovis subsp bovis AF2122/97
cgcgaacgauuucggccca

SEQ ID NO: 3145539 - RNA, 18 nt, Mycobacterium bovis subsp bovis AF2122/97
cgcgaacgcgacagccac

SEQ ID NO: 3145540 - RNA, 18 nt, Mycobacterium bovis subsp bovis AF2122/97
cgcgaacgcggccaccac

SEQ ID NO: 3145541 - RNA, 14 nt, Mycobacterium bovis subsp bovis AF2122/97
cgcgaacgggucgg

SEQ ID NO: 3145542 - RNA, 23 nt, Mycobacterium bovis subsp bovis AF2122/97
cgcgaacgggucgggacgcugcc

SEQ ID NO: 3145543 - RNA, 20 nt, Mycobacterium bovis subsp bovis AF2122/97
cgcgaacgucagugccccgc

SEQ ID NO: 3145544 - RNA, 18 nt, Mycobacterium bovis subsp bovis AF2122/97
cgcgaacuccagcagccc

SEQ ID NO: 3145545 - RNA, 17 nt, Mycobacterium bovis subsp bovis AF2122/97
cgcgaacuugcugacga

SEQ ID NO: 3145546 - RNA, 18 nt, Mycobacterium bovis subsp bovis AF2122/97
cgcgaagaacgacgccac

SEQ ID NO: 3145547 - RNA, 22 nt, Mycobacterium bovis subsp bovis AF2122/97
cgcgaagaacgacgccaccgcg

SEQ ID NO: 3145548 - RNA, 15 nt, Mycobacterium bovis subsp bovis AF2122/97
cgcgaagaucagcgg

SEQ ID NO: 3145549 - RNA, 13 nt, Mycobacterium bovis subsp bovis AF2122/97
cgcgaagccacca

SEQ ID NO: 3145550 - RNA, 15 nt, Mycobacterium bovis subsp bovis AF2122/97
cgcgaagccaccagg

SEQ ID NO: 3145551 - RNA, 16 nt, Mycobacterium bovis subsp bovis AF2122/97
cgcgaagccaccaggu

SEQ ID NO: 3145552 - RNA, 17 nt, Mycobacterium bovis subsp bovis AF2122/97
cgcgaagccaccagguc

SEQ ID NO: 3145553 - RNA, 13 nt, Mycobacterium bovis subsp bovis AF2122/97
cgcgaagccgcca

SEQ ID NO: 3145554 - RNA, 16 nt, Mycobacterium bovis subsp bovis AF2122/97
cgcgaagcgcucggca

SEQ ID NO: 3145555 - RNA, 22 nt, Mycobacterium bovis subsp bovis AF2122/97
cgcgaagcgcucggcagccggc

SEQ ID NO: 3145556 - RNA, 19 nt, Mycobacterium bovis subsp bovis AF2122/97
cgcgaagcggaccgagccg

SEQ ID NO: 3145557 - RNA, 16 nt, Mycobacterium bovis subsp bovis AF2122/97
cgcgaagcugugcccg

SEQ ID NO: 3145558 - RNA, 21 nt, Mycobacterium bovis subsp bovis AF2122/97
cgcgaagcugugcccggcgcc

SEQ ID NO: 3145559 - RNA, 21 nt, Mycobacterium bovis subsp bovis AF2122/97
cgcgaaggauuugauaggcgc

SEQ ID NO: 3145560 - RNA, 23 nt, Mycobacterium bovis subsp bovis AF2122/97
cgcgaaggauuugauaggcgcgc

SEQ ID NO: 3145561 - RNA, 22 nt, Mycobacterium bovis subsp bovis AF2122/97
cgcgaaggggugcccggcggcc

SEQ ID NO: 3145562 - RNA, 16 nt, Mycobacterium bovis subsp bovis AF2122/97
cgcgaagucuugaccg

SEQ ID NO: 3145563 - RNA, 19 nt, Mycobacterium bovis subsp bovis AF2122/97
cgcgaagucuugaccgcac

SEQ ID NO: 3145564 - RNA, 21 nt, Mycobacterium bovis subsp bovis AF2122/97
cgcgaagucuugaccgcaccg

SEQ ID NO: 3145565 - RNA, 19 nt, Mycobacterium bovis subsp bovis AF2122/97
cgcgaagugcuugggccgc

SEQ ID NO: 3145566 - RNA, 14 nt, Mycobacterium bovis subsp bovis AF2122/97
cgcgaauaccagac

SEQ ID NO: 3145567 - RNA, 20 nt, Mycobacterium bovis subsp bovis AF2122/97
cgcgaauauagcggcguucc

SEQ ID NO: 3145568 - RNA, 21 nt, Mycobacterium bovis subsp bovis AF2122/97
cgcgaauauucgcugggcgca

SEQ ID NO: 3145569 - RNA, 18 nt, Mycobacterium bovis subsp bovis AF2122/97
cgcgaaucgcgucgagcg

SEQ ID NO: 3145570 - RNA, 15 nt, Mycobacterium bovis subsp bovis AF2122/97
cgcgaaugaagcccu

SEQ ID NO: 3145571 - RNA, 20 nt, Mycobacterium bovis subsp bovis AF2122/97
cgcgaaugaagcccucgucg

SEQ ID NO: 3145572 - RNA, 21 nt, Mycobacterium bovis subsp bovis AF2122/97
cgcgaaugacgauccagccca

SEQ ID NO: 3145573 - RNA, 19 nt, Mycobacterium bovis subsp bovis AF2122/97
cgcgaauggcggacagggc

SEQ ID NO: 3145574 - RNA, 23 nt, Mycobacterium bovis subsp bovis AF2122/97
cgcgaauggcggacagggcggca

SEQ ID NO: 3145575 - RNA, 15 nt, Mycobacterium bovis subsp bovis AF2122/97
cgcgaauguccggca

SEQ ID NO: 3145576 - RNA, 15 nt, Mycobacterium bovis subsp bovis AF2122/97
cgcgaaugucgccgc

SEQ ID NO: 3145577 - RNA, 17 nt, Mycobacterium bovis subsp bovis AF2122/97
cgcgaaugucgcgcugu

SEQ ID NO: 3145578 - RNA, 19 nt, Mycobacterium bovis subsp bovis AF2122/97
cgcgacaaaucggucgacg

SEQ ID NO: 3145579 - RNA, 21 nt, Mycobacterium bovis subsp bovis AF2122/97
cgcgacaacaacucuucggcg

SEQ ID NO: 3145580 - RNA, 20 nt, Mycobacterium bovis subsp bovis AF2122/97
cgcgacguagacgacgucgg

SEQ ID NO: 3145581 - RNA, 14 nt, Mycobacterium bovis subsp bovis AF2122/97
cgcgacguccacca

SEQ ID NO: 3145582 - RNA, 18 nt, Mycobacterium bovis subsp bovis AF2122/97
cgcgacguccaccagccg

SEQ ID NO: 3145583 - RNA, 19 nt, Mycobacterium bovis subsp bovis AF2122/97
cgcgacguccaccagccgg

SEQ ID NO: 3145584 - RNA, 12 nt, Mycobacterium bovis subsp bovis AF2122/97
cgcgacgucugc

SEQ ID NO: 3145585 - RNA, 17 nt, Mycobacterium bovis subsp bovis AF2122/97
cgcgacgucugccaggc

SEQ ID NO: 3145586 - RNA, 22 nt, Mycobacterium bovis subsp bovis AF2122/97
cgcgacgucugccaggcgcagc

SEQ ID NO: 3145587 - RNA, 19 nt, Mycobacterium bovis subsp bovis AF2122/97
cgcgacguugaacucgagu

SEQ ID NO: 3145588 - RNA, 14 nt, Mycobacterium bovis subsp bovis AF2122/97
cgcgacuaccaucg

SEQ ID NO: 3145589 - RNA, 17 nt, Mycobacterium bovis subsp bovis AF2122/97
cgcgacuaccaucgccg

SEQ ID NO: 3145590 - RNA, 20 nt, Mycobacterium bovis subsp bovis AF2122/97
cgcgacuaccaucgccgccc

SEQ ID NO: 3145591 - RNA, 18 nt, Mycobacterium bovis subsp bovis AF2122/97
cgcgacuagacgccgccg

SEQ ID NO: 3145592 - RNA, 16 nt, Mycobacterium bovis subsp bovis AF2122/97
cgcgacugauccucga

SEQ ID NO: 3145593 - RNA, 16 nt, Mycobacterium bovis subsp bovis AF2122/97
cgcgacugcaccuggc

SEQ ID NO: 3145594 - RNA, 23 nt, Mycobacterium bovis subsp bovis AF2122/97
cgcgacugcaccuggccgcccgc

SEQ ID NO: 3145595 - RNA, 16 nt, Mycobacterium bovis subsp bovis AF2122/97
cgcgacuugcaccccg

SEQ ID NO: 3145596 - RNA, 18 nt, Mycobacterium bovis subsp bovis AF2122/97
cgcgacuugcaccccguc

SEQ ID NO: 3145597 - RNA, 22 nt, Mycobacterium bovis subsp bovis AF2122/97
cgcgacuugcaccccgucucgg

SEQ ID NO: 3145598 - RNA, 20 nt, Mycobacterium bovis subsp bovis AF2122/97
cgcgacuuucugcgcguggg

SEQ ID NO: 3145599 - RNA, 15 nt, Mycobacterium bovis subsp bovis AF2122/97
cgcgagaacacccgu

SEQ ID NO: 3145600 - RNA, 17 nt, Mycobacterium bovis subsp bovis AF2122/97
cgcgagagccggcggcg

SEQ ID NO: 3145601 - RNA, 18 nt, Mycobacterium bovis subsp bovis AF2122/97
cgcgagagccuccauggc

SEQ ID NO: 3145602 - RNA, 17 nt, Mycobacterium bovis subsp bovis AF2122/97
cgcgagaucagccggca

SEQ ID NO: 3145603 - RNA, 19 nt, Mycobacterium bovis subsp bovis AF2122/97
cgcgagaucagccggcagc

SEQ ID NO: 3145604 - RNA, 20 nt, Mycobacterium bovis subsp bovis AF2122/97
cgcgagaucagccggcagcg

SEQ ID NO: 3145605 - RNA, 22 nt, Mycobacterium bovis subsp bovis AF2122/97
cgcgagauccuucgcguuggcc

SEQ ID NO: 3145606 - RNA, 20 nt, Mycobacterium bovis subsp bovis AF2122/97
cgcgagcaacaccagggccu

SEQ ID NO: 3145607 - RNA, 21 nt, Mycobacterium bovis subsp bovis AF2122/97
cgcgagcagacgcaaaaucgc

SEQ ID NO: 3145608 - RNA, 18 nt, Mycobacterium bovis subsp bovis AF2122/97
cgcgagcagacgcagaag

SEQ ID NO: 3145609 - RNA, 21 nt, Mycobacterium bovis subsp bovis AF2122/97
cgcgagcagacgcagaaucgc

SEQ ID NO: 3145610 - RNA, 15 nt, Mycobacterium bovis subsp bovis AF2122/97
cgcgagcagacgcgg

SEQ ID NO: 3145611 - RNA, 22 nt, Mycobacterium bovis subsp bovis AF2122/97
cgcgagcagacgcuaaagcccc

SEQ ID NO: 3145612 - RNA, 13 nt, Mycobacterium bovis subsp bovis AF2122/97
cgcgagcagcccg

SEQ ID NO: 3145613 - RNA, 14 nt, Mycobacterium bovis subsp bovis AF2122/97
cgcgagcagcccgg

SEQ ID NO: 3145614 - RNA, 15 nt, Mycobacterium bovis subsp bovis AF2122/97
cgcgagcagcccggc

SEQ ID NO: 3145615 - RNA, 15 nt, Mycobacterium bovis subsp bovis AF2122/97
cgcgagcaucgacga

SEQ ID NO: 3145616 - RNA, 23 nt, Mycobacterium bovis subsp bovis AF2122/97
cgcgagcaucugggguccgguga

SEQ ID NO: 3145617 - RNA, 22 nt, Mycobacterium bovis subsp bovis AF2122/97
cgcgagccagcugcuccacccg

SEQ ID NO: 3145618 - RNA, 18 nt, Mycobacterium bovis subsp bovis AF2122/97
cgcgagcccgaaccaccg

SEQ ID NO: 3145619 - RNA, 23 nt, Mycobacterium bovis subsp bovis AF2122/97
cgcgagcccggccucggcgagca

SEQ ID NO: 3145620 - RNA, 18 nt, Mycobacterium bovis subsp bovis AF2122/97
cgcgagccggugauccgg

SEQ ID NO: 3145621 - RNA, 15 nt, Mycobacterium bovis subsp bovis AF2122/97
cgcgagccucgcgcg

SEQ ID NO: 3145622 - RNA, 17 nt, Mycobacterium bovis subsp bovis AF2122/97
cgcgagccucgcgcgug

SEQ ID NO: 3145623 - RNA, 23 nt, Mycobacterium bovis subsp bovis AF2122/97
cgcgagccugauaaagcccggcg

SEQ ID NO: 3145624 - RNA, 13 nt, Mycobacterium bovis subsp bovis AF2122/97
cgcgagcgagcca

SEQ ID NO: 3145625 - RNA, 20 nt, Mycobacterium bovis subsp bovis AF2122/97
cgcgagcgccgcuaugaggc

SEQ ID NO: 3145626 - RNA, 15 nt, Mycobacterium bovis subsp bovis AF2122/97
cgcgagcgccggccg

SEQ ID NO: 3145627 - RNA, 14 nt, Mycobacterium bovis subsp bovis AF2122/97
cgcgagcgcggcgg

SEQ ID NO: 3145628 - RNA, 20 nt, Mycobacterium bovis subsp bovis AF2122/97
cgcgagcgcuaucaccgccu

SEQ ID NO: 3145629 - RNA, 22 nt, Mycobacterium bovis subsp bovis AF2122/97
cgcgagcggaauggaggccgcc

SEQ ID NO: 3145630 - RNA, 23 nt, Mycobacterium bovis subsp bovis AF2122/97
cgcgagcucccuaacaucguuga

SEQ ID NO: 3145631 - RNA, 22 nt, Mycobacterium bovis subsp bovis AF2122/97
cgcgagcuguaggucagcgcgu

SEQ ID NO: 3145632 - RNA, 21 nt, Mycobacterium bovis subsp bovis AF2122/97
cgcgagcuuggccagcagcag

SEQ ID NO: 3145633 - RNA, 20 nt, Mycobacterium bovis subsp bovis AF2122/97
cgcgagcuuggccggcaggu

SEQ ID NO: 3145634 - RNA, 14 nt, Mycobacterium bovis subsp bovis AF2122/97
cgcgaggaugcuga

SEQ ID NO: 3145635 - RNA, 23 nt, Mycobacterium bovis subsp bovis AF2122/97
cgcgaggaugcugagcgccaggc

SEQ ID NO: 3145636 - RNA, 18 nt, Mycobacterium bovis subsp bovis AF2122/97
cgcgaggcaagaacccga

SEQ ID NO: 3145637 - RNA, 20 nt, Mycobacterium bovis subsp bovis AF2122/97
cgcgaggcgcucacccgccg

SEQ ID NO: 3145638 - RNA, 17 nt, Mycobacterium bovis subsp bovis AF2122/97
cgcgaggcgucaccccg

SEQ ID NO: 3145639 - RNA, 16 nt, Mycobacterium bovis subsp bovis AF2122/97
cgcgaggcucgcgugg

SEQ ID NO: 3145640 - RNA, 15 nt, Mycobacterium bovis subsp bovis AF2122/97
cgcgaggcucggucg

SEQ ID NO: 3145641 - RNA, 17 nt, Mycobacterium bovis subsp bovis AF2122/97
cgcgagggcauccgagc

SEQ ID NO: 3145642 - RNA, 14 nt, Mycobacterium bovis subsp bovis AF2122/97
cgcgaggggccggc

SEQ ID NO: 3145643 - RNA, 21 nt, Mycobacterium bovis subsp bovis AF2122/97
cgcgaggggccggcucaguca

SEQ ID NO: 3145644 - RNA, 17 nt, Mycobacterium bovis subsp bovis AF2122/97
cgcgagggggguguuga

SEQ ID NO: 3145645 - RNA, 23 nt, Mycobacterium bovis subsp bovis AF2122/97
cgcgagggggguguugaggccgg

SEQ ID NO: 3145646 - RNA, 22 nt, Mycobacterium bovis subsp bovis AF2122/97
cgcgagguacccaucgucgagc

SEQ ID NO: 3145647 - RNA, 18 nt, Mycobacterium bovis subsp bovis AF2122/97
cgcgaggucggcggcgca

SEQ ID NO: 3145648 - RNA, 21 nt, Mycobacterium bovis subsp bovis AF2122/97
cgcgaggucggcggcgcaggu

SEQ ID NO: 3145649 - RNA, 19 nt, Mycobacterium bovis subsp bovis AF2122/97
cgcgagguugaccaccagc

SEQ ID NO: 3145650 - RNA, 20 nt, Mycobacterium bovis subsp bovis AF2122/97
cgcgagguugaccaccagcg

SEQ ID NO: 3145651 - RNA, 21 nt, Mycobacterium bovis subsp bovis AF2122/97
cgcgaguaagcgaacagcggc

SEQ ID NO: 3145652 - RNA, 17 nt, Mycobacterium bovis subsp bovis AF2122/97
cgcgaguagaucaucga

SEQ ID NO: 3145653 - RNA, 23 nt, Mycobacterium bovis subsp bovis AF2122/97
cgcgaguagcugacccgcgguag

SEQ ID NO: 3145654 - RNA, 16 nt, Mycobacterium bovis subsp bovis AF2122/97
cgcgagugccaguccg

SEQ ID NO: 3145655 - RNA, 23 nt, Mycobacterium bovis subsp bovis AF2122/97
cgcgauagauacccgcggcagca

SEQ ID NO: 3145656 - RNA, 16 nt, Mycobacterium bovis subsp bovis AF2122/97
cgcgauagccgccgcg

SEQ ID NO: 3145657 - RNA, 18 nt, Mycobacterium bovis subsp bovis AF2122/97
cgcgauagccgccgcggu

SEQ ID NO: 3145658 - RNA, 15 nt, Mycobacterium bovis subsp bovis AF2122/97
cgcgaucaccgaguc

SEQ ID NO: 3145659 - RNA, 12 nt, Mycobacterium bovis subsp bovis AF2122/97
cgcgaucagcgc

SEQ ID NO: 3145660 - RNA, 14 nt, Mycobacterium bovis subsp bovis AF2122/97
cgcgaucagcgcgc

SEQ ID NO: 3145661 - RNA, 16 nt, Mycobacterium bovis subsp bovis AF2122/97
cgcgaucagcgcgcac

SEQ ID NO: 3145662 - RNA, 13 nt, Mycobacterium bovis subsp bovis AF2122/97
cgcgaucagcugg

SEQ ID NO: 3145663 - RNA, 16 nt, Mycobacterium bovis subsp bovis AF2122/97
cgcgaucaggcgcucg

SEQ ID NO: 3145664 - RNA, 18 nt, Mycobacterium bovis subsp bovis AF2122/97
cgcgaucagguaccggcg

SEQ ID NO: 3145665 - RNA, 13 nt, Mycobacterium bovis subsp bovis AF2122/97
cgcgauccagcgc

SEQ ID NO: 3145666 - RNA, 18 nt, Mycobacterium bovis subsp bovis AF2122/97
cgcgcaacucgccacggu

SEQ ID NO: 3145667 - RNA, 20 nt, Mycobacterium bovis subsp bovis AF2122/97
cgcgcaacuuccauuuucgc

SEQ ID NO: 3145668 - RNA, 19 nt, Mycobacterium bovis subsp bovis AF2122/97
cgcgcaagcggacccgacc

SEQ ID NO: 3145669 - RNA, 14 nt, Mycobacterium bovis subsp bovis AF2122/97
cgcgcaaggcgccg

SEQ ID NO: 3145670 - RNA, 15 nt, Mycobacterium bovis subsp bovis AF2122/97
cgcgcaaggcgccgc

SEQ ID NO: 3145671 - RNA, 12 nt, Mycobacterium bovis subsp bovis AF2122/97
cgcgcacacggc

SEQ ID NO: 3145672 - RNA, 21 nt, Mycobacterium bovis subsp bovis AF2122/97
cgcgcacauaggcgaucgcau

SEQ ID NO: 3145673 - RNA, 13 nt, Mycobacterium bovis subsp bovis AF2122/97
cgcgcaccaacac

SEQ ID NO: 3145674 - RNA, 15 nt, Mycobacterium bovis subsp bovis AF2122/97
cgcgcaccaacacca

SEQ ID NO: 3145675 - RNA, 13 nt, Mycobacterium bovis subsp bovis AF2122/97
cgcgcaccaccgc

SEQ ID NO: 3145676 - RNA, 20 nt, Mycobacterium bovis subsp bovis AF2122/97
cgcgcaccaccgcggcggcg

SEQ ID NO: 3145677 - RNA, 13 nt, Mycobacterium bovis subsp bovis AF2122/97
cgcgcacccagcc

SEQ ID NO: 3145678 - RNA, 15 nt, Mycobacterium bovis subsp bovis AF2122/97
cgcgcacccagccca

SEQ ID NO: 3145679 - RNA, 16 nt, Mycobacterium bovis subsp bovis AF2122/97
cgcgcacccagcccag

SEQ ID NO: 3145680 - RNA, 15 nt, Mycobacterium bovis subsp bovis AF2122/97
cgcgcaccccggcau

SEQ ID NO: 3145681 - RNA, 15 nt, Mycobacterium bovis subsp bovis AF2122/97
cgcgcaccgaccgca

SEQ ID NO: 3145682 - RNA, 19 nt, Mycobacterium bovis subsp bovis AF2122/97
cgcgcaccgaccgcaccgu

SEQ ID NO: 3145683 - RNA, 13 nt, Mycobacterium bovis subsp bovis AF2122/97
cgcgcaccggauc

SEQ ID NO: 3145684 - RNA, 16 nt, Mycobacterium bovis subsp bovis AF2122/97
cgcgcaccggaucgcc

SEQ ID NO: 3145685 - RNA, 20 nt, Mycobacterium bovis subsp bovis AF2122/97
cgcgcaccggaucgccgucg

SEQ ID NO: 3145686 - RNA, 20 nt, Mycobacterium bovis subsp bovis AF2122/97
cgcgcaccggguugagccgc

SEQ ID NO: 3145687 - RNA, 18 nt, Mycobacterium bovis subsp bovis AF2122/97
cgcgcaccugaucgguca

SEQ ID NO: 3145688 - RNA, 15 nt, Mycobacterium bovis subsp bovis AF2122/97
cgcgcaccuggcgcg

SEQ ID NO: 3145689 - RNA, 22 nt, Mycobacterium bovis subsp bovis AF2122/97
cgcgcaccuggcgcgcgcaacg

SEQ ID NO: 3145690 - RNA, 14 nt, Mycobacterium bovis subsp bovis AF2122/97
cgcgcacgccaccg

SEQ ID NO: 3145691 - RNA, 14 nt, Mycobacterium bovis subsp bovis AF2122/97
cgcgcacgcgugcc

SEQ ID NO: 3145692 - RNA, 17 nt, Mycobacterium bovis subsp bovis AF2122/97
cgcgcacgcgugccgca

SEQ ID NO: 3145693 - RNA, 19 nt, Mycobacterium bovis subsp bovis AF2122/97
cgcgcacgcgugccgcaac

SEQ ID NO: 3145694 - RNA, 14 nt, Mycobacterium bovis subsp bovis AF2122/97
cgcgcacggcguug

SEQ ID NO: 3145695 - RNA, 13 nt, Mycobacterium bovis subsp bovis AF2122/97
cgcgcacucgacg

SEQ ID NO: 3145696 - RNA, 18 nt, Mycobacterium bovis subsp bovis AF2122/97
cgcgcacucgacgccaau

SEQ ID NO: 3145697 - RNA, 17 nt, Mycobacterium bovis subsp bovis AF2122/97
cgcgcacuugcguggcg

SEQ ID NO: 3145698 - RNA, 20 nt, Mycobacterium bovis subsp bovis AF2122/97
cgcgcacuugcguggcguug

SEQ ID NO: 3145699 - RNA, 23 nt, Mycobacterium bovis subsp bovis AF2122/97
cgcgcagaaagucgcgcgcgaac

SEQ ID NO: 3145700 - RNA, 21 nt, Mycobacterium bovis subsp bovis AF2122/97
cgcgcagaacgaucgcgcugg

SEQ ID NO: 3145701 - RNA, 23 nt, Mycobacterium bovis subsp bovis AF2122/97
cgcgcagaacgaucgcgcuggcg

SEQ ID NO: 3145702 - RNA, 18 nt, Mycobacterium bovis subsp bovis AF2122/97
cgcgcagacucgccaccg

SEQ ID NO: 3145703 - RNA, 21 nt, Mycobacterium bovis subsp bovis AF2122/97
cgcgcagacucgccaccgcgg

SEQ ID NO: 3145704 - RNA, 16 nt, Mycobacterium bovis subsp bovis AF2122/97
cgcgcagauacgcgug

SEQ ID NO: 3145705 - RNA, 19 nt, Mycobacterium bovis subsp bovis AF2122/97
cgcgcagauacgcgugugg

SEQ ID NO: 3145706 - RNA, 15 nt, Mycobacterium bovis subsp bovis AF2122/97
cgcgcagaucgucca

SEQ ID NO: 3145707 - RNA, 18 nt, Mycobacterium bovis subsp bovis AF2122/97
cgcgcagaucguccaccg

SEQ ID NO: 3145708 - RNA, 21 nt, Mycobacterium bovis subsp bovis AF2122/97
cgcgcagaucguccaccgccg

SEQ ID NO: 3145709 - RNA, 19 nt, Mycobacterium bovis subsp bovis AF2122/97
cgcgcagaugagcgcggcg

SEQ ID NO: 3145710 - RNA, 15 nt, Mycobacterium bovis subsp bovis AF2122/97
cgcgcagcacugcgg

SEQ ID NO: 3145711 - RNA, 12 nt, Mycobacterium bovis subsp bovis AF2122/97
cgcgcagcagug

SEQ ID NO: 3145712 - RNA, 13 nt, Mycobacterium bovis subsp bovis AF2122/97
cgcgcagcagugc

SEQ ID NO: 3145713 - RNA, 22 nt, Mycobacterium bovis subsp bovis AF2122/97
cgcgcagcaguuggucgcgguc

SEQ ID NO: 3145714 - RNA, 16 nt, Mycobacterium bovis subsp bovis AF2122/97
cgcgcagcaucggcga

SEQ ID NO: 3145715 - RNA, 20 nt, Mycobacterium bovis subsp bovis AF2122/97
cgcgcagcauggugcggcgg

SEQ ID NO: 3145716 - RNA, 17 nt, Mycobacterium bovis subsp bovis AF2122/97
cgcgcagccgccgcgcc

SEQ ID NO: 3145717 - RNA, 15 nt, Mycobacterium bovis subsp bovis AF2122/97
cgcgcagccgcucga

SEQ ID NO: 3145718 - RNA, 14 nt, Mycobacterium bovis subsp bovis AF2122/97
cgcgcagccggccc

SEQ ID NO: 3145719 - RNA, 15 nt, Mycobacterium bovis subsp bovis AF2122/97
cgcgcagccggcccg

SEQ ID NO: 3145720 - RNA, 17 nt, Mycobacterium bovis subsp bovis AF2122/97
cgcgcagccgggcaccg

SEQ ID NO: 3145721 - RNA, 20 nt, Mycobacterium bovis subsp bovis AF2122/97
cgcgcagccgggcaccgaac

SEQ ID NO: 3145722 - RNA, 19 nt, Mycobacterium bovis subsp bovis AF2122/97
cgcgcagccgggccaaccg

SEQ ID NO: 3145723 - RNA, 14 nt, Mycobacterium bovis subsp bovis AF2122/97
cgcgcagcgauucg

SEQ ID NO: 3145724 - RNA, 12 nt, Mycobacterium bovis subsp bovis AF2122/97
cgcgcagcgccg

SEQ ID NO: 3145725 - RNA, 15 nt, Mycobacterium bovis subsp bovis AF2122/97
cgcgcagcgccgcca

SEQ ID NO: 3145726 - RNA, 16 nt, Mycobacterium bovis subsp bovis AF2122/97
cgcgcagcgguccgcc

SEQ ID NO: 3145727 - RNA, 17 nt, Mycobacterium bovis subsp bovis AF2122/97
cgcgcagcgucaaaccu

SEQ ID NO: 3145728 - RNA, 18 nt, Mycobacterium bovis subsp bovis AF2122/97
cgcgcagcgugcgaugca

SEQ ID NO: 3145729 - RNA, 14 nt, Mycobacterium bovis subsp bovis AF2122/97
cgcgcagcuccacc

SEQ ID NO: 3145730 - RNA, 19 nt, Mycobacterium bovis subsp bovis AF2122/97
cgcgcagcugacgucacca

SEQ ID NO: 3145731 - RNA, 17 nt, Mycobacterium bovis subsp bovis AF2122/97
cgcgcagcugccgcacc

SEQ ID NO: 3145732 - RNA, 19 nt, Mycobacterium bovis subsp bovis AF2122/97
cgcgcagcugccgcacccc

SEQ ID NO: 3145733 - RNA, 20 nt, Mycobacterium bovis subsp bovis AF2122/97
cgcgcagcugccgcaccccc

SEQ ID NO: 3145734 - RNA, 19 nt, Mycobacterium bovis subsp bovis AF2122/97
cgcgcaggaagccggcgug

SEQ ID NO: 3145735 - RNA, 17 nt, Mycobacterium bovis subsp bovis AF2122/97
cgcgcaggccgccgcca

SEQ ID NO: 3145736 - RNA, 22 nt, Mycobacterium bovis subsp bovis AF2122/97
cgcgcaggcuuccagccacagc

SEQ ID NO: 3145737 - RNA, 16 nt, Mycobacterium bovis subsp bovis AF2122/97
cgcgcagggaucgcag

SEQ ID NO: 3145738 - RNA, 17 nt, Mycobacterium bovis subsp bovis AF2122/97
cgcgcagggcgucggcg

SEQ ID NO: 3145739 - RNA, 19 nt, Mycobacterium bovis subsp bovis AF2122/97
cgcgcagguagcgccgcac

SEQ ID NO: 3145740 - RNA, 21 nt, Mycobacterium bovis subsp bovis AF2122/97
cgcgcagguagcgccgcacuu

SEQ ID NO: 3145741 - RNA, 18 nt, Mycobacterium bovis subsp bovis AF2122/97
cgcgcagguagcgcucga

SEQ ID NO: 3145742 - RNA, 19 nt, Mycobacterium bovis subsp bovis AF2122/97
cgcgcaguacuugaccguc

SEQ ID NO: 3145743 - RNA, 23 nt, Mycobacterium bovis subsp bovis AF2122/97
cgcgcaguacuugaccguccacc

SEQ ID NO: 3145744 - RNA, 21 nt, Mycobacterium bovis subsp bovis AF2122/97
cgcgcaguuuggcggcgcgca

SEQ ID NO: 3145745 - RNA, 15 nt, Mycobacterium bovis subsp bovis AF2122/97
cgcgcauauccgcag

SEQ ID NO: 3145746 - RNA, 16 nt, Mycobacterium bovis subsp bovis AF2122/97
cgcgcaucaucgccca

SEQ ID NO: 3145747 - RNA, 19 nt, Mycobacterium bovis subsp bovis AF2122/97
cgcgcaucaucgcccaccg

SEQ ID NO: 3145748 - RNA, 20 nt, Mycobacterium bovis subsp bovis AF2122/97
cgcgcaucaucgcccaccgc

SEQ ID NO: 3145749 - RNA, 14 nt, Mycobacterium bovis subsp bovis AF2122/97
cgcgcauccgcagc

SEQ ID NO: 3145750 - RNA, 16 nt, Mycobacterium bovis subsp bovis AF2122/97
cgcgcauccgcagccc

SEQ ID NO: 3145751 - RNA, 18 nt, Mycobacterium bovis subsp bovis AF2122/97
cgcgcauccgcagcccaa

SEQ ID NO: 3145752 - RNA, 21 nt, Mycobacterium bovis subsp bovis AF2122/97
cgcgcaucgcacgggccacca

SEQ ID NO: 3145753 - RNA, 23 nt, Mycobacterium bovis subsp bovis AF2122/97
cgcgcaucgcacgggccaccagc

SEQ ID NO: 3145754 - RNA, 18 nt, Mycobacterium bovis subsp bovis AF2122/97
cgcgcaucgccuccucga

SEQ ID NO: 3145755 - RNA, 19 nt, Mycobacterium bovis subsp bovis AF2122/97
cgcgcaucgccuccucgac

SEQ ID NO: 3145756 - RNA, 17 nt, Mycobacterium bovis subsp bovis AF2122/97
cgcgcaucugcucggca

SEQ ID NO: 3145757 - RNA, 17 nt, Mycobacterium bovis subsp bovis AF2122/97
cgcgcaucugucgcgcg

SEQ ID NO: 3145758 - RNA, 21 nt, Mycobacterium bovis subsp bovis AF2122/97
cgcgcaucugucgcgcggcaa

SEQ ID NO: 3145759 - RNA, 14 nt, Mycobacterium bovis subsp bovis AF2122/97
cgcgcaugccccga

SEQ ID NO: 3145760 - RNA, 22 nt, Mycobacterium bovis subsp bovis AF2122/97
cgcgcauguuaugagcgcucgg

SEQ ID NO: 3145761 - RNA, 18 nt, Mycobacterium bovis subsp bovis AF2122/97
cgcgcauucgccgggcgg

SEQ ID NO: 3145762 - RNA, 19 nt, Mycobacterium bovis subsp bovis AF2122/97
cgcgcauucgccgggcggc

SEQ ID NO: 3145763 - RNA, 20 nt, Mycobacterium bovis subsp bovis AF2122/97
cgcgcauucgccgggcggca

SEQ ID NO: 3145764 - RNA, 16 nt, Mycobacterium bovis subsp bovis AF2122/97
cgcgcauuucaccggg

SEQ ID NO: 3145765 - RNA, 17 nt, Mycobacterium bovis subsp bovis AF2122/97
cgcgcauuucguggcgc

SEQ ID NO: 3145766 - RNA, 18 nt, Mycobacterium bovis subsp bovis AF2122/97
cgcgccaaacaccccggc

SEQ ID NO: 3145767 - RNA, 20 nt, Mycobacterium bovis subsp bovis AF2122/97
cgcgccaaacaccccggccu

SEQ ID NO: 3145768 - RNA, 22 nt, Mycobacterium bovis subsp bovis AF2122/97
cgcgccaaacaccccggccuug

SEQ ID NO: 3145769 - RNA, 13 nt, Mycobacterium bovis subsp bovis AF2122/97
cgcgccaacaccu

SEQ ID NO: 3145770 - RNA, 15 nt, Mycobacterium bovis subsp bovis AF2122/97
cgcgccaccagcacc

SEQ ID NO: 3145771 - RNA, 16 nt, Mycobacterium bovis subsp bovis AF2122/97
cgcgccaccagcaccg

SEQ ID NO: 3145772 - RNA, 22 nt, Mycobacterium bovis subsp bovis AF2122/97
cgcgccaccagcaccgccgcug

SEQ ID NO: 3145773 - RNA, 16 nt, Mycobacterium bovis subsp bovis AF2122/97
cgcgccacccagcacc

SEQ ID NO: 3145774 - RNA, 23 nt, Mycobacterium bovis subsp bovis AF2122/97
cgcgccaccgagcccuccagggc

SEQ ID NO: 3145775 - RNA, 17 nt, Mycobacterium bovis subsp bovis AF2122/97
cgcgccaccggcaccgc

SEQ ID NO: 3145776 - RNA, 21 nt, Mycobacterium bovis subsp bovis AF2122/97
cgcgccaccggcaccgccugc

SEQ ID NO: 3145777 - RNA, 23 nt, Mycobacterium bovis subsp bovis AF2122/97
cgcgccaccucccacgccgccgu

SEQ ID NO: 3145778 - RNA, 16 nt, Mycobacterium bovis subsp bovis AF2122/97
cgcgccacgcacccgg

SEQ ID NO: 3145779 - RNA, 18 nt, Mycobacterium bovis subsp bovis AF2122/97
cgcgccacgcacccggca

SEQ ID NO: 3145780 - RNA, 21 nt, Mycobacterium bovis subsp bovis AF2122/97
cgcgccagacacaaccgcuuu

SEQ ID NO: 3145781 - RNA, 14 nt, Mycobacterium bovis subsp bovis AF2122/97
cgcgccagccucca

SEQ ID NO: 3145782 - RNA, 21 nt, Mycobacterium bovis subsp bovis AF2122/97
cgcgccagccuccaccagguc

SEQ ID NO: 3145783 - RNA, 16 nt, Mycobacterium bovis subsp bovis AF2122/97
cgcgccagcuugucgg

SEQ ID NO: 3145784 - RNA, 22 nt, Mycobacterium bovis subsp bovis AF2122/97
cgcgccaggcgcgaucgcgccc

SEQ ID NO: 3145785 - RNA, 17 nt, Mycobacterium bovis subsp bovis AF2122/97
cgcgccaggcuugcggc

SEQ ID NO: 3145786 - RNA, 15 nt, Mycobacterium bovis subsp bovis AF2122/97
cgcgccaggucggug

SEQ ID NO: 3145787 - RNA, 19 nt, Mycobacterium bovis subsp bovis AF2122/97
cgcgccaggucggugacga

SEQ ID NO: 3145788 - RNA, 18 nt, Mycobacterium bovis subsp bovis AF2122/97
cgcgccaguggccaccau

SEQ ID NO: 3145789 - RNA, 21 nt, Mycobacterium bovis subsp bovis AF2122/97
cgcgccaguguggugcggcgc

SEQ ID NO: 3145790 - RNA, 19 nt, Mycobacterium bovis subsp bovis AF2122/97
cgcgccaucgccuccagcc

SEQ ID NO: 3145791 - RNA, 21 nt, Mycobacterium bovis subsp bovis AF2122/97
cgcgccaucgccuccagccgg

SEQ ID NO: 3145792 - RNA, 20 nt, Mycobacterium bovis subsp bovis AF2122/97
cgcgccauuggcgccgccga

SEQ ID NO: 3145793 - RNA, 13 nt, Mycobacterium bovis subsp bovis AF2122/97
cgcgcccaaccug

SEQ ID NO: 3145794 - RNA, 18 nt, Mycobacterium bovis subsp bovis AF2122/97
cgcgcccaccagcggcgg

SEQ ID NO: 3145795 - RNA, 19 nt, Mycobacterium bovis subsp bovis AF2122/97
cgcgcccaccagcggcggc

SEQ ID NO: 3145796 - RNA, 20 nt, Mycobacterium bovis subsp bovis AF2122/97
cgcgcccaccagcggcggca

SEQ ID NO: 3145797 - RNA, 13 nt, Mycobacterium bovis subsp bovis AF2122/97
cgcgcccaccaug

SEQ ID NO: 3145798 - RNA, 22 nt, Mycobacterium bovis subsp bovis AF2122/97
cgcgcccaccaugaucacaccg

SEQ ID NO: 3145799 - RNA, 19 nt, Mycobacterium bovis subsp bovis AF2122/97
cgcgcccaccccggccgca

SEQ ID NO: 3145800 - RNA, 14 nt, Mycobacterium bovis subsp bovis AF2122/97
cgcgcccaccggcu

SEQ ID NO: 3145801 - RNA, 13 nt, Mycobacterium bovis subsp bovis AF2122/97
cgcgcccaccggg

SEQ ID NO: 3145802 - RNA, 15 nt, Mycobacterium bovis subsp bovis AF2122/97
cgcgcccaccgggcg

SEQ ID NO: 3145803 - RNA, 16 nt, Mycobacterium bovis subsp bovis AF2122/97
cgcgcccaccgggcgg

SEQ ID NO: 3145804 - RNA, 20 nt, Mycobacterium bovis subsp bovis AF2122/97
cgcgcccagaccgacccgca

SEQ ID NO: 3145805 - RNA, 17 nt, Mycobacterium bovis subsp bovis AF2122/97
cgcgccccaccgcgccg

SEQ ID NO: 3145806 - RNA, 19 nt, Mycobacterium bovis subsp bovis AF2122/97
cgcgccccagacgcgcagg

SEQ ID NO: 3145807 - RNA, 17 nt, Mycobacterium bovis subsp bovis AF2122/97
cgcgccccaguucgacg

SEQ ID NO: 3145808 - RNA, 19 nt, Mycobacterium bovis subsp bovis AF2122/97
cgcgcccccggugccguug

SEQ ID NO: 3145809 - RNA, 15 nt, Mycobacterium bovis subsp bovis AF2122/97
cgcgccccgcggcag

SEQ ID NO: 3145810 - RNA, 22 nt, Mycobacterium bovis subsp bovis AF2122/97
cgcgcccgacgagauugccggg

SEQ ID NO: 3145811 - RNA, 14 nt, Mycobacterium bovis subsp bovis AF2122/97
cgcgcccgcaccac

SEQ ID NO: 3145812 - RNA, 15 nt, Mycobacterium bovis subsp bovis AF2122/97
cgcgcccgcaccacc

SEQ ID NO: 3145813 - RNA, 16 nt, Mycobacterium bovis subsp bovis AF2122/97
cgcgcccgcaccaccg

SEQ ID NO: 3145814 - RNA, 19 nt, Mycobacterium bovis subsp bovis AF2122/97
cgcgcccgcaccaccggcc

SEQ ID NO: 3145815 - RNA, 22 nt, Mycobacterium bovis subsp bovis AF2122/97
cgcgcccgccaucagcccggcg

SEQ ID NO: 3145816 - RNA, 14 nt, Mycobacterium bovis subsp bovis AF2122/97
cgcgcccgccgcgg

SEQ ID NO: 3145817 - RNA, 14 nt, Mycobacterium bovis subsp bovis AF2122/97
cgcgcccgccucga

SEQ ID NO: 3145818 - RNA, 14 nt, Mycobacterium bovis subsp bovis AF2122/97
cgcgcccgcgcgcu

SEQ ID NO: 3145819 - RNA, 13 nt, Mycobacterium bovis subsp bovis AF2122/97
cgcgcccgcggcc

SEQ ID NO: 3145820 - RNA, 16 nt, Mycobacterium bovis subsp bovis AF2122/97
cgcgcccgcggccgcc

SEQ ID NO: 3145821 - RNA, 19 nt, Mycobacterium bovis subsp bovis AF2122/97
cgcgcccggaucucggcgu

SEQ ID NO: 3145822 - RNA, 21 nt, Mycobacterium bovis subsp bovis AF2122/97
cgcgcccggaucucggcguag

SEQ ID NO: 3145823 - RNA, 23 nt, Mycobacterium bovis subsp bovis AF2122/97
cgcgcccgucccacugaccgaac

SEQ ID NO: 3145824 - RNA, 14 nt, Mycobacterium bovis subsp bovis AF2122/97
cgcgcccuagcugg

SEQ ID NO: 3145825 - RNA, 20 nt, Mycobacterium bovis subsp bovis AF2122/97
cgcgcccuagcuggugcgcc

SEQ ID NO: 3145826 - RNA, 13 nt, Mycobacterium bovis subsp bovis AF2122/97
cgcgcccucagcc

SEQ ID NO: 3145827 - RNA, 14 nt, Mycobacterium bovis subsp bovis AF2122/97
cgcgcccucagccg

SEQ ID NO: 3145828 - RNA, 15 nt, Mycobacterium bovis subsp bovis AF2122/97
cgcgcccucagccgc

SEQ ID NO: 3145829 - RNA, 20 nt, Mycobacterium bovis subsp bovis AF2122/97
cgcgcccucagccgcggcca

SEQ ID NO: 3145830 - RNA, 20 nt, Mycobacterium bovis subsp bovis AF2122/97
cgcgcccugcggaucggaca

SEQ ID NO: 3145831 - RNA, 18 nt, Mycobacterium bovis subsp bovis AF2122/97
cgcgccgaaggccgccac

SEQ ID NO: 3145832 - RNA, 17 nt, Mycobacterium bovis subsp bovis AF2122/97
cgcgccgaaucgcgggc

SEQ ID NO: 3145833 - RNA, 17 nt, Mycobacterium bovis subsp bovis AF2122/97
cgcgccgaccaccgcug

SEQ ID NO: 3145834 - RNA, 23 nt, Mycobacterium bovis subsp bovis AF2122/97
cgcgccgaccagaacgacgccgc

SEQ ID NO: 3145835 - RNA, 14 nt, Mycobacterium bovis subsp bovis AF2122/97
cgcgccgacggcca

SEQ ID NO: 3145836 - RNA, 15 nt, Mycobacterium bovis subsp bovis AF2122/97
cgcgccgagccagca

SEQ ID NO: 3145837 - RNA, 17 nt, Mycobacterium bovis subsp bovis AF2122/97
cgcgccgagccagcacc

SEQ ID NO: 3145838 - RNA, 15 nt, Mycobacterium bovis subsp bovis AF2122/97
cgcgccgagcccggg

SEQ ID NO: 3145839 - RNA, 13 nt, Mycobacterium bovis subsp bovis AF2122/97
cgcgcgaacccca

SEQ ID NO: 3145840 - RNA, 17 nt, Mycobacterium bovis subsp bovis AF2122/97
cgcgcgaaccccagccg

SEQ ID NO: 3145841 - RNA, 15 nt, Mycobacterium bovis subsp bovis AF2122/97
cgcgcgaaccgcucc

SEQ ID NO: 3145842 - RNA, 16 nt, Mycobacterium bovis subsp bovis AF2122/97
cgcgcgaaccgcuccg

SEQ ID NO: 3145843 - RNA, 16 nt, Mycobacterium bovis subsp bovis AF2122/97
cgcgcgaauguccggc

SEQ ID NO: 3145844 - RNA, 16 nt, Mycobacterium bovis subsp bovis AF2122/97
cgcgcgacaacccggc

SEQ ID NO: 3145845 - RNA, 21 nt, Mycobacterium bovis subsp bovis AF2122/97
cgcgcgacaacccggcgucga

SEQ ID NO: 3145846 - RNA, 20 nt, Mycobacterium bovis subsp bovis AF2122/97
cgcgcgaccauacccgcgcg

SEQ ID NO: 3145847 - RNA, 21 nt, Mycobacterium bovis subsp bovis AF2122/97
cgcgcgaccucgcuggccgca

SEQ ID NO: 3145848 - RNA, 17 nt, Mycobacterium bovis subsp bovis AF2122/97
cgcgcgacuuucugcgc

SEQ ID NO: 3145849 - RNA, 19 nt, Mycobacterium bovis subsp bovis AF2122/97
cgcgcgacuuucugcgcgu

SEQ ID NO: 3145850 - RNA, 15 nt, Mycobacterium bovis subsp bovis AF2122/97
cgcgcgauggcgcgu

SEQ ID NO: 3145851 - RNA, 19 nt, Mycobacterium bovis subsp bovis AF2122/97
cgcgcgcacgccaccggga

SEQ ID NO: 3145852 - RNA, 13 nt, Mycobacterium bovis subsp bovis AF2122/97
cgcgcgcacggcg

SEQ ID NO: 3145853 - RNA, 23 nt, Mycobacterium bovis subsp bovis AF2122/97
cgcgcgcagaucguccaccgccg

SEQ ID NO: 3145854 - RNA, 14 nt, Mycobacterium bovis subsp bovis AF2122/97
cgcgcgcagccggg

SEQ ID NO: 3145855 - RNA, 16 nt, Mycobacterium bovis subsp bovis AF2122/97
cgcgcgcagcugacgu

SEQ ID NO: 3145856 - RNA, 15 nt, Mycobacterium bovis subsp bovis AF2122/97
cgcgcgcaggccgcc

SEQ ID NO: 3145857 - RNA, 19 nt, Mycobacterium bovis subsp bovis AF2122/97
cgcgcgcaggccgccgcca

SEQ ID NO: 3145858 - RNA, 13 nt, Mycobacterium bovis subsp bovis AF2122/97
cgcgcgcagggcg

SEQ ID NO: 3145859 - RNA, 14 nt, Mycobacterium bovis subsp bovis AF2122/97
cgcgcgccagcucg

SEQ ID NO: 3145860 - RNA, 17 nt, Mycobacterium bovis subsp bovis AF2122/97
cgcgcgccagcucggcg

SEQ ID NO: 3145861 - RNA, 17 nt, Mycobacterium bovis subsp bovis AF2122/97
cgcgcgccaucgccucc

SEQ ID NO: 3145862 - RNA, 19 nt, Mycobacterium bovis subsp bovis AF2122/97
cgcgcgccauuggcggugg

SEQ ID NO: 3145863 - RNA, 23 nt, Mycobacterium bovis subsp bovis AF2122/97
cgcgcgcccgaaugcgacgucgu

SEQ ID NO: 3145864 - RNA, 16 nt, Mycobacterium bovis subsp bovis AF2122/97
cgcgcgcccgauccgg

SEQ ID NO: 3145865 - RNA, 17 nt, Mycobacterium bovis subsp bovis AF2122/97
cgcgcgcccgauccggu

SEQ ID NO: 3145866 - RNA, 12 nt, Mycobacterium bovis subsp bovis AF2122/97
cgcgcgcccggg

SEQ ID NO: 3145867 - RNA, 20 nt, Mycobacterium bovis subsp bovis AF2122/97
cgcgcgccgaccgacgucgc

SEQ ID NO: 3145868 - RNA, 13 nt, Mycobacterium bovis subsp bovis AF2122/97
cgcgcgccgagcc

SEQ ID NO: 3145869 - RNA, 14 nt, Mycobacterium bovis subsp bovis AF2122/97
cgcgcgccgcagcg

SEQ ID NO: 3145870 - RNA, 12 nt, Mycobacterium bovis subsp bovis AF2122/97
cgcgcgccgcga

SEQ ID NO: 3145871 - RNA, 15 nt, Mycobacterium bovis subsp bovis AF2122/97
cgcgcgccgcgacga

SEQ ID NO: 3145872 - RNA, 12 nt, Mycobacterium bovis subsp bovis AF2122/97
cgcgcgccggcg

SEQ ID NO: 3145873 - RNA, 13 nt, Mycobacterium bovis subsp bovis AF2122/97
cgcgcgccggcga

SEQ ID NO: 3145874 - RNA, 13 nt, Mycobacterium bovis subsp bovis AF2122/97
cgcgcgccggcgg

SEQ ID NO: 3145875 - RNA, 15 nt, Mycobacterium bovis subsp bovis AF2122/97
cgcgcgccggcggua

SEQ ID NO: 3145876 - RNA, 14 nt, Mycobacterium bovis subsp bovis AF2122/97
cgcgcgcgauggac

SEQ ID NO: 3145877 - RNA, 20 nt, Mycobacterium bovis subsp bovis AF2122/97
cgcgcgcgauggacaacaag

SEQ ID NO: 3145878 - RNA, 11 nt, Mycobacterium bovis subsp bovis AF2122/97
cgcgcgcgcca

SEQ ID NO: 3145879 - RNA, 14 nt, Mycobacterium bovis subsp bovis AF2122/97
cgcgcgcggcgacg

SEQ ID NO: 3145880 - RNA, 14 nt, Mycobacterium bovis subsp bovis AF2122/97
cgcgcgcggcguag

SEQ ID NO: 3145881 - RNA, 12 nt, Mycobacterium bovis subsp bovis AF2122/97
cgcgcgcgggug

SEQ ID NO: 3145882 - RNA, 13 nt, Mycobacterium bovis subsp bovis AF2122/97
cgcgcgcggucga

SEQ ID NO: 3145883 - RNA, 18 nt, Mycobacterium bovis subsp bovis AF2122/97
cgcgcgcggugcggccac

SEQ ID NO: 3145884 - RNA, 15 nt, Mycobacterium bovis subsp bovis AF2122/97
cgcgcgcuccagaug

SEQ ID NO: 3145885 - RNA, 13 nt, Mycobacterium bovis subsp bovis AF2122/97
cgcgcgcucgccc

SEQ ID NO: 3145886 - RNA, 15 nt, Mycobacterium bovis subsp bovis AF2122/97
cgcgcgcucgcccag

SEQ ID NO: 3145887 - RNA, 12 nt, Mycobacterium bovis subsp bovis AF2122/97
cgcgcgcucgcg

SEQ ID NO: 3145888 - RNA, 14 nt, Mycobacterium bovis subsp bovis AF2122/97
cgcgcgcucgcggc

SEQ ID NO: 3145889 - RNA, 17 nt, Mycobacterium bovis subsp bovis AF2122/97
cgcgcgcucgcucaccg

SEQ ID NO: 3145890 - RNA, 18 nt, Mycobacterium bovis subsp bovis AF2122/97
cgcgcgcucgcucaccgg

SEQ ID NO: 3145891 - RNA, 20 nt, Mycobacterium bovis subsp bovis AF2122/97
cgcgcgcucgcucaccggcg

SEQ ID NO: 3145892 - RNA, 13 nt, Mycobacterium bovis subsp bovis AF2122/97
cgcgcgcugcgca

SEQ ID NO: 3145893 - RNA, 14 nt, Mycobacterium bovis subsp bovis AF2122/97
cgcgcgcugggccc

SEQ ID NO: 3145894 - RNA, 13 nt, Mycobacterium bovis subsp bovis AF2122/97
cgcgcgcugggcg

SEQ ID NO: 3145895 - RNA, 14 nt, Mycobacterium bovis subsp bovis AF2122/97
cgcgcgcugggcgc

SEQ ID NO: 3145896 - RNA, 19 nt, Mycobacterium bovis subsp bovis AF2122/97
cgcgcgcugggcgcgcuca

SEQ ID NO: 3145897 - RNA, 15 nt, Mycobacterium bovis subsp bovis AF2122/97
cgcgcggaagcucau

SEQ ID NO: 3145898 - RNA, 17 nt, Mycobacterium bovis subsp bovis AF2122/97
cgcgcggacccagcacc

SEQ ID NO: 3145899 - RNA, 19 nt, Mycobacterium bovis subsp bovis AF2122/97
cgcgcggagaccccgcgcg

SEQ ID NO: 3145900 - RNA, 21 nt, Mycobacterium bovis subsp bovis AF2122/97
cgcgcggagaccccgcgcgcu

SEQ ID NO: 3145901 - RNA, 15 nt, Mycobacterium bovis subsp bovis AF2122/97
cgcgcggaucggcgg

SEQ ID NO: 3145902 - RNA, 20 nt, Mycobacterium bovis subsp bovis AF2122/97
cgcgcggaucggcggccgcg

SEQ ID NO: 3145903 - RNA, 21 nt, Mycobacterium bovis subsp bovis AF2122/97
cgcgcggaucggcggccgcga

SEQ ID NO: 3145904 - RNA, 20 nt, Mycobacterium bovis subsp bovis AF2122/97
cgcgcggauggccucggcga

SEQ ID NO: 3145905 - RNA, 20 nt, Mycobacterium bovis subsp bovis AF2122/97
cgcgcggcaccgauggcgca

SEQ ID NO: 3145906 - RNA, 13 nt, Mycobacterium bovis subsp bovis AF2122/97
cgcgcggcacuug

SEQ ID NO: 3145907 - RNA, 21 nt, Mycobacterium bovis subsp bovis AF2122/97
cgcgcggccaaucagcccgcc

SEQ ID NO: 3145908 - RNA, 14 nt, Mycobacterium bovis subsp bovis AF2122/97
cgcgcggccagccc

SEQ ID NO: 3145909 - RNA, 16 nt, Mycobacterium bovis subsp bovis AF2122/97
cgcgcggccagcccac

SEQ ID NO: 3145910 - RNA, 17 nt, Mycobacterium bovis subsp bovis AF2122/97
cgcgcggccagcccacu

SEQ ID NO: 3145911 - RNA, 22 nt, Mycobacterium bovis subsp bovis AF2122/97
cgcgcggccagcccacucgucg

SEQ ID NO: 3145912 - RNA, 14 nt, Mycobacterium bovis subsp bovis AF2122/97
cgcgcggcccgccg

SEQ ID NO: 3145913 - RNA, 16 nt, Mycobacterium bovis subsp bovis AF2122/97
cgcgcggcccgccgag

SEQ ID NO: 3145914 - RNA, 22 nt, Mycobacterium bovis subsp bovis AF2122/97
cgcgcggcgagagccucggcca

SEQ ID NO: 3145915 - RNA, 13 nt, Mycobacterium bovis subsp bovis AF2122/97
cgcgcggcgcagc

SEQ ID NO: 3145916 - RNA, 15 nt, Mycobacterium bovis subsp bovis AF2122/97
cgcgcggcgcagcac

SEQ ID NO: 3145917 - RNA, 14 nt, Mycobacterium bovis subsp bovis AF2122/97
cgcgcggcgccgca

SEQ ID NO: 3145918 - RNA, 15 nt, Mycobacterium bovis subsp bovis AF2122/97
cgcgcggcggccgcg

SEQ ID NO: 3145919 - RNA, 14 nt, Mycobacterium bovis subsp bovis AF2122/97
cgcgcggcgucgug

SEQ ID NO: 3145920 - RNA, 23 nt, Mycobacterium bovis subsp bovis AF2122/97
cgcgcggcuccguuguccagcgc

SEQ ID NO: 3145921 - RNA, 12 nt, Mycobacterium bovis subsp bovis AF2122/97
cgcgcggcucga

SEQ ID NO: 3145922 - RNA, 16 nt, Mycobacterium bovis subsp bovis AF2122/97
cgcgcgggccgccgca

SEQ ID NO: 3145923 - RNA, 16 nt, Mycobacterium bovis subsp bovis AF2122/97
cgcgcggggccucgcg

SEQ ID NO: 3145924 - RNA, 20 nt, Mycobacterium bovis subsp bovis AF2122/97
cgcgcgggguggcggcgcug

SEQ ID NO: 3145925 - RNA, 15 nt, Mycobacterium bovis subsp bovis AF2122/97
cgcgcggguggcggc

SEQ ID NO: 3145926 - RNA, 16 nt, Mycobacterium bovis subsp bovis AF2122/97
cgcgcggguuacccgc

SEQ ID NO: 3145927 - RNA, 21 nt, Mycobacterium bovis subsp bovis AF2122/97
cgcgcugcggcccacaccagc

SEQ ID NO: 3145928 - RNA, 23 nt, Mycobacterium bovis subsp bovis AF2122/97
cgcgcugcggcccacaccagcgc

SEQ ID NO: 3145929 - RNA, 15 nt, Mycobacterium bovis subsp bovis AF2122/97
cgcgcugcuucuucg

SEQ ID NO: 3145930 - RNA, 13 nt, Mycobacterium bovis subsp bovis AF2122/97
cgcgcuggcgccc

SEQ ID NO: 3145931 - RNA, 22 nt, Mycobacterium bovis subsp bovis AF2122/97
cgcgcuggcgcccuugccggcg

SEQ ID NO: 3145932 - RNA, 18 nt, Mycobacterium bovis subsp bovis AF2122/97
cgcgcuggcuacccaccg

SEQ ID NO: 3145933 - RNA, 20 nt, Mycobacterium bovis subsp bovis AF2122/97
cgcgcugggcccgagcgcgc

SEQ ID NO: 3145934 - RNA, 23 nt, Mycobacterium bovis subsp bovis AF2122/97
cgcgcuggucaacuccacgcgga

SEQ ID NO: 3145935 - RNA, 17 nt, Mycobacterium bovis subsp bovis AF2122/97
cgcgcuggugauucgca

SEQ ID NO: 3145936 - RNA, 22 nt, Mycobacterium bovis subsp bovis AF2122/97
cgcgcuguccacgaugacgucg

SEQ ID NO: 3145937 - RNA, 13 nt, Mycobacterium bovis subsp bovis AF2122/97
cgcgcugugccgu

SEQ ID NO: 3145938 - RNA, 16 nt, Mycobacterium bovis subsp bovis AF2122/97
cgcgcugugccgugcg

SEQ ID NO: 3145939 - RNA, 17 nt, Mycobacterium bovis subsp bovis AF2122/97
cgcgcugugccgugcga

SEQ ID NO: 3145940 - RNA, 22 nt, Mycobacterium bovis subsp bovis AF2122/97
cgcgcuguugccaucgacgccg

SEQ ID NO: 3145941 - RNA, 13 nt, Mycobacterium bovis subsp bovis AF2122/97
cgcgcuucacagc

SEQ ID NO: 3145942 - RNA, 20 nt, Mycobacterium bovis subsp bovis AF2122/97
cgcgcuucacagccaccagc

SEQ ID NO: 3145943 - RNA, 23 nt, Mycobacterium bovis subsp bovis AF2122/97
cgcgcuucacagccaccagccgg

SEQ ID NO: 3145944 - RNA, 19 nt, Mycobacterium bovis subsp bovis AF2122/97
cgcgcuucaggcaucaccg

SEQ ID NO: 3145945 - RNA, 16 nt, Mycobacterium bovis subsp bovis AF2122/97
cgcgcuucaugagccg

SEQ ID NO: 3145946 - RNA, 15 nt, Mycobacterium bovis subsp bovis AF2122/97
cgcgcuugauccacc

SEQ ID NO: 3145947 - RNA, 19 nt, Mycobacterium bovis subsp bovis AF2122/97
cgcgcuugauccacccgac

SEQ ID NO: 3145948 - RNA, 12 nt, Mycobacterium bovis subsp bovis AF2122/97
cgcgcuugcgau

SEQ ID NO: 3145949 - RNA, 14 nt, Mycobacterium bovis subsp bovis AF2122/97
cgcgcuugcgaucg

SEQ ID NO: 3145950 - RNA, 18 nt, Mycobacterium bovis subsp bovis AF2122/97
cgcgcuugcgaucggcac

SEQ ID NO: 3145951 - RNA, 13 nt, Mycobacterium bovis subsp bovis AF2122/97
cgcgcuugcgccg

SEQ ID NO: 3145952 - RNA, 14 nt, Mycobacterium bovis subsp bovis AF2122/97
cgcgcuugggcacu

SEQ ID NO: 3145953 - RNA, 21 nt, Mycobacterium bovis subsp bovis AF2122/97
cgcgcuugggcacuucggcga

SEQ ID NO: 3145954 - RNA, 17 nt, Mycobacterium bovis subsp bovis AF2122/97
cgcgcuugggguccgga

SEQ ID NO: 3145955 - RNA, 22 nt, Mycobacterium bovis subsp bovis AF2122/97
cgcgcuugguguggcccaaccg

SEQ ID NO: 3145956 - RNA, 21 nt, Mycobacterium bovis subsp bovis AF2122/97
cgcgcuuucgagugcagcggc

SEQ ID NO: 3145957 - RNA, 22 nt, Mycobacterium bovis subsp bovis AF2122/97
cgcgcuuucgagugcagcggcg

SEQ ID NO: 3145958 - RNA, 21 nt, Mycobacterium bovis subsp bovis AF2122/97
cgcgcuuuucuccgccgagca

SEQ ID NO: 3145959 - RNA, 18 nt, Mycobacterium bovis subsp bovis AF2122/97
cgcggaaaccaucgccag

SEQ ID NO: 3145960 - RNA, 20 nt, Mycobacterium bovis subsp bovis AF2122/97
cgcggaaaccaucgccagcc

SEQ ID NO: 3145961 - RNA, 22 nt, Mycobacterium bovis subsp bovis AF2122/97
cgcggaaaccaucgccagccgg

SEQ ID NO: 3145962 - RNA, 15 nt, Mycobacterium bovis subsp bovis AF2122/97
cgcggaaaggcuucc

SEQ ID NO: 3145963 - RNA, 17 nt, Mycobacterium bovis subsp bovis AF2122/97
cgcggaacaccgaggcg

SEQ ID NO: 3145964 - RNA, 23 nt, Mycobacterium bovis subsp bovis AF2122/97
cgcggaacgcgucgccgacgccg

SEQ ID NO: 3145965 - RNA, 20 nt, Mycobacterium bovis subsp bovis AF2122/97
cgcggaacucgucgcugccc

SEQ ID NO: 3145966 - RNA, 18 nt, Mycobacterium bovis subsp bovis AF2122/97
cgcggaagcgggcgaugc

SEQ ID NO: 3145967 - RNA, 15 nt, Mycobacterium bovis subsp bovis AF2122/97
cgcggaaggccagcu

SEQ ID NO: 3145968 - RNA, 23 nt, Mycobacterium bovis subsp bovis AF2122/97
cgcggaaguaccguuccacgucg

SEQ ID NO: 3145969 - RNA, 16 nt, Mycobacterium bovis subsp bovis AF2122/97
cgcggaagugucgucg

SEQ ID NO: 3145970 - RNA, 15 nt, Mycobacterium bovis subsp bovis AF2122/97
cgcggaaucgcaccg

SEQ ID NO: 3145971 - RNA, 20 nt, Mycobacterium bovis subsp bovis AF2122/97
cgcggaaucgcaucggcggg

SEQ ID NO: 3145972 - RNA, 14 nt, Mycobacterium bovis subsp bovis AF2122/97
cgcggacaccagga

SEQ ID NO: 3145973 - RNA, 23 nt, Mycobacterium bovis subsp bovis AF2122/97
cgcggacaccaggaugccuaccg

SEQ ID NO: 3145974 - RNA, 17 nt, Mycobacterium bovis subsp bovis AF2122/97
cgcggacaccgcggcga

SEQ ID NO: 3145975 - RNA, 20 nt, Mycobacterium bovis subsp bovis AF2122/97
cgcggacacgaucgcgucgg

SEQ ID NO: 3145976 - RNA, 14 nt, Mycobacterium bovis subsp bovis AF2122/97
cgcggacacugcga

SEQ ID NO: 3145977 - RNA, 16 nt, Mycobacterium bovis subsp bovis AF2122/97
cgcggacacugcgaag

SEQ ID NO: 3145978 - RNA, 12 nt, Mycobacterium bovis subsp bovis AF2122/97
cgcggacagccc

SEQ ID NO: 3145979 - RNA, 20 nt, Mycobacterium bovis subsp bovis AF2122/97
cgcggacagcccggacgcgc

SEQ ID NO: 3145980 - RNA, 23 nt, Mycobacterium bovis subsp bovis AF2122/97
cgcggacagguagucgccgguca

SEQ ID NO: 3145981 - RNA, 22 nt, Mycobacterium bovis subsp bovis AF2122/97
cgcggacauccgggccgagcgc

SEQ ID NO: 3145982 - RNA, 19 nt, Mycobacterium bovis subsp bovis AF2122/97
cgcggacaugacagccccg

SEQ ID NO: 3145983 - RNA, 20 nt, Mycobacterium bovis subsp bovis AF2122/97
cgcggacaugacagccccgc

SEQ ID NO: 3145984 - RNA, 15 nt, Mycobacterium bovis subsp bovis AF2122/97
cgcggaccagagugg

SEQ ID NO: 3145985 - RNA, 17 nt, Mycobacterium bovis subsp bovis AF2122/97
cgcggacccgcagcugc

SEQ ID NO: 3145986 - RNA, 13 nt, Mycobacterium bovis subsp bovis AF2122/97
cgcggacccgccg

SEQ ID NO: 3145987 - RNA, 12 nt, Mycobacterium bovis subsp bovis AF2122/97
cgcggacccgcg

SEQ ID NO: 3145988 - RNA, 13 nt, Mycobacterium bovis subsp bovis AF2122/97
cgcggacccgcgc

SEQ ID NO: 3145989 - RNA, 20 nt, Mycobacterium bovis subsp bovis AF2122/97
cgcggacccgcgcgucgccc

SEQ ID NO: 3145990 - RNA, 16 nt, Mycobacterium bovis subsp bovis AF2122/97
cgcggacccgucggcg

SEQ ID NO: 3145991 - RNA, 20 nt, Mycobacterium bovis subsp bovis AF2122/97
cgcggacccgucggcguggc

SEQ ID NO: 3145992 - RNA, 21 nt, Mycobacterium bovis subsp bovis AF2122/97
cgcggaccgcaacgacggccg

SEQ ID NO: 3145993 - RNA, 23 nt, Mycobacterium bovis subsp bovis AF2122/97
cgcggaccgcgaaugugaucacc

SEQ ID NO: 3145994 - RNA, 12 nt, Mycobacterium bovis subsp bovis AF2122/97
cgcggaccucga

SEQ ID NO: 3145995 - RNA, 21 nt, Mycobacterium bovis subsp bovis AF2122/97
cgcggaccucgaagcccagca

SEQ ID NO: 3145996 - RNA, 23 nt, Mycobacterium bovis subsp bovis AF2122/97
cgcggaccucgaagcccagcacc

SEQ ID NO: 3145997 - RNA, 14 nt, Mycobacterium bovis subsp bovis AF2122/97
cgcggaccucggcg

SEQ ID NO: 3145998 - RNA, 15 nt, Mycobacterium bovis subsp bovis AF2122/97
cgcggacggugcggu

SEQ ID NO: 3145999 - RNA, 14 nt, Mycobacterium bovis subsp bovis AF2122/97
cgcggacucgggca

SEQ ID NO: 3146000 - RNA, 19 nt, Mycobacterium bovis subsp bovis AF2122/97
cgcggacucgggcaggccc

SEQ ID NO: 3146001 - RNA, 16 nt, Mycobacterium bovis subsp bovis AF2122/97
cgcggacuugcgagcc

SEQ ID NO: 3146002 - RNA, 17 nt, Mycobacterium bovis subsp bovis AF2122/97
cgcggacuugcgagccg

SEQ ID NO: 3146003 - RNA, 16 nt, Mycobacterium bovis subsp bovis AF2122/97
cgcggagagccugcuc

SEQ ID NO: 3146004 - RNA, 21 nt, Mycobacterium bovis subsp bovis AF2122/97
cgcggagagcgccuuagccau

SEQ ID NO: 3146005 - RNA, 19 nt, Mycobacterium bovis subsp bovis AF2122/97
cgcggagccaggacgacgc

SEQ ID NO: 3146006 - RNA, 16 nt, Mycobacterium bovis subsp bovis AF2122/97
cgcggagcgugagcca

SEQ ID NO: 3146007 - RNA, 21 nt, Mycobacterium bovis subsp bovis AF2122/97
cgcggagcgugagccaugccg

SEQ ID NO: 3146008 - RNA, 14 nt, Mycobacterium bovis subsp bovis AF2122/97
cgcggaguagccgc

SEQ ID NO: 3146009 - RNA, 23 nt, Mycobacterium bovis subsp bovis AF2122/97
cgcggagucugcugaucgagcgg

SEQ ID NO: 3146010 - RNA, 17 nt, Mycobacterium bovis subsp bovis AF2122/97
cgcggagugcccagggc

SEQ ID NO: 3146011 - RNA, 19 nt, Mycobacterium bovis subsp bovis AF2122/97
cgcggagugcccagggccg

SEQ ID NO: 3146012 - RNA, 19 nt, Mycobacterium bovis subsp bovis AF2122/97
cgcggaucaacaggccggc

SEQ ID NO: 3146013 - RNA, 22 nt, Mycobacterium bovis subsp bovis AF2122/97
cgcggccaauugcgccgccaac

SEQ ID NO: 3146014 - RNA, 20 nt, Mycobacterium bovis subsp bovis AF2122/97
cgcggccacaaccucgucgu

SEQ ID NO: 3146015 - RNA, 22 nt, Mycobacterium bovis subsp bovis AF2122/97
cgcggccacaccuuggccgccg

SEQ ID NO: 3146016 - RNA, 22 nt, Mycobacterium bovis subsp bovis AF2122/97
cgcggccacauaccaccacgug

SEQ ID NO: 3146017 - RNA, 18 nt, Mycobacterium bovis subsp bovis AF2122/97
cgcggccacaucgccagc

SEQ ID NO: 3146018 - RNA, 19 nt, Mycobacterium bovis subsp bovis AF2122/97
cgcggccacaucgccagca

SEQ ID NO: 3146019 - RNA, 21 nt, Mycobacterium bovis subsp bovis AF2122/97
cgcggccacaucgccagcagc

SEQ ID NO: 3146020 - RNA, 21 nt, Mycobacterium bovis subsp bovis AF2122/97
cgcggccacaugaucgagcag

SEQ ID NO: 3146021 - RNA, 12 nt, Mycobacterium bovis subsp bovis AF2122/97
cgcggccaccac

SEQ ID NO: 3146022 - RNA, 20 nt, Mycobacterium bovis subsp bovis AF2122/97
cgcggccaccacaacgccag

SEQ ID NO: 3146023 - RNA, 15 nt, Mycobacterium bovis subsp bovis AF2122/97
cgcggccaccaccag

SEQ ID NO: 3146024 - RNA, 23 nt, Mycobacterium bovis subsp bovis AF2122/97
cgcggccaccaccaggcugacgu

SEQ ID NO: 3146025 - RNA, 16 nt, Mycobacterium bovis subsp bovis AF2122/97
cgcggccaccaccgcc

SEQ ID NO: 3146026 - RNA, 17 nt, Mycobacterium bovis subsp bovis AF2122/97
cgcggccaccaccgccg

SEQ ID NO: 3146027 - RNA, 13 nt, Mycobacterium bovis subsp bovis AF2122/97
cgcggccaccgac

SEQ ID NO: 3146028 - RNA, 15 nt, Mycobacterium bovis subsp bovis AF2122/97
cgcggccaccgaccg

SEQ ID NO: 3146029 - RNA, 18 nt, Mycobacterium bovis subsp bovis AF2122/97
cgcggccaccgccgccgc

SEQ ID NO: 3146030 - RNA, 21 nt, Mycobacterium bovis subsp bovis AF2122/97
cgcggccaccgccgccgccga

SEQ ID NO: 3146031 - RNA, 22 nt, Mycobacterium bovis subsp bovis AF2122/97
cgcggccaccgccgccgccgac

SEQ ID NO: 3146032 - RNA, 13 nt, Mycobacterium bovis subsp bovis AF2122/97
cgcggccacgccg

SEQ ID NO: 3146033 - RNA, 16 nt, Mycobacterium bovis subsp bovis AF2122/97
cgcggccacgccgauc

SEQ ID NO: 3146034 - RNA, 18 nt, Mycobacterium bovis subsp bovis AF2122/97
cgcggccacggucagcca

SEQ ID NO: 3146035 - RNA, 22 nt, Mycobacterium bovis subsp bovis AF2122/97
cgcggccacggucagccaggug

SEQ ID NO: 3146036 - RNA, 18 nt, Mycobacterium bovis subsp bovis AF2122/97
cgcggccagagccgcgcg

SEQ ID NO: 3146037 - RNA, 16 nt, Mycobacterium bovis subsp bovis AF2122/97
cgcggccagcaccggg

SEQ ID NO: 3146038 - RNA, 13 nt, Mycobacterium bovis subsp bovis AF2122/97
cgcggccagcagc

SEQ ID NO: 3146039 - RNA, 14 nt, Mycobacterium bovis subsp bovis AF2122/97
cgcggccagcggga

SEQ ID NO: 3146040 - RNA, 18 nt, Mycobacterium bovis subsp bovis AF2122/97
cgcggccaucgccgacac

SEQ ID NO: 3146041 - RNA, 22 nt, Mycobacterium bovis subsp bovis AF2122/97
cgcggccauuagcagcacccgg

SEQ ID NO: 3146042 - RNA, 14 nt, Mycobacterium bovis subsp bovis AF2122/97
cgcggcccaccuca

SEQ ID NO: 3146043 - RNA, 23 nt, Mycobacterium bovis subsp bovis AF2122/97
cgcggcccacucucgccacgccg

SEQ ID NO: 3146044 - RNA, 23 nt, Mycobacterium bovis subsp bovis AF2122/97
cgcggcccagguccgcgugcugc

SEQ ID NO: 3146045 - RNA, 22 nt, Mycobacterium bovis subsp bovis AF2122/97
cgcggcccaugaaggagauccc

SEQ ID NO: 3146046 - RNA, 18 nt, Mycobacterium bovis subsp bovis AF2122/97
cgcggccccgacugccgc

SEQ ID NO: 3146047 - RNA, 14 nt, Mycobacterium bovis subsp bovis AF2122/97
cgcggcccgcagcg

SEQ ID NO: 3146048 - RNA, 20 nt, Mycobacterium bovis subsp bovis AF2122/97
cgcggcccgccucggcggcg

SEQ ID NO: 3146049 - RNA, 21 nt, Mycobacterium bovis subsp bovis AF2122/97
cgcggcccgcucgaucggcag

SEQ ID NO: 3146050 - RNA, 18 nt, Mycobacterium bovis subsp bovis AF2122/97
cgcggcccggacgucggc

SEQ ID NO: 3146051 - RNA, 13 nt, Mycobacterium bovis subsp bovis AF2122/97
cgcggcccggccc

SEQ ID NO: 3146052 - RNA, 20 nt, Mycobacterium bovis subsp bovis AF2122/97
cgcggcccggcccuccgggc

SEQ ID NO: 3146053 - RNA, 13 nt, Mycobacterium bovis subsp bovis AF2122/97
cgcggcccucgau

SEQ ID NO: 3146054 - RNA, 15 nt, Mycobacterium bovis subsp bovis AF2122/97
cgcggccgagacggc

SEQ ID NO: 3146055 - RNA, 15 nt, Mycobacterium bovis subsp bovis AF2122/97
cgcggccgaggucgc

SEQ ID NO: 3146056 - RNA, 18 nt, Mycobacterium bovis subsp bovis AF2122/97
cgcggccgaggucgcggu

SEQ ID NO: 3146057 - RNA, 18 nt, Mycobacterium bovis subsp bovis AF2122/97
cgcggccgcagccagcaa

SEQ ID NO: 3146058 - RNA, 13 nt, Mycobacterium bovis subsp bovis AF2122/97
cgcggccgccagc

SEQ ID NO: 3146059 - RNA, 15 nt, Mycobacterium bovis subsp bovis AF2122/97
cgcggccgccagcgg

SEQ ID NO: 3146060 - RNA, 16 nt, Mycobacterium bovis subsp bovis AF2122/97
cgcggccgccagcgga

SEQ ID NO: 3146061 - RNA, 19 nt, Mycobacterium bovis subsp bovis AF2122/97
cgcggccgccccaggcugg

SEQ ID NO: 3146062 - RNA, 15 nt, Mycobacterium bovis subsp bovis AF2122/97
cgcggccgccguccc

SEQ ID NO: 3146063 - RNA, 19 nt, Mycobacterium bovis subsp bovis AF2122/97
cgcggccgccguccccgcc

SEQ ID NO: 3146064 - RNA, 20 nt, Mycobacterium bovis subsp bovis AF2122/97
cgcggccgccguccccgccg

SEQ ID NO: 3146065 - RNA, 13 nt, Mycobacterium bovis subsp bovis AF2122/97
cgcggccgcggug

SEQ ID NO: 3146066 - RNA, 15 nt, Mycobacterium bovis subsp bovis AF2122/97
cgcggccgcucacau

SEQ ID NO: 3146067 - RNA, 21 nt, Mycobacterium bovis subsp bovis AF2122/97
cgcggccggaauacccggccc

SEQ ID NO: 3146068 - RNA, 13 nt, Mycobacterium bovis subsp bovis AF2122/97
cgcggccggcgcu

SEQ ID NO: 3146069 - RNA, 15 nt, Mycobacterium bovis subsp bovis AF2122/97
cgcggccggcgcucg

SEQ ID NO: 3146070 - RNA, 18 nt, Mycobacterium bovis subsp bovis AF2122/97
cgcggccggcgcucgcgg

SEQ ID NO: 3146071 - RNA, 23 nt, Mycobacterium bovis subsp bovis AF2122/97
cgcggccggcgcucgcggcggcg

SEQ ID NO: 3146072 - RNA, 13 nt, Mycobacterium bovis subsp bovis AF2122/97
cgcggccggcggc

SEQ ID NO: 3146073 - RNA, 14 nt, Mycobacterium bovis subsp bovis AF2122/97
cgcggccggcggcc

SEQ ID NO: 3146074 - RNA, 15 nt, Mycobacterium bovis subsp bovis AF2122/97
cgcggccggcggccg

SEQ ID NO: 3146075 - RNA, 19 nt, Mycobacterium bovis subsp bovis AF2122/97
cgcggccggcgucggcguc

SEQ ID NO: 3146076 - RNA, 16 nt, Mycobacterium bovis subsp bovis AF2122/97
cgcggccggcgugcca

SEQ ID NO: 3146077 - RNA, 19 nt, Mycobacterium bovis subsp bovis AF2122/97
cgcggccggcgugccagca

SEQ ID NO: 3146078 - RNA, 22 nt, Mycobacterium bovis subsp bovis AF2122/97
cgcggccggguggcccggcgaa

SEQ ID NO: 3146079 - RNA, 18 nt, Mycobacterium bovis subsp bovis AF2122/97
cgcggccguagugcacgu

SEQ ID NO: 3146080 - RNA, 14 nt, Mycobacterium bovis subsp bovis AF2122/97
cgcggccgucgcgg

SEQ ID NO: 3146081 - RNA, 12 nt, Mycobacterium bovis subsp bovis AF2122/97
cgcggccgugaa

SEQ ID NO: 3146082 - RNA, 17 nt, Mycobacterium bovis subsp bovis AF2122/97
cgcggccguggaugucg

SEQ ID NO: 3146083 - RNA, 15 nt, Mycobacterium bovis subsp bovis AF2122/97
cgcggccgugguggu

SEQ ID NO: 3146084 - RNA, 14 nt, Mycobacterium bovis subsp bovis AF2122/97
cgcggccucccgca

SEQ ID NO: 3146085 - RNA, 16 nt, Mycobacterium bovis subsp bovis AF2122/97
cgcggccucguagucc

SEQ ID NO: 3146086 - RNA, 13 nt, Mycobacterium bovis subsp bovis AF2122/97
cgcggccucgucg

SEQ ID NO: 3146087 - RNA, 20 nt, Mycobacterium bovis subsp bovis AF2122/97
cgcggccucguuguagccga

SEQ ID NO: 3146088 - RNA, 12 nt, Mycobacterium bovis subsp bovis AF2122/97
cgcggccugcac

SEQ ID NO: 3146089 - RNA, 17 nt, Mycobacterium bovis subsp bovis AF2122/97
cgcggccugcaccagcg

SEQ ID NO: 3146090 - RNA, 20 nt, Mycobacterium bovis subsp bovis AF2122/97
cgcggccugcaccagcgagu

SEQ ID NO: 3146091 - RNA, 22 nt, Mycobacterium bovis subsp bovis AF2122/97
cgcggccuugcgcacaggcgcg

SEQ ID NO: 3146092 - RNA, 16 nt, Mycobacterium bovis subsp bovis AF2122/97
cgcggccuuggcggcc

SEQ ID NO: 3146093 - RNA, 19 nt, Mycobacterium bovis subsp bovis AF2122/97
cgcggccuuggcggccgcg

SEQ ID NO: 3146094 - RNA, 21 nt, Mycobacterium bovis subsp bovis AF2122/97
cgcggccuuggcggccgcgac

SEQ ID NO: 3146095 - RNA, 18 nt, Mycobacterium bovis subsp bovis AF2122/97
cgcggcgaacaucaccgu

SEQ ID NO: 3146096 - RNA, 16 nt, Mycobacterium bovis subsp bovis AF2122/97
cgcggcgaaccagcgc

SEQ ID NO: 3146097 - RNA, 23 nt, Mycobacterium bovis subsp bovis AF2122/97
cgcggcgaaccgucucgcccccu

SEQ ID NO: 3146098 - RNA, 17 nt, Mycobacterium bovis subsp bovis AF2122/97
cgcggcgaagauaucgg

SEQ ID NO: 3146099 - RNA, 20 nt, Mycobacterium bovis subsp bovis AF2122/97
cgcggcugggggauaccgcu

SEQ ID NO: 3146100 - RNA, 21 nt, Mycobacterium bovis subsp bovis AF2122/97
cgcggcugggggauaccgcug

SEQ ID NO: 3146101 - RNA, 22 nt, Mycobacterium bovis subsp bovis AF2122/97
cgcggcugggggauaccgcugg

SEQ ID NO: 3146102 - RNA, 20 nt, Mycobacterium bovis subsp bovis AF2122/97
cgcggcugugcccgaucagc

SEQ ID NO: 3146103 - RNA, 16 nt, Mycobacterium bovis subsp bovis AF2122/97
cgcggcuucaguccgg

SEQ ID NO: 3146104 - RNA, 14 nt, Mycobacterium bovis subsp bovis AF2122/97
cgcggcuuccccgg

SEQ ID NO: 3146105 - RNA, 19 nt, Mycobacterium bovis subsp bovis AF2122/97
cgcggcuuccccgguagcg

SEQ ID NO: 3146106 - RNA, 23 nt, Mycobacterium bovis subsp bovis AF2122/97
cgcggcuucgucgacaucgccau

SEQ ID NO: 3146107 - RNA, 21 nt, Mycobacterium bovis subsp bovis AF2122/97
cgcggcuugggcuugcgccgg

SEQ ID NO: 3146108 - RNA, 15 nt, Mycobacterium bovis subsp bovis AF2122/97
cgcggcuugucgccc

SEQ ID NO: 3146109 - RNA, 15 nt, Mycobacterium bovis subsp bovis AF2122/97
cgcggcuugucgcgg

SEQ ID NO: 3146110 - RNA, 17 nt, Mycobacterium bovis subsp bovis AF2122/97
cgcggcuugucgcggug

SEQ ID NO: 3146111 - RNA, 16 nt, Mycobacterium bovis subsp bovis AF2122/97
cgcggcuuugacgccc

SEQ ID NO: 3146112 - RNA, 19 nt, Mycobacterium bovis subsp bovis AF2122/97
cgcggcuuugacgcccggc

SEQ ID NO: 3146113 - RNA, 22 nt, Mycobacterium bovis subsp bovis AF2122/97
cgcggcuuugacgcccggcacc

SEQ ID NO: 3146114 - RNA, 17 nt, Mycobacterium bovis subsp bovis AF2122/97
cgcgggaaaacggggug

SEQ ID NO: 3146115 - RNA, 19 nt, Mycobacterium bovis subsp bovis AF2122/97
cgcgggaaaacgggguggc

SEQ ID NO: 3146116 - RNA, 21 nt, Mycobacterium bovis subsp bovis AF2122/97
cgcgggaaacguuccagcuug

SEQ ID NO: 3146117 - RNA, 15 nt, Mycobacterium bovis subsp bovis AF2122/97
cgcgggaacgaugcc

SEQ ID NO: 3146118 - RNA, 21 nt, Mycobacterium bovis subsp bovis AF2122/97
cgcgggaacgaugccgccggc

SEQ ID NO: 3146119 - RNA, 13 nt, Mycobacterium bovis subsp bovis AF2122/97
cgcgggaagugca

SEQ ID NO: 3146120 - RNA, 18 nt, Mycobacterium bovis subsp bovis AF2122/97
cgcgggacaccaccgccc

SEQ ID NO: 3146121 - RNA, 17 nt, Mycobacterium bovis subsp bovis AF2122/97
cgcgggacacgucgcgc

SEQ ID NO: 3146122 - RNA, 20 nt, Mycobacterium bovis subsp bovis AF2122/97
cgcgggacacgucgcgccag

SEQ ID NO: 3146123 - RNA, 23 nt, Mycobacterium bovis subsp bovis AF2122/97
cgcgggacacgucgcgccaggcg

SEQ ID NO: 3146124 - RNA, 17 nt, Mycobacterium bovis subsp bovis AF2122/97
cgcgggacagauggcgg

SEQ ID NO: 3146125 - RNA, 17 nt, Mycobacterium bovis subsp bovis AF2122/97
cgcgggaccuucgagcc

SEQ ID NO: 3146126 - RNA, 20 nt, Mycobacterium bovis subsp bovis AF2122/97
cgcgggacgcgacucggcgg

SEQ ID NO: 3146127 - RNA, 23 nt, Mycobacterium bovis subsp bovis AF2122/97
cgcgggagaaaacggcggcgccg

SEQ ID NO: 3146128 - RNA, 22 nt, Mycobacterium bovis subsp bovis AF2122/97
cgcgggauccaggcccagccga

SEQ ID NO: 3146129 - RNA, 15 nt, Mycobacterium bovis subsp bovis AF2122/97
cgcgggaucgguggc

SEQ ID NO: 3146130 - RNA, 16 nt, Mycobacterium bovis subsp bovis AF2122/97
cgcgggaucgguggcg

SEQ ID NO: 3146131 - RNA, 19 nt, Mycobacterium bovis subsp bovis AF2122/97
cgcgggaucgguggcggca

SEQ ID NO: 3146132 - RNA, 21 nt, Mycobacterium bovis subsp bovis AF2122/97
cgcgggaucgguggcggcacg

SEQ ID NO: 3146133 - RNA, 18 nt, Mycobacterium bovis subsp bovis AF2122/97
cgcgggauggggcccgca

SEQ ID NO: 3146134 - RNA, 20 nt, Mycobacterium bovis subsp bovis AF2122/97
cgcgggauguaccccggccc

SEQ ID NO: 3146135 - RNA, 21 nt, Mycobacterium bovis subsp bovis AF2122/97
cgcgggauguaccccggcccg

SEQ ID NO: 3146136 - RNA, 15 nt, Mycobacterium bovis subsp bovis AF2122/97
cgcgggcaagccgga

SEQ ID NO: 3146137 - RNA, 13 nt, Mycobacterium bovis subsp bovis AF2122/97
cgcgggcaguggc

SEQ ID NO: 3146138 - RNA, 21 nt, Mycobacterium bovis subsp bovis AF2122/97
cgcgggcaguggcagcccguc

SEQ ID NO: 3146139 - RNA, 23 nt, Mycobacterium bovis subsp bovis AF2122/97
cgcgggcaguggcagcccgucgg

SEQ ID NO: 3146140 - RNA, 12 nt, Mycobacterium bovis subsp bovis AF2122/97
cgcgggcaucgu

SEQ ID NO: 3146141 - RNA, 14 nt, Mycobacterium bovis subsp bovis AF2122/97
cgcgggccaagccg

SEQ ID NO: 3146142 - RNA, 12 nt, Mycobacterium bovis subsp bovis AF2122/97
cgcgggccacca

SEQ ID NO: 3146143 - RNA, 17 nt, Mycobacterium bovis subsp bovis AF2122/97
cgcgggccaccaccgag

SEQ ID NO: 3146144 - RNA, 19 nt, Mycobacterium bovis subsp bovis AF2122/97
cgcgggccaccacgcgccg

SEQ ID NO: 3146145 - RNA, 22 nt, Mycobacterium bovis subsp bovis AF2122/97
cgcgggccaccacgcgccgcac

SEQ ID NO: 3146146 - RNA, 12 nt, Mycobacterium bovis subsp bovis AF2122/97
cgcgggccaccg

SEQ ID NO: 3146147 - RNA, 14 nt, Mycobacterium bovis subsp bovis AF2122/97
cgcgggccagcacc

SEQ ID NO: 3146148 - RNA, 21 nt, Mycobacterium bovis subsp bovis AF2122/97
cgcgggccccaucgccuggau

SEQ ID NO: 3146149 - RNA, 22 nt, Mycobacterium bovis subsp bovis AF2122/97
cgcgggcccgcgcggcgguguc

SEQ ID NO: 3146150 - RNA, 17 nt, Mycobacterium bovis subsp bovis AF2122/97
cgcgggccgacgcaggu

SEQ ID NO: 3146151 - RNA, 12 nt, Mycobacterium bovis subsp bovis AF2122/97
cgcgggccgccg

SEQ ID NO: 3146152 - RNA, 17 nt, Mycobacterium bovis subsp bovis AF2122/97
cgcgggccggcgacugu

SEQ ID NO: 3146153 - RNA, 14 nt, Mycobacterium bovis subsp bovis AF2122/97
cgcgggccuggccc

SEQ ID NO: 3146154 - RNA, 20 nt, Mycobacterium bovis subsp bovis AF2122/97
cgcgggccuggcccacgccg

SEQ ID NO: 3146155 - RNA, 20 nt, Mycobacterium bovis subsp bovis AF2122/97
cgcgggcgaccaccgcggca

SEQ ID NO: 3146156 - RNA, 14 nt, Mycobacterium bovis subsp bovis AF2122/97
cgcgggcgauggcc

SEQ ID NO: 3146157 - RNA, 20 nt, Mycobacterium bovis subsp bovis AF2122/97
cgcgggcgccgggaagcccc

SEQ ID NO: 3146158 - RNA, 13 nt, Mycobacterium bovis subsp bovis AF2122/97
cgcgggcgccggu

SEQ ID NO: 3146159 - RNA, 15 nt, Mycobacterium bovis subsp bovis AF2122/97
cgcgggcggaucgcc

SEQ ID NO: 3146160 - RNA, 19 nt, Mycobacterium bovis subsp bovis AF2122/97
cgcgggcggaucgccgggg

SEQ ID NO: 3146161 - RNA, 16 nt, Mycobacterium bovis subsp bovis AF2122/97
cgcgggcggcgcuggc

SEQ ID NO: 3146162 - RNA, 13 nt, Mycobacterium bovis subsp bovis AF2122/97
cgcgggcggcgug

SEQ ID NO: 3146163 - RNA, 19 nt, Mycobacterium bovis subsp bovis AF2122/97
cgcgggcgguaaucgcgag

SEQ ID NO: 3146164 - RNA, 22 nt, Mycobacterium bovis subsp bovis AF2122/97
cgcgggcgguaaucgcgagacc

SEQ ID NO: 3146165 - RNA, 16 nt, Mycobacterium bovis subsp bovis AF2122/97
cgcgggcgugccgacc

SEQ ID NO: 3146166 - RNA, 21 nt, Mycobacterium bovis subsp bovis AF2122/97
cgcgggcgugccgaccagcau

SEQ ID NO: 3146167 - RNA, 13 nt, Mycobacterium bovis subsp bovis AF2122/97
cgcgggcguuggc

SEQ ID NO: 3146168 - RNA, 17 nt, Mycobacterium bovis subsp bovis AF2122/97
cgcgggcguuggccagc

SEQ ID NO: 3146169 - RNA, 19 nt, Mycobacterium bovis subsp bovis AF2122/97
cgcgggcguuggccagcag

SEQ ID NO: 3146170 - RNA, 21 nt, Mycobacterium bovis subsp bovis AF2122/97
cgcgggcguuggccagcaggu

SEQ ID NO: 3146171 - RNA, 13 nt, Mycobacterium bovis subsp bovis AF2122/97
cgcgggcucacau

SEQ ID NO: 3146172 - RNA, 15 nt, Mycobacterium bovis subsp bovis AF2122/97
cgcgggcucgguggc

SEQ ID NO: 3146173 - RNA, 20 nt, Mycobacterium bovis subsp bovis AF2122/97
cgcggggaaucacccacucg

SEQ ID NO: 3146174 - RNA, 13 nt, Mycobacterium bovis subsp bovis AF2122/97
cgcggggccgccg

SEQ ID NO: 3146175 - RNA, 14 nt, Mycobacterium bovis subsp bovis AF2122/97
cgcggggccgccgc

SEQ ID NO: 3146176 - RNA, 17 nt, Mycobacterium bovis subsp bovis AF2122/97
cgcggggccgccgcggc

SEQ ID NO: 3146177 - RNA, 18 nt, Mycobacterium bovis subsp bovis AF2122/97
cgcggggccgccgcggcc

SEQ ID NO: 3146178 - RNA, 18 nt, Mycobacterium bovis subsp bovis AF2122/97
cgcggggccggaugacga

SEQ ID NO: 3146179 - RNA, 12 nt, Mycobacterium bovis subsp bovis AF2122/97
cgcggggccggc

SEQ ID NO: 3146180 - RNA, 13 nt, Mycobacterium bovis subsp bovis AF2122/97
cgcggggccggcc

SEQ ID NO: 3146181 - RNA, 17 nt, Mycobacterium bovis subsp bovis AF2122/97
cgcggggccggccggca

SEQ ID NO: 3146182 - RNA, 18 nt, Mycobacterium bovis subsp bovis AF2122/97
cgcggggccggccggcaa

SEQ ID NO: 3146183 - RNA, 14 nt, Mycobacterium bovis subsp bovis AF2122/97
cgcggggcucaacc

SEQ ID NO: 3146184 - RNA, 14 nt, Mycobacterium bovis subsp bovis AF2122/97
cgcgggggcggccg

SEQ ID NO: 3146185 - RNA, 13 nt, Mycobacterium bovis subsp bovis AF2122/97
cgcggucgugauc

SEQ ID NO: 3146186 - RNA, 18 nt, Mycobacterium bovis subsp bovis AF2122/97
cgcggucgugaucagcag

SEQ ID NO: 3146187 - RNA, 19 nt, Mycobacterium bovis subsp bovis AF2122/97
cgcggucgugaucagcagg

SEQ ID NO: 3146188 - RNA, 19 nt, Mycobacterium bovis subsp bovis AF2122/97
cgcggucucagugcucgcc

SEQ ID NO: 3146189 - RNA, 13 nt, Mycobacterium bovis subsp bovis AF2122/97
cgcggucucgagu

SEQ ID NO: 3146190 - RNA, 16 nt, Mycobacterium bovis subsp bovis AF2122/97
cgcggucucgagucgg

SEQ ID NO: 3146191 - RNA, 19 nt, Mycobacterium bovis subsp bovis AF2122/97
cgcggucugcgccuucgcc

SEQ ID NO: 3146192 - RNA, 23 nt, Mycobacterium bovis subsp bovis AF2122/97
cgcggucugcgccuucgccagcg

SEQ ID NO: 3146193 - RNA, 18 nt, Mycobacterium bovis subsp bovis AF2122/97
cgcggucugcuccaggcg

SEQ ID NO: 3146194 - RNA, 22 nt, Mycobacterium bovis subsp bovis AF2122/97
cgcggucugcuccaggcgcgcc

SEQ ID NO: 3146195 - RNA, 23 nt, Mycobacterium bovis subsp bovis AF2122/97
cgcggucugcuccaggcgcgccg

SEQ ID NO: 3146196 - RNA, 14 nt, Mycobacterium bovis subsp bovis AF2122/97
cgcggugaccaccc

SEQ ID NO: 3146197 - RNA, 19 nt, Mycobacterium bovis subsp bovis AF2122/97
cgcggugaccggcucggcg

SEQ ID NO: 3146198 - RNA, 20 nt, Mycobacterium bovis subsp bovis AF2122/97
cgcggugaccggcucggcgg

SEQ ID NO: 3146199 - RNA, 21 nt, Mycobacterium bovis subsp bovis AF2122/97
cgcggugaccggcucggcggu

SEQ ID NO: 3146200 - RNA, 19 nt, Mycobacterium bovis subsp bovis AF2122/97
cgcggugacgagccaccac

SEQ ID NO: 3146201 - RNA, 12 nt, Mycobacterium bovis subsp bovis AF2122/97
cgcggugacgau

SEQ ID NO: 3146202 - RNA, 20 nt, Mycobacterium bovis subsp bovis AF2122/97
cgcggugacgauugccacca

SEQ ID NO: 3146203 - RNA, 15 nt, Mycobacterium bovis subsp bovis AF2122/97
cgcggugacgccagc

SEQ ID NO: 3146204 - RNA, 19 nt, Mycobacterium bovis subsp bovis AF2122/97
cgcggugacgccagccugg

SEQ ID NO: 3146205 - RNA, 22 nt, Mycobacterium bovis subsp bovis AF2122/97
cgcggugacgccagccuggcca

SEQ ID NO: 3146206 - RNA, 12 nt, Mycobacterium bovis subsp bovis AF2122/97
cgcggugcccgc

SEQ ID NO: 3146207 - RNA, 13 nt, Mycobacterium bovis subsp bovis AF2122/97
cgcggugcccgcg

SEQ ID NO: 3146208 - RNA, 15 nt, Mycobacterium bovis subsp bovis AF2122/97
cgcggugcccgucgg

SEQ ID NO: 3146209 - RNA, 13 nt, Mycobacterium bovis subsp bovis AF2122/97
cgcggugcccugc

SEQ ID NO: 3146210 - RNA, 17 nt, Mycobacterium bovis subsp bovis AF2122/97
cgcggugcccugccggc

SEQ ID NO: 3146211 - RNA, 21 nt, Mycobacterium bovis subsp bovis AF2122/97
cgcggugcccugccggcagcg

SEQ ID NO: 3146212 - RNA, 23 nt, Mycobacterium bovis subsp bovis AF2122/97
cgcggugcccugccggcagcggc

SEQ ID NO: 3146213 - RNA, 19 nt, Mycobacterium bovis subsp bovis AF2122/97
cgcggugccgccaccggcg

SEQ ID NO: 3146214 - RNA, 14 nt, Mycobacterium bovis subsp bovis AF2122/97
cgcggugccggccg

SEQ ID NO: 3146215 - RNA, 15 nt, Mycobacterium bovis subsp bovis AF2122/97
cgcggugccggccgu

SEQ ID NO: 3146216 - RNA, 18 nt, Mycobacterium bovis subsp bovis AF2122/97
cgcggugccggccguucg

SEQ ID NO: 3146217 - RNA, 15 nt, Mycobacterium bovis subsp bovis AF2122/97
cgcggugccggcgga

SEQ ID NO: 3146218 - RNA, 14 nt, Mycobacterium bovis subsp bovis AF2122/97
cgcggugcgcgcaa

SEQ ID NO: 3146219 - RNA, 14 nt, Mycobacterium bovis subsp bovis AF2122/97
cgcggugcgcguga

SEQ ID NO: 3146220 - RNA, 18 nt, Mycobacterium bovis subsp bovis AF2122/97
cgcggugcgcgugacgac

SEQ ID NO: 3146221 - RNA, 20 nt, Mycobacterium bovis subsp bovis AF2122/97
cgcggugcgcgugacgacca

SEQ ID NO: 3146222 - RNA, 13 nt, Mycobacterium bovis subsp bovis AF2122/97
cgcggugcggcaa

SEQ ID NO: 3146223 - RNA, 17 nt, Mycobacterium bovis subsp bovis AF2122/97
cgcgguggaccgggcaa

SEQ ID NO: 3146224 - RNA, 14 nt, Mycobacterium bovis subsp bovis AF2122/97
cgcgguggaugcga

SEQ ID NO: 3146225 - RNA, 20 nt, Mycobacterium bovis subsp bovis AF2122/97
cgcgguggaugcgaugcgcg

SEQ ID NO: 3146226 - RNA, 17 nt, Mycobacterium bovis subsp bovis AF2122/97
cgcgguggccccgaugg

SEQ ID NO: 3146227 - RNA, 17 nt, Mycobacterium bovis subsp bovis AF2122/97
cgcgguggcggcgagca

SEQ ID NO: 3146228 - RNA, 20 nt, Mycobacterium bovis subsp bovis AF2122/97
cgcgguggcggcgagcagca

SEQ ID NO: 3146229 - RNA, 15 nt, Mycobacterium bovis subsp bovis AF2122/97
cgcgguggcggcggu

SEQ ID NO: 3146230 - RNA, 13 nt, Mycobacterium bovis subsp bovis AF2122/97
cgcgguggcgguc

SEQ ID NO: 3146231 - RNA, 20 nt, Mycobacterium bovis subsp bovis AF2122/97
cgcgguggcggucgccacac

SEQ ID NO: 3146232 - RNA, 15 nt, Mycobacterium bovis subsp bovis AF2122/97
cgcgguggcgguguc

SEQ ID NO: 3146233 - RNA, 15 nt, Mycobacterium bovis subsp bovis AF2122/97
cgcggugggcacagc

SEQ ID NO: 3146234 - RNA, 16 nt, Mycobacterium bovis subsp bovis AF2122/97
cgcggugggccccgau

SEQ ID NO: 3146235 - RNA, 18 nt, Mycobacterium bovis subsp bovis AF2122/97
cgcgguggggucgacgca

SEQ ID NO: 3146236 - RNA, 19 nt, Mycobacterium bovis subsp bovis AF2122/97
cgcgguggggucgacgcag

SEQ ID NO: 3146237 - RNA, 22 nt, Mycobacterium bovis subsp bovis AF2122/97
cgcgguggggucgacgcagugc

SEQ ID NO: 3146238 - RNA, 20 nt, Mycobacterium bovis subsp bovis AF2122/97
cgcgguggucagcaccggcg

SEQ ID NO: 3146239 - RNA, 20 nt, Mycobacterium bovis subsp bovis AF2122/97
cgcgguguagaagcgggcgu

SEQ ID NO: 3146240 - RNA, 21 nt, Mycobacterium bovis subsp bovis AF2122/97
cgcgguguagagcgcaccgcg

SEQ ID NO: 3146241 - RNA, 16 nt, Mycobacterium bovis subsp bovis AF2122/97
cgcgguguauccgacg

SEQ ID NO: 3146242 - RNA, 19 nt, Mycobacterium bovis subsp bovis AF2122/97
cgcggugucggggcccccg

SEQ ID NO: 3146243 - RNA, 21 nt, Mycobacterium bovis subsp bovis AF2122/97
cgcggugucuucucgucgaac

SEQ ID NO: 3146244 - RNA, 22 nt, Mycobacterium bovis subsp bovis AF2122/97
cgcggugugcagggacccggcg

SEQ ID NO: 3146245 - RNA, 22 nt, Mycobacterium bovis subsp bovis AF2122/97
cgcggugugccggucuccgaac

SEQ ID NO: 3146246 - RNA, 15 nt, Mycobacterium bovis subsp bovis AF2122/97
cgcggugugcggcag

SEQ ID NO: 3146247 - RNA, 21 nt, Mycobacterium bovis subsp bovis AF2122/97
cgcggugugcggcagcccgcu

SEQ ID NO: 3146248 - RNA, 23 nt, Mycobacterium bovis subsp bovis AF2122/97
cgcggugugcgugucacccaaug

SEQ ID NO: 3146249 - RNA, 11 nt, Mycobacterium bovis subsp bovis AF2122/97
cgcgguguucg

SEQ ID NO: 3146250 - RNA, 15 nt, Mycobacterium bovis subsp bovis AF2122/97
cgcgguguugcggug

SEQ ID NO: 3146251 - RNA, 18 nt, Mycobacterium bovis subsp bovis AF2122/97
cgcgguuaucgccgagau

SEQ ID NO: 3146252 - RNA, 19 nt, Mycobacterium bovis subsp bovis AF2122/97
cgcgguuaucgccgagauc

SEQ ID NO: 3146253 - RNA, 17 nt, Mycobacterium bovis subsp bovis AF2122/97
cgcgguucaccacgucg

SEQ ID NO: 3146254 - RNA, 15 nt, Mycobacterium bovis subsp bovis AF2122/97
cgcgguucgaugaca

SEQ ID NO: 3146255 - RNA, 14 nt, Mycobacterium bovis subsp bovis AF2122/97
cgcgguuggcagug

SEQ ID NO: 3146256 - RNA, 20 nt, Mycobacterium bovis subsp bovis AF2122/97
cgcgguuggcaguggcgcgg

SEQ ID NO: 3146257 - RNA, 13 nt, Mycobacterium bovis subsp bovis AF2122/97
cgcgguuggcggc

SEQ ID NO: 3146258 - RNA, 14 nt, Mycobacterium bovis subsp bovis AF2122/97
cgcgguuggcggcg

SEQ ID NO: 3146259 - RNA, 21 nt, Mycobacterium bovis subsp bovis AF2122/97
cgcgguuggcugaugacgcgg

SEQ ID NO: 3146260 - RNA, 20 nt, Mycobacterium bovis subsp bovis AF2122/97
cgcgguuguccuccgacggg

SEQ ID NO: 3146261 - RNA, 17 nt, Mycobacterium bovis subsp bovis AF2122/97
cgcgguugugacgguga

SEQ ID NO: 3146262 - RNA, 18 nt, Mycobacterium bovis subsp bovis AF2122/97
cgcgguugugacggugaa

SEQ ID NO: 3146263 - RNA, 21 nt, Mycobacterium bovis subsp bovis AF2122/97
cgcgguuguggcugaucccgg

SEQ ID NO: 3146264 - RNA, 18 nt, Mycobacterium bovis subsp bovis AF2122/97
cgcgguuguuucggcgug

SEQ ID NO: 3146265 - RNA, 14 nt, Mycobacterium bovis subsp bovis AF2122/97
cgcgguuucggcga

SEQ ID NO: 3146266 - RNA, 16 nt, Mycobacterium bovis subsp bovis AF2122/97
cgcgguuucgggccga

SEQ ID NO: 3146267 - RNA, 20 nt, Mycobacterium bovis subsp bovis AF2122/97
cgcgguuuggcgacgucgac

SEQ ID NO: 3146268 - RNA, 15 nt, Mycobacterium bovis subsp bovis AF2122/97
cgcgguuuucgccgg

SEQ ID NO: 3146269 - RNA, 15 nt, Mycobacterium bovis subsp bovis AF2122/97
cgcgguuuucggcug

SEQ ID NO: 3146270 - RNA, 18 nt, Mycobacterium bovis subsp bovis AF2122/97
cgcgguuuucggcugccg

SEQ ID NO: 3146271 - RNA, 17 nt, Mycobacterium bovis subsp bovis AF2122/97
cgcgucgggcucggcga

SEQ ID NO: 3146272 - RNA, 13 nt, Mycobacterium bovis subsp bovis AF2122/97
cgcgucggucacc

SEQ ID NO: 3146273 - RNA, 15 nt, Mycobacterium bovis subsp bovis AF2122/97
cgcgucggucaccga

SEQ ID NO: 3146274 - RNA, 23 nt, Mycobacterium bovis subsp bovis AF2122/97
cgcgucggucgcggacagguagu

SEQ ID NO: 3146275 - RNA, 17 nt, Mycobacterium bovis subsp bovis AF2122/97
cgcgucggugucgaugc

SEQ ID NO: 3146276 - RNA, 21 nt, Mycobacterium bovis subsp bovis AF2122/97
cgcgucgguugauugugccca

SEQ ID NO: 3146277 - RNA, 22 nt, Mycobacterium bovis subsp bovis AF2122/97
cgcgucguagcgcucgugaccg

SEQ ID NO: 3146278 - RNA, 14 nt, Mycobacterium bovis subsp bovis AF2122/97
cgcgucgucccagu

SEQ ID NO: 3146279 - RNA, 12 nt, Mycobacterium bovis subsp bovis AF2122/97
cgcgucgucggu

SEQ ID NO: 3146280 - RNA, 16 nt, Mycobacterium bovis subsp bovis AF2122/97
cgcgucguggucggcg

SEQ ID NO: 3146281 - RNA, 19 nt, Mycobacterium bovis subsp bovis AF2122/97
cgcgucuacgucguccagc

SEQ ID NO: 3146282 - RNA, 22 nt, Mycobacterium bovis subsp bovis AF2122/97
cgcgucuacgucguccagcacc

SEQ ID NO: 3146283 - RNA, 13 nt, Mycobacterium bovis subsp bovis AF2122/97
cgcgucucgagcg

SEQ ID NO: 3146284 - RNA, 19 nt, Mycobacterium bovis subsp bovis AF2122/97
cgcgucucgagcgcgccgc

SEQ ID NO: 3146285 - RNA, 20 nt, Mycobacterium bovis subsp bovis AF2122/97
cgcgucucggugcagcagcg

SEQ ID NO: 3146286 - RNA, 24 nt, Mycobacterium bovis subsp bovis AF2122/97
cgcgucucguugauacggcaugcg

SEQ ID NO: 3146287 - RNA, 15 nt, Mycobacterium bovis subsp bovis AF2122/97
cgcgucugcucgcca

SEQ ID NO: 3146288 - RNA, 17 nt, Mycobacterium bovis subsp bovis AF2122/97
cgcgucugcucgccagc

SEQ ID NO: 3146289 - RNA, 18 nt, Mycobacterium bovis subsp bovis AF2122/97
cgcgucugcucgccagcg

SEQ ID NO: 3146290 - RNA, 15 nt, Mycobacterium bovis subsp bovis AF2122/97
cgcgucugcucggcg

SEQ ID NO: 3146291 - RNA, 14 nt, Mycobacterium bovis subsp bovis AF2122/97
cgcgucugggugca

SEQ ID NO: 3146292 - RNA, 21 nt, Mycobacterium bovis subsp bovis AF2122/97
cgcgucuuggugcgcgucagc

SEQ ID NO: 3146293 - RNA, 23 nt, Mycobacterium bovis subsp bovis AF2122/97
cgcgucuuggugcgcgucagccg

SEQ ID NO: 3146294 - RNA, 16 nt, Mycobacterium bovis subsp bovis AF2122/97
cgcgugacguaccacg

SEQ ID NO: 3146295 - RNA, 18 nt, Mycobacterium bovis subsp bovis AF2122/97
cgcgugacguaccacggc

SEQ ID NO: 3146296 - RNA, 22 nt, Mycobacterium bovis subsp bovis AF2122/97
cgcgugcaccauacucaccgac

SEQ ID NO: 3146297 - RNA, 24 nt, Mycobacterium bovis subsp bovis AF2122/97
cgcgugcaccauacucaccgacgc

SEQ ID NO: 3146298 - RNA, 22 nt, Mycobacterium bovis subsp bovis AF2122/97
cgcgugcagccauugacggucc

SEQ ID NO: 3146299 - RNA, 13 nt, Mycobacterium bovis subsp bovis AF2122/97
cgcgugcagcggc

SEQ ID NO: 3146300 - RNA, 23 nt, Mycobacterium bovis subsp bovis AF2122/97
cgcgugcagcggcgccgccaagg

SEQ ID NO: 3146301 - RNA, 19 nt, Mycobacterium bovis subsp bovis AF2122/97
cgcgugcaggcugucaauc

SEQ ID NO: 3146302 - RNA, 14 nt, Mycobacterium bovis subsp bovis AF2122/97
cgcgugccacagca

SEQ ID NO: 3146303 - RNA, 13 nt, Mycobacterium bovis subsp bovis AF2122/97
cgcgugccagcgc

SEQ ID NO: 3146304 - RNA, 14 nt, Mycobacterium bovis subsp bovis AF2122/97
cgcgugccagcgcc

SEQ ID NO: 3146305 - RNA, 15 nt, Mycobacterium bovis subsp bovis AF2122/97
cgcgugcccguggug

SEQ ID NO: 3146306 - RNA, 19 nt, Mycobacterium bovis subsp bovis AF2122/97
cgcgugcccguggugaugg

SEQ ID NO: 3146307 - RNA, 15 nt, Mycobacterium bovis subsp bovis AF2122/97
cgcgugccgcaaccg

SEQ ID NO: 3146308 - RNA, 18 nt, Mycobacterium bovis subsp bovis AF2122/97
cgcgugccgcccgccucu

SEQ ID NO: 3146309 - RNA, 13 nt, Mycobacterium bovis subsp bovis AF2122/97
cgcgugcgccggg

SEQ ID NO: 3146310 - RNA, 14 nt, Mycobacterium bovis subsp bovis AF2122/97
cgcgugcgccgggg

SEQ ID NO: 3146311 - RNA, 14 nt, Mycobacterium bovis subsp bovis AF2122/97
cgcgugcggcugcc

SEQ ID NO: 3146312 - RNA, 15 nt, Mycobacterium bovis subsp bovis AF2122/97
cgcgugcggcugcca

SEQ ID NO: 3146313 - RNA, 17 nt, Mycobacterium bovis subsp bovis AF2122/97
cgcgugcggcugccagu

SEQ ID NO: 3146314 - RNA, 18 nt, Mycobacterium bovis subsp bovis AF2122/97
cgcgugcgggggacgggu

SEQ ID NO: 3146315 - RNA, 13 nt, Mycobacterium bovis subsp bovis AF2122/97
cgcgugcucgacg

SEQ ID NO: 3146316 - RNA, 12 nt, Mycobacterium bovis subsp bovis AF2122/97
cgcgugcugagu

SEQ ID NO: 3146317 - RNA, 21 nt, Mycobacterium bovis subsp bovis AF2122/97
cgcgugcugcagaucggccgg

SEQ ID NO: 3146318 - RNA, 22 nt, Mycobacterium bovis subsp bovis AF2122/97
cgcgugcugccguauccaggcg

SEQ ID NO: 3146319 - RNA, 14 nt, Mycobacterium bovis subsp bovis AF2122/97
cgcgugcugcggac

SEQ ID NO: 3146320 - RNA, 17 nt, Mycobacterium bovis subsp bovis AF2122/97
cgcgugcugcggcuggu

SEQ ID NO: 3146321 - RNA, 20 nt, Mycobacterium bovis subsp bovis AF2122/97
cgcgugcuggaacagguuga

SEQ ID NO: 3146322 - RNA, 15 nt, Mycobacterium bovis subsp bovis AF2122/97
cgcgugcuuggcagc

SEQ ID NO: 3146323 - RNA, 20 nt, Mycobacterium bovis subsp bovis AF2122/97
cgcguggaacuugcgcaggu

SEQ ID NO: 3146324 - RNA, 20 nt, Mycobacterium bovis subsp bovis AF2122/97
cgcguggcaccaccaaggug

SEQ ID NO: 3146325 - RNA, 18 nt, Mycobacterium bovis subsp bovis AF2122/97
cgcguggcaccgacagca

SEQ ID NO: 3146326 - RNA, 22 nt, Mycobacterium bovis subsp bovis AF2122/97
cgcguggcagugcaggcggccg

SEQ ID NO: 3146327 - RNA, 20 nt, Mycobacterium bovis subsp bovis AF2122/97
cgcguggcauccagcagcgc

SEQ ID NO: 3146328 - RNA, 18 nt, Mycobacterium bovis subsp bovis AF2122/97
cgcguggccgccggcgcu

SEQ ID NO: 3146329 - RNA, 17 nt, Mycobacterium bovis subsp bovis AF2122/97
cgcguggcgcaccaccg

SEQ ID NO: 3146330 - RNA, 21 nt, Mycobacterium bovis subsp bovis AF2122/97
cgcguggcgcaccaccgcccc

SEQ ID NO: 3146331 - RNA, 22 nt, Mycobacterium bovis subsp bovis AF2122/97
cgcguggcgcaccaccgccccg

SEQ ID NO: 3146332 - RNA, 15 nt, Mycobacterium bovis subsp bovis AF2122/97
cgcguggcuggcggc

SEQ ID NO: 3146333 - RNA, 20 nt, Mycobacterium bovis subsp bovis AF2122/97
cgcguggcuggcggcgaccg

SEQ ID NO: 3146334 - RNA, 14 nt, Mycobacterium bovis subsp bovis AF2122/97
cgcguggugcugac

SEQ ID NO: 3146335 - RNA, 17 nt, Mycobacterium bovis subsp bovis AF2122/97
cgcguggugcugaccgc

SEQ ID NO: 3146336 - RNA, 20 nt, Mycobacterium bovis subsp bovis AF2122/97
cgcguggugcugaccgcgcc

SEQ ID NO: 3146337 - RNA, 14 nt, Mycobacterium bovis subsp bovis AF2122/97
cgcgugguucgguc

SEQ ID NO: 3146338 - RNA, 20 nt, Mycobacterium bovis subsp bovis AF2122/97
cgcgugguucggucgggggc

SEQ ID NO: 3146339 - RNA, 16 nt, Mycobacterium bovis subsp bovis AF2122/97
cgcguguaccgcgacg

SEQ ID NO: 3146340 - RNA, 20 nt, Mycobacterium bovis subsp bovis AF2122/97
cgcgugucugggaccccgcu

SEQ ID NO: 3146341 - RNA, 15 nt, Mycobacterium bovis subsp bovis AF2122/97
cgcgugugcgucgca

SEQ ID NO: 3146342 - RNA, 14 nt, Mycobacterium bovis subsp bovis AF2122/97
cgcguucaacaccg

SEQ ID NO: 3146343 - RNA, 21 nt, Mycobacterium bovis subsp bovis AF2122/97
cgcguucaacaccgccgaccu

SEQ ID NO: 3146344 - RNA, 17 nt, Mycobacterium bovis subsp bovis AF2122/97
cgcguucaggaugccag

SEQ ID NO: 3146345 - RNA, 21 nt, Mycobacterium bovis subsp bovis AF2122/97
cgcguucaggaugccaggacg

SEQ ID NO: 3146346 - RNA, 15 nt, Mycobacterium bovis subsp bovis AF2122/97
cgcguucccacgguu

SEQ ID NO: 3146347 - RNA, 17 nt, Mycobacterium bovis subsp bovis AF2122/97
cgcguucgagugcgguc

SEQ ID NO: 3146348 - RNA, 22 nt, Mycobacterium bovis subsp bovis AF2122/97
cgcguucgcgcaaaugccugcu

SEQ ID NO: 3146349 - RNA, 14 nt, Mycobacterium bovis subsp bovis AF2122/97
cgcguucggcaccu

SEQ ID NO: 3146350 - RNA, 15 nt, Mycobacterium bovis subsp bovis AF2122/97
cgcguucggcgagca

SEQ ID NO: 3146351 - RNA, 18 nt, Mycobacterium bovis subsp bovis AF2122/97
cgcguucggcgagcagcg

SEQ ID NO: 3146352 - RNA, 16 nt, Mycobacterium bovis subsp bovis AF2122/97
cgcguucuccggcacc

SEQ ID NO: 3146353 - RNA, 14 nt, Mycobacterium bovis subsp bovis AF2122/97
cgcguucucggcac

SEQ ID NO: 3146354 - RNA, 16 nt, Mycobacterium bovis subsp bovis AF2122/97
cgcguucugcaccagc

SEQ ID NO: 3146355 - RNA, 19 nt, Mycobacterium bovis subsp bovis AF2122/97
cgcguugacucugcgucca

SEQ ID NO: 3146356 - RNA, 23 nt, Mycobacterium bovis subsp bovis AF2122/97
cgcguugagcucaauggcuucga

SEQ ID NO: 3146357 - RNA, 15 nt, Mycobacterium bovis subsp bovis AF2122/97
cgcucacccgcccgg

SEQ ID NO: 3146358 - RNA, 16 nt, Mycobacterium bovis subsp bovis AF2122/97
cgcucacccgcccgga

SEQ ID NO: 3146359 - RNA, 14 nt, Mycobacterium bovis subsp bovis AF2122/97
cgcucacccgccgc

SEQ ID NO: 3146360 - RNA, 16 nt, Mycobacterium bovis subsp bovis AF2122/97
cgcucacccgccgcgg

SEQ ID NO: 3146361 - RNA, 12 nt, Mycobacterium bovis subsp bovis AF2122/97
cgcucacccggu

SEQ ID NO: 3146362 - RNA, 15 nt, Mycobacterium bovis subsp bovis AF2122/97
cgcucacccggucgc

SEQ ID NO: 3146363 - RNA, 16 nt, Mycobacterium bovis subsp bovis AF2122/97
cgcucacccggucgca

SEQ ID NO: 3146364 - RNA, 23 nt, Mycobacterium bovis subsp bovis AF2122/97
cgcucacccggucgcacuuggcc

SEQ ID NO: 3146365 - RNA, 18 nt, Mycobacterium bovis subsp bovis AF2122/97
cgcucaccgacgcugacc

SEQ ID NO: 3146366 - RNA, 17 nt, Mycobacterium bovis subsp bovis AF2122/97
cgcucaccggcuggugc

SEQ ID NO: 3146367 - RNA, 15 nt, Mycobacterium bovis subsp bovis AF2122/97
cgcucaccggggccg

SEQ ID NO: 3146368 - RNA, 20 nt, Mycobacterium bovis subsp bovis AF2122/97
cgcucaccuuuggccgcgac

SEQ ID NO: 3146369 - RNA, 22 nt, Mycobacterium bovis subsp bovis AF2122/97
cgcucacgaagaccgcgucggc

SEQ ID NO: 3146370 - RNA, 13 nt, Mycobacterium bovis subsp bovis AF2122/97
cgcucacgccguc

SEQ ID NO: 3146371 - RNA, 14 nt, Mycobacterium bovis subsp bovis AF2122/97
cgcucacgcucacc

SEQ ID NO: 3146372 - RNA, 16 nt, Mycobacterium bovis subsp bovis AF2122/97
cgcucacugcagcgcc

SEQ ID NO: 3146373 - RNA, 23 nt, Mycobacterium bovis subsp bovis AF2122/97
cgcucacugcagcgccucgaucc

SEQ ID NO: 3146374 - RNA, 19 nt, Mycobacterium bovis subsp bovis AF2122/97
cgcucagccguccgggcgg

SEQ ID NO: 3146375 - RNA, 14 nt, Mycobacterium bovis subsp bovis AF2122/97
cgcucagcgcagca

SEQ ID NO: 3146376 - RNA, 19 nt, Mycobacterium bovis subsp bovis AF2122/97
cgcucagcgcggccacgcc

SEQ ID NO: 3146377 - RNA, 21 nt, Mycobacterium bovis subsp bovis AF2122/97
cgcucagcgcggccacgccga

SEQ ID NO: 3146378 - RNA, 15 nt, Mycobacterium bovis subsp bovis AF2122/97
cgcucagcuccggcg

SEQ ID NO: 3146379 - RNA, 15 nt, Mycobacterium bovis subsp bovis AF2122/97
cgcucagggugcgcc

SEQ ID NO: 3146380 - RNA, 18 nt, Mycobacterium bovis subsp bovis AF2122/97
cgcucagggugcgccgca

SEQ ID NO: 3146381 - RNA, 20 nt, Mycobacterium bovis subsp bovis AF2122/97
cgcucagggugcgccgcagc

SEQ ID NO: 3146382 - RNA, 16 nt, Mycobacterium bovis subsp bovis AF2122/97
cgcucaggucaucggc

SEQ ID NO: 3146383 - RNA, 18 nt, Mycobacterium bovis subsp bovis AF2122/97
cgcucaggucaucggcgg

SEQ ID NO: 3146384 - RNA, 13 nt, Mycobacterium bovis subsp bovis AF2122/97
cgcucaguuuggc

SEQ ID NO: 3146385 - RNA, 18 nt, Mycobacterium bovis subsp bovis AF2122/97
cgcucaguuuggccuggu

SEQ ID NO: 3146386 - RNA, 16 nt, Mycobacterium bovis subsp bovis AF2122/97
cgcucaguuuggcggg

SEQ ID NO: 3146387 - RNA, 17 nt, Mycobacterium bovis subsp bovis AF2122/97
cgcucaguuuggcgggu

SEQ ID NO: 3146388 - RNA, 16 nt, Mycobacterium bovis subsp bovis AF2122/97
cgcucauaggccggcg

SEQ ID NO: 3146389 - RNA, 17 nt, Mycobacterium bovis subsp bovis AF2122/97
cgcucaucacccagcgc

SEQ ID NO: 3146390 - RNA, 14 nt, Mycobacterium bovis subsp bovis AF2122/97
cgcucauccagcgc

SEQ ID NO: 3146391 - RNA, 22 nt, Mycobacterium bovis subsp bovis AF2122/97
cgcucauccauucggcggcggc

SEQ ID NO: 3146392 - RNA, 21 nt, Mycobacterium bovis subsp bovis AF2122/97
cgcucaugggcgccaucccgc

SEQ ID NO: 3146393 - RNA, 18 nt, Mycobacterium bovis subsp bovis AF2122/97
cgcucauguucucgaccg

SEQ ID NO: 3146394 - RNA, 18 nt, Mycobacterium bovis subsp bovis AF2122/97
cgcucauugcaucugcca

SEQ ID NO: 3146395 - RNA, 19 nt, Mycobacterium bovis subsp bovis AF2122/97
cgcuccaaaagccucagcc

SEQ ID NO: 3146396 - RNA, 23 nt, Mycobacterium bovis subsp bovis AF2122/97
cgcuccaaaagccucagccgcuc

SEQ ID NO: 3146397 - RNA, 18 nt, Mycobacterium bovis subsp bovis AF2122/97
cgcuccaacaacuccagc

SEQ ID NO: 3146398 - RNA, 20 nt, Mycobacterium bovis subsp bovis AF2122/97
cgcuccaacacccgccgguc

SEQ ID NO: 3146399 - RNA, 20 nt, Mycobacterium bovis subsp bovis AF2122/97
cgcuccaacgcacacaccgu

SEQ ID NO: 3146400 - RNA, 14 nt, Mycobacterium bovis subsp bovis AF2122/97
cgcuccaagcgcgg

SEQ ID NO: 3146401 - RNA, 12 nt, Mycobacterium bovis subsp bovis AF2122/97
cgcuccaccacg

SEQ ID NO: 3146402 - RNA, 16 nt, Mycobacterium bovis subsp bovis AF2122/97
cgcuccaccacgaccg

SEQ ID NO: 3146403 - RNA, 18 nt, Mycobacterium bovis subsp bovis AF2122/97
cgcuccaccacgaccgcg

SEQ ID NO: 3146404 - RNA, 16 nt, Mycobacterium bovis subsp bovis AF2122/97
cgcuccaccucggcgu

SEQ ID NO: 3146405 - RNA, 18 nt, Mycobacterium bovis subsp bovis AF2122/97
cgcuccacguacgcggcu

SEQ ID NO: 3146406 - RNA, 21 nt, Mycobacterium bovis subsp bovis AF2122/97
cgcuccacguacgcggcugcg

SEQ ID NO: 3146407 - RNA, 15 nt, Mycobacterium bovis subsp bovis AF2122/97
cgcuccacugaccag

SEQ ID NO: 3146408 - RNA, 13 nt, Mycobacterium bovis subsp bovis AF2122/97
cgcuccagauggg

SEQ ID NO: 3146409 - RNA, 14 nt, Mycobacterium bovis subsp bovis AF2122/97
cgcuccagaugggg

SEQ ID NO: 3146410 - RNA, 17 nt, Mycobacterium bovis subsp bovis AF2122/97
cgcuccagauggggcuc

SEQ ID NO: 3146411 - RNA, 20 nt, Mycobacterium bovis subsp bovis AF2122/97
cgcuccagauggggcucgag

SEQ ID NO: 3146412 - RNA, 15 nt, Mycobacterium bovis subsp bovis AF2122/97
cgcuccagcacccgc

SEQ ID NO: 3146413 - RNA, 19 nt, Mycobacterium bovis subsp bovis AF2122/97
cgcuccagcacccgcgcga

SEQ ID NO: 3146414 - RNA, 17 nt, Mycobacterium bovis subsp bovis AF2122/97
cgcuccagccgcgcguc

SEQ ID NO: 3146415 - RNA, 20 nt, Mycobacterium bovis subsp bovis AF2122/97
cgcuccagcugagcggccgg

SEQ ID NO: 3146416 - RNA, 17 nt, Mycobacterium bovis subsp bovis AF2122/97
cgcuccaguggcgccag

SEQ ID NO: 3146417 - RNA, 18 nt, Mycobacterium bovis subsp bovis AF2122/97
cgcuccaguggcgccagg

SEQ ID NO: 3146418 - RNA, 20 nt, Mycobacterium bovis subsp bovis AF2122/97
cgcuccaguggcgccagggc

SEQ ID NO: 3146419 - RNA, 23 nt, Mycobacterium bovis subsp bovis AF2122/97
cgcuccaguggcgccagggccuu

SEQ ID NO: 3146420 - RNA, 20 nt, Mycobacterium bovis subsp bovis AF2122/97
cgcuccauaucgucgggcgu

SEQ ID NO: 3146421 - RNA, 22 nt, Mycobacterium bovis subsp bovis AF2122/97
cgcuccccagcgaaucacccgc

SEQ ID NO: 3146422 - RNA, 12 nt, Mycobacterium bovis subsp bovis AF2122/97
cgcucccccgcc

SEQ ID NO: 3146423 - RNA, 15 nt, Mycobacterium bovis subsp bovis AF2122/97
cgcucccccgccaac

SEQ ID NO: 3146424 - RNA, 17 nt, Mycobacterium bovis subsp bovis AF2122/97
cgcucccccgccaaccc

SEQ ID NO: 3146425 - RNA, 20 nt, Mycobacterium bovis subsp bovis AF2122/97
cgcucccccgcuacgcgcgc

SEQ ID NO: 3146426 - RNA, 17 nt, Mycobacterium bovis subsp bovis AF2122/97
cgcucccguacgccggc

SEQ ID NO: 3146427 - RNA, 16 nt, Mycobacterium bovis subsp bovis AF2122/97
cgcucccgucucgaca

SEQ ID NO: 3146428 - RNA, 17 nt, Mycobacterium bovis subsp bovis AF2122/97
cgcucccgugcuggcgc

SEQ ID NO: 3146429 - RNA, 19 nt, Mycobacterium bovis subsp bovis AF2122/97
cgcucccgugcuggcgccg

SEQ ID NO: 3146430 - RNA, 17 nt, Mycobacterium bovis subsp bovis AF2122/97
cgcucccucuacacccg

SEQ ID NO: 3146431 - RNA, 18 nt, Mycobacterium bovis subsp bovis AF2122/97
cgcucccucuacacccgg

SEQ ID NO: 3146432 - RNA, 21 nt, Mycobacterium bovis subsp bovis AF2122/97
cgcucccucuacacccggacu

SEQ ID NO: 3146433 - RNA, 17 nt, Mycobacterium bovis subsp bovis AF2122/97
cgcucccugcacccagc

SEQ ID NO: 3146434 - RNA, 21 nt, Mycobacterium bovis subsp bovis AF2122/97
cgcuccgaugugccgauuggc

SEQ ID NO: 3146435 - RNA, 22 nt, Mycobacterium bovis subsp bovis AF2122/97
cgcuccgccggguuggcgccgg

SEQ ID NO: 3146436 - RNA, 23 nt, Mycobacterium bovis subsp bovis AF2122/97
cgcuccgccgucgccgccggcgc

SEQ ID NO: 3146437 - RNA, 16 nt, Mycobacterium bovis subsp bovis AF2122/97
cgcuccgcggcgcagc

SEQ ID NO: 3146438 - RNA, 17 nt, Mycobacterium bovis subsp bovis AF2122/97
cgcuccgcggcgcagca

SEQ ID NO: 3146439 - RNA, 12 nt, Mycobacterium bovis subsp bovis AF2122/97
cgcuccgcggcu

SEQ ID NO: 3146440 - RNA, 23 nt, Mycobacterium bovis subsp bovis AF2122/97
cgcuccgcggcucaaucuccucc

SEQ ID NO: 3146441 - RNA, 21 nt, Mycobacterium bovis subsp bovis AF2122/97
cgcuccggcccugccgccggc

SEQ ID NO: 3146442 - RNA, 23 nt, Mycobacterium bovis subsp bovis AF2122/97
cgcuccggcccugccgccggccc

SEQ ID NO: 3146443 - RNA, 20 nt, Mycobacterium bovis subsp bovis AF2122/97
cgcucguggucgacgugauc

SEQ ID NO: 3146444 - RNA, 22 nt, Mycobacterium bovis subsp bovis AF2122/97
cgcucguuacgccgagcacacg

SEQ ID NO: 3146445 - RNA, 22 nt, Mycobacterium bovis subsp bovis AF2122/97
cgcucguuagcggcgggcacgc

SEQ ID NO: 3146446 - RNA, 16 nt, Mycobacterium bovis subsp bovis AF2122/97
cgcucguuccggcggu

SEQ ID NO: 3146447 - RNA, 13 nt, Mycobacterium bovis subsp bovis AF2122/97
cgcucguugcguu

SEQ ID NO: 3146448 - RNA, 21 nt, Mycobacterium bovis subsp bovis AF2122/97
cgcucguugcguugcaucagc

SEQ ID NO: 3146449 - RNA, 21 nt, Mycobacterium bovis subsp bovis AF2122/97
cgcucguugguucagcucgag

SEQ ID NO: 3146450 - RNA, 16 nt, Mycobacterium bovis subsp bovis AF2122/97
cgcucguuugcgagca

SEQ ID NO: 3146451 - RNA, 17 nt, Mycobacterium bovis subsp bovis AF2122/97
cgcucucggcgauuuug

SEQ ID NO: 3146452 - RNA, 15 nt, Mycobacterium bovis subsp bovis AF2122/97
cgcucugcgaguucg

SEQ ID NO: 3146453 - RNA, 13 nt, Mycobacterium bovis subsp bovis AF2122/97
cgcucugcgcggc

SEQ ID NO: 3146454 - RNA, 15 nt, Mycobacterium bovis subsp bovis AF2122/97
cgcucuggucgucga

SEQ ID NO: 3146455 - RNA, 14 nt, Mycobacterium bovis subsp bovis AF2122/97
cgcucugugucgcc

SEQ ID NO: 3146456 - RNA, 23 nt, Mycobacterium bovis subsp bovis AF2122/97
cgcucugugucgccgaucaccgc

SEQ ID NO: 3146457 - RNA, 18 nt, Mycobacterium bovis subsp bovis AF2122/97
cgcucuucgauggguagc

SEQ ID NO: 3146458 - RNA, 18 nt, Mycobacterium bovis subsp bovis AF2122/97
cgcugaacagacggcuca

SEQ ID NO: 3146459 - RNA, 24 nt, Mycobacterium bovis subsp bovis AF2122/97
cgcugaacagacggcucagcgugc

SEQ ID NO: 3146460 - RNA, 22 nt, Mycobacterium bovis subsp bovis AF2122/97
cgcugaacgcuguaagcaugcc

SEQ ID NO: 3146461 - RNA, 21 nt, Mycobacterium bovis subsp bovis AF2122/97
cgcugaacuagggucgggguc

SEQ ID NO: 3146462 - RNA, 15 nt, Mycobacterium bovis subsp bovis AF2122/97
cgcugaagccgacga

SEQ ID NO: 3146463 - RNA, 16 nt, Mycobacterium bovis subsp bovis AF2122/97
cgcugaagccgcugga

SEQ ID NO: 3146464 - RNA, 23 nt, Mycobacterium bovis subsp bovis AF2122/97
cgcugaagguggcgaacccgguc

SEQ ID NO: 3146465 - RNA, 17 nt, Mycobacterium bovis subsp bovis AF2122/97
cgcugaaguggcacaag

SEQ ID NO: 3146466 - RNA, 20 nt, Mycobacterium bovis subsp bovis AF2122/97
cgcugaaguggcacaagcug

SEQ ID NO: 3146467 - RNA, 23 nt, Mycobacterium bovis subsp bovis AF2122/97
cgcugaaucaccccggcggccau

SEQ ID NO: 3146468 - RNA, 18 nt, Mycobacterium bovis subsp bovis AF2122/97
cgcugaaugcgccgugga

SEQ ID NO: 3146469 - RNA, 16 nt, Mycobacterium bovis subsp bovis AF2122/97
cgcugaauuggcgccg

SEQ ID NO: 3146470 - RNA, 18 nt, Mycobacterium bovis subsp bovis AF2122/97
cgcugaauuggcgccgau

SEQ ID NO: 3146471 - RNA, 22 nt, Mycobacterium bovis subsp bovis AF2122/97
cgcugaauuggcgccgaugacc

SEQ ID NO: 3146472 - RNA, 22 nt, Mycobacterium bovis subsp bovis AF2122/97
cgcugaccacaaccgugagcac

SEQ ID NO: 3146473 - RNA, 17 nt, Mycobacterium bovis subsp bovis AF2122/97
cgcugaccccggcagcg

SEQ ID NO: 3146474 - RNA, 19 nt, Mycobacterium bovis subsp bovis AF2122/97
cgcugaccggaucugacgg

SEQ ID NO: 3146475 - RNA, 14 nt, Mycobacterium bovis subsp bovis AF2122/97
cgcugaccguuucg

SEQ ID NO: 3146476 - RNA, 20 nt, Mycobacterium bovis subsp bovis AF2122/97
cgcugaccguuucgaucucg

SEQ ID NO: 3146477 - RNA, 21 nt, Mycobacterium bovis subsp bovis AF2122/97
cgcugaccuuguugaccacca

SEQ ID NO: 3146478 - RNA, 19 nt, Mycobacterium bovis subsp bovis AF2122/97
cgcugaccuuuucccgcag

SEQ ID NO: 3146479 - RNA, 19 nt, Mycobacterium bovis subsp bovis AF2122/97
cgcugacgaagcacaguuc

SEQ ID NO: 3146480 - RNA, 19 nt, Mycobacterium bovis subsp bovis AF2122/97
cgcugacgacccuccgcac

SEQ ID NO: 3146481 - RNA, 14 nt, Mycobacterium bovis subsp bovis AF2122/97
cgcugacgcccucc

SEQ ID NO: 3146482 - RNA, 17 nt, Mycobacterium bovis subsp bovis AF2122/97
cgcugacgcccuccugg

SEQ ID NO: 3146483 - RNA, 22 nt, Mycobacterium bovis subsp bovis AF2122/97
cgcugacgcccuccuggcgggu

SEQ ID NO: 3146484 - RNA, 15 nt, Mycobacterium bovis subsp bovis AF2122/97
cgcugacggccaugg

SEQ ID NO: 3146485 - RNA, 14 nt, Mycobacterium bovis subsp bovis AF2122/97
cgcugacuccugcg

SEQ ID NO: 3146486 - RNA, 21 nt, Mycobacterium bovis subsp bovis AF2122/97
cgcugacuccugcggcaccgc

SEQ ID NO: 3146487 - RNA, 17 nt, Mycobacterium bovis subsp bovis AF2122/97
cgcugagcacgcggauc

SEQ ID NO: 3146488 - RNA, 13 nt, Mycobacterium bovis subsp bovis AF2122/97
cgcugagcacggc

SEQ ID NO: 3146489 - RNA, 20 nt, Mycobacterium bovis subsp bovis AF2122/97
cgcugagcacggcgcggcgg

SEQ ID NO: 3146490 - RNA, 18 nt, Mycobacterium bovis subsp bovis AF2122/97
cgcugagcacucaugaug

SEQ ID NO: 3146491 - RNA, 16 nt, Mycobacterium bovis subsp bovis AF2122/97
cgcugagcagcgccgc

SEQ ID NO: 3146492 - RNA, 17 nt, Mycobacterium bovis subsp bovis AF2122/97
cgcugagcagcgccgcg

SEQ ID NO: 3146493 - RNA, 15 nt, Mycobacterium bovis subsp bovis AF2122/97
cgcugagccagcucc

SEQ ID NO: 3146494 - RNA, 15 nt, Mycobacterium bovis subsp bovis AF2122/97
cgcugagccgcucau

SEQ ID NO: 3146495 - RNA, 17 nt, Mycobacterium bovis subsp bovis AF2122/97
cgcugagccgcucaucg

SEQ ID NO: 3146496 - RNA, 19 nt, Mycobacterium bovis subsp bovis AF2122/97
cgcugagccguagugucgg

SEQ ID NO: 3146497 - RNA, 12 nt, Mycobacterium bovis subsp bovis AF2122/97
cgcugagcucga

SEQ ID NO: 3146498 - RNA, 18 nt, Mycobacterium bovis subsp bovis AF2122/97
cgcugaggaacccuccgg

SEQ ID NO: 3146499 - RNA, 19 nt, Mycobacterium bovis subsp bovis AF2122/97
cgcugaggaacccuccgga

SEQ ID NO: 3146500 - RNA, 22 nt, Mycobacterium bovis subsp bovis AF2122/97
cgcugagguauugggcgcggca

SEQ ID NO: 3146501 - RNA, 23 nt, Mycobacterium bovis subsp bovis AF2122/97
cgcugagguggcggugcggcgag

SEQ ID NO: 3146502 - RNA, 15 nt, Mycobacterium bovis subsp bovis AF2122/97
cgcugaguccccagg

SEQ ID NO: 3146503 - RNA, 16 nt, Mycobacterium bovis subsp bovis AF2122/97
cgcugauagcggucgg

SEQ ID NO: 3146504 - RNA, 20 nt, Mycobacterium bovis subsp bovis AF2122/97
cgcugauagcggucggucac

SEQ ID NO: 3146505 - RNA, 22 nt, Mycobacterium bovis subsp bovis AF2122/97
cgcugauaguggcgcgcggcgc

SEQ ID NO: 3146506 - RNA, 19 nt, Mycobacterium bovis subsp bovis AF2122/97
cgcugaucagauccucgac

SEQ ID NO: 3146507 - RNA, 20 nt, Mycobacterium bovis subsp bovis AF2122/97
cgcugaucagauccucgacu

SEQ ID NO: 3146508 - RNA, 15 nt, Mycobacterium bovis subsp bovis AF2122/97
cgcugauccacgaua

SEQ ID NO: 3146509 - RNA, 19 nt, Mycobacterium bovis subsp bovis AF2122/97
cgcugauccacgauaucga

SEQ ID NO: 3146510 - RNA, 12 nt, Mycobacterium bovis subsp bovis AF2122/97
cgcugauccggg

SEQ ID NO: 3146511 - RNA, 17 nt, Mycobacterium bovis subsp bovis AF2122/97
cgcugauccgggcgccg

SEQ ID NO: 3146512 - RNA, 16 nt, Mycobacterium bovis subsp bovis AF2122/97
cgcugaucugccgccg

SEQ ID NO: 3146513 - RNA, 22 nt, Mycobacterium bovis subsp bovis AF2122/97
cgcugaucugccgccgcggcca

SEQ ID NO: 3146514 - RNA, 22 nt, Mycobacterium bovis subsp bovis AF2122/97
cgcugaucuuccccucggccgc

SEQ ID NO: 3146515 - RNA, 20 nt, Mycobacterium bovis subsp bovis AF2122/97
cgcugaugagccgcagaugc

SEQ ID NO: 3146516 - RNA, 23 nt, Mycobacterium bovis subsp bovis AF2122/97
cgcugaugagccgcagaugcacc

SEQ ID NO: 3146517 - RNA, 16 nt, Mycobacterium bovis subsp bovis AF2122/97
cgcugaugcaucccaa

SEQ ID NO: 3146518 - RNA, 14 nt, Mycobacterium bovis subsp bovis AF2122/97
cgcugaugcuggcc

SEQ ID NO: 3146519 - RNA, 16 nt, Mycobacterium bovis subsp bovis AF2122/97
cgcugauggugcugcg

SEQ ID NO: 3146520 - RNA, 19 nt, Mycobacterium bovis subsp bovis AF2122/97
cgcugauggugcugcggcg

SEQ ID NO: 3146521 - RNA, 23 nt, Mycobacterium bovis subsp bovis AF2122/97
cgcugauggugcugcggcguccg

SEQ ID NO: 3146522 - RNA, 18 nt, Mycobacterium bovis subsp bovis AF2122/97
cgcugauugcggucgucc

SEQ ID NO: 3146523 - RNA, 22 nt, Mycobacterium bovis subsp bovis AF2122/97
cgcugcaaccgccggugccgau

SEQ ID NO: 3146524 - RNA, 14 nt, Mycobacterium bovis subsp bovis AF2122/97
cgcugcaccagcug

SEQ ID NO: 3146525 - RNA, 12 nt, Mycobacterium bovis subsp bovis AF2122/97
cgcugcacgccg

SEQ ID NO: 3146526 - RNA, 20 nt, Mycobacterium bovis subsp bovis AF2122/97
cgcugcacggaaucgcaucu

SEQ ID NO: 3146527 - RNA, 18 nt, Mycobacterium bovis subsp bovis AF2122/97
cgcugcagacgccccuuc

SEQ ID NO: 3146528 - RNA, 14 nt, Mycobacterium bovis subsp bovis AF2122/97
cgcugcagcacggc

SEQ ID NO: 3146529 - RNA, 13 nt, Mycobacterium bovis subsp bovis AF2122/97
cgcugcgcgacga

SEQ ID NO: 3146530 - RNA, 18 nt, Mycobacterium bovis subsp bovis AF2122/97
cgcugcggcaggucgaug

SEQ ID NO: 3146531 - RNA, 13 nt, Mycobacterium bovis subsp bovis AF2122/97
cgcugcggccagc

SEQ ID NO: 3146532 - RNA, 14 nt, Mycobacterium bovis subsp bovis AF2122/97
cgcugcggccagcg

SEQ ID NO: 3146533 - RNA, 15 nt, Mycobacterium bovis subsp bovis AF2122/97
cgcugcggccagcgc

SEQ ID NO: 3146534 - RNA, 15 nt, Mycobacterium bovis subsp bovis AF2122/97
cgcugcggcccacac

SEQ ID NO: 3146535 - RNA, 19 nt, Mycobacterium bovis subsp bovis AF2122/97
cgcugcggcccacaccagc

SEQ ID NO: 3146536 - RNA, 18 nt, Mycobacterium bovis subsp bovis AF2122/97
cgcugcggcgcuggccag

SEQ ID NO: 3146537 - RNA, 12 nt, Mycobacterium bovis subsp bovis AF2122/97
cgcugcggcggu

SEQ ID NO: 3146538 - RNA, 15 nt, Mycobacterium bovis subsp bovis AF2122/97
cgcugcggcgguaug

SEQ ID NO: 3146539 - RNA, 18 nt, Mycobacterium bovis subsp bovis AF2122/97
cgcugcggcgugccgggu

SEQ ID NO: 3146540 - RNA, 22 nt, Mycobacterium bovis subsp bovis AF2122/97
cgcugcggguagccgucgaucc

SEQ ID NO: 3146541 - RNA, 22 nt, Mycobacterium bovis subsp bovis AF2122/97
cgcugcgggucccaaucgucgg

SEQ ID NO: 3146542 - RNA, 12 nt, Mycobacterium bovis subsp bovis AF2122/97
cgcugcggugga

SEQ ID NO: 3146543 - RNA, 14 nt, Mycobacterium bovis subsp bovis AF2122/97
cgcugcgguggaac

SEQ ID NO: 3146544 - RNA, 17 nt, Mycobacterium bovis subsp bovis AF2122/97
cgcugcggugggccagg

SEQ ID NO: 3146545 - RNA, 16 nt, Mycobacterium bovis subsp bovis AF2122/97
cgcugcgucguggaga

SEQ ID NO: 3146546 - RNA, 20 nt, Mycobacterium bovis subsp bovis AF2122/97
cgcugcguugggaucccagc

SEQ ID NO: 3146547 - RNA, 22 nt, Mycobacterium bovis subsp bovis AF2122/97
cgcugcguugggaucccagcgc

SEQ ID NO: 3146548 - RNA, 15 nt, Mycobacterium bovis subsp bovis AF2122/97
cgcugcucacgcagc

SEQ ID NO: 3146549 - RNA, 16 nt, Mycobacterium bovis subsp bovis AF2122/97
cgcugcucacgcagca

SEQ ID NO: 3146550 - RNA, 17 nt, Mycobacterium bovis subsp bovis AF2122/97
cgcugcucagcaacggc

SEQ ID NO: 3146551 - RNA, 18 nt, Mycobacterium bovis subsp bovis AF2122/97
cgcugcucagcaacggcg

SEQ ID NO: 3146552 - RNA, 21 nt, Mycobacterium bovis subsp bovis AF2122/97
cgcugcuccucgcgguaguug

SEQ ID NO: 3146553 - RNA, 14 nt, Mycobacterium bovis subsp bovis AF2122/97
cgcugcucgacggu

SEQ ID NO: 3146554 - RNA, 22 nt, Mycobacterium bovis subsp bovis AF2122/97
cgcugcucuuuuagccacaauc

SEQ ID NO: 3146555 - RNA, 23 nt, Mycobacterium bovis subsp bovis AF2122/97
cgcugcucuuuuagccacaaucg

SEQ ID NO: 3146556 - RNA, 17 nt, Mycobacterium bovis subsp bovis AF2122/97
cgcugcugaacaaccag

SEQ ID NO: 3146557 - RNA, 13 nt, Mycobacterium bovis subsp bovis AF2122/97
cgcugcugccauu

SEQ ID NO: 3146558 - RNA, 13 nt, Mycobacterium bovis subsp bovis AF2122/97
cgcugcugccgca

SEQ ID NO: 3146559 - RNA, 19 nt, Mycobacterium bovis subsp bovis AF2122/97
cgcugcugccgcaccggug

SEQ ID NO: 3146560 - RNA, 15 nt, Mycobacterium bovis subsp bovis AF2122/97
cgcugcugcgaucgc

SEQ ID NO: 3146561 - RNA, 20 nt, Mycobacterium bovis subsp bovis AF2122/97
cgcugcugcgaucgccgcgc

SEQ ID NO: 3146562 - RNA, 23 nt, Mycobacterium bovis subsp bovis AF2122/97
cgcugcugcgaucgccgcgcugg

SEQ ID NO: 3146563 - RNA, 16 nt, Mycobacterium bovis subsp bovis AF2122/97
cgcugcuggcagacca

SEQ ID NO: 3146564 - RNA, 21 nt, Mycobacterium bovis subsp bovis AF2122/97
cgcugcuggucuugccgugca

SEQ ID NO: 3146565 - RNA, 22 nt, Mycobacterium bovis subsp bovis AF2122/97
cgcugcuugucgaggcgcaggu

SEQ ID NO: 3146566 - RNA, 23 nt, Mycobacterium bovis subsp bovis AF2122/97
cgcugcuugucgaggcgcagguc

SEQ ID NO: 3146567 - RNA, 21 nt, Mycobacterium bovis subsp bovis AF2122/97
cgcuggaaaccucuucgggug

SEQ ID NO: 3146568 - RNA, 19 nt, Mycobacterium bovis subsp bovis AF2122/97
cgcuggaacuuggcgucga

SEQ ID NO: 3146569 - RNA, 20 nt, Mycobacterium bovis subsp bovis AF2122/97
cgcuggaaugcggucgauag

SEQ ID NO: 3146570 - RNA, 23 nt, Mycobacterium bovis subsp bovis AF2122/97
cgcuggaccugaugagcucaccg

SEQ ID NO: 3146571 - RNA, 14 nt, Mycobacterium bovis subsp bovis AF2122/97
cgcuggacggaucu

SEQ ID NO: 3146572 - RNA, 13 nt, Mycobacterium bovis subsp bovis AF2122/97
cgcuggacggcgg

SEQ ID NO: 3146573 - RNA, 17 nt, Mycobacterium bovis subsp bovis AF2122/97
cgcuggacggcgggccg

SEQ ID NO: 3146574 - RNA, 18 nt, Mycobacterium bovis subsp bovis AF2122/97
cgcuggacggcgggccgc

SEQ ID NO: 3146575 - RNA, 15 nt, Mycobacterium bovis subsp bovis AF2122/97
cgcuggagacguuga

SEQ ID NO: 3146576 - RNA, 17 nt, Mycobacterium bovis subsp bovis AF2122/97
cgcuggagaucacgccg

SEQ ID NO: 3146577 - RNA, 21 nt, Mycobacterium bovis subsp bovis AF2122/97
cgcuggagaucacgccgacga

SEQ ID NO: 3146578 - RNA, 21 nt, Mycobacterium bovis subsp bovis AF2122/97
cgcuggaggacccgcuacgac

SEQ ID NO: 3146579 - RNA, 14 nt, Mycobacterium bovis subsp bovis AF2122/97
cgcuggaggccacc

SEQ ID NO: 3146580 - RNA, 15 nt, Mycobacterium bovis subsp bovis AF2122/97
cgcuggaggccacca

SEQ ID NO: 3146581 - RNA, 16 nt, Mycobacterium bovis subsp bovis AF2122/97
cgcuggaggccaccac

SEQ ID NO: 3146582 - RNA, 12 nt, Mycobacterium bovis subsp bovis AF2122/97
cgcuggaggcga

SEQ ID NO: 3146583 - RNA, 15 nt, Mycobacterium bovis subsp bovis AF2122/97
cgcuggaggcggcgc

SEQ ID NO: 3146584 - RNA, 15 nt, Mycobacterium bovis subsp bovis AF2122/97
cgcuggaggcuccug

SEQ ID NO: 3146585 - RNA, 22 nt, Mycobacterium bovis subsp bovis AF2122/97
cgcuggaggcuccuggucgccg

SEQ ID NO: 3146586 - RNA, 23 nt, Mycobacterium bovis subsp bovis AF2122/97
cgcuggaggcuccuggucgccgu

SEQ ID NO: 3146587 - RNA, 15 nt, Mycobacterium bovis subsp bovis AF2122/97
cgcuggaucaacccg

SEQ ID NO: 3146588 - RNA, 16 nt, Mycobacterium bovis subsp bovis AF2122/97
cgcuggcaaucccgcg

SEQ ID NO: 3146589 - RNA, 14 nt, Mycobacterium bovis subsp bovis AF2122/97
cgcuggcaggccgg

SEQ ID NO: 3146590 - RNA, 12 nt, Mycobacterium bovis subsp bovis AF2122/97
cgcuggccacga

SEQ ID NO: 3146591 - RNA, 13 nt, Mycobacterium bovis subsp bovis AF2122/97
cgcuggccacgau

SEQ ID NO: 3146592 - RNA, 22 nt, Mycobacterium bovis subsp bovis AF2122/97
cgcuggccagaaacgcgauggu

SEQ ID NO: 3146593 - RNA, 12 nt, Mycobacterium bovis subsp bovis AF2122/97
cgcuggccagca

SEQ ID NO: 3146594 - RNA, 13 nt, Mycobacterium bovis subsp bovis AF2122/97
cgcuggccagccc

SEQ ID NO: 3146595 - RNA, 15 nt, Mycobacterium bovis subsp bovis AF2122/97
cgcuggccagcccgg

SEQ ID NO: 3146596 - RNA, 15 nt, Mycobacterium bovis subsp bovis AF2122/97
cgcuggccauggugg

SEQ ID NO: 3146597 - RNA, 19 nt, Mycobacterium bovis subsp bovis AF2122/97
cgcuggcccaauugcgccg

SEQ ID NO: 3146598 - RNA, 13 nt, Mycobacterium bovis subsp bovis AF2122/97
cgcuggcccggcg

SEQ ID NO: 3146599 - RNA, 14 nt, Mycobacterium bovis subsp bovis AF2122/97
cgcuggccggcacc

SEQ ID NO: 3146600 - RNA, 15 nt, Mycobacterium bovis subsp bovis AF2122/97
cgcuggccggcaccg

SEQ ID NO: 3146601 - RNA, 13 nt, Mycobacterium bovis subsp bovis AF2122/97
cgcuggccgucga

SEQ ID NO: 3146602 - RNA, 14 nt, Mycobacterium bovis subsp bovis AF2122/97
cgcuggccuccagc

SEQ ID NO: 3146603 - RNA, 16 nt, Mycobacterium bovis subsp bovis AF2122/97
cgcuggccuccagcuu

SEQ ID NO: 3146604 - RNA, 18 nt, Mycobacterium bovis subsp bovis AF2122/97
cgcuggccuccagcuugg

SEQ ID NO: 3146605 - RNA, 13 nt, Mycobacterium bovis subsp bovis AF2122/97
cgcuggccuccug

SEQ ID NO: 3146606 - RNA, 15 nt, Mycobacterium bovis subsp bovis AF2122/97
cgcuggccuccugga

SEQ ID NO: 3146607 - RNA, 17 nt, Mycobacterium bovis subsp bovis AF2122/97
cgcuggccuccuggaag

SEQ ID NO: 3146608 - RNA, 14 nt, Mycobacterium bovis subsp bovis AF2122/97
cgcuggccucgucg

SEQ ID NO: 3146609 - RNA, 15 nt, Mycobacterium bovis subsp bovis AF2122/97
cgcuggcgcccccga

SEQ ID NO: 3146610 - RNA, 23 nt, Mycobacterium bovis subsp bovis AF2122/97
cgcuggcgcccccgacgacggca

SEQ ID NO: 3146611 - RNA, 22 nt, Mycobacterium bovis subsp bovis AF2122/97
cgcuggcgcccuugccggcgag

SEQ ID NO: 3146612 - RNA, 14 nt, Mycobacterium bovis subsp bovis AF2122/97
cgcuggcgccgccg

SEQ ID NO: 3146613 - RNA, 15 nt, Mycobacterium bovis subsp bovis AF2122/97
cgcuggcgccgccgg

SEQ ID NO: 3146614 - RNA, 21 nt, Mycobacterium bovis subsp bovis AF2122/97
cgcuggcgccgccggugccac

SEQ ID NO: 3146615 - RNA, 15 nt, Mycobacterium bovis subsp bovis AF2122/97
cgcuggcgccggcca

SEQ ID NO: 3146616 - RNA, 17 nt, Mycobacterium bovis subsp bovis AF2122/97
cgcuguugccaucgacg

SEQ ID NO: 3146617 - RNA, 21 nt, Mycobacterium bovis subsp bovis AF2122/97
cgcuguugccaucgacgccgc

SEQ ID NO: 3146618 - RNA, 17 nt, Mycobacterium bovis subsp bovis AF2122/97
cgcuguugcuggcgccc

SEQ ID NO: 3146619 - RNA, 19 nt, Mycobacterium bovis subsp bovis AF2122/97
cgcuguugcuggcgccccc

SEQ ID NO: 3146620 - RNA, 13 nt, Mycobacterium bovis subsp bovis AF2122/97
cgcuguuggccgg

SEQ ID NO: 3146621 - RNA, 14 nt, Mycobacterium bovis subsp bovis AF2122/97
cgcuguuggccggu

SEQ ID NO: 3146622 - RNA, 22 nt, Mycobacterium bovis subsp bovis AF2122/97
cgcuguuguggaacaccgcggc

SEQ ID NO: 3146623 - RNA, 13 nt, Mycobacterium bovis subsp bovis AF2122/97
cgcuguuguuguc

SEQ ID NO: 3146624 - RNA, 20 nt, Mycobacterium bovis subsp bovis AF2122/97
cgcuuacgggugucgggcgc

SEQ ID NO: 3146625 - RNA, 15 nt, Mycobacterium bovis subsp bovis AF2122/97
cgcuucacagccacc

SEQ ID NO: 3146626 - RNA, 16 nt, Mycobacterium bovis subsp bovis AF2122/97
cgcuucacagccacca

SEQ ID NO: 3146627 - RNA, 18 nt, Mycobacterium bovis subsp bovis AF2122/97
cgcuucacagccaccagc

SEQ ID NO: 3146628 - RNA, 14 nt, Mycobacterium bovis subsp bovis AF2122/97
cgcuucacgggccg

SEQ ID NO: 3146629 - RNA, 19 nt, Mycobacterium bovis subsp bovis AF2122/97
cgcuucaggcaccggauga

SEQ ID NO: 3146630 - RNA, 21 nt, Mycobacterium bovis subsp bovis AF2122/97
cgcuucaggcgccacugcuuc

SEQ ID NO: 3146631 - RNA, 18 nt, Mycobacterium bovis subsp bovis AF2122/97
cgcuucaugagccgcugc

SEQ ID NO: 3146632 - RNA, 18 nt, Mycobacterium bovis subsp bovis AF2122/97
cgcuucccggaagcgccg

SEQ ID NO: 3146633 - RNA, 22 nt, Mycobacterium bovis subsp bovis AF2122/97
cgcuucccggaagcgccggccc

SEQ ID NO: 3146634 - RNA, 14 nt, Mycobacterium bovis subsp bovis AF2122/97
cgcuucgccacacc

SEQ ID NO: 3146635 - RNA, 16 nt, Mycobacterium bovis subsp bovis AF2122/97
cgcuucgccacaccau

SEQ ID NO: 3146636 - RNA, 19 nt, Mycobacterium bovis subsp bovis AF2122/97
cgcuucgccacaccaugau

SEQ ID NO: 3146637 - RNA, 13 nt, Mycobacterium bovis subsp bovis AF2122/97
cgcuucggcagcu

SEQ ID NO: 3146638 - RNA, 21 nt, Mycobacterium bovis subsp bovis AF2122/97
cgcuucggcagcucccgccac

SEQ ID NO: 3146639 - RNA, 17 nt, Mycobacterium bovis subsp bovis AF2122/97
cgcuucggcggucgccg

SEQ ID NO: 3146640 - RNA, 22 nt, Mycobacterium bovis subsp bovis AF2122/97
cgcuucguccagcgaucccggu

SEQ ID NO: 3146641 - RNA, 20 nt, Mycobacterium bovis subsp bovis AF2122/97
cgcuucgucggccggcaccc

SEQ ID NO: 3146642 - RNA, 16 nt, Mycobacterium bovis subsp bovis AF2122/97
cgcuugaccccuggcc

SEQ ID NO: 3146643 - RNA, 17 nt, Mycobacterium bovis subsp bovis AF2122/97
cgcuugaccccuggccg

SEQ ID NO: 3146644 - RNA, 18 nt, Mycobacterium bovis subsp bovis AF2122/97
cgcuugaccccuggccgc

SEQ ID NO: 3146645 - RNA, 19 nt, Mycobacterium bovis subsp bovis AF2122/97
cgcuugaccccuggccgcc

SEQ ID NO: 3146646 - RNA, 21 nt, Mycobacterium bovis subsp bovis AF2122/97
cgcuugaccccuggccgccgg

SEQ ID NO: 3146647 - RNA, 18 nt, Mycobacterium bovis subsp bovis AF2122/97
cgcuugacccgcggaccg

SEQ ID NO: 3146648 - RNA, 22 nt, Mycobacterium bovis subsp bovis AF2122/97
cgcuugagcgaguugcagucgc

SEQ ID NO: 3146649 - RNA, 16 nt, Mycobacterium bovis subsp bovis AF2122/97
cgcuugauccacccga

SEQ ID NO: 3146650 - RNA, 23 nt, Mycobacterium bovis subsp bovis AF2122/97
cgcuugaucugggcugcggccgc

SEQ ID NO: 3146651 - RNA, 22 nt, Mycobacterium bovis subsp bovis AF2122/97
cgcuugcaccaggggcgcguca

SEQ ID NO: 3146652 - RNA, 12 nt, Mycobacterium bovis subsp bovis AF2122/97
cgcuugcauuga

SEQ ID NO: 3146653 - RNA, 12 nt, Mycobacterium bovis subsp bovis AF2122/97
cgcuugccccgc

SEQ ID NO: 3146654 - RNA, 15 nt, Mycobacterium bovis subsp bovis AF2122/97
cgcuugccccgccuu

SEQ ID NO: 3146655 - RNA, 14 nt, Mycobacterium bovis subsp bovis AF2122/97
cgcuugccgcugag

SEQ ID NO: 3146656 - RNA, 17 nt, Mycobacterium bovis subsp bovis AF2122/97
cgcuugccgcugagccc

SEQ ID NO: 3146657 - RNA, 16 nt, Mycobacterium bovis subsp bovis AF2122/97
cgcuugcgaccccggc

SEQ ID NO: 3146658 - RNA, 13 nt, Mycobacterium bovis subsp bovis AF2122/97
cgcuugcgcggcu

SEQ ID NO: 3146659 - RNA, 14 nt, Mycobacterium bovis subsp bovis AF2122/97
cgcuugcggccgcg

SEQ ID NO: 3146660 - RNA, 17 nt, Mycobacterium bovis subsp bovis AF2122/97
cgcuugcggggccgggc

SEQ ID NO: 3146661 - RNA, 23 nt, Mycobacterium bovis subsp bovis AF2122/97
cgcuugcggggccgggcgaucgc

SEQ ID NO: 3146662 - RNA, 15 nt, Mycobacterium bovis subsp bovis AF2122/97
cgcuugcucucgcag

SEQ ID NO: 3146663 - RNA, 18 nt, Mycobacterium bovis subsp bovis AF2122/97
cgcuugcucucgcagcau

SEQ ID NO: 3146664 - RNA, 18 nt, Mycobacterium bovis subsp bovis AF2122/97
cgcuugcuggguaguuca

SEQ ID NO: 3146665 - RNA, 18 nt, Mycobacterium bovis subsp bovis AF2122/97
cgcuuggcaaucaucucc

SEQ ID NO: 3146666 - RNA, 22 nt, Mycobacterium bovis subsp bovis AF2122/97
cgcuuggcaaucaucucccgac

SEQ ID NO: 3146667 - RNA, 16 nt, Mycobacterium bovis subsp bovis AF2122/97
cgcuuggccaggucau

SEQ ID NO: 3146668 - RNA, 18 nt, Mycobacterium bovis subsp bovis AF2122/97
cgcuuggccgcugccuuc

SEQ ID NO: 3146669 - RNA, 18 nt, Mycobacterium bovis subsp bovis AF2122/97
cgcuuggcgagccacggc

SEQ ID NO: 3146670 - RNA, 15 nt, Mycobacterium bovis subsp bovis AF2122/97
cgcuuggcgcggccc

SEQ ID NO: 3146671 - RNA, 23 nt, Mycobacterium bovis subsp bovis AF2122/97
cgcuuggcguauccuugcgacgu

SEQ ID NO: 3146672 - RNA, 22 nt, Mycobacterium bovis subsp bovis AF2122/97
cgcuuggucaaaaagcucggcc

SEQ ID NO: 3146673 - RNA, 22 nt, Mycobacterium bovis subsp bovis AF2122/97
cgcuuggugugauacaacgcca

SEQ ID NO: 3146674 - RNA, 20 nt, Mycobacterium bovis subsp bovis AF2122/97
cgcuugugacaccacaucgg

SEQ ID NO: 3146675 - RNA, 21 nt, Mycobacterium bovis subsp bovis AF2122/97
cgcuugugacaccacaucggg

SEQ ID NO: 3146676 - RNA, 17 nt, Mycobacterium bovis subsp bovis AF2122/97
cgcuuuccggcgguggu

SEQ ID NO: 3146677 - RNA, 13 nt, Mycobacterium bovis subsp bovis AF2122/97
cgcuuucuuggcg

SEQ ID NO: 3146678 - RNA, 18 nt, Mycobacterium bovis subsp bovis AF2122/97
cgcuuugaauugcgcgcc

SEQ ID NO: 3146679 - RNA, 13 nt, Mycobacterium bovis subsp bovis AF2122/97
cgcuuugaugccg

SEQ ID NO: 3146680 - RNA, 15 nt, Mycobacterium bovis subsp bovis AF2122/97
cgcuuuucgauggug

SEQ ID NO: 3146681 - RNA, 16 nt, Mycobacterium bovis subsp bovis AF2122/97
cggaaaaccgcaccgu

SEQ ID NO: 3146682 - RNA, 17 nt, Mycobacterium bovis subsp bovis AF2122/97
cggaaaaccgcaccguc

SEQ ID NO: 3146683 - RNA, 16 nt, Mycobacterium bovis subsp bovis AF2122/97
cggaaaaucggcuggc

SEQ ID NO: 3146684 - RNA, 13 nt, Mycobacterium bovis subsp bovis AF2122/97
cggaaacagcaug

SEQ ID NO: 3146685 - RNA, 17 nt, Mycobacterium bovis subsp bovis AF2122/97
cggaaaccaucgccagc

SEQ ID NO: 3146686 - RNA, 15 nt, Mycobacterium bovis subsp bovis AF2122/97
cggaaacccggccgc

SEQ ID NO: 3146687 - RNA, 18 nt, Mycobacterium bovis subsp bovis AF2122/97
cggaaacccggccgccga

SEQ ID NO: 3146688 - RNA, 17 nt, Mycobacterium bovis subsp bovis AF2122/97
cggaaaccgccccgugg

SEQ ID NO: 3146689 - RNA, 18 nt, Mycobacterium bovis subsp bovis AF2122/97
cggaaagcccgucgucgg

SEQ ID NO: 3146690 - RNA, 16 nt, Mycobacterium bovis subsp bovis AF2122/97
cggaaaggucggccug

SEQ ID NO: 3146691 - RNA, 17 nt, Mycobacterium bovis subsp bovis AF2122/97
cggaaaggucggccugc

SEQ ID NO: 3146692 - RNA, 23 nt, Mycobacterium bovis subsp bovis AF2122/97
cggaaauggcgucgccggcaccg

SEQ ID NO: 3146693 - RNA, 23 nt, Mycobacterium bovis subsp bovis AF2122/97
cggaacaagguauggccggagcg

SEQ ID NO: 3146694 - RNA, 13 nt, Mycobacterium bovis subsp bovis AF2122/97
cggaacaccacca

SEQ ID NO: 3146695 - RNA, 16 nt, Mycobacterium bovis subsp bovis AF2122/97
cggaacaccaccaggc

SEQ ID NO: 3146696 - RNA, 12 nt, Mycobacterium bovis subsp bovis AF2122/97
cggaacaccagc

SEQ ID NO: 3146697 - RNA, 18 nt, Mycobacterium bovis subsp bovis AF2122/97
cggaacaccgacgucagg

SEQ ID NO: 3146698 - RNA, 13 nt, Mycobacterium bovis subsp bovis AF2122/97
cggaacaccgccc

SEQ ID NO: 3146699 - RNA, 14 nt, Mycobacterium bovis subsp bovis AF2122/97
cggaacaccgcccg

SEQ ID NO: 3146700 - RNA, 16 nt, Mycobacterium bovis subsp bovis AF2122/97
cggaacaccgcccggc

SEQ ID NO: 3146701 - RNA, 20 nt, Mycobacterium bovis subsp bovis AF2122/97
cggaacaccgcccggcccgg

SEQ ID NO: 3146702 - RNA, 21 nt, Mycobacterium bovis subsp bovis AF2122/97
cggaacacgaugcgcggugcg

SEQ ID NO: 3146703 - RNA, 15 nt, Mycobacterium bovis subsp bovis AF2122/97
cggaauucagcgacg

SEQ ID NO: 3146704 - RNA, 20 nt, Mycobacterium bovis subsp bovis AF2122/97
cggaauucgguuggcucggg

SEQ ID NO: 3146705 - RNA, 19 nt, Mycobacterium bovis subsp bovis AF2122/97
cggacaaagcugcucgucg

SEQ ID NO: 3146706 - RNA, 23 nt, Mycobacterium bovis subsp bovis AF2122/97
cggacaaagcugcucgucggcgc

SEQ ID NO: 3146707 - RNA, 12 nt, Mycobacterium bovis subsp bovis AF2122/97
cggacaaccugg

SEQ ID NO: 3146708 - RNA, 19 nt, Mycobacterium bovis subsp bovis AF2122/97
cggacaaccuggggccacc

SEQ ID NO: 3146709 - RNA, 22 nt, Mycobacterium bovis subsp bovis AF2122/97
cggacaaccuggggccaccaga

SEQ ID NO: 3146710 - RNA, 18 nt, Mycobacterium bovis subsp bovis AF2122/97
cggacaaggacugaccgu

SEQ ID NO: 3146711 - RNA, 14 nt, Mycobacterium bovis subsp bovis AF2122/97
cggacaagucggca

SEQ ID NO: 3146712 - RNA, 20 nt, Mycobacterium bovis subsp bovis AF2122/97
cggacaagucggcaccggug

SEQ ID NO: 3146713 - RNA, 15 nt, Mycobacterium bovis subsp bovis AF2122/97
cggacaccccgcacg

SEQ ID NO: 3146714 - RNA, 12 nt, Mycobacterium bovis subsp bovis AF2122/97
cggacaccgcgg

SEQ ID NO: 3146715 - RNA, 14 nt, Mycobacterium bovis subsp bovis AF2122/97
cggacaccgcggcg

SEQ ID NO: 3146716 - RNA, 15 nt, Mycobacterium bovis subsp bovis AF2122/97
cggacaccgcggcga

SEQ ID NO: 3146717 - RNA, 14 nt, Mycobacterium bovis subsp bovis AF2122/97
cggacaccucgggc

SEQ ID NO: 3146718 - RNA, 13 nt, Mycobacterium bovis subsp bovis AF2122/97
cggacacgaucgc

SEQ ID NO: 3146719 - RNA, 18 nt, Mycobacterium bovis subsp bovis AF2122/97
cggacacgaucgcgucgg

SEQ ID NO: 3146720 - RNA, 13 nt, Mycobacterium bovis subsp bovis AF2122/97
cggacagcgaguu

SEQ ID NO: 3146721 - RNA, 20 nt, Mycobacterium bovis subsp bovis AF2122/97
cggacagcgcauccacaauc

SEQ ID NO: 3146722 - RNA, 15 nt, Mycobacterium bovis subsp bovis AF2122/97
cggacagcgucucgg

SEQ ID NO: 3146723 - RNA, 12 nt, Mycobacterium bovis subsp bovis AF2122/97
cggacagcucgc

SEQ ID NO: 3146724 - RNA, 15 nt, Mycobacterium bovis subsp bovis AF2122/97
cggacagggcggcaa

SEQ ID NO: 3146725 - RNA, 16 nt, Mycobacterium bovis subsp bovis AF2122/97
cggacagggcggcaac

SEQ ID NO: 3146726 - RNA, 17 nt, Mycobacterium bovis subsp bovis AF2122/97
cggacagggcggcaacg

SEQ ID NO: 3146727 - RNA, 14 nt, Mycobacterium bovis subsp bovis AF2122/97
cggacagguagucg

SEQ ID NO: 3146728 - RNA, 18 nt, Mycobacterium bovis subsp bovis AF2122/97
cggacagguagucgccgg

SEQ ID NO: 3146729 - RNA, 14 nt, Mycobacterium bovis subsp bovis AF2122/97
cggacauaccgcga

SEQ ID NO: 3146730 - RNA, 16 nt, Mycobacterium bovis subsp bovis AF2122/97
cggacauagccgcgcu

SEQ ID NO: 3146731 - RNA, 16 nt, Mycobacterium bovis subsp bovis AF2122/97
cggacaugcgggcagc

SEQ ID NO: 3146732 - RNA, 22 nt, Mycobacterium bovis subsp bovis AF2122/97
cggaccacaccgucaccgagcc

SEQ ID NO: 3146733 - RNA, 17 nt, Mycobacterium bovis subsp bovis AF2122/97
cggaccacaucugguca

SEQ ID NO: 3146734 - RNA, 12 nt, Mycobacterium bovis subsp bovis AF2122/97
cggaccaccagg

SEQ ID NO: 3146735 - RNA, 16 nt, Mycobacterium bovis subsp bovis AF2122/97
cggaccacccggcgcg

SEQ ID NO: 3146736 - RNA, 17 nt, Mycobacterium bovis subsp bovis AF2122/97
cggaccacccggcgcga

SEQ ID NO: 3146737 - RNA, 12 nt, Mycobacterium bovis subsp bovis AF2122/97
cggaccaccgcc

SEQ ID NO: 3146738 - RNA, 16 nt, Mycobacterium bovis subsp bovis AF2122/97
cggaccaccgccgaag

SEQ ID NO: 3146739 - RNA, 16 nt, Mycobacterium bovis subsp bovis AF2122/97
cggaccacuguuggug

SEQ ID NO: 3146740 - RNA, 21 nt, Mycobacterium bovis subsp bovis AF2122/97
cggaccacuguuggugccgcc

SEQ ID NO: 3146741 - RNA, 19 nt, Mycobacterium bovis subsp bovis AF2122/97
cggaccagagugguggcga

SEQ ID NO: 3146742 - RNA, 13 nt, Mycobacterium bovis subsp bovis AF2122/97
cggaccagcugcc

SEQ ID NO: 3146743 - RNA, 15 nt, Mycobacterium bovis subsp bovis AF2122/97
cggaccagcugccgg

SEQ ID NO: 3146744 - RNA, 16 nt, Mycobacterium bovis subsp bovis AF2122/97
cggaccaggccgcgcg

SEQ ID NO: 3146745 - RNA, 18 nt, Mycobacterium bovis subsp bovis AF2122/97
cggaccaggccgcgcgca

SEQ ID NO: 3146746 - RNA, 17 nt, Mycobacterium bovis subsp bovis AF2122/97
cggaccaucagcgucga

SEQ ID NO: 3146747 - RNA, 16 nt, Mycobacterium bovis subsp bovis AF2122/97
cggaccaucgccaggc

SEQ ID NO: 3146748 - RNA, 18 nt, Mycobacterium bovis subsp bovis AF2122/97
cggaccaucgccaggccc

SEQ ID NO: 3146749 - RNA, 12 nt, Mycobacterium bovis subsp bovis AF2122/97
cggacccaccaa

SEQ ID NO: 3146750 - RNA, 18 nt, Mycobacterium bovis subsp bovis AF2122/97
cggacccacccgcaccgc

SEQ ID NO: 3146751 - RNA, 20 nt, Mycobacterium bovis subsp bovis AF2122/97
cggacccacccgcaccgccg

SEQ ID NO: 3146752 - RNA, 22 nt, Mycobacterium bovis subsp bovis AF2122/97
cggacccacccgcaccgccggc

SEQ ID NO: 3146753 - RNA, 12 nt, Mycobacterium bovis subsp bovis AF2122/97
cggacccaccgu

SEQ ID NO: 3146754 - RNA, 14 nt, Mycobacterium bovis subsp bovis AF2122/97
cggacccagcaccc

SEQ ID NO: 3146755 - RNA, 17 nt, Mycobacterium bovis subsp bovis AF2122/97
cggaccccacgaguagc

SEQ ID NO: 3146756 - RNA, 18 nt, Mycobacterium bovis subsp bovis AF2122/97
cggacccgcagcugcgga

SEQ ID NO: 3146757 - RNA, 20 nt, Mycobacterium bovis subsp bovis AF2122/97
cggacccgcagcugcggauc

SEQ ID NO: 3146758 - RNA, 21 nt, Mycobacterium bovis subsp bovis AF2122/97
cggacccgcccuugccgccga

SEQ ID NO: 3146759 - RNA, 14 nt, Mycobacterium bovis subsp bovis AF2122/97
cggacccgccgggu

SEQ ID NO: 3146760 - RNA, 15 nt, Mycobacterium bovis subsp bovis AF2122/97
cggacccgccggguc

SEQ ID NO: 3146761 - RNA, 13 nt, Mycobacterium bovis subsp bovis AF2122/97
cggacccgccgug

SEQ ID NO: 3146762 - RNA, 13 nt, Mycobacterium bovis subsp bovis AF2122/97
cggacccgcgcgu

SEQ ID NO: 3146763 - RNA, 14 nt, Mycobacterium bovis subsp bovis AF2122/97
cggacccgcucgcg

SEQ ID NO: 3146764 - RNA, 19 nt, Mycobacterium bovis subsp bovis AF2122/97
cggacccggugacccgcug

SEQ ID NO: 3146765 - RNA, 15 nt, Mycobacterium bovis subsp bovis AF2122/97
cggacccggugcacg

SEQ ID NO: 3146766 - RNA, 12 nt, Mycobacterium bovis subsp bovis AF2122/97
cggacccgucgg

SEQ ID NO: 3146767 - RNA, 13 nt, Mycobacterium bovis subsp bovis AF2122/97
cggacccuuccgc

SEQ ID NO: 3146768 - RNA, 22 nt, Mycobacterium bovis subsp bovis AF2122/97
cggacccuuccgccgccgccgg

SEQ ID NO: 3146769 - RNA, 14 nt, Mycobacterium bovis subsp bovis AF2122/97
cggaccgaccaccg

SEQ ID NO: 3146770 - RNA, 14 nt, Mycobacterium bovis subsp bovis AF2122/97
cggaccgaccggcu

SEQ ID NO: 3146771 - RNA, 18 nt, Mycobacterium bovis subsp bovis AF2122/97
cggaccgaccggcucacg

SEQ ID NO: 3146772 - RNA, 22 nt, Mycobacterium bovis subsp bovis AF2122/97
cggaccgaugacgaucggcggc

SEQ ID NO: 3146773 - RNA, 16 nt, Mycobacterium bovis subsp bovis AF2122/97
cggaccgaugguugag

SEQ ID NO: 3146774 - RNA, 20 nt, Mycobacterium bovis subsp bovis AF2122/97
cggaccgauugucggcaacg

SEQ ID NO: 3146775 - RNA, 21 nt, Mycobacterium bovis subsp bovis AF2122/97
cggaccgauugucggcaacga

SEQ ID NO: 3146776 - RNA, 22 nt, Mycobacterium bovis subsp bovis AF2122/97
cggaccgauugucggcaacgac

SEQ ID NO: 3146777 - RNA, 23 nt, Mycobacterium bovis subsp bovis AF2122/97
cggaccgauugucggcaacgacc

SEQ ID NO: 3146778 - RNA, 21 nt, Mycobacterium bovis subsp bovis AF2122/97
cggaccgauuucuuuaccagc

SEQ ID NO: 3146779 - RNA, 23 nt, Mycobacterium bovis subsp bovis AF2122/97
cggaccgauuucuuuaccagcac

SEQ ID NO: 3146780 - RNA, 19 nt, Mycobacterium bovis subsp bovis AF2122/97
cggaccgcaacgacggccg

SEQ ID NO: 3146781 - RNA, 12 nt, Mycobacterium bovis subsp bovis AF2122/97
cggaccgcagcg

SEQ ID NO: 3146782 - RNA, 22 nt, Mycobacterium bovis subsp bovis AF2122/97
cggaccgcagcgugaucuggcc

SEQ ID NO: 3146783 - RNA, 13 nt, Mycobacterium bovis subsp bovis AF2122/97
cggaccgcgacgg

SEQ ID NO: 3146784 - RNA, 16 nt, Mycobacterium bovis subsp bovis AF2122/97
cggaccgcugccugcc

SEQ ID NO: 3146785 - RNA, 21 nt, Mycobacterium bovis subsp bovis AF2122/97
cggaccgcuucgacgucguug

SEQ ID NO: 3146786 - RNA, 14 nt, Mycobacterium bovis subsp bovis AF2122/97
cggaccggcgcgcu

SEQ ID NO: 3146787 - RNA, 19 nt, Mycobacterium bovis subsp bovis AF2122/97
cggaccggcuuccccagca

SEQ ID NO: 3146788 - RNA, 20 nt, Mycobacterium bovis subsp bovis AF2122/97
cggaccggcuuccccagcag

SEQ ID NO: 3146789 - RNA, 21 nt, Mycobacterium bovis subsp bovis AF2122/97
cggaccgggggaagcgguagc

SEQ ID NO: 3146790 - RNA, 22 nt, Mycobacterium bovis subsp bovis AF2122/97
cggagaaguucgugagcgaacg

SEQ ID NO: 3146791 - RNA, 17 nt, Mycobacterium bovis subsp bovis AF2122/97
cggagaauagaucaggg

SEQ ID NO: 3146792 - RNA, 20 nt, Mycobacterium bovis subsp bovis AF2122/97
cggagaauuccgcuagguca

SEQ ID NO: 3146793 - RNA, 23 nt, Mycobacterium bovis subsp bovis AF2122/97
cggagaauuccgcuaggucaggu

SEQ ID NO: 3146794 - RNA, 14 nt, Mycobacterium bovis subsp bovis AF2122/97
cggagacacccgcc

SEQ ID NO: 3146795 - RNA, 15 nt, Mycobacterium bovis subsp bovis AF2122/97
cggagacacccgcca

SEQ ID NO: 3146796 - RNA, 17 nt, Mycobacterium bovis subsp bovis AF2122/97
cggagacacccgccagg

SEQ ID NO: 3146797 - RNA, 20 nt, Mycobacterium bovis subsp bovis AF2122/97
cggagacacccgccaggccg

SEQ ID NO: 3146798 - RNA, 14 nt, Mycobacterium bovis subsp bovis AF2122/97
cggagaccagcucg

SEQ ID NO: 3146799 - RNA, 15 nt, Mycobacterium bovis subsp bovis AF2122/97
cggagacccguccgg

SEQ ID NO: 3146800 - RNA, 17 nt, Mycobacterium bovis subsp bovis AF2122/97
cggagaccgccucgucg

SEQ ID NO: 3146801 - RNA, 15 nt, Mycobacterium bovis subsp bovis AF2122/97
cggagaccggccggg

SEQ ID NO: 3146802 - RNA, 22 nt, Mycobacterium bovis subsp bovis AF2122/97
cggagaccggccgggugaacca

SEQ ID NO: 3146803 - RNA, 14 nt, Mycobacterium bovis subsp bovis AF2122/97
cggagacgaucgcc

SEQ ID NO: 3146804 - RNA, 20 nt, Mycobacterium bovis subsp bovis AF2122/97
cggagacgaucgccaggccg

SEQ ID NO: 3146805 - RNA, 13 nt, Mycobacterium bovis subsp bovis AF2122/97
cggagacgucgcc

SEQ ID NO: 3146806 - RNA, 15 nt, Mycobacterium bovis subsp bovis AF2122/97
cggagacgucuucgg

SEQ ID NO: 3146807 - RNA, 20 nt, Mycobacterium bovis subsp bovis AF2122/97
cggagagccugcucgcagcg

SEQ ID NO: 3146808 - RNA, 16 nt, Mycobacterium bovis subsp bovis AF2122/97
cggagauaccggaccc

SEQ ID NO: 3146809 - RNA, 21 nt, Mycobacterium bovis subsp bovis AF2122/97
cggagauaccggaccccaacg

SEQ ID NO: 3146810 - RNA, 19 nt, Mycobacterium bovis subsp bovis AF2122/97
cggagauacgggccaccgu

SEQ ID NO: 3146811 - RNA, 18 nt, Mycobacterium bovis subsp bovis AF2122/97
cggagaucauggcgagcg

SEQ ID NO: 3146812 - RNA, 18 nt, Mycobacterium bovis subsp bovis AF2122/97
cggagaucgagaucaccu

SEQ ID NO: 3146813 - RNA, 13 nt, Mycobacterium bovis subsp bovis AF2122/97
cggagaucgccac

SEQ ID NO: 3146814 - RNA, 22 nt, Mycobacterium bovis subsp bovis AF2122/97
cggagaucgucgcguagugaug

SEQ ID NO: 3146815 - RNA, 15 nt, Mycobacterium bovis subsp bovis AF2122/97
cggagaugaacucgg

SEQ ID NO: 3146816 - RNA, 23 nt, Mycobacterium bovis subsp bovis AF2122/97
cggagaugccauuucgucgucgc

SEQ ID NO: 3146817 - RNA, 23 nt, Mycobacterium bovis subsp bovis AF2122/97
cggagauguaguccucgguggcc

SEQ ID NO: 3146818 - RNA, 17 nt, Mycobacterium bovis subsp bovis AF2122/97
cggagcagcucacuggu

SEQ ID NO: 3146819 - RNA, 18 nt, Mycobacterium bovis subsp bovis AF2122/97
cggagccaaugucuacgc

SEQ ID NO: 3146820 - RNA, 23 nt, Mycobacterium bovis subsp bovis AF2122/97
cggagccacucggcccggcagga

SEQ ID NO: 3146821 - RNA, 12 nt, Mycobacterium bovis subsp bovis AF2122/97
cggagccaggac

SEQ ID NO: 3146822 - RNA, 15 nt, Mycobacterium bovis subsp bovis AF2122/97
cggagccaggacgac

SEQ ID NO: 3146823 - RNA, 17 nt, Mycobacterium bovis subsp bovis AF2122/97
cggagccaggacgacgc

SEQ ID NO: 3146824 - RNA, 22 nt, Mycobacterium bovis subsp bovis AF2122/97
cggagccaggacgacgccgacg

SEQ ID NO: 3146825 - RNA, 23 nt, Mycobacterium bovis subsp bovis AF2122/97
cggagccaggacgacgccgacga

SEQ ID NO: 3146826 - RNA, 20 nt, Mycobacterium bovis subsp bovis AF2122/97
cggagcccacacgcucacgg

SEQ ID NO: 3146827 - RNA, 22 nt, Mycobacterium bovis subsp bovis AF2122/97
cggagcccacacgcucacgggc

SEQ ID NO: 3146828 - RNA, 12 nt, Mycobacterium bovis subsp bovis AF2122/97
cggagccgagcc

SEQ ID NO: 3146829 - RNA, 13 nt, Mycobacterium bovis subsp bovis AF2122/97
cggagccgaugac

SEQ ID NO: 3146830 - RNA, 14 nt, Mycobacterium bovis subsp bovis AF2122/97
cggagccgaugacc

SEQ ID NO: 3146831 - RNA, 20 nt, Mycobacterium bovis subsp bovis AF2122/97
cggagccgcccaagccgccg

SEQ ID NO: 3146832 - RNA, 22 nt, Mycobacterium bovis subsp bovis AF2122/97
cggagccgcccaagccgccggc

SEQ ID NO: 3146833 - RNA, 12 nt, Mycobacterium bovis subsp bovis AF2122/97
cggagccgccga

SEQ ID NO: 3146834 - RNA, 17 nt, Mycobacterium bovis subsp bovis AF2122/97
cggagccgccgacucgg

SEQ ID NO: 3146835 - RNA, 13 nt, Mycobacterium bovis subsp bovis AF2122/97
cggagccgccgcu

SEQ ID NO: 3146836 - RNA, 14 nt, Mycobacterium bovis subsp bovis AF2122/97
cggagccgccgcug

SEQ ID NO: 3146837 - RNA, 18 nt, Mycobacterium bovis subsp bovis AF2122/97
cggagccgccgcuggucu

SEQ ID NO: 3146838 - RNA, 12 nt, Mycobacterium bovis subsp bovis AF2122/97
cggagccgccgg

SEQ ID NO: 3146839 - RNA, 15 nt, Mycobacterium bovis subsp bovis AF2122/97
cggagccgccggccc

SEQ ID NO: 3146840 - RNA, 19 nt, Mycobacterium bovis subsp bovis AF2122/97
cggagccgccggccccgcc

SEQ ID NO: 3146841 - RNA, 14 nt, Mycobacterium bovis subsp bovis AF2122/97
cggagccgccggcg

SEQ ID NO: 3146842 - RNA, 16 nt, Mycobacterium bovis subsp bovis AF2122/97
cggagccgccggcggu

SEQ ID NO: 3146843 - RNA, 19 nt, Mycobacterium bovis subsp bovis AF2122/97
cggagccgccggcggugau

SEQ ID NO: 3146844 - RNA, 12 nt, Mycobacterium bovis subsp bovis AF2122/97
cggagccgcuac

SEQ ID NO: 3146845 - RNA, 13 nt, Mycobacterium bovis subsp bovis AF2122/97
cggagccggccac

SEQ ID NO: 3146846 - RNA, 15 nt, Mycobacterium bovis subsp bovis AF2122/97
cggagccggccaccu

SEQ ID NO: 3146847 - RNA, 16 nt, Mycobacterium bovis subsp bovis AF2122/97
cggagccggccaccuc

SEQ ID NO: 3146848 - RNA, 17 nt, Mycobacterium bovis subsp bovis AF2122/97
cggagccggccaccucg

SEQ ID NO: 3146849 - RNA, 13 nt, Mycobacterium bovis subsp bovis AF2122/97
cggagccggcgca

SEQ ID NO: 3146850 - RNA, 16 nt, Mycobacterium bovis subsp bovis AF2122/97
cggagccggugccgac

SEQ ID NO: 3146851 - RNA, 16 nt, Mycobacterium bovis subsp bovis AF2122/97
cggagccgucgagcag

SEQ ID NO: 3146852 - RNA, 20 nt, Mycobacterium bovis subsp bovis AF2122/97
cggagccgucgagcagccga

SEQ ID NO: 3146853 - RNA, 23 nt, Mycobacterium bovis subsp bovis AF2122/97
cggagccgucgagcagccgagcu

SEQ ID NO: 3146854 - RNA, 12 nt, Mycobacterium bovis subsp bovis AF2122/97
cggagccgucgc

SEQ ID NO: 3146855 - RNA, 21 nt, Mycobacterium bovis subsp bovis AF2122/97
cggagccgucgcaucaggucg

SEQ ID NO: 3146856 - RNA, 18 nt, Mycobacterium bovis subsp bovis AF2122/97
cggagccucgaacaucgg

SEQ ID NO: 3146857 - RNA, 13 nt, Mycobacterium bovis subsp bovis AF2122/97
cggagcgauccgg

SEQ ID NO: 3146858 - RNA, 21 nt, Mycobacterium bovis subsp bovis AF2122/97
cggagcgcauuuguugcugcu

SEQ ID NO: 3146859 - RNA, 14 nt, Mycobacterium bovis subsp bovis AF2122/97
cggagcgccgagcu

SEQ ID NO: 3146860 - RNA, 19 nt, Mycobacterium bovis subsp bovis AF2122/97
cggagcgccgagcucggcg

SEQ ID NO: 3146861 - RNA, 20 nt, Mycobacterium bovis subsp bovis AF2122/97
cggagcgggccagcacccgc

SEQ ID NO: 3146862 - RNA, 23 nt, Mycobacterium bovis subsp bovis AF2122/97
cggagcggggaaguuggcugagc

SEQ ID NO: 3146863 - RNA, 16 nt, Mycobacterium bovis subsp bovis AF2122/97
cggagcgggugcgggc

SEQ ID NO: 3146864 - RNA, 17 nt, Mycobacterium bovis subsp bovis AF2122/97
cggagcgggugcgggcg

SEQ ID NO: 3146865 - RNA, 18 nt, Mycobacterium bovis subsp bovis AF2122/97
cggagcgggugcgggcgu

SEQ ID NO: 3146866 - RNA, 16 nt, Mycobacterium bovis subsp bovis AF2122/97
cggagcuagacccguc

SEQ ID NO: 3146867 - RNA, 20 nt, Mycobacterium bovis subsp bovis AF2122/97
cggagcuagacccgucaccg

SEQ ID NO: 3146868 - RNA, 16 nt, Mycobacterium bovis subsp bovis AF2122/97
cggagcucaaccaccu

SEQ ID NO: 3146869 - RNA, 20 nt, Mycobacterium bovis subsp bovis AF2122/97
cggagcucaaccaccucgcc

SEQ ID NO: 3146870 - RNA, 12 nt, Mycobacterium bovis subsp bovis AF2122/97
cggagcugggcu

SEQ ID NO: 3146871 - RNA, 17 nt, Mycobacterium bovis subsp bovis AF2122/97
cggagcuuguugcagcg

SEQ ID NO: 3146872 - RNA, 15 nt, Mycobacterium bovis subsp bovis AF2122/97
cggaggaaccccgcg

SEQ ID NO: 3146873 - RNA, 23 nt, Mycobacterium bovis subsp bovis AF2122/97
cggaggauagggcuuugucaccg

SEQ ID NO: 3146874 - RNA, 18 nt, Mycobacterium bovis subsp bovis AF2122/97
cggaggaucgcugguuug

SEQ ID NO: 3146875 - RNA, 21 nt, Mycobacterium bovis subsp bovis AF2122/97
cggaggcaagcaaccggugcg

SEQ ID NO: 3146876 - RNA, 15 nt, Mycobacterium bovis subsp bovis AF2122/97
cggaggcaauccgau

SEQ ID NO: 3146877 - RNA, 15 nt, Mycobacterium bovis subsp bovis AF2122/97
cggauaggccgcgcg

SEQ ID NO: 3146878 - RNA, 19 nt, Mycobacterium bovis subsp bovis AF2122/97
cggauagugguugcggccg

SEQ ID NO: 3146879 - RNA, 14 nt, Mycobacterium bovis subsp bovis AF2122/97
cggauauuccuuua

SEQ ID NO: 3146880 - RNA, 16 nt, Mycobacterium bovis subsp bovis AF2122/97
cggaucaacaggccgg

SEQ ID NO: 3146881 - RNA, 20 nt, Mycobacterium bovis subsp bovis AF2122/97
cggaucaacaggccggcucg

SEQ ID NO: 3146882 - RNA, 21 nt, Mycobacterium bovis subsp bovis AF2122/97
cggaucaaccccacacccggg

SEQ ID NO: 3146883 - RNA, 15 nt, Mycobacterium bovis subsp bovis AF2122/97
cggaucaagcgcaca

SEQ ID NO: 3146884 - RNA, 13 nt, Mycobacterium bovis subsp bovis AF2122/97
cggaucaccaucg

SEQ ID NO: 3146885 - RNA, 16 nt, Mycobacterium bovis subsp bovis AF2122/97
cggaucaccaucgccg

SEQ ID NO: 3146886 - RNA, 13 nt, Mycobacterium bovis subsp bovis AF2122/97
cggaucaccgcgc

SEQ ID NO: 3146887 - RNA, 22 nt, Mycobacterium bovis subsp bovis AF2122/97
cggaucaccgcgcccgccgcgg

SEQ ID NO: 3146888 - RNA, 21 nt, Mycobacterium bovis subsp bovis AF2122/97
cggaucacgaaaucgcccuga

SEQ ID NO: 3146889 - RNA, 22 nt, Mycobacterium bovis subsp bovis AF2122/97
cggaucagcccgcgcagcagug

SEQ ID NO: 3146890 - RNA, 15 nt, Mycobacterium bovis subsp bovis AF2122/97
cggaucaggcccggg

SEQ ID NO: 3146891 - RNA, 16 nt, Mycobacterium bovis subsp bovis AF2122/97
cggaucaggcccgggc

SEQ ID NO: 3146892 - RNA, 18 nt, Mycobacterium bovis subsp bovis AF2122/97
cggaucaggcccgggcgg

SEQ ID NO: 3146893 - RNA, 22 nt, Mycobacterium bovis subsp bovis AF2122/97
cggaucaucgccgcggccaggu

SEQ ID NO: 3146894 - RNA, 17 nt, Mycobacterium bovis subsp bovis AF2122/97
cggaucauucugcggcc

SEQ ID NO: 3146895 - RNA, 18 nt, Mycobacterium bovis subsp bovis AF2122/97
cggaucauucugcggccu

SEQ ID NO: 3146896 - RNA, 20 nt, Mycobacterium bovis subsp bovis AF2122/97
cggauccacaccgagaagcu

SEQ ID NO: 3146897 - RNA, 13 nt, Mycobacterium bovis subsp bovis AF2122/97
cggauccaccacg

SEQ ID NO: 3146898 - RNA, 20 nt, Mycobacterium bovis subsp bovis AF2122/97
cggauccauuagcacaucgc

SEQ ID NO: 3146899 - RNA, 13 nt, Mycobacterium bovis subsp bovis AF2122/97
cggaucccaccac

SEQ ID NO: 3146900 - RNA, 16 nt, Mycobacterium bovis subsp bovis AF2122/97
cggaucccaccaccgc

SEQ ID NO: 3146901 - RNA, 16 nt, Mycobacterium bovis subsp bovis AF2122/97
cggaucccagugccag

SEQ ID NO: 3146902 - RNA, 14 nt, Mycobacterium bovis subsp bovis AF2122/97
cggaucccgaggcg

SEQ ID NO: 3146903 - RNA, 15 nt, Mycobacterium bovis subsp bovis AF2122/97
cggaucccgaggcgc

SEQ ID NO: 3146904 - RNA, 21 nt, Mycobacterium bovis subsp bovis AF2122/97
cggaucccugugccagcagca

SEQ ID NO: 3146905 - RNA, 19 nt, Mycobacterium bovis subsp bovis AF2122/97
cggauccgauccgcacagc

SEQ ID NO: 3146906 - RNA, 12 nt, Mycobacterium bovis subsp bovis AF2122/97
cggauccgccag

SEQ ID NO: 3146907 - RNA, 13 nt, Mycobacterium bovis subsp bovis AF2122/97
cggauccgucgcg

SEQ ID NO: 3146908 - RNA, 24 nt, Mycobacterium bovis subsp bovis AF2122/97
cggauccgucgcguugagcgcagc

SEQ ID NO: 3146909 - RNA, 19 nt, Mycobacterium bovis subsp bovis AF2122/97
cggauccgugucgcagauc

SEQ ID NO: 3146910 - RNA, 23 nt, Mycobacterium bovis subsp bovis AF2122/97
cggaucgacauaguuggcgcccg

SEQ ID NO: 3146911 - RNA, 19 nt, Mycobacterium bovis subsp bovis AF2122/97
cggaucgaccaauucgacc

SEQ ID NO: 3146912 - RNA, 23 nt, Mycobacterium bovis subsp bovis AF2122/97
cggaucgaccgccagcgccgcca

SEQ ID NO: 3146913 - RNA, 18 nt, Mycobacterium bovis subsp bovis AF2122/97
cggaucgauuccgccgca

SEQ ID NO: 3146914 - RNA, 18 nt, Mycobacterium bovis subsp bovis AF2122/97
cggaucgauucgucgcgg

SEQ ID NO: 3146915 - RNA, 15 nt, Mycobacterium bovis subsp bovis AF2122/97
cggaucgccaggccg

SEQ ID NO: 3146916 - RNA, 18 nt, Mycobacterium bovis subsp bovis AF2122/97
cggaucgccaggccgucg

SEQ ID NO: 3146917 - RNA, 22 nt, Mycobacterium bovis subsp bovis AF2122/97
cggaucgccggggacgccgcgg

SEQ ID NO: 3146918 - RNA, 23 nt, Mycobacterium bovis subsp bovis AF2122/97
cggaucgccggugaacagggacu

SEQ ID NO: 3146919 - RNA, 14 nt, Mycobacterium bovis subsp bovis AF2122/97
cggaucgccgucgc

SEQ ID NO: 3146920 - RNA, 20 nt, Mycobacterium bovis subsp bovis AF2122/97
cggaucgccgucgcgaccga

SEQ ID NO: 3146921 - RNA, 14 nt, Mycobacterium bovis subsp bovis AF2122/97
cggaucgcggucag

SEQ ID NO: 3146922 - RNA, 15 nt, Mycobacterium bovis subsp bovis AF2122/97
cggaucgcggucagc

SEQ ID NO: 3146923 - RNA, 19 nt, Mycobacterium bovis subsp bovis AF2122/97
cggaucgcggucagcgggu

SEQ ID NO: 3146924 - RNA, 15 nt, Mycobacterium bovis subsp bovis AF2122/97
cggaucgcucccguc

SEQ ID NO: 3146925 - RNA, 17 nt, Mycobacterium bovis subsp bovis AF2122/97
cggaucggccuguccac

SEQ ID NO: 3146926 - RNA, 23 nt, Mycobacterium bovis subsp bovis AF2122/97
cggaucggcggaccgcagcguga

SEQ ID NO: 3146927 - RNA, 13 nt, Mycobacterium bovis subsp bovis AF2122/97
cggaucggcggcc

SEQ ID NO: 3146928 - RNA, 14 nt, Mycobacterium bovis subsp bovis AF2122/97
cggaucggcggccg

SEQ ID NO: 3146929 - RNA, 15 nt, Mycobacterium bovis subsp bovis AF2122/97
cggaucggcggccgg

SEQ ID NO: 3146930 - RNA, 17 nt, Mycobacterium bovis subsp bovis AF2122/97
cggaucggcggccggca

SEQ ID NO: 3146931 - RNA, 18 nt, Mycobacterium bovis subsp bovis AF2122/97
cggaucggcucgccaccu

SEQ ID NO: 3146932 - RNA, 13 nt, Mycobacterium bovis subsp bovis AF2122/97
cggaucgggaccg

SEQ ID NO: 3146933 - RNA, 16 nt, Mycobacterium bovis subsp bovis AF2122/97
cggaucgggaccggga

SEQ ID NO: 3146934 - RNA, 16 nt, Mycobacterium bovis subsp bovis AF2122/97
cggaucgggcaccccg

SEQ ID NO: 3146935 - RNA, 17 nt, Mycobacterium bovis subsp bovis AF2122/97
cggaucgggcaccccga

SEQ ID NO: 3146936 - RNA, 23 nt, Mycobacterium bovis subsp bovis AF2122/97
cggaucgggcaccccgaccacca

SEQ ID NO: 3146937 - RNA, 14 nt, Mycobacterium bovis subsp bovis AF2122/97
cggaucggucggca

SEQ ID NO: 3146938 - RNA, 21 nt, Mycobacterium bovis subsp bovis AF2122/97
cggaucgucgaacagcaccgc

SEQ ID NO: 3146939 - RNA, 22 nt, Mycobacterium bovis subsp bovis AF2122/97
cggaucgucgaacagcaccgcc

SEQ ID NO: 3146940 - RNA, 17 nt, Mycobacterium bovis subsp bovis AF2122/97
cggaucgucgugcacgg

SEQ ID NO: 3146941 - RNA, 23 nt, Mycobacterium bovis subsp bovis AF2122/97
cggaucgucgugcacggcggcca

SEQ ID NO: 3146942 - RNA, 22 nt, Mycobacterium bovis subsp bovis AF2122/97
cggaucgugcccuguccggcgc

SEQ ID NO: 3146943 - RNA, 15 nt, Mycobacterium bovis subsp bovis AF2122/97
cggaucucaccaccc

SEQ ID NO: 3146944 - RNA, 15 nt, Mycobacterium bovis subsp bovis AF2122/97
cggaucugacggcgc

SEQ ID NO: 3146945 - RNA, 21 nt, Mycobacterium bovis subsp bovis AF2122/97
cggaucugacggcgccgucga

SEQ ID NO: 3146946 - RNA, 16 nt, Mycobacterium bovis subsp bovis AF2122/97
cggaucugggcggccu

SEQ ID NO: 3146947 - RNA, 15 nt, Mycobacterium bovis subsp bovis AF2122/97
cggaucugguccagu

SEQ ID NO: 3146948 - RNA, 20 nt, Mycobacterium bovis subsp bovis AF2122/97
cggaucuggugggugcggcc

SEQ ID NO: 3146949 - RNA, 16 nt, Mycobacterium bovis subsp bovis AF2122/97
cggaugacaccgaccg

SEQ ID NO: 3146950 - RNA, 16 nt, Mycobacterium bovis subsp bovis AF2122/97
cggaugacgcccaggg

SEQ ID NO: 3146951 - RNA, 22 nt, Mycobacterium bovis subsp bovis AF2122/97
cggaugacgcccagggcgucgg

SEQ ID NO: 3146952 - RNA, 16 nt, Mycobacterium bovis subsp bovis AF2122/97
cggaugagcucggcca

SEQ ID NO: 3146953 - RNA, 20 nt, Mycobacterium bovis subsp bovis AF2122/97
cggaugagcucggccaucag

SEQ ID NO: 3146954 - RNA, 17 nt, Mycobacterium bovis subsp bovis AF2122/97
cggaugcaacccgguga

SEQ ID NO: 3146955 - RNA, 20 nt, Mycobacterium bovis subsp bovis AF2122/97
cggaugcaacccggugaugg

SEQ ID NO: 3146956 - RNA, 17 nt, Mycobacterium bovis subsp bovis AF2122/97
cggaugccggucggcgu

SEQ ID NO: 3146957 - RNA, 20 nt, Mycobacterium bovis subsp bovis AF2122/97
cggaugccggucggcgucga

SEQ ID NO: 3146958 - RNA, 15 nt, Mycobacterium bovis subsp bovis AF2122/97
cggaugcgcaaccgc

SEQ ID NO: 3146959 - RNA, 19 nt, Mycobacterium bovis subsp bovis AF2122/97
cggaugcgcaaccgcggcc

SEQ ID NO: 3146960 - RNA, 22 nt, Mycobacterium bovis subsp bovis AF2122/97
cggaugcucaggucaccggccg

SEQ ID NO: 3146961 - RNA, 15 nt, Mycobacterium bovis subsp bovis AF2122/97
cggaugcugucagca

SEQ ID NO: 3146962 - RNA, 22 nt, Mycobacterium bovis subsp bovis AF2122/97
cggaugcugucagcagcccauu

SEQ ID NO: 3146963 - RNA, 23 nt, Mycobacterium bovis subsp bovis AF2122/97
cggcaacgcggccuugcgcacag

SEQ ID NO: 3146964 - RNA, 16 nt, Mycobacterium bovis subsp bovis AF2122/97
cggcaacgcggucugc

SEQ ID NO: 3146965 - RNA, 23 nt, Mycobacterium bovis subsp bovis AF2122/97
cggcaacgcggucugcuccaggc

SEQ ID NO: 3146966 - RNA, 16 nt, Mycobacterium bovis subsp bovis AF2122/97
cggcaacggcgcgccg

SEQ ID NO: 3146967 - RNA, 17 nt, Mycobacterium bovis subsp bovis AF2122/97
cggcaacggcgcgccga

SEQ ID NO: 3146968 - RNA, 18 nt, Mycobacterium bovis subsp bovis AF2122/97
cggcaacggcgcgccgac

SEQ ID NO: 3146969 - RNA, 15 nt, Mycobacterium bovis subsp bovis AF2122/97
cggcaacggcggauc

SEQ ID NO: 3146970 - RNA, 13 nt, Mycobacterium bovis subsp bovis AF2122/97
cggcaacggcggc

SEQ ID NO: 3146971 - RNA, 14 nt, Mycobacterium bovis subsp bovis AF2122/97
cggcaacggcggca

SEQ ID NO: 3146972 - RNA, 16 nt, Mycobacterium bovis subsp bovis AF2122/97
cggcaacggcggcauc

SEQ ID NO: 3146973 - RNA, 21 nt, Mycobacterium bovis subsp bovis AF2122/97
cggcaacggcggcaucggcgg

SEQ ID NO: 3146974 - RNA, 14 nt, Mycobacterium bovis subsp bovis AF2122/97
cggcaacggcggcg

SEQ ID NO: 3146975 - RNA, 16 nt, Mycobacterium bovis subsp bovis AF2122/97
cggcaacggcggcgac

SEQ ID NO: 3146976 - RNA, 17 nt, Mycobacterium bovis subsp bovis AF2122/97
cggcaacggcggcgacg

SEQ ID NO: 3146977 - RNA, 21 nt, Mycobacterium bovis subsp bovis AF2122/97
cggcaacggcggcgacggcgg

SEQ ID NO: 3146978 - RNA, 21 nt, Mycobacterium bovis subsp bovis AF2122/97
cggcaacggcucgucgaacau

SEQ ID NO: 3146979 - RNA, 17 nt, Mycobacterium bovis subsp bovis AF2122/97
cggcaacgggggcgccg

SEQ ID NO: 3146980 - RNA, 18 nt, Mycobacterium bovis subsp bovis AF2122/97
cggcaacgggggcgccgg

SEQ ID NO: 3146981 - RNA, 19 nt, Mycobacterium bovis subsp bovis AF2122/97
cggcaacgggggcgccgga

SEQ ID NO: 3146982 - RNA, 21 nt, Mycobacterium bovis subsp bovis AF2122/97
cggcaacguuuacgaugcuca

SEQ ID NO: 3146983 - RNA, 18 nt, Mycobacterium bovis subsp bovis AF2122/97
cggcaagaaacagguaag

SEQ ID NO: 3146984 - RNA, 15 nt, Mycobacterium bovis subsp bovis AF2122/97
cggcaagacgcgguc

SEQ ID NO: 3146985 - RNA, 21 nt, Mycobacterium bovis subsp bovis AF2122/97
cggcaagaguugccggaucga

SEQ ID NO: 3146986 - RNA, 13 nt, Mycobacterium bovis subsp bovis AF2122/97
cggcaagauccgg

SEQ ID NO: 3146987 - RNA, 15 nt, Mycobacterium bovis subsp bovis AF2122/97
cggcaagcacaccgc

SEQ ID NO: 3146988 - RNA, 18 nt, Mycobacterium bovis subsp bovis AF2122/97
cggcaagcacaccgccag

SEQ ID NO: 3146989 - RNA, 20 nt, Mycobacterium bovis subsp bovis AF2122/97
cggcaagcacaccgccagcg

SEQ ID NO: 3146990 - RNA, 22 nt, Mycobacterium bovis subsp bovis AF2122/97
cggcaagcacaccgccagcggc

SEQ ID NO: 3146991 - RNA, 17 nt, Mycobacterium bovis subsp bovis AF2122/97
cggcaagcacgguggcc

SEQ ID NO: 3146992 - RNA, 18 nt, Mycobacterium bovis subsp bovis AF2122/97
cggcaagcacgguggccg

SEQ ID NO: 3146993 - RNA, 15 nt, Mycobacterium bovis subsp bovis AF2122/97
cggcaagccacgccg

SEQ ID NO: 3146994 - RNA, 16 nt, Mycobacterium bovis subsp bovis AF2122/97
cggcaagccacgccgg

SEQ ID NO: 3146995 - RNA, 22 nt, Mycobacterium bovis subsp bovis AF2122/97
cggcaagccacgccggucgcgg

SEQ ID NO: 3146996 - RNA, 14 nt, Mycobacterium bovis subsp bovis AF2122/97
cggcaagcgcagac

SEQ ID NO: 3146997 - RNA, 18 nt, Mycobacterium bovis subsp bovis AF2122/97
cggcaagcgcagacacga

SEQ ID NO: 3146998 - RNA, 24 nt, Mycobacterium bovis subsp bovis AF2122/97
cggcaagcggaauuccgccuagga

SEQ ID NO: 3146999 - RNA, 20 nt, Mycobacterium bovis subsp bovis AF2122/97
cggcaagcucguccggugcg

SEQ ID NO: 3147000 - RNA, 18 nt, Mycobacterium bovis subsp bovis AF2122/97
cggcaaggacguggcgcu

SEQ ID NO: 3147001 - RNA, 14 nt, Mycobacterium bovis subsp bovis AF2122/97
cggcaaggcggauc

SEQ ID NO: 3147002 - RNA, 14 nt, Mycobacterium bovis subsp bovis AF2122/97
cggcaagggcggca

SEQ ID NO: 3147003 - RNA, 15 nt, Mycobacterium bovis subsp bovis AF2122/97
cggcaagggcggcaa

SEQ ID NO: 3147004 - RNA, 15 nt, Mycobacterium bovis subsp bovis AF2122/97
cggcaagggcuucgg

SEQ ID NO: 3147005 - RNA, 18 nt, Mycobacterium bovis subsp bovis AF2122/97
cggcaaggguggggccgg

SEQ ID NO: 3147006 - RNA, 19 nt, Mycobacterium bovis subsp bovis AF2122/97
cggcaaggguggggccggc

SEQ ID NO: 3147007 - RNA, 22 nt, Mycobacterium bovis subsp bovis AF2122/97
cggcaaggguggggccggcggu

SEQ ID NO: 3147008 - RNA, 13 nt, Mycobacterium bovis subsp bovis AF2122/97
cggcaaggguggu

SEQ ID NO: 3147009 - RNA, 17 nt, Mycobacterium bovis subsp bovis AF2122/97
cggcaaggucgcggcca

SEQ ID NO: 3147010 - RNA, 14 nt, Mycobacterium bovis subsp bovis AF2122/97
cggcaauacccgcc

SEQ ID NO: 3147011 - RNA, 17 nt, Mycobacterium bovis subsp bovis AF2122/97
cggcaauacccgccgcg

SEQ ID NO: 3147012 - RNA, 22 nt, Mycobacterium bovis subsp bovis AF2122/97
cggcaauacccgccgcgaugcc

SEQ ID NO: 3147013 - RNA, 19 nt, Mycobacterium bovis subsp bovis AF2122/97
cggcaauaccgaaccggug

SEQ ID NO: 3147014 - RNA, 13 nt, Mycobacterium bovis subsp bovis AF2122/97
cggcaauaccgcc

SEQ ID NO: 3147015 - RNA, 14 nt, Mycobacterium bovis subsp bovis AF2122/97
cggcaauaccggca

SEQ ID NO: 3147016 - RNA, 17 nt, Mycobacterium bovis subsp bovis AF2122/97
cggcaaucaggucgucg

SEQ ID NO: 3147017 - RNA, 20 nt, Mycobacterium bovis subsp bovis AF2122/97
cggcaaucaggucgucggug

SEQ ID NO: 3147018 - RNA, 21 nt, Mycobacterium bovis subsp bovis AF2122/97
cggcaaucgacucagcccggc

SEQ ID NO: 3147019 - RNA, 12 nt, Mycobacterium bovis subsp bovis AF2122/97
cggcaaucggcg

SEQ ID NO: 3147020 - RNA, 18 nt, Mycobacterium bovis subsp bovis AF2122/97
cggcaaucggcggcaccc

SEQ ID NO: 3147021 - RNA, 13 nt, Mycobacterium bovis subsp bovis AF2122/97
cggcaaucggguc

SEQ ID NO: 3147022 - RNA, 17 nt, Mycobacterium bovis subsp bovis AF2122/97
cggcaaucgggucugga

SEQ ID NO: 3147023 - RNA, 12 nt, Mycobacterium bovis subsp bovis AF2122/97
cggcaaucggug

SEQ ID NO: 3147024 - RNA, 12 nt, Mycobacterium bovis subsp bovis AF2122/97
cggcaaucucga

SEQ ID NO: 3147025 - RNA, 18 nt, Mycobacterium bovis subsp bovis AF2122/97
cggcaaucucgaucuugg

SEQ ID NO: 3147026 - RNA, 19 nt, Mycobacterium bovis subsp bovis AF2122/97
cggcaaugacggccugcac

SEQ ID NO: 3147027 - RNA, 20 nt, Mycobacterium bovis subsp bovis AF2122/97
cggcaaugacguacgggguc

SEQ ID NO: 3147028 - RNA, 18 nt, Mycobacterium bovis subsp bovis AF2122/97
cggcaaugaggccgucug

SEQ ID NO: 3147029 - RNA, 19 nt, Mycobacterium bovis subsp bovis AF2122/97
cggcaaugcggggcaaucc

SEQ ID NO: 3147030 - RNA, 16 nt, Mycobacterium bovis subsp bovis AF2122/97
cggcaauggccagcac

SEQ ID NO: 3147031 - RNA, 22 nt, Mycobacterium bovis subsp bovis AF2122/97
cggcaauucgggauaggacacc

SEQ ID NO: 3147032 - RNA, 19 nt, Mycobacterium bovis subsp bovis AF2122/97
cggcaauugcgguucgaac

SEQ ID NO: 3147033 - RNA, 16 nt, Mycobacterium bovis subsp bovis AF2122/97
cggcaauugugcugcg

SEQ ID NO: 3147034 - RNA, 17 nt, Mycobacterium bovis subsp bovis AF2122/97
cggcaauuuucugcugc

SEQ ID NO: 3147035 - RNA, 23 nt, Mycobacterium bovis subsp bovis AF2122/97
cggcacaaucggauagccgugcu

SEQ ID NO: 3147036 - RNA, 15 nt, Mycobacterium bovis subsp bovis AF2122/97
cggcacaaucggcgc

SEQ ID NO: 3147037 - RNA, 18 nt, Mycobacterium bovis subsp bovis AF2122/97
cggcacacccaucaccgc

SEQ ID NO: 3147038 - RNA, 21 nt, Mycobacterium bovis subsp bovis AF2122/97
cggcacacccaucaccgccag

SEQ ID NO: 3147039 - RNA, 23 nt, Mycobacterium bovis subsp bovis AF2122/97
cggcacacccuccacagcggcca

SEQ ID NO: 3147040 - RNA, 13 nt, Mycobacterium bovis subsp bovis AF2122/97
cggcacaggcggc

SEQ ID NO: 3147041 - RNA, 15 nt, Mycobacterium bovis subsp bovis AF2122/97
cggcacaggcggcca

SEQ ID NO: 3147042 - RNA, 16 nt, Mycobacterium bovis subsp bovis AF2122/97
cggcacaggcggccag

SEQ ID NO: 3147043 - RNA, 23 nt, Mycobacterium bovis subsp bovis AF2122/97
cggcacaggcggccagcaucgcg

SEQ ID NO: 3147044 - RNA, 16 nt, Mycobacterium bovis subsp bovis AF2122/97
cggcacaugcgcgucc

SEQ ID NO: 3147045 - RNA, 18 nt, Mycobacterium bovis subsp bovis AF2122/97
cggcacaugcgcguccag

SEQ ID NO: 3147046 - RNA, 18 nt, Mycobacterium bovis subsp bovis AF2122/97
cggcacauugaucgacgg

SEQ ID NO: 3147047 - RNA, 22 nt, Mycobacterium bovis subsp bovis AF2122/97
cggcacauugaucgacggccag

SEQ ID NO: 3147048 - RNA, 23 nt, Mycobacterium bovis subsp bovis AF2122/97
cggcacauugaucgacggccagc

SEQ ID NO: 3147049 - RNA, 23 nt, Mycobacterium bovis subsp bovis AF2122/97
cggcaccgcggauaggccgcgcg

SEQ ID NO: 3147050 - RNA, 16 nt, Mycobacterium bovis subsp bovis AF2122/97
cggcaccgcggccagc

SEQ ID NO: 3147051 - RNA, 14 nt, Mycobacterium bovis subsp bovis AF2122/97
cggcaccgcggccg

SEQ ID NO: 3147052 - RNA, 15 nt, Mycobacterium bovis subsp bovis AF2122/97
cggcaccgcggccgc

SEQ ID NO: 3147053 - RNA, 15 nt, Mycobacterium bovis subsp bovis AF2122/97
cggcaccgcugccgc

SEQ ID NO: 3147054 - RNA, 16 nt, Mycobacterium bovis subsp bovis AF2122/97
cggcaccgcugccgcu

SEQ ID NO: 3147055 - RNA, 23 nt, Mycobacterium bovis subsp bovis AF2122/97
cggcaccgcugccgcugccgaag

SEQ ID NO: 3147056 - RNA, 15 nt, Mycobacterium bovis subsp bovis AF2122/97
cggcaccggcccaga

SEQ ID NO: 3147057 - RNA, 15 nt, Mycobacterium bovis subsp bovis AF2122/97
cggcaccggccgugc

SEQ ID NO: 3147058 - RNA, 17 nt, Mycobacterium bovis subsp bovis AF2122/97
cggcaccggccgugccg

SEQ ID NO: 3147059 - RNA, 19 nt, Mycobacterium bovis subsp bovis AF2122/97
cggcaccggccgugccgcc

SEQ ID NO: 3147060 - RNA, 20 nt, Mycobacterium bovis subsp bovis AF2122/97
cggcaccggccgugccgccg

SEQ ID NO: 3147061 - RNA, 21 nt, Mycobacterium bovis subsp bovis AF2122/97
cggcaccggccgugccgccga

SEQ ID NO: 3147062 - RNA, 15 nt, Mycobacterium bovis subsp bovis AF2122/97
cggcaccggccuugc

SEQ ID NO: 3147063 - RNA, 12 nt, Mycobacterium bovis subsp bovis AF2122/97
cggcaccggcuc

SEQ ID NO: 3147064 - RNA, 13 nt, Mycobacterium bovis subsp bovis AF2122/97
cggcaccggggcu

SEQ ID NO: 3147065 - RNA, 16 nt, Mycobacterium bovis subsp bovis AF2122/97
cggcaccggggcugcc

SEQ ID NO: 3147066 - RNA, 21 nt, Mycobacterium bovis subsp bovis AF2122/97
cggcaccggggcugcccgcgg

SEQ ID NO: 3147067 - RNA, 21 nt, Mycobacterium bovis subsp bovis AF2122/97
cggcaccggugcccaccaccg

SEQ ID NO: 3147068 - RNA, 22 nt, Mycobacterium bovis subsp bovis AF2122/97
cggcaccggugcccaccaccga

SEQ ID NO: 3147069 - RNA, 19 nt, Mycobacterium bovis subsp bovis AF2122/97
cggcaccgguuuucgccgg

SEQ ID NO: 3147070 - RNA, 22 nt, Mycobacterium bovis subsp bovis AF2122/97
cggcaccgguuuucgccggcuc

SEQ ID NO: 3147071 - RNA, 22 nt, Mycobacterium bovis subsp bovis AF2122/97
cggcaccguagagcaugccgcc

SEQ ID NO: 3147072 - RNA, 19 nt, Mycobacterium bovis subsp bovis AF2122/97
cggcaccgucucgcaccgc

SEQ ID NO: 3147073 - RNA, 15 nt, Mycobacterium bovis subsp bovis AF2122/97
cggcaccgugcgggg

SEQ ID NO: 3147074 - RNA, 17 nt, Mycobacterium bovis subsp bovis AF2122/97
cggcaccuccagcacca

SEQ ID NO: 3147075 - RNA, 22 nt, Mycobacterium bovis subsp bovis AF2122/97
cggcaccuccagcaccaccgga

SEQ ID NO: 3147076 - RNA, 19 nt, Mycobacterium bovis subsp bovis AF2122/97
cggcaccuucggcccaugc

SEQ ID NO: 3147077 - RNA, 18 nt, Mycobacterium bovis subsp bovis AF2122/97
cggcacgaaauugggcga

SEQ ID NO: 3147078 - RNA, 19 nt, Mycobacterium bovis subsp bovis AF2122/97
cggcacgaaauugggcgau

SEQ ID NO: 3147079 - RNA, 17 nt, Mycobacterium bovis subsp bovis AF2122/97
cggcacgaaucccccgg

SEQ ID NO: 3147080 - RNA, 19 nt, Mycobacterium bovis subsp bovis AF2122/97
cggcacgaaucccccggac

SEQ ID NO: 3147081 - RNA, 16 nt, Mycobacterium bovis subsp bovis AF2122/97
cggcacgaccaccgga

SEQ ID NO: 3147082 - RNA, 15 nt, Mycobacterium bovis subsp bovis AF2122/97
cggcacgacccggga

SEQ ID NO: 3147083 - RNA, 17 nt, Mycobacterium bovis subsp bovis AF2122/97
cggcacgacccgggaag

SEQ ID NO: 3147084 - RNA, 22 nt, Mycobacterium bovis subsp bovis AF2122/97
cggcacgaucaucgggguggcc

SEQ ID NO: 3147085 - RNA, 17 nt, Mycobacterium bovis subsp bovis AF2122/97
cggcacgaucgccaacg

SEQ ID NO: 3147086 - RNA, 13 nt, Mycobacterium bovis subsp bovis AF2122/97
cggcacgcacgcg

SEQ ID NO: 3147087 - RNA, 16 nt, Mycobacterium bovis subsp bovis AF2122/97
cggcacgcacgcgguu

SEQ ID NO: 3147088 - RNA, 23 nt, Mycobacterium bovis subsp bovis AF2122/97
cggcacgcacgcgguucaccacg

SEQ ID NO: 3147089 - RNA, 19 nt, Mycobacterium bovis subsp bovis AF2122/97
cggcacgcagccaaugccg

SEQ ID NO: 3147090 - RNA, 13 nt, Mycobacterium bovis subsp bovis AF2122/97
cggcacgcccaca

SEQ ID NO: 3147091 - RNA, 15 nt, Mycobacterium bovis subsp bovis AF2122/97
cggcacgccgaccgg

SEQ ID NO: 3147092 - RNA, 16 nt, Mycobacterium bovis subsp bovis AF2122/97
cggcacgccgaccggu

SEQ ID NO: 3147093 - RNA, 17 nt, Mycobacterium bovis subsp bovis AF2122/97
cggcacgccggcggcgg

SEQ ID NO: 3147094 - RNA, 13 nt, Mycobacterium bovis subsp bovis AF2122/97
cggcacgcgcagu

SEQ ID NO: 3147095 - RNA, 22 nt, Mycobacterium bovis subsp bovis AF2122/97
cggcacgcgcaguuuggcggcg

SEQ ID NO: 3147096 - RNA, 18 nt, Mycobacterium bovis subsp bovis AF2122/97
cggcacgcgucuggaacg

SEQ ID NO: 3147097 - RNA, 15 nt, Mycobacterium bovis subsp bovis AF2122/97
cggcacgcuccagcu

SEQ ID NO: 3147098 - RNA, 16 nt, Mycobacterium bovis subsp bovis AF2122/97
cggcacgcuccagcuc

SEQ ID NO: 3147099 - RNA, 15 nt, Mycobacterium bovis subsp bovis AF2122/97
cggcacgcugaccgg

SEQ ID NO: 3147100 - RNA, 23 nt, Mycobacterium bovis subsp bovis AF2122/97
cggcacggaccgcgucgcggguc

SEQ ID NO: 3147101 - RNA, 18 nt, Mycobacterium bovis subsp bovis AF2122/97
cggcacggaugcgauggc

SEQ ID NO: 3147102 - RNA, 20 nt, Mycobacterium bovis subsp bovis AF2122/97
cggcacggaugcgauggccg

SEQ ID NO: 3147103 - RNA, 21 nt, Mycobacterium bovis subsp bovis AF2122/97
cggcacgggaaucgcucgcgc

SEQ ID NO: 3147104 - RNA, 15 nt, Mycobacterium bovis subsp bovis AF2122/97
cggcacgggcggcca

SEQ ID NO: 3147105 - RNA, 21 nt, Mycobacterium bovis subsp bovis AF2122/97
cggcacgggcggccauggcac

SEQ ID NO: 3147106 - RNA, 21 nt, Mycobacterium bovis subsp bovis AF2122/97
cggcacgggcggggacggcgg

SEQ ID NO: 3147107 - RNA, 19 nt, Mycobacterium bovis subsp bovis AF2122/97
cggcacgggcgucgucggu

SEQ ID NO: 3147108 - RNA, 16 nt, Mycobacterium bovis subsp bovis AF2122/97
cggcacggucgcccga

SEQ ID NO: 3147109 - RNA, 23 nt, Mycobacterium bovis subsp bovis AF2122/97
cggcacggugaacaauccgagga

SEQ ID NO: 3147110 - RNA, 18 nt, Mycobacterium bovis subsp bovis AF2122/97
cggcacggugucgcgcga

SEQ ID NO: 3147111 - RNA, 18 nt, Mycobacterium bovis subsp bovis AF2122/97
cggcacgucgcccccggc

SEQ ID NO: 3147112 - RNA, 19 nt, Mycobacterium bovis subsp bovis AF2122/97
cggcacgucgcccccggcc

SEQ ID NO: 3147113 - RNA, 18 nt, Mycobacterium bovis subsp bovis AF2122/97
cggcacgucgucguccca

SEQ ID NO: 3147114 - RNA, 17 nt, Mycobacterium bovis subsp bovis AF2122/97
cggcacuagcccgaccg

SEQ ID NO: 3147115 - RNA, 19 nt, Mycobacterium bovis subsp bovis AF2122/97
cggcacuagcccgaccggu

SEQ ID NO: 3147116 - RNA, 20 nt, Mycobacterium bovis subsp bovis AF2122/97
cggcacuagcgagccggcgc

SEQ ID NO: 3147117 - RNA, 21 nt, Mycobacterium bovis subsp bovis AF2122/97
cggcacuagcgagccggcgcc

SEQ ID NO: 3147118 - RNA, 17 nt, Mycobacterium bovis subsp bovis AF2122/97
cggcacugaccgcgaug

SEQ ID NO: 3147119 - RNA, 14 nt, Mycobacterium bovis subsp bovis AF2122/97
cggcacugcccagc

SEQ ID NO: 3147120 - RNA, 19 nt, Mycobacterium bovis subsp bovis AF2122/97
cggcacugcccagcagacc

SEQ ID NO: 3147121 - RNA, 20 nt, Mycobacterium bovis subsp bovis AF2122/97
cggcacugcgaaucuccgcg

SEQ ID NO: 3147122 - RNA, 21 nt, Mycobacterium bovis subsp bovis AF2122/97
cggcacugcgaaucuccgcgc

SEQ ID NO: 3147123 - RNA, 13 nt, Mycobacterium bovis subsp bovis AF2122/97
cggcacugcggcc

SEQ ID NO: 3147124 - RNA, 15 nt, Mycobacterium bovis subsp bovis AF2122/97
cggcacugcggccag

SEQ ID NO: 3147125 - RNA, 13 nt, Mycobacterium bovis subsp bovis AF2122/97
cggcacuggcccc

SEQ ID NO: 3147126 - RNA, 17 nt, Mycobacterium bovis subsp bovis AF2122/97
cggcacuggguccacgc

SEQ ID NO: 3147127 - RNA, 20 nt, Mycobacterium bovis subsp bovis AF2122/97
cggcacuugggaaggauggu

SEQ ID NO: 3147128 - RNA, 21 nt, Mycobacterium bovis subsp bovis AF2122/97
cggcacuugggaaggaugguc

SEQ ID NO: 3147129 - RNA, 22 nt, Mycobacterium bovis subsp bovis AF2122/97
cggcacuugggaaggauggucg

SEQ ID NO: 3147130 - RNA, 21 nt, Mycobacterium bovis subsp bovis AF2122/97
cggcacuuuguagcccgcgau

SEQ ID NO: 3147131 - RNA, 15 nt, Mycobacterium bovis subsp bovis AF2122/97
cggcagacaucuggg

SEQ ID NO: 3147132 - RNA, 13 nt, Mycobacterium bovis subsp bovis AF2122/97
cggcagacccgag

SEQ ID NO: 3147133 - RNA, 17 nt, Mycobacterium bovis subsp bovis AF2122/97
cggcagacccgagcgcu

SEQ ID NO: 3147134 - RNA, 17 nt, Mycobacterium bovis subsp bovis AF2122/97
cggcagaccgaccucgg

SEQ ID NO: 3147135 - RNA, 22 nt, Mycobacterium bovis subsp bovis AF2122/97
cggcagcgcggcacccaaccag

SEQ ID NO: 3147136 - RNA, 13 nt, Mycobacterium bovis subsp bovis AF2122/97
cggcagcgcggcc

SEQ ID NO: 3147137 - RNA, 18 nt, Mycobacterium bovis subsp bovis AF2122/97
cggcagcggaccgcugcc

SEQ ID NO: 3147138 - RNA, 21 nt, Mycobacterium bovis subsp bovis AF2122/97
cggcagcggcgaguuggccgu

SEQ ID NO: 3147139 - RNA, 14 nt, Mycobacterium bovis subsp bovis AF2122/97
cggcagcggcgauc

SEQ ID NO: 3147140 - RNA, 12 nt, Mycobacterium bovis subsp bovis AF2122/97
cggcagcggcgc

SEQ ID NO: 3147141 - RNA, 13 nt, Mycobacterium bovis subsp bovis AF2122/97
cggcagcggcgcc

SEQ ID NO: 3147142 - RNA, 16 nt, Mycobacterium bovis subsp bovis AF2122/97
cggcagcggcgccgcc

SEQ ID NO: 3147143 - RNA, 18 nt, Mycobacterium bovis subsp bovis AF2122/97
cggcagcggcgccgccug

SEQ ID NO: 3147144 - RNA, 15 nt, Mycobacterium bovis subsp bovis AF2122/97
cggcagcggcgcgcu

SEQ ID NO: 3147145 - RNA, 20 nt, Mycobacterium bovis subsp bovis AF2122/97
cggcagcggcgcgcugcacg

SEQ ID NO: 3147146 - RNA, 13 nt, Mycobacterium bovis subsp bovis AF2122/97
cggcagcggcgcu

SEQ ID NO: 3147147 - RNA, 21 nt, Mycobacterium bovis subsp bovis AF2122/97
cggcagcggcggucucggcgu

SEQ ID NO: 3147148 - RNA, 13 nt, Mycobacterium bovis subsp bovis AF2122/97
cggcagcggcgua

SEQ ID NO: 3147149 - RNA, 22 nt, Mycobacterium bovis subsp bovis AF2122/97
cggcagcggcuaacgaagccag

SEQ ID NO: 3147150 - RNA, 22 nt, Mycobacterium bovis subsp bovis AF2122/97
cggcagcggguuugccgggcgc

SEQ ID NO: 3147151 - RNA, 16 nt, Mycobacterium bovis subsp bovis AF2122/97
cggcagcggugcuggu

SEQ ID NO: 3147152 - RNA, 19 nt, Mycobacterium bovis subsp bovis AF2122/97
cggcagcgguggcuugccc

SEQ ID NO: 3147153 - RNA, 20 nt, Mycobacterium bovis subsp bovis AF2122/97
cggcagcguccgaaccaccu

SEQ ID NO: 3147154 - RNA, 19 nt, Mycobacterium bovis subsp bovis AF2122/97
cggcagcgugcggggcgcc

SEQ ID NO: 3147155 - RNA, 21 nt, Mycobacterium bovis subsp bovis AF2122/97
cggcagcgugcggggcgccug

SEQ ID NO: 3147156 - RNA, 19 nt, Mycobacterium bovis subsp bovis AF2122/97
cggcagcuacuaugccaac

SEQ ID NO: 3147157 - RNA, 24 nt, Mycobacterium bovis subsp bovis AF2122/97
cggcagcuacuaugccaacgacag

SEQ ID NO: 3147158 - RNA, 17 nt, Mycobacterium bovis subsp bovis AF2122/97
cggcagcucccgccacg

SEQ ID NO: 3147159 - RNA, 20 nt, Mycobacterium bovis subsp bovis AF2122/97
cggcagcucccgccacgucg

SEQ ID NO: 3147160 - RNA, 16 nt, Mycobacterium bovis subsp bovis AF2122/97
cggcagcugcucgguc

SEQ ID NO: 3147161 - RNA, 16 nt, Mycobacterium bovis subsp bovis AF2122/97
cggcagcuggcgcagc

SEQ ID NO: 3147162 - RNA, 22 nt, Mycobacterium bovis subsp bovis AF2122/97
cggcagcuggcgcagccugccg

SEQ ID NO: 3147163 - RNA, 23 nt, Mycobacterium bovis subsp bovis AF2122/97
cggcagcuggcgcagccugccga

SEQ ID NO: 3147164 - RNA, 16 nt, Mycobacterium bovis subsp bovis AF2122/97
cggcagcuggucggug

SEQ ID NO: 3147165 - RNA, 19 nt, Mycobacterium bovis subsp bovis AF2122/97
cggcagcuggucggugggc

SEQ ID NO: 3147166 - RNA, 13 nt, Mycobacterium bovis subsp bovis AF2122/97
cggcagcuugcag

SEQ ID NO: 3147167 - RNA, 21 nt, Mycobacterium bovis subsp bovis AF2122/97
cggcagcuugcagugccgccg

SEQ ID NO: 3147168 - RNA, 22 nt, Mycobacterium bovis subsp bovis AF2122/97
cggcagcuugcagugccgccgg

SEQ ID NO: 3147169 - RNA, 17 nt, Mycobacterium bovis subsp bovis AF2122/97
cggcagcuuugacgccc

SEQ ID NO: 3147170 - RNA, 22 nt, Mycobacterium bovis subsp bovis AF2122/97
cggcaggaagaaaccgcagucg

SEQ ID NO: 3147171 - RNA, 20 nt, Mycobacterium bovis subsp bovis AF2122/97
cggcaggaaugccgcgggga

SEQ ID NO: 3147172 - RNA, 15 nt, Mycobacterium bovis subsp bovis AF2122/97
cggcaggauucccuc

SEQ ID NO: 3147173 - RNA, 16 nt, Mycobacterium bovis subsp bovis AF2122/97
cggcaggcagcucggc

SEQ ID NO: 3147174 - RNA, 15 nt, Mycobacterium bovis subsp bovis AF2122/97
cggcaggcagggcag

SEQ ID NO: 3147175 - RNA, 21 nt, Mycobacterium bovis subsp bovis AF2122/97
cggcaggcagggcagcccggc

SEQ ID NO: 3147176 - RNA, 20 nt, Mycobacterium bovis subsp bovis AF2122/97
cggcaggcccgacggcgccc

SEQ ID NO: 3147177 - RNA, 21 nt, Mycobacterium bovis subsp bovis AF2122/97
cggcaggcccgacggcgccca

SEQ ID NO: 3147178 - RNA, 16 nt, Mycobacterium bovis subsp bovis AF2122/97
cggcaggcccggaggg

SEQ ID NO: 3147179 - RNA, 23 nt, Mycobacterium bovis subsp bovis AF2122/97
cggcaggcccggaggguucggac

SEQ ID NO: 3147180 - RNA, 14 nt, Mycobacterium bovis subsp bovis AF2122/97
cggcaggccgacca

SEQ ID NO: 3147181 - RNA, 16 nt, Mycobacterium bovis subsp bovis AF2122/97
cggcaggccggcgucg

SEQ ID NO: 3147182 - RNA, 18 nt, Mycobacterium bovis subsp bovis AF2122/97
cggcaggccggcgucgau

SEQ ID NO: 3147183 - RNA, 20 nt, Mycobacterium bovis subsp bovis AF2122/97
cggcaggccggcgucgauca

SEQ ID NO: 3147184 - RNA, 15 nt, Mycobacterium bovis subsp bovis AF2122/97
cggcaggccuggcga

SEQ ID NO: 3147185 - RNA, 17 nt, Mycobacterium bovis subsp bovis AF2122/97
cggcaggccuggcgagc

SEQ ID NO: 3147186 - RNA, 14 nt, Mycobacterium bovis subsp bovis AF2122/97
cggcaggcggccgc

SEQ ID NO: 3147187 - RNA, 15 nt, Mycobacterium bovis subsp bovis AF2122/97
cggcaggcggccgcc

SEQ ID NO: 3147188 - RNA, 16 nt, Mycobacterium bovis subsp bovis AF2122/97
cggcaggcggccgccg

SEQ ID NO: 3147189 - RNA, 18 nt, Mycobacterium bovis subsp bovis AF2122/97
cggcaggcuggcgagggc

SEQ ID NO: 3147190 - RNA, 20 nt, Mycobacterium bovis subsp bovis AF2122/97
cggcaggcuggcgagggcug

SEQ ID NO: 3147191 - RNA, 23 nt, Mycobacterium bovis subsp bovis AF2122/97
cggcaggcuggcgagggcugacg

SEQ ID NO: 3147192 - RNA, 12 nt, Mycobacterium bovis subsp bovis AF2122/97
cggcagggcccc

SEQ ID NO: 3147193 - RNA, 15 nt, Mycobacterium bovis subsp bovis AF2122/97
cggcagggcggugcc

SEQ ID NO: 3147194 - RNA, 15 nt, Mycobacterium bovis subsp bovis AF2122/97
cggcagguaccaccg

SEQ ID NO: 3147195 - RNA, 20 nt, Mycobacterium bovis subsp bovis AF2122/97
cggcagguaccaccgcggug

SEQ ID NO: 3147196 - RNA, 19 nt, Mycobacterium bovis subsp bovis AF2122/97
cggcaggucuucgcugucg

SEQ ID NO: 3147197 - RNA, 16 nt, Mycobacterium bovis subsp bovis AF2122/97
cggcaggugcccaucg

SEQ ID NO: 3147198 - RNA, 14 nt, Mycobacterium bovis subsp bovis AF2122/97
cggcaggugcggcg

SEQ ID NO: 3147199 - RNA, 16 nt, Mycobacterium bovis subsp bovis AF2122/97
cggcaggugcggcggc

SEQ ID NO: 3147200 - RNA, 19 nt, Mycobacterium bovis subsp bovis AF2122/97
cggcaggugcggcggcauc

SEQ ID NO: 3147201 - RNA, 20 nt, Mycobacterium bovis subsp bovis AF2122/97
cggcaggugcggucaaagga

SEQ ID NO: 3147202 - RNA, 15 nt, Mycobacterium bovis subsp bovis AF2122/97
cggcagguguuggug

SEQ ID NO: 3147203 - RNA, 19 nt, Mycobacterium bovis subsp bovis AF2122/97
cggcagguguuggugcggg

SEQ ID NO: 3147204 - RNA, 15 nt, Mycobacterium bovis subsp bovis AF2122/97
cggcagguucggcga

SEQ ID NO: 3147205 - RNA, 21 nt, Mycobacterium bovis subsp bovis AF2122/97
cggcaguaccccucgcacaau

SEQ ID NO: 3147206 - RNA, 19 nt, Mycobacterium bovis subsp bovis AF2122/97
cggcagucauuauucgcgc

SEQ ID NO: 3147207 - RNA, 20 nt, Mycobacterium bovis subsp bovis AF2122/97
cggcagucauuauucgcgca

SEQ ID NO: 3147208 - RNA, 21 nt, Mycobacterium bovis subsp bovis AF2122/97
cggcagucauuauucgcgcaa

SEQ ID NO: 3147209 - RNA, 15 nt, Mycobacterium bovis subsp bovis AF2122/97
cggcagucccagcgc

SEQ ID NO: 3147210 - RNA, 16 nt, Mycobacterium bovis subsp bovis AF2122/97
cggcagugagucggug

SEQ ID NO: 3147211 - RNA, 16 nt, Mycobacterium bovis subsp bovis AF2122/97
cggcagugccaugggc

SEQ ID NO: 3147212 - RNA, 16 nt, Mycobacterium bovis subsp bovis AF2122/97
cggcaguggccagacc

SEQ ID NO: 3147213 - RNA, 18 nt, Mycobacterium bovis subsp bovis AF2122/97
cggcaguucgcggccauc

SEQ ID NO: 3147214 - RNA, 21 nt, Mycobacterium bovis subsp bovis AF2122/97
cggcaguucgcggccaucgcc

SEQ ID NO: 3147215 - RNA, 19 nt, Mycobacterium bovis subsp bovis AF2122/97
cggcaguugaacucgacca

SEQ ID NO: 3147216 - RNA, 22 nt, Mycobacterium bovis subsp bovis AF2122/97
cggcaguugaacucgaccaccg

SEQ ID NO: 3147217 - RNA, 19 nt, Mycobacterium bovis subsp bovis AF2122/97
cggcaguuguggcgcugcg

SEQ ID NO: 3147218 - RNA, 22 nt, Mycobacterium bovis subsp bovis AF2122/97
cggcauaacccuggccggugcg

SEQ ID NO: 3147219 - RNA, 18 nt, Mycobacterium bovis subsp bovis AF2122/97
cggcauaacgaucccgug

SEQ ID NO: 3147220 - RNA, 20 nt, Mycobacterium bovis subsp bovis AF2122/97
cggcauaacgaucccgugau

SEQ ID NO: 3147221 - RNA, 17 nt, Mycobacterium bovis subsp bovis AF2122/97
cggcauugccgccguug

SEQ ID NO: 3147222 - RNA, 22 nt, Mycobacterium bovis subsp bovis AF2122/97
cggcauuggcggugccgguagc

SEQ ID NO: 3147223 - RNA, 14 nt, Mycobacterium bovis subsp bovis AF2122/97
cggcauuggcgucg

SEQ ID NO: 3147224 - RNA, 21 nt, Mycobacterium bovis subsp bovis AF2122/97
cggcauugguaccggcuucgu

SEQ ID NO: 3147225 - RNA, 21 nt, Mycobacterium bovis subsp bovis AF2122/97
cggccaaaauggcgcgaacgu

SEQ ID NO: 3147226 - RNA, 23 nt, Mycobacterium bovis subsp bovis AF2122/97
cggccaaaauuuugucggccgcc

SEQ ID NO: 3147227 - RNA, 18 nt, Mycobacterium bovis subsp bovis AF2122/97
cggccaaagacccggcac

SEQ ID NO: 3147228 - RNA, 23 nt, Mycobacterium bovis subsp bovis AF2122/97
cggccaaagacccggcacccagu

SEQ ID NO: 3147229 - RNA, 20 nt, Mycobacterium bovis subsp bovis AF2122/97
cggccaaagcuuucccguug

SEQ ID NO: 3147230 - RNA, 15 nt, Mycobacterium bovis subsp bovis AF2122/97
cggccaacaccacua

SEQ ID NO: 3147231 - RNA, 16 nt, Mycobacterium bovis subsp bovis AF2122/97
cggccaacagcacccg

SEQ ID NO: 3147232 - RNA, 20 nt, Mycobacterium bovis subsp bovis AF2122/97
cggccaacagguccaccggc

SEQ ID NO: 3147233 - RNA, 22 nt, Mycobacterium bovis subsp bovis AF2122/97
cggccaacagguccaccggcca

SEQ ID NO: 3147234 - RNA, 19 nt, Mycobacterium bovis subsp bovis AF2122/97
cggccaacagucgcagcac

SEQ ID NO: 3147235 - RNA, 17 nt, Mycobacterium bovis subsp bovis AF2122/97
cggccaacauccggugg

SEQ ID NO: 3147236 - RNA, 14 nt, Mycobacterium bovis subsp bovis AF2122/97
cggccaaccaccaa

SEQ ID NO: 3147237 - RNA, 14 nt, Mycobacterium bovis subsp bovis AF2122/97
cggccaaccaugcu

SEQ ID NO: 3147238 - RNA, 17 nt, Mycobacterium bovis subsp bovis AF2122/97
cggccaaccaugcuguc

SEQ ID NO: 3147239 - RNA, 18 nt, Mycobacterium bovis subsp bovis AF2122/97
cggccaaccaugcugucg

SEQ ID NO: 3147240 - RNA, 22 nt, Mycobacterium bovis subsp bovis AF2122/97
cggccaaccaugcugucggugc

SEQ ID NO: 3147241 - RNA, 13 nt, Mycobacterium bovis subsp bovis AF2122/97
cggccaacccauc

SEQ ID NO: 3147242 - RNA, 17 nt, Mycobacterium bovis subsp bovis AF2122/97
cggccaacccaucccga

SEQ ID NO: 3147243 - RNA, 15 nt, Mycobacterium bovis subsp bovis AF2122/97
cggccaacccgggcc

SEQ ID NO: 3147244 - RNA, 18 nt, Mycobacterium bovis subsp bovis AF2122/97
cggccaacccgggccgcc

SEQ ID NO: 3147245 - RNA, 19 nt, Mycobacterium bovis subsp bovis AF2122/97
cggccaacccgggccgcca

SEQ ID NO: 3147246 - RNA, 18 nt, Mycobacterium bovis subsp bovis AF2122/97
cggccaacccguagcuga

SEQ ID NO: 3147247 - RNA, 17 nt, Mycobacterium bovis subsp bovis AF2122/97
cggccaacgaacgugcc

SEQ ID NO: 3147248 - RNA, 22 nt, Mycobacterium bovis subsp bovis AF2122/97
cggccaacgaacgugccccggc

SEQ ID NO: 3147249 - RNA, 23 nt, Mycobacterium bovis subsp bovis AF2122/97
cggccaacgaacgugccccggcg

SEQ ID NO: 3147250 - RNA, 18 nt, Mycobacterium bovis subsp bovis AF2122/97
cggccaacgacgacccgu

SEQ ID NO: 3147251 - RNA, 15 nt, Mycobacterium bovis subsp bovis AF2122/97
cggccaacgacggcc

SEQ ID NO: 3147252 - RNA, 18 nt, Mycobacterium bovis subsp bovis AF2122/97
cggccaacgacggccgac

SEQ ID NO: 3147253 - RNA, 20 nt, Mycobacterium bovis subsp bovis AF2122/97
cggccaacgacggccgacaa

SEQ ID NO: 3147254 - RNA, 14 nt, Mycobacterium bovis subsp bovis AF2122/97
cggccaacgccgcc

SEQ ID NO: 3147255 - RNA, 18 nt, Mycobacterium bovis subsp bovis AF2122/97
cggccaacggcuccgggc

SEQ ID NO: 3147256 - RNA, 21 nt, Mycobacterium bovis subsp bovis AF2122/97
cggccaacggcuccgggcgcu

SEQ ID NO: 3147257 - RNA, 13 nt, Mycobacterium bovis subsp bovis AF2122/97
cggccaacugggc

SEQ ID NO: 3147258 - RNA, 16 nt, Mycobacterium bovis subsp bovis AF2122/97
cggccaacugggccga

SEQ ID NO: 3147259 - RNA, 20 nt, Mycobacterium bovis subsp bovis AF2122/97
cggccaacuucugcacgaac

SEQ ID NO: 3147260 - RNA, 18 nt, Mycobacterium bovis subsp bovis AF2122/97
cggccaagaucggcgccc

SEQ ID NO: 3147261 - RNA, 15 nt, Mycobacterium bovis subsp bovis AF2122/97
cggccaagccggcga

SEQ ID NO: 3147262 - RNA, 19 nt, Mycobacterium bovis subsp bovis AF2122/97
cggccaagggugcuugucg

SEQ ID NO: 3147263 - RNA, 16 nt, Mycobacterium bovis subsp bovis AF2122/97
cggccaaucagcccgc

SEQ ID NO: 3147264 - RNA, 17 nt, Mycobacterium bovis subsp bovis AF2122/97
cggccaaucagcccgcc

SEQ ID NO: 3147265 - RNA, 20 nt, Mycobacterium bovis subsp bovis AF2122/97
cggccaaucagcccgccgga

SEQ ID NO: 3147266 - RNA, 15 nt, Mycobacterium bovis subsp bovis AF2122/97
cggccaauccggggc

SEQ ID NO: 3147267 - RNA, 20 nt, Mycobacterium bovis subsp bovis AF2122/97
cggccaauggccugcagcgc

SEQ ID NO: 3147268 - RNA, 17 nt, Mycobacterium bovis subsp bovis AF2122/97
cggccaauggugggcga

SEQ ID NO: 3147269 - RNA, 22 nt, Mycobacterium bovis subsp bovis AF2122/97
cggccaauggugggcgagcugc

SEQ ID NO: 3147270 - RNA, 17 nt, Mycobacterium bovis subsp bovis AF2122/97
cggccaauugcgccgcc

SEQ ID NO: 3147271 - RNA, 22 nt, Mycobacterium bovis subsp bovis AF2122/97
cggccaauugcgccgccaacuc

SEQ ID NO: 3147272 - RNA, 12 nt, Mycobacterium bovis subsp bovis AF2122/97
cggccacaaccu

SEQ ID NO: 3147273 - RNA, 13 nt, Mycobacterium bovis subsp bovis AF2122/97
cggccacaaccuc

SEQ ID NO: 3147274 - RNA, 17 nt, Mycobacterium bovis subsp bovis AF2122/97
cggccacaaccucgucg

SEQ ID NO: 3147275 - RNA, 18 nt, Mycobacterium bovis subsp bovis AF2122/97
cggccacaaugcggccgu

SEQ ID NO: 3147276 - RNA, 21 nt, Mycobacterium bovis subsp bovis AF2122/97
cggccacaccgucacgccacc

SEQ ID NO: 3147277 - RNA, 22 nt, Mycobacterium bovis subsp bovis AF2122/97
cggccacaccgucacgccaccg

SEQ ID NO: 3147278 - RNA, 23 nt, Mycobacterium bovis subsp bovis AF2122/97
cggccacaccgucacgccaccgc

SEQ ID NO: 3147279 - RNA, 19 nt, Mycobacterium bovis subsp bovis AF2122/97
cggccacaccuuggccgcc

SEQ ID NO: 3147280 - RNA, 22 nt, Mycobacterium bovis subsp bovis AF2122/97
cggccacacucgccagggccau

SEQ ID NO: 3147281 - RNA, 22 nt, Mycobacterium bovis subsp bovis AF2122/97
cggccacagugcauacgguuga

SEQ ID NO: 3147282 - RNA, 17 nt, Mycobacterium bovis subsp bovis AF2122/97
cggccacauaccaccac

SEQ ID NO: 3147283 - RNA, 18 nt, Mycobacterium bovis subsp bovis AF2122/97
cggccacauaccaccacg

SEQ ID NO: 3147284 - RNA, 20 nt, Mycobacterium bovis subsp bovis AF2122/97
cggccacaucgccagcagca

SEQ ID NO: 3147285 - RNA, 12 nt, Mycobacterium bovis subsp bovis AF2122/97
cggccaccaacc

SEQ ID NO: 3147286 - RNA, 14 nt, Mycobacterium bovis subsp bovis AF2122/97
cggccaccaaccuc

SEQ ID NO: 3147287 - RNA, 18 nt, Mycobacterium bovis subsp bovis AF2122/97
cggccaccaaccucaucg

SEQ ID NO: 3147288 - RNA, 13 nt, Mycobacterium bovis subsp bovis AF2122/97
cggccaccaacuc

SEQ ID NO: 3147289 - RNA, 23 nt, Mycobacterium bovis subsp bovis AF2122/97
cggccaccaacucggcgaccugc

SEQ ID NO: 3147290 - RNA, 14 nt, Mycobacterium bovis subsp bovis AF2122/97
cggccaccaccagg

SEQ ID NO: 3147291 - RNA, 20 nt, Mycobacterium bovis subsp bovis AF2122/97
cggccaccaccaggcugacg

SEQ ID NO: 3147292 - RNA, 13 nt, Mycobacterium bovis subsp bovis AF2122/97
cggccaccaccgc

SEQ ID NO: 3147293 - RNA, 14 nt, Mycobacterium bovis subsp bovis AF2122/97
cggccaccaccgcc

SEQ ID NO: 3147294 - RNA, 16 nt, Mycobacterium bovis subsp bovis AF2122/97
cggccaccaccgccgc

SEQ ID NO: 3147295 - RNA, 20 nt, Mycobacterium bovis subsp bovis AF2122/97
cggccaccaccgccgccggc

SEQ ID NO: 3147296 - RNA, 16 nt, Mycobacterium bovis subsp bovis AF2122/97
cggccaccaccgcgcc

SEQ ID NO: 3147297 - RNA, 20 nt, Mycobacterium bovis subsp bovis AF2122/97
cggccaccaccgcgccgucg

SEQ ID NO: 3147298 - RNA, 14 nt, Mycobacterium bovis subsp bovis AF2122/97
cggccaccagcccg

SEQ ID NO: 3147299 - RNA, 19 nt, Mycobacterium bovis subsp bovis AF2122/97
cggccaccagcccgaugau

SEQ ID NO: 3147300 - RNA, 14 nt, Mycobacterium bovis subsp bovis AF2122/97
cggccaccagcgcc

SEQ ID NO: 3147301 - RNA, 16 nt, Mycobacterium bovis subsp bovis AF2122/97
cggccaccagcgcccg

SEQ ID NO: 3147302 - RNA, 18 nt, Mycobacterium bovis subsp bovis AF2122/97
cggccaccagcgcccggc

SEQ ID NO: 3147303 - RNA, 22 nt, Mycobacterium bovis subsp bovis AF2122/97
cggccaccagcgcccggcccgc

SEQ ID NO: 3147304 - RNA, 23 nt, Mycobacterium bovis subsp bovis AF2122/97
cggccaccagcgcccggcccgcc

SEQ ID NO: 3147305 - RNA, 15 nt, Mycobacterium bovis subsp bovis AF2122/97
cggccaccagcgccu

SEQ ID NO: 3147306 - RNA, 16 nt, Mycobacterium bovis subsp bovis AF2122/97
cggccaccagcgccuu

SEQ ID NO: 3147307 - RNA, 15 nt, Mycobacterium bovis subsp bovis AF2122/97
cggccagcgagauca

SEQ ID NO: 3147308 - RNA, 14 nt, Mycobacterium bovis subsp bovis AF2122/97
cggccagcgcaccg

SEQ ID NO: 3147309 - RNA, 17 nt, Mycobacterium bovis subsp bovis AF2122/97
cggccagcgcaccgccg

SEQ ID NO: 3147310 - RNA, 17 nt, Mycobacterium bovis subsp bovis AF2122/97
cggccagcgcccgcagg

SEQ ID NO: 3147311 - RNA, 12 nt, Mycobacterium bovis subsp bovis AF2122/97
cggccagcgcgc

SEQ ID NO: 3147312 - RNA, 15 nt, Mycobacterium bovis subsp bovis AF2122/97
cggccagcgcgucgg

SEQ ID NO: 3147313 - RNA, 17 nt, Mycobacterium bovis subsp bovis AF2122/97
cggccagcgcgucggga

SEQ ID NO: 3147314 - RNA, 14 nt, Mycobacterium bovis subsp bovis AF2122/97
cggccagcggcccg

SEQ ID NO: 3147315 - RNA, 17 nt, Mycobacterium bovis subsp bovis AF2122/97
cggccagcgggaacaca

SEQ ID NO: 3147316 - RNA, 21 nt, Mycobacterium bovis subsp bovis AF2122/97
cggccagcgggugaaucgaca

SEQ ID NO: 3147317 - RNA, 17 nt, Mycobacterium bovis subsp bovis AF2122/97
cggccagcgucaacagc

SEQ ID NO: 3147318 - RNA, 14 nt, Mycobacterium bovis subsp bovis AF2122/97
cggccagcgugucc

SEQ ID NO: 3147319 - RNA, 19 nt, Mycobacterium bovis subsp bovis AF2122/97
cggccagcgugucccaacg

SEQ ID NO: 3147320 - RNA, 23 nt, Mycobacterium bovis subsp bovis AF2122/97
cggccagcgugucccaacgccac

SEQ ID NO: 3147321 - RNA, 17 nt, Mycobacterium bovis subsp bovis AF2122/97
cggccagcguguccgcc

SEQ ID NO: 3147322 - RNA, 15 nt, Mycobacterium bovis subsp bovis AF2122/97
cggccagcuccgccu

SEQ ID NO: 3147323 - RNA, 16 nt, Mycobacterium bovis subsp bovis AF2122/97
cggccagcuccgccug

SEQ ID NO: 3147324 - RNA, 21 nt, Mycobacterium bovis subsp bovis AF2122/97
cggccagcuccucagccaccg

SEQ ID NO: 3147325 - RNA, 22 nt, Mycobacterium bovis subsp bovis AF2122/97
cggccagcuccucagccaccgc

SEQ ID NO: 3147326 - RNA, 13 nt, Mycobacterium bovis subsp bovis AF2122/97
cggccagcucgcg

SEQ ID NO: 3147327 - RNA, 20 nt, Mycobacterium bovis subsp bovis AF2122/97
cggccagcucgcgggccgcg

SEQ ID NO: 3147328 - RNA, 17 nt, Mycobacterium bovis subsp bovis AF2122/97
cggccagcucggccagc

SEQ ID NO: 3147329 - RNA, 19 nt, Mycobacterium bovis subsp bovis AF2122/97
cggccagcugcagcagacc

SEQ ID NO: 3147330 - RNA, 18 nt, Mycobacterium bovis subsp bovis AF2122/97
cggccagcuguucgagcc

SEQ ID NO: 3147331 - RNA, 21 nt, Mycobacterium bovis subsp bovis AF2122/97
cggccagcuguucgagccgcg

SEQ ID NO: 3147332 - RNA, 13 nt, Mycobacterium bovis subsp bovis AF2122/97
cggccagcuuccc

SEQ ID NO: 3147333 - RNA, 20 nt, Mycobacterium bovis subsp bovis AF2122/97
cggccagcuugagguccguc

SEQ ID NO: 3147334 - RNA, 13 nt, Mycobacterium bovis subsp bovis AF2122/97
cggccagcuugcg

SEQ ID NO: 3147335 - RNA, 18 nt, Mycobacterium bovis subsp bovis AF2122/97
cggccagcuugcggagcc

SEQ ID NO: 3147336 - RNA, 21 nt, Mycobacterium bovis subsp bovis AF2122/97
cggccagcuugcggagccgcc

SEQ ID NO: 3147337 - RNA, 23 nt, Mycobacterium bovis subsp bovis AF2122/97
cggccagcuugcggagccgccgc

SEQ ID NO: 3147338 - RNA, 12 nt, Mycobacterium bovis subsp bovis AF2122/97
cggccaggacaa

SEQ ID NO: 3147339 - RNA, 15 nt, Mycobacterium bovis subsp bovis AF2122/97
cggccaggacaacgc

SEQ ID NO: 3147340 - RNA, 20 nt, Mycobacterium bovis subsp bovis AF2122/97
cggccaggaguuugaccacc

SEQ ID NO: 3147341 - RNA, 20 nt, Mycobacterium bovis subsp bovis AF2122/97
cggccaggaucaaccggccc

SEQ ID NO: 3147342 - RNA, 19 nt, Mycobacterium bovis subsp bovis AF2122/97
cggccaggaucuguuuggg

SEQ ID NO: 3147343 - RNA, 23 nt, Mycobacterium bovis subsp bovis AF2122/97
cggccaggaugaagacgcggguc

SEQ ID NO: 3147344 - RNA, 22 nt, Mycobacterium bovis subsp bovis AF2122/97
cggccaggaugccugccacccg

SEQ ID NO: 3147345 - RNA, 15 nt, Mycobacterium bovis subsp bovis AF2122/97
cggccaggccacggg

SEQ ID NO: 3147346 - RNA, 13 nt, Mycobacterium bovis subsp bovis AF2122/97
cggccaggccgac

SEQ ID NO: 3147347 - RNA, 14 nt, Mycobacterium bovis subsp bovis AF2122/97
cggccaggccgaca

SEQ ID NO: 3147348 - RNA, 14 nt, Mycobacterium bovis subsp bovis AF2122/97
cggccaggccggcg

SEQ ID NO: 3147349 - RNA, 15 nt, Mycobacterium bovis subsp bovis AF2122/97
cggccaggccggcgg

SEQ ID NO: 3147350 - RNA, 17 nt, Mycobacterium bovis subsp bovis AF2122/97
cggccaggccggcggcg

SEQ ID NO: 3147351 - RNA, 15 nt, Mycobacterium bovis subsp bovis AF2122/97
cggccaggccgucgg

SEQ ID NO: 3147352 - RNA, 16 nt, Mycobacterium bovis subsp bovis AF2122/97
cggccaggggcgcagc

SEQ ID NO: 3147353 - RNA, 20 nt, Mycobacterium bovis subsp bovis AF2122/97
cggccaggggcgcagcgcgg

SEQ ID NO: 3147354 - RNA, 23 nt, Mycobacterium bovis subsp bovis AF2122/97
cggccagggugcccucggccgcc

SEQ ID NO: 3147355 - RNA, 23 nt, Mycobacterium bovis subsp bovis AF2122/97
cggccagguaauugccgaccgcc

SEQ ID NO: 3147356 - RNA, 22 nt, Mycobacterium bovis subsp bovis AF2122/97
cggccagguauguccgccauug

SEQ ID NO: 3147357 - RNA, 16 nt, Mycobacterium bovis subsp bovis AF2122/97
cggccaggucgacacc

SEQ ID NO: 3147358 - RNA, 17 nt, Mycobacterium bovis subsp bovis AF2122/97
cggccaggucgacaccg

SEQ ID NO: 3147359 - RNA, 24 nt, Mycobacterium bovis subsp bovis AF2122/97
cggccaggucgacaccgcggugcc

SEQ ID NO: 3147360 - RNA, 15 nt, Mycobacterium bovis subsp bovis AF2122/97
cggccaggucgacgg

SEQ ID NO: 3147361 - RNA, 17 nt, Mycobacterium bovis subsp bovis AF2122/97
cggccaggucgacgggc

SEQ ID NO: 3147362 - RNA, 17 nt, Mycobacterium bovis subsp bovis AF2122/97
cggccaggucgagcacc

SEQ ID NO: 3147363 - RNA, 18 nt, Mycobacterium bovis subsp bovis AF2122/97
cggccaggucgagcaccg

SEQ ID NO: 3147364 - RNA, 21 nt, Mycobacterium bovis subsp bovis AF2122/97
cggccaggucgagcaccggcu

SEQ ID NO: 3147365 - RNA, 14 nt, Mycobacterium bovis subsp bovis AF2122/97
cggccaggucgcga

SEQ ID NO: 3147366 - RNA, 22 nt, Mycobacterium bovis subsp bovis AF2122/97
cggccaggucgcgauagccgcc

SEQ ID NO: 3147367 - RNA, 13 nt, Mycobacterium bovis subsp bovis AF2122/97
cggccaggucggc

SEQ ID NO: 3147368 - RNA, 15 nt, Mycobacterium bovis subsp bovis AF2122/97
cggccaggucggcgu

SEQ ID NO: 3147369 - RNA, 21 nt, Mycobacterium bovis subsp bovis AF2122/97
cggccaggucggcguugaucg

SEQ ID NO: 3147370 - RNA, 15 nt, Mycobacterium bovis subsp bovis AF2122/97
cggccagguugaucg

SEQ ID NO: 3147371 - RNA, 15 nt, Mycobacterium bovis subsp bovis AF2122/97
cggccaguacgucga

SEQ ID NO: 3147372 - RNA, 16 nt, Mycobacterium bovis subsp bovis AF2122/97
cggccaguacgucgau

SEQ ID NO: 3147373 - RNA, 22 nt, Mycobacterium bovis subsp bovis AF2122/97
cggccagucguacucccaggcc

SEQ ID NO: 3147374 - RNA, 12 nt, Mycobacterium bovis subsp bovis AF2122/97
cggccagugaca

SEQ ID NO: 3147375 - RNA, 23 nt, Mycobacterium bovis subsp bovis AF2122/97
cggccagugacaacgcgaugccg

SEQ ID NO: 3147376 - RNA, 16 nt, Mycobacterium bovis subsp bovis AF2122/97
cggccagugccaucgc

SEQ ID NO: 3147377 - RNA, 20 nt, Mycobacterium bovis subsp bovis AF2122/97
cggccagugcgcagaacacc

SEQ ID NO: 3147378 - RNA, 15 nt, Mycobacterium bovis subsp bovis AF2122/97
cggccagugcgcgcg

SEQ ID NO: 3147379 - RNA, 16 nt, Mycobacterium bovis subsp bovis AF2122/97
cggccagugcgcgcgu

SEQ ID NO: 3147380 - RNA, 18 nt, Mycobacterium bovis subsp bovis AF2122/97
cggccagugcgcgcguca

SEQ ID NO: 3147381 - RNA, 19 nt, Mycobacterium bovis subsp bovis AF2122/97
cggccagugucagcacgac

SEQ ID NO: 3147382 - RNA, 20 nt, Mycobacterium bovis subsp bovis AF2122/97
cggccagugucagcacgacg

SEQ ID NO: 3147383 - RNA, 13 nt, Mycobacterium bovis subsp bovis AF2122/97
cggccaguucggc

SEQ ID NO: 3147384 - RNA, 17 nt, Mycobacterium bovis subsp bovis AF2122/97
cggccaguucggcggcc

SEQ ID NO: 3147385 - RNA, 19 nt, Mycobacterium bovis subsp bovis AF2122/97
cggccaguucggcggccgc

SEQ ID NO: 3147386 - RNA, 20 nt, Mycobacterium bovis subsp bovis AF2122/97
cggccaguucggcggccgcc

SEQ ID NO: 3147387 - RNA, 21 nt, Mycobacterium bovis subsp bovis AF2122/97
cggccaguucggcggccgccg

SEQ ID NO: 3147388 - RNA, 22 nt, Mycobacterium bovis subsp bovis AF2122/97
cggccaguucggcggccgccgc

SEQ ID NO: 3147389 - RNA, 17 nt, Mycobacterium bovis subsp bovis AF2122/97
cggccaguugcacaucg

SEQ ID NO: 3147390 - RNA, 20 nt, Mycobacterium bovis subsp bovis AF2122/97
cggccaguugguagccgccc

SEQ ID NO: 3147391 - RNA, 18 nt, Mycobacterium bovis subsp bovis AF2122/97
cggccauacgcgcgcggu

SEQ ID NO: 3147392 - RNA, 17 nt, Mycobacterium bovis subsp bovis AF2122/97
cggccauagcgccgcgc

SEQ ID NO: 3147393 - RNA, 21 nt, Mycobacterium bovis subsp bovis AF2122/97
cggccccgaaacgauggccgg

SEQ ID NO: 3147394 - RNA, 15 nt, Mycobacterium bovis subsp bovis AF2122/97
cggccccgacacagc

SEQ ID NO: 3147395 - RNA, 20 nt, Mycobacterium bovis subsp bovis AF2122/97
cggccccgacacagcggcgg

SEQ ID NO: 3147396 - RNA, 13 nt, Mycobacterium bovis subsp bovis AF2122/97
cggccccgacggu

SEQ ID NO: 3147397 - RNA, 16 nt, Mycobacterium bovis subsp bovis AF2122/97
cggccccgacggucaa

SEQ ID NO: 3147398 - RNA, 12 nt, Mycobacterium bovis subsp bovis AF2122/97
cggccccgccag

SEQ ID NO: 3147399 - RNA, 13 nt, Mycobacterium bovis subsp bovis AF2122/97
cggccccgccagc

SEQ ID NO: 3147400 - RNA, 17 nt, Mycobacterium bovis subsp bovis AF2122/97
cggccccgccagcgccg

SEQ ID NO: 3147401 - RNA, 19 nt, Mycobacterium bovis subsp bovis AF2122/97
cggccccgccagcgccgcc

SEQ ID NO: 3147402 - RNA, 21 nt, Mycobacterium bovis subsp bovis AF2122/97
cggccccgccagcgccgccga

SEQ ID NO: 3147403 - RNA, 20 nt, Mycobacterium bovis subsp bovis AF2122/97
cggccccgccgaugccgccg

SEQ ID NO: 3147404 - RNA, 19 nt, Mycobacterium bovis subsp bovis AF2122/97
cggccccgccgccggugcg

SEQ ID NO: 3147405 - RNA, 17 nt, Mycobacterium bovis subsp bovis AF2122/97
cggccccgccgcuaccg

SEQ ID NO: 3147406 - RNA, 20 nt, Mycobacterium bovis subsp bovis AF2122/97
cggccccgccgcuaccgaac

SEQ ID NO: 3147407 - RNA, 15 nt, Mycobacterium bovis subsp bovis AF2122/97
cggccccgccggccc

SEQ ID NO: 3147408 - RNA, 18 nt, Mycobacterium bovis subsp bovis AF2122/97
cggccccgccggccccgc

SEQ ID NO: 3147409 - RNA, 14 nt, Mycobacterium bovis subsp bovis AF2122/97
cggccccgccggcg

SEQ ID NO: 3147410 - RNA, 14 nt, Mycobacterium bovis subsp bovis AF2122/97
cggccccgccguca

SEQ ID NO: 3147411 - RNA, 15 nt, Mycobacterium bovis subsp bovis AF2122/97
cggccccgccgucac

SEQ ID NO: 3147412 - RNA, 23 nt, Mycobacterium bovis subsp bovis AF2122/97
cggccccgccgucaccgccguug

SEQ ID NO: 3147413 - RNA, 15 nt, Mycobacterium bovis subsp bovis AF2122/97
cggccccgccgucgc

SEQ ID NO: 3147414 - RNA, 14 nt, Mycobacterium bovis subsp bovis AF2122/97
cggccccgccguua

SEQ ID NO: 3147415 - RNA, 14 nt, Mycobacterium bovis subsp bovis AF2122/97
cggccccgccguug

SEQ ID NO: 3147416 - RNA, 23 nt, Mycobacterium bovis subsp bovis AF2122/97
cggccccgccguugccgccgacg

SEQ ID NO: 3147417 - RNA, 21 nt, Mycobacterium bovis subsp bovis AF2122/97
cggccccgccguuuccgccgc

SEQ ID NO: 3147418 - RNA, 15 nt, Mycobacterium bovis subsp bovis AF2122/97
cggccccgcggccag

SEQ ID NO: 3147419 - RNA, 14 nt, Mycobacterium bovis subsp bovis AF2122/97
cggccccggccgcg

SEQ ID NO: 3147420 - RNA, 16 nt, Mycobacterium bovis subsp bovis AF2122/97
cggccccggccgcguc

SEQ ID NO: 3147421 - RNA, 17 nt, Mycobacterium bovis subsp bovis AF2122/97
cggccccggccgcguca

SEQ ID NO: 3147422 - RNA, 14 nt, Mycobacterium bovis subsp bovis AF2122/97
cggccccugccacg

SEQ ID NO: 3147423 - RNA, 13 nt, Mycobacterium bovis subsp bovis AF2122/97
cggcccgacgggu

SEQ ID NO: 3147424 - RNA, 14 nt, Mycobacterium bovis subsp bovis AF2122/97
cggcccgagccgcg

SEQ ID NO: 3147425 - RNA, 14 nt, Mycobacterium bovis subsp bovis AF2122/97
cggcccgaggcggg

SEQ ID NO: 3147426 - RNA, 19 nt, Mycobacterium bovis subsp bovis AF2122/97
cggcccgaggcucgggccg

SEQ ID NO: 3147427 - RNA, 14 nt, Mycobacterium bovis subsp bovis AF2122/97
cggcccgaggugcc

SEQ ID NO: 3147428 - RNA, 17 nt, Mycobacterium bovis subsp bovis AF2122/97
cggcccgaggugccggg

SEQ ID NO: 3147429 - RNA, 21 nt, Mycobacterium bovis subsp bovis AF2122/97
cggcccgaggugccggggccc

SEQ ID NO: 3147430 - RNA, 22 nt, Mycobacterium bovis subsp bovis AF2122/97
cggcccgaggugccggggcccc

SEQ ID NO: 3147431 - RNA, 15 nt, Mycobacterium bovis subsp bovis AF2122/97
cggcccgaucaccag

SEQ ID NO: 3147432 - RNA, 17 nt, Mycobacterium bovis subsp bovis AF2122/97
cggcccgaucaccagcc

SEQ ID NO: 3147433 - RNA, 18 nt, Mycobacterium bovis subsp bovis AF2122/97
cggcccgaucaccagccc

SEQ ID NO: 3147434 - RNA, 13 nt, Mycobacterium bovis subsp bovis AF2122/97
cggcccgaucggc

SEQ ID NO: 3147435 - RNA, 12 nt, Mycobacterium bovis subsp bovis AF2122/97
cggcccgaugac

SEQ ID NO: 3147436 - RNA, 21 nt, Mycobacterium bovis subsp bovis AF2122/97
cggcccgcaaacagucggaga

SEQ ID NO: 3147437 - RNA, 13 nt, Mycobacterium bovis subsp bovis AF2122/97
cggcccgcaacgc

SEQ ID NO: 3147438 - RNA, 15 nt, Mycobacterium bovis subsp bovis AF2122/97
cggcccgcagcagca

SEQ ID NO: 3147439 - RNA, 20 nt, Mycobacterium bovis subsp bovis AF2122/97
cggcccgcagcccgccgggc

SEQ ID NO: 3147440 - RNA, 23 nt, Mycobacterium bovis subsp bovis AF2122/97
cggcccgccaaaaacgccccggc

SEQ ID NO: 3147441 - RNA, 13 nt, Mycobacterium bovis subsp bovis AF2122/97
cggcccgccaccc

SEQ ID NO: 3147442 - RNA, 20 nt, Mycobacterium bovis subsp bovis AF2122/97
cggcccgccguccggcgccc

SEQ ID NO: 3147443 - RNA, 16 nt, Mycobacterium bovis subsp bovis AF2122/97
cggcccgccucggcgg

SEQ ID NO: 3147444 - RNA, 12 nt, Mycobacterium bovis subsp bovis AF2122/97
cggcccgcgggc

SEQ ID NO: 3147445 - RNA, 14 nt, Mycobacterium bovis subsp bovis AF2122/97
cggcccgcgggcgg

SEQ ID NO: 3147446 - RNA, 17 nt, Mycobacterium bovis subsp bovis AF2122/97
cggcccgcucaccuugg

SEQ ID NO: 3147447 - RNA, 15 nt, Mycobacterium bovis subsp bovis AF2122/97
cggcccgcucagccg

SEQ ID NO: 3147448 - RNA, 13 nt, Mycobacterium bovis subsp bovis AF2122/97
cggcccgcuccac

SEQ ID NO: 3147449 - RNA, 12 nt, Mycobacterium bovis subsp bovis AF2122/97
cggcccgcucga

SEQ ID NO: 3147450 - RNA, 16 nt, Mycobacterium bovis subsp bovis AF2122/97
cggcccgcucgaucgg

SEQ ID NO: 3147451 - RNA, 15 nt, Mycobacterium bovis subsp bovis AF2122/97
cggcccgcugaccau

SEQ ID NO: 3147452 - RNA, 19 nt, Mycobacterium bovis subsp bovis AF2122/97
cggcccgcugaccaucaca

SEQ ID NO: 3147453 - RNA, 13 nt, Mycobacterium bovis subsp bovis AF2122/97
cggcccgcugugg

SEQ ID NO: 3147454 - RNA, 15 nt, Mycobacterium bovis subsp bovis AF2122/97
cggcccggacgucgg

SEQ ID NO: 3147455 - RNA, 20 nt, Mycobacterium bovis subsp bovis AF2122/97
cggcccggcacccggugaga

SEQ ID NO: 3147456 - RNA, 14 nt, Mycobacterium bovis subsp bovis AF2122/97
cggcccggcucggu

SEQ ID NO: 3147457 - RNA, 15 nt, Mycobacterium bovis subsp bovis AF2122/97
cggcccggcucggug

SEQ ID NO: 3147458 - RNA, 22 nt, Mycobacterium bovis subsp bovis AF2122/97
cggcccggcucggugcgccaga

SEQ ID NO: 3147459 - RNA, 16 nt, Mycobacterium bovis subsp bovis AF2122/97
cggcccgggcucggcg

SEQ ID NO: 3147460 - RNA, 17 nt, Mycobacterium bovis subsp bovis AF2122/97
cggcccgggcucggcga

SEQ ID NO: 3147461 - RNA, 13 nt, Mycobacterium bovis subsp bovis AF2122/97
cggcccggggacg

SEQ ID NO: 3147462 - RNA, 15 nt, Mycobacterium bovis subsp bovis AF2122/97
cggcccggggacgcc

SEQ ID NO: 3147463 - RNA, 16 nt, Mycobacterium bovis subsp bovis AF2122/97
cggcccgggucagcga

SEQ ID NO: 3147464 - RNA, 18 nt, Mycobacterium bovis subsp bovis AF2122/97
cggcccgggucagcgacc

SEQ ID NO: 3147465 - RNA, 21 nt, Mycobacterium bovis subsp bovis AF2122/97
cggcccggguggcccggaaca

SEQ ID NO: 3147466 - RNA, 17 nt, Mycobacterium bovis subsp bovis AF2122/97
cggcccggguuggccga

SEQ ID NO: 3147467 - RNA, 18 nt, Mycobacterium bovis subsp bovis AF2122/97
cggcccggguuggccgaa

SEQ ID NO: 3147468 - RNA, 19 nt, Mycobacterium bovis subsp bovis AF2122/97
cggcccggguuggccgaac

SEQ ID NO: 3147469 - RNA, 13 nt, Mycobacterium bovis subsp bovis AF2122/97
cggcccggugagc

SEQ ID NO: 3147470 - RNA, 14 nt, Mycobacterium bovis subsp bovis AF2122/97
cggcccgguggaca

SEQ ID NO: 3147471 - RNA, 18 nt, Mycobacterium bovis subsp bovis AF2122/97
cggcccgucgcgucgacc

SEQ ID NO: 3147472 - RNA, 22 nt, Mycobacterium bovis subsp bovis AF2122/97
cggcccgugccacagcucgccg

SEQ ID NO: 3147473 - RNA, 22 nt, Mycobacterium bovis subsp bovis AF2122/97
cggcccguguggucccggcacg

SEQ ID NO: 3147474 - RNA, 23 nt, Mycobacterium bovis subsp bovis AF2122/97
cggcccguuugccgguucggcga

SEQ ID NO: 3147475 - RNA, 17 nt, Mycobacterium bovis subsp bovis AF2122/97
cggcccuaaacaccgcg

SEQ ID NO: 3147476 - RNA, 22 nt, Mycobacterium bovis subsp bovis AF2122/97
cggcccuaucguuaucgacacc

SEQ ID NO: 3147477 - RNA, 14 nt, Mycobacterium bovis subsp bovis AF2122/97
cggcccuccaccgg

SEQ ID NO: 3147478 - RNA, 22 nt, Mycobacterium bovis subsp bovis AF2122/97
cggcccucgagcagugccgugc

SEQ ID NO: 3147479 - RNA, 17 nt, Mycobacterium bovis subsp bovis AF2122/97
cggcccucgaugccgcg

SEQ ID NO: 3147480 - RNA, 15 nt, Mycobacterium bovis subsp bovis AF2122/97
cggccgccagcagcu

SEQ ID NO: 3147481 - RNA, 18 nt, Mycobacterium bovis subsp bovis AF2122/97
cggccgccagcagcuucu

SEQ ID NO: 3147482 - RNA, 13 nt, Mycobacterium bovis subsp bovis AF2122/97
cggccgccagccc

SEQ ID NO: 3147483 - RNA, 19 nt, Mycobacterium bovis subsp bovis AF2122/97
cggccgccagccccacccg

SEQ ID NO: 3147484 - RNA, 16 nt, Mycobacterium bovis subsp bovis AF2122/97
cggccgccagcgcgcc

SEQ ID NO: 3147485 - RNA, 15 nt, Mycobacterium bovis subsp bovis AF2122/97
cggccgccaucaucg

SEQ ID NO: 3147486 - RNA, 14 nt, Mycobacterium bovis subsp bovis AF2122/97
cggccgccccaggc

SEQ ID NO: 3147487 - RNA, 17 nt, Mycobacterium bovis subsp bovis AF2122/97
cggccgccccaggcugg

SEQ ID NO: 3147488 - RNA, 15 nt, Mycobacterium bovis subsp bovis AF2122/97
cggccgcccgcucga

SEQ ID NO: 3147489 - RNA, 11 nt, Mycobacterium bovis subsp bovis AF2122/97
cggccgcccgu

SEQ ID NO: 3147490 - RNA, 19 nt, Mycobacterium bovis subsp bovis AF2122/97
cggccgcccguaaaccgau

SEQ ID NO: 3147491 - RNA, 21 nt, Mycobacterium bovis subsp bovis AF2122/97
cggccgccgaaacucaccagc

SEQ ID NO: 3147492 - RNA, 18 nt, Mycobacterium bovis subsp bovis AF2122/97
cggccgccgacagggacc

SEQ ID NO: 3147493 - RNA, 21 nt, Mycobacterium bovis subsp bovis AF2122/97
cggccgccgacagggacccga

SEQ ID NO: 3147494 - RNA, 22 nt, Mycobacterium bovis subsp bovis AF2122/97
cggccgccgacagggacccgag

SEQ ID NO: 3147495 - RNA, 12 nt, Mycobacterium bovis subsp bovis AF2122/97
cggccgccgacg

SEQ ID NO: 3147496 - RNA, 15 nt, Mycobacterium bovis subsp bovis AF2122/97
cggccgccgacguug

SEQ ID NO: 3147497 - RNA, 18 nt, Mycobacterium bovis subsp bovis AF2122/97
cggccgccgacuccccgc

SEQ ID NO: 3147498 - RNA, 15 nt, Mycobacterium bovis subsp bovis AF2122/97
cggccgccgagacga

SEQ ID NO: 3147499 - RNA, 12 nt, Mycobacterium bovis subsp bovis AF2122/97
cggccgccgagu

SEQ ID NO: 3147500 - RNA, 19 nt, Mycobacterium bovis subsp bovis AF2122/97
cggccgccgaucugcugca

SEQ ID NO: 3147501 - RNA, 13 nt, Mycobacterium bovis subsp bovis AF2122/97
cggccgccgcggg

SEQ ID NO: 3147502 - RNA, 14 nt, Mycobacterium bovis subsp bovis AF2122/97
cggccgccgcgucg

SEQ ID NO: 3147503 - RNA, 16 nt, Mycobacterium bovis subsp bovis AF2122/97
cggccgccgcgucgac

SEQ ID NO: 3147504 - RNA, 18 nt, Mycobacterium bovis subsp bovis AF2122/97
cggccgccgcgucgacua

SEQ ID NO: 3147505 - RNA, 13 nt, Mycobacterium bovis subsp bovis AF2122/97
cggccgccgcguu

SEQ ID NO: 3147506 - RNA, 23 nt, Mycobacterium bovis subsp bovis AF2122/97
cggccgccgggaaauaucucggu

SEQ ID NO: 3147507 - RNA, 15 nt, Mycobacterium bovis subsp bovis AF2122/97
cggccgccguccccg

SEQ ID NO: 3147508 - RNA, 13 nt, Mycobacterium bovis subsp bovis AF2122/97
cggccgccucgua

SEQ ID NO: 3147509 - RNA, 24 nt, Mycobacterium bovis subsp bovis AF2122/97
cggccgccucguacggaccgucgc

SEQ ID NO: 3147510 - RNA, 17 nt, Mycobacterium bovis subsp bovis AF2122/97
cggccgccuucuccggc

SEQ ID NO: 3147511 - RNA, 14 nt, Mycobacterium bovis subsp bovis AF2122/97
cggccgcgacgaca

SEQ ID NO: 3147512 - RNA, 12 nt, Mycobacterium bovis subsp bovis AF2122/97
cggccgcgacgg

SEQ ID NO: 3147513 - RNA, 14 nt, Mycobacterium bovis subsp bovis AF2122/97
cggccgcgacggau

SEQ ID NO: 3147514 - RNA, 14 nt, Mycobacterium bovis subsp bovis AF2122/97
cggccgcgauggug

SEQ ID NO: 3147515 - RNA, 21 nt, Mycobacterium bovis subsp bovis AF2122/97
cggccgcgauggugcgccggg

SEQ ID NO: 3147516 - RNA, 22 nt, Mycobacterium bovis subsp bovis AF2122/97
cggccgcgauggugcgccgggc

SEQ ID NO: 3147517 - RNA, 21 nt, Mycobacterium bovis subsp bovis AF2122/97
cggccgcgcgcucgagcaggc

SEQ ID NO: 3147518 - RNA, 20 nt, Mycobacterium bovis subsp bovis AF2122/97
cggccgcgcggggugcgcgc

SEQ ID NO: 3147519 - RNA, 22 nt, Mycobacterium bovis subsp bovis AF2122/97
cggccgcgcggggugcgcgcga

SEQ ID NO: 3147520 - RNA, 12 nt, Mycobacterium bovis subsp bovis AF2122/97
cggccgcgcugc

SEQ ID NO: 3147521 - RNA, 14 nt, Mycobacterium bovis subsp bovis AF2122/97
cggccgcgcugcag

SEQ ID NO: 3147522 - RNA, 23 nt, Mycobacterium bovis subsp bovis AF2122/97
cggccgcggaugcucaggucacc

SEQ ID NO: 3147523 - RNA, 17 nt, Mycobacterium bovis subsp bovis AF2122/97
cggccgcggccucccgc

SEQ ID NO: 3147524 - RNA, 12 nt, Mycobacterium bovis subsp bovis AF2122/97
cggccgcggcga

SEQ ID NO: 3147525 - RNA, 15 nt, Mycobacterium bovis subsp bovis AF2122/97
cggccgcggcggccc

SEQ ID NO: 3147526 - RNA, 16 nt, Mycobacterium bovis subsp bovis AF2122/97
cggccgcggcggcccc

SEQ ID NO: 3147527 - RNA, 15 nt, Mycobacterium bovis subsp bovis AF2122/97
cggccgcggcgucgu

SEQ ID NO: 3147528 - RNA, 14 nt, Mycobacterium bovis subsp bovis AF2122/97
cggccgcggcuuca

SEQ ID NO: 3147529 - RNA, 18 nt, Mycobacterium bovis subsp bovis AF2122/97
cggccgcgggcgcgcagg

SEQ ID NO: 3147530 - RNA, 20 nt, Mycobacterium bovis subsp bovis AF2122/97
cggccgcgggcgcgcaggua

SEQ ID NO: 3147531 - RNA, 13 nt, Mycobacterium bovis subsp bovis AF2122/97
cggccgcgggcgu

SEQ ID NO: 3147532 - RNA, 17 nt, Mycobacterium bovis subsp bovis AF2122/97
cggccgcgggucccggc

SEQ ID NO: 3147533 - RNA, 13 nt, Mycobacterium bovis subsp bovis AF2122/97
cggccgcggucgg

SEQ ID NO: 3147534 - RNA, 19 nt, Mycobacterium bovis subsp bovis AF2122/97
cggccgcggucggccacca

SEQ ID NO: 3147535 - RNA, 21 nt, Mycobacterium bovis subsp bovis AF2122/97
cggccgcggucggccaccaac

SEQ ID NO: 3147536 - RNA, 22 nt, Mycobacterium bovis subsp bovis AF2122/97
cggccgcggucggccaccaacu

SEQ ID NO: 3147537 - RNA, 20 nt, Mycobacterium bovis subsp bovis AF2122/97
cggccgcggugacggcggcu

SEQ ID NO: 3147538 - RNA, 22 nt, Mycobacterium bovis subsp bovis AF2122/97
cggccgcggugacggcggcugu

SEQ ID NO: 3147539 - RNA, 19 nt, Mycobacterium bovis subsp bovis AF2122/97
cggccgcggugcccgucgg

SEQ ID NO: 3147540 - RNA, 20 nt, Mycobacterium bovis subsp bovis AF2122/97
cggccgcguaaaccggcuga

SEQ ID NO: 3147541 - RNA, 23 nt, Mycobacterium bovis subsp bovis AF2122/97
cggccgcguaaaccggcugaccg

SEQ ID NO: 3147542 - RNA, 21 nt, Mycobacterium bovis subsp bovis AF2122/97
cggccgcgucacggaccugga

SEQ ID NO: 3147543 - RNA, 18 nt, Mycobacterium bovis subsp bovis AF2122/97
cggccgcgugccgcccgc

SEQ ID NO: 3147544 - RNA, 13 nt, Mycobacterium bovis subsp bovis AF2122/97
cggccgcgugcuc

SEQ ID NO: 3147545 - RNA, 17 nt, Mycobacterium bovis subsp bovis AF2122/97
cggccgcgugcucgccg

SEQ ID NO: 3147546 - RNA, 23 nt, Mycobacterium bovis subsp bovis AF2122/97
cggccgcuauggcccgggccgaa

SEQ ID NO: 3147547 - RNA, 18 nt, Mycobacterium bovis subsp bovis AF2122/97
cggccgcucacauacagc

SEQ ID NO: 3147548 - RNA, 15 nt, Mycobacterium bovis subsp bovis AF2122/97
cggccgcucaccccg

SEQ ID NO: 3147549 - RNA, 16 nt, Mycobacterium bovis subsp bovis AF2122/97
cggccgcucaccccgc

SEQ ID NO: 3147550 - RNA, 19 nt, Mycobacterium bovis subsp bovis AF2122/97
cggccgcucaccccgcgcu

SEQ ID NO: 3147551 - RNA, 19 nt, Mycobacterium bovis subsp bovis AF2122/97
cggccgcuccaccucggcg

SEQ ID NO: 3147552 - RNA, 13 nt, Mycobacterium bovis subsp bovis AF2122/97
cggccgcucgggc

SEQ ID NO: 3147553 - RNA, 14 nt, Mycobacterium bovis subsp bovis AF2122/97
cggccgcucgggcc

SEQ ID NO: 3147554 - RNA, 18 nt, Mycobacterium bovis subsp bovis AF2122/97
cggccgcucgggccagcg

SEQ ID NO: 3147555 - RNA, 14 nt, Mycobacterium bovis subsp bovis AF2122/97
cggccgcugacgcc

SEQ ID NO: 3147556 - RNA, 15 nt, Mycobacterium bovis subsp bovis AF2122/97
cggccgcugacgccg

SEQ ID NO: 3147557 - RNA, 17 nt, Mycobacterium bovis subsp bovis AF2122/97
cggccgcugaucaacag

SEQ ID NO: 3147558 - RNA, 15 nt, Mycobacterium bovis subsp bovis AF2122/97
cggccgcuggcguug

SEQ ID NO: 3147559 - RNA, 16 nt, Mycobacterium bovis subsp bovis AF2122/97
cggccgcugggcccau

SEQ ID NO: 3147560 - RNA, 16 nt, Mycobacterium bovis subsp bovis AF2122/97
cggccgcuucggcggu

SEQ ID NO: 3147561 - RNA, 18 nt, Mycobacterium bovis subsp bovis AF2122/97
cggccgcuucggcgguca

SEQ ID NO: 3147562 - RNA, 17 nt, Mycobacterium bovis subsp bovis AF2122/97
cggccggaacgcccggc

SEQ ID NO: 3147563 - RNA, 20 nt, Mycobacterium bovis subsp bovis AF2122/97
cggccggaauacccggccca

SEQ ID NO: 3147564 - RNA, 21 nt, Mycobacterium bovis subsp bovis AF2122/97
cggccggacaacagagucacc

SEQ ID NO: 3147565 - RNA, 14 nt, Mycobacterium bovis subsp bovis AF2122/97
cggccggagccgcc

SEQ ID NO: 3147566 - RNA, 20 nt, Mycobacterium bovis subsp bovis AF2122/97
cggccggagccgccggcccc

SEQ ID NO: 3147567 - RNA, 19 nt, Mycobacterium bovis subsp bovis AF2122/97
cggccgucgggacggccaa

SEQ ID NO: 3147568 - RNA, 21 nt, Mycobacterium bovis subsp bovis AF2122/97
cggccgucgggacggccaaca

SEQ ID NO: 3147569 - RNA, 13 nt, Mycobacterium bovis subsp bovis AF2122/97
cggccgucgggca

SEQ ID NO: 3147570 - RNA, 15 nt, Mycobacterium bovis subsp bovis AF2122/97
cggccgucgggcagc

SEQ ID NO: 3147571 - RNA, 16 nt, Mycobacterium bovis subsp bovis AF2122/97
cggccgucgggcagca

SEQ ID NO: 3147572 - RNA, 13 nt, Mycobacterium bovis subsp bovis AF2122/97
cggccgucgucgg

SEQ ID NO: 3147573 - RNA, 16 nt, Mycobacterium bovis subsp bovis AF2122/97
cggccgucgucggcca

SEQ ID NO: 3147574 - RNA, 22 nt, Mycobacterium bovis subsp bovis AF2122/97
cggccgugaauucgccgaacgg

SEQ ID NO: 3147575 - RNA, 14 nt, Mycobacterium bovis subsp bovis AF2122/97
cggccgugaccgag

SEQ ID NO: 3147576 - RNA, 20 nt, Mycobacterium bovis subsp bovis AF2122/97
cggccgugaccgagccgcga

SEQ ID NO: 3147577 - RNA, 14 nt, Mycobacterium bovis subsp bovis AF2122/97
cggccgugccgccg

SEQ ID NO: 3147578 - RNA, 15 nt, Mycobacterium bovis subsp bovis AF2122/97
cggccgugccgccga

SEQ ID NO: 3147579 - RNA, 20 nt, Mycobacterium bovis subsp bovis AF2122/97
cggccguggaaagccggcgu

SEQ ID NO: 3147580 - RNA, 20 nt, Mycobacterium bovis subsp bovis AF2122/97
cggccguggcauguugcgga

SEQ ID NO: 3147581 - RNA, 22 nt, Mycobacterium bovis subsp bovis AF2122/97
cggccguggcauguugcggacc

SEQ ID NO: 3147582 - RNA, 16 nt, Mycobacterium bovis subsp bovis AF2122/97
cggccguggcguggcu

SEQ ID NO: 3147583 - RNA, 16 nt, Mycobacterium bovis subsp bovis AF2122/97
cggccguggcuggacc

SEQ ID NO: 3147584 - RNA, 22 nt, Mycobacterium bovis subsp bovis AF2122/97
cggccgugguggucucgagggu

SEQ ID NO: 3147585 - RNA, 14 nt, Mycobacterium bovis subsp bovis AF2122/97
cggccgugucgggc

SEQ ID NO: 3147586 - RNA, 18 nt, Mycobacterium bovis subsp bovis AF2122/97
cggccgugucgggcgcga

SEQ ID NO: 3147587 - RNA, 12 nt, Mycobacterium bovis subsp bovis AF2122/97
cggccguugggc

SEQ ID NO: 3147588 - RNA, 17 nt, Mycobacterium bovis subsp bovis AF2122/97
cggccguugggccaccg

SEQ ID NO: 3147589 - RNA, 18 nt, Mycobacterium bovis subsp bovis AF2122/97
cggccguugggccaccgg

SEQ ID NO: 3147590 - RNA, 19 nt, Mycobacterium bovis subsp bovis AF2122/97
cggccguugggccaccggc

SEQ ID NO: 3147591 - RNA, 21 nt, Mycobacterium bovis subsp bovis AF2122/97
cggccuaacucgccugcaccc

SEQ ID NO: 3147592 - RNA, 19 nt, Mycobacterium bovis subsp bovis AF2122/97
cggccuaccgagcuacgac

SEQ ID NO: 3147593 - RNA, 16 nt, Mycobacterium bovis subsp bovis AF2122/97
cggccuaggacgccgc

SEQ ID NO: 3147594 - RNA, 21 nt, Mycobacterium bovis subsp bovis AF2122/97
cggccuagggaaaggcgccgg

SEQ ID NO: 3147595 - RNA, 18 nt, Mycobacterium bovis subsp bovis AF2122/97
cggccuagggcggcggcg

SEQ ID NO: 3147596 - RNA, 17 nt, Mycobacterium bovis subsp bovis AF2122/97
cggccucaacacccggc

SEQ ID NO: 3147597 - RNA, 21 nt, Mycobacterium bovis subsp bovis AF2122/97
cggccucaguacagcgcguug

SEQ ID NO: 3147598 - RNA, 23 nt, Mycobacterium bovis subsp bovis AF2122/97
cggccucaguacagcgcguuggc

SEQ ID NO: 3147599 - RNA, 12 nt, Mycobacterium bovis subsp bovis AF2122/97
cggccuccacca

SEQ ID NO: 3147600 - RNA, 14 nt, Mycobacterium bovis subsp bovis AF2122/97
cggccuccaccacg

SEQ ID NO: 3147601 - RNA, 18 nt, Mycobacterium bovis subsp bovis AF2122/97
cggccuccaccacgucgg

SEQ ID NO: 3147602 - RNA, 15 nt, Mycobacterium bovis subsp bovis AF2122/97
cggccuccagcaccc

SEQ ID NO: 3147603 - RNA, 13 nt, Mycobacterium bovis subsp bovis AF2122/97
cggccuccaucgc

SEQ ID NO: 3147604 - RNA, 15 nt, Mycobacterium bovis subsp bovis AF2122/97
cggccuccaucgcga

SEQ ID NO: 3147605 - RNA, 16 nt, Mycobacterium bovis subsp bovis AF2122/97
cggccuccaucgcgac

SEQ ID NO: 3147606 - RNA, 18 nt, Mycobacterium bovis subsp bovis AF2122/97
cggccucccgggccgccg

SEQ ID NO: 3147607 - RNA, 19 nt, Mycobacterium bovis subsp bovis AF2122/97
cggccucccgggccgccgc

SEQ ID NO: 3147608 - RNA, 14 nt, Mycobacterium bovis subsp bovis AF2122/97
cggccuccgccgag

SEQ ID NO: 3147609 - RNA, 14 nt, Mycobacterium bovis subsp bovis AF2122/97
cggccuccggaccg

SEQ ID NO: 3147610 - RNA, 12 nt, Mycobacterium bovis subsp bovis AF2122/97
cggccuccgggc

SEQ ID NO: 3147611 - RNA, 15 nt, Mycobacterium bovis subsp bovis AF2122/97
cggccuccgggccau

SEQ ID NO: 3147612 - RNA, 15 nt, Mycobacterium bovis subsp bovis AF2122/97
cggccuccucgucgc

SEQ ID NO: 3147613 - RNA, 21 nt, Mycobacterium bovis subsp bovis AF2122/97
cggccuccucgucgcucccgg

SEQ ID NO: 3147614 - RNA, 14 nt, Mycobacterium bovis subsp bovis AF2122/97
cggccucgaugucg

SEQ ID NO: 3147615 - RNA, 20 nt, Mycobacterium bovis subsp bovis AF2122/97
cggccucgaugucgcggucg

SEQ ID NO: 3147616 - RNA, 16 nt, Mycobacterium bovis subsp bovis AF2122/97
cggccucgccggcgcg

SEQ ID NO: 3147617 - RNA, 20 nt, Mycobacterium bovis subsp bovis AF2122/97
cggccucgccggcgcgcagc

SEQ ID NO: 3147618 - RNA, 15 nt, Mycobacterium bovis subsp bovis AF2122/97
cggccucgccggggc

SEQ ID NO: 3147619 - RNA, 19 nt, Mycobacterium bovis subsp bovis AF2122/97
cggccucgccggggcaaac

SEQ ID NO: 3147620 - RNA, 12 nt, Mycobacterium bovis subsp bovis AF2122/97
cggccucgcugc

SEQ ID NO: 3147621 - RNA, 23 nt, Mycobacterium bovis subsp bovis AF2122/97
cggccucgggacucccgcgcggg

SEQ ID NO: 3147622 - RNA, 17 nt, Mycobacterium bovis subsp bovis AF2122/97
cggccucgggcucaaac

SEQ ID NO: 3147623 - RNA, 17 nt, Mycobacterium bovis subsp bovis AF2122/97
cggccucgucgaguucc

SEQ ID NO: 3147624 - RNA, 16 nt, Mycobacterium bovis subsp bovis AF2122/97
cggccucguugaccgg

SEQ ID NO: 3147625 - RNA, 15 nt, Mycobacterium bovis subsp bovis AF2122/97
cggccucugaccagc

SEQ ID NO: 3147626 - RNA, 12 nt, Mycobacterium bovis subsp bovis AF2122/97
cggccugaccgg

SEQ ID NO: 3147627 - RNA, 13 nt, Mycobacterium bovis subsp bovis AF2122/97
cggccugaccggc

SEQ ID NO: 3147628 - RNA, 19 nt, Mycobacterium bovis subsp bovis AF2122/97
cggccugaccggcucgccg

SEQ ID NO: 3147629 - RNA, 23 nt, Mycobacterium bovis subsp bovis AF2122/97
cggccugaccggcucgccggcgc

SEQ ID NO: 3147630 - RNA, 21 nt, Mycobacterium bovis subsp bovis AF2122/97
cggccugaccggucacccgug

SEQ ID NO: 3147631 - RNA, 22 nt, Mycobacterium bovis subsp bovis AF2122/97
cggccugaccggucacccgugc

SEQ ID NO: 3147632 - RNA, 13 nt, Mycobacterium bovis subsp bovis AF2122/97
cggccugagcggc

SEQ ID NO: 3147633 - RNA, 15 nt, Mycobacterium bovis subsp bovis AF2122/97
cggccugcaccagcg

SEQ ID NO: 3147634 - RNA, 17 nt, Mycobacterium bovis subsp bovis AF2122/97
cggccugcacggcgcug

SEQ ID NO: 3147635 - RNA, 20 nt, Mycobacterium bovis subsp bovis AF2122/97
cggccugcacggcgcugacg

SEQ ID NO: 3147636 - RNA, 15 nt, Mycobacterium bovis subsp bovis AF2122/97
cggccugccgcucgc

SEQ ID NO: 3147637 - RNA, 18 nt, Mycobacterium bovis subsp bovis AF2122/97
cggccugccgcucgccgg

SEQ ID NO: 3147638 - RNA, 12 nt, Mycobacterium bovis subsp bovis AF2122/97
cggccugcgaac

SEQ ID NO: 3147639 - RNA, 21 nt, Mycobacterium bovis subsp bovis AF2122/97
cggccugcgacgagcccaccg

SEQ ID NO: 3147640 - RNA, 12 nt, Mycobacterium bovis subsp bovis AF2122/97
cggccugcgagu

SEQ ID NO: 3147641 - RNA, 17 nt, Mycobacterium bovis subsp bovis AF2122/97
cggccugcgagucgcgc

SEQ ID NO: 3147642 - RNA, 16 nt, Mycobacterium bovis subsp bovis AF2122/97
cggccugcgccggcgc

SEQ ID NO: 3147643 - RNA, 17 nt, Mycobacterium bovis subsp bovis AF2122/97
cggccugcgccggcgcu

SEQ ID NO: 3147644 - RNA, 15 nt, Mycobacterium bovis subsp bovis AF2122/97
cggccugcgcgaccg

SEQ ID NO: 3147645 - RNA, 18 nt, Mycobacterium bovis subsp bovis AF2122/97
cggccugcgcgaccgacc

SEQ ID NO: 3147646 - RNA, 14 nt, Mycobacterium bovis subsp bovis AF2122/97
cggccugcggcaac

SEQ ID NO: 3147647 - RNA, 17 nt, Mycobacterium bovis subsp bovis AF2122/97
cggccugcggcaacggc

SEQ ID NO: 3147648 - RNA, 23 nt, Mycobacterium bovis subsp bovis AF2122/97
cggccugcggcaacggcucgucg

SEQ ID NO: 3147649 - RNA, 13 nt, Mycobacterium bovis subsp bovis AF2122/97
cggccugcggcac

SEQ ID NO: 3147650 - RNA, 15 nt, Mycobacterium bovis subsp bovis AF2122/97
cggccugcggcaccg

SEQ ID NO: 3147651 - RNA, 17 nt, Mycobacterium bovis subsp bovis AF2122/97
cggccugcggcaccggc

SEQ ID NO: 3147652 - RNA, 18 nt, Mycobacterium bovis subsp bovis AF2122/97
cggccugcuggucaccau

SEQ ID NO: 3147653 - RNA, 19 nt, Mycobacterium bovis subsp bovis AF2122/97
cggccugcuggucaccauc

SEQ ID NO: 3147654 - RNA, 22 nt, Mycobacterium bovis subsp bovis AF2122/97
cggcgaaccggcccaccgacgg

SEQ ID NO: 3147655 - RNA, 19 nt, Mycobacterium bovis subsp bovis AF2122/97
cggcgaaccgucucgcccc

SEQ ID NO: 3147656 - RNA, 19 nt, Mycobacterium bovis subsp bovis AF2122/97
cggcgaaccuugguugcca

SEQ ID NO: 3147657 - RNA, 23 nt, Mycobacterium bovis subsp bovis AF2122/97
cggcgaaccuugguugccaacga

SEQ ID NO: 3147658 - RNA, 21 nt, Mycobacterium bovis subsp bovis AF2122/97
cggcgaacgcguccagcgcgg

SEQ ID NO: 3147659 - RNA, 19 nt, Mycobacterium bovis subsp bovis AF2122/97
cggcgaacggauucccgcc

SEQ ID NO: 3147660 - RNA, 22 nt, Mycobacterium bovis subsp bovis AF2122/97
cggcgaacggauucccgcccag

SEQ ID NO: 3147661 - RNA, 23 nt, Mycobacterium bovis subsp bovis AF2122/97
cggcgaacggauucccgcccagc

SEQ ID NO: 3147662 - RNA, 15 nt, Mycobacterium bovis subsp bovis AF2122/97
cggcgaacucgcgcc

SEQ ID NO: 3147663 - RNA, 20 nt, Mycobacterium bovis subsp bovis AF2122/97
cggcgaacucgcgccgagcc

SEQ ID NO: 3147664 - RNA, 19 nt, Mycobacterium bovis subsp bovis AF2122/97
cggcgaacucuacgguggu

SEQ ID NO: 3147665 - RNA, 23 nt, Mycobacterium bovis subsp bovis AF2122/97
cggcgaacucuacgguggugcgg

SEQ ID NO: 3147666 - RNA, 13 nt, Mycobacterium bovis subsp bovis AF2122/97
cggcgaacugcga

SEQ ID NO: 3147667 - RNA, 21 nt, Mycobacterium bovis subsp bovis AF2122/97
cggcgaacugggugcggucuc

SEQ ID NO: 3147668 - RNA, 15 nt, Mycobacterium bovis subsp bovis AF2122/97
cggcgaagaccgccg

SEQ ID NO: 3147669 - RNA, 19 nt, Mycobacterium bovis subsp bovis AF2122/97
cggcgaagauaucggcacg

SEQ ID NO: 3147670 - RNA, 15 nt, Mycobacterium bovis subsp bovis AF2122/97
cggcgaagcacaccg

SEQ ID NO: 3147671 - RNA, 16 nt, Mycobacterium bovis subsp bovis AF2122/97
cggcgaagcacaccgu

SEQ ID NO: 3147672 - RNA, 19 nt, Mycobacterium bovis subsp bovis AF2122/97
cggcgaagcacaccguccg

SEQ ID NO: 3147673 - RNA, 23 nt, Mycobacterium bovis subsp bovis AF2122/97
cggcgaagcacaccguccgucgg

SEQ ID NO: 3147674 - RNA, 15 nt, Mycobacterium bovis subsp bovis AF2122/97
cggcgaagccggccg

SEQ ID NO: 3147675 - RNA, 13 nt, Mycobacterium bovis subsp bovis AF2122/97
cggcgaagccggg

SEQ ID NO: 3147676 - RNA, 18 nt, Mycobacterium bovis subsp bovis AF2122/97
cggcgaagcgggcgugcu

SEQ ID NO: 3147677 - RNA, 19 nt, Mycobacterium bovis subsp bovis AF2122/97
cggcgaagcgugcgccgac

SEQ ID NO: 3147678 - RNA, 20 nt, Mycobacterium bovis subsp bovis AF2122/97
cggcgaagcgugcgccgacu

SEQ ID NO: 3147679 - RNA, 19 nt, Mycobacterium bovis subsp bovis AF2122/97
cggcgaaggccgcgcgcag

SEQ ID NO: 3147680 - RNA, 20 nt, Mycobacterium bovis subsp bovis AF2122/97
cggcgaaggccgcgcgcagg

SEQ ID NO: 3147681 - RNA, 23 nt, Mycobacterium bovis subsp bovis AF2122/97
cggcgaaggguaagaguucgcgc

SEQ ID NO: 3147682 - RNA, 13 nt, Mycobacterium bovis subsp bovis AF2122/97
cggcgaagguagu

SEQ ID NO: 3147683 - RNA, 22 nt, Mycobacterium bovis subsp bovis AF2122/97
cggcgaagucacgcacccggcg

SEQ ID NO: 3147684 - RNA, 17 nt, Mycobacterium bovis subsp bovis AF2122/97
cggcgaagucgagugcc

SEQ ID NO: 3147685 - RNA, 23 nt, Mycobacterium bovis subsp bovis AF2122/97
cggcgaagucgagugccgcguca

SEQ ID NO: 3147686 - RNA, 14 nt, Mycobacterium bovis subsp bovis AF2122/97
cggcgaauacgacc

SEQ ID NO: 3147687 - RNA, 15 nt, Mycobacterium bovis subsp bovis AF2122/97
cggcgaauacgaccg

SEQ ID NO: 3147688 - RNA, 14 nt, Mycobacterium bovis subsp bovis AF2122/97
cggcgaaucgggca

SEQ ID NO: 3147689 - RNA, 15 nt, Mycobacterium bovis subsp bovis AF2122/97
cggcgaaucgggcaa

SEQ ID NO: 3147690 - RNA, 20 nt, Mycobacterium bovis subsp bovis AF2122/97
cggcgaaucgggcaaagucg

SEQ ID NO: 3147691 - RNA, 13 nt, Mycobacterium bovis subsp bovis AF2122/97
cggcgaaucggug

SEQ ID NO: 3147692 - RNA, 21 nt, Mycobacterium bovis subsp bovis AF2122/97
cggcgaaucgguggucgaugg

SEQ ID NO: 3147693 - RNA, 18 nt, Mycobacterium bovis subsp bovis AF2122/97
cggcgaaugccagugaca

SEQ ID NO: 3147694 - RNA, 17 nt, Mycobacterium bovis subsp bovis AF2122/97
cggcgaaugcgguccuc

SEQ ID NO: 3147695 - RNA, 22 nt, Mycobacterium bovis subsp bovis AF2122/97
cggcgaaugcgguccucgaucg

SEQ ID NO: 3147696 - RNA, 14 nt, Mycobacterium bovis subsp bovis AF2122/97
cggcgacaacagca

SEQ ID NO: 3147697 - RNA, 15 nt, Mycobacterium bovis subsp bovis AF2122/97
cggcgacaacagcac

SEQ ID NO: 3147698 - RNA, 17 nt, Mycobacterium bovis subsp bovis AF2122/97
cggcgacaacagcacgu

SEQ ID NO: 3147699 - RNA, 21 nt, Mycobacterium bovis subsp bovis AF2122/97
cggcgacaacagcacguacug

SEQ ID NO: 3147700 - RNA, 23 nt, Mycobacterium bovis subsp bovis AF2122/97
cggcgacaagccgagcccgucga

SEQ ID NO: 3147701 - RNA, 17 nt, Mycobacterium bovis subsp bovis AF2122/97
cggcgacacgccagccg

SEQ ID NO: 3147702 - RNA, 23 nt, Mycobacterium bovis subsp bovis AF2122/97
cggcgacacgccagccgugccgg

SEQ ID NO: 3147703 - RNA, 16 nt, Mycobacterium bovis subsp bovis AF2122/97
cggcgacacgccaggu

SEQ ID NO: 3147704 - RNA, 21 nt, Mycobacterium bovis subsp bovis AF2122/97
cggcgacacgccaggugaugc

SEQ ID NO: 3147705 - RNA, 20 nt, Mycobacterium bovis subsp bovis AF2122/97
cggcgacagcgcggcggucg

SEQ ID NO: 3147706 - RNA, 18 nt, Mycobacterium bovis subsp bovis AF2122/97
cggcgacagcuuggccgg

SEQ ID NO: 3147707 - RNA, 19 nt, Mycobacterium bovis subsp bovis AF2122/97
cggcgacagcuuggccggu

SEQ ID NO: 3147708 - RNA, 22 nt, Mycobacterium bovis subsp bovis AF2122/97
cggcgacagcuuggccgguuca

SEQ ID NO: 3147709 - RNA, 17 nt, Mycobacterium bovis subsp bovis AF2122/97
cggcgacaggccgagca

SEQ ID NO: 3147710 - RNA, 16 nt, Mycobacterium bovis subsp bovis AF2122/97
cggcgacauacccgau

SEQ ID NO: 3147711 - RNA, 20 nt, Mycobacterium bovis subsp bovis AF2122/97
cggcgacauccacaccgcgg

SEQ ID NO: 3147712 - RNA, 14 nt, Mycobacterium bovis subsp bovis AF2122/97
cggcgacaucggcc

SEQ ID NO: 3147713 - RNA, 20 nt, Mycobacterium bovis subsp bovis AF2122/97
cggcgacaucggcccgauca

SEQ ID NO: 3147714 - RNA, 15 nt, Mycobacterium bovis subsp bovis AF2122/97
cggcgaccaaggccg

SEQ ID NO: 3147715 - RNA, 15 nt, Mycobacterium bovis subsp bovis AF2122/97
cggcgaccaccagcg

SEQ ID NO: 3147716 - RNA, 16 nt, Mycobacterium bovis subsp bovis AF2122/97
cggcgaccaccagcgc

SEQ ID NO: 3147717 - RNA, 17 nt, Mycobacterium bovis subsp bovis AF2122/97
cggcgaccaccagcgcc

SEQ ID NO: 3147718 - RNA, 18 nt, Mycobacterium bovis subsp bovis AF2122/97
cggcgaccaccagcgccg

SEQ ID NO: 3147719 - RNA, 19 nt, Mycobacterium bovis subsp bovis AF2122/97
cggcgaccaccgcggcugc

SEQ ID NO: 3147720 - RNA, 20 nt, Mycobacterium bovis subsp bovis AF2122/97
cggcgaccaccgcggcugcu

SEQ ID NO: 3147721 - RNA, 22 nt, Mycobacterium bovis subsp bovis AF2122/97
cggcgaccaccgcggcugcucc

SEQ ID NO: 3147722 - RNA, 13 nt, Mycobacterium bovis subsp bovis AF2122/97
cggcgaccaccgu

SEQ ID NO: 3147723 - RNA, 17 nt, Mycobacterium bovis subsp bovis AF2122/97
cggcgaccaccguuuga

SEQ ID NO: 3147724 - RNA, 16 nt, Mycobacterium bovis subsp bovis AF2122/97
cggcgaccacgccgcc

SEQ ID NO: 3147725 - RNA, 17 nt, Mycobacterium bovis subsp bovis AF2122/97
cggcgaccacgccgccg

SEQ ID NO: 3147726 - RNA, 18 nt, Mycobacterium bovis subsp bovis AF2122/97
cggcgaccacgccgccgg

SEQ ID NO: 3147727 - RNA, 19 nt, Mycobacterium bovis subsp bovis AF2122/97
cggcgaccacgccgccggc

SEQ ID NO: 3147728 - RNA, 20 nt, Mycobacterium bovis subsp bovis AF2122/97
cggcgaccacgccgccggcg

SEQ ID NO: 3147729 - RNA, 22 nt, Mycobacterium bovis subsp bovis AF2122/97
cggcgaccacgccgccggcgcu

SEQ ID NO: 3147730 - RNA, 13 nt, Mycobacterium bovis subsp bovis AF2122/97
cggcgaccacggc

SEQ ID NO: 3147731 - RNA, 18 nt, Mycobacterium bovis subsp bovis AF2122/97
cggcgaccacggcaccga

SEQ ID NO: 3147732 - RNA, 19 nt, Mycobacterium bovis subsp bovis AF2122/97
cggcgaccacggcaccgau

SEQ ID NO: 3147733 - RNA, 16 nt, Mycobacterium bovis subsp bovis AF2122/97
cggcgaccagaaucuc

SEQ ID NO: 3147734 - RNA, 23 nt, Mycobacterium bovis subsp bovis AF2122/97
cggcgaccagaaucucgccgggc

SEQ ID NO: 3147735 - RNA, 19 nt, Mycobacterium bovis subsp bovis AF2122/97
cggcgaccagcucagcugc

SEQ ID NO: 3147736 - RNA, 20 nt, Mycobacterium bovis subsp bovis AF2122/97
cggcgaccagcucagcugcg

SEQ ID NO: 3147737 - RNA, 22 nt, Mycobacterium bovis subsp bovis AF2122/97
cggcgaccagcucagcugcgga

SEQ ID NO: 3147738 - RNA, 16 nt, Mycobacterium bovis subsp bovis AF2122/97
cggcgaccaggucggc

SEQ ID NO: 3147739 - RNA, 23 nt, Mycobacterium bovis subsp bovis AF2122/97
cggcgaccauaagcucguagagc

SEQ ID NO: 3147740 - RNA, 17 nt, Mycobacterium bovis subsp bovis AF2122/97
cggcgacucgaggaccu

SEQ ID NO: 3147741 - RNA, 23 nt, Mycobacterium bovis subsp bovis AF2122/97
cggcgacucgaggaccugcucgg

SEQ ID NO: 3147742 - RNA, 15 nt, Mycobacterium bovis subsp bovis AF2122/97
cggcgacucugcggg

SEQ ID NO: 3147743 - RNA, 14 nt, Mycobacterium bovis subsp bovis AF2122/97
cggcgacugcagcg

SEQ ID NO: 3147744 - RNA, 16 nt, Mycobacterium bovis subsp bovis AF2122/97
cggcgacugcgcaccu

SEQ ID NO: 3147745 - RNA, 20 nt, Mycobacterium bovis subsp bovis AF2122/97
cggcgacugcgcaccugggu

SEQ ID NO: 3147746 - RNA, 19 nt, Mycobacterium bovis subsp bovis AF2122/97
cggcgacugcgucggcggc

SEQ ID NO: 3147747 - RNA, 13 nt, Mycobacterium bovis subsp bovis AF2122/97
cggcgacuguccc

SEQ ID NO: 3147748 - RNA, 17 nt, Mycobacterium bovis subsp bovis AF2122/97
cggcgacuugcuuggug

SEQ ID NO: 3147749 - RNA, 18 nt, Mycobacterium bovis subsp bovis AF2122/97
cggcgagaagucgcagcg

SEQ ID NO: 3147750 - RNA, 17 nt, Mycobacterium bovis subsp bovis AF2122/97
cggcgagagccucggcc

SEQ ID NO: 3147751 - RNA, 18 nt, Mycobacterium bovis subsp bovis AF2122/97
cggcgagagccucggcca

SEQ ID NO: 3147752 - RNA, 21 nt, Mycobacterium bovis subsp bovis AF2122/97
cggcgagagcgucaaccacgg

SEQ ID NO: 3147753 - RNA, 18 nt, Mycobacterium bovis subsp bovis AF2122/97
cggcgagagggcggggca

SEQ ID NO: 3147754 - RNA, 23 nt, Mycobacterium bovis subsp bovis AF2122/97
cggcgagagggcggggcagaagu

SEQ ID NO: 3147755 - RNA, 21 nt, Mycobacterium bovis subsp bovis AF2122/97
cggcgagcaauuccucagccg

SEQ ID NO: 3147756 - RNA, 19 nt, Mycobacterium bovis subsp bovis AF2122/97
cggcgagcacaugcugccg

SEQ ID NO: 3147757 - RNA, 11 nt, Mycobacterium bovis subsp bovis AF2122/97
cggcgagcacc

SEQ ID NO: 3147758 - RNA, 22 nt, Mycobacterium bovis subsp bovis AF2122/97
cggcgagcaccaccccagcggc

SEQ ID NO: 3147759 - RNA, 14 nt, Mycobacterium bovis subsp bovis AF2122/97
cggcgagcacccgc

SEQ ID NO: 3147760 - RNA, 17 nt, Mycobacterium bovis subsp bovis AF2122/97
cggcgagcacccgcugg

SEQ ID NO: 3147761 - RNA, 19 nt, Mycobacterium bovis subsp bovis AF2122/97
cggcgagcacccgcugguc

SEQ ID NO: 3147762 - RNA, 12 nt, Mycobacterium bovis subsp bovis AF2122/97
cggcgagcaccg

SEQ ID NO: 3147763 - RNA, 15 nt, Mycobacterium bovis subsp bovis AF2122/97
cggcgagcacgcggg

SEQ ID NO: 3147764 - RNA, 16 nt, Mycobacterium bovis subsp bovis AF2122/97
cggcgagcacgcgggc

SEQ ID NO: 3147765 - RNA, 22 nt, Mycobacterium bovis subsp bovis AF2122/97
cggcgagcacgucacgcgcggc

SEQ ID NO: 3147766 - RNA, 20 nt, Mycobacterium bovis subsp bovis AF2122/97
cggcgagcagacgcaaaagc

SEQ ID NO: 3147767 - RNA, 14 nt, Mycobacterium bovis subsp bovis AF2122/97
cggcgagcagagaa

SEQ ID NO: 3147768 - RNA, 23 nt, Mycobacterium bovis subsp bovis AF2122/97
cggcgagcagagaacuccgccac

SEQ ID NO: 3147769 - RNA, 15 nt, Mycobacterium bovis subsp bovis AF2122/97
cggcgagcagcaggu

SEQ ID NO: 3147770 - RNA, 14 nt, Mycobacterium bovis subsp bovis AF2122/97
cggcgagcaggccg

SEQ ID NO: 3147771 - RNA, 15 nt, Mycobacterium bovis subsp bovis AF2122/97
cggcgagcaucucga

SEQ ID NO: 3147772 - RNA, 18 nt, Mycobacterium bovis subsp bovis AF2122/97
cggcgagcaucucgacau

SEQ ID NO: 3147773 - RNA, 16 nt, Mycobacterium bovis subsp bovis AF2122/97
cggcgagcccgcaucg

SEQ ID NO: 3147774 - RNA, 14 nt, Mycobacterium bovis subsp bovis AF2122/97
cggcgagccgcgcc

SEQ ID NO: 3147775 - RNA, 15 nt, Mycobacterium bovis subsp bovis AF2122/97
cggcgagccgcgccc

SEQ ID NO: 3147776 - RNA, 17 nt, Mycobacterium bovis subsp bovis AF2122/97
cggcgagcgcaucggcc

SEQ ID NO: 3147777 - RNA, 19 nt, Mycobacterium bovis subsp bovis AF2122/97
cggcgagcgcaucggccaa

SEQ ID NO: 3147778 - RNA, 13 nt, Mycobacterium bovis subsp bovis AF2122/97
cggcgagcgcccu

SEQ ID NO: 3147779 - RNA, 21 nt, Mycobacterium bovis subsp bovis AF2122/97
cggcgagcgcccuggcgugug

SEQ ID NO: 3147780 - RNA, 22 nt, Mycobacterium bovis subsp bovis AF2122/97
cggcgagcgcccuggcgugugu

SEQ ID NO: 3147781 - RNA, 15 nt, Mycobacterium bovis subsp bovis AF2122/97
cggcgagcgcgaugc

SEQ ID NO: 3147782 - RNA, 13 nt, Mycobacterium bovis subsp bovis AF2122/97
cggcgagcgucgg

SEQ ID NO: 3147783 - RNA, 15 nt, Mycobacterium bovis subsp bovis AF2122/97
cggcgagcgucgggc

SEQ ID NO: 3147784 - RNA, 17 nt, Mycobacterium bovis subsp bovis AF2122/97
cggcgagcuccgaugcc

SEQ ID NO: 3147785 - RNA, 22 nt, Mycobacterium bovis subsp bovis AF2122/97
cggcgagcucggccccgccgcc

SEQ ID NO: 3147786 - RNA, 18 nt, Mycobacterium bovis subsp bovis AF2122/97
cggcgaggaacuggaccg

SEQ ID NO: 3147787 - RNA, 17 nt, Mycobacterium bovis subsp bovis AF2122/97
cggcgaggacgcgcccg

SEQ ID NO: 3147788 - RNA, 15 nt, Mycobacterium bovis subsp bovis AF2122/97
cggcgaggccgaacu

SEQ ID NO: 3147789 - RNA, 19 nt, Mycobacterium bovis subsp bovis AF2122/97
cggcgaggccucggcggcc

SEQ ID NO: 3147790 - RNA, 18 nt, Mycobacterium bovis subsp bovis AF2122/97
cggcgaggcggucgccga

SEQ ID NO: 3147791 - RNA, 20 nt, Mycobacterium bovis subsp bovis AF2122/97
cggcgaggcggucgccgaau

SEQ ID NO: 3147792 - RNA, 14 nt, Mycobacterium bovis subsp bovis AF2122/97
cggcgagggccacg

SEQ ID NO: 3147793 - RNA, 14 nt, Mycobacterium bovis subsp bovis AF2122/97
cggcgagggcgguc

SEQ ID NO: 3147794 - RNA, 20 nt, Mycobacterium bovis subsp bovis AF2122/97
cggcgagggcggucagcggc

SEQ ID NO: 3147795 - RNA, 22 nt, Mycobacterium bovis subsp bovis AF2122/97
cggcgagggcggucagcggcca

SEQ ID NO: 3147796 - RNA, 22 nt, Mycobacterium bovis subsp bovis AF2122/97
cggcgaggucccggccgagcgu

SEQ ID NO: 3147797 - RNA, 23 nt, Mycobacterium bovis subsp bovis AF2122/97
cggcgaggugcccaaggccagga

SEQ ID NO: 3147798 - RNA, 15 nt, Mycobacterium bovis subsp bovis AF2122/97
cggcgagucgguugu

SEQ ID NO: 3147799 - RNA, 19 nt, Mycobacterium bovis subsp bovis AF2122/97
cggcgagucgguugucggg

SEQ ID NO: 3147800 - RNA, 14 nt, Mycobacterium bovis subsp bovis AF2122/97
cggcgagugcuguc

SEQ ID NO: 3147801 - RNA, 15 nt, Mycobacterium bovis subsp bovis AF2122/97
cggcgagugcugucg

SEQ ID NO: 3147802 - RNA, 13 nt, Mycobacterium bovis subsp bovis AF2122/97
cggcgaguggcuc

SEQ ID NO: 3147803 - RNA, 19 nt, Mycobacterium bovis subsp bovis AF2122/97
cggcgagugguccagccag

SEQ ID NO: 3147804 - RNA, 21 nt, Mycobacterium bovis subsp bovis AF2122/97
cggcgagugguccagccagau

SEQ ID NO: 3147805 - RNA, 20 nt, Mycobacterium bovis subsp bovis AF2122/97
cggcgaguucggcagcgggc

SEQ ID NO: 3147806 - RNA, 21 nt, Mycobacterium bovis subsp bovis AF2122/97
cggcgauaccgaggaucucgc

SEQ ID NO: 3147807 - RNA, 24 nt, Mycobacterium bovis subsp bovis AF2122/97
cggcgauaccgaggaucucgcggu

SEQ ID NO: 3147808 - RNA, 14 nt, Mycobacterium bovis subsp bovis AF2122/97
cggcgauaccgguu

SEQ ID NO: 3147809 - RNA, 16 nt, Mycobacterium bovis subsp bovis AF2122/97
cggcgauaccgguugc

SEQ ID NO: 3147810 - RNA, 21 nt, Mycobacterium bovis subsp bovis AF2122/97
cggcgauauaggacgccgcgc

SEQ ID NO: 3147811 - RNA, 17 nt, Mycobacterium bovis subsp bovis AF2122/97
cggcgaucaacgcgcac

SEQ ID NO: 3147812 - RNA, 18 nt, Mycobacterium bovis subsp bovis AF2122/97
cggcgaucaacucgggca

SEQ ID NO: 3147813 - RNA, 20 nt, Mycobacterium bovis subsp bovis AF2122/97
cggcgaucaacucgggcagc

SEQ ID NO: 3147814 - RNA, 21 nt, Mycobacterium bovis subsp bovis AF2122/97
cggcgaucaacucgggcagcg

SEQ ID NO: 3147815 - RNA, 13 nt, Mycobacterium bovis subsp bovis AF2122/97
cggcgaucaccgu

SEQ ID NO: 3147816 - RNA, 13 nt, Mycobacterium bovis subsp bovis AF2122/97
cggcgaucacgcg

SEQ ID NO: 3147817 - RNA, 14 nt, Mycobacterium bovis subsp bovis AF2122/97
cggcgaucacgcga

SEQ ID NO: 3147818 - RNA, 22 nt, Mycobacterium bovis subsp bovis AF2122/97
cggcgaucaggcggacgggacg

SEQ ID NO: 3147819 - RNA, 12 nt, Mycobacterium bovis subsp bovis AF2122/97
cggcgauccgac

SEQ ID NO: 3147820 - RNA, 21 nt, Mycobacterium bovis subsp bovis AF2122/97
cggcgauccggucggccaggc

SEQ ID NO: 3147821 - RNA, 22 nt, Mycobacterium bovis subsp bovis AF2122/97
cggcgaucgaggugacggugac

SEQ ID NO: 3147822 - RNA, 15 nt, Mycobacterium bovis subsp bovis AF2122/97
cggcgaucgcauggu

SEQ ID NO: 3147823 - RNA, 15 nt, Mycobacterium bovis subsp bovis AF2122/97
cggcgaucgcuccgc

SEQ ID NO: 3147824 - RNA, 20 nt, Mycobacterium bovis subsp bovis AF2122/97
cggcgaucgcuccgcggcgc

SEQ ID NO: 3147825 - RNA, 18 nt, Mycobacterium bovis subsp bovis AF2122/97
cggcgaucggaggcccgc

SEQ ID NO: 3147826 - RNA, 23 nt, Mycobacterium bovis subsp bovis AF2122/97
cggcgcaguuuccguucgacauc

SEQ ID NO: 3147827 - RNA, 15 nt, Mycobacterium bovis subsp bovis AF2122/97
cggcgcauaggcggc

SEQ ID NO: 3147828 - RNA, 22 nt, Mycobacterium bovis subsp bovis AF2122/97
cggcgcaucaccacccgaccgc

SEQ ID NO: 3147829 - RNA, 15 nt, Mycobacterium bovis subsp bovis AF2122/97
cggcgcaugcaaguc

SEQ ID NO: 3147830 - RNA, 16 nt, Mycobacterium bovis subsp bovis AF2122/97
cggcgcaugcguaugc

SEQ ID NO: 3147831 - RNA, 23 nt, Mycobacterium bovis subsp bovis AF2122/97
cggcgcauucccuugucggucga

SEQ ID NO: 3147832 - RNA, 17 nt, Mycobacterium bovis subsp bovis AF2122/97
cggcgcauuccggcgcc

SEQ ID NO: 3147833 - RNA, 19 nt, Mycobacterium bovis subsp bovis AF2122/97
cggcgcauuccggcgccag

SEQ ID NO: 3147834 - RNA, 18 nt, Mycobacterium bovis subsp bovis AF2122/97
cggcgccaauucagcggc

SEQ ID NO: 3147835 - RNA, 21 nt, Mycobacterium bovis subsp bovis AF2122/97
cggcgccaauucagcggcaac

SEQ ID NO: 3147836 - RNA, 17 nt, Mycobacterium bovis subsp bovis AF2122/97
cggcgccacccccaccg

SEQ ID NO: 3147837 - RNA, 18 nt, Mycobacterium bovis subsp bovis AF2122/97
cggcgccacccgcgccgc

SEQ ID NO: 3147838 - RNA, 21 nt, Mycobacterium bovis subsp bovis AF2122/97
cggcgccacccgcgccgcccg

SEQ ID NO: 3147839 - RNA, 15 nt, Mycobacterium bovis subsp bovis AF2122/97
cggcgccaccgccgc

SEQ ID NO: 3147840 - RNA, 16 nt, Mycobacterium bovis subsp bovis AF2122/97
cggcgccaccgccgcu

SEQ ID NO: 3147841 - RNA, 20 nt, Mycobacterium bovis subsp bovis AF2122/97
cggcgccaccgccgcugccg

SEQ ID NO: 3147842 - RNA, 22 nt, Mycobacterium bovis subsp bovis AF2122/97
cggcgccaccgccgcugccggu

SEQ ID NO: 3147843 - RNA, 17 nt, Mycobacterium bovis subsp bovis AF2122/97
cggcgccaccggcgccg

SEQ ID NO: 3147844 - RNA, 18 nt, Mycobacterium bovis subsp bovis AF2122/97
cggcgccaccggcgccgc

SEQ ID NO: 3147845 - RNA, 19 nt, Mycobacterium bovis subsp bovis AF2122/97
cggcgccaccggcgccgcc

SEQ ID NO: 3147846 - RNA, 20 nt, Mycobacterium bovis subsp bovis AF2122/97
cggcgccaccggcgccgccc

SEQ ID NO: 3147847 - RNA, 19 nt, Mycobacterium bovis subsp bovis AF2122/97
cggcgccaccgucaccgcc

SEQ ID NO: 3147848 - RNA, 20 nt, Mycobacterium bovis subsp bovis AF2122/97
cggcgccaccgucaccgccg

SEQ ID NO: 3147849 - RNA, 23 nt, Mycobacterium bovis subsp bovis AF2122/97
cggcgccaccgucaccgccguug

SEQ ID NO: 3147850 - RNA, 19 nt, Mycobacterium bovis subsp bovis AF2122/97
cggcgccaccgucgccgua

SEQ ID NO: 3147851 - RNA, 18 nt, Mycobacterium bovis subsp bovis AF2122/97
cggcgccaccguggugga

SEQ ID NO: 3147852 - RNA, 17 nt, Mycobacterium bovis subsp bovis AF2122/97
cggcgccaccguugccg

SEQ ID NO: 3147853 - RNA, 16 nt, Mycobacterium bovis subsp bovis AF2122/97
cggcgccagaucgacg

SEQ ID NO: 3147854 - RNA, 19 nt, Mycobacterium bovis subsp bovis AF2122/97
cggcgccagaucgacgcca

SEQ ID NO: 3147855 - RNA, 14 nt, Mycobacterium bovis subsp bovis AF2122/97
cggcgccagaugcc

SEQ ID NO: 3147856 - RNA, 16 nt, Mycobacterium bovis subsp bovis AF2122/97
cggcgccagcgccgcc

SEQ ID NO: 3147857 - RNA, 17 nt, Mycobacterium bovis subsp bovis AF2122/97
cggcgccagcgccgcca

SEQ ID NO: 3147858 - RNA, 18 nt, Mycobacterium bovis subsp bovis AF2122/97
cggcgccagcgccgccac

SEQ ID NO: 3147859 - RNA, 20 nt, Mycobacterium bovis subsp bovis AF2122/97
cggcgccagcgccgccaccg

SEQ ID NO: 3147860 - RNA, 15 nt, Mycobacterium bovis subsp bovis AF2122/97
cggcgccaggcacca

SEQ ID NO: 3147861 - RNA, 16 nt, Mycobacterium bovis subsp bovis AF2122/97
cggcgccaggcaccac

SEQ ID NO: 3147862 - RNA, 19 nt, Mycobacterium bovis subsp bovis AF2122/97
cggcgccaggcaccacgac

SEQ ID NO: 3147863 - RNA, 20 nt, Mycobacterium bovis subsp bovis AF2122/97
cggcgccaggcaccacgacc

SEQ ID NO: 3147864 - RNA, 17 nt, Mycobacterium bovis subsp bovis AF2122/97
cggcgccaguauggccg

SEQ ID NO: 3147865 - RNA, 23 nt, Mycobacterium bovis subsp bovis AF2122/97
cggcgccaguauggccgccaccg

SEQ ID NO: 3147866 - RNA, 17 nt, Mycobacterium bovis subsp bovis AF2122/97
cggcgccauagccgcga

SEQ ID NO: 3147867 - RNA, 18 nt, Mycobacterium bovis subsp bovis AF2122/97
cggcgccauagccgcgac

SEQ ID NO: 3147868 - RNA, 22 nt, Mycobacterium bovis subsp bovis AF2122/97
cggcgccauagccgcgacccgc

SEQ ID NO: 3147869 - RNA, 23 nt, Mycobacterium bovis subsp bovis AF2122/97
cggcgccauagccgcgacccgcg

SEQ ID NO: 3147870 - RNA, 21 nt, Mycobacterium bovis subsp bovis AF2122/97
cggcgccauggaucccacgag

SEQ ID NO: 3147871 - RNA, 17 nt, Mycobacterium bovis subsp bovis AF2122/97
cggcgccauuggcgucc

SEQ ID NO: 3147872 - RNA, 16 nt, Mycobacterium bovis subsp bovis AF2122/97
cggcgcccacaucguc

SEQ ID NO: 3147873 - RNA, 14 nt, Mycobacterium bovis subsp bovis AF2122/97
cggcgcccagcgcc

SEQ ID NO: 3147874 - RNA, 15 nt, Mycobacterium bovis subsp bovis AF2122/97
cggcgcccagcgccu

SEQ ID NO: 3147875 - RNA, 18 nt, Mycobacterium bovis subsp bovis AF2122/97
cggcgcccagcgccucga

SEQ ID NO: 3147876 - RNA, 14 nt, Mycobacterium bovis subsp bovis AF2122/97
cggcgcccagcucg

SEQ ID NO: 3147877 - RNA, 18 nt, Mycobacterium bovis subsp bovis AF2122/97
cggcgcccagcucgucga

SEQ ID NO: 3147878 - RNA, 15 nt, Mycobacterium bovis subsp bovis AF2122/97
cggcgcccaggaacu

SEQ ID NO: 3147879 - RNA, 12 nt, Mycobacterium bovis subsp bovis AF2122/97
cggcgcccaggc

SEQ ID NO: 3147880 - RNA, 14 nt, Mycobacterium bovis subsp bovis AF2122/97
cggcgcccaggccg

SEQ ID NO: 3147881 - RNA, 17 nt, Mycobacterium bovis subsp bovis AF2122/97
cggcgcccaggccgauc

SEQ ID NO: 3147882 - RNA, 20 nt, Mycobacterium bovis subsp bovis AF2122/97
cggcgcccaggccgaucagc

SEQ ID NO: 3147883 - RNA, 18 nt, Mycobacterium bovis subsp bovis AF2122/97
cggcgcccauagcaccuc

SEQ ID NO: 3147884 - RNA, 15 nt, Mycobacterium bovis subsp bovis AF2122/97
cggcgcccaucgcga

SEQ ID NO: 3147885 - RNA, 23 nt, Mycobacterium bovis subsp bovis AF2122/97
cggcgcccgagauccccaaaucg

SEQ ID NO: 3147886 - RNA, 13 nt, Mycobacterium bovis subsp bovis AF2122/97
cggcgcccgccac

SEQ ID NO: 3147887 - RNA, 15 nt, Mycobacterium bovis subsp bovis AF2122/97
cggcgcccgccaccg

SEQ ID NO: 3147888 - RNA, 17 nt, Mycobacterium bovis subsp bovis AF2122/97
cggcgcccgccaccgga

SEQ ID NO: 3147889 - RNA, 14 nt, Mycobacterium bovis subsp bovis AF2122/97
cggcgcccgcccga

SEQ ID NO: 3147890 - RNA, 13 nt, Mycobacterium bovis subsp bovis AF2122/97
cggcgcccgccgc

SEQ ID NO: 3147891 - RNA, 17 nt, Mycobacterium bovis subsp bovis AF2122/97
cggcgcccgccgcgaac

SEQ ID NO: 3147892 - RNA, 16 nt, Mycobacterium bovis subsp bovis AF2122/97
cggcgcccgcucggcc

SEQ ID NO: 3147893 - RNA, 19 nt, Mycobacterium bovis subsp bovis AF2122/97
cggcgcccgcucggccgca

SEQ ID NO: 3147894 - RNA, 13 nt, Mycobacterium bovis subsp bovis AF2122/97
cggcgcccggcgg

SEQ ID NO: 3147895 - RNA, 13 nt, Mycobacterium bovis subsp bovis AF2122/97
cggcgcccggcuu

SEQ ID NO: 3147896 - RNA, 14 nt, Mycobacterium bovis subsp bovis AF2122/97
cggcgcccggggcg

SEQ ID NO: 3147897 - RNA, 17 nt, Mycobacterium bovis subsp bovis AF2122/97
cggcgcccggucgagcc

SEQ ID NO: 3147898 - RNA, 17 nt, Mycobacterium bovis subsp bovis AF2122/97
cggcgcccuccuuggcg

SEQ ID NO: 3147899 - RNA, 20 nt, Mycobacterium bovis subsp bovis AF2122/97
cggcgcccuccuuggcguug

SEQ ID NO: 3147900 - RNA, 16 nt, Mycobacterium bovis subsp bovis AF2122/97
cggcgcccuggccgcc

SEQ ID NO: 3147901 - RNA, 17 nt, Mycobacterium bovis subsp bovis AF2122/97
cggcgcccuggccgccc

SEQ ID NO: 3147902 - RNA, 21 nt, Mycobacterium bovis subsp bovis AF2122/97
cggcgcccuggccgcccuggc

SEQ ID NO: 3147903 - RNA, 16 nt, Mycobacterium bovis subsp bovis AF2122/97
cggcgccgaacccggu

SEQ ID NO: 3147904 - RNA, 22 nt, Mycobacterium bovis subsp bovis AF2122/97
cggcgccgaagagucgugccgc

SEQ ID NO: 3147905 - RNA, 23 nt, Mycobacterium bovis subsp bovis AF2122/97
cggcgccgaagagucgugccgcc

SEQ ID NO: 3147906 - RNA, 14 nt, Mycobacterium bovis subsp bovis AF2122/97
cggcgccgagcagc

SEQ ID NO: 3147907 - RNA, 15 nt, Mycobacterium bovis subsp bovis AF2122/97
cggcgccgaggucga

SEQ ID NO: 3147908 - RNA, 16 nt, Mycobacterium bovis subsp bovis AF2122/97
cggcgccgcaccaagc

SEQ ID NO: 3147909 - RNA, 18 nt, Mycobacterium bovis subsp bovis AF2122/97
cggcgccgcagaucaccg

SEQ ID NO: 3147910 - RNA, 20 nt, Mycobacterium bovis subsp bovis AF2122/97
cggcgccgcagaucaccgcc

SEQ ID NO: 3147911 - RNA, 21 nt, Mycobacterium bovis subsp bovis AF2122/97
cggcgccgcagaucaccgcca

SEQ ID NO: 3147912 - RNA, 20 nt, Mycobacterium bovis subsp bovis AF2122/97
cggcgccuggcggcgccgca

SEQ ID NO: 3147913 - RNA, 21 nt, Mycobacterium bovis subsp bovis AF2122/97
cggcgccuggcggcgccgcag

SEQ ID NO: 3147914 - RNA, 17 nt, Mycobacterium bovis subsp bovis AF2122/97
cggcgccuuggucgccg

SEQ ID NO: 3147915 - RNA, 19 nt, Mycobacterium bovis subsp bovis AF2122/97
cggcgccuuggucgccgcc

SEQ ID NO: 3147916 - RNA, 20 nt, Mycobacterium bovis subsp bovis AF2122/97
cggcgcgaagucuugaccgc

SEQ ID NO: 3147917 - RNA, 22 nt, Mycobacterium bovis subsp bovis AF2122/97
cggcgcgaagucuugaccgcac

SEQ ID NO: 3147918 - RNA, 15 nt, Mycobacterium bovis subsp bovis AF2122/97
cggcgcgacgcccga

SEQ ID NO: 3147919 - RNA, 13 nt, Mycobacterium bovis subsp bovis AF2122/97
cggcgcgagccgc

SEQ ID NO: 3147920 - RNA, 18 nt, Mycobacterium bovis subsp bovis AF2122/97
cggcgcgagccgcacgau

SEQ ID NO: 3147921 - RNA, 15 nt, Mycobacterium bovis subsp bovis AF2122/97
cggcgcgagccggcu

SEQ ID NO: 3147922 - RNA, 16 nt, Mycobacterium bovis subsp bovis AF2122/97
cggcgcgagccggcuc

SEQ ID NO: 3147923 - RNA, 15 nt, Mycobacterium bovis subsp bovis AF2122/97
cggcgcgaggaacgc

SEQ ID NO: 3147924 - RNA, 16 nt, Mycobacterium bovis subsp bovis AF2122/97
cggcgcgaggaacgcc

SEQ ID NO: 3147925 - RNA, 18 nt, Mycobacterium bovis subsp bovis AF2122/97
cggcgcgaggaacgccgg

SEQ ID NO: 3147926 - RNA, 21 nt, Mycobacterium bovis subsp bovis AF2122/97
cggcgcgaggaacgccggggc

SEQ ID NO: 3147927 - RNA, 18 nt, Mycobacterium bovis subsp bovis AF2122/97
cggcgcgauccccgcgcu

SEQ ID NO: 3147928 - RNA, 18 nt, Mycobacterium bovis subsp bovis AF2122/97
cggcgcgaucgacgcucg

SEQ ID NO: 3147929 - RNA, 15 nt, Mycobacterium bovis subsp bovis AF2122/97
cggcgcgaucgucgg

SEQ ID NO: 3147930 - RNA, 12 nt, Mycobacterium bovis subsp bovis AF2122/97
cggcgcgcaccc

SEQ ID NO: 3147931 - RNA, 14 nt, Mycobacterium bovis subsp bovis AF2122/97
cggcgcgcaccccg

SEQ ID NO: 3147932 - RNA, 15 nt, Mycobacterium bovis subsp bovis AF2122/97
cggcgcgcaccucgg

SEQ ID NO: 3147933 - RNA, 18 nt, Mycobacterium bovis subsp bovis AF2122/97
cggcgcgcaccucggcga

SEQ ID NO: 3147934 - RNA, 13 nt, Mycobacterium bovis subsp bovis AF2122/97
cggcgcgcagccg

SEQ ID NO: 3147935 - RNA, 14 nt, Mycobacterium bovis subsp bovis AF2122/97
cggcgcgcagccgg

SEQ ID NO: 3147936 - RNA, 15 nt, Mycobacterium bovis subsp bovis AF2122/97
cggcgcgcagccggg

SEQ ID NO: 3147937 - RNA, 14 nt, Mycobacterium bovis subsp bovis AF2122/97
cggcgcgcagcgau

SEQ ID NO: 3147938 - RNA, 15 nt, Mycobacterium bovis subsp bovis AF2122/97
cggcgcgcaggaccu

SEQ ID NO: 3147939 - RNA, 19 nt, Mycobacterium bovis subsp bovis AF2122/97
cggcgcgccaaacaccccg

SEQ ID NO: 3147940 - RNA, 21 nt, Mycobacterium bovis subsp bovis AF2122/97
cggcgcgccaaacaccccggc

SEQ ID NO: 3147941 - RNA, 15 nt, Mycobacterium bovis subsp bovis AF2122/97
cggcgcgccccaccg

SEQ ID NO: 3147942 - RNA, 16 nt, Mycobacterium bovis subsp bovis AF2122/97
cggcgcgccccaccgc

SEQ ID NO: 3147943 - RNA, 22 nt, Mycobacterium bovis subsp bovis AF2122/97
cggcgcgccccaccgcgccgag

SEQ ID NO: 3147944 - RNA, 12 nt, Mycobacterium bovis subsp bovis AF2122/97
cggcgcgccccg

SEQ ID NO: 3147945 - RNA, 16 nt, Mycobacterium bovis subsp bovis AF2122/97
cggcgcgccccgccgc

SEQ ID NO: 3147946 - RNA, 14 nt, Mycobacterium bovis subsp bovis AF2122/97
cggcgcgccgacca

SEQ ID NO: 3147947 - RNA, 21 nt, Mycobacterium bovis subsp bovis AF2122/97
cggcgcgccgaguugcccggg

SEQ ID NO: 3147948 - RNA, 16 nt, Mycobacterium bovis subsp bovis AF2122/97
cggcgcgccgggcggc

SEQ ID NO: 3147949 - RNA, 14 nt, Mycobacterium bovis subsp bovis AF2122/97
cggcgcgccggucg

SEQ ID NO: 3147950 - RNA, 14 nt, Mycobacterium bovis subsp bovis AF2122/97
cggcgcgcgcgccg

SEQ ID NO: 3147951 - RNA, 16 nt, Mycobacterium bovis subsp bovis AF2122/97
cggcgcgcgcgccggc

SEQ ID NO: 3147952 - RNA, 17 nt, Mycobacterium bovis subsp bovis AF2122/97
cggcgcgcgcgccggcu

SEQ ID NO: 3147953 - RNA, 18 nt, Mycobacterium bovis subsp bovis AF2122/97
cggcgcgcgcgccggcug

SEQ ID NO: 3147954 - RNA, 14 nt, Mycobacterium bovis subsp bovis AF2122/97
cggcgcggaacgcg

SEQ ID NO: 3147955 - RNA, 23 nt, Mycobacterium bovis subsp bovis AF2122/97
cggcgcggaacgcgucgccgacg

SEQ ID NO: 3147956 - RNA, 22 nt, Mycobacterium bovis subsp bovis AF2122/97
cggcgcggagagccugcucgca

SEQ ID NO: 3147957 - RNA, 14 nt, Mycobacterium bovis subsp bovis AF2122/97
cggcgcggagugcc

SEQ ID NO: 3147958 - RNA, 14 nt, Mycobacterium bovis subsp bovis AF2122/97
cggcgcggccagcu

SEQ ID NO: 3147959 - RNA, 14 nt, Mycobacterium bovis subsp bovis AF2122/97
cggcgcggccgcaa

SEQ ID NO: 3147960 - RNA, 20 nt, Mycobacterium bovis subsp bovis AF2122/97
cggcgcggccgcagccagca

SEQ ID NO: 3147961 - RNA, 13 nt, Mycobacterium bovis subsp bovis AF2122/97
cggcgcggccggc

SEQ ID NO: 3147962 - RNA, 17 nt, Mycobacterium bovis subsp bovis AF2122/97
cggcgcggccggccgcu

SEQ ID NO: 3147963 - RNA, 21 nt, Mycobacterium bovis subsp bovis AF2122/97
cggcgcggccggccgcucacc

SEQ ID NO: 3147964 - RNA, 12 nt, Mycobacterium bovis subsp bovis AF2122/97
cggcgcggccgu

SEQ ID NO: 3147965 - RNA, 14 nt, Mycobacterium bovis subsp bovis AF2122/97
cggcgcggccguga

SEQ ID NO: 3147966 - RNA, 12 nt, Mycobacterium bovis subsp bovis AF2122/97
cggcgcggcgga

SEQ ID NO: 3147967 - RNA, 16 nt, Mycobacterium bovis subsp bovis AF2122/97
cggcgcggcggaccgu

SEQ ID NO: 3147968 - RNA, 15 nt, Mycobacterium bovis subsp bovis AF2122/97
cggcgcgggccacca

SEQ ID NO: 3147969 - RNA, 22 nt, Mycobacterium bovis subsp bovis AF2122/97
cggcgcgggccaccacgcgccg

SEQ ID NO: 3147970 - RNA, 24 nt, Mycobacterium bovis subsp bovis AF2122/97
cggcgcgggccaccacgcgccgca

SEQ ID NO: 3147971 - RNA, 17 nt, Mycobacterium bovis subsp bovis AF2122/97
cggcgcgggucggcgac

SEQ ID NO: 3147972 - RNA, 15 nt, Mycobacterium bovis subsp bovis AF2122/97
cggcgcgggugcgga

SEQ ID NO: 3147973 - RNA, 21 nt, Mycobacterium bovis subsp bovis AF2122/97
cggcgcgguggggcgcgccgg

SEQ ID NO: 3147974 - RNA, 21 nt, Mycobacterium bovis subsp bovis AF2122/97
cggcgcgguuucggcgucacc

SEQ ID NO: 3147975 - RNA, 22 nt, Mycobacterium bovis subsp bovis AF2122/97
cggcgcguacggaaccaccgga

SEQ ID NO: 3147976 - RNA, 14 nt, Mycobacterium bovis subsp bovis AF2122/97
cggcgcguccgggc

SEQ ID NO: 3147977 - RNA, 21 nt, Mycobacterium bovis subsp bovis AF2122/97
cggcgcguccgggcucgcgcu

SEQ ID NO: 3147978 - RNA, 14 nt, Mycobacterium bovis subsp bovis AF2122/97
cggcgcgucgcgga

SEQ ID NO: 3147979 - RNA, 16 nt, Mycobacterium bovis subsp bovis AF2122/97
cggcgcgucguugccg

SEQ ID NO: 3147980 - RNA, 13 nt, Mycobacterium bovis subsp bovis AF2122/97
cggcgcgugcggu

SEQ ID NO: 3147981 - RNA, 19 nt, Mycobacterium bovis subsp bovis AF2122/97
cggcgcguggugccuacac

SEQ ID NO: 3147982 - RNA, 21 nt, Mycobacterium bovis subsp bovis AF2122/97
cggcgcguucgucgucgcuga

SEQ ID NO: 3147983 - RNA, 19 nt, Mycobacterium bovis subsp bovis AF2122/97
cggcgcguugggaccagug

SEQ ID NO: 3147984 - RNA, 15 nt, Mycobacterium bovis subsp bovis AF2122/97
cggcgcuagcgccgc

SEQ ID NO: 3147985 - RNA, 17 nt, Mycobacterium bovis subsp bovis AF2122/97
cggcgcucaaugcgguc

SEQ ID NO: 3147986 - RNA, 22 nt, Mycobacterium bovis subsp bovis AF2122/97
cggcgcucacgggcgaucgugc

SEQ ID NO: 3147987 - RNA, 22 nt, Mycobacterium bovis subsp bovis AF2122/97
cggcgcuccaacgcacacaccg

SEQ ID NO: 3147988 - RNA, 17 nt, Mycobacterium bovis subsp bovis AF2122/97
cggcgcuccacugacca

SEQ ID NO: 3147989 - RNA, 15 nt, Mycobacterium bovis subsp bovis AF2122/97
cggcgcuccgccaga

SEQ ID NO: 3147990 - RNA, 13 nt, Mycobacterium bovis subsp bovis AF2122/97
cggcgcucggcca

SEQ ID NO: 3147991 - RNA, 13 nt, Mycobacterium bovis subsp bovis AF2122/97
cggcgcucggcga

SEQ ID NO: 3147992 - RNA, 13 nt, Mycobacterium bovis subsp bovis AF2122/97
cggcgcucgucga

SEQ ID NO: 3147993 - RNA, 15 nt, Mycobacterium bovis subsp bovis AF2122/97
cggcgcucgucgauc

SEQ ID NO: 3147994 - RNA, 20 nt, Mycobacterium bovis subsp bovis AF2122/97
cggcgcucgucgaucuccuc

SEQ ID NO: 3147995 - RNA, 19 nt, Mycobacterium bovis subsp bovis AF2122/97
cggcgcucgucgcggcccg

SEQ ID NO: 3147996 - RNA, 19 nt, Mycobacterium bovis subsp bovis AF2122/97
cggcgcugaacuagggucg

SEQ ID NO: 3147997 - RNA, 21 nt, Mycobacterium bovis subsp bovis AF2122/97
cggcgcugacuagggucaccg

SEQ ID NO: 3147998 - RNA, 23 nt, Mycobacterium bovis subsp bovis AF2122/97
cggcgcugacuagggucaccgac

SEQ ID NO: 3147999 - RNA, 20 nt, Mycobacterium bovis subsp bovis AF2122/97
cggcggcaacggcggcgacg

SEQ ID NO: 3148000 - RNA, 22 nt, Mycobacterium bovis subsp bovis AF2122/97
cggcggcaacggcggcgacggc

SEQ ID NO: 3148001 - RNA, 15 nt, Mycobacterium bovis subsp bovis AF2122/97
cggcggcaacggugg

SEQ ID NO: 3148002 - RNA, 16 nt, Mycobacterium bovis subsp bovis AF2122/97
cggcggcaacgguggc

SEQ ID NO: 3148003 - RNA, 14 nt, Mycobacterium bovis subsp bovis AF2122/97
cggcggcaagggcg

SEQ ID NO: 3148004 - RNA, 19 nt, Mycobacterium bovis subsp bovis AF2122/97
cggcggcaagggcggcaac

SEQ ID NO: 3148005 - RNA, 20 nt, Mycobacterium bovis subsp bovis AF2122/97
cggcggcaagggcggcaacg

SEQ ID NO: 3148006 - RNA, 21 nt, Mycobacterium bovis subsp bovis AF2122/97
cggcggcaagggcggcaacgg

SEQ ID NO: 3148007 - RNA, 14 nt, Mycobacterium bovis subsp bovis AF2122/97
cggcggcaagggug

SEQ ID NO: 3148008 - RNA, 17 nt, Mycobacterium bovis subsp bovis AF2122/97
cggcggcaaggguggug

SEQ ID NO: 3148009 - RNA, 18 nt, Mycobacterium bovis subsp bovis AF2122/97
cggcggcaagugcggaac

SEQ ID NO: 3148010 - RNA, 14 nt, Mycobacterium bovis subsp bovis AF2122/97
cggcggcacccggg

SEQ ID NO: 3148011 - RNA, 17 nt, Mycobacterium bovis subsp bovis AF2122/97
cggcggcacccgggugg

SEQ ID NO: 3148012 - RNA, 14 nt, Mycobacterium bovis subsp bovis AF2122/97
cggcggcacgcucg

SEQ ID NO: 3148013 - RNA, 16 nt, Mycobacterium bovis subsp bovis AF2122/97
cggcggcacgcucgcg

SEQ ID NO: 3148014 - RNA, 16 nt, Mycobacterium bovis subsp bovis AF2122/97
cggcggcacgcugacc

SEQ ID NO: 3148015 - RNA, 18 nt, Mycobacterium bovis subsp bovis AF2122/97
cggcggcacuacgcagcc

SEQ ID NO: 3148016 - RNA, 22 nt, Mycobacterium bovis subsp bovis AF2122/97
cggcggcagcauauccgccggc

SEQ ID NO: 3148017 - RNA, 20 nt, Mycobacterium bovis subsp bovis AF2122/97
cggcggcagcggcgccgccu

SEQ ID NO: 3148018 - RNA, 15 nt, Mycobacterium bovis subsp bovis AF2122/97
cggcggcagcggcgg

SEQ ID NO: 3148019 - RNA, 15 nt, Mycobacterium bovis subsp bovis AF2122/97
cggcggcaggccggc

SEQ ID NO: 3148020 - RNA, 20 nt, Mycobacterium bovis subsp bovis AF2122/97
cggcggcaggccggccaccg

SEQ ID NO: 3148021 - RNA, 18 nt, Mycobacterium bovis subsp bovis AF2122/97
cggcggcaucaccuggcg

SEQ ID NO: 3148022 - RNA, 23 nt, Mycobacterium bovis subsp bovis AF2122/97
cggcggcaucaccuggcgugucg

SEQ ID NO: 3148023 - RNA, 23 nt, Mycobacterium bovis subsp bovis AF2122/97
cggcggcaucgaguucggcccgc

SEQ ID NO: 3148024 - RNA, 16 nt, Mycobacterium bovis subsp bovis AF2122/97
cggcggcaucggcggc

SEQ ID NO: 3148025 - RNA, 19 nt, Mycobacterium bovis subsp bovis AF2122/97
cggcggcaucggcggcaac

SEQ ID NO: 3148026 - RNA, 20 nt, Mycobacterium bovis subsp bovis AF2122/97
cggcggcaucggcggcaacg

SEQ ID NO: 3148027 - RNA, 23 nt, Mycobacterium bovis subsp bovis AF2122/97
cggcggcaucucgcaccgcgccg

SEQ ID NO: 3148028 - RNA, 20 nt, Mycobacterium bovis subsp bovis AF2122/97
cggcggcaugggucgugcag

SEQ ID NO: 3148029 - RNA, 17 nt, Mycobacterium bovis subsp bovis AF2122/97
cggcggccaacagcacc

SEQ ID NO: 3148030 - RNA, 18 nt, Mycobacterium bovis subsp bovis AF2122/97
cggcggccaacagcaccc

SEQ ID NO: 3148031 - RNA, 12 nt, Mycobacterium bovis subsp bovis AF2122/97
cggcggccaacg

SEQ ID NO: 3148032 - RNA, 18 nt, Mycobacterium bovis subsp bovis AF2122/97
cggcggccaccugcuggc

SEQ ID NO: 3148033 - RNA, 20 nt, Mycobacterium bovis subsp bovis AF2122/97
cggcggccaccugcuggccg

SEQ ID NO: 3148034 - RNA, 15 nt, Mycobacterium bovis subsp bovis AF2122/97
cggcggccacgccgg

SEQ ID NO: 3148035 - RNA, 17 nt, Mycobacterium bovis subsp bovis AF2122/97
cggcggccacgccggcg

SEQ ID NO: 3148036 - RNA, 13 nt, Mycobacterium bovis subsp bovis AF2122/97
cggcggccacggc

SEQ ID NO: 3148037 - RNA, 14 nt, Mycobacterium bovis subsp bovis AF2122/97
cggcggccacgucc

SEQ ID NO: 3148038 - RNA, 13 nt, Mycobacterium bovis subsp bovis AF2122/97
cggcggccacgug

SEQ ID NO: 3148039 - RNA, 22 nt, Mycobacterium bovis subsp bovis AF2122/97
cggcggccagcauuagccaggc

SEQ ID NO: 3148040 - RNA, 13 nt, Mycobacterium bovis subsp bovis AF2122/97
cggcggccagccg

SEQ ID NO: 3148041 - RNA, 14 nt, Mycobacterium bovis subsp bovis AF2122/97
cggcggccagcgca

SEQ ID NO: 3148042 - RNA, 14 nt, Mycobacterium bovis subsp bovis AF2122/97
cggcggccaggucg

SEQ ID NO: 3148043 - RNA, 20 nt, Mycobacterium bovis subsp bovis AF2122/97
cggcggccauagugaggccg

SEQ ID NO: 3148044 - RNA, 20 nt, Mycobacterium bovis subsp bovis AF2122/97
cggcggccaucccgcguucg

SEQ ID NO: 3148045 - RNA, 21 nt, Mycobacterium bovis subsp bovis AF2122/97
cggcggccauggcgggucggu

SEQ ID NO: 3148046 - RNA, 24 nt, Mycobacterium bovis subsp bovis AF2122/97
cggcggccauggcgggucggucgg

SEQ ID NO: 3148047 - RNA, 14 nt, Mycobacterium bovis subsp bovis AF2122/97
cggcggcccacgcg

SEQ ID NO: 3148048 - RNA, 15 nt, Mycobacterium bovis subsp bovis AF2122/97
cggcggcccaucgac

SEQ ID NO: 3148049 - RNA, 22 nt, Mycobacterium bovis subsp bovis AF2122/97
cggcggccccaggggcaccagc

SEQ ID NO: 3148050 - RNA, 12 nt, Mycobacterium bovis subsp bovis AF2122/97
cggcggccccgg

SEQ ID NO: 3148051 - RNA, 13 nt, Mycobacterium bovis subsp bovis AF2122/97
cggcggccccggc

SEQ ID NO: 3148052 - RNA, 24 nt, Mycobacterium bovis subsp bovis AF2122/97
cggcggccccggcauugcccgagc

SEQ ID NO: 3148053 - RNA, 13 nt, Mycobacterium bovis subsp bovis AF2122/97
cggcggcccgaua

SEQ ID NO: 3148054 - RNA, 20 nt, Mycobacterium bovis subsp bovis AF2122/97
cggcggcccgauagaucgcg

SEQ ID NO: 3148055 - RNA, 19 nt, Mycobacterium bovis subsp bovis AF2122/97
cggcggcccgauccagugg

SEQ ID NO: 3148056 - RNA, 24 nt, Mycobacterium bovis subsp bovis AF2122/97
cggcggcccgauccagugguaggc

SEQ ID NO: 3148057 - RNA, 17 nt, Mycobacterium bovis subsp bovis AF2122/97
cggcggcccgcagcccg

SEQ ID NO: 3148058 - RNA, 20 nt, Mycobacterium bovis subsp bovis AF2122/97
cggcggcccgcagcccgccg

SEQ ID NO: 3148059 - RNA, 12 nt, Mycobacterium bovis subsp bovis AF2122/97
cggcggcccgcu

SEQ ID NO: 3148060 - RNA, 16 nt, Mycobacterium bovis subsp bovis AF2122/97
cggcggcccgcucggg

SEQ ID NO: 3148061 - RNA, 14 nt, Mycobacterium bovis subsp bovis AF2122/97
cggcggcccggccg

SEQ ID NO: 3148062 - RNA, 21 nt, Mycobacterium bovis subsp bovis AF2122/97
cggcggcccuaaacaccgcga

SEQ ID NO: 3148063 - RNA, 16 nt, Mycobacterium bovis subsp bovis AF2122/97
cggcggcccuguucac

SEQ ID NO: 3148064 - RNA, 20 nt, Mycobacterium bovis subsp bovis AF2122/97
cggcggcccuuuccagggga

SEQ ID NO: 3148065 - RNA, 13 nt, Mycobacterium bovis subsp bovis AF2122/97
cggcggccgagcg

SEQ ID NO: 3148066 - RNA, 15 nt, Mycobacterium bovis subsp bovis AF2122/97
cggcggccgagcgca

SEQ ID NO: 3148067 - RNA, 22 nt, Mycobacterium bovis subsp bovis AF2122/97
cggcggccgagcgcaccgcuga

SEQ ID NO: 3148068 - RNA, 21 nt, Mycobacterium bovis subsp bovis AF2122/97
cggcggccgcagcggccagcc

SEQ ID NO: 3148069 - RNA, 13 nt, Mycobacterium bovis subsp bovis AF2122/97
cggcggccgccag

SEQ ID NO: 3148070 - RNA, 19 nt, Mycobacterium bovis subsp bovis AF2122/97
cggcggccgccaucagccg

SEQ ID NO: 3148071 - RNA, 15 nt, Mycobacterium bovis subsp bovis AF2122/97
cggcggccgcccaga

SEQ ID NO: 3148072 - RNA, 15 nt, Mycobacterium bovis subsp bovis AF2122/97
cggcggccgcgaugg

SEQ ID NO: 3148073 - RNA, 14 nt, Mycobacterium bovis subsp bovis AF2122/97
cggcggccgcggcu

SEQ ID NO: 3148074 - RNA, 15 nt, Mycobacterium bovis subsp bovis AF2122/97
cggcggccgcgugcu

SEQ ID NO: 3148075 - RNA, 20 nt, Mycobacterium bovis subsp bovis AF2122/97
cggcggccgcgugcucgccg

SEQ ID NO: 3148076 - RNA, 19 nt, Mycobacterium bovis subsp bovis AF2122/97
cggcggccgcuucggcggu

SEQ ID NO: 3148077 - RNA, 19 nt, Mycobacterium bovis subsp bovis AF2122/97
cggcggccggcacgggcgg

SEQ ID NO: 3148078 - RNA, 18 nt, Mycobacterium bovis subsp bovis AF2122/97
cggcggccggcgccggcg

SEQ ID NO: 3148079 - RNA, 16 nt, Mycobacterium bovis subsp bovis AF2122/97
cggcggccgguagauc

SEQ ID NO: 3148080 - RNA, 12 nt, Mycobacterium bovis subsp bovis AF2122/97
cggcggccguca

SEQ ID NO: 3148081 - RNA, 14 nt, Mycobacterium bovis subsp bovis AF2122/97
cggcggccgucacc

SEQ ID NO: 3148082 - RNA, 15 nt, Mycobacterium bovis subsp bovis AF2122/97
cggcggccgucaccg

SEQ ID NO: 3148083 - RNA, 16 nt, Mycobacterium bovis subsp bovis AF2122/97
cggcggccgucaccgg

SEQ ID NO: 3148084 - RNA, 20 nt, Mycobacterium bovis subsp bovis AF2122/97
cggcggccgugucgggcgcg

SEQ ID NO: 3148085 - RNA, 16 nt, Mycobacterium bovis subsp bovis AF2122/97
cggcggccucgcugcu

SEQ ID NO: 3148086 - RNA, 16 nt, Mycobacterium bovis subsp bovis AF2122/97
cggcgggaugcgcgcc

SEQ ID NO: 3148087 - RNA, 12 nt, Mycobacterium bovis subsp bovis AF2122/97
cggcgggcaccu

SEQ ID NO: 3148088 - RNA, 15 nt, Mycobacterium bovis subsp bovis AF2122/97
cggcgggcaccuccg

SEQ ID NO: 3148089 - RNA, 18 nt, Mycobacterium bovis subsp bovis AF2122/97
cggcgggcagauggugaa

SEQ ID NO: 3148090 - RNA, 20 nt, Mycobacterium bovis subsp bovis AF2122/97
cggcgggcagauggugaagu

SEQ ID NO: 3148091 - RNA, 13 nt, Mycobacterium bovis subsp bovis AF2122/97
cggcgggcccgcc

SEQ ID NO: 3148092 - RNA, 16 nt, Mycobacterium bovis subsp bovis AF2122/97
cggcgggcccgccggc

SEQ ID NO: 3148093 - RNA, 18 nt, Mycobacterium bovis subsp bovis AF2122/97
cggcgggccgcgcggcga

SEQ ID NO: 3148094 - RNA, 20 nt, Mycobacterium bovis subsp bovis AF2122/97
cggcgggccgcgcggcgaca

SEQ ID NO: 3148095 - RNA, 23 nt, Mycobacterium bovis subsp bovis AF2122/97
cggcgggccgcgcggcgacagcu

SEQ ID NO: 3148096 - RNA, 16 nt, Mycobacterium bovis subsp bovis AF2122/97
cggcgggccucggcga

SEQ ID NO: 3148097 - RNA, 14 nt, Mycobacterium bovis subsp bovis AF2122/97
cggcgggccugccc

SEQ ID NO: 3148098 - RNA, 13 nt, Mycobacterium bovis subsp bovis AF2122/97
cggcgggcgacau

SEQ ID NO: 3148099 - RNA, 13 nt, Mycobacterium bovis subsp bovis AF2122/97
cggcgggcgagcc

SEQ ID NO: 3148100 - RNA, 21 nt, Mycobacterium bovis subsp bovis AF2122/97
cggcgggcgaucuuggcgaca

SEQ ID NO: 3148101 - RNA, 21 nt, Mycobacterium bovis subsp bovis AF2122/97
cggcgggcgauuucggcgccg

SEQ ID NO: 3148102 - RNA, 14 nt, Mycobacterium bovis subsp bovis AF2122/97
cggcgggcgcgggc

SEQ ID NO: 3148103 - RNA, 14 nt, Mycobacterium bovis subsp bovis AF2122/97
cggcgggcggcagc

SEQ ID NO: 3148104 - RNA, 16 nt, Mycobacterium bovis subsp bovis AF2122/97
cggcgggcggcagcga

SEQ ID NO: 3148105 - RNA, 13 nt, Mycobacterium bovis subsp bovis AF2122/97
cggcgggcggugg

SEQ ID NO: 3148106 - RNA, 14 nt, Mycobacterium bovis subsp bovis AF2122/97
cggcgggcgguggg

SEQ ID NO: 3148107 - RNA, 23 nt, Mycobacterium bovis subsp bovis AF2122/97
cggcgggcucgcuucaggcaccg

SEQ ID NO: 3148108 - RNA, 15 nt, Mycobacterium bovis subsp bovis AF2122/97
cggcggggaucgcug

SEQ ID NO: 3148109 - RNA, 14 nt, Mycobacterium bovis subsp bovis AF2122/97
cggcggggccggcg

SEQ ID NO: 3148110 - RNA, 17 nt, Mycobacterium bovis subsp bovis AF2122/97
cggcggggccggcggcu

SEQ ID NO: 3148111 - RNA, 14 nt, Mycobacterium bovis subsp bovis AF2122/97
cggcggggcgccgg

SEQ ID NO: 3148112 - RNA, 18 nt, Mycobacterium bovis subsp bovis AF2122/97
cggcggggcggcgguggg

SEQ ID NO: 3148113 - RNA, 18 nt, Mycobacterium bovis subsp bovis AF2122/97
cggcgggggaccccgcca

SEQ ID NO: 3148114 - RNA, 20 nt, Mycobacterium bovis subsp bovis AF2122/97
cggcgggggaccccgccagc

SEQ ID NO: 3148115 - RNA, 21 nt, Mycobacterium bovis subsp bovis AF2122/97
cggcgggggaccccgccagcc

SEQ ID NO: 3148116 - RNA, 16 nt, Mycobacterium bovis subsp bovis AF2122/97
cggcgggggcggcggc

SEQ ID NO: 3148117 - RNA, 18 nt, Mycobacterium bovis subsp bovis AF2122/97
cggcgggggcgucgccgc

SEQ ID NO: 3148118 - RNA, 22 nt, Mycobacterium bovis subsp bovis AF2122/97
cggcggggggugaucgccaccg

SEQ ID NO: 3148119 - RNA, 22 nt, Mycobacterium bovis subsp bovis AF2122/97
cggcggggguggaaucaggguc

SEQ ID NO: 3148120 - RNA, 21 nt, Mycobacterium bovis subsp bovis AF2122/97
cggcggggucgaacagcucga

SEQ ID NO: 3148121 - RNA, 15 nt, Mycobacterium bovis subsp bovis AF2122/97
cggcggguagcucgc

SEQ ID NO: 3148122 - RNA, 16 nt, Mycobacterium bovis subsp bovis AF2122/97
cggcggguccucgcgg

SEQ ID NO: 3148123 - RNA, 19 nt, Mycobacterium bovis subsp bovis AF2122/97
cggcggguccucgcggagc

SEQ ID NO: 3148124 - RNA, 16 nt, Mycobacterium bovis subsp bovis AF2122/97
cggcgggugccgagcu

SEQ ID NO: 3148125 - RNA, 18 nt, Mycobacterium bovis subsp bovis AF2122/97
cggcgggugccgagcugg

SEQ ID NO: 3148126 - RNA, 21 nt, Mycobacterium bovis subsp bovis AF2122/97
cggcggguggcccccgccggc

SEQ ID NO: 3148127 - RNA, 19 nt, Mycobacterium bovis subsp bovis AF2122/97
cggcggguuugcccauccc

SEQ ID NO: 3148128 - RNA, 20 nt, Mycobacterium bovis subsp bovis AF2122/97
cggcggguuugcccaucccc

SEQ ID NO: 3148129 - RNA, 20 nt, Mycobacterium bovis subsp bovis AF2122/97
cggcggguuuucucgccguu

SEQ ID NO: 3148130 - RNA, 23 nt, Mycobacterium bovis subsp bovis AF2122/97
cggcgguaaaugccugcccaccu

SEQ ID NO: 3148131 - RNA, 17 nt, Mycobacterium bovis subsp bovis AF2122/97
cggcgguaacggcggua

SEQ ID NO: 3148132 - RNA, 17 nt, Mycobacterium bovis subsp bovis AF2122/97
cggcgguaagggcgggc

SEQ ID NO: 3148133 - RNA, 15 nt, Mycobacterium bovis subsp bovis AF2122/97
cggcgguaccgccgc

SEQ ID NO: 3148134 - RNA, 18 nt, Mycobacterium bovis subsp bovis AF2122/97
cggcgguaccgccgcggu

SEQ ID NO: 3148135 - RNA, 22 nt, Mycobacterium bovis subsp bovis AF2122/97
cggcgguaccgccgcugccggu

SEQ ID NO: 3148136 - RNA, 23 nt, Mycobacterium bovis subsp bovis AF2122/97
cggcgguaccggaaucggcggcg

SEQ ID NO: 3148137 - RNA, 16 nt, Mycobacterium bovis subsp bovis AF2122/97
cggcgguaccggagca

SEQ ID NO: 3148138 - RNA, 21 nt, Mycobacterium bovis subsp bovis AF2122/97
cggcgguaccggagcagcuca

SEQ ID NO: 3148139 - RNA, 16 nt, Mycobacterium bovis subsp bovis AF2122/97
cggcgguagccgacca

SEQ ID NO: 3148140 - RNA, 19 nt, Mycobacterium bovis subsp bovis AF2122/97
cggcgguaguacucgcgca

SEQ ID NO: 3148141 - RNA, 21 nt, Mycobacterium bovis subsp bovis AF2122/97
cggcgguaguacucgcgcagg

SEQ ID NO: 3148142 - RNA, 13 nt, Mycobacterium bovis subsp bovis AF2122/97
cggcgguagucgg

SEQ ID NO: 3148143 - RNA, 17 nt, Mycobacterium bovis subsp bovis AF2122/97
cggcgguagucggccag

SEQ ID NO: 3148144 - RNA, 19 nt, Mycobacterium bovis subsp bovis AF2122/97
cggcgguagucggccagcu

SEQ ID NO: 3148145 - RNA, 21 nt, Mycobacterium bovis subsp bovis AF2122/97
cggcgguagucggccagcucg

SEQ ID NO: 3148146 - RNA, 18 nt, Mycobacterium bovis subsp bovis AF2122/97
cggcgguaugccacaggc

SEQ ID NO: 3148147 - RNA, 23 nt, Mycobacterium bovis subsp bovis AF2122/97
cggcgguaugccacaggcugcca

SEQ ID NO: 3148148 - RNA, 15 nt, Mycobacterium bovis subsp bovis AF2122/97
cggcgguaugcucgc

SEQ ID NO: 3148149 - RNA, 22 nt, Mycobacterium bovis subsp bovis AF2122/97
cggcgguaugcucgcuggcgcu

SEQ ID NO: 3148150 - RNA, 18 nt, Mycobacterium bovis subsp bovis AF2122/97
cggcggucaccaccgacc

SEQ ID NO: 3148151 - RNA, 19 nt, Mycobacterium bovis subsp bovis AF2122/97
cggcggucaccaccgaccc

SEQ ID NO: 3148152 - RNA, 15 nt, Mycobacterium bovis subsp bovis AF2122/97
cggcggucagcagcg

SEQ ID NO: 3148153 - RNA, 18 nt, Mycobacterium bovis subsp bovis AF2122/97
cggcggucagcagcgccg

SEQ ID NO: 3148154 - RNA, 21 nt, Mycobacterium bovis subsp bovis AF2122/97
cggcggucagcagcgccguca

SEQ ID NO: 3148155 - RNA, 14 nt, Mycobacterium bovis subsp bovis AF2122/97
cggcggucagcggc

SEQ ID NO: 3148156 - RNA, 13 nt, Mycobacterium bovis subsp bovis AF2122/97
cggcggucgccag

SEQ ID NO: 3148157 - RNA, 16 nt, Mycobacterium bovis subsp bovis AF2122/97
cggcggucgccgcgcg

SEQ ID NO: 3148158 - RNA, 15 nt, Mycobacterium bovis subsp bovis AF2122/97
cggcggucggcuggg

SEQ ID NO: 3148159 - RNA, 12 nt, Mycobacterium bovis subsp bovis AF2122/97
cggcggucggga

SEQ ID NO: 3148160 - RNA, 22 nt, Mycobacterium bovis subsp bovis AF2122/97
cggcggucguugauuucggcgg

SEQ ID NO: 3148161 - RNA, 14 nt, Mycobacterium bovis subsp bovis AF2122/97
cggcggucucggcg

SEQ ID NO: 3148162 - RNA, 20 nt, Mycobacterium bovis subsp bovis AF2122/97
cggcggucucggcgucgacc

SEQ ID NO: 3148163 - RNA, 21 nt, Mycobacterium bovis subsp bovis AF2122/97
cggcggucucggcgucgacca

SEQ ID NO: 3148164 - RNA, 22 nt, Mycobacterium bovis subsp bovis AF2122/97
cggcggucucgucaaccugcgc

SEQ ID NO: 3148165 - RNA, 20 nt, Mycobacterium bovis subsp bovis AF2122/97
cggcggucugagacucgucg

SEQ ID NO: 3148166 - RNA, 21 nt, Mycobacterium bovis subsp bovis AF2122/97
cggcggucugagacucgucga

SEQ ID NO: 3148167 - RNA, 14 nt, Mycobacterium bovis subsp bovis AF2122/97
cggcggucugggug

SEQ ID NO: 3148168 - RNA, 15 nt, Mycobacterium bovis subsp bovis AF2122/97
cggcggucugguugu

SEQ ID NO: 3148169 - RNA, 12 nt, Mycobacterium bovis subsp bovis AF2122/97
cggcggucugua

SEQ ID NO: 3148170 - RNA, 19 nt, Mycobacterium bovis subsp bovis AF2122/97
cggcggucuuggcgcgccc

SEQ ID NO: 3148171 - RNA, 20 nt, Mycobacterium bovis subsp bovis AF2122/97
cggcggucuuggcgcgccca

SEQ ID NO: 3148172 - RNA, 21 nt, Mycobacterium bovis subsp bovis AF2122/97
cggcguccuugcgcagcacca

SEQ ID NO: 3148173 - RNA, 14 nt, Mycobacterium bovis subsp bovis AF2122/97
cggcgucgaaggug

SEQ ID NO: 3148174 - RNA, 21 nt, Mycobacterium bovis subsp bovis AF2122/97
cggcgucgaaggugaccaggc

SEQ ID NO: 3148175 - RNA, 22 nt, Mycobacterium bovis subsp bovis AF2122/97
cggcgucgaaggugaccaggcg

SEQ ID NO: 3148176 - RNA, 13 nt, Mycobacterium bovis subsp bovis AF2122/97
cggcgucgaagug

SEQ ID NO: 3148177 - RNA, 19 nt, Mycobacterium bovis subsp bovis AF2122/97
cggcgucgaagugggugaa

SEQ ID NO: 3148178 - RNA, 18 nt, Mycobacterium bovis subsp bovis AF2122/97
cggcgucgaauaggccgc

SEQ ID NO: 3148179 - RNA, 18 nt, Mycobacterium bovis subsp bovis AF2122/97
cggcgucgaccaguucgg

SEQ ID NO: 3148180 - RNA, 14 nt, Mycobacterium bovis subsp bovis AF2122/97
cggcgucgacccag

SEQ ID NO: 3148181 - RNA, 15 nt, Mycobacterium bovis subsp bovis AF2122/97
cggcgucgacgucgg

SEQ ID NO: 3148182 - RNA, 21 nt, Mycobacterium bovis subsp bovis AF2122/97
cggcgucgagauagucggccg

SEQ ID NO: 3148183 - RNA, 15 nt, Mycobacterium bovis subsp bovis AF2122/97
cggcgucgagcaccu

SEQ ID NO: 3148184 - RNA, 13 nt, Mycobacterium bovis subsp bovis AF2122/97
cggcgucgagcuc

SEQ ID NO: 3148185 - RNA, 19 nt, Mycobacterium bovis subsp bovis AF2122/97
cggcgucgagcucguccuc

SEQ ID NO: 3148186 - RNA, 20 nt, Mycobacterium bovis subsp bovis AF2122/97
cggcgucgagggagcgccgc

SEQ ID NO: 3148187 - RNA, 23 nt, Mycobacterium bovis subsp bovis AF2122/97
cggcgucgagggagcgccgcagg

SEQ ID NO: 3148188 - RNA, 18 nt, Mycobacterium bovis subsp bovis AF2122/97
cggcgucgaugacgacgc

SEQ ID NO: 3148189 - RNA, 20 nt, Mycobacterium bovis subsp bovis AF2122/97
cggcgucgaugacgacgccg

SEQ ID NO: 3148190 - RNA, 19 nt, Mycobacterium bovis subsp bovis AF2122/97
cggcgucgauggccacccg

SEQ ID NO: 3148191 - RNA, 12 nt, Mycobacterium bovis subsp bovis AF2122/97
cggcgucgccgc

SEQ ID NO: 3148192 - RNA, 14 nt, Mycobacterium bovis subsp bovis AF2122/97
cggcgucgccgcca

SEQ ID NO: 3148193 - RNA, 13 nt, Mycobacterium bovis subsp bovis AF2122/97
cggcgucgcuggc

SEQ ID NO: 3148194 - RNA, 15 nt, Mycobacterium bovis subsp bovis AF2122/97
cggcgucggccaccc

SEQ ID NO: 3148195 - RNA, 16 nt, Mycobacterium bovis subsp bovis AF2122/97
cggcgucggccacccg

SEQ ID NO: 3148196 - RNA, 17 nt, Mycobacterium bovis subsp bovis AF2122/97
cggcgucggcgcccagc

SEQ ID NO: 3148197 - RNA, 21 nt, Mycobacterium bovis subsp bovis AF2122/97
cggcgucgggaugcucgaucc

SEQ ID NO: 3148198 - RNA, 14 nt, Mycobacterium bovis subsp bovis AF2122/97
cggcgucggucguc

SEQ ID NO: 3148199 - RNA, 21 nt, Mycobacterium bovis subsp bovis AF2122/97
cggcgucggugagcgcgucgc

SEQ ID NO: 3148200 - RNA, 22 nt, Mycobacterium bovis subsp bovis AF2122/97
cggcgucguaggagccgucacg

SEQ ID NO: 3148201 - RNA, 16 nt, Mycobacterium bovis subsp bovis AF2122/97
cggcgucgucgacggc

SEQ ID NO: 3148202 - RNA, 15 nt, Mycobacterium bovis subsp bovis AF2122/97
cggcgucgucgauga

SEQ ID NO: 3148203 - RNA, 15 nt, Mycobacterium bovis subsp bovis AF2122/97
cggcgucgucgucga

SEQ ID NO: 3148204 - RNA, 14 nt, Mycobacterium bovis subsp bovis AF2122/97
cggcgucguggauc

SEQ ID NO: 3148205 - RNA, 16 nt, Mycobacterium bovis subsp bovis AF2122/97
cggcgucguggcuucc

SEQ ID NO: 3148206 - RNA, 14 nt, Mycobacterium bovis subsp bovis AF2122/97
cggcgucguggugg

SEQ ID NO: 3148207 - RNA, 20 nt, Mycobacterium bovis subsp bovis AF2122/97
cggcgucguucgagaccccg

SEQ ID NO: 3148208 - RNA, 23 nt, Mycobacterium bovis subsp bovis AF2122/97
cggcgucguugccgggucaaccg

SEQ ID NO: 3148209 - RNA, 16 nt, Mycobacterium bovis subsp bovis AF2122/97
cggcgucuccgccggc

SEQ ID NO: 3148210 - RNA, 14 nt, Mycobacterium bovis subsp bovis AF2122/97
cggcgucucgcagc

SEQ ID NO: 3148211 - RNA, 22 nt, Mycobacterium bovis subsp bovis AF2122/97
cggcgucucgcagcaacggcgg

SEQ ID NO: 3148212 - RNA, 16 nt, Mycobacterium bovis subsp bovis AF2122/97
cggcgucugcccgccc

SEQ ID NO: 3148213 - RNA, 15 nt, Mycobacterium bovis subsp bovis AF2122/97
cggcgucugcgccag

SEQ ID NO: 3148214 - RNA, 15 nt, Mycobacterium bovis subsp bovis AF2122/97
cggcgucugcggugg

SEQ ID NO: 3148215 - RNA, 16 nt, Mycobacterium bovis subsp bovis AF2122/97
cggcgucugcgguggc

SEQ ID NO: 3148216 - RNA, 17 nt, Mycobacterium bovis subsp bovis AF2122/97
cggcgucuguaccacgg

SEQ ID NO: 3148217 - RNA, 20 nt, Mycobacterium bovis subsp bovis AF2122/97
cggcgucuuccucggccacc

SEQ ID NO: 3148218 - RNA, 23 nt, Mycobacterium bovis subsp bovis AF2122/97
cggcgucuuccucggccacccgc

SEQ ID NO: 3148219 - RNA, 15 nt, Mycobacterium bovis subsp bovis AF2122/97
cggcgucuucgucgg

SEQ ID NO: 3148220 - RNA, 21 nt, Mycobacterium bovis subsp bovis AF2122/97
cggcgucuucgucggagucuu

SEQ ID NO: 3148221 - RNA, 17 nt, Mycobacterium bovis subsp bovis AF2122/97
cggcgucuugcaucagc

SEQ ID NO: 3148222 - RNA, 23 nt, Mycobacterium bovis subsp bovis AF2122/97
cggcgucuugcaucagcggcgcc

SEQ ID NO: 3148223 - RNA, 14 nt, Mycobacterium bovis subsp bovis AF2122/97
cggcgugacgucgu

SEQ ID NO: 3148224 - RNA, 15 nt, Mycobacterium bovis subsp bovis AF2122/97
cggcgugaucaccgg

SEQ ID NO: 3148225 - RNA, 16 nt, Mycobacterium bovis subsp bovis AF2122/97
cggcgugaucaccggc

SEQ ID NO: 3148226 - RNA, 17 nt, Mycobacterium bovis subsp bovis AF2122/97
cggcgugaucaccggca

SEQ ID NO: 3148227 - RNA, 22 nt, Mycobacterium bovis subsp bovis AF2122/97
cggcgugaucaccggcaucccg

SEQ ID NO: 3148228 - RNA, 23 nt, Mycobacterium bovis subsp bovis AF2122/97
cggcgugaugucuaccaacaccg

SEQ ID NO: 3148229 - RNA, 12 nt, Mycobacterium bovis subsp bovis AF2122/97
cggcgugcagca

SEQ ID NO: 3148230 - RNA, 14 nt, Mycobacterium bovis subsp bovis AF2122/97
cggcgugcagcacu

SEQ ID NO: 3148231 - RNA, 23 nt, Mycobacterium bovis subsp bovis AF2122/97
cggcgugcagcagcuugacccac

SEQ ID NO: 3148232 - RNA, 16 nt, Mycobacterium bovis subsp bovis AF2122/97
cggcgugcaugagccg

SEQ ID NO: 3148233 - RNA, 20 nt, Mycobacterium bovis subsp bovis AF2122/97
cggcgugccagcacacgccu

SEQ ID NO: 3148234 - RNA, 15 nt, Mycobacterium bovis subsp bovis AF2122/97
cggcgugccgggugg

SEQ ID NO: 3148235 - RNA, 16 nt, Mycobacterium bovis subsp bovis AF2122/97
cggcgugccggguggu

SEQ ID NO: 3148236 - RNA, 13 nt, Mycobacterium bovis subsp bovis AF2122/97
cggcgugcgcgag

SEQ ID NO: 3148237 - RNA, 14 nt, Mycobacterium bovis subsp bovis AF2122/97
cggcgugcggacug

SEQ ID NO: 3148238 - RNA, 14 nt, Mycobacterium bovis subsp bovis AF2122/97
cggcgugcggcgag

SEQ ID NO: 3148239 - RNA, 15 nt, Mycobacterium bovis subsp bovis AF2122/97
cggcgugcggcgagg

SEQ ID NO: 3148240 - RNA, 13 nt, Mycobacterium bovis subsp bovis AF2122/97
cggcgugcucggc

SEQ ID NO: 3148241 - RNA, 12 nt, Mycobacterium bovis subsp bovis AF2122/97
cggcgugcuggc

SEQ ID NO: 3148242 - RNA, 15 nt, Mycobacterium bovis subsp bovis AF2122/97
cggcgugcugugcuc

SEQ ID NO: 3148243 - RNA, 20 nt, Mycobacterium bovis subsp bovis AF2122/97
cggcgugcuugcccagguug

SEQ ID NO: 3148244 - RNA, 22 nt, Mycobacterium bovis subsp bovis AF2122/97
cggcguggaucaguuugccauc

SEQ ID NO: 3148245 - RNA, 18 nt, Mycobacterium bovis subsp bovis AF2122/97
cggcguggaugcccgguu

SEQ ID NO: 3148246 - RNA, 18 nt, Mycobacterium bovis subsp bovis AF2122/97
cggcguggcaguacaccg

SEQ ID NO: 3148247 - RNA, 19 nt, Mycobacterium bovis subsp bovis AF2122/97
cggcguggcaguacaccgg

SEQ ID NO: 3148248 - RNA, 20 nt, Mycobacterium bovis subsp bovis AF2122/97
cggcguggcaguacaccggc

SEQ ID NO: 3148249 - RNA, 23 nt, Mycobacterium bovis subsp bovis AF2122/97
cggcguggcaguacaccggcgug

SEQ ID NO: 3148250 - RNA, 15 nt, Mycobacterium bovis subsp bovis AF2122/97
cggcguggcgccggc

SEQ ID NO: 3148251 - RNA, 17 nt, Mycobacterium bovis subsp bovis AF2122/97
cggcguggcgccggcca

SEQ ID NO: 3148252 - RNA, 18 nt, Mycobacterium bovis subsp bovis AF2122/97
cggcguggcgccggccac

SEQ ID NO: 3148253 - RNA, 19 nt, Mycobacterium bovis subsp bovis AF2122/97
cggcguggcgccggccacg

SEQ ID NO: 3148254 - RNA, 21 nt, Mycobacterium bovis subsp bovis AF2122/97
cggcguggcgccggccacgag

SEQ ID NO: 3148255 - RNA, 15 nt, Mycobacterium bovis subsp bovis AF2122/97
cggcguggcgggggc

SEQ ID NO: 3148256 - RNA, 13 nt, Mycobacterium bovis subsp bovis AF2122/97
cggcguggcugcc

SEQ ID NO: 3148257 - RNA, 18 nt, Mycobacterium bovis subsp bovis AF2122/97
cggcguggcugccuucgg

SEQ ID NO: 3148258 - RNA, 21 nt, Mycobacterium bovis subsp bovis AF2122/97
cggcguggcugccuucggcga

SEQ ID NO: 3148259 - RNA, 18 nt, Mycobacterium bovis subsp bovis AF2122/97
cggcuaggccagcacggc

SEQ ID NO: 3148260 - RNA, 20 nt, Mycobacterium bovis subsp bovis AF2122/97
cggcuaggccagcacggcga

SEQ ID NO: 3148261 - RNA, 15 nt, Mycobacterium bovis subsp bovis AF2122/97
cggcuaggccggccg

SEQ ID NO: 3148262 - RNA, 16 nt, Mycobacterium bovis subsp bovis AF2122/97
cggcuaggccggccgg

SEQ ID NO: 3148263 - RNA, 20 nt, Mycobacterium bovis subsp bovis AF2122/97
cggcuagggcagcagcccgg

SEQ ID NO: 3148264 - RNA, 19 nt, Mycobacterium bovis subsp bovis AF2122/97
cggcuaggucagcgggcuu

SEQ ID NO: 3148265 - RNA, 23 nt, Mycobacterium bovis subsp bovis AF2122/97
cggcuagugugaccgucagcccg

SEQ ID NO: 3148266 - RNA, 20 nt, Mycobacterium bovis subsp bovis AF2122/97
cggcuauaucccgccccggg

SEQ ID NO: 3148267 - RNA, 12 nt, Mycobacterium bovis subsp bovis AF2122/97
cggcuaugcugg

SEQ ID NO: 3148268 - RNA, 14 nt, Mycobacterium bovis subsp bovis AF2122/97
cggcuauggcgccg

SEQ ID NO: 3148269 - RNA, 17 nt, Mycobacterium bovis subsp bovis AF2122/97
cggcuauggcgccgcgg

SEQ ID NO: 3148270 - RNA, 18 nt, Mycobacterium bovis subsp bovis AF2122/97
cggcuauggcgccgcggc

SEQ ID NO: 3148271 - RNA, 18 nt, Mycobacterium bovis subsp bovis AF2122/97
cggcuauggguucgcggu

SEQ ID NO: 3148272 - RNA, 22 nt, Mycobacterium bovis subsp bovis AF2122/97
cggcucaacaccgaguuccucu

SEQ ID NO: 3148273 - RNA, 15 nt, Mycobacterium bovis subsp bovis AF2122/97
cggcucaaucuccuc

SEQ ID NO: 3148274 - RNA, 19 nt, Mycobacterium bovis subsp bovis AF2122/97
cggcucaaucuccuccgcg

SEQ ID NO: 3148275 - RNA, 21 nt, Mycobacterium bovis subsp bovis AF2122/97
cggcucacagcacagcgcagc

SEQ ID NO: 3148276 - RNA, 13 nt, Mycobacterium bovis subsp bovis AF2122/97
cggcucaccgcgc

SEQ ID NO: 3148277 - RNA, 14 nt, Mycobacterium bovis subsp bovis AF2122/97
cggcucaccgcgca

SEQ ID NO: 3148278 - RNA, 21 nt, Mycobacterium bovis subsp bovis AF2122/97
cggcucaccgcgcaucaucgc

SEQ ID NO: 3148279 - RNA, 13 nt, Mycobacterium bovis subsp bovis AF2122/97
cggcucacgaccg

SEQ ID NO: 3148280 - RNA, 17 nt, Mycobacterium bovis subsp bovis AF2122/97
cggcucacgaccggcca

SEQ ID NO: 3148281 - RNA, 18 nt, Mycobacterium bovis subsp bovis AF2122/97
cggcucacgaccggccaa

SEQ ID NO: 3148282 - RNA, 20 nt, Mycobacterium bovis subsp bovis AF2122/97
cggcucagaccaaggcgaag

SEQ ID NO: 3148283 - RNA, 21 nt, Mycobacterium bovis subsp bovis AF2122/97
cggcucagacgacgaucgcgu

SEQ ID NO: 3148284 - RNA, 23 nt, Mycobacterium bovis subsp bovis AF2122/97
cggcucaggugugugacgaucgu

SEQ ID NO: 3148285 - RNA, 16 nt, Mycobacterium bovis subsp bovis AF2122/97
cggcucaucccgaccc

SEQ ID NO: 3148286 - RNA, 14 nt, Mycobacterium bovis subsp bovis AF2122/97
cggcuccaacgaug

SEQ ID NO: 3148287 - RNA, 18 nt, Mycobacterium bovis subsp bovis AF2122/97
cggcuccaacgauggaac

SEQ ID NO: 3148288 - RNA, 13 nt, Mycobacterium bovis subsp bovis AF2122/97
cggcuccaccggg

SEQ ID NO: 3148289 - RNA, 19 nt, Mycobacterium bovis subsp bovis AF2122/97
cggcuccaccgggcccgcc

SEQ ID NO: 3148290 - RNA, 19 nt, Mycobacterium bovis subsp bovis AF2122/97
cggcuccacuuggggcgcc

SEQ ID NO: 3148291 - RNA, 21 nt, Mycobacterium bovis subsp bovis AF2122/97
cggcuccacuuggggcgccag

SEQ ID NO: 3148292 - RNA, 13 nt, Mycobacterium bovis subsp bovis AF2122/97
cggcuccagcacc

SEQ ID NO: 3148293 - RNA, 14 nt, Mycobacterium bovis subsp bovis AF2122/97
cggcuccagcaccg

SEQ ID NO: 3148294 - RNA, 23 nt, Mycobacterium bovis subsp bovis AF2122/97
cggcuccagcaccgugacccuga

SEQ ID NO: 3148295 - RNA, 17 nt, Mycobacterium bovis subsp bovis AF2122/97
cggcuccagcaugggcg

SEQ ID NO: 3148296 - RNA, 20 nt, Mycobacterium bovis subsp bovis AF2122/97
cggcuccagguccacaucca

SEQ ID NO: 3148297 - RNA, 22 nt, Mycobacterium bovis subsp bovis AF2122/97
cggcuccagguccacauccagg

SEQ ID NO: 3148298 - RNA, 17 nt, Mycobacterium bovis subsp bovis AF2122/97
cggcuccgaaggccgcc

SEQ ID NO: 3148299 - RNA, 13 nt, Mycobacterium bovis subsp bovis AF2122/97
cggcuccgaugca

SEQ ID NO: 3148300 - RNA, 13 nt, Mycobacterium bovis subsp bovis AF2122/97
cggcuccgcaacc

SEQ ID NO: 3148301 - RNA, 15 nt, Mycobacterium bovis subsp bovis AF2122/97
cggcuccgcaaccag

SEQ ID NO: 3148302 - RNA, 13 nt, Mycobacterium bovis subsp bovis AF2122/97
cggcuccgccacu

SEQ ID NO: 3148303 - RNA, 21 nt, Mycobacterium bovis subsp bovis AF2122/97
cggcuccgccacuggcgccgg

SEQ ID NO: 3148304 - RNA, 22 nt, Mycobacterium bovis subsp bovis AF2122/97
cggcuccgccacuggcgccggu

SEQ ID NO: 3148305 - RNA, 23 nt, Mycobacterium bovis subsp bovis AF2122/97
cggcuccgccacuggcgccggug

SEQ ID NO: 3148306 - RNA, 16 nt, Mycobacterium bovis subsp bovis AF2122/97
cggcuccgcccggcgu

SEQ ID NO: 3148307 - RNA, 18 nt, Mycobacterium bovis subsp bovis AF2122/97
cggcuccgcccggcgugu

SEQ ID NO: 3148308 - RNA, 13 nt, Mycobacterium bovis subsp bovis AF2122/97
cggcuccgccgcg

SEQ ID NO: 3148309 - RNA, 14 nt, Mycobacterium bovis subsp bovis AF2122/97
cggcuccgccgcgg

SEQ ID NO: 3148310 - RNA, 16 nt, Mycobacterium bovis subsp bovis AF2122/97
cggcuccgccgcgggc

SEQ ID NO: 3148311 - RNA, 15 nt, Mycobacterium bovis subsp bovis AF2122/97
cggcuccgccguuga

SEQ ID NO: 3148312 - RNA, 15 nt, Mycobacterium bovis subsp bovis AF2122/97
cggcuccgccguugc

SEQ ID NO: 3148313 - RNA, 17 nt, Mycobacterium bovis subsp bovis AF2122/97
cggcuccgccguugccg

SEQ ID NO: 3148314 - RNA, 19 nt, Mycobacterium bovis subsp bovis AF2122/97
cggcuccgccguugccgcc

SEQ ID NO: 3148315 - RNA, 20 nt, Mycobacterium bovis subsp bovis AF2122/97
cggcuccgccguugccgccg

SEQ ID NO: 3148316 - RNA, 21 nt, Mycobacterium bovis subsp bovis AF2122/97
cggcuccgccguugccgccgc

SEQ ID NO: 3148317 - RNA, 16 nt, Mycobacterium bovis subsp bovis AF2122/97
cggcuccgcgacgggc

SEQ ID NO: 3148318 - RNA, 16 nt, Mycobacterium bovis subsp bovis AF2122/97
cggcuccggcggcagc

SEQ ID NO: 3148319 - RNA, 13 nt, Mycobacterium bovis subsp bovis AF2122/97
cggcuccggcggu

SEQ ID NO: 3148320 - RNA, 16 nt, Mycobacterium bovis subsp bovis AF2122/97
cggcuccggcggugcc

SEQ ID NO: 3148321 - RNA, 16 nt, Mycobacterium bovis subsp bovis AF2122/97
cggcuccgguaggcga

SEQ ID NO: 3148322 - RNA, 15 nt, Mycobacterium bovis subsp bovis AF2122/97
cggcuccuccccggc

SEQ ID NO: 3148323 - RNA, 16 nt, Mycobacterium bovis subsp bovis AF2122/97
cggcuccuccccggcc

SEQ ID NO: 3148324 - RNA, 19 nt, Mycobacterium bovis subsp bovis AF2122/97
cggcuccuccccggcccgc

SEQ ID NO: 3148325 - RNA, 22 nt, Mycobacterium bovis subsp bovis AF2122/97
cggcuccuccccggcccgcuca

SEQ ID NO: 3148326 - RNA, 20 nt, Mycobacterium bovis subsp bovis AF2122/97
cggcuccuccgguaucggcg

SEQ ID NO: 3148327 - RNA, 21 nt, Mycobacterium bovis subsp bovis AF2122/97
cggcucgaauacggugccaag

SEQ ID NO: 3148328 - RNA, 16 nt, Mycobacterium bovis subsp bovis AF2122/97
cggcucgacgcgucgc

SEQ ID NO: 3148329 - RNA, 17 nt, Mycobacterium bovis subsp bovis AF2122/97
cggcucgagucgcagca

SEQ ID NO: 3148330 - RNA, 17 nt, Mycobacterium bovis subsp bovis AF2122/97
cggcucgccgacccgcc

SEQ ID NO: 3148331 - RNA, 21 nt, Mycobacterium bovis subsp bovis AF2122/97
cggcucgccgacccgccgcgg

SEQ ID NO: 3148332 - RNA, 13 nt, Mycobacterium bovis subsp bovis AF2122/97
cggcucgccggcg

SEQ ID NO: 3148333 - RNA, 14 nt, Mycobacterium bovis subsp bovis AF2122/97
cggcucgccggcga

SEQ ID NO: 3148334 - RNA, 19 nt, Mycobacterium bovis subsp bovis AF2122/97
cggcucgccggcgaccggg

SEQ ID NO: 3148335 - RNA, 22 nt, Mycobacterium bovis subsp bovis AF2122/97
cggcucgccggcgcgcaccccg

SEQ ID NO: 3148336 - RNA, 23 nt, Mycobacterium bovis subsp bovis AF2122/97
cggcucgccggcgcgcaccccgg

SEQ ID NO: 3148337 - RNA, 14 nt, Mycobacterium bovis subsp bovis AF2122/97
cggcucgccggcgg

SEQ ID NO: 3148338 - RNA, 17 nt, Mycobacterium bovis subsp bovis AF2122/97
cggcucgccggcggccc

SEQ ID NO: 3148339 - RNA, 15 nt, Mycobacterium bovis subsp bovis AF2122/97
cggcucgccggcucg

SEQ ID NO: 3148340 - RNA, 20 nt, Mycobacterium bovis subsp bovis AF2122/97
cggcucgccggcucggcggu

SEQ ID NO: 3148341 - RNA, 24 nt, Mycobacterium bovis subsp bovis AF2122/97
cggcucgcugaucuggggcaccac

SEQ ID NO: 3148342 - RNA, 17 nt, Mycobacterium bovis subsp bovis AF2122/97
cggcucggaaaccgccc

SEQ ID NO: 3148343 - RNA, 15 nt, Mycobacterium bovis subsp bovis AF2122/97
cggcucggccaccga

SEQ ID NO: 3148344 - RNA, 12 nt, Mycobacterium bovis subsp bovis AF2122/97
cggcucggccag

SEQ ID NO: 3148345 - RNA, 18 nt, Mycobacterium bovis subsp bovis AF2122/97
cggcugcguuguguuccg

SEQ ID NO: 3148346 - RNA, 23 nt, Mycobacterium bovis subsp bovis AF2122/97
cggcugcuaugggucguugucgg

SEQ ID NO: 3148347 - RNA, 18 nt, Mycobacterium bovis subsp bovis AF2122/97
cggcugcuccgucgccga

SEQ ID NO: 3148348 - RNA, 16 nt, Mycobacterium bovis subsp bovis AF2122/97
cggcugcugcgcggug

SEQ ID NO: 3148349 - RNA, 18 nt, Mycobacterium bovis subsp bovis AF2122/97
cggcugcuuggucgccca

SEQ ID NO: 3148350 - RNA, 20 nt, Mycobacterium bovis subsp bovis AF2122/97
cggcugcuuggucgcccagc

SEQ ID NO: 3148351 - RNA, 23 nt, Mycobacterium bovis subsp bovis AF2122/97
cggcugcuuggucgcccagccac

SEQ ID NO: 3148352 - RNA, 20 nt, Mycobacterium bovis subsp bovis AF2122/97
cggcugcuuuaaccgcguca

SEQ ID NO: 3148353 - RNA, 19 nt, Mycobacterium bovis subsp bovis AF2122/97
cggcuggaagcggcgacua

SEQ ID NO: 3148354 - RNA, 17 nt, Mycobacterium bovis subsp bovis AF2122/97
cggcuggacggcgccgg

SEQ ID NO: 3148355 - RNA, 14 nt, Mycobacterium bovis subsp bovis AF2122/97
cggcuggccgcgcc

SEQ ID NO: 3148356 - RNA, 21 nt, Mycobacterium bovis subsp bovis AF2122/97
cggcuggccgcgccucggucu

SEQ ID NO: 3148357 - RNA, 15 nt, Mycobacterium bovis subsp bovis AF2122/97
cggcuggcgucgaug

SEQ ID NO: 3148358 - RNA, 20 nt, Mycobacterium bovis subsp bovis AF2122/97
cggcuggcgugcugcuagcc

SEQ ID NO: 3148359 - RNA, 23 nt, Mycobacterium bovis subsp bovis AF2122/97
cggcuggcuagcagguacucgcc

SEQ ID NO: 3148360 - RNA, 13 nt, Mycobacterium bovis subsp bovis AF2122/97
cggcugggcgaag

SEQ ID NO: 3148361 - RNA, 17 nt, Mycobacterium bovis subsp bovis AF2122/97
cggcugggcgaagccca

SEQ ID NO: 3148362 - RNA, 16 nt, Mycobacterium bovis subsp bovis AF2122/97
cggcugggggauaccg

SEQ ID NO: 3148363 - RNA, 18 nt, Mycobacterium bovis subsp bovis AF2122/97
cggcugggggauaccgcu

SEQ ID NO: 3148364 - RNA, 21 nt, Mycobacterium bovis subsp bovis AF2122/97
cggcugggggauaccgcuggg

SEQ ID NO: 3148365 - RNA, 18 nt, Mycobacterium bovis subsp bovis AF2122/97
cggcuggugccaacugcg

SEQ ID NO: 3148366 - RNA, 22 nt, Mycobacterium bovis subsp bovis AF2122/97
cggcuggugccaacugcgccgu

SEQ ID NO: 3148367 - RNA, 19 nt, Mycobacterium bovis subsp bovis AF2122/97
cggcuggugggacgcggcc

SEQ ID NO: 3148368 - RNA, 22 nt, Mycobacterium bovis subsp bovis AF2122/97
cggcuggugggggagcggccgc

SEQ ID NO: 3148369 - RNA, 20 nt, Mycobacterium bovis subsp bovis AF2122/97
cggcugguguccagccaggc

SEQ ID NO: 3148370 - RNA, 21 nt, Mycobacterium bovis subsp bovis AF2122/97
cggcugucacaagccugccgg

SEQ ID NO: 3148371 - RNA, 18 nt, Mycobacterium bovis subsp bovis AF2122/97
cggcugucacgccugcca

SEQ ID NO: 3148372 - RNA, 16 nt, Mycobacterium bovis subsp bovis AF2122/97
cggcugucggccgggu

SEQ ID NO: 3148373 - RNA, 19 nt, Mycobacterium bovis subsp bovis AF2122/97
cggcugucgugccucucgg

SEQ ID NO: 3148374 - RNA, 23 nt, Mycobacterium bovis subsp bovis AF2122/97
cggcuguggucgcugcugccgca

SEQ ID NO: 3148375 - RNA, 19 nt, Mycobacterium bovis subsp bovis AF2122/97
cggcuguugcggcggcgcu

SEQ ID NO: 3148376 - RNA, 16 nt, Mycobacterium bovis subsp bovis AF2122/97
cggcuguugcguucgg

SEQ ID NO: 3148377 - RNA, 17 nt, Mycobacterium bovis subsp bovis AF2122/97
cggcuguugcguucggu

SEQ ID NO: 3148378 - RNA, 21 nt, Mycobacterium bovis subsp bovis AF2122/97
cggcuucaguccggcccccga

SEQ ID NO: 3148379 - RNA, 18 nt, Mycobacterium bovis subsp bovis AF2122/97
cggcuuccaacucggcgg

SEQ ID NO: 3148380 - RNA, 21 nt, Mycobacterium bovis subsp bovis AF2122/97
cggcuuccaacucggcggcca

SEQ ID NO: 3148381 - RNA, 24 nt, Mycobacterium bovis subsp bovis AF2122/97
cggcuuccaacucggcggccagcg

SEQ ID NO: 3148382 - RNA, 22 nt, Mycobacterium bovis subsp bovis AF2122/97
cggcuuccccgguagcguucgg

SEQ ID NO: 3148383 - RNA, 13 nt, Mycobacterium bovis subsp bovis AF2122/97
cggcuuccuccuc

SEQ ID NO: 3148384 - RNA, 14 nt, Mycobacterium bovis subsp bovis AF2122/97
cggcuuccuccucg

SEQ ID NO: 3148385 - RNA, 17 nt, Mycobacterium bovis subsp bovis AF2122/97
cggcuuccuccucggcg

SEQ ID NO: 3148386 - RNA, 19 nt, Mycobacterium bovis subsp bovis AF2122/97
cggcuuccuccucggcgcg

SEQ ID NO: 3148387 - RNA, 20 nt, Mycobacterium bovis subsp bovis AF2122/97
cggcuuccuccucggcgcga

SEQ ID NO: 3148388 - RNA, 17 nt, Mycobacterium bovis subsp bovis AF2122/97
cggcuucgaccaucacc

SEQ ID NO: 3148389 - RNA, 22 nt, Mycobacterium bovis subsp bovis AF2122/97
cggcuucgaccaucaccacggc

SEQ ID NO: 3148390 - RNA, 21 nt, Mycobacterium bovis subsp bovis AF2122/97
cggcuucgacgucggcgacca

SEQ ID NO: 3148391 - RNA, 20 nt, Mycobacterium bovis subsp bovis AF2122/97
cggcuucgcccagagccgcu

SEQ ID NO: 3148392 - RNA, 16 nt, Mycobacterium bovis subsp bovis AF2122/97
cggcuucgccgcgcuu

SEQ ID NO: 3148393 - RNA, 14 nt, Mycobacterium bovis subsp bovis AF2122/97
cggcuucgccgcgg

SEQ ID NO: 3148394 - RNA, 19 nt, Mycobacterium bovis subsp bovis AF2122/97
cggcuucgccgcgggacag

SEQ ID NO: 3148395 - RNA, 21 nt, Mycobacterium bovis subsp bovis AF2122/97
cggcuucgcuuuugaaccggg

SEQ ID NO: 3148396 - RNA, 15 nt, Mycobacterium bovis subsp bovis AF2122/97
cggcuucggcagacc

SEQ ID NO: 3148397 - RNA, 14 nt, Mycobacterium bovis subsp bovis AF2122/97
cggcuucggccagc

SEQ ID NO: 3148398 - RNA, 15 nt, Mycobacterium bovis subsp bovis AF2122/97
cggcuucggccagca

SEQ ID NO: 3148399 - RNA, 21 nt, Mycobacterium bovis subsp bovis AF2122/97
cggcuucgggguaaccggcgg

SEQ ID NO: 3148400 - RNA, 16 nt, Mycobacterium bovis subsp bovis AF2122/97
cggcuucggguguucg

SEQ ID NO: 3148401 - RNA, 23 nt, Mycobacterium bovis subsp bovis AF2122/97
cggcuucggguguucgcgcgcga

SEQ ID NO: 3148402 - RNA, 18 nt, Mycobacterium bovis subsp bovis AF2122/97
cggcuucggugagcgggc

SEQ ID NO: 3148403 - RNA, 15 nt, Mycobacterium bovis subsp bovis AF2122/97
cggcuucguccaccg

SEQ ID NO: 3148404 - RNA, 18 nt, Mycobacterium bovis subsp bovis AF2122/97
cggcuucguccaccgcga

SEQ ID NO: 3148405 - RNA, 14 nt, Mycobacterium bovis subsp bovis AF2122/97
cggcuucgucgaca

SEQ ID NO: 3148406 - RNA, 17 nt, Mycobacterium bovis subsp bovis AF2122/97
cggcuucgucggccagc

SEQ ID NO: 3148407 - RNA, 18 nt, Mycobacterium bovis subsp bovis AF2122/97
cggcuucgucggccagca

SEQ ID NO: 3148408 - RNA, 21 nt, Mycobacterium bovis subsp bovis AF2122/97
cggcuucgucggccagcagca

SEQ ID NO: 3148409 - RNA, 16 nt, Mycobacterium bovis subsp bovis AF2122/97
cggcuucguggcggcg

SEQ ID NO: 3148410 - RNA, 21 nt, Mycobacterium bovis subsp bovis AF2122/97
cggcuucguggcggcgcgcgc

SEQ ID NO: 3148411 - RNA, 20 nt, Mycobacterium bovis subsp bovis AF2122/97
cggcuucucgaugaugucga

SEQ ID NO: 3148412 - RNA, 19 nt, Mycobacterium bovis subsp bovis AF2122/97
cggcuucuugaccacgaac

SEQ ID NO: 3148413 - RNA, 13 nt, Mycobacterium bovis subsp bovis AF2122/97
cggcuugagccgc

SEQ ID NO: 3148414 - RNA, 14 nt, Mycobacterium bovis subsp bovis AF2122/97
cggcuugagccgca

SEQ ID NO: 3148415 - RNA, 17 nt, Mycobacterium bovis subsp bovis AF2122/97
cggcuugagccgcagca

SEQ ID NO: 3148416 - RNA, 20 nt, Mycobacterium bovis subsp bovis AF2122/97
cggcuugagccgcagcaccu

SEQ ID NO: 3148417 - RNA, 23 nt, Mycobacterium bovis subsp bovis AF2122/97
cggcuugcagugaggucaucguc

SEQ ID NO: 3148418 - RNA, 16 nt, Mycobacterium bovis subsp bovis AF2122/97
cggcuugcccaggcgc

SEQ ID NO: 3148419 - RNA, 13 nt, Mycobacterium bovis subsp bovis AF2122/97
cggcuugccgccg

SEQ ID NO: 3148420 - RNA, 19 nt, Mycobacterium bovis subsp bovis AF2122/97
cggcuugcgauuggcuggg

SEQ ID NO: 3148421 - RNA, 22 nt, Mycobacterium bovis subsp bovis AF2122/97
cggcuugcgauuggcugggucg

SEQ ID NO: 3148422 - RNA, 15 nt, Mycobacterium bovis subsp bovis AF2122/97
cggcuugcgugaugg

SEQ ID NO: 3148423 - RNA, 12 nt, Mycobacterium bovis subsp bovis AF2122/97
cggcuugcugcc

SEQ ID NO: 3148424 - RNA, 20 nt, Mycobacterium bovis subsp bovis AF2122/97
cggcuugcugccccauaaac

SEQ ID NO: 3148425 - RNA, 17 nt, Mycobacterium bovis subsp bovis AF2122/97
cggcuuggccgccccgg

SEQ ID NO: 3148426 - RNA, 21 nt, Mycobacterium bovis subsp bovis AF2122/97
cggcuuggccgccccggccgc

SEQ ID NO: 3148427 - RNA, 22 nt, Mycobacterium bovis subsp bovis AF2122/97
cggcuuggccgccccggccgcu

SEQ ID NO: 3148428 - RNA, 19 nt, Mycobacterium bovis subsp bovis AF2122/97
cggcuuggccuagccgcgg

SEQ ID NO: 3148429 - RNA, 23 nt, Mycobacterium bovis subsp bovis AF2122/97
cggcuuggccuagccgcggcacc

SEQ ID NO: 3148430 - RNA, 16 nt, Mycobacterium bovis subsp bovis AF2122/97
cggcuuggcgggaccg

SEQ ID NO: 3148431 - RNA, 21 nt, Mycobacterium bovis subsp bovis AF2122/97
cgggacgaaaaaaucgugcgg

SEQ ID NO: 3148432 - RNA, 19 nt, Mycobacterium bovis subsp bovis AF2122/97
cgggacgaaucccgcgccc

SEQ ID NO: 3148433 - RNA, 14 nt, Mycobacterium bovis subsp bovis AF2122/97
cgggacgccccguc

SEQ ID NO: 3148434 - RNA, 21 nt, Mycobacterium bovis subsp bovis AF2122/97
cgggacgccccgucuggcaug

SEQ ID NO: 3148435 - RNA, 13 nt, Mycobacterium bovis subsp bovis AF2122/97
cgggacgccgccc

SEQ ID NO: 3148436 - RNA, 12 nt, Mycobacterium bovis subsp bovis AF2122/97
cgggacgccgug

SEQ ID NO: 3148437 - RNA, 20 nt, Mycobacterium bovis subsp bovis AF2122/97
cgggacgccuugaucggcga

SEQ ID NO: 3148438 - RNA, 18 nt, Mycobacterium bovis subsp bovis AF2122/97
cgggacgcgagugcguga

SEQ ID NO: 3148439 - RNA, 19 nt, Mycobacterium bovis subsp bovis AF2122/97
cgggacgcugccggucaua

SEQ ID NO: 3148440 - RNA, 14 nt, Mycobacterium bovis subsp bovis AF2122/97
cgggacggccaaca

SEQ ID NO: 3148441 - RNA, 23 nt, Mycobacterium bovis subsp bovis AF2122/97
cgggacggccaacagggcgccga

SEQ ID NO: 3148442 - RNA, 21 nt, Mycobacterium bovis subsp bovis AF2122/97
cgggacgggggcuguccaccg

SEQ ID NO: 3148443 - RNA, 14 nt, Mycobacterium bovis subsp bovis AF2122/97
cgggacgucgucgu

SEQ ID NO: 3148444 - RNA, 17 nt, Mycobacterium bovis subsp bovis AF2122/97
cgggacgucgucguuga

SEQ ID NO: 3148445 - RNA, 13 nt, Mycobacterium bovis subsp bovis AF2122/97
cgggacguugucc

SEQ ID NO: 3148446 - RNA, 19 nt, Mycobacterium bovis subsp bovis AF2122/97
cgggacguuguccaccgcc

SEQ ID NO: 3148447 - RNA, 20 nt, Mycobacterium bovis subsp bovis AF2122/97
cgggacguuguccaccgcca

SEQ ID NO: 3148448 - RNA, 21 nt, Mycobacterium bovis subsp bovis AF2122/97
cgggacguuguccaccgccac

SEQ ID NO: 3148449 - RNA, 16 nt, Mycobacterium bovis subsp bovis AF2122/97
cgggacucccgcgcgg

SEQ ID NO: 3148450 - RNA, 20 nt, Mycobacterium bovis subsp bovis AF2122/97
cgggacucccgcgcgggcgg

SEQ ID NO: 3148451 - RNA, 14 nt, Mycobacterium bovis subsp bovis AF2122/97
cgggacucggcgag

SEQ ID NO: 3148452 - RNA, 21 nt, Mycobacterium bovis subsp bovis AF2122/97
cgggacugacccugaucguga

SEQ ID NO: 3148453 - RNA, 15 nt, Mycobacterium bovis subsp bovis AF2122/97
cgggacugcagcgcg

SEQ ID NO: 3148454 - RNA, 22 nt, Mycobacterium bovis subsp bovis AF2122/97
cgggacugcagcgcggugguca

SEQ ID NO: 3148455 - RNA, 16 nt, Mycobacterium bovis subsp bovis AF2122/97
cgggacuggcugaucg

SEQ ID NO: 3148456 - RNA, 21 nt, Mycobacterium bovis subsp bovis AF2122/97
cgggacuggcugaucggcguu

SEQ ID NO: 3148457 - RNA, 17 nt, Mycobacterium bovis subsp bovis AF2122/97
cgggacuucgugccucg

SEQ ID NO: 3148458 - RNA, 19 nt, Mycobacterium bovis subsp bovis AF2122/97
cgggagaaaacggcggcgc

SEQ ID NO: 3148459 - RNA, 19 nt, Mycobacterium bovis subsp bovis AF2122/97
cgggagaacgugccgaguu

SEQ ID NO: 3148460 - RNA, 19 nt, Mycobacterium bovis subsp bovis AF2122/97
cgggagacgcugcgcgcca

SEQ ID NO: 3148461 - RNA, 14 nt, Mycobacterium bovis subsp bovis AF2122/97
cgggagaucgucgc

SEQ ID NO: 3148462 - RNA, 22 nt, Mycobacterium bovis subsp bovis AF2122/97
cgggagcaccgaccagggccgc

SEQ ID NO: 3148463 - RNA, 16 nt, Mycobacterium bovis subsp bovis AF2122/97
cgggagcccgagcuca

SEQ ID NO: 3148464 - RNA, 15 nt, Mycobacterium bovis subsp bovis AF2122/97
cgggagcgacgucgg

SEQ ID NO: 3148465 - RNA, 21 nt, Mycobacterium bovis subsp bovis AF2122/97
cgggagcggaauggcgccggc

SEQ ID NO: 3148466 - RNA, 17 nt, Mycobacterium bovis subsp bovis AF2122/97
cgggagcggcugcggca

SEQ ID NO: 3148467 - RNA, 17 nt, Mycobacterium bovis subsp bovis AF2122/97
cgggaggaugucgagcc

SEQ ID NO: 3148468 - RNA, 18 nt, Mycobacterium bovis subsp bovis AF2122/97
cgggaggcggcgccgcac

SEQ ID NO: 3148469 - RNA, 17 nt, Mycobacterium bovis subsp bovis AF2122/97
cgggagguacccccagc

SEQ ID NO: 3148470 - RNA, 19 nt, Mycobacterium bovis subsp bovis AF2122/97
cgggaguaagggaagcgau

SEQ ID NO: 3148471 - RNA, 19 nt, Mycobacterium bovis subsp bovis AF2122/97
cgggaguacgggagccggc

SEQ ID NO: 3148472 - RNA, 15 nt, Mycobacterium bovis subsp bovis AF2122/97
cgggaguccgguagc

SEQ ID NO: 3148473 - RNA, 13 nt, Mycobacterium bovis subsp bovis AF2122/97
cgggagucgacgg

SEQ ID NO: 3148474 - RNA, 13 nt, Mycobacterium bovis subsp bovis AF2122/97
cgggagucgucga

SEQ ID NO: 3148475 - RNA, 15 nt, Mycobacterium bovis subsp bovis AF2122/97
cgggagugcgccggc

SEQ ID NO: 3148476 - RNA, 15 nt, Mycobacterium bovis subsp bovis AF2122/97
cgggaguucggggug

SEQ ID NO: 3148477 - RNA, 17 nt, Mycobacterium bovis subsp bovis AF2122/97
cgggauaacccagcacc

SEQ ID NO: 3148478 - RNA, 18 nt, Mycobacterium bovis subsp bovis AF2122/97
cgggauaacccagcacca

SEQ ID NO: 3148479 - RNA, 21 nt, Mycobacterium bovis subsp bovis AF2122/97
cgggauagacgaccccgguga

SEQ ID NO: 3148480 - RNA, 17 nt, Mycobacterium bovis subsp bovis AF2122/97
cgggauaucgucgacgc

SEQ ID NO: 3148481 - RNA, 14 nt, Mycobacterium bovis subsp bovis AF2122/97
cgggauccaggccc

SEQ ID NO: 3148482 - RNA, 20 nt, Mycobacterium bovis subsp bovis AF2122/97
cgggauccaggcccagccga

SEQ ID NO: 3148483 - RNA, 18 nt, Mycobacterium bovis subsp bovis AF2122/97
cgggaucccacggcgggc

SEQ ID NO: 3148484 - RNA, 17 nt, Mycobacterium bovis subsp bovis AF2122/97
cgggaucccgaucguga

SEQ ID NO: 3148485 - RNA, 15 nt, Mycobacterium bovis subsp bovis AF2122/97
cgggauccuccgggu

SEQ ID NO: 3148486 - RNA, 14 nt, Mycobacterium bovis subsp bovis AF2122/97
cgggaucgacccgc

SEQ ID NO: 3148487 - RNA, 13 nt, Mycobacterium bovis subsp bovis AF2122/97
cgggaucgcccag

SEQ ID NO: 3148488 - RNA, 15 nt, Mycobacterium bovis subsp bovis AF2122/97
cgggaucgcccaggc

SEQ ID NO: 3148489 - RNA, 16 nt, Mycobacterium bovis subsp bovis AF2122/97
cgggaucgcccaggcg

SEQ ID NO: 3148490 - RNA, 17 nt, Mycobacterium bovis subsp bovis AF2122/97
cgggaucgcccaggcgc

SEQ ID NO: 3148491 - RNA, 19 nt, Mycobacterium bovis subsp bovis AF2122/97
cgggaucgcccaggcgcga

SEQ ID NO: 3148492 - RNA, 16 nt, Mycobacterium bovis subsp bovis AF2122/97
cgggaucgccgagacc

SEQ ID NO: 3148493 - RNA, 20 nt, Mycobacterium bovis subsp bovis AF2122/97
cgggaucgccgagaccgcgu

SEQ ID NO: 3148494 - RNA, 15 nt, Mycobacterium bovis subsp bovis AF2122/97
cgggaucgcugccag

SEQ ID NO: 3148495 - RNA, 19 nt, Mycobacterium bovis subsp bovis AF2122/97
cgggaucgcugccagcggc

SEQ ID NO: 3148496 - RNA, 21 nt, Mycobacterium bovis subsp bovis AF2122/97
cgggaucgcugccagcggccg

SEQ ID NO: 3148497 - RNA, 15 nt, Mycobacterium bovis subsp bovis AF2122/97
cgggaucggcuccgc

SEQ ID NO: 3148498 - RNA, 20 nt, Mycobacterium bovis subsp bovis AF2122/97
cgggaucgggcccuccggcg

SEQ ID NO: 3148499 - RNA, 17 nt, Mycobacterium bovis subsp bovis AF2122/97
cgggaucguuggccagu

SEQ ID NO: 3148500 - RNA, 22 nt, Mycobacterium bovis subsp bovis AF2122/97
cgggaucugagggcucgguggc

SEQ ID NO: 3148501 - RNA, 18 nt, Mycobacterium bovis subsp bovis AF2122/97
cgggaucugggcucgguc

SEQ ID NO: 3148502 - RNA, 17 nt, Mycobacterium bovis subsp bovis AF2122/97
cgggaugaagccaccca

SEQ ID NO: 3148503 - RNA, 13 nt, Mycobacterium bovis subsp bovis AF2122/97
cgggaugaccacc

SEQ ID NO: 3148504 - RNA, 14 nt, Mycobacterium bovis subsp bovis AF2122/97
cgggaugaccaccg

SEQ ID NO: 3148505 - RNA, 22 nt, Mycobacterium bovis subsp bovis AF2122/97
cgggaugcagcugcccggcgug

SEQ ID NO: 3148506 - RNA, 15 nt, Mycobacterium bovis subsp bovis AF2122/97
cgggaugccggcgaa

SEQ ID NO: 3148507 - RNA, 22 nt, Mycobacterium bovis subsp bovis AF2122/97
cgggaugccggcgaaggccagc

SEQ ID NO: 3148508 - RNA, 16 nt, Mycobacterium bovis subsp bovis AF2122/97
cgggaugcgcgcccga

SEQ ID NO: 3148509 - RNA, 19 nt, Mycobacterium bovis subsp bovis AF2122/97
cgggaugcgcgcccgacga

SEQ ID NO: 3148510 - RNA, 16 nt, Mycobacterium bovis subsp bovis AF2122/97
cgggaugcggucgauc

SEQ ID NO: 3148511 - RNA, 14 nt, Mycobacterium bovis subsp bovis AF2122/97
cgggaugcucccua

SEQ ID NO: 3148512 - RNA, 20 nt, Mycobacterium bovis subsp bovis AF2122/97
cgggaugcucgauccacugc

SEQ ID NO: 3148513 - RNA, 15 nt, Mycobacterium bovis subsp bovis AF2122/97
cgggauggacaccac

SEQ ID NO: 3148514 - RNA, 15 nt, Mycobacterium bovis subsp bovis AF2122/97
cgggauggacagcug

SEQ ID NO: 3148515 - RNA, 14 nt, Mycobacterium bovis subsp bovis AF2122/97
cgggauggccgccg

SEQ ID NO: 3148516 - RNA, 15 nt, Mycobacterium bovis subsp bovis AF2122/97
cgggauggccgccga

SEQ ID NO: 3148517 - RNA, 16 nt, Mycobacterium bovis subsp bovis AF2122/97
cgggauggccgccgac

SEQ ID NO: 3148518 - RNA, 17 nt, Mycobacterium bovis subsp bovis AF2122/97
cgggccccacggcgggu

SEQ ID NO: 3148519 - RNA, 21 nt, Mycobacterium bovis subsp bovis AF2122/97
cgggccccggggugcccccgg

SEQ ID NO: 3148520 - RNA, 14 nt, Mycobacterium bovis subsp bovis AF2122/97
cgggcccgacgacg

SEQ ID NO: 3148521 - RNA, 15 nt, Mycobacterium bovis subsp bovis AF2122/97
cgggcccgacgacga

SEQ ID NO: 3148522 - RNA, 15 nt, Mycobacterium bovis subsp bovis AF2122/97
cgggcccgacgcgug

SEQ ID NO: 3148523 - RNA, 17 nt, Mycobacterium bovis subsp bovis AF2122/97
cgggcccgacgcguggc

SEQ ID NO: 3148524 - RNA, 14 nt, Mycobacterium bovis subsp bovis AF2122/97
cgggcccgacguug

SEQ ID NO: 3148525 - RNA, 20 nt, Mycobacterium bovis subsp bovis AF2122/97
cgggcccgaugucgucgacg

SEQ ID NO: 3148526 - RNA, 13 nt, Mycobacterium bovis subsp bovis AF2122/97
cgggcccgccggc

SEQ ID NO: 3148527 - RNA, 16 nt, Mycobacterium bovis subsp bovis AF2122/97
cgggcccgccggcccc

SEQ ID NO: 3148528 - RNA, 17 nt, Mycobacterium bovis subsp bovis AF2122/97
cgggcccgccggccccg

SEQ ID NO: 3148529 - RNA, 19 nt, Mycobacterium bovis subsp bovis AF2122/97
cgggcccgccggccccgcc

SEQ ID NO: 3148530 - RNA, 14 nt, Mycobacterium bovis subsp bovis AF2122/97
cgggcccgcgcggc

SEQ ID NO: 3148531 - RNA, 16 nt, Mycobacterium bovis subsp bovis AF2122/97
cgggcccgcgcggcgg

SEQ ID NO: 3148532 - RNA, 13 nt, Mycobacterium bovis subsp bovis AF2122/97
cgggcccggcgag

SEQ ID NO: 3148533 - RNA, 16 nt, Mycobacterium bovis subsp bovis AF2122/97
cgggcccguccugcgg

SEQ ID NO: 3148534 - RNA, 17 nt, Mycobacterium bovis subsp bovis AF2122/97
cgggcccgucgucgucg

SEQ ID NO: 3148535 - RNA, 20 nt, Mycobacterium bovis subsp bovis AF2122/97
cgggcccuccacugcgagcg

SEQ ID NO: 3148536 - RNA, 13 nt, Mycobacterium bovis subsp bovis AF2122/97
cgggcccuccggc

SEQ ID NO: 3148537 - RNA, 17 nt, Mycobacterium bovis subsp bovis AF2122/97
cgggccgaacacaccgg

SEQ ID NO: 3148538 - RNA, 16 nt, Mycobacterium bovis subsp bovis AF2122/97
cgggccgacgcaggug

SEQ ID NO: 3148539 - RNA, 13 nt, Mycobacterium bovis subsp bovis AF2122/97
cgggccgacgggc

SEQ ID NO: 3148540 - RNA, 17 nt, Mycobacterium bovis subsp bovis AF2122/97
cgggccgacgggcgcaa

SEQ ID NO: 3148541 - RNA, 21 nt, Mycobacterium bovis subsp bovis AF2122/97
cgggccgagaucacgccgggc

SEQ ID NO: 3148542 - RNA, 22 nt, Mycobacterium bovis subsp bovis AF2122/97
cgggccgagaucacgccgggcg

SEQ ID NO: 3148543 - RNA, 23 nt, Mycobacterium bovis subsp bovis AF2122/97
cgggccgagaucacgccgggcga

SEQ ID NO: 3148544 - RNA, 14 nt, Mycobacterium bovis subsp bovis AF2122/97
cgggccgagcgcac

SEQ ID NO: 3148545 - RNA, 19 nt, Mycobacterium bovis subsp bovis AF2122/97
cgggccgaggccgucgcga

SEQ ID NO: 3148546 - RNA, 13 nt, Mycobacterium bovis subsp bovis AF2122/97
cgggccgaucacc

SEQ ID NO: 3148547 - RNA, 15 nt, Mycobacterium bovis subsp bovis AF2122/97
cgggccgaucacccc

SEQ ID NO: 3148548 - RNA, 20 nt, Mycobacterium bovis subsp bovis AF2122/97
cgggccgaucaccccggugg

SEQ ID NO: 3148549 - RNA, 22 nt, Mycobacterium bovis subsp bovis AF2122/97
cgggccgaucucuccggcggcg

SEQ ID NO: 3148550 - RNA, 22 nt, Mycobacterium bovis subsp bovis AF2122/97
cgggccgauugcucggggagga

SEQ ID NO: 3148551 - RNA, 12 nt, Mycobacterium bovis subsp bovis AF2122/97
cgggccgccagg

SEQ ID NO: 3148552 - RNA, 13 nt, Mycobacterium bovis subsp bovis AF2122/97
cgggccgccaggc

SEQ ID NO: 3148553 - RNA, 15 nt, Mycobacterium bovis subsp bovis AF2122/97
cgggccgccaggcgg

SEQ ID NO: 3148554 - RNA, 16 nt, Mycobacterium bovis subsp bovis AF2122/97
cgggccgccaggcggc

SEQ ID NO: 3148555 - RNA, 19 nt, Mycobacterium bovis subsp bovis AF2122/97
cgggccgccaucucguagg

SEQ ID NO: 3148556 - RNA, 12 nt, Mycobacterium bovis subsp bovis AF2122/97
cgggccgcgcgc

SEQ ID NO: 3148557 - RNA, 19 nt, Mycobacterium bovis subsp bovis AF2122/97
cgggccgcgcgcagagcgu

SEQ ID NO: 3148558 - RNA, 13 nt, Mycobacterium bovis subsp bovis AF2122/97
cgggccgcgcggc

SEQ ID NO: 3148559 - RNA, 19 nt, Mycobacterium bovis subsp bovis AF2122/97
cgggccgcgcgggccgccg

SEQ ID NO: 3148560 - RNA, 14 nt, Mycobacterium bovis subsp bovis AF2122/97
cgggccgcggcggc

SEQ ID NO: 3148561 - RNA, 21 nt, Mycobacterium bovis subsp bovis AF2122/97
cgggccgcgguacccaccucc

SEQ ID NO: 3148562 - RNA, 21 nt, Mycobacterium bovis subsp bovis AF2122/97
cgggccgcugugggucgaucc

SEQ ID NO: 3148563 - RNA, 24 nt, Mycobacterium bovis subsp bovis AF2122/97
cgggccggaccaucagcgucgacg

SEQ ID NO: 3148564 - RNA, 14 nt, Mycobacterium bovis subsp bovis AF2122/97
cgggccggagccgg

SEQ ID NO: 3148565 - RNA, 18 nt, Mycobacterium bovis subsp bovis AF2122/97
cgggccggaugacgccca

SEQ ID NO: 3148566 - RNA, 21 nt, Mycobacterium bovis subsp bovis AF2122/97
cgggccggaugacgcccaggg

SEQ ID NO: 3148567 - RNA, 13 nt, Mycobacterium bovis subsp bovis AF2122/97
cgggccggccacg

SEQ ID NO: 3148568 - RNA, 15 nt, Mycobacterium bovis subsp bovis AF2122/97
cgggccggccgagcg

SEQ ID NO: 3148569 - RNA, 15 nt, Mycobacterium bovis subsp bovis AF2122/97
cgggccggccgccgc

SEQ ID NO: 3148570 - RNA, 16 nt, Mycobacterium bovis subsp bovis AF2122/97
cgggccggccgccgcg

SEQ ID NO: 3148571 - RNA, 17 nt, Mycobacterium bovis subsp bovis AF2122/97
cgggccggccgccgcgg

SEQ ID NO: 3148572 - RNA, 13 nt, Mycobacterium bovis subsp bovis AF2122/97
cgggccggucggu

SEQ ID NO: 3148573 - RNA, 21 nt, Mycobacterium bovis subsp bovis AF2122/97
cgggccggucggugagccgug

SEQ ID NO: 3148574 - RNA, 14 nt, Mycobacterium bovis subsp bovis AF2122/97
cgggccggugcgca

SEQ ID NO: 3148575 - RNA, 17 nt, Mycobacterium bovis subsp bovis AF2122/97
cgggccggugcgcacca

SEQ ID NO: 3148576 - RNA, 19 nt, Mycobacterium bovis subsp bovis AF2122/97
cgggccggugcgcaccaga

SEQ ID NO: 3148577 - RNA, 14 nt, Mycobacterium bovis subsp bovis AF2122/97
cgggccguacggcg

SEQ ID NO: 3148578 - RNA, 18 nt, Mycobacterium bovis subsp bovis AF2122/97
cgggccgucaaucgcaau

SEQ ID NO: 3148579 - RNA, 14 nt, Mycobacterium bovis subsp bovis AF2122/97
cgggccguccuccc

SEQ ID NO: 3148580 - RNA, 15 nt, Mycobacterium bovis subsp bovis AF2122/97
cgggccguccuccca

SEQ ID NO: 3148581 - RNA, 17 nt, Mycobacterium bovis subsp bovis AF2122/97
cgggccguguccgccgg

SEQ ID NO: 3148582 - RNA, 21 nt, Mycobacterium bovis subsp bovis AF2122/97
cgggccucaugcuaggccacc

SEQ ID NO: 3148583 - RNA, 14 nt, Mycobacterium bovis subsp bovis AF2122/97
cgggccucccccaa

SEQ ID NO: 3148584 - RNA, 15 nt, Mycobacterium bovis subsp bovis AF2122/97
cgggccuccugcugg

SEQ ID NO: 3148585 - RNA, 16 nt, Mycobacterium bovis subsp bovis AF2122/97
cgggccuccugcuggc

SEQ ID NO: 3148586 - RNA, 17 nt, Mycobacterium bovis subsp bovis AF2122/97
cgggccuccugcuggcc

SEQ ID NO: 3148587 - RNA, 16 nt, Mycobacterium bovis subsp bovis AF2122/97
cgggccucggcgacca

SEQ ID NO: 3148588 - RNA, 19 nt, Mycobacterium bovis subsp bovis AF2122/97
cgggccucggcgccgucgg

SEQ ID NO: 3148589 - RNA, 17 nt, Mycobacterium bovis subsp bovis AF2122/97
cgggccugaaccacgcg

SEQ ID NO: 3148590 - RNA, 17 nt, Mycobacterium bovis subsp bovis AF2122/97
cgggccugcaccacggc

SEQ ID NO: 3148591 - RNA, 12 nt, Mycobacterium bovis subsp bovis AF2122/97
cgggccugcacg

SEQ ID NO: 3148592 - RNA, 16 nt, Mycobacterium bovis subsp bovis AF2122/97
cgggccugcacgccgg

SEQ ID NO: 3148593 - RNA, 20 nt, Mycobacterium bovis subsp bovis AF2122/97
cgggccugcacgccggcgcu

SEQ ID NO: 3148594 - RNA, 12 nt, Mycobacterium bovis subsp bovis AF2122/97
cgggccugcgcg

SEQ ID NO: 3148595 - RNA, 22 nt, Mycobacterium bovis subsp bovis AF2122/97
cgggccugcgcgauccgcgcgc

SEQ ID NO: 3148596 - RNA, 14 nt, Mycobacterium bovis subsp bovis AF2122/97
cgggccuggccugc

SEQ ID NO: 3148597 - RNA, 20 nt, Mycobacterium bovis subsp bovis AF2122/97
cgggccuggccugcccagca

SEQ ID NO: 3148598 - RNA, 22 nt, Mycobacterium bovis subsp bovis AF2122/97
cgggccuggccugcccagcacc

SEQ ID NO: 3148599 - RNA, 16 nt, Mycobacterium bovis subsp bovis AF2122/97
cgggccugggacggcg

SEQ ID NO: 3148600 - RNA, 17 nt, Mycobacterium bovis subsp bovis AF2122/97
cgggccugggacggcgg

SEQ ID NO: 3148601 - RNA, 19 nt, Mycobacterium bovis subsp bovis AF2122/97
cgggccugggacggcggca

SEQ ID NO: 3148602 - RNA, 13 nt, Mycobacterium bovis subsp bovis AF2122/97
cgggccuucgcca

SEQ ID NO: 3148603 - RNA, 15 nt, Mycobacterium bovis subsp bovis AF2122/97
cgggccuucgccacu

SEQ ID NO: 3148604 - RNA, 20 nt, Mycobacterium bovis subsp bovis AF2122/97
cgggcgaaacgcccgggcgg

SEQ ID NO: 3148605 - RNA, 21 nt, Mycobacterium bovis subsp bovis AF2122/97
cgggcggauacaugguccggc

SEQ ID NO: 3148606 - RNA, 22 nt, Mycobacterium bovis subsp bovis AF2122/97
cgggcggaugcuguugacccgu

SEQ ID NO: 3148607 - RNA, 15 nt, Mycobacterium bovis subsp bovis AF2122/97
cgggcggcagcggcu

SEQ ID NO: 3148608 - RNA, 21 nt, Mycobacterium bovis subsp bovis AF2122/97
cgggcggcauccugcacgacc

SEQ ID NO: 3148609 - RNA, 21 nt, Mycobacterium bovis subsp bovis AF2122/97
cgggcggcaucgccgaggugg

SEQ ID NO: 3148610 - RNA, 14 nt, Mycobacterium bovis subsp bovis AF2122/97
cgggcggccaccgc

SEQ ID NO: 3148611 - RNA, 15 nt, Mycobacterium bovis subsp bovis AF2122/97
cgggcggccaccgca

SEQ ID NO: 3148612 - RNA, 13 nt, Mycobacterium bovis subsp bovis AF2122/97
cgggcggccagcu

SEQ ID NO: 3148613 - RNA, 15 nt, Mycobacterium bovis subsp bovis AF2122/97
cgggcggccagcugc

SEQ ID NO: 3148614 - RNA, 13 nt, Mycobacterium bovis subsp bovis AF2122/97
cgggcggccagga

SEQ ID NO: 3148615 - RNA, 14 nt, Mycobacterium bovis subsp bovis AF2122/97
cgggcggccaggau

SEQ ID NO: 3148616 - RNA, 21 nt, Mycobacterium bovis subsp bovis AF2122/97
cgggcggccauggcacugccg

SEQ ID NO: 3148617 - RNA, 22 nt, Mycobacterium bovis subsp bovis AF2122/97
cgggcggccucccgggccgccg

SEQ ID NO: 3148618 - RNA, 14 nt, Mycobacterium bovis subsp bovis AF2122/97
cgggcggcgcuggc

SEQ ID NO: 3148619 - RNA, 15 nt, Mycobacterium bovis subsp bovis AF2122/97
cgggcggcggccugg

SEQ ID NO: 3148620 - RNA, 13 nt, Mycobacterium bovis subsp bovis AF2122/97
cgggcggcgucga

SEQ ID NO: 3148621 - RNA, 14 nt, Mycobacterium bovis subsp bovis AF2122/97
cgggcggcgucgaa

SEQ ID NO: 3148622 - RNA, 15 nt, Mycobacterium bovis subsp bovis AF2122/97
cgggcggcgucgcgg

SEQ ID NO: 3148623 - RNA, 13 nt, Mycobacterium bovis subsp bovis AF2122/97
cgggcggcgucgg

SEQ ID NO: 3148624 - RNA, 15 nt, Mycobacterium bovis subsp bovis AF2122/97
cgggcggcgucggug

SEQ ID NO: 3148625 - RNA, 11 nt, Mycobacterium bovis subsp bovis AF2122/97
cgggcggcgug

SEQ ID NO: 3148626 - RNA, 17 nt, Mycobacterium bovis subsp bovis AF2122/97
cgggcgggacucggcga

SEQ ID NO: 3148627 - RNA, 17 nt, Mycobacterium bovis subsp bovis AF2122/97
cgggcgggagucgucga

SEQ ID NO: 3148628 - RNA, 20 nt, Mycobacterium bovis subsp bovis AF2122/97
cgggcgggagucgucgagcu

SEQ ID NO: 3148629 - RNA, 13 nt, Mycobacterium bovis subsp bovis AF2122/97
cgggcgggcuggu

SEQ ID NO: 3148630 - RNA, 15 nt, Mycobacterium bovis subsp bovis AF2122/97
cgggcggggacggcg

SEQ ID NO: 3148631 - RNA, 16 nt, Mycobacterium bovis subsp bovis AF2122/97
cgggcggggacggcgg

SEQ ID NO: 3148632 - RNA, 17 nt, Mycobacterium bovis subsp bovis AF2122/97
cgggcgggugaacgcgu

SEQ ID NO: 3148633 - RNA, 21 nt, Mycobacterium bovis subsp bovis AF2122/97
cgggcgguaaucgcgagacca

SEQ ID NO: 3148634 - RNA, 16 nt, Mycobacterium bovis subsp bovis AF2122/97
cgggcggucgaagacc

SEQ ID NO: 3148635 - RNA, 19 nt, Mycobacterium bovis subsp bovis AF2122/97
cgggcggugcacaccgucg

SEQ ID NO: 3148636 - RNA, 15 nt, Mycobacterium bovis subsp bovis AF2122/97
cgggcggugggcagc

SEQ ID NO: 3148637 - RNA, 19 nt, Mycobacterium bovis subsp bovis AF2122/97
cgggcggugggcagcagcu

SEQ ID NO: 3148638 - RNA, 21 nt, Mycobacterium bovis subsp bovis AF2122/97
cgggcggugggcagcagcugg

SEQ ID NO: 3148639 - RNA, 22 nt, Mycobacterium bovis subsp bovis AF2122/97
cgggcguacauucgggcgugcu

SEQ ID NO: 3148640 - RNA, 17 nt, Mycobacterium bovis subsp bovis AF2122/97
cgggcgucaagccacac

SEQ ID NO: 3148641 - RNA, 23 nt, Mycobacterium bovis subsp bovis AF2122/97
cgggcgucaagccacacccggcg

SEQ ID NO: 3148642 - RNA, 15 nt, Mycobacterium bovis subsp bovis AF2122/97
cgggcgucacggugc

SEQ ID NO: 3148643 - RNA, 23 nt, Mycobacterium bovis subsp bovis AF2122/97
cgggcgucacggugcguucgugc

SEQ ID NO: 3148644 - RNA, 22 nt, Mycobacterium bovis subsp bovis AF2122/97
cgggcgucaugaugucgacauc

SEQ ID NO: 3148645 - RNA, 13 nt, Mycobacterium bovis subsp bovis AF2122/97
cgggcguccacgc

SEQ ID NO: 3148646 - RNA, 19 nt, Mycobacterium bovis subsp bovis AF2122/97
cgggcguccacgcugacca

SEQ ID NO: 3148647 - RNA, 21 nt, Mycobacterium bovis subsp bovis AF2122/97
cgggcguccacgcugaccaac

SEQ ID NO: 3148648 - RNA, 13 nt, Mycobacterium bovis subsp bovis AF2122/97
cgggcguccgccg

SEQ ID NO: 3148649 - RNA, 15 nt, Mycobacterium bovis subsp bovis AF2122/97
cgggcguccgccggc

SEQ ID NO: 3148650 - RNA, 23 nt, Mycobacterium bovis subsp bovis AF2122/97
cgggcgucgggguggcgguccgg

SEQ ID NO: 3148651 - RNA, 16 nt, Mycobacterium bovis subsp bovis AF2122/97
cgggcgucgucgguga

SEQ ID NO: 3148652 - RNA, 19 nt, Mycobacterium bovis subsp bovis AF2122/97
cgggcgugaguggcucgcu

SEQ ID NO: 3148653 - RNA, 12 nt, Mycobacterium bovis subsp bovis AF2122/97
cgggcgugccga

SEQ ID NO: 3148654 - RNA, 18 nt, Mycobacterium bovis subsp bovis AF2122/97
cgggcgugccgaccagca

SEQ ID NO: 3148655 - RNA, 21 nt, Mycobacterium bovis subsp bovis AF2122/97
cgggcgugccgaccagcaucu

SEQ ID NO: 3148656 - RNA, 14 nt, Mycobacterium bovis subsp bovis AF2122/97
cgggcgugcggcgg

SEQ ID NO: 3148657 - RNA, 21 nt, Mycobacterium bovis subsp bovis AF2122/97
cgggcgugcuacacccguaga

SEQ ID NO: 3148658 - RNA, 17 nt, Mycobacterium bovis subsp bovis AF2122/97
cgggcgugcucgccggg

SEQ ID NO: 3148659 - RNA, 14 nt, Mycobacterium bovis subsp bovis AF2122/97
cgggcgugggccgc

SEQ ID NO: 3148660 - RNA, 15 nt, Mycobacterium bovis subsp bovis AF2122/97
cgggcgugggccgcu

SEQ ID NO: 3148661 - RNA, 17 nt, Mycobacterium bovis subsp bovis AF2122/97
cgggcgugggccgcugg

SEQ ID NO: 3148662 - RNA, 19 nt, Mycobacterium bovis subsp bovis AF2122/97
cgggcgugggugucggcga

SEQ ID NO: 3148663 - RNA, 14 nt, Mycobacterium bovis subsp bovis AF2122/97
cgggcgugguaacc

SEQ ID NO: 3148664 - RNA, 15 nt, Mycobacterium bovis subsp bovis AF2122/97
cgggcgugguaucgc

SEQ ID NO: 3148665 - RNA, 17 nt, Mycobacterium bovis subsp bovis AF2122/97
cgggcgugguaucgccg

SEQ ID NO: 3148666 - RNA, 19 nt, Mycobacterium bovis subsp bovis AF2122/97
cgggcgugguaucgccggg

SEQ ID NO: 3148667 - RNA, 14 nt, Mycobacterium bovis subsp bovis AF2122/97
cgggcguggugagc

SEQ ID NO: 3148668 - RNA, 13 nt, Mycobacterium bovis subsp bovis AF2122/97
cgggcgugucggg

SEQ ID NO: 3148669 - RNA, 15 nt, Mycobacterium bovis subsp bovis AF2122/97
cgggcgugugcaguc

SEQ ID NO: 3148670 - RNA, 19 nt, Mycobacterium bovis subsp bovis AF2122/97
cgggcgugugcaguccgau

SEQ ID NO: 3148671 - RNA, 20 nt, Mycobacterium bovis subsp bovis AF2122/97
cgggcguugcccuccuucuc

SEQ ID NO: 3148672 - RNA, 18 nt, Mycobacterium bovis subsp bovis AF2122/97
cgggcguuggccagcagg

SEQ ID NO: 3148673 - RNA, 22 nt, Mycobacterium bovis subsp bovis AF2122/97
cgggcguuuggacgggcgugcu

SEQ ID NO: 3148674 - RNA, 15 nt, Mycobacterium bovis subsp bovis AF2122/97
cgggcuaccggcagc

SEQ ID NO: 3148675 - RNA, 22 nt, Mycobacterium bovis subsp bovis AF2122/97
cgggcucaaacggaauguagcc

SEQ ID NO: 3148676 - RNA, 14 nt, Mycobacterium bovis subsp bovis AF2122/97
cgggcucaacacca

SEQ ID NO: 3148677 - RNA, 17 nt, Mycobacterium bovis subsp bovis AF2122/97
cgggcucaacaccagcc

SEQ ID NO: 3148678 - RNA, 20 nt, Mycobacterium bovis subsp bovis AF2122/97
cgggcucaacaccagccggu

SEQ ID NO: 3148679 - RNA, 22 nt, Mycobacterium bovis subsp bovis AF2122/97
cgggcucacaugugcgcgucgc

SEQ ID NO: 3148680 - RNA, 14 nt, Mycobacterium bovis subsp bovis AF2122/97
cgggcucagcggcg

SEQ ID NO: 3148681 - RNA, 19 nt, Mycobacterium bovis subsp bovis AF2122/97
cgggcucagcggcgaccgc

SEQ ID NO: 3148682 - RNA, 19 nt, Mycobacterium bovis subsp bovis AF2122/97
cgggcuccaauugcggccg

SEQ ID NO: 3148683 - RNA, 21 nt, Mycobacterium bovis subsp bovis AF2122/97
cgggcuccaauugcggccgcg

SEQ ID NO: 3148684 - RNA, 16 nt, Mycobacterium bovis subsp bovis AF2122/97
cgggcuccccaagucg

SEQ ID NO: 3148685 - RNA, 17 nt, Mycobacterium bovis subsp bovis AF2122/97
cgggcuccccaagucga

SEQ ID NO: 3148686 - RNA, 18 nt, Mycobacterium bovis subsp bovis AF2122/97
cgggcuccccaagucgac

SEQ ID NO: 3148687 - RNA, 22 nt, Mycobacterium bovis subsp bovis AF2122/97
cgggcuccccggauuccucguc

SEQ ID NO: 3148688 - RNA, 21 nt, Mycobacterium bovis subsp bovis AF2122/97
cgggcuccccggcaaccggga

SEQ ID NO: 3148689 - RNA, 20 nt, Mycobacterium bovis subsp bovis AF2122/97
cgggcuccgugguugccgaa

SEQ ID NO: 3148690 - RNA, 13 nt, Mycobacterium bovis subsp bovis AF2122/97
cgggcucgcaugu

SEQ ID NO: 3148691 - RNA, 14 nt, Mycobacterium bovis subsp bovis AF2122/97
cgggcucgcauucg

SEQ ID NO: 3148692 - RNA, 19 nt, Mycobacterium bovis subsp bovis AF2122/97
cggggacggcggcaagggc

SEQ ID NO: 3148693 - RNA, 14 nt, Mycobacterium bovis subsp bovis AF2122/97
cggggacgggucgg

SEQ ID NO: 3148694 - RNA, 16 nt, Mycobacterium bovis subsp bovis AF2122/97
cggggagauccaggug

SEQ ID NO: 3148695 - RNA, 14 nt, Mycobacterium bovis subsp bovis AF2122/97
cggggagcugcggc

SEQ ID NO: 3148696 - RNA, 21 nt, Mycobacterium bovis subsp bovis AF2122/97
cggggaggucaaaaucagggu

SEQ ID NO: 3148697 - RNA, 23 nt, Mycobacterium bovis subsp bovis AF2122/97
cggggaguggaaacccgccgaac

SEQ ID NO: 3148698 - RNA, 17 nt, Mycobacterium bovis subsp bovis AF2122/97
cggggauaccggucagc

SEQ ID NO: 3148699 - RNA, 20 nt, Mycobacterium bovis subsp bovis AF2122/97
cggggauaccggucagcacc

SEQ ID NO: 3148700 - RNA, 17 nt, Mycobacterium bovis subsp bovis AF2122/97
cggggaucgcuggccgc

SEQ ID NO: 3148701 - RNA, 14 nt, Mycobacterium bovis subsp bovis AF2122/97
cggggaucggggca

SEQ ID NO: 3148702 - RNA, 14 nt, Mycobacterium bovis subsp bovis AF2122/97
cggggaugccgaac

SEQ ID NO: 3148703 - RNA, 21 nt, Mycobacterium bovis subsp bovis AF2122/97
cggggaugccuagguagucgg

SEQ ID NO: 3148704 - RNA, 18 nt, Mycobacterium bovis subsp bovis AF2122/97
cggggaugcgaccgccgg

SEQ ID NO: 3148705 - RNA, 15 nt, Mycobacterium bovis subsp bovis AF2122/97
cggggauggagccgg

SEQ ID NO: 3148706 - RNA, 20 nt, Mycobacterium bovis subsp bovis AF2122/97
cggggauggagccggugacg

SEQ ID NO: 3148707 - RNA, 18 nt, Mycobacterium bovis subsp bovis AF2122/97
cggggaugggggagccgg

SEQ ID NO: 3148708 - RNA, 22 nt, Mycobacterium bovis subsp bovis AF2122/97
cggggaugggggagccggugac

SEQ ID NO: 3148709 - RNA, 18 nt, Mycobacterium bovis subsp bovis AF2122/97
cggggauguccgcggcca

SEQ ID NO: 3148710 - RNA, 21 nt, Mycobacterium bovis subsp bovis AF2122/97
cggggauguccgcggccacca

SEQ ID NO: 3148711 - RNA, 23 nt, Mycobacterium bovis subsp bovis AF2122/97
cggggauucgucgugcgggcggg

SEQ ID NO: 3148712 - RNA, 19 nt, Mycobacterium bovis subsp bovis AF2122/97
cggggauuuauugagucgg

SEQ ID NO: 3148713 - RNA, 22 nt, Mycobacterium bovis subsp bovis AF2122/97
cggggauuuauugagucggcug

SEQ ID NO: 3148714 - RNA, 14 nt, Mycobacterium bovis subsp bovis AF2122/97
cggggcaaacgggg

SEQ ID NO: 3148715 - RNA, 17 nt, Mycobacterium bovis subsp bovis AF2122/97
cggggcaaaggagccgu

SEQ ID NO: 3148716 - RNA, 14 nt, Mycobacterium bovis subsp bovis AF2122/97
cggggcaacgauca

SEQ ID NO: 3148717 - RNA, 13 nt, Mycobacterium bovis subsp bovis AF2122/97
cggggcacaaggg

SEQ ID NO: 3148718 - RNA, 15 nt, Mycobacterium bovis subsp bovis AF2122/97
cggggcaccacgcca

SEQ ID NO: 3148719 - RNA, 23 nt, Mycobacterium bovis subsp bovis AF2122/97
cggggcaccgugcggaucgcgcu

SEQ ID NO: 3148720 - RNA, 22 nt, Mycobacterium bovis subsp bovis AF2122/97
cggggcacuggggucugauggc

SEQ ID NO: 3148721 - RNA, 15 nt, Mycobacterium bovis subsp bovis AF2122/97
cggggcagcgggccg

SEQ ID NO: 3148722 - RNA, 17 nt, Mycobacterium bovis subsp bovis AF2122/97
cggggcagcgggccgcc

SEQ ID NO: 3148723 - RNA, 23 nt, Mycobacterium bovis subsp bovis AF2122/97
cggggccacaccugcgccaccug

SEQ ID NO: 3148724 - RNA, 13 nt, Mycobacterium bovis subsp bovis AF2122/97
cggggccacccgc

SEQ ID NO: 3148725 - RNA, 13 nt, Mycobacterium bovis subsp bovis AF2122/97
cggggcccacacg

SEQ ID NO: 3148726 - RNA, 18 nt, Mycobacterium bovis subsp bovis AF2122/97
cggggccccaugccgacc

SEQ ID NO: 3148727 - RNA, 21 nt, Mycobacterium bovis subsp bovis AF2122/97
cggggccccaugccgaccggc

SEQ ID NO: 3148728 - RNA, 23 nt, Mycobacterium bovis subsp bovis AF2122/97
cggggccccaugccgaccggcac

SEQ ID NO: 3148729 - RNA, 14 nt, Mycobacterium bovis subsp bovis AF2122/97
cggggcccccgccg

SEQ ID NO: 3148730 - RNA, 21 nt, Mycobacterium bovis subsp bovis AF2122/97
cggggccccgcggcgccgcca

SEQ ID NO: 3148731 - RNA, 21 nt, Mycobacterium bovis subsp bovis AF2122/97
cggggcccggacaggcucacg

SEQ ID NO: 3148732 - RNA, 15 nt, Mycobacterium bovis subsp bovis AF2122/97
cggggcccugggaga

SEQ ID NO: 3148733 - RNA, 14 nt, Mycobacterium bovis subsp bovis AF2122/97
cggggccgccagcu

SEQ ID NO: 3148734 - RNA, 21 nt, Mycobacterium bovis subsp bovis AF2122/97
cggggccgccgaugccaccgc

SEQ ID NO: 3148735 - RNA, 23 nt, Mycobacterium bovis subsp bovis AF2122/97
cggggccgccgaugccaccgcuu

SEQ ID NO: 3148736 - RNA, 14 nt, Mycobacterium bovis subsp bovis AF2122/97
cggggccgccgcgg

SEQ ID NO: 3148737 - RNA, 12 nt, Mycobacterium bovis subsp bovis AF2122/97
cggggccgcgcu

SEQ ID NO: 3148738 - RNA, 15 nt, Mycobacterium bovis subsp bovis AF2122/97
cggggccgcggccca

SEQ ID NO: 3148739 - RNA, 18 nt, Mycobacterium bovis subsp bovis AF2122/97
cggggccggaugacgauc

SEQ ID NO: 3148740 - RNA, 19 nt, Mycobacterium bovis subsp bovis AF2122/97
cggggccgucggcaauacu

SEQ ID NO: 3148741 - RNA, 15 nt, Mycobacterium bovis subsp bovis AF2122/97
cggggccgucgucgg

SEQ ID NO: 3148742 - RNA, 23 nt, Mycobacterium bovis subsp bovis AF2122/97
cggggccgucgucggucaccgac

SEQ ID NO: 3148743 - RNA, 20 nt, Mycobacterium bovis subsp bovis AF2122/97
cggggccgucucgccgugga

SEQ ID NO: 3148744 - RNA, 18 nt, Mycobacterium bovis subsp bovis AF2122/97
cggggccuucggcccggu

SEQ ID NO: 3148745 - RNA, 21 nt, Mycobacterium bovis subsp bovis AF2122/97
cggggcgaagcuugacguugc

SEQ ID NO: 3148746 - RNA, 21 nt, Mycobacterium bovis subsp bovis AF2122/97
cggggcgacgauccgcacgau

SEQ ID NO: 3148747 - RNA, 15 nt, Mycobacterium bovis subsp bovis AF2122/97
cggggcgauccccag

SEQ ID NO: 3148748 - RNA, 19 nt, Mycobacterium bovis subsp bovis AF2122/97
cggggcgauccccagcacc

SEQ ID NO: 3148749 - RNA, 23 nt, Mycobacterium bovis subsp bovis AF2122/97
cggggcgaugagccugcaggccg

SEQ ID NO: 3148750 - RNA, 18 nt, Mycobacterium bovis subsp bovis AF2122/97
cggggcgcccggccaggu

SEQ ID NO: 3148751 - RNA, 22 nt, Mycobacterium bovis subsp bovis AF2122/97
cggggcgccugaugcggccggc

SEQ ID NO: 3148752 - RNA, 14 nt, Mycobacterium bovis subsp bovis AF2122/97
cggggcgcgguacc

SEQ ID NO: 3148753 - RNA, 15 nt, Mycobacterium bovis subsp bovis AF2122/97
cggggcgcucgcgcg

SEQ ID NO: 3148754 - RNA, 22 nt, Mycobacterium bovis subsp bovis AF2122/97
cggggcggcauuggcggugccg

SEQ ID NO: 3148755 - RNA, 19 nt, Mycobacterium bovis subsp bovis AF2122/97
cggggcggccugcccgccg

SEQ ID NO: 3148756 - RNA, 16 nt, Mycobacterium bovis subsp bovis AF2122/97
cggggcggcggugggc

SEQ ID NO: 3148757 - RNA, 13 nt, Mycobacterium bovis subsp bovis AF2122/97
cggggcggucggc

SEQ ID NO: 3148758 - RNA, 13 nt, Mycobacterium bovis subsp bovis AF2122/97
cggggcggugggc

SEQ ID NO: 3148759 - RNA, 19 nt, Mycobacterium bovis subsp bovis AF2122/97
cggggcgucgcaacccggc

SEQ ID NO: 3148760 - RNA, 20 nt, Mycobacterium bovis subsp bovis AF2122/97
cggggcgucguaaacgucgg

SEQ ID NO: 3148761 - RNA, 20 nt, Mycobacterium bovis subsp bovis AF2122/97
cggggcucaagucucccggc

SEQ ID NO: 3148762 - RNA, 22 nt, Mycobacterium bovis subsp bovis AF2122/97
cggggcucaagucucccggccg

SEQ ID NO: 3148763 - RNA, 13 nt, Mycobacterium bovis subsp bovis AF2122/97
cggggcugaccgc

SEQ ID NO: 3148764 - RNA, 16 nt, Mycobacterium bovis subsp bovis AF2122/97
cggggcugaccgccac

SEQ ID NO: 3148765 - RNA, 20 nt, Mycobacterium bovis subsp bovis AF2122/97
cggggcugaccgccaccccg

SEQ ID NO: 3148766 - RNA, 11 nt, Mycobacterium bovis subsp bovis AF2122/97
cggggcugccc

SEQ ID NO: 3148767 - RNA, 14 nt, Mycobacterium bovis subsp bovis AF2122/97
cggggcugccgaac

SEQ ID NO: 3148768 - RNA, 17 nt, Mycobacterium bovis subsp bovis AF2122/97
cggggcugccgaacagc

SEQ ID NO: 3148769 - RNA, 15 nt, Mycobacterium bovis subsp bovis AF2122/97
cggggcugccgccgu

SEQ ID NO: 3148770 - RNA, 17 nt, Mycobacterium bovis subsp bovis AF2122/97
cggggcugccgccguug

SEQ ID NO: 3148771 - RNA, 12 nt, Mycobacterium bovis subsp bovis AF2122/97
cggggcugccgg

SEQ ID NO: 3148772 - RNA, 17 nt, Mycobacterium bovis subsp bovis AF2122/97
cggggcugccggugagu

SEQ ID NO: 3148773 - RNA, 22 nt, Mycobacterium bovis subsp bovis AF2122/97
cggggcuguacucgcggcgcgg

SEQ ID NO: 3148774 - RNA, 23 nt, Mycobacterium bovis subsp bovis AF2122/97
cggggcuguacucgcggcgcggc

SEQ ID NO: 3148775 - RNA, 23 nt, Mycobacterium bovis subsp bovis AF2122/97
cggggcuucaucuggcgccguua

SEQ ID NO: 3148776 - RNA, 12 nt, Mycobacterium bovis subsp bovis AF2122/97
cgggggaagcgc

SEQ ID NO: 3148777 - RNA, 20 nt, Mycobacterium bovis subsp bovis AF2122/97
cgggggaccccgccagccgg

SEQ ID NO: 3148778 - RNA, 16 nt, Mycobacterium bovis subsp bovis AF2122/97
cgggguugaccgccac

SEQ ID NO: 3148779 - RNA, 19 nt, Mycobacterium bovis subsp bovis AF2122/97
cgggguugaccguggucgg

SEQ ID NO: 3148780 - RNA, 20 nt, Mycobacterium bovis subsp bovis AF2122/97
cgggguugacuggccgcccg

SEQ ID NO: 3148781 - RNA, 22 nt, Mycobacterium bovis subsp bovis AF2122/97
cgggguugacuggccgcccggc

SEQ ID NO: 3148782 - RNA, 14 nt, Mycobacterium bovis subsp bovis AF2122/97
cgggguugaucacc

SEQ ID NO: 3148783 - RNA, 16 nt, Mycobacterium bovis subsp bovis AF2122/97
cgggguugaucaccga

SEQ ID NO: 3148784 - RNA, 19 nt, Mycobacterium bovis subsp bovis AF2122/97
cgggguugaucaccgacac

SEQ ID NO: 3148785 - RNA, 21 nt, Mycobacterium bovis subsp bovis AF2122/97
cgggguugaucaccgacaccg

SEQ ID NO: 3148786 - RNA, 14 nt, Mycobacterium bovis subsp bovis AF2122/97
cgggguugcucgcg

SEQ ID NO: 3148787 - RNA, 14 nt, Mycobacterium bovis subsp bovis AF2122/97
cgggguugggcgga

SEQ ID NO: 3148788 - RNA, 17 nt, Mycobacterium bovis subsp bovis AF2122/97
cgggguugggcggagca

SEQ ID NO: 3148789 - RNA, 17 nt, Mycobacterium bovis subsp bovis AF2122/97
cgggguuguccucggcg

SEQ ID NO: 3148790 - RNA, 21 nt, Mycobacterium bovis subsp bovis AF2122/97
cgggguuguccucggcgauca

SEQ ID NO: 3148791 - RNA, 22 nt, Mycobacterium bovis subsp bovis AF2122/97
cgggguuguccucggcgaucac

SEQ ID NO: 3148792 - RNA, 19 nt, Mycobacterium bovis subsp bovis AF2122/97
cgggguuucaggcggcagg

SEQ ID NO: 3148793 - RNA, 24 nt, Mycobacterium bovis subsp bovis AF2122/97
cggguaaaccagguggccaggccg

SEQ ID NO: 3148794 - RNA, 21 nt, Mycobacterium bovis subsp bovis AF2122/97
cggguaaauauugcgcccggc

SEQ ID NO: 3148795 - RNA, 14 nt, Mycobacterium bovis subsp bovis AF2122/97
cggguaaccggcuc

SEQ ID NO: 3148796 - RNA, 18 nt, Mycobacterium bovis subsp bovis AF2122/97
cggguaacgcacccaccg

SEQ ID NO: 3148797 - RNA, 18 nt, Mycobacterium bovis subsp bovis AF2122/97
cggguaaugcgacgccgg

SEQ ID NO: 3148798 - RNA, 20 nt, Mycobacterium bovis subsp bovis AF2122/97
cggguaauucuugacgccga

SEQ ID NO: 3148799 - RNA, 18 nt, Mycobacterium bovis subsp bovis AF2122/97
cggguacacccgcucgcc

SEQ ID NO: 3148800 - RNA, 23 nt, Mycobacterium bovis subsp bovis AF2122/97
cggguacacccgcucgcccgccg

SEQ ID NO: 3148801 - RNA, 20 nt, Mycobacterium bovis subsp bovis AF2122/97
cggguacaucgaggccacgc

SEQ ID NO: 3148802 - RNA, 19 nt, Mycobacterium bovis subsp bovis AF2122/97
cggguaccacgcuggcgcg

SEQ ID NO: 3148803 - RNA, 13 nt, Mycobacterium bovis subsp bovis AF2122/97
cggguacccggga

SEQ ID NO: 3148804 - RNA, 20 nt, Mycobacterium bovis subsp bovis AF2122/97
cggguacuuacgggucgcgg

SEQ ID NO: 3148805 - RNA, 21 nt, Mycobacterium bovis subsp bovis AF2122/97
cggguagaaccagcccggccg

SEQ ID NO: 3148806 - RNA, 15 nt, Mycobacterium bovis subsp bovis AF2122/97
cggguagacaccgcg

SEQ ID NO: 3148807 - RNA, 22 nt, Mycobacterium bovis subsp bovis AF2122/97
cggguagacaugggugaaucga

SEQ ID NO: 3148808 - RNA, 19 nt, Mycobacterium bovis subsp bovis AF2122/97
cggguagaccaccugcaug

SEQ ID NO: 3148809 - RNA, 14 nt, Mycobacterium bovis subsp bovis AF2122/97
cggguagccgucga

SEQ ID NO: 3148810 - RNA, 15 nt, Mycobacterium bovis subsp bovis AF2122/97
cggguagcggcgccg

SEQ ID NO: 3148811 - RNA, 16 nt, Mycobacterium bovis subsp bovis AF2122/97
cggguagcggcgccgc

SEQ ID NO: 3148812 - RNA, 18 nt, Mycobacterium bovis subsp bovis AF2122/97
cggguagcggcgccgccc

SEQ ID NO: 3148813 - RNA, 19 nt, Mycobacterium bovis subsp bovis AF2122/97
cggguagcgguucaucacc

SEQ ID NO: 3148814 - RNA, 14 nt, Mycobacterium bovis subsp bovis AF2122/97
cggguagcucccug

SEQ ID NO: 3148815 - RNA, 14 nt, Mycobacterium bovis subsp bovis AF2122/97
cggguagcugccgc

SEQ ID NO: 3148816 - RNA, 19 nt, Mycobacterium bovis subsp bovis AF2122/97
cggguagcugccgcggccg

SEQ ID NO: 3148817 - RNA, 21 nt, Mycobacterium bovis subsp bovis AF2122/97
cggguagcugccgcggccggc

SEQ ID NO: 3148818 - RNA, 14 nt, Mycobacterium bovis subsp bovis AF2122/97
cggguaggccgccg

SEQ ID NO: 3148819 - RNA, 15 nt, Mycobacterium bovis subsp bovis AF2122/97
cggguaggccgccgu

SEQ ID NO: 3148820 - RNA, 21 nt, Mycobacterium bovis subsp bovis AF2122/97
cggguagggcaucgucgccga

SEQ ID NO: 3148821 - RNA, 13 nt, Mycobacterium bovis subsp bovis AF2122/97
cggguagucgggc

SEQ ID NO: 3148822 - RNA, 13 nt, Mycobacterium bovis subsp bovis AF2122/97
cggguaucgccag

SEQ ID NO: 3148823 - RNA, 15 nt, Mycobacterium bovis subsp bovis AF2122/97
cggguauggcggcga

SEQ ID NO: 3148824 - RNA, 21 nt, Mycobacterium bovis subsp bovis AF2122/97
cggguauggcggcgacggccg

SEQ ID NO: 3148825 - RNA, 22 nt, Mycobacterium bovis subsp bovis AF2122/97
cggguaugggagucccaccauc

SEQ ID NO: 3148826 - RNA, 23 nt, Mycobacterium bovis subsp bovis AF2122/97
cggguaugggagucccaccaucg

SEQ ID NO: 3148827 - RNA, 19 nt, Mycobacterium bovis subsp bovis AF2122/97
cggguauugaaguucgggc

SEQ ID NO: 3148828 - RNA, 17 nt, Mycobacterium bovis subsp bovis AF2122/97
cgggucaacgccaucac

SEQ ID NO: 3148829 - RNA, 20 nt, Mycobacterium bovis subsp bovis AF2122/97
cgggucaacgccaucacccc

SEQ ID NO: 3148830 - RNA, 19 nt, Mycobacterium bovis subsp bovis AF2122/97
cgggucaaugcuggcagcg

SEQ ID NO: 3148831 - RNA, 21 nt, Mycobacterium bovis subsp bovis AF2122/97
cgggucaaugcuggcagcggc

SEQ ID NO: 3148832 - RNA, 14 nt, Mycobacterium bovis subsp bovis AF2122/97
cgggucacacuccc

SEQ ID NO: 3148833 - RNA, 13 nt, Mycobacterium bovis subsp bovis AF2122/97
cgggucaccagcg

SEQ ID NO: 3148834 - RNA, 14 nt, Mycobacterium bovis subsp bovis AF2122/97
cgggucaccagcgc

SEQ ID NO: 3148835 - RNA, 15 nt, Mycobacterium bovis subsp bovis AF2122/97
cgggucaccagcgca

SEQ ID NO: 3148836 - RNA, 21 nt, Mycobacterium bovis subsp bovis AF2122/97
cgggucaccgauucggccagc

SEQ ID NO: 3148837 - RNA, 18 nt, Mycobacterium bovis subsp bovis AF2122/97
cgggucacuccggcggcu

SEQ ID NO: 3148838 - RNA, 22 nt, Mycobacterium bovis subsp bovis AF2122/97
cgggucacuccggcggcuucgc

SEQ ID NO: 3148839 - RNA, 14 nt, Mycobacterium bovis subsp bovis AF2122/97
cgggucagcaccac

SEQ ID NO: 3148840 - RNA, 18 nt, Mycobacterium bovis subsp bovis AF2122/97
cgggucagcaccaccagc

SEQ ID NO: 3148841 - RNA, 14 nt, Mycobacterium bovis subsp bovis AF2122/97
cgggucagcccagc

SEQ ID NO: 3148842 - RNA, 13 nt, Mycobacterium bovis subsp bovis AF2122/97
cgggucagcccgg

SEQ ID NO: 3148843 - RNA, 18 nt, Mycobacterium bovis subsp bovis AF2122/97
cgggucagcccggcgcga

SEQ ID NO: 3148844 - RNA, 11 nt, Mycobacterium bovis subsp bovis AF2122/97
cgggucagcgc

SEQ ID NO: 3148845 - RNA, 13 nt, Mycobacterium bovis subsp bovis AF2122/97
cgggucagcgccg

SEQ ID NO: 3148846 - RNA, 13 nt, Mycobacterium bovis subsp bovis AF2122/97
cgggucagcgcgu

SEQ ID NO: 3148847 - RNA, 18 nt, Mycobacterium bovis subsp bovis AF2122/97
cgggucagcucgaccuga

SEQ ID NO: 3148848 - RNA, 16 nt, Mycobacterium bovis subsp bovis AF2122/97
cgggucaggccagggu

SEQ ID NO: 3148849 - RNA, 23 nt, Mycobacterium bovis subsp bovis AF2122/97
cgggucauccgugucgagaucuc

SEQ ID NO: 3148850 - RNA, 23 nt, Mycobacterium bovis subsp bovis AF2122/97
cggguccaagaaccacgacguug

SEQ ID NO: 3148851 - RNA, 22 nt, Mycobacterium bovis subsp bovis AF2122/97
cggguccagccaccgaccccgg

SEQ ID NO: 3148852 - RNA, 14 nt, Mycobacterium bovis subsp bovis AF2122/97
cggguccagcccgg

SEQ ID NO: 3148853 - RNA, 15 nt, Mycobacterium bovis subsp bovis AF2122/97
cggguccagcccgga

SEQ ID NO: 3148854 - RNA, 16 nt, Mycobacterium bovis subsp bovis AF2122/97
cggguccaggaacggc

SEQ ID NO: 3148855 - RNA, 17 nt, Mycobacterium bovis subsp bovis AF2122/97
cgggucccaaucgucgg

SEQ ID NO: 3148856 - RNA, 23 nt, Mycobacterium bovis subsp bovis AF2122/97
cgggucccaaucgucggccagca

SEQ ID NO: 3148857 - RNA, 13 nt, Mycobacterium bovis subsp bovis AF2122/97
cggguccccaccg

SEQ ID NO: 3148858 - RNA, 14 nt, Mycobacterium bovis subsp bovis AF2122/97
cggguccccaccgg

SEQ ID NO: 3148859 - RNA, 15 nt, Mycobacterium bovis subsp bovis AF2122/97
cgggucccgccacca

SEQ ID NO: 3148860 - RNA, 13 nt, Mycobacterium bovis subsp bovis AF2122/97
cgggucccggccg

SEQ ID NO: 3148861 - RNA, 21 nt, Mycobacterium bovis subsp bovis AF2122/97
cgggucccuuguggucugcca

SEQ ID NO: 3148862 - RNA, 23 nt, Mycobacterium bovis subsp bovis AF2122/97
cgggucccuuguggucugccagc

SEQ ID NO: 3148863 - RNA, 19 nt, Mycobacterium bovis subsp bovis AF2122/97
cggguccgaaguacuggcc

SEQ ID NO: 3148864 - RNA, 20 nt, Mycobacterium bovis subsp bovis AF2122/97
cggguccgaaguacuggccg

SEQ ID NO: 3148865 - RNA, 22 nt, Mycobacterium bovis subsp bovis AF2122/97
cggguccgaaguacuggccgcc

SEQ ID NO: 3148866 - RNA, 11 nt, Mycobacterium bovis subsp bovis AF2122/97
cggguccgacg

SEQ ID NO: 3148867 - RNA, 16 nt, Mycobacterium bovis subsp bovis AF2122/97
cggguccgacggugua

SEQ ID NO: 3148868 - RNA, 15 nt, Mycobacterium bovis subsp bovis AF2122/97
cggguccgccgggcc

SEQ ID NO: 3148869 - RNA, 16 nt, Mycobacterium bovis subsp bovis AF2122/97
cggguccgccgggccc

SEQ ID NO: 3148870 - RNA, 20 nt, Mycobacterium bovis subsp bovis AF2122/97
cggguccgccgggccccggg

SEQ ID NO: 3148871 - RNA, 14 nt, Mycobacterium bovis subsp bovis AF2122/97
cggguccgccguug

SEQ ID NO: 3148872 - RNA, 15 nt, Mycobacterium bovis subsp bovis AF2122/97
cggguccgccguugc

SEQ ID NO: 3148873 - RNA, 13 nt, Mycobacterium bovis subsp bovis AF2122/97
cggguccggugaa

SEQ ID NO: 3148874 - RNA, 18 nt, Mycobacterium bovis subsp bovis AF2122/97
cggguccuauccgggccc

SEQ ID NO: 3148875 - RNA, 20 nt, Mycobacterium bovis subsp bovis AF2122/97
cgggucgaacaggccggccg

SEQ ID NO: 3148876 - RNA, 22 nt, Mycobacterium bovis subsp bovis AF2122/97
cgggucgaacaggccggccgcg

SEQ ID NO: 3148877 - RNA, 23 nt, Mycobacterium bovis subsp bovis AF2122/97
cgggucgaacuugaucaccgcgu

SEQ ID NO: 3148878 - RNA, 16 nt, Mycobacterium bovis subsp bovis AF2122/97
cgggucgaaucguguc

SEQ ID NO: 3148879 - RNA, 14 nt, Mycobacterium bovis subsp bovis AF2122/97
cgggucgaccccgg

SEQ ID NO: 3148880 - RNA, 20 nt, Mycobacterium bovis subsp bovis AF2122/97
cgggucgaccccggccagga

SEQ ID NO: 3148881 - RNA, 14 nt, Mycobacterium bovis subsp bovis AF2122/97
cgggucgagccgga

SEQ ID NO: 3148882 - RNA, 23 nt, Mycobacterium bovis subsp bovis AF2122/97
cgggucgaguccgacggggaugg

SEQ ID NO: 3148883 - RNA, 14 nt, Mycobacterium bovis subsp bovis AF2122/97
cgggucgaucaccg

SEQ ID NO: 3148884 - RNA, 15 nt, Mycobacterium bovis subsp bovis AF2122/97
cgggucgaucaccga

SEQ ID NO: 3148885 - RNA, 17 nt, Mycobacterium bovis subsp bovis AF2122/97
cgggucgaucaccgaca

SEQ ID NO: 3148886 - RNA, 22 nt, Mycobacterium bovis subsp bovis AF2122/97
cgggucgaucaccgacaccgug

SEQ ID NO: 3148887 - RNA, 24 nt, Mycobacterium bovis subsp bovis AF2122/97
cgggucgaucaccgacaccguguu

SEQ ID NO: 3148888 - RNA, 22 nt, Mycobacterium bovis subsp bovis AF2122/97
cgggucgaugacgccgucagcg

SEQ ID NO: 3148889 - RNA, 12 nt, Mycobacterium bovis subsp bovis AF2122/97
cgggucgauggg

SEQ ID NO: 3148890 - RNA, 22 nt, Mycobacterium bovis subsp bovis AF2122/97
cgggucgauggguaccgcgggg

SEQ ID NO: 3148891 - RNA, 16 nt, Mycobacterium bovis subsp bovis AF2122/97
cgggucgaugucggca

SEQ ID NO: 3148892 - RNA, 18 nt, Mycobacterium bovis subsp bovis AF2122/97
cgggucgaugucggcaau

SEQ ID NO: 3148893 - RNA, 16 nt, Mycobacterium bovis subsp bovis AF2122/97
cgggucgcaccccggc

SEQ ID NO: 3148894 - RNA, 18 nt, Mycobacterium bovis subsp bovis AF2122/97
cgggucgcaccccggcgg

SEQ ID NO: 3148895 - RNA, 17 nt, Mycobacterium bovis subsp bovis AF2122/97
cgggucgccgaugacgg

SEQ ID NO: 3148896 - RNA, 13 nt, Mycobacterium bovis subsp bovis AF2122/97
cgggucgccgcca

SEQ ID NO: 3148897 - RNA, 14 nt, Mycobacterium bovis subsp bovis AF2122/97
cgggucgccgccau

SEQ ID NO: 3148898 - RNA, 14 nt, Mycobacterium bovis subsp bovis AF2122/97
cgggucgccgggcc

SEQ ID NO: 3148899 - RNA, 23 nt, Mycobacterium bovis subsp bovis AF2122/97
cgggucgcgggguaggcccagca

SEQ ID NO: 3148900 - RNA, 14 nt, Mycobacterium bovis subsp bovis AF2122/97
cgggucgcguuucg

SEQ ID NO: 3148901 - RNA, 21 nt, Mycobacterium bovis subsp bovis AF2122/97
cgggucgcugccggcugacga

SEQ ID NO: 3148902 - RNA, 16 nt, Mycobacterium bovis subsp bovis AF2122/97
cgggucggcacgaccc

SEQ ID NO: 3148903 - RNA, 18 nt, Mycobacterium bovis subsp bovis AF2122/97
cgggucggcacgacccgg

SEQ ID NO: 3148904 - RNA, 19 nt, Mycobacterium bovis subsp bovis AF2122/97
cgggucggcacgacccggg

SEQ ID NO: 3148905 - RNA, 20 nt, Mycobacterium bovis subsp bovis AF2122/97
cgggucggcacgacccggga

SEQ ID NO: 3148906 - RNA, 22 nt, Mycobacterium bovis subsp bovis AF2122/97
cgggucggcacgacccgggaag

SEQ ID NO: 3148907 - RNA, 12 nt, Mycobacterium bovis subsp bovis AF2122/97
cgggucggccgc

SEQ ID NO: 3148908 - RNA, 16 nt, Mycobacterium bovis subsp bovis AF2122/97
cgggucggccgcugga

SEQ ID NO: 3148909 - RNA, 11 nt, Mycobacterium bovis subsp bovis AF2122/97
cgggucggcga

SEQ ID NO: 3148910 - RNA, 18 nt, Mycobacterium bovis subsp bovis AF2122/97
cgggucggcgaccgcgcu

SEQ ID NO: 3148911 - RNA, 12 nt, Mycobacterium bovis subsp bovis AF2122/97
cgggucggcgcc

SEQ ID NO: 3148912 - RNA, 14 nt, Mycobacterium bovis subsp bovis AF2122/97
cgggucggcgccga

SEQ ID NO: 3148913 - RNA, 16 nt, Mycobacterium bovis subsp bovis AF2122/97
cgggucggcgccgagc

SEQ ID NO: 3148914 - RNA, 12 nt, Mycobacterium bovis subsp bovis AF2122/97
cgggucgggacg

SEQ ID NO: 3148915 - RNA, 24 nt, Mycobacterium bovis subsp bovis AF2122/97
cgggucgguccacuucagaucggc

SEQ ID NO: 3148916 - RNA, 19 nt, Mycobacterium bovis subsp bovis AF2122/97
cgggucgguuuccuccggc

SEQ ID NO: 3148917 - RNA, 22 nt, Mycobacterium bovis subsp bovis AF2122/97
cgggucguacaacacgggcagc

SEQ ID NO: 3148918 - RNA, 20 nt, Mycobacterium bovis subsp bovis AF2122/97
cgggucguaggacaccaccg

SEQ ID NO: 3148919 - RNA, 22 nt, Mycobacterium bovis subsp bovis AF2122/97
cgggucgucaugccagucgccg

SEQ ID NO: 3148920 - RNA, 14 nt, Mycobacterium bovis subsp bovis AF2122/97
cgggucguccgccu

SEQ ID NO: 3148921 - RNA, 20 nt, Mycobacterium bovis subsp bovis AF2122/97
cgggucguccgccugcaccg

SEQ ID NO: 3148922 - RNA, 23 nt, Mycobacterium bovis subsp bovis AF2122/97
cgggucguccgccugcaccgccg

SEQ ID NO: 3148923 - RNA, 19 nt, Mycobacterium bovis subsp bovis AF2122/97
cgggucguccggcggcagg

SEQ ID NO: 3148924 - RNA, 17 nt, Mycobacterium bovis subsp bovis AF2122/97
cgggucgucgcgaucca

SEQ ID NO: 3148925 - RNA, 15 nt, Mycobacterium bovis subsp bovis AF2122/97
cgggucgugccagca

SEQ ID NO: 3148926 - RNA, 14 nt, Mycobacterium bovis subsp bovis AF2122/97
cgggucgugccccg

SEQ ID NO: 3148927 - RNA, 19 nt, Mycobacterium bovis subsp bovis AF2122/97
cgggucgugccccggcgcg

SEQ ID NO: 3148928 - RNA, 15 nt, Mycobacterium bovis subsp bovis AF2122/97
cgggucgugcgacaa

SEQ ID NO: 3148929 - RNA, 14 nt, Mycobacterium bovis subsp bovis AF2122/97
cgggucgugcgugc

SEQ ID NO: 3148930 - RNA, 18 nt, Mycobacterium bovis subsp bovis AF2122/97
cgggucguuggcggcggu

SEQ ID NO: 3148931 - RNA, 22 nt, Mycobacterium bovis subsp bovis AF2122/97
cgggucguuggcggcggucggc

SEQ ID NO: 3148932 - RNA, 22 nt, Mycobacterium bovis subsp bovis AF2122/97
cgggucuacagcguugccaggu

SEQ ID NO: 3148933 - RNA, 15 nt, Mycobacterium bovis subsp bovis AF2122/97
cgggucuccggcgca

SEQ ID NO: 3148934 - RNA, 17 nt, Mycobacterium bovis subsp bovis AF2122/97
cgggucuccggcgcacc

SEQ ID NO: 3148935 - RNA, 17 nt, Mycobacterium bovis subsp bovis AF2122/97
cgggucucgccgaccuu

SEQ ID NO: 3148936 - RNA, 21 nt, Mycobacterium bovis subsp bovis AF2122/97
cgggucuggccaacgccgggu

SEQ ID NO: 3148937 - RNA, 16 nt, Mycobacterium bovis subsp bovis AF2122/97
cgggucugggugguga

SEQ ID NO: 3148938 - RNA, 20 nt, Mycobacterium bovis subsp bovis AF2122/97
cgggucuuccggugcgccga

SEQ ID NO: 3148939 - RNA, 18 nt, Mycobacterium bovis subsp bovis AF2122/97
cgggucuuggcacacagg

SEQ ID NO: 3148940 - RNA, 18 nt, Mycobacterium bovis subsp bovis AF2122/97
cgggugaaacgauggcga

SEQ ID NO: 3148941 - RNA, 18 nt, Mycobacterium bovis subsp bovis AF2122/97
cgggugaaggaugcggcc

SEQ ID NO: 3148942 - RNA, 19 nt, Mycobacterium bovis subsp bovis AF2122/97
cgggugaaggaugcggccc

SEQ ID NO: 3148943 - RNA, 17 nt, Mycobacterium bovis subsp bovis AF2122/97
cgggugaaguuggcgug

SEQ ID NO: 3148944 - RNA, 18 nt, Mycobacterium bovis subsp bovis AF2122/97
cgggugaaucgacaccgc

SEQ ID NO: 3148945 - RNA, 20 nt, Mycobacterium bovis subsp bovis AF2122/97
cgggugaaucgacaccgccc

SEQ ID NO: 3148946 - RNA, 14 nt, Mycobacterium bovis subsp bovis AF2122/97
cgggugaccaggcg

SEQ ID NO: 3148947 - RNA, 23 nt, Mycobacterium bovis subsp bovis AF2122/97
cgggugaccaggcggcgcggguc

SEQ ID NO: 3148948 - RNA, 15 nt, Mycobacterium bovis subsp bovis AF2122/97
cgggugagauccgau

SEQ ID NO: 3148949 - RNA, 17 nt, Mycobacterium bovis subsp bovis AF2122/97
cgggugaguucggcgua

SEQ ID NO: 3148950 - RNA, 16 nt, Mycobacterium bovis subsp bovis AF2122/97
cggguuacccgcagcg

SEQ ID NO: 3148951 - RNA, 23 nt, Mycobacterium bovis subsp bovis AF2122/97
cggguuacccgcagcgugcccag

SEQ ID NO: 3148952 - RNA, 16 nt, Mycobacterium bovis subsp bovis AF2122/97
cggguuaucggcagca

SEQ ID NO: 3148953 - RNA, 16 nt, Mycobacterium bovis subsp bovis AF2122/97
cggguucaacgcgcgc

SEQ ID NO: 3148954 - RNA, 20 nt, Mycobacterium bovis subsp bovis AF2122/97
cggguucaccgaggugccgc

SEQ ID NO: 3148955 - RNA, 20 nt, Mycobacterium bovis subsp bovis AF2122/97
cggguucacuuccgggcagc

SEQ ID NO: 3148956 - RNA, 17 nt, Mycobacterium bovis subsp bovis AF2122/97
cggguuccauguccggc

SEQ ID NO: 3148957 - RNA, 19 nt, Mycobacterium bovis subsp bovis AF2122/97
cggguucgccggauccgau

SEQ ID NO: 3148958 - RNA, 20 nt, Mycobacterium bovis subsp bovis AF2122/97
cggguucgccggauccgauc

SEQ ID NO: 3148959 - RNA, 15 nt, Mycobacterium bovis subsp bovis AF2122/97
cggguucgcgucuga

SEQ ID NO: 3148960 - RNA, 15 nt, Mycobacterium bovis subsp bovis AF2122/97
cggguugagccgccg

SEQ ID NO: 3148961 - RNA, 16 nt, Mycobacterium bovis subsp bovis AF2122/97
cggguugagccgccgc

SEQ ID NO: 3148962 - RNA, 17 nt, Mycobacterium bovis subsp bovis AF2122/97
cggguugagccgccgcg

SEQ ID NO: 3148963 - RNA, 18 nt, Mycobacterium bovis subsp bovis AF2122/97
cggguugagguaggggca

SEQ ID NO: 3148964 - RNA, 17 nt, Mycobacterium bovis subsp bovis AF2122/97
cggguugcggucaccgg

SEQ ID NO: 3148965 - RNA, 22 nt, Mycobacterium bovis subsp bovis AF2122/97
cggguuggccgaacagcugccc

SEQ ID NO: 3148966 - RNA, 14 nt, Mycobacterium bovis subsp bovis AF2122/97
cggguuggccggcg

SEQ ID NO: 3148967 - RNA, 15 nt, Mycobacterium bovis subsp bovis AF2122/97
cggguuggccggcgc

SEQ ID NO: 3148968 - RNA, 19 nt, Mycobacterium bovis subsp bovis AF2122/97
cggguuggccggcgcugcc

SEQ ID NO: 3148969 - RNA, 14 nt, Mycobacterium bovis subsp bovis AF2122/97
cggguuggcgacga

SEQ ID NO: 3148970 - RNA, 15 nt, Mycobacterium bovis subsp bovis AF2122/97
cggguuggcgacgau

SEQ ID NO: 3148971 - RNA, 21 nt, Mycobacterium bovis subsp bovis AF2122/97
cggguugggcaucaggccgcg

SEQ ID NO: 3148972 - RNA, 23 nt, Mycobacterium bovis subsp bovis AF2122/97
cggguugggcaucaggccgcgcg

SEQ ID NO: 3148973 - RNA, 21 nt, Mycobacterium bovis subsp bovis AF2122/97
cggguuggguguguucggagc

SEQ ID NO: 3148974 - RNA, 13 nt, Mycobacterium bovis subsp bovis AF2122/97
cggguugucggcg

SEQ ID NO: 3148975 - RNA, 14 nt, Mycobacterium bovis subsp bovis AF2122/97
cggguuguggcacc

SEQ ID NO: 3148976 - RNA, 23 nt, Mycobacterium bovis subsp bovis AF2122/97
cggguuucgcucgcaccgcccgc

SEQ ID NO: 3148977 - RNA, 14 nt, Mycobacterium bovis subsp bovis AF2122/97
cggguuugaucucc

SEQ ID NO: 3148978 - RNA, 15 nt, Mycobacterium bovis subsp bovis AF2122/97
cggguuugccgggcg

SEQ ID NO: 3148979 - RNA, 13 nt, Mycobacterium bovis subsp bovis AF2122/97
cggguuuggccga

SEQ ID NO: 3148980 - RNA, 23 nt, Mycobacterium bovis subsp bovis AF2122/97
cggguuuggccgacagccaccgc

SEQ ID NO: 3148981 - RNA, 17 nt, Mycobacterium bovis subsp bovis AF2122/97
cggguuuggugcagccg

SEQ ID NO: 3148982 - RNA, 22 nt, Mycobacterium bovis subsp bovis AF2122/97
cggguuuucucgccguuggcgg

SEQ ID NO: 3148983 - RNA, 14 nt, Mycobacterium bovis subsp bovis AF2122/97
cgguaaaccacucg

SEQ ID NO: 3148984 - RNA, 14 nt, Mycobacterium bovis subsp bovis AF2122/97
cgguaaagccccgc

SEQ ID NO: 3148985 - RNA, 20 nt, Mycobacterium bovis subsp bovis AF2122/97
cgguaaagcucaccacaucg

SEQ ID NO: 3148986 - RNA, 19 nt, Mycobacterium bovis subsp bovis AF2122/97
cgguaaccgcgucgaccgg

SEQ ID NO: 3148987 - RNA, 18 nt, Mycobacterium bovis subsp bovis AF2122/97
cgguaacgaacagcguca

SEQ ID NO: 3148988 - RNA, 16 nt, Mycobacterium bovis subsp bovis AF2122/97
cgguaacgccaacacc

SEQ ID NO: 3148989 - RNA, 19 nt, Mycobacterium bovis subsp bovis AF2122/97
cgguaacgccaacaccggc

SEQ ID NO: 3148990 - RNA, 15 nt, Mycobacterium bovis subsp bovis AF2122/97
cgguaacuguccgcc

SEQ ID NO: 3148991 - RNA, 18 nt, Mycobacterium bovis subsp bovis AF2122/97
cgguaacuguccgcccgg

SEQ ID NO: 3148992 - RNA, 22 nt, Mycobacterium bovis subsp bovis AF2122/97
cgguaagaaucgaagcggcugc

SEQ ID NO: 3148993 - RNA, 15 nt, Mycobacterium bovis subsp bovis AF2122/97
cgguaagccggcgug

SEQ ID NO: 3148994 - RNA, 17 nt, Mycobacterium bovis subsp bovis AF2122/97
cgguaagcgccaaggcg

SEQ ID NO: 3148995 - RNA, 17 nt, Mycobacterium bovis subsp bovis AF2122/97
cgguaauacaggugcag

SEQ ID NO: 3148996 - RNA, 23 nt, Mycobacterium bovis subsp bovis AF2122/97
cgguaauccacuccagcgaaccg

SEQ ID NO: 3148997 - RNA, 15 nt, Mycobacterium bovis subsp bovis AF2122/97
cgguaaucgccaccg

SEQ ID NO: 3148998 - RNA, 22 nt, Mycobacterium bovis subsp bovis AF2122/97
cgguaaugccagcggcacaccc

SEQ ID NO: 3148999 - RNA, 14 nt, Mycobacterium bovis subsp bovis AF2122/97
cgguaauggccgcc

SEQ ID NO: 3149000 - RNA, 15 nt, Mycobacterium bovis subsp bovis AF2122/97
cgguaauggccgccg

SEQ ID NO: 3149001 - RNA, 19 nt, Mycobacterium bovis subsp bovis AF2122/97
cgguaauggcgugcagacc

SEQ ID NO: 3149002 - RNA, 23 nt, Mycobacterium bovis subsp bovis AF2122/97
cgguacaacccccaggcgcucag

SEQ ID NO: 3149003 - RNA, 17 nt, Mycobacterium bovis subsp bovis AF2122/97
cgguaccaaccugcgcg

SEQ ID NO: 3149004 - RNA, 21 nt, Mycobacterium bovis subsp bovis AF2122/97
cgguaccaaccugcgcggcga

SEQ ID NO: 3149005 - RNA, 18 nt, Mycobacterium bovis subsp bovis AF2122/97
cgguaccaucaccgcgcc

SEQ ID NO: 3149006 - RNA, 21 nt, Mycobacterium bovis subsp bovis AF2122/97
cgguaccaucaccgcgccagc

SEQ ID NO: 3149007 - RNA, 24 nt, Mycobacterium bovis subsp bovis AF2122/97
cgguaccaucaccgcgccagccuc

SEQ ID NO: 3149008 - RNA, 23 nt, Mycobacterium bovis subsp bovis AF2122/97
cgguacccgauguccuauuugca

SEQ ID NO: 3149009 - RNA, 17 nt, Mycobacterium bovis subsp bovis AF2122/97
cgguacccgcacccguu

SEQ ID NO: 3149010 - RNA, 14 nt, Mycobacterium bovis subsp bovis AF2122/97
cgguaccgacgggg

SEQ ID NO: 3149011 - RNA, 13 nt, Mycobacterium bovis subsp bovis AF2122/97
cgguaccgcccag

SEQ ID NO: 3149012 - RNA, 14 nt, Mycobacterium bovis subsp bovis AF2122/97
cgguaccgccgcgg

SEQ ID NO: 3149013 - RNA, 19 nt, Mycobacterium bovis subsp bovis AF2122/97
cgguaccgccgcugccggu

SEQ ID NO: 3149014 - RNA, 12 nt, Mycobacterium bovis subsp bovis AF2122/97
cgguaccgccgg

SEQ ID NO: 3149015 - RNA, 13 nt, Mycobacterium bovis subsp bovis AF2122/97
cgguaccgccggc

SEQ ID NO: 3149016 - RNA, 17 nt, Mycobacterium bovis subsp bovis AF2122/97
cgguaccgcucgggcgc

SEQ ID NO: 3149017 - RNA, 18 nt, Mycobacterium bovis subsp bovis AF2122/97
cgguaccgcucgggcgcg

SEQ ID NO: 3149018 - RNA, 12 nt, Mycobacterium bovis subsp bovis AF2122/97
cgguaccggcga

SEQ ID NO: 3149019 - RNA, 19 nt, Mycobacterium bovis subsp bovis AF2122/97
cgguaccugacagcucacg

SEQ ID NO: 3149020 - RNA, 12 nt, Mycobacterium bovis subsp bovis AF2122/97
cgguacgcaacc

SEQ ID NO: 3149021 - RNA, 13 nt, Mycobacterium bovis subsp bovis AF2122/97
cgguacgccgccg

SEQ ID NO: 3149022 - RNA, 14 nt, Mycobacterium bovis subsp bovis AF2122/97
cgguacgccgccgc

SEQ ID NO: 3149023 - RNA, 15 nt, Mycobacterium bovis subsp bovis AF2122/97
cgguacgccgcgccg

SEQ ID NO: 3149024 - RNA, 15 nt, Mycobacterium bovis subsp bovis AF2122/97
cgguacgccggucgg

SEQ ID NO: 3149025 - RNA, 16 nt, Mycobacterium bovis subsp bovis AF2122/97
cgguacgggucgccgg

SEQ ID NO: 3149026 - RNA, 20 nt, Mycobacterium bovis subsp bovis AF2122/97
cgguacugcgcagcgccugc

SEQ ID NO: 3149027 - RNA, 15 nt, Mycobacterium bovis subsp bovis AF2122/97
cgguacugugggcga

SEQ ID NO: 3149028 - RNA, 19 nt, Mycobacterium bovis subsp bovis AF2122/97
cgguagacaagucggcgcu

SEQ ID NO: 3149029 - RNA, 15 nt, Mycobacterium bovis subsp bovis AF2122/97
cgguagacgccgccg

SEQ ID NO: 3149030 - RNA, 18 nt, Mycobacterium bovis subsp bovis AF2122/97
cgguagaucuucggccgc

SEQ ID NO: 3149031 - RNA, 20 nt, Mycobacterium bovis subsp bovis AF2122/97
cgguagaucuucggccgcac

SEQ ID NO: 3149032 - RNA, 18 nt, Mycobacterium bovis subsp bovis AF2122/97
cgguagcacagcagcaac

SEQ ID NO: 3149033 - RNA, 18 nt, Mycobacterium bovis subsp bovis AF2122/97
cgguagcacugucgaggu

SEQ ID NO: 3149034 - RNA, 19 nt, Mycobacterium bovis subsp bovis AF2122/97
cgguagcagcagcgggccg

SEQ ID NO: 3149035 - RNA, 13 nt, Mycobacterium bovis subsp bovis AF2122/97
cgguagcagcgcu

SEQ ID NO: 3149036 - RNA, 16 nt, Mycobacterium bovis subsp bovis AF2122/97
cgguagcauccagcgc

SEQ ID NO: 3149037 - RNA, 14 nt, Mycobacterium bovis subsp bovis AF2122/97
cggucacccgugcu

SEQ ID NO: 3149038 - RNA, 17 nt, Mycobacterium bovis subsp bovis AF2122/97
cggucaccgacgcagaa

SEQ ID NO: 3149039 - RNA, 15 nt, Mycobacterium bovis subsp bovis AF2122/97
cggucaccgcgcagc

SEQ ID NO: 3149040 - RNA, 19 nt, Mycobacterium bovis subsp bovis AF2122/97
cggucaccggagagccggu

SEQ ID NO: 3149041 - RNA, 12 nt, Mycobacterium bovis subsp bovis AF2122/97
cggucaccggcg

SEQ ID NO: 3149042 - RNA, 14 nt, Mycobacterium bovis subsp bovis AF2122/97
cggucaccggcgca

SEQ ID NO: 3149043 - RNA, 19 nt, Mycobacterium bovis subsp bovis AF2122/97
cggucaccggcgcaccgga

SEQ ID NO: 3149044 - RNA, 17 nt, Mycobacterium bovis subsp bovis AF2122/97
cggucaccucgccggcg

SEQ ID NO: 3149045 - RNA, 18 nt, Mycobacterium bovis subsp bovis AF2122/97
cggucaccucgccggcgg

SEQ ID NO: 3149046 - RNA, 13 nt, Mycobacterium bovis subsp bovis AF2122/97
cggucacgcugug

SEQ ID NO: 3149047 - RNA, 20 nt, Mycobacterium bovis subsp bovis AF2122/97
cggucacgcugugcgguauc

SEQ ID NO: 3149048 - RNA, 15 nt, Mycobacterium bovis subsp bovis AF2122/97
cggucacguccgcgg

SEQ ID NO: 3149049 - RNA, 21 nt, Mycobacterium bovis subsp bovis AF2122/97
cggucacgugguccaagacag

SEQ ID NO: 3149050 - RNA, 19 nt, Mycobacterium bovis subsp bovis AF2122/97
cggucacuuuacguagucg

SEQ ID NO: 3149051 - RNA, 22 nt, Mycobacterium bovis subsp bovis AF2122/97
cggucagcaauacggcggcgcc

SEQ ID NO: 3149052 - RNA, 22 nt, Mycobacterium bovis subsp bovis AF2122/97
cggucagcacaugguccaacca

SEQ ID NO: 3149053 - RNA, 22 nt, Mycobacterium bovis subsp bovis AF2122/97
cggucagcaccuccaccgcgcc

SEQ ID NO: 3149054 - RNA, 22 nt, Mycobacterium bovis subsp bovis AF2122/97
cggucagcacgcugaccacaac

SEQ ID NO: 3149055 - RNA, 15 nt, Mycobacterium bovis subsp bovis AF2122/97
cggucagcagcgccg

SEQ ID NO: 3149056 - RNA, 14 nt, Mycobacterium bovis subsp bovis AF2122/97
cggucagccacgcc

SEQ ID NO: 3149057 - RNA, 15 nt, Mycobacterium bovis subsp bovis AF2122/97
cggucagccagccca

SEQ ID NO: 3149058 - RNA, 12 nt, Mycobacterium bovis subsp bovis AF2122/97
cggucagccagg

SEQ ID NO: 3149059 - RNA, 17 nt, Mycobacterium bovis subsp bovis AF2122/97
cggucagccauguccgc

SEQ ID NO: 3149060 - RNA, 14 nt, Mycobacterium bovis subsp bovis AF2122/97
cggucagccgcggg

SEQ ID NO: 3149061 - RNA, 16 nt, Mycobacterium bovis subsp bovis AF2122/97
cggucagccgcggggc

SEQ ID NO: 3149062 - RNA, 14 nt, Mycobacterium bovis subsp bovis AF2122/97
cggucagccggcca

SEQ ID NO: 3149063 - RNA, 13 nt, Mycobacterium bovis subsp bovis AF2122/97
cggucagcgccga

SEQ ID NO: 3149064 - RNA, 18 nt, Mycobacterium bovis subsp bovis AF2122/97
cggucagcgcggcgaccu

SEQ ID NO: 3149065 - RNA, 15 nt, Mycobacterium bovis subsp bovis AF2122/97
cggucagcgcggcgc

SEQ ID NO: 3149066 - RNA, 16 nt, Mycobacterium bovis subsp bovis AF2122/97
cggucagcgcggcgca

SEQ ID NO: 3149067 - RNA, 22 nt, Mycobacterium bovis subsp bovis AF2122/97
cggucagcgcggcgcacaaccc

SEQ ID NO: 3149068 - RNA, 13 nt, Mycobacterium bovis subsp bovis AF2122/97
cggucagcggcca

SEQ ID NO: 3149069 - RNA, 17 nt, Mycobacterium bovis subsp bovis AF2122/97
cggucagcggccaaccc

SEQ ID NO: 3149070 - RNA, 17 nt, Mycobacterium bovis subsp bovis AF2122/97
cggucagcggcucggcg

SEQ ID NO: 3149071 - RNA, 20 nt, Mycobacterium bovis subsp bovis AF2122/97
cggucagcgggcacgccgcc

SEQ ID NO: 3149072 - RNA, 14 nt, Mycobacterium bovis subsp bovis AF2122/97
cggucagcucggca

SEQ ID NO: 3149073 - RNA, 19 nt, Mycobacterium bovis subsp bovis AF2122/97
cggucagcucggcagcauc

SEQ ID NO: 3149074 - RNA, 15 nt, Mycobacterium bovis subsp bovis AF2122/97
cggucagcucgucgg

SEQ ID NO: 3149075 - RNA, 16 nt, Mycobacterium bovis subsp bovis AF2122/97
cggucaggacggcacc

SEQ ID NO: 3149076 - RNA, 13 nt, Mycobacterium bovis subsp bovis AF2122/97
cggucaggauggg

SEQ ID NO: 3149077 - RNA, 20 nt, Mycobacterium bovis subsp bovis AF2122/97
cggucaggauggggaccacu

SEQ ID NO: 3149078 - RNA, 22 nt, Mycobacterium bovis subsp bovis AF2122/97
cggucaggcaguccaccgcgcg

SEQ ID NO: 3149079 - RNA, 16 nt, Mycobacterium bovis subsp bovis AF2122/97
cggucaggccgccgcg

SEQ ID NO: 3149080 - RNA, 20 nt, Mycobacterium bovis subsp bovis AF2122/97
cggucaggccgccgcggcga

SEQ ID NO: 3149081 - RNA, 22 nt, Mycobacterium bovis subsp bovis AF2122/97
cggucaggcucauccgccgggc

SEQ ID NO: 3149082 - RNA, 23 nt, Mycobacterium bovis subsp bovis AF2122/97
cggucagggugggcucguugugu

SEQ ID NO: 3149083 - RNA, 21 nt, Mycobacterium bovis subsp bovis AF2122/97
cggucaggucgagguccucgg

SEQ ID NO: 3149084 - RNA, 18 nt, Mycobacterium bovis subsp bovis AF2122/97
cggucaggucugacagac

SEQ ID NO: 3149085 - RNA, 16 nt, Mycobacterium bovis subsp bovis AF2122/97
cggucagugggacggg

SEQ ID NO: 3149086 - RNA, 23 nt, Mycobacterium bovis subsp bovis AF2122/97
cggucagugggacgggcgcgucc

SEQ ID NO: 3149087 - RNA, 22 nt, Mycobacterium bovis subsp bovis AF2122/97
cggucauagucgaauggcaaca

SEQ ID NO: 3149088 - RNA, 18 nt, Mycobacterium bovis subsp bovis AF2122/97
cggucaucccuuucgcgc

SEQ ID NO: 3149089 - RNA, 21 nt, Mycobacterium bovis subsp bovis AF2122/97
cggucaucccuuucgcgccgc

SEQ ID NO: 3149090 - RNA, 16 nt, Mycobacterium bovis subsp bovis AF2122/97
cggucauccggccguc

SEQ ID NO: 3149091 - RNA, 18 nt, Mycobacterium bovis subsp bovis AF2122/97
cggucauccggccgucgg

SEQ ID NO: 3149092 - RNA, 14 nt, Mycobacterium bovis subsp bovis AF2122/97
cggucauccgggcg

SEQ ID NO: 3149093 - RNA, 15 nt, Mycobacterium bovis subsp bovis AF2122/97
cggucauccgggcga

SEQ ID NO: 3149094 - RNA, 18 nt, Mycobacterium bovis subsp bovis AF2122/97
cggucauccgggcgacca

SEQ ID NO: 3149095 - RNA, 15 nt, Mycobacterium bovis subsp bovis AF2122/97
cggucaugccgccgc

SEQ ID NO: 3149096 - RNA, 18 nt, Mycobacterium bovis subsp bovis AF2122/97
cggucaugccgccgccga

SEQ ID NO: 3149097 - RNA, 15 nt, Mycobacterium bovis subsp bovis AF2122/97
cggucauggcgacgg

SEQ ID NO: 3149098 - RNA, 20 nt, Mycobacterium bovis subsp bovis AF2122/97
cggucauguccguccgcgac

SEQ ID NO: 3149099 - RNA, 18 nt, Mycobacterium bovis subsp bovis AF2122/97
cggucaugucggccaccg

SEQ ID NO: 3149100 - RNA, 19 nt, Mycobacterium bovis subsp bovis AF2122/97
cggucaugucggccaccgg

SEQ ID NO: 3149101 - RNA, 17 nt, Mycobacterium bovis subsp bovis AF2122/97
cgguccaaaacaccgcc

SEQ ID NO: 3149102 - RNA, 20 nt, Mycobacterium bovis subsp bovis AF2122/97
cgguccaaaacaccgccagc

SEQ ID NO: 3149103 - RNA, 22 nt, Mycobacterium bovis subsp bovis AF2122/97
cgguccaaaacaccgccagcuc

SEQ ID NO: 3149104 - RNA, 12 nt, Mycobacterium bovis subsp bovis AF2122/97
cgguccaacagc

SEQ ID NO: 3149105 - RNA, 13 nt, Mycobacterium bovis subsp bovis AF2122/97
cgguccaacccga

SEQ ID NO: 3149106 - RNA, 22 nt, Mycobacterium bovis subsp bovis AF2122/97
cgguccaccgaccuaccgucga

SEQ ID NO: 3149107 - RNA, 14 nt, Mycobacterium bovis subsp bovis AF2122/97
cgguccaccggccc

SEQ ID NO: 3149108 - RNA, 17 nt, Mycobacterium bovis subsp bovis AF2122/97
cgguccagacaucagug

SEQ ID NO: 3149109 - RNA, 15 nt, Mycobacterium bovis subsp bovis AF2122/97
cgguccagacccagc

SEQ ID NO: 3149110 - RNA, 15 nt, Mycobacterium bovis subsp bovis AF2122/97
cgguccagccaccgc

SEQ ID NO: 3149111 - RNA, 17 nt, Mycobacterium bovis subsp bovis AF2122/97
cgguccagcccagcgcg

SEQ ID NO: 3149112 - RNA, 14 nt, Mycobacterium bovis subsp bovis AF2122/97
cgguccagccggua

SEQ ID NO: 3149113 - RNA, 14 nt, Mycobacterium bovis subsp bovis AF2122/97
cgguccagcgccgg

SEQ ID NO: 3149114 - RNA, 14 nt, Mycobacterium bovis subsp bovis AF2122/97
cgguccagcggccg

SEQ ID NO: 3149115 - RNA, 19 nt, Mycobacterium bovis subsp bovis AF2122/97
cgguccagcggccgccgcg

SEQ ID NO: 3149116 - RNA, 13 nt, Mycobacterium bovis subsp bovis AF2122/97
cgguccagcgucg

SEQ ID NO: 3149117 - RNA, 18 nt, Mycobacterium bovis subsp bovis AF2122/97
cgguccagcgucgccgcc

SEQ ID NO: 3149118 - RNA, 16 nt, Mycobacterium bovis subsp bovis AF2122/97
cgguccaggccggcac

SEQ ID NO: 3149119 - RNA, 17 nt, Mycobacterium bovis subsp bovis AF2122/97
cgguccaggccggcacc

SEQ ID NO: 3149120 - RNA, 13 nt, Mycobacterium bovis subsp bovis AF2122/97
cgguccagggccu

SEQ ID NO: 3149121 - RNA, 15 nt, Mycobacterium bovis subsp bovis AF2122/97
cgguccagggccugu

SEQ ID NO: 3149122 - RNA, 16 nt, Mycobacterium bovis subsp bovis AF2122/97
cgguccagggccuguu

SEQ ID NO: 3149123 - RNA, 12 nt, Mycobacterium bovis subsp bovis AF2122/97
cgguccaucagc

SEQ ID NO: 3149124 - RNA, 21 nt, Mycobacterium bovis subsp bovis AF2122/97
cggucgccaccgccggcagca

SEQ ID NO: 3149125 - RNA, 13 nt, Mycobacterium bovis subsp bovis AF2122/97
cggucgccaccgu

SEQ ID NO: 3149126 - RNA, 14 nt, Mycobacterium bovis subsp bovis AF2122/97
cggucgccaccgug

SEQ ID NO: 3149127 - RNA, 16 nt, Mycobacterium bovis subsp bovis AF2122/97
cggucgccaccguguc

SEQ ID NO: 3149128 - RNA, 21 nt, Mycobacterium bovis subsp bovis AF2122/97
cggucgccaccgugucacgcg

SEQ ID NO: 3149129 - RNA, 14 nt, Mycobacterium bovis subsp bovis AF2122/97
cggucgcccaggcc

SEQ ID NO: 3149130 - RNA, 17 nt, Mycobacterium bovis subsp bovis AF2122/97
cggucgcccgagucgaa

SEQ ID NO: 3149131 - RNA, 18 nt, Mycobacterium bovis subsp bovis AF2122/97
cggucgcccgaucggcgg

SEQ ID NO: 3149132 - RNA, 20 nt, Mycobacterium bovis subsp bovis AF2122/97
cggucgcccgcuaccaacgc

SEQ ID NO: 3149133 - RNA, 18 nt, Mycobacterium bovis subsp bovis AF2122/97
cggucgccgaauggcugg

SEQ ID NO: 3149134 - RNA, 16 nt, Mycobacterium bovis subsp bovis AF2122/97
cggucgccgacggcga

SEQ ID NO: 3149135 - RNA, 20 nt, Mycobacterium bovis subsp bovis AF2122/97
cggucgccggucaucgccga

SEQ ID NO: 3149136 - RNA, 18 nt, Mycobacterium bovis subsp bovis AF2122/97
cggucgccucaccggcgc

SEQ ID NO: 3149137 - RNA, 24 nt, Mycobacterium bovis subsp bovis AF2122/97
cggucgccucaccggcgcgagcag

SEQ ID NO: 3149138 - RNA, 22 nt, Mycobacterium bovis subsp bovis AF2122/97
cggucgccucgcuaacucccca

SEQ ID NO: 3149139 - RNA, 23 nt, Mycobacterium bovis subsp bovis AF2122/97
cggucgcgcccucagccgcggcc

SEQ ID NO: 3149140 - RNA, 17 nt, Mycobacterium bovis subsp bovis AF2122/97
cggucgcgcgacggccg

SEQ ID NO: 3149141 - RNA, 14 nt, Mycobacterium bovis subsp bovis AF2122/97
cggucgcgcgaugg

SEQ ID NO: 3149142 - RNA, 12 nt, Mycobacterium bovis subsp bovis AF2122/97
cggucgcggaac

SEQ ID NO: 3149143 - RNA, 16 nt, Mycobacterium bovis subsp bovis AF2122/97
cggucgcggcugacaa

SEQ ID NO: 3149144 - RNA, 22 nt, Mycobacterium bovis subsp bovis AF2122/97
cggucgcguaccgguggaaacc

SEQ ID NO: 3149145 - RNA, 16 nt, Mycobacterium bovis subsp bovis AF2122/97
cggucgcuauccggcg

SEQ ID NO: 3149146 - RNA, 19 nt, Mycobacterium bovis subsp bovis AF2122/97
cggucgcuauccggcggcc

SEQ ID NO: 3149147 - RNA, 21 nt, Mycobacterium bovis subsp bovis AF2122/97
cggucgcuauccggcggccag

SEQ ID NO: 3149148 - RNA, 16 nt, Mycobacterium bovis subsp bovis AF2122/97
cggucgcugauccggg

SEQ ID NO: 3149149 - RNA, 18 nt, Mycobacterium bovis subsp bovis AF2122/97
cggucgcugauccgggcg

SEQ ID NO: 3149150 - RNA, 17 nt, Mycobacterium bovis subsp bovis AF2122/97
cggucgcuguccacugc

SEQ ID NO: 3149151 - RNA, 20 nt, Mycobacterium bovis subsp bovis AF2122/97
cggucgcuguccacugccac

SEQ ID NO: 3149152 - RNA, 16 nt, Mycobacterium bovis subsp bovis AF2122/97
cggucgcuucagcgcc

SEQ ID NO: 3149153 - RNA, 15 nt, Mycobacterium bovis subsp bovis AF2122/97
cggucgcuugcuguc

SEQ ID NO: 3149154 - RNA, 19 nt, Mycobacterium bovis subsp bovis AF2122/97
cggucggacggccaucgcc

SEQ ID NO: 3149155 - RNA, 22 nt, Mycobacterium bovis subsp bovis AF2122/97
cggucggacggccaucgccagc

SEQ ID NO: 3149156 - RNA, 17 nt, Mycobacterium bovis subsp bovis AF2122/97
cggucggaguaagcgau

SEQ ID NO: 3149157 - RNA, 14 nt, Mycobacterium bovis subsp bovis AF2122/97
cggucggaucggug

SEQ ID NO: 3149158 - RNA, 15 nt, Mycobacterium bovis subsp bovis AF2122/97
cggucggcaccaggu

SEQ ID NO: 3149159 - RNA, 17 nt, Mycobacterium bovis subsp bovis AF2122/97
cggucggcagaccgacc

SEQ ID NO: 3149160 - RNA, 12 nt, Mycobacterium bovis subsp bovis AF2122/97
cggucggcagcg

SEQ ID NO: 3149161 - RNA, 19 nt, Mycobacterium bovis subsp bovis AF2122/97
cggucggcagcgacgccgg

SEQ ID NO: 3149162 - RNA, 17 nt, Mycobacterium bovis subsp bovis AF2122/97
cggucggcagcuccagc

SEQ ID NO: 3149163 - RNA, 18 nt, Mycobacterium bovis subsp bovis AF2122/97
cggucggcagcuccagca

SEQ ID NO: 3149164 - RNA, 14 nt, Mycobacterium bovis subsp bovis AF2122/97
cggucggcagcuuc

SEQ ID NO: 3149165 - RNA, 19 nt, Mycobacterium bovis subsp bovis AF2122/97
cggucggcagcuucucgcc

SEQ ID NO: 3149166 - RNA, 21 nt, Mycobacterium bovis subsp bovis AF2122/97
cggucggccacauccagcgcu

SEQ ID NO: 3149167 - RNA, 13 nt, Mycobacterium bovis subsp bovis AF2122/97
cggucggccacca

SEQ ID NO: 3149168 - RNA, 23 nt, Mycobacterium bovis subsp bovis AF2122/97
cggucggccaccaacucggcgac

SEQ ID NO: 3149169 - RNA, 13 nt, Mycobacterium bovis subsp bovis AF2122/97
cggucggccaggc

SEQ ID NO: 3149170 - RNA, 15 nt, Mycobacterium bovis subsp bovis AF2122/97
cggucggccaggccg

SEQ ID NO: 3149171 - RNA, 19 nt, Mycobacterium bovis subsp bovis AF2122/97
cggucggccauccaccgca

SEQ ID NO: 3149172 - RNA, 20 nt, Mycobacterium bovis subsp bovis AF2122/97
cggucggccauccaccgcag

SEQ ID NO: 3149173 - RNA, 20 nt, Mycobacterium bovis subsp bovis AF2122/97
cggucggccauugcccgggc

SEQ ID NO: 3149174 - RNA, 21 nt, Mycobacterium bovis subsp bovis AF2122/97
cggucggccauugcccgggcg

SEQ ID NO: 3149175 - RNA, 23 nt, Mycobacterium bovis subsp bovis AF2122/97
cggucggccugcgaacacgcgau

SEQ ID NO: 3149176 - RNA, 22 nt, Mycobacterium bovis subsp bovis AF2122/97
cggucggcgaccaccagcgccg

SEQ ID NO: 3149177 - RNA, 15 nt, Mycobacterium bovis subsp bovis AF2122/97
cggucggcgacguag

SEQ ID NO: 3149178 - RNA, 13 nt, Mycobacterium bovis subsp bovis AF2122/97
cggucggcggccg

SEQ ID NO: 3149179 - RNA, 14 nt, Mycobacterium bovis subsp bovis AF2122/97
cggucggcggccgc

SEQ ID NO: 3149180 - RNA, 15 nt, Mycobacterium bovis subsp bovis AF2122/97
cggucggcggccgcc

SEQ ID NO: 3149181 - RNA, 16 nt, Mycobacterium bovis subsp bovis AF2122/97
cggucggcggccgcca

SEQ ID NO: 3149182 - RNA, 19 nt, Mycobacterium bovis subsp bovis AF2122/97
cggucggcgguagccgacc

SEQ ID NO: 3149183 - RNA, 21 nt, Mycobacterium bovis subsp bovis AF2122/97
cggucggcgucgagauagucg

SEQ ID NO: 3149184 - RNA, 16 nt, Mycobacterium bovis subsp bovis AF2122/97
cggucggcuccacgcu

SEQ ID NO: 3149185 - RNA, 23 nt, Mycobacterium bovis subsp bovis AF2122/97
cggucggggagcugcggcggcca

SEQ ID NO: 3149186 - RNA, 18 nt, Mycobacterium bovis subsp bovis AF2122/97
cggucggggauccgaccu

SEQ ID NO: 3149187 - RNA, 16 nt, Mycobacterium bovis subsp bovis AF2122/97
cggucgguaacggcgg

SEQ ID NO: 3149188 - RNA, 18 nt, Mycobacterium bovis subsp bovis AF2122/97
cggucgguaacggcggug

SEQ ID NO: 3149189 - RNA, 20 nt, Mycobacterium bovis subsp bovis AF2122/97
cggucgguacccgcacccgu

SEQ ID NO: 3149190 - RNA, 18 nt, Mycobacterium bovis subsp bovis AF2122/97
cggucggucaccauggcg

SEQ ID NO: 3149191 - RNA, 18 nt, Mycobacterium bovis subsp bovis AF2122/97
cggucggugaacccgccg

SEQ ID NO: 3149192 - RNA, 15 nt, Mycobacterium bovis subsp bovis AF2122/97
cggucggugagccgu

SEQ ID NO: 3149193 - RNA, 19 nt, Mycobacterium bovis subsp bovis AF2122/97
cggucggugagccgugccg

SEQ ID NO: 3149194 - RNA, 13 nt, Mycobacterium bovis subsp bovis AF2122/97
cggucggugcgga

SEQ ID NO: 3149195 - RNA, 17 nt, Mycobacterium bovis subsp bovis AF2122/97
cggucgguguagcaacg

SEQ ID NO: 3149196 - RNA, 20 nt, Mycobacterium bovis subsp bovis AF2122/97
cggucguagacagucugcga

SEQ ID NO: 3149197 - RNA, 23 nt, Mycobacterium bovis subsp bovis AF2122/97
cggucguagcuuccgguccagcg

SEQ ID NO: 3149198 - RNA, 16 nt, Mycobacterium bovis subsp bovis AF2122/97
cggucguccggaucgg

SEQ ID NO: 3149199 - RNA, 12 nt, Mycobacterium bovis subsp bovis AF2122/97
cggucgucgcga

SEQ ID NO: 3149200 - RNA, 16 nt, Mycobacterium bovis subsp bovis AF2122/97
cggucgucugucucgg

SEQ ID NO: 3149201 - RNA, 20 nt, Mycobacterium bovis subsp bovis AF2122/97
cggucgucugucucggugcc

SEQ ID NO: 3149202 - RNA, 16 nt, Mycobacterium bovis subsp bovis AF2122/97
cggucgugaucggcgu

SEQ ID NO: 3149203 - RNA, 18 nt, Mycobacterium bovis subsp bovis AF2122/97
cggucgugccccgcgguc

SEQ ID NO: 3149204 - RNA, 20 nt, Mycobacterium bovis subsp bovis AF2122/97
cggucgugccggggcugccg

SEQ ID NO: 3149205 - RNA, 23 nt, Mycobacterium bovis subsp bovis AF2122/97
cggucgugccggggcugccgaac

SEQ ID NO: 3149206 - RNA, 12 nt, Mycobacterium bovis subsp bovis AF2122/97
cggucguggucc

SEQ ID NO: 3149207 - RNA, 16 nt, Mycobacterium bovis subsp bovis AF2122/97
cggucguugccgaccg

SEQ ID NO: 3149208 - RNA, 22 nt, Mycobacterium bovis subsp bovis AF2122/97
cggucguugccgcggucggcga

SEQ ID NO: 3149209 - RNA, 16 nt, Mycobacterium bovis subsp bovis AF2122/97
cggucguuggucgggg

SEQ ID NO: 3149210 - RNA, 18 nt, Mycobacterium bovis subsp bovis AF2122/97
cggugacgacgucgccgc

SEQ ID NO: 3149211 - RNA, 19 nt, Mycobacterium bovis subsp bovis AF2122/97
cggugacgacgucgccgcc

SEQ ID NO: 3149212 - RNA, 21 nt, Mycobacterium bovis subsp bovis AF2122/97
cggugacgacgucgccgccgc

SEQ ID NO: 3149213 - RNA, 16 nt, Mycobacterium bovis subsp bovis AF2122/97
cggugacgagccacca

SEQ ID NO: 3149214 - RNA, 18 nt, Mycobacterium bovis subsp bovis AF2122/97
cggugacgagccaccacc

SEQ ID NO: 3149215 - RNA, 20 nt, Mycobacterium bovis subsp bovis AF2122/97
cggugacgagccaccaccgc

SEQ ID NO: 3149216 - RNA, 17 nt, Mycobacterium bovis subsp bovis AF2122/97
cggugacgaucaggccg

SEQ ID NO: 3149217 - RNA, 19 nt, Mycobacterium bovis subsp bovis AF2122/97
cggugacgaugaccgcgcg

SEQ ID NO: 3149218 - RNA, 18 nt, Mycobacterium bovis subsp bovis AF2122/97
cggugacgauugccacca

SEQ ID NO: 3149219 - RNA, 16 nt, Mycobacterium bovis subsp bovis AF2122/97
cggugacgcaacaucg

SEQ ID NO: 3149220 - RNA, 19 nt, Mycobacterium bovis subsp bovis AF2122/97
cggugacgcaacaucggau

SEQ ID NO: 3149221 - RNA, 21 nt, Mycobacterium bovis subsp bovis AF2122/97
cggugacgcacagcagcaccg

SEQ ID NO: 3149222 - RNA, 14 nt, Mycobacterium bovis subsp bovis AF2122/97
cggugacgccagcc

SEQ ID NO: 3149223 - RNA, 13 nt, Mycobacterium bovis subsp bovis AF2122/97
cggugacgccguc

SEQ ID NO: 3149224 - RNA, 23 nt, Mycobacterium bovis subsp bovis AF2122/97
cggugacggccggcggucgggcc

SEQ ID NO: 3149225 - RNA, 15 nt, Mycobacterium bovis subsp bovis AF2122/97
cggugacggcggcaa

SEQ ID NO: 3149226 - RNA, 14 nt, Mycobacterium bovis subsp bovis AF2122/97
cggugacggcggcu

SEQ ID NO: 3149227 - RNA, 21 nt, Mycobacterium bovis subsp bovis AF2122/97
cggugacggggcugaccgcca

SEQ ID NO: 3149228 - RNA, 23 nt, Mycobacterium bovis subsp bovis AF2122/97
cggugacggggcugaccgccacc

SEQ ID NO: 3149229 - RNA, 19 nt, Mycobacterium bovis subsp bovis AF2122/97
cggugacgggguugaccgc

SEQ ID NO: 3149230 - RNA, 22 nt, Mycobacterium bovis subsp bovis AF2122/97
cggugacgggguugaccgccac

SEQ ID NO: 3149231 - RNA, 13 nt, Mycobacterium bovis subsp bovis AF2122/97
cggugacgguguu

SEQ ID NO: 3149232 - RNA, 15 nt, Mycobacterium bovis subsp bovis AF2122/97
cggugacguagacgg

SEQ ID NO: 3149233 - RNA, 16 nt, Mycobacterium bovis subsp bovis AF2122/97
cggugacucggccucc

SEQ ID NO: 3149234 - RNA, 19 nt, Mycobacterium bovis subsp bovis AF2122/97
cggugacucggccuccgcc

SEQ ID NO: 3149235 - RNA, 16 nt, Mycobacterium bovis subsp bovis AF2122/97
cggugagaagaagccc

SEQ ID NO: 3149236 - RNA, 12 nt, Mycobacterium bovis subsp bovis AF2122/97
cggugagaucgg

SEQ ID NO: 3149237 - RNA, 15 nt, Mycobacterium bovis subsp bovis AF2122/97
cggugagaucggguu

SEQ ID NO: 3149238 - RNA, 19 nt, Mycobacterium bovis subsp bovis AF2122/97
cggugagcaacuggcauuu

SEQ ID NO: 3149239 - RNA, 21 nt, Mycobacterium bovis subsp bovis AF2122/97
cggugagcagcucggugacaa

SEQ ID NO: 3149240 - RNA, 14 nt, Mycobacterium bovis subsp bovis AF2122/97
cggugagccgggcg

SEQ ID NO: 3149241 - RNA, 17 nt, Mycobacterium bovis subsp bovis AF2122/97
cggugagccgggcggcc

SEQ ID NO: 3149242 - RNA, 17 nt, Mycobacterium bovis subsp bovis AF2122/97
cggugagccgugccgcc

SEQ ID NO: 3149243 - RNA, 18 nt, Mycobacterium bovis subsp bovis AF2122/97
cggugagcgagcgcgcgu

SEQ ID NO: 3149244 - RNA, 21 nt, Mycobacterium bovis subsp bovis AF2122/97
cggugagcucuucggacacag

SEQ ID NO: 3149245 - RNA, 18 nt, Mycobacterium bovis subsp bovis AF2122/97
cggugaggaagcggccgg

SEQ ID NO: 3149246 - RNA, 14 nt, Mycobacterium bovis subsp bovis AF2122/97
cggugagguauucg

SEQ ID NO: 3149247 - RNA, 15 nt, Mycobacterium bovis subsp bovis AF2122/97
cggugagguccucgg

SEQ ID NO: 3149248 - RNA, 15 nt, Mycobacterium bovis subsp bovis AF2122/97
cggugaggucgaugc

SEQ ID NO: 3149249 - RNA, 18 nt, Mycobacterium bovis subsp bovis AF2122/97
cggugaggucgaugccgg

SEQ ID NO: 3149250 - RNA, 14 nt, Mycobacterium bovis subsp bovis AF2122/97
cggugaggugacca

SEQ ID NO: 3149251 - RNA, 13 nt, Mycobacterium bovis subsp bovis AF2122/97
cggugaguccgcu

SEQ ID NO: 3149252 - RNA, 16 nt, Mycobacterium bovis subsp bovis AF2122/97
cggugaguccgcugag

SEQ ID NO: 3149253 - RNA, 18 nt, Mycobacterium bovis subsp bovis AF2122/97
cggugaucaaaccggcgg

SEQ ID NO: 3149254 - RNA, 17 nt, Mycobacterium bovis subsp bovis AF2122/97
cggugaucaccaugauc

SEQ ID NO: 3149255 - RNA, 18 nt, Mycobacterium bovis subsp bovis AF2122/97
cggugaucaccgacaccg

SEQ ID NO: 3149256 - RNA, 19 nt, Mycobacterium bovis subsp bovis AF2122/97
cggugaucaccgacaccgu

SEQ ID NO: 3149257 - RNA, 15 nt, Mycobacterium bovis subsp bovis AF2122/97
cggugaucaccgcgg

SEQ ID NO: 3149258 - RNA, 18 nt, Mycobacterium bovis subsp bovis AF2122/97
cggugaucaccgcggcgg

SEQ ID NO: 3149259 - RNA, 19 nt, Mycobacterium bovis subsp bovis AF2122/97
cggugaucacggucggcgg

SEQ ID NO: 3149260 - RNA, 15 nt, Mycobacterium bovis subsp bovis AF2122/97
cggugaucagccacc

SEQ ID NO: 3149261 - RNA, 17 nt, Mycobacterium bovis subsp bovis AF2122/97
cggugaucagccaccgg

SEQ ID NO: 3149262 - RNA, 18 nt, Mycobacterium bovis subsp bovis AF2122/97
cggugaucagccaccggg

SEQ ID NO: 3149263 - RNA, 21 nt, Mycobacterium bovis subsp bovis AF2122/97
cggugaucagguaagcgaacg

SEQ ID NO: 3149264 - RNA, 22 nt, Mycobacterium bovis subsp bovis AF2122/97
cggugaucagguaagcgaacgg

SEQ ID NO: 3149265 - RNA, 19 nt, Mycobacterium bovis subsp bovis AF2122/97
cggugauccacgcucgggc

SEQ ID NO: 3149266 - RNA, 16 nt, Mycobacterium bovis subsp bovis AF2122/97
cggugaucccacgagc

SEQ ID NO: 3149267 - RNA, 23 nt, Mycobacterium bovis subsp bovis AF2122/97
cggugaucgaacugggggccggc

SEQ ID NO: 3149268 - RNA, 23 nt, Mycobacterium bovis subsp bovis AF2122/97
cggugaucgccggcuucgcccag

SEQ ID NO: 3149269 - RNA, 15 nt, Mycobacterium bovis subsp bovis AF2122/97
cggugaucgcggugg

SEQ ID NO: 3149270 - RNA, 16 nt, Mycobacterium bovis subsp bovis AF2122/97
cggugaucgcgguggc

SEQ ID NO: 3149271 - RNA, 13 nt, Mycobacterium bovis subsp bovis AF2122/97
cggugaucggcgg

SEQ ID NO: 3149272 - RNA, 19 nt, Mycobacterium bovis subsp bovis AF2122/97
cggugaucgggcagcacgc

SEQ ID NO: 3149273 - RNA, 20 nt, Mycobacterium bovis subsp bovis AF2122/97
cggugaucuuguccgggccc

SEQ ID NO: 3149274 - RNA, 20 nt, Mycobacterium bovis subsp bovis AF2122/97
cggugaugaacgacauccgg

SEQ ID NO: 3149275 - RNA, 23 nt, Mycobacterium bovis subsp bovis AF2122/97
cggugaugaacgacauccggccg

SEQ ID NO: 3149276 - RNA, 14 nt, Mycobacterium bovis subsp bovis AF2122/97
cggugaugaagcgc

SEQ ID NO: 3149277 - RNA, 18 nt, Mycobacterium bovis subsp bovis AF2122/97
cggugaugagucaggcgc

SEQ ID NO: 3149278 - RNA, 19 nt, Mycobacterium bovis subsp bovis AF2122/97
cggugaugcccagcgccga

SEQ ID NO: 3149279 - RNA, 21 nt, Mycobacterium bovis subsp bovis AF2122/97
cggugauggacugaucgcgau

SEQ ID NO: 3149280 - RNA, 15 nt, Mycobacterium bovis subsp bovis AF2122/97
cggugauggagccgg

SEQ ID NO: 3149281 - RNA, 16 nt, Mycobacterium bovis subsp bovis AF2122/97
cggugauggagccggu

SEQ ID NO: 3149282 - RNA, 23 nt, Mycobacterium bovis subsp bovis AF2122/97
cggugauggagccggugacggug

SEQ ID NO: 3149283 - RNA, 18 nt, Mycobacterium bovis subsp bovis AF2122/97
cggugauggccgaccagc

SEQ ID NO: 3149284 - RNA, 13 nt, Mycobacterium bovis subsp bovis AF2122/97
cggugaugggggu

SEQ ID NO: 3149285 - RNA, 16 nt, Mycobacterium bovis subsp bovis AF2122/97
cggugauggucaccgu

SEQ ID NO: 3149286 - RNA, 20 nt, Mycobacterium bovis subsp bovis AF2122/97
cggugauggucagcuggccg

SEQ ID NO: 3149287 - RNA, 20 nt, Mycobacterium bovis subsp bovis AF2122/97
cggugauggugaccagcagg

SEQ ID NO: 3149288 - RNA, 17 nt, Mycobacterium bovis subsp bovis AF2122/97
cggugaugguggcaacg

SEQ ID NO: 3149289 - RNA, 20 nt, Mycobacterium bovis subsp bovis AF2122/97
cggugauguagggcugcucc

SEQ ID NO: 3149290 - RNA, 22 nt, Mycobacterium bovis subsp bovis AF2122/97
cggugauugcaagcgggcaccg

SEQ ID NO: 3149291 - RNA, 20 nt, Mycobacterium bovis subsp bovis AF2122/97
cggugcacaaaauacuccgc

SEQ ID NO: 3149292 - RNA, 21 nt, Mycobacterium bovis subsp bovis AF2122/97
cggugcacaacgcccaccacg

SEQ ID NO: 3149293 - RNA, 22 nt, Mycobacterium bovis subsp bovis AF2122/97
cggugcacaacgcccaccacgc

SEQ ID NO: 3149294 - RNA, 21 nt, Mycobacterium bovis subsp bovis AF2122/97
cggugcacacugaccccgccg

SEQ ID NO: 3149295 - RNA, 18 nt, Mycobacterium bovis subsp bovis AF2122/97
cggugcacgagcggacag

SEQ ID NO: 3149296 - RNA, 22 nt, Mycobacterium bovis subsp bovis AF2122/97
cggugccgccguucccaccacc

SEQ ID NO: 3149297 - RNA, 14 nt, Mycobacterium bovis subsp bovis AF2122/97
cggugccgccguug

SEQ ID NO: 3149298 - RNA, 15 nt, Mycobacterium bovis subsp bovis AF2122/97
cggugccgccuccgc

SEQ ID NO: 3149299 - RNA, 19 nt, Mycobacterium bovis subsp bovis AF2122/97
cggugccgccuccgccugc

SEQ ID NO: 3149300 - RNA, 20 nt, Mycobacterium bovis subsp bovis AF2122/97
cggugccgccuccgccugcc

SEQ ID NO: 3149301 - RNA, 18 nt, Mycobacterium bovis subsp bovis AF2122/97
cggugccgccugcgccgc

SEQ ID NO: 3149302 - RNA, 17 nt, Mycobacterium bovis subsp bovis AF2122/97
cggugccgcgaucgcgg

SEQ ID NO: 3149303 - RNA, 15 nt, Mycobacterium bovis subsp bovis AF2122/97
cggugccgcgguagg

SEQ ID NO: 3149304 - RNA, 23 nt, Mycobacterium bovis subsp bovis AF2122/97
cggugccggagacaccgcaacgc

SEQ ID NO: 3149305 - RNA, 14 nt, Mycobacterium bovis subsp bovis AF2122/97
cggugccggccaga

SEQ ID NO: 3149306 - RNA, 21 nt, Mycobacterium bovis subsp bovis AF2122/97
cggugccggccagacucgcgg

SEQ ID NO: 3149307 - RNA, 15 nt, Mycobacterium bovis subsp bovis AF2122/97
cggugccggccaucg

SEQ ID NO: 3149308 - RNA, 12 nt, Mycobacterium bovis subsp bovis AF2122/97
cggugccggccc

SEQ ID NO: 3149309 - RNA, 13 nt, Mycobacterium bovis subsp bovis AF2122/97
cggugccggccgc

SEQ ID NO: 3149310 - RNA, 13 nt, Mycobacterium bovis subsp bovis AF2122/97
cggugccggcgac

SEQ ID NO: 3149311 - RNA, 13 nt, Mycobacterium bovis subsp bovis AF2122/97
cggugccggcgca

SEQ ID NO: 3149312 - RNA, 12 nt, Mycobacterium bovis subsp bovis AF2122/97
cggugccggcgg

SEQ ID NO: 3149313 - RNA, 15 nt, Mycobacterium bovis subsp bovis AF2122/97
cggugccggcggauc

SEQ ID NO: 3149314 - RNA, 16 nt, Mycobacterium bovis subsp bovis AF2122/97
cggugccggcggcgca

SEQ ID NO: 3149315 - RNA, 14 nt, Mycobacterium bovis subsp bovis AF2122/97
cggugccggcguug

SEQ ID NO: 3149316 - RNA, 14 nt, Mycobacterium bovis subsp bovis AF2122/97
cggugccgggaucg

SEQ ID NO: 3149317 - RNA, 18 nt, Mycobacterium bovis subsp bovis AF2122/97
cggugccgggaucgccgu

SEQ ID NO: 3149318 - RNA, 19 nt, Mycobacterium bovis subsp bovis AF2122/97
cggugccgggaugccgccg

SEQ ID NO: 3149319 - RNA, 22 nt, Mycobacterium bovis subsp bovis AF2122/97
cggugccgggcaccaccacacc

SEQ ID NO: 3149320 - RNA, 16 nt, Mycobacterium bovis subsp bovis AF2122/97
cggugccggggcugcc

SEQ ID NO: 3149321 - RNA, 18 nt, Mycobacterium bovis subsp bovis AF2122/97
cggugccggggcugccgc

SEQ ID NO: 3149322 - RNA, 19 nt, Mycobacterium bovis subsp bovis AF2122/97
cggugccggggcugccgcc

SEQ ID NO: 3149323 - RNA, 21 nt, Mycobacterium bovis subsp bovis AF2122/97
cggugccggggcugccgccgu

SEQ ID NO: 3149324 - RNA, 23 nt, Mycobacterium bovis subsp bovis AF2122/97
cggugccggggcugccgccguug

SEQ ID NO: 3149325 - RNA, 16 nt, Mycobacterium bovis subsp bovis AF2122/97
cggugccgguagcggc

SEQ ID NO: 3149326 - RNA, 21 nt, Mycobacterium bovis subsp bovis AF2122/97
cggugccggucgagugccucg

SEQ ID NO: 3149327 - RNA, 16 nt, Mycobacterium bovis subsp bovis AF2122/97
cggugccgguggugac

SEQ ID NO: 3149328 - RNA, 20 nt, Mycobacterium bovis subsp bovis AF2122/97
cggugccgucagcggcggcc

SEQ ID NO: 3149329 - RNA, 21 nt, Mycobacterium bovis subsp bovis AF2122/97
cggugccgucagcggcggcca

SEQ ID NO: 3149330 - RNA, 12 nt, Mycobacterium bovis subsp bovis AF2122/97
cggugccgucga

SEQ ID NO: 3149331 - RNA, 21 nt, Mycobacterium bovis subsp bovis AF2122/97
cggugccgucgaguccaggcc

SEQ ID NO: 3149332 - RNA, 15 nt, Mycobacterium bovis subsp bovis AF2122/97
cggugccgucgccgc

SEQ ID NO: 3149333 - RNA, 18 nt, Mycobacterium bovis subsp bovis AF2122/97
cggugccgucggugccgc

SEQ ID NO: 3149334 - RNA, 19 nt, Mycobacterium bovis subsp bovis AF2122/97
cggugccgugaucggcgcc

SEQ ID NO: 3149335 - RNA, 22 nt, Mycobacterium bovis subsp bovis AF2122/97
cggugccgugaucggcgcccgg

SEQ ID NO: 3149336 - RNA, 12 nt, Mycobacterium bovis subsp bovis AF2122/97
cggugccgugcu

SEQ ID NO: 3149337 - RNA, 17 nt, Mycobacterium bovis subsp bovis AF2122/97
cggugccgugcucacgg

SEQ ID NO: 3149338 - RNA, 19 nt, Mycobacterium bovis subsp bovis AF2122/97
cggugccguuggagccgcc

SEQ ID NO: 3149339 - RNA, 20 nt, Mycobacterium bovis subsp bovis AF2122/97
cggugccucgcagccaacgc

SEQ ID NO: 3149340 - RNA, 17 nt, Mycobacterium bovis subsp bovis AF2122/97
cggugcgauccugacca

SEQ ID NO: 3149341 - RNA, 20 nt, Mycobacterium bovis subsp bovis AF2122/97
cggugcgauuccgcgucugc

SEQ ID NO: 3149342 - RNA, 17 nt, Mycobacterium bovis subsp bovis AF2122/97
cggugcgcaacuucgac

SEQ ID NO: 3149343 - RNA, 14 nt, Mycobacterium bovis subsp bovis AF2122/97
cggugcgcaccaga

SEQ ID NO: 3149344 - RNA, 22 nt, Mycobacterium bovis subsp bovis AF2122/97
cggugcgcaccagagugguguu

SEQ ID NO: 3149345 - RNA, 13 nt, Mycobacterium bovis subsp bovis AF2122/97
cggugcgcacggc

SEQ ID NO: 3149346 - RNA, 19 nt, Mycobacterium bovis subsp bovis AF2122/97
cggugcgcacggcggccca

SEQ ID NO: 3149347 - RNA, 15 nt, Mycobacterium bovis subsp bovis AF2122/97
cggugcgcagggccu

SEQ ID NO: 3149348 - RNA, 22 nt, Mycobacterium bovis subsp bovis AF2122/97
cggugcgcagggccuggaagac

SEQ ID NO: 3149349 - RNA, 20 nt, Mycobacterium bovis subsp bovis AF2122/97
cggugcgcauggacaacagc

SEQ ID NO: 3149350 - RNA, 19 nt, Mycobacterium bovis subsp bovis AF2122/97
cggugcgccagaucaccgu

SEQ ID NO: 3149351 - RNA, 15 nt, Mycobacterium bovis subsp bovis AF2122/97
cggugcgccgauccc

SEQ ID NO: 3149352 - RNA, 18 nt, Mycobacterium bovis subsp bovis AF2122/97
cggugcgccgaucccgcc

SEQ ID NO: 3149353 - RNA, 18 nt, Mycobacterium bovis subsp bovis AF2122/97
cggugcgcgaucacuucc

SEQ ID NO: 3149354 - RNA, 13 nt, Mycobacterium bovis subsp bovis AF2122/97
cggugcgcgcaga

SEQ ID NO: 3149355 - RNA, 14 nt, Mycobacterium bovis subsp bovis AF2122/97
cggugcgcgguugu

SEQ ID NO: 3149356 - RNA, 22 nt, Mycobacterium bovis subsp bovis AF2122/97
cggugcgcgguugugacgguga

SEQ ID NO: 3149357 - RNA, 20 nt, Mycobacterium bovis subsp bovis AF2122/97
cggugcgcgugacgaccagc

SEQ ID NO: 3149358 - RNA, 19 nt, Mycobacterium bovis subsp bovis AF2122/97
cggugcgcuggaucuucga

SEQ ID NO: 3149359 - RNA, 20 nt, Mycobacterium bovis subsp bovis AF2122/97
cggugcgcuggcggcgcagc

SEQ ID NO: 3149360 - RNA, 13 nt, Mycobacterium bovis subsp bovis AF2122/97
cggugcgcugguu

SEQ ID NO: 3149361 - RNA, 16 nt, Mycobacterium bovis subsp bovis AF2122/97
cggugcggaacaccgc

SEQ ID NO: 3149362 - RNA, 18 nt, Mycobacterium bovis subsp bovis AF2122/97
cggugcggaacaccgccc

SEQ ID NO: 3149363 - RNA, 20 nt, Mycobacterium bovis subsp bovis AF2122/97
cggugcggaacaccgcccgg

SEQ ID NO: 3149364 - RNA, 21 nt, Mycobacterium bovis subsp bovis AF2122/97
cggugcggaacaccgcccggc

SEQ ID NO: 3149365 - RNA, 15 nt, Mycobacterium bovis subsp bovis AF2122/97
cggugcggcaacagc

SEQ ID NO: 3149366 - RNA, 19 nt, Mycobacterium bovis subsp bovis AF2122/97
cggugcggcaacagcgcca

SEQ ID NO: 3149367 - RNA, 14 nt, Mycobacterium bovis subsp bovis AF2122/97
cggugcggcuguug

SEQ ID NO: 3149368 - RNA, 15 nt, Mycobacterium bovis subsp bovis AF2122/97
cggugcgggcgccag

SEQ ID NO: 3149369 - RNA, 15 nt, Mycobacterium bovis subsp bovis AF2122/97
cggugcgggcuaggc

SEQ ID NO: 3149370 - RNA, 21 nt, Mycobacterium bovis subsp bovis AF2122/97
cggugcgggcuaggcggcguu

SEQ ID NO: 3149371 - RNA, 22 nt, Mycobacterium bovis subsp bovis AF2122/97
cggugcgggcuaggcggcguuu

SEQ ID NO: 3149372 - RNA, 21 nt, Mycobacterium bovis subsp bovis AF2122/97
cggugcggguggugccggcgg

SEQ ID NO: 3149373 - RNA, 23 nt, Mycobacterium bovis subsp bovis AF2122/97
cggugcggucagauucggcgaug

SEQ ID NO: 3149374 - RNA, 14 nt, Mycobacterium bovis subsp bovis AF2122/97
cggugcggugcaca

SEQ ID NO: 3149375 - RNA, 21 nt, Mycobacterium bovis subsp bovis AF2122/97
cggugcgguucgcugcggcgg

SEQ ID NO: 3149376 - RNA, 23 nt, Mycobacterium bovis subsp bovis AF2122/97
cggugcgguuucaccgacgacgc

SEQ ID NO: 3149377 - RNA, 14 nt, Mycobacterium bovis subsp bovis AF2122/97
cggugcguccggug

SEQ ID NO: 3149378 - RNA, 20 nt, Mycobacterium bovis subsp bovis AF2122/97
cggugcguccggugcugguc

SEQ ID NO: 3149379 - RNA, 13 nt, Mycobacterium bovis subsp bovis AF2122/97
cggugcgucgugg

SEQ ID NO: 3149380 - RNA, 23 nt, Mycobacterium bovis subsp bovis AF2122/97
cggugcuaugcaacaccgcaccg

SEQ ID NO: 3149381 - RNA, 18 nt, Mycobacterium bovis subsp bovis AF2122/97
cggugcucuucggcacca

SEQ ID NO: 3149382 - RNA, 18 nt, Mycobacterium bovis subsp bovis AF2122/97
cgguggcuucgacggcgg

SEQ ID NO: 3149383 - RNA, 17 nt, Mycobacterium bovis subsp bovis AF2122/97
cggugggcacagccagu

SEQ ID NO: 3149384 - RNA, 15 nt, Mycobacterium bovis subsp bovis AF2122/97
cggugggcagcagcu

SEQ ID NO: 3149385 - RNA, 21 nt, Mycobacterium bovis subsp bovis AF2122/97
cggugggcgccgacaccggcu

SEQ ID NO: 3149386 - RNA, 14 nt, Mycobacterium bovis subsp bovis AF2122/97
cggugggcggcucg

SEQ ID NO: 3149387 - RNA, 18 nt, Mycobacterium bovis subsp bovis AF2122/97
cggugggcuugccgcgca

SEQ ID NO: 3149388 - RNA, 14 nt, Mycobacterium bovis subsp bovis AF2122/97
cggugggcuuggcg

SEQ ID NO: 3149389 - RNA, 18 nt, Mycobacterium bovis subsp bovis AF2122/97
cgguggggccggcgucga

SEQ ID NO: 3149390 - RNA, 15 nt, Mycobacterium bovis subsp bovis AF2122/97
cgguggggcgcgccg

SEQ ID NO: 3149391 - RNA, 15 nt, Mycobacterium bovis subsp bovis AF2122/97
cgguggggucgacgc

SEQ ID NO: 3149392 - RNA, 18 nt, Mycobacterium bovis subsp bovis AF2122/97
cgguggggucgccgucga

SEQ ID NO: 3149393 - RNA, 21 nt, Mycobacterium bovis subsp bovis AF2122/97
cgguggggucgcugccgccgu

SEQ ID NO: 3149394 - RNA, 15 nt, Mycobacterium bovis subsp bovis AF2122/97
cgguggguagccagc

SEQ ID NO: 3149395 - RNA, 13 nt, Mycobacterium bovis subsp bovis AF2122/97
cggugggucgucg

SEQ ID NO: 3149396 - RNA, 13 nt, Mycobacterium bovis subsp bovis AF2122/97
cggugggucucgg

SEQ ID NO: 3149397 - RNA, 21 nt, Mycobacterium bovis subsp bovis AF2122/97
cggugggucugcucagcgcgg

SEQ ID NO: 3149398 - RNA, 17 nt, Mycobacterium bovis subsp bovis AF2122/97
cggugggugccagccgg

SEQ ID NO: 3149399 - RNA, 12 nt, Mycobacterium bovis subsp bovis AF2122/97
cggugggugggc

SEQ ID NO: 3149400 - RNA, 16 nt, Mycobacterium bovis subsp bovis AF2122/97
cggugguaagacgccg

SEQ ID NO: 3149401 - RNA, 17 nt, Mycobacterium bovis subsp bovis AF2122/97
cggugguaagacgccga

SEQ ID NO: 3149402 - RNA, 19 nt, Mycobacterium bovis subsp bovis AF2122/97
cggugguaagacgccgaac

SEQ ID NO: 3149403 - RNA, 16 nt, Mycobacterium bovis subsp bovis AF2122/97
cggugguaccggcgcc

SEQ ID NO: 3149404 - RNA, 15 nt, Mycobacterium bovis subsp bovis AF2122/97
cggugguaccggcgg

SEQ ID NO: 3149405 - RNA, 19 nt, Mycobacterium bovis subsp bovis AF2122/97
cggugguaccggcggcgcc

SEQ ID NO: 3149406 - RNA, 21 nt, Mycobacterium bovis subsp bovis AF2122/97
cggugguaccggcggcgccgg

SEQ ID NO: 3149407 - RNA, 14 nt, Mycobacterium bovis subsp bovis AF2122/97
cggugguagcgacg

SEQ ID NO: 3149408 - RNA, 17 nt, Mycobacterium bovis subsp bovis AF2122/97
cggugguagcgacgaug

SEQ ID NO: 3149409 - RNA, 22 nt, Mycobacterium bovis subsp bovis AF2122/97
cggugguagcggacagcucgcg

SEQ ID NO: 3149410 - RNA, 15 nt, Mycobacterium bovis subsp bovis AF2122/97
cggugguagcggcgg

SEQ ID NO: 3149411 - RNA, 17 nt, Mycobacterium bovis subsp bovis AF2122/97
cggugguaggacgccag

SEQ ID NO: 3149412 - RNA, 19 nt, Mycobacterium bovis subsp bovis AF2122/97
cggugguaggacgccagca

SEQ ID NO: 3149413 - RNA, 15 nt, Mycobacterium bovis subsp bovis AF2122/97
cggugguccagcgcu

SEQ ID NO: 3149414 - RNA, 19 nt, Mycobacterium bovis subsp bovis AF2122/97
cgguggucccccgcagcca

SEQ ID NO: 3149415 - RNA, 15 nt, Mycobacterium bovis subsp bovis AF2122/97
cgguggucccgaugg

SEQ ID NO: 3149416 - RNA, 15 nt, Mycobacterium bovis subsp bovis AF2122/97
cgguggucgcgaccg

SEQ ID NO: 3149417 - RNA, 15 nt, Mycobacterium bovis subsp bovis AF2122/97
cgguggucggcgcgc

SEQ ID NO: 3149418 - RNA, 16 nt, Mycobacterium bovis subsp bovis AF2122/97
cgguggucggcgcgcc

SEQ ID NO: 3149419 - RNA, 17 nt, Mycobacterium bovis subsp bovis AF2122/97
cgguggucggcgcgccg

SEQ ID NO: 3149420 - RNA, 10 nt, Mycobacterium bovis subsp bovis AF2122/97
cgguggucgu

SEQ ID NO: 3149421 - RNA, 13 nt, Mycobacterium bovis subsp bovis AF2122/97
cgguggucguagg

SEQ ID NO: 3149422 - RNA, 21 nt, Mycobacterium bovis subsp bovis AF2122/97
cgguggucucgacggcgccgc

SEQ ID NO: 3149423 - RNA, 22 nt, Mycobacterium bovis subsp bovis AF2122/97
cgguggucucgacggcgccgcc

SEQ ID NO: 3149424 - RNA, 14 nt, Mycobacterium bovis subsp bovis AF2122/97
cgguggucugcgcg

SEQ ID NO: 3149425 - RNA, 18 nt, Mycobacterium bovis subsp bovis AF2122/97
cgguggucugcgcggugc

SEQ ID NO: 3149426 - RNA, 20 nt, Mycobacterium bovis subsp bovis AF2122/97
cgguggucuuggcccggcgg

SEQ ID NO: 3149427 - RNA, 21 nt, Mycobacterium bovis subsp bovis AF2122/97
cgguggucuuggcccggcggu

SEQ ID NO: 3149428 - RNA, 15 nt, Mycobacterium bovis subsp bovis AF2122/97
cgguggugaccgcgg

SEQ ID NO: 3149429 - RNA, 11 nt, Mycobacterium bovis subsp bovis AF2122/97
cgguggugacg

SEQ ID NO: 3149430 - RNA, 18 nt, Mycobacterium bovis subsp bovis AF2122/97
cgguggugacgucgaggu

SEQ ID NO: 3149431 - RNA, 15 nt, Mycobacterium bovis subsp bovis AF2122/97
cgguggugaucacgu

SEQ ID NO: 3149432 - RNA, 22 nt, Mycobacterium bovis subsp bovis AF2122/97
cgguggugaucacgucggaucc

SEQ ID NO: 3149433 - RNA, 14 nt, Mycobacterium bovis subsp bovis AF2122/97
cgguggugccgcgg

SEQ ID NO: 3149434 - RNA, 15 nt, Mycobacterium bovis subsp bovis AF2122/97
cgguggugccgcggc

SEQ ID NO: 3149435 - RNA, 17 nt, Mycobacterium bovis subsp bovis AF2122/97
cgguggugccgcggcca

SEQ ID NO: 3149436 - RNA, 20 nt, Mycobacterium bovis subsp bovis AF2122/97
cgguggugccgcggccaccg

SEQ ID NO: 3149437 - RNA, 21 nt, Mycobacterium bovis subsp bovis AF2122/97
cgguggugccgcggccaccgc

SEQ ID NO: 3149438 - RNA, 14 nt, Mycobacterium bovis subsp bovis AF2122/97
cgguggugcggccc

SEQ ID NO: 3149439 - RNA, 13 nt, Mycobacterium bovis subsp bovis AF2122/97
cgguggugcgguc

SEQ ID NO: 3149440 - RNA, 16 nt, Mycobacterium bovis subsp bovis AF2122/97
cgguggugcucgucgg

SEQ ID NO: 3149441 - RNA, 17 nt, Mycobacterium bovis subsp bovis AF2122/97
cgguggugcugucgugg

SEQ ID NO: 3149442 - RNA, 15 nt, Mycobacterium bovis subsp bovis AF2122/97
cggugguggcgaccc

SEQ ID NO: 3149443 - RNA, 18 nt, Mycobacterium bovis subsp bovis AF2122/97
cggugguggcgucgaugg

SEQ ID NO: 3149444 - RNA, 14 nt, Mycobacterium bovis subsp bovis AF2122/97
cgguggugggccgu

SEQ ID NO: 3149445 - RNA, 15 nt, Mycobacterium bovis subsp bovis AF2122/97
cgguggugggcuagg

SEQ ID NO: 3149446 - RNA, 24 nt, Mycobacterium bovis subsp bovis AF2122/97
cgguggugguguaggaguacaaca

SEQ ID NO: 3149447 - RNA, 20 nt, Mycobacterium bovis subsp bovis AF2122/97
cgguggugucagccaccggu

SEQ ID NO: 3149448 - RNA, 14 nt, Mycobacterium bovis subsp bovis AF2122/97
cgguggugucgguu

SEQ ID NO: 3149449 - RNA, 16 nt, Mycobacterium bovis subsp bovis AF2122/97
cggugguuccggcugg

SEQ ID NO: 3149450 - RNA, 15 nt, Mycobacterium bovis subsp bovis AF2122/97
cgguguaacccucga

SEQ ID NO: 3149451 - RNA, 16 nt, Mycobacterium bovis subsp bovis AF2122/97
cgguguaacccuggcg

SEQ ID NO: 3149452 - RNA, 23 nt, Mycobacterium bovis subsp bovis AF2122/97
cgguguaacugcguuggcgacca

SEQ ID NO: 3149453 - RNA, 18 nt, Mycobacterium bovis subsp bovis AF2122/97
cgguguacgcccgcucgg

SEQ ID NO: 3149454 - RNA, 17 nt, Mycobacterium bovis subsp bovis AF2122/97
cgguguagaagcgggcg

SEQ ID NO: 3149455 - RNA, 18 nt, Mycobacterium bovis subsp bovis AF2122/97
cgguguagagcgcaccgc

SEQ ID NO: 3149456 - RNA, 21 nt, Mycobacterium bovis subsp bovis AF2122/97
cgguguagcaacgguagcggc

SEQ ID NO: 3149457 - RNA, 13 nt, Mycobacterium bovis subsp bovis AF2122/97
cgguguagcagcg

SEQ ID NO: 3149458 - RNA, 17 nt, Mycobacterium bovis subsp bovis AF2122/97
cgguguagcagcgccag

SEQ ID NO: 3149459 - RNA, 19 nt, Mycobacterium bovis subsp bovis AF2122/97
cgguguagcagcgccagca

SEQ ID NO: 3149460 - RNA, 14 nt, Mycobacterium bovis subsp bovis AF2122/97
cgguguagcccagc

SEQ ID NO: 3149461 - RNA, 19 nt, Mycobacterium bovis subsp bovis AF2122/97
cgguguagcccagccgggu

SEQ ID NO: 3149462 - RNA, 12 nt, Mycobacterium bovis subsp bovis AF2122/97
cgguguagccgc

SEQ ID NO: 3149463 - RNA, 14 nt, Mycobacterium bovis subsp bovis AF2122/97
cgguguagccgccg

SEQ ID NO: 3149464 - RNA, 15 nt, Mycobacterium bovis subsp bovis AF2122/97
cgguguagccgccgg

SEQ ID NO: 3149465 - RNA, 20 nt, Mycobacterium bovis subsp bovis AF2122/97
cgguguagccgccggcagug

SEQ ID NO: 3149466 - RNA, 16 nt, Mycobacterium bovis subsp bovis AF2122/97
cgguguagccggcgcc

SEQ ID NO: 3149467 - RNA, 18 nt, Mycobacterium bovis subsp bovis AF2122/97
cgguguagccggcgccgc

SEQ ID NO: 3149468 - RNA, 21 nt, Mycobacterium bovis subsp bovis AF2122/97
cgguguagcguucccacacgc

SEQ ID NO: 3149469 - RNA, 21 nt, Mycobacterium bovis subsp bovis AF2122/97
cgguuagaucacccgcagccg

SEQ ID NO: 3149470 - RNA, 16 nt, Mycobacterium bovis subsp bovis AF2122/97
cgguuagcgcggccag

SEQ ID NO: 3149471 - RNA, 20 nt, Mycobacterium bovis subsp bovis AF2122/97
cgguuauggcauucgauacc

SEQ ID NO: 3149472 - RNA, 19 nt, Mycobacterium bovis subsp bovis AF2122/97
cgguucaccacgucgucgg

SEQ ID NO: 3149473 - RNA, 19 nt, Mycobacterium bovis subsp bovis AF2122/97
cgguucagggguggcgcgg

SEQ ID NO: 3149474 - RNA, 23 nt, Mycobacterium bovis subsp bovis AF2122/97
cgguucagggguggcgcgggccg

SEQ ID NO: 3149475 - RNA, 20 nt, Mycobacterium bovis subsp bovis AF2122/97
cgguucagguugagugucgg

SEQ ID NO: 3149476 - RNA, 21 nt, Mycobacterium bovis subsp bovis AF2122/97
cgguucagguugagugucggg

SEQ ID NO: 3149477 - RNA, 18 nt, Mycobacterium bovis subsp bovis AF2122/97
cgguucauccacuccgcc

SEQ ID NO: 3149478 - RNA, 19 nt, Mycobacterium bovis subsp bovis AF2122/97
cgguucauccacuccgcca

SEQ ID NO: 3149479 - RNA, 16 nt, Mycobacterium bovis subsp bovis AF2122/97
cgguuccacgcugccc

SEQ ID NO: 3149480 - RNA, 16 nt, Mycobacterium bovis subsp bovis AF2122/97
cgguuccauacagccg

SEQ ID NO: 3149481 - RNA, 19 nt, Mycobacterium bovis subsp bovis AF2122/97
cgguuccauacagccgccg

SEQ ID NO: 3149482 - RNA, 18 nt, Mycobacterium bovis subsp bovis AF2122/97
cgguucccgggcagccgc

SEQ ID NO: 3149483 - RNA, 19 nt, Mycobacterium bovis subsp bovis AF2122/97
cgguuccgauagccgacca

SEQ ID NO: 3149484 - RNA, 20 nt, Mycobacterium bovis subsp bovis AF2122/97
cgguuccgccaggccgaccg

SEQ ID NO: 3149485 - RNA, 16 nt, Mycobacterium bovis subsp bovis AF2122/97
cgguuccgccggcccc

SEQ ID NO: 3149486 - RNA, 16 nt, Mycobacterium bovis subsp bovis AF2122/97
cgguuccggccccguc

SEQ ID NO: 3149487 - RNA, 14 nt, Mycobacterium bovis subsp bovis AF2122/97
cgguuccggccggc

SEQ ID NO: 3149488 - RNA, 15 nt, Mycobacterium bovis subsp bovis AF2122/97
cgguuccggccggcu

SEQ ID NO: 3149489 - RNA, 16 nt, Mycobacterium bovis subsp bovis AF2122/97
cgguuccggccggcuc

SEQ ID NO: 3149490 - RNA, 20 nt, Mycobacterium bovis subsp bovis AF2122/97
cgguuccgguguaggccugc

SEQ ID NO: 3149491 - RNA, 19 nt, Mycobacterium bovis subsp bovis AF2122/97
cgguucgacccccgcaucg

SEQ ID NO: 3149492 - RNA, 14 nt, Mycobacterium bovis subsp bovis AF2122/97
cgguucgcccagca

SEQ ID NO: 3149493 - RNA, 22 nt, Mycobacterium bovis subsp bovis AF2122/97
cgguucgcccgaggcgagacgc

SEQ ID NO: 3149494 - RNA, 16 nt, Mycobacterium bovis subsp bovis AF2122/97
cgguucgccgccguug

SEQ ID NO: 3149495 - RNA, 13 nt, Mycobacterium bovis subsp bovis AF2122/97
cgguucggccaga

SEQ ID NO: 3149496 - RNA, 20 nt, Mycobacterium bovis subsp bovis AF2122/97
cgguucggccggagccgccg

SEQ ID NO: 3149497 - RNA, 19 nt, Mycobacterium bovis subsp bovis AF2122/97
cgguucggcgaucuccggc

SEQ ID NO: 3149498 - RNA, 23 nt, Mycobacterium bovis subsp bovis AF2122/97
cgguucggcguacaaaccgucgg

SEQ ID NO: 3149499 - RNA, 12 nt, Mycobacterium bovis subsp bovis AF2122/97
cgguucgggacg

SEQ ID NO: 3149500 - RNA, 14 nt, Mycobacterium bovis subsp bovis AF2122/97
cgguucgggcagca

SEQ ID NO: 3149501 - RNA, 21 nt, Mycobacterium bovis subsp bovis AF2122/97
cgguucgggcagcacccgcgc

SEQ ID NO: 3149502 - RNA, 15 nt, Mycobacterium bovis subsp bovis AF2122/97
cgguucguagcgggc

SEQ ID NO: 3149503 - RNA, 16 nt, Mycobacterium bovis subsp bovis AF2122/97
cgguucguagcgggca

SEQ ID NO: 3149504 - RNA, 15 nt, Mycobacterium bovis subsp bovis AF2122/97
cgguucugcgcccac

SEQ ID NO: 3149505 - RNA, 14 nt, Mycobacterium bovis subsp bovis AF2122/97
cgguucugcggccg

SEQ ID NO: 3149506 - RNA, 15 nt, Mycobacterium bovis subsp bovis AF2122/97
cgguucugcggccgc

SEQ ID NO: 3149507 - RNA, 14 nt, Mycobacterium bovis subsp bovis AF2122/97
cgguugacacccgg

SEQ ID NO: 3149508 - RNA, 13 nt, Mycobacterium bovis subsp bovis AF2122/97
cgguugacccggc

SEQ ID NO: 3149509 - RNA, 19 nt, Mycobacterium bovis subsp bovis AF2122/97
cgguugacccggcagcccg

SEQ ID NO: 3149510 - RNA, 15 nt, Mycobacterium bovis subsp bovis AF2122/97
cgguugaccggucga

SEQ ID NO: 3149511 - RNA, 13 nt, Mycobacterium bovis subsp bovis AF2122/97
cgguugacgccgg

SEQ ID NO: 3149512 - RNA, 17 nt, Mycobacterium bovis subsp bovis AF2122/97
cgguugacgccgguccc

SEQ ID NO: 3149513 - RNA, 15 nt, Mycobacterium bovis subsp bovis AF2122/97
cgguugacgggcucg

SEQ ID NO: 3149514 - RNA, 18 nt, Mycobacterium bovis subsp bovis AF2122/97
cgguugacgggcucggca

SEQ ID NO: 3149515 - RNA, 17 nt, Mycobacterium bovis subsp bovis AF2122/97
cgguugaucgccggccu

SEQ ID NO: 3149516 - RNA, 14 nt, Mycobacterium bovis subsp bovis AF2122/97
cgguugaucggcca

SEQ ID NO: 3149517 - RNA, 17 nt, Mycobacterium bovis subsp bovis AF2122/97
cgguugaucugucagcg

SEQ ID NO: 3149518 - RNA, 18 nt, Mycobacterium bovis subsp bovis AF2122/97
cgguugaucugucagcgc

SEQ ID NO: 3149519 - RNA, 21 nt, Mycobacterium bovis subsp bovis AF2122/97
cgguugaugaucuuggugaag

SEQ ID NO: 3149520 - RNA, 15 nt, Mycobacterium bovis subsp bovis AF2122/97
cgguugaugcaucca

SEQ ID NO: 3149521 - RNA, 21 nt, Mycobacterium bovis subsp bovis AF2122/97
cgguugaugcauccagaagua

SEQ ID NO: 3149522 - RNA, 16 nt, Mycobacterium bovis subsp bovis AF2122/97
cgguugaugcggccgc

SEQ ID NO: 3149523 - RNA, 18 nt, Mycobacterium bovis subsp bovis AF2122/97
cgguugaugcggccgcgg

SEQ ID NO: 3149524 - RNA, 19 nt, Mycobacterium bovis subsp bovis AF2122/97
cgguugaugcggccgcggc

SEQ ID NO: 3149525 - RNA, 14 nt, Mycobacterium bovis subsp bovis AF2122/97
cgguugauucgugc

SEQ ID NO: 3149526 - RNA, 17 nt, Mycobacterium bovis subsp bovis AF2122/97
cgguugauugugcccag

SEQ ID NO: 3149527 - RNA, 15 nt, Mycobacterium bovis subsp bovis AF2122/97
cgguugcacccgcgc

SEQ ID NO: 3149528 - RNA, 22 nt, Mycobacterium bovis subsp bovis AF2122/97
cgguugcacccgcgcggagacc

SEQ ID NO: 3149529 - RNA, 15 nt, Mycobacterium bovis subsp bovis AF2122/97
cgguugccacgccgc

SEQ ID NO: 3149530 - RNA, 19 nt, Mycobacterium bovis subsp bovis AF2122/97
cgguugccacgccgccggu

SEQ ID NO: 3149531 - RNA, 15 nt, Mycobacterium bovis subsp bovis AF2122/97
cgguugcccccaggg

SEQ ID NO: 3149532 - RNA, 15 nt, Mycobacterium bovis subsp bovis AF2122/97
cgguugccccgaccg

SEQ ID NO: 3149533 - RNA, 16 nt, Mycobacterium bovis subsp bovis AF2122/97
cgguugccgcgaucgg

SEQ ID NO: 3149534 - RNA, 13 nt, Mycobacterium bovis subsp bovis AF2122/97
cgguugccggcgg

SEQ ID NO: 3149535 - RNA, 17 nt, Mycobacterium bovis subsp bovis AF2122/97
cgguugccgucugcggu

SEQ ID NO: 3149536 - RNA, 18 nt, Mycobacterium bovis subsp bovis AF2122/97
cgguugccgucugcgguc

SEQ ID NO: 3149537 - RNA, 16 nt, Mycobacterium bovis subsp bovis AF2122/97
cgguugccuucuuggc

SEQ ID NO: 3149538 - RNA, 21 nt, Mycobacterium bovis subsp bovis AF2122/97
cgguugcggucaucggcgcca

SEQ ID NO: 3149539 - RNA, 18 nt, Mycobacterium bovis subsp bovis AF2122/97
cgguugcugugucguggu

SEQ ID NO: 3149540 - RNA, 13 nt, Mycobacterium bovis subsp bovis AF2122/97
cgguuggaucggc

SEQ ID NO: 3149541 - RNA, 18 nt, Mycobacterium bovis subsp bovis AF2122/97
cgguuggcagccacgggu

SEQ ID NO: 3149542 - RNA, 13 nt, Mycobacterium bovis subsp bovis AF2122/97
cgguuggccacca

SEQ ID NO: 3149543 - RNA, 16 nt, Mycobacterium bovis subsp bovis AF2122/97
cgguuggccagccaca

SEQ ID NO: 3149544 - RNA, 21 nt, Mycobacterium bovis subsp bovis AF2122/97
cgguuggccagccacagccga

SEQ ID NO: 3149545 - RNA, 18 nt, Mycobacterium bovis subsp bovis AF2122/97
cgguuggccagugacuca

SEQ ID NO: 3149546 - RNA, 14 nt, Mycobacterium bovis subsp bovis AF2122/97
cgguuggcgcgggc

SEQ ID NO: 3149547 - RNA, 13 nt, Mycobacterium bovis subsp bovis AF2122/97
cgguugggcgaaa

SEQ ID NO: 3149548 - RNA, 16 nt, Mycobacterium bovis subsp bovis AF2122/97
cgguugggguggcggu

SEQ ID NO: 3149549 - RNA, 17 nt, Mycobacterium bovis subsp bovis AF2122/97
cgguugguccgccgucg

SEQ ID NO: 3149550 - RNA, 21 nt, Mycobacterium bovis subsp bovis AF2122/97
cgguugguccgccgucgacca

SEQ ID NO: 3149551 - RNA, 14 nt, Mycobacterium bovis subsp bovis AF2122/97
cgguugguccucgg

SEQ ID NO: 3149552 - RNA, 15 nt, Mycobacterium bovis subsp bovis AF2122/97
cgguuguccggucgc

SEQ ID NO: 3149553 - RNA, 14 nt, Mycobacterium bovis subsp bovis AF2122/97
cgguuguccuccga

SEQ ID NO: 3149554 - RNA, 16 nt, Mycobacterium bovis subsp bovis AF2122/97
cgguuguccuccgacg

SEQ ID NO: 3149555 - RNA, 19 nt, Mycobacterium bovis subsp bovis AF2122/97
cgguuguccuccgacgggg

SEQ ID NO: 3149556 - RNA, 15 nt, Mycobacterium bovis subsp bovis AF2122/97
cguacucgugcaccg

SEQ ID NO: 3149557 - RNA, 13 nt, Mycobacterium bovis subsp bovis AF2122/97
cguacugaucuuc

SEQ ID NO: 3149558 - RNA, 14 nt, Mycobacterium bovis subsp bovis AF2122/97
cguacugaucuucg

SEQ ID NO: 3149559 - RNA, 15 nt, Mycobacterium bovis subsp bovis AF2122/97
cguacugcuugaugg

SEQ ID NO: 3149560 - RNA, 15 nt, Mycobacterium bovis subsp bovis AF2122/97
cguacugguagcacu

SEQ ID NO: 3149561 - RNA, 16 nt, Mycobacterium bovis subsp bovis AF2122/97
cguacugguccgcacg

SEQ ID NO: 3149562 - RNA, 19 nt, Mycobacterium bovis subsp bovis AF2122/97
cguacuucgcuggaaaccu

SEQ ID NO: 3149563 - RNA, 14 nt, Mycobacterium bovis subsp bovis AF2122/97
cguacuugccaccc

SEQ ID NO: 3149564 - RNA, 15 nt, Mycobacterium bovis subsp bovis AF2122/97
cguagaacccaggcc

SEQ ID NO: 3149565 - RNA, 22 nt, Mycobacterium bovis subsp bovis AF2122/97
cguagaaccggggugaggcuuc

SEQ ID NO: 3149566 - RNA, 17 nt, Mycobacterium bovis subsp bovis AF2122/97
cguagaacgcuagcgcc

SEQ ID NO: 3149567 - RNA, 15 nt, Mycobacterium bovis subsp bovis AF2122/97
cguagaagucgaucg

SEQ ID NO: 3149568 - RNA, 15 nt, Mycobacterium bovis subsp bovis AF2122/97
cguagacaaggccaa

SEQ ID NO: 3149569 - RNA, 20 nt, Mycobacterium bovis subsp bovis AF2122/97
cguagacaaggccaagcgcc

SEQ ID NO: 3149570 - RNA, 16 nt, Mycobacterium bovis subsp bovis AF2122/97
cguagaccacgccggu

SEQ ID NO: 3149571 - RNA, 14 nt, Mycobacterium bovis subsp bovis AF2122/97
cguagaccagcagg

SEQ ID NO: 3149572 - RNA, 13 nt, Mycobacterium bovis subsp bovis AF2122/97
cguagaccaggcc

SEQ ID NO: 3149573 - RNA, 16 nt, Mycobacterium bovis subsp bovis AF2122/97
cguagaccaggcccag

SEQ ID NO: 3149574 - RNA, 20 nt, Mycobacterium bovis subsp bovis AF2122/97
cguagaccaggcccagguca

SEQ ID NO: 3149575 - RNA, 21 nt, Mycobacterium bovis subsp bovis AF2122/97
cguagaccaggcccaggucaa

SEQ ID NO: 3149576 - RNA, 14 nt, Mycobacterium bovis subsp bovis AF2122/97
cguagacccacagu

SEQ ID NO: 3149577 - RNA, 21 nt, Mycobacterium bovis subsp bovis AF2122/97
cguagaccgucgauccgucgg

SEQ ID NO: 3149578 - RNA, 19 nt, Mycobacterium bovis subsp bovis AF2122/97
cguagacggggugagccga

SEQ ID NO: 3149579 - RNA, 22 nt, Mycobacterium bovis subsp bovis AF2122/97
cguagacggugucacccucgcg

SEQ ID NO: 3149580 - RNA, 20 nt, Mycobacterium bovis subsp bovis AF2122/97
cguagacgguuaccgcgaag

SEQ ID NO: 3149581 - RNA, 13 nt, Mycobacterium bovis subsp bovis AF2122/97
cguagagcagcag

SEQ ID NO: 3149582 - RNA, 15 nt, Mycobacterium bovis subsp bovis AF2122/97
cguagagcagcagcg

SEQ ID NO: 3149583 - RNA, 22 nt, Mycobacterium bovis subsp bovis AF2122/97
cguagagcaugccgcccgcgcc

SEQ ID NO: 3149584 - RNA, 17 nt, Mycobacterium bovis subsp bovis AF2122/97
cguagaguguccccggc

SEQ ID NO: 3149585 - RNA, 19 nt, Mycobacterium bovis subsp bovis AF2122/97
cguagaucaucuggcuggu

SEQ ID NO: 3149586 - RNA, 21 nt, Mycobacterium bovis subsp bovis AF2122/97
cguagaugguggucaccacca

SEQ ID NO: 3149587 - RNA, 17 nt, Mycobacterium bovis subsp bovis AF2122/97
cguagcaacccaggauu

SEQ ID NO: 3149588 - RNA, 14 nt, Mycobacterium bovis subsp bovis AF2122/97
cguagcaccacauc

SEQ ID NO: 3149589 - RNA, 15 nt, Mycobacterium bovis subsp bovis AF2122/97
cguagcaccacaucg

SEQ ID NO: 3149590 - RNA, 17 nt, Mycobacterium bovis subsp bovis AF2122/97
cguagcaccacaucggu

SEQ ID NO: 3149591 - RNA, 16 nt, Mycobacterium bovis subsp bovis AF2122/97
cguagcaccggucccu

SEQ ID NO: 3149592 - RNA, 16 nt, Mycobacterium bovis subsp bovis AF2122/97
cguagcagcgccggca

SEQ ID NO: 3149593 - RNA, 15 nt, Mycobacterium bovis subsp bovis AF2122/97
cguagcaucgggcga

SEQ ID NO: 3149594 - RNA, 12 nt, Mycobacterium bovis subsp bovis AF2122/97
cguagccagcag

SEQ ID NO: 3149595 - RNA, 18 nt, Mycobacterium bovis subsp bovis AF2122/97
cguagcccacccgggugg

SEQ ID NO: 3149596 - RNA, 19 nt, Mycobacterium bovis subsp bovis AF2122/97
cguagcccacccggguggg

SEQ ID NO: 3149597 - RNA, 14 nt, Mycobacterium bovis subsp bovis AF2122/97
cguagcccacgacg

SEQ ID NO: 3149598 - RNA, 16 nt, Mycobacterium bovis subsp bovis AF2122/97
cguagcccacgacgaa

SEQ ID NO: 3149599 - RNA, 19 nt, Mycobacterium bovis subsp bovis AF2122/97
cguagcccacgacgaaguc

SEQ ID NO: 3149600 - RNA, 12 nt, Mycobacterium bovis subsp bovis AF2122/97
cguagcccaggu

SEQ ID NO: 3149601 - RNA, 22 nt, Mycobacterium bovis subsp bovis AF2122/97
cguagcccaggucgaugcgggc

SEQ ID NO: 3149602 - RNA, 15 nt, Mycobacterium bovis subsp bovis AF2122/97
cguagcccugcucag

SEQ ID NO: 3149603 - RNA, 16 nt, Mycobacterium bovis subsp bovis AF2122/97
cguagcccugcucagc

SEQ ID NO: 3149604 - RNA, 19 nt, Mycobacterium bovis subsp bovis AF2122/97
cguagccgaucaacagggc

SEQ ID NO: 3149605 - RNA, 12 nt, Mycobacterium bovis subsp bovis AF2122/97
cguagccgccgu

SEQ ID NO: 3149606 - RNA, 18 nt, Mycobacterium bovis subsp bovis AF2122/97
cguagccgccgucgccgg

SEQ ID NO: 3149607 - RNA, 13 nt, Mycobacterium bovis subsp bovis AF2122/97
cguagccgccgug

SEQ ID NO: 3149608 - RNA, 14 nt, Mycobacterium bovis subsp bovis AF2122/97
cguagccggccggc

SEQ ID NO: 3149609 - RNA, 15 nt, Mycobacterium bovis subsp bovis AF2122/97
cguagccggccggcc

SEQ ID NO: 3149610 - RNA, 14 nt, Mycobacterium bovis subsp bovis AF2122/97
cguagccggcggug

SEQ ID NO: 3149611 - RNA, 13 nt, Mycobacterium bovis subsp bovis AF2122/97
cguagcgaccgcg

SEQ ID NO: 3149612 - RNA, 18 nt, Mycobacterium bovis subsp bovis AF2122/97
cguagcgaccgcggucgc

SEQ ID NO: 3149613 - RNA, 19 nt, Mycobacterium bovis subsp bovis AF2122/97
cguagcgaccgcggucgcu

SEQ ID NO: 3149614 - RNA, 16 nt, Mycobacterium bovis subsp bovis AF2122/97
cguagcgaccucgccg

SEQ ID NO: 3149615 - RNA, 13 nt, Mycobacterium bovis subsp bovis AF2122/97
cguagcgcagcgc

SEQ ID NO: 3149616 - RNA, 15 nt, Mycobacterium bovis subsp bovis AF2122/97
cguagcgcagcgccu

SEQ ID NO: 3149617 - RNA, 16 nt, Mycobacterium bovis subsp bovis AF2122/97
cguagcgcccacucca

SEQ ID NO: 3149618 - RNA, 16 nt, Mycobacterium bovis subsp bovis AF2122/97
cguagcggcggcgccc

SEQ ID NO: 3149619 - RNA, 18 nt, Mycobacterium bovis subsp bovis AF2122/97
cguagcggcggcgcccgg

SEQ ID NO: 3149620 - RNA, 15 nt, Mycobacterium bovis subsp bovis AF2122/97
cguagcgggcgcccu

SEQ ID NO: 3149621 - RNA, 17 nt, Mycobacterium bovis subsp bovis AF2122/97
cguagcgggggagcgaa

SEQ ID NO: 3149622 - RNA, 18 nt, Mycobacterium bovis subsp bovis AF2122/97
cguagcggucuccccaga

SEQ ID NO: 3149623 - RNA, 22 nt, Mycobacterium bovis subsp bovis AF2122/97
cguagcggucugugcugcgcug

SEQ ID NO: 3149624 - RNA, 15 nt, Mycobacterium bovis subsp bovis AF2122/97
cguagcucagcggua

SEQ ID NO: 3149625 - RNA, 15 nt, Mycobacterium bovis subsp bovis AF2122/97
cguagcugcgcagcg

SEQ ID NO: 3149626 - RNA, 21 nt, Mycobacterium bovis subsp bovis AF2122/97
cguagcugcgcagcgcaaaca

SEQ ID NO: 3149627 - RNA, 18 nt, Mycobacterium bovis subsp bovis AF2122/97
cguagcuggccagguugc

SEQ ID NO: 3149628 - RNA, 19 nt, Mycobacterium bovis subsp bovis AF2122/97
cguagcuggcgaucugguc

SEQ ID NO: 3149629 - RNA, 14 nt, Mycobacterium bovis subsp bovis AF2122/97
cguagcugggcacc

SEQ ID NO: 3149630 - RNA, 15 nt, Mycobacterium bovis subsp bovis AF2122/97
cguagcuggucccac

SEQ ID NO: 3149631 - RNA, 21 nt, Mycobacterium bovis subsp bovis AF2122/97
cguagcuggugcguagcccac

SEQ ID NO: 3149632 - RNA, 18 nt, Mycobacterium bovis subsp bovis AF2122/97
cguaggacaccaccgugg

SEQ ID NO: 3149633 - RNA, 15 nt, Mycobacterium bovis subsp bovis AF2122/97
cguaggacucggcgg

SEQ ID NO: 3149634 - RNA, 16 nt, Mycobacterium bovis subsp bovis AF2122/97
cguaggacucggcgga

SEQ ID NO: 3149635 - RNA, 13 nt, Mycobacterium bovis subsp bovis AF2122/97
cguaggcaccccg

SEQ ID NO: 3149636 - RNA, 22 nt, Mycobacterium bovis subsp bovis AF2122/97
cguaggcaccccggugcccgcg

SEQ ID NO: 3149637 - RNA, 16 nt, Mycobacterium bovis subsp bovis AF2122/97
cguaggcaggaucgcc

SEQ ID NO: 3149638 - RNA, 22 nt, Mycobacterium bovis subsp bovis AF2122/97
cguaggcaggaucgccugagcg

SEQ ID NO: 3149639 - RNA, 19 nt, Mycobacterium bovis subsp bovis AF2122/97
cguaggccacagcccggcg

SEQ ID NO: 3149640 - RNA, 21 nt, Mycobacterium bovis subsp bovis AF2122/97
cguaggccuugcucagccggc

SEQ ID NO: 3149641 - RNA, 22 nt, Mycobacterium bovis subsp bovis AF2122/97
cguaggccuugcucagccggcc

SEQ ID NO: 3149642 - RNA, 23 nt, Mycobacterium bovis subsp bovis AF2122/97
cguaggcgauggcggcgcguucg

SEQ ID NO: 3149643 - RNA, 15 nt, Mycobacterium bovis subsp bovis AF2122/97
cgucaagauugaacg

SEQ ID NO: 3149644 - RNA, 22 nt, Mycobacterium bovis subsp bovis AF2122/97
cgucaagcacacuggccacaau

SEQ ID NO: 3149645 - RNA, 19 nt, Mycobacterium bovis subsp bovis AF2122/97
cgucaagccgugcugccca

SEQ ID NO: 3149646 - RNA, 17 nt, Mycobacterium bovis subsp bovis AF2122/97
cgucaaguccgagucgg

SEQ ID NO: 3149647 - RNA, 16 nt, Mycobacterium bovis subsp bovis AF2122/97
cgucaauggaaccggu

SEQ ID NO: 3149648 - RNA, 21 nt, Mycobacterium bovis subsp bovis AF2122/97
cgucacaagucgacacgccga

SEQ ID NO: 3149649 - RNA, 17 nt, Mycobacterium bovis subsp bovis AF2122/97
cgucacaaugcccaggc

SEQ ID NO: 3149650 - RNA, 14 nt, Mycobacterium bovis subsp bovis AF2122/97
cgucacagccgggu

SEQ ID NO: 3149651 - RNA, 18 nt, Mycobacterium bovis subsp bovis AF2122/97
cgucacaggccgccuggg

SEQ ID NO: 3149652 - RNA, 19 nt, Mycobacterium bovis subsp bovis AF2122/97
cgucacauccgacagcagc

SEQ ID NO: 3149653 - RNA, 18 nt, Mycobacterium bovis subsp bovis AF2122/97
cgucaccaaacccgaugg

SEQ ID NO: 3149654 - RNA, 15 nt, Mycobacterium bovis subsp bovis AF2122/97
cgucaccaccgccgc

SEQ ID NO: 3149655 - RNA, 17 nt, Mycobacterium bovis subsp bovis AF2122/97
cgucaccaccgccgcca

SEQ ID NO: 3149656 - RNA, 19 nt, Mycobacterium bovis subsp bovis AF2122/97
cgucaccaccgccgccacc

SEQ ID NO: 3149657 - RNA, 16 nt, Mycobacterium bovis subsp bovis AF2122/97
cgucaccacgagggcc

SEQ ID NO: 3149658 - RNA, 15 nt, Mycobacterium bovis subsp bovis AF2122/97
cgucaccacgaucgc

SEQ ID NO: 3149659 - RNA, 16 nt, Mycobacterium bovis subsp bovis AF2122/97
cgucaccacgaucgca

SEQ ID NO: 3149660 - RNA, 23 nt, Mycobacterium bovis subsp bovis AF2122/97
cgucaccaucgggucgucggcgu

SEQ ID NO: 3149661 - RNA, 12 nt, Mycobacterium bovis subsp bovis AF2122/97
cgucaccccacc

SEQ ID NO: 3149662 - RNA, 12 nt, Mycobacterium bovis subsp bovis AF2122/97
cgucacccccga

SEQ ID NO: 3149663 - RNA, 22 nt, Mycobacterium bovis subsp bovis AF2122/97
cgucacccccgauagcgaccgc

SEQ ID NO: 3149664 - RNA, 23 nt, Mycobacterium bovis subsp bovis AF2122/97
cgucaccccgauucgugucggug

SEQ ID NO: 3149665 - RNA, 13 nt, Mycobacterium bovis subsp bovis AF2122/97
cgucaccccgguc

SEQ ID NO: 3149666 - RNA, 20 nt, Mycobacterium bovis subsp bovis AF2122/97
cgucaccccggucccgccga

SEQ ID NO: 3149667 - RNA, 13 nt, Mycobacterium bovis subsp bovis AF2122/97
cgucacccgcaac

SEQ ID NO: 3149668 - RNA, 15 nt, Mycobacterium bovis subsp bovis AF2122/97
cgucacccggggcuc

SEQ ID NO: 3149669 - RNA, 14 nt, Mycobacterium bovis subsp bovis AF2122/97
cgucacccgguguc

SEQ ID NO: 3149670 - RNA, 19 nt, Mycobacterium bovis subsp bovis AF2122/97
cgucaccgacgcacaggcg

SEQ ID NO: 3149671 - RNA, 13 nt, Mycobacterium bovis subsp bovis AF2122/97
cgucaccgacugc

SEQ ID NO: 3149672 - RNA, 17 nt, Mycobacterium bovis subsp bovis AF2122/97
cgucaccgaugcgccgg

SEQ ID NO: 3149673 - RNA, 20 nt, Mycobacterium bovis subsp bovis AF2122/97
cgucaccgaugcgccggacc

SEQ ID NO: 3149674 - RNA, 21 nt, Mycobacterium bovis subsp bovis AF2122/97
cgucaccgaugcgccggacca

SEQ ID NO: 3149675 - RNA, 21 nt, Mycobacterium bovis subsp bovis AF2122/97
cgucaccgcccuugccgccgg

SEQ ID NO: 3149676 - RNA, 22 nt, Mycobacterium bovis subsp bovis AF2122/97
cgucaccgcccuugccgccggc

SEQ ID NO: 3149677 - RNA, 12 nt, Mycobacterium bovis subsp bovis AF2122/97
cgucaccgccga

SEQ ID NO: 3149678 - RNA, 15 nt, Mycobacterium bovis subsp bovis AF2122/97
cgucaccgccgacga

SEQ ID NO: 3149679 - RNA, 17 nt, Mycobacterium bovis subsp bovis AF2122/97
cgucaccgccggcaccg

SEQ ID NO: 3149680 - RNA, 20 nt, Mycobacterium bovis subsp bovis AF2122/97
cgucaccgccggcaccgcca

SEQ ID NO: 3149681 - RNA, 15 nt, Mycobacterium bovis subsp bovis AF2122/97
cgucaccgccggugc

SEQ ID NO: 3149682 - RNA, 12 nt, Mycobacterium bovis subsp bovis AF2122/97
cgucaccgccgu

SEQ ID NO: 3149683 - RNA, 14 nt, Mycobacterium bovis subsp bovis AF2122/97
cgucaccgccguug

SEQ ID NO: 3149684 - RNA, 15 nt, Mycobacterium bovis subsp bovis AF2122/97
cgucaccgccguugc

SEQ ID NO: 3149685 - RNA, 22 nt, Mycobacterium bovis subsp bovis AF2122/97
cgucaccgccguugccgccggc

SEQ ID NO: 3149686 - RNA, 13 nt, Mycobacterium bovis subsp bovis AF2122/97
cgucaccgcgacc

SEQ ID NO: 3149687 - RNA, 14 nt, Mycobacterium bovis subsp bovis AF2122/97
cgucaccgcgacgg

SEQ ID NO: 3149688 - RNA, 13 nt, Mycobacterium bovis subsp bovis AF2122/97
cgucaccgcgggc

SEQ ID NO: 3149689 - RNA, 13 nt, Mycobacterium bovis subsp bovis AF2122/97
cgucaccgcgggu

SEQ ID NO: 3149690 - RNA, 20 nt, Mycobacterium bovis subsp bovis AF2122/97
cgucaccggaauccccccug

SEQ ID NO: 3149691 - RNA, 19 nt, Mycobacterium bovis subsp bovis AF2122/97
cgucaccggaggccgccgc

SEQ ID NO: 3149692 - RNA, 21 nt, Mycobacterium bovis subsp bovis AF2122/97
cgucaccggaggccgccgcgc

SEQ ID NO: 3149693 - RNA, 22 nt, Mycobacterium bovis subsp bovis AF2122/97
cgucaccggaggccgccgcgcc

SEQ ID NO: 3149694 - RNA, 23 nt, Mycobacterium bovis subsp bovis AF2122/97
cgucaccggaggccgccgcgccg

SEQ ID NO: 3149695 - RNA, 24 nt, Mycobacterium bovis subsp bovis AF2122/97
cgucaccggaggccgccgcgccgg

SEQ ID NO: 3149696 - RNA, 17 nt, Mycobacterium bovis subsp bovis AF2122/97
cgucaccggucagcgac

SEQ ID NO: 3149697 - RNA, 18 nt, Mycobacterium bovis subsp bovis AF2122/97
cgucaccggucagcgacg

SEQ ID NO: 3149698 - RNA, 17 nt, Mycobacterium bovis subsp bovis AF2122/97
cgucaccgucaguucgg

SEQ ID NO: 3149699 - RNA, 12 nt, Mycobacterium bovis subsp bovis AF2122/97
cgucaccgucau

SEQ ID NO: 3149700 - RNA, 22 nt, Mycobacterium bovis subsp bovis AF2122/97
cgucaccgugggccugcccggc

SEQ ID NO: 3149701 - RNA, 17 nt, Mycobacterium bovis subsp bovis AF2122/97
cgucaccguguugcacg

SEQ ID NO: 3149702 - RNA, 13 nt, Mycobacterium bovis subsp bovis AF2122/97
cgucaccguuggc

SEQ ID NO: 3149703 - RNA, 17 nt, Mycobacterium bovis subsp bovis AF2122/97
cgucaccguuggccgcg

SEQ ID NO: 3149704 - RNA, 19 nt, Mycobacterium bovis subsp bovis AF2122/97
cgucaccguuggccgcgcu

SEQ ID NO: 3149705 - RNA, 17 nt, Mycobacterium bovis subsp bovis AF2122/97
cgucaccucaccgaacg

SEQ ID NO: 3149706 - RNA, 19 nt, Mycobacterium bovis subsp bovis AF2122/97
cgucacgaucagggcgaug

SEQ ID NO: 3149707 - RNA, 22 nt, Mycobacterium bovis subsp bovis AF2122/97
cgucacgcaaccggcggacacc

SEQ ID NO: 3149708 - RNA, 12 nt, Mycobacterium bovis subsp bovis AF2122/97
cgucacgccacc

SEQ ID NO: 3149709 - RNA, 16 nt, Mycobacterium bovis subsp bovis AF2122/97
cgucacgccaccgcaa

SEQ ID NO: 3149710 - RNA, 19 nt, Mycobacterium bovis subsp bovis AF2122/97
cgucacgccccucacgugg

SEQ ID NO: 3149711 - RNA, 17 nt, Mycobacterium bovis subsp bovis AF2122/97
cgucacgccggaugguc

SEQ ID NO: 3149712 - RNA, 21 nt, Mycobacterium bovis subsp bovis AF2122/97
cgucacgcgcggcggcgucca

SEQ ID NO: 3149713 - RNA, 23 nt, Mycobacterium bovis subsp bovis AF2122/97
cgucacgcggaaaccaucgccag

SEQ ID NO: 3149714 - RNA, 13 nt, Mycobacterium bovis subsp bovis AF2122/97
cgucacgcggguu

SEQ ID NO: 3149715 - RNA, 17 nt, Mycobacterium bovis subsp bovis AF2122/97
cgucacgcguacgucgg

SEQ ID NO: 3149716 - RNA, 20 nt, Mycobacterium bovis subsp bovis AF2122/97
cgucacggacccuuccgccg

SEQ ID NO: 3149717 - RNA, 14 nt, Mycobacterium bovis subsp bovis AF2122/97
cgucacggaccgcc

SEQ ID NO: 3149718 - RNA, 18 nt, Mycobacterium bovis subsp bovis AF2122/97
cgucacggaccuggaacu

SEQ ID NO: 3149719 - RNA, 13 nt, Mycobacterium bovis subsp bovis AF2122/97
cgucacggugcgu

SEQ ID NO: 3149720 - RNA, 13 nt, Mycobacterium bovis subsp bovis AF2122/97
cgucacgucgacg

SEQ ID NO: 3149721 - RNA, 15 nt, Mycobacterium bovis subsp bovis AF2122/97
cgucacgucgacggc

SEQ ID NO: 3149722 - RNA, 17 nt, Mycobacterium bovis subsp bovis AF2122/97
cgucacgucgacggcgg

SEQ ID NO: 3149723 - RNA, 18 nt, Mycobacterium bovis subsp bovis AF2122/97
cgucacguggucggccac

SEQ ID NO: 3149724 - RNA, 19 nt, Mycobacterium bovis subsp bovis AF2122/97
cgucacguggucggccacc

SEQ ID NO: 3149725 - RNA, 21 nt, Mycobacterium bovis subsp bovis AF2122/97
cgucacguggucggccacccc

SEQ ID NO: 3149726 - RNA, 17 nt, Mycobacterium bovis subsp bovis AF2122/97
cgucacgugucccgcau

SEQ ID NO: 3149727 - RNA, 16 nt, Mycobacterium bovis subsp bovis AF2122/97
cgucacguucggcgca

SEQ ID NO: 3149728 - RNA, 14 nt, Mycobacterium bovis subsp bovis AF2122/97
cgucacucccgaca

SEQ ID NO: 3149729 - RNA, 11 nt, Mycobacterium bovis subsp bovis AF2122/97
cgucacugcca

SEQ ID NO: 3149730 - RNA, 17 nt, Mycobacterium bovis subsp bovis AF2122/97
cguccaagccggccacg

SEQ ID NO: 3149731 - RNA, 16 nt, Mycobacterium bovis subsp bovis AF2122/97
cguccaagccggcugc

SEQ ID NO: 3149732 - RNA, 17 nt, Mycobacterium bovis subsp bovis AF2122/97
cguccaagccggcugca

SEQ ID NO: 3149733 - RNA, 20 nt, Mycobacterium bovis subsp bovis AF2122/97
cguccaagccguagaccagg

SEQ ID NO: 3149734 - RNA, 23 nt, Mycobacterium bovis subsp bovis AF2122/97
cguccaagccguagaccaggccc

SEQ ID NO: 3149735 - RNA, 16 nt, Mycobacterium bovis subsp bovis AF2122/97
cguccaauagcugaca

SEQ ID NO: 3149736 - RNA, 22 nt, Mycobacterium bovis subsp bovis AF2122/97
cguccaccacaccugcggcugc

SEQ ID NO: 3149737 - RNA, 23 nt, Mycobacterium bovis subsp bovis AF2122/97
cguccaccacaccugcggcugcu

SEQ ID NO: 3149738 - RNA, 12 nt, Mycobacterium bovis subsp bovis AF2122/97
cguccaccagcc

SEQ ID NO: 3149739 - RNA, 14 nt, Mycobacterium bovis subsp bovis AF2122/97
cguccaccagccgg

SEQ ID NO: 3149740 - RNA, 16 nt, Mycobacterium bovis subsp bovis AF2122/97
cguccacccacgauca

SEQ ID NO: 3149741 - RNA, 21 nt, Mycobacterium bovis subsp bovis AF2122/97
cguccacccacgaucagcagc

SEQ ID NO: 3149742 - RNA, 13 nt, Mycobacterium bovis subsp bovis AF2122/97
cguccaccgacgu

SEQ ID NO: 3149743 - RNA, 20 nt, Mycobacterium bovis subsp bovis AF2122/97
cguccaccgauacccccggc

SEQ ID NO: 3149744 - RNA, 13 nt, Mycobacterium bovis subsp bovis AF2122/97
cguccaccgccga

SEQ ID NO: 3149745 - RNA, 20 nt, Mycobacterium bovis subsp bovis AF2122/97
cguccaccgccgacauggcg

SEQ ID NO: 3149746 - RNA, 14 nt, Mycobacterium bovis subsp bovis AF2122/97
cguccaccgucacg

SEQ ID NO: 3149747 - RNA, 18 nt, Mycobacterium bovis subsp bovis AF2122/97
cguccaccgucacggucg

SEQ ID NO: 3149748 - RNA, 15 nt, Mycobacterium bovis subsp bovis AF2122/97
cguccacgacagcag

SEQ ID NO: 3149749 - RNA, 17 nt, Mycobacterium bovis subsp bovis AF2122/97
cguccacgacagcagag

SEQ ID NO: 3149750 - RNA, 19 nt, Mycobacterium bovis subsp bovis AF2122/97
cguccacgaccccggcggu

SEQ ID NO: 3149751 - RNA, 21 nt, Mycobacterium bovis subsp bovis AF2122/97
cguccacgaccccggcgguac

SEQ ID NO: 3149752 - RNA, 13 nt, Mycobacterium bovis subsp bovis AF2122/97
cguccacgcagag

SEQ ID NO: 3149753 - RNA, 15 nt, Mycobacterium bovis subsp bovis AF2122/97
cguccacgcagaggc

SEQ ID NO: 3149754 - RNA, 15 nt, Mycobacterium bovis subsp bovis AF2122/97
cguccacgccgacgg

SEQ ID NO: 3149755 - RNA, 16 nt, Mycobacterium bovis subsp bovis AF2122/97
cguccacgggaucugc

SEQ ID NO: 3149756 - RNA, 22 nt, Mycobacterium bovis subsp bovis AF2122/97
cguccacgugagugccggcgug

SEQ ID NO: 3149757 - RNA, 23 nt, Mycobacterium bovis subsp bovis AF2122/97
cguccacgugagugccggcgugc

SEQ ID NO: 3149758 - RNA, 19 nt, Mycobacterium bovis subsp bovis AF2122/97
cguccagaccguagcggcc

SEQ ID NO: 3149759 - RNA, 20 nt, Mycobacterium bovis subsp bovis AF2122/97
cguccagaccguagcggccg

SEQ ID NO: 3149760 - RNA, 21 nt, Mycobacterium bovis subsp bovis AF2122/97
cguccagaccguagcggccgg

SEQ ID NO: 3149761 - RNA, 19 nt, Mycobacterium bovis subsp bovis AF2122/97
cguccagacgccacugcca

SEQ ID NO: 3149762 - RNA, 20 nt, Mycobacterium bovis subsp bovis AF2122/97
cguccagauaggccaaccgg

SEQ ID NO: 3149763 - RNA, 20 nt, Mycobacterium bovis subsp bovis AF2122/97
cguccagcaaaugcggcgcg

SEQ ID NO: 3149764 - RNA, 22 nt, Mycobacterium bovis subsp bovis AF2122/97
cguccagcaaaugcggcgcguu

SEQ ID NO: 3149765 - RNA, 14 nt, Mycobacterium bovis subsp bovis AF2122/97
cguccagcaggacg

SEQ ID NO: 3149766 - RNA, 19 nt, Mycobacterium bovis subsp bovis AF2122/97
cguccagcccagauccagc

SEQ ID NO: 3149767 - RNA, 14 nt, Mycobacterium bovis subsp bovis AF2122/97
cguccagcgccgcg

SEQ ID NO: 3149768 - RNA, 15 nt, Mycobacterium bovis subsp bovis AF2122/97
cguccagcgccgcgg

SEQ ID NO: 3149769 - RNA, 16 nt, Mycobacterium bovis subsp bovis AF2122/97
cguccagcgccgcggc

SEQ ID NO: 3149770 - RNA, 18 nt, Mycobacterium bovis subsp bovis AF2122/97
cguccagcgccgcggccc

SEQ ID NO: 3149771 - RNA, 20 nt, Mycobacterium bovis subsp bovis AF2122/97
cguccagcgccgcggcccgc

SEQ ID NO: 3149772 - RNA, 22 nt, Mycobacterium bovis subsp bovis AF2122/97
cguccagcuggcauaggaucgc

SEQ ID NO: 3149773 - RNA, 15 nt, Mycobacterium bovis subsp bovis AF2122/97
cguccagggcgacga

SEQ ID NO: 3149774 - RNA, 15 nt, Mycobacterium bovis subsp bovis AF2122/97
cguccagggcgccga

SEQ ID NO: 3149775 - RNA, 20 nt, Mycobacterium bovis subsp bovis AF2122/97
cguccaggucggccgccucg

SEQ ID NO: 3149776 - RNA, 18 nt, Mycobacterium bovis subsp bovis AF2122/97
cguccaguggcagccagc

SEQ ID NO: 3149777 - RNA, 19 nt, Mycobacterium bovis subsp bovis AF2122/97
cguccaguggcagccagcg

SEQ ID NO: 3149778 - RNA, 21 nt, Mycobacterium bovis subsp bovis AF2122/97
cguccaguggcagccagcggc

SEQ ID NO: 3149779 - RNA, 22 nt, Mycobacterium bovis subsp bovis AF2122/97
cguccaguggcagccagcggcg

SEQ ID NO: 3149780 - RNA, 18 nt, Mycobacterium bovis subsp bovis AF2122/97
cguccaucaccagcagug

SEQ ID NO: 3149781 - RNA, 10 nt, Mycobacterium bovis subsp bovis AF2122/97
cguccaucag

SEQ ID NO: 3149782 - RNA, 20 nt, Mycobacterium bovis subsp bovis AF2122/97
cguccaucagcaacacgucg

SEQ ID NO: 3149783 - RNA, 18 nt, Mycobacterium bovis subsp bovis AF2122/97
cguccaucccggcgccgc

SEQ ID NO: 3149784 - RNA, 19 nt, Mycobacterium bovis subsp bovis AF2122/97
cguccaucccggcgccgcg

SEQ ID NO: 3149785 - RNA, 21 nt, Mycobacterium bovis subsp bovis AF2122/97
cguccaucucggaccacaucu

SEQ ID NO: 3149786 - RNA, 14 nt, Mycobacterium bovis subsp bovis AF2122/97
cguccauggucgcg

SEQ ID NO: 3149787 - RNA, 20 nt, Mycobacterium bovis subsp bovis AF2122/97
cgucccaaugcaacaaggca

SEQ ID NO: 3149788 - RNA, 20 nt, Mycobacterium bovis subsp bovis AF2122/97
cgucccacagguuugcgccg

SEQ ID NO: 3149789 - RNA, 12 nt, Mycobacterium bovis subsp bovis AF2122/97
cgucccagaagu

SEQ ID NO: 3149790 - RNA, 13 nt, Mycobacterium bovis subsp bovis AF2122/97
cgucccagaaguc

SEQ ID NO: 3149791 - RNA, 14 nt, Mycobacterium bovis subsp bovis AF2122/97
cgucccagagaauc

SEQ ID NO: 3149792 - RNA, 17 nt, Mycobacterium bovis subsp bovis AF2122/97
cgucccagccgaucacg

SEQ ID NO: 3149793 - RNA, 15 nt, Mycobacterium bovis subsp bovis AF2122/97
cgucccagcgccgca

SEQ ID NO: 3149794 - RNA, 16 nt, Mycobacterium bovis subsp bovis AF2122/97
cgucccagcgcggugu

SEQ ID NO: 3149795 - RNA, 17 nt, Mycobacterium bovis subsp bovis AF2122/97
cgucccagcgguagccg

SEQ ID NO: 3149796 - RNA, 23 nt, Mycobacterium bovis subsp bovis AF2122/97
cgucccagcgguagccgagcucg

SEQ ID NO: 3149797 - RNA, 14 nt, Mycobacterium bovis subsp bovis AF2122/97
cgucccaggacucc

SEQ ID NO: 3149798 - RNA, 20 nt, Mycobacterium bovis subsp bovis AF2122/97
cgucccaggacuccggccgc

SEQ ID NO: 3149799 - RNA, 17 nt, Mycobacterium bovis subsp bovis AF2122/97
cgucccagggcacaucg

SEQ ID NO: 3149800 - RNA, 20 nt, Mycobacterium bovis subsp bovis AF2122/97
cgucccagucccgcgucgga

SEQ ID NO: 3149801 - RNA, 19 nt, Mycobacterium bovis subsp bovis AF2122/97
cguccccagaccggcggcu

SEQ ID NO: 3149802 - RNA, 18 nt, Mycobacterium bovis subsp bovis AF2122/97
cguccccagcgccaccgu

SEQ ID NO: 3149803 - RNA, 15 nt, Mycobacterium bovis subsp bovis AF2122/97
cgucccccgcacgcg

SEQ ID NO: 3149804 - RNA, 15 nt, Mycobacterium bovis subsp bovis AF2122/97
cguccccgacgucag

SEQ ID NO: 3149805 - RNA, 12 nt, Mycobacterium bovis subsp bovis AF2122/97
cguccccgcagc

SEQ ID NO: 3149806 - RNA, 15 nt, Mycobacterium bovis subsp bovis AF2122/97
cguccccgcagcgcc

SEQ ID NO: 3149807 - RNA, 13 nt, Mycobacterium bovis subsp bovis AF2122/97
cguccccgccgac

SEQ ID NO: 3149808 - RNA, 15 nt, Mycobacterium bovis subsp bovis AF2122/97
cguccccgccgacgc

SEQ ID NO: 3149809 - RNA, 20 nt, Mycobacterium bovis subsp bovis AF2122/97
cguccccgccgacgccgaua

SEQ ID NO: 3149810 - RNA, 20 nt, Mycobacterium bovis subsp bovis AF2122/97
cguccccgucgcuggccggc

SEQ ID NO: 3149811 - RNA, 19 nt, Mycobacterium bovis subsp bovis AF2122/97
cgucccgaaccgaucauca

SEQ ID NO: 3149812 - RNA, 17 nt, Mycobacterium bovis subsp bovis AF2122/97
cgucccgauacggccgg

SEQ ID NO: 3149813 - RNA, 17 nt, Mycobacterium bovis subsp bovis AF2122/97
cgucccgauggcggugg

SEQ ID NO: 3149814 - RNA, 16 nt, Mycobacterium bovis subsp bovis AF2122/97
cgucccgccgcaccgc

SEQ ID NO: 3149815 - RNA, 20 nt, Mycobacterium bovis subsp bovis AF2122/97
cgucccgcgagcagcccggc

SEQ ID NO: 3149816 - RNA, 23 nt, Mycobacterium bovis subsp bovis AF2122/97
cgucgaaccagaggucacgcagc

SEQ ID NO: 3149817 - RNA, 14 nt, Mycobacterium bovis subsp bovis AF2122/97
cgucgaaccagucc

SEQ ID NO: 3149818 - RNA, 22 nt, Mycobacterium bovis subsp bovis AF2122/97
cgucgaacggcagcccgggcgu

SEQ ID NO: 3149819 - RNA, 17 nt, Mycobacterium bovis subsp bovis AF2122/97
cgucgaacgguagcacg

SEQ ID NO: 3149820 - RNA, 18 nt, Mycobacterium bovis subsp bovis AF2122/97
cgucgaacugccggacua

SEQ ID NO: 3149821 - RNA, 18 nt, Mycobacterium bovis subsp bovis AF2122/97
cgucgaacugggcgcccg

SEQ ID NO: 3149822 - RNA, 19 nt, Mycobacterium bovis subsp bovis AF2122/97
cgucgaacuuugucgcgcu

SEQ ID NO: 3149823 - RNA, 22 nt, Mycobacterium bovis subsp bovis AF2122/97
cgucgaacuuugucgcgcugcu

SEQ ID NO: 3149824 - RNA, 17 nt, Mycobacterium bovis subsp bovis AF2122/97
cgucgaagaccgccucc

SEQ ID NO: 3149825 - RNA, 22 nt, Mycobacterium bovis subsp bovis AF2122/97
cgucgaagaccgccuccaccgc

SEQ ID NO: 3149826 - RNA, 22 nt, Mycobacterium bovis subsp bovis AF2122/97
cgucgaagaccucaacccccuu

SEQ ID NO: 3149827 - RNA, 19 nt, Mycobacterium bovis subsp bovis AF2122/97
cgucgaagacgaacguguc

SEQ ID NO: 3149828 - RNA, 13 nt, Mycobacterium bovis subsp bovis AF2122/97
cgucgaagacggc

SEQ ID NO: 3149829 - RNA, 15 nt, Mycobacterium bovis subsp bovis AF2122/97
cgucgaagcggacca

SEQ ID NO: 3149830 - RNA, 18 nt, Mycobacterium bovis subsp bovis AF2122/97
cgucgaagggaucacgac

SEQ ID NO: 3149831 - RNA, 19 nt, Mycobacterium bovis subsp bovis AF2122/97
cgucgaaggugaccaggcg

SEQ ID NO: 3149832 - RNA, 23 nt, Mycobacterium bovis subsp bovis AF2122/97
cgucgaaggugaccaggcggacg

SEQ ID NO: 3149833 - RNA, 23 nt, Mycobacterium bovis subsp bovis AF2122/97
cgucgaaggugaugaacaccggc

SEQ ID NO: 3149834 - RNA, 21 nt, Mycobacterium bovis subsp bovis AF2122/97
cgucgaaguagccgacgucgc

SEQ ID NO: 3149835 - RNA, 15 nt, Mycobacterium bovis subsp bovis AF2122/97
cgucgaauccugccg

SEQ ID NO: 3149836 - RNA, 17 nt, Mycobacterium bovis subsp bovis AF2122/97
cgucgaauccugccgca

SEQ ID NO: 3149837 - RNA, 16 nt, Mycobacterium bovis subsp bovis AF2122/97
cgucgaauucagcugc

SEQ ID NO: 3149838 - RNA, 14 nt, Mycobacterium bovis subsp bovis AF2122/97
cgucgaauuccggc

SEQ ID NO: 3149839 - RNA, 17 nt, Mycobacterium bovis subsp bovis AF2122/97
cgucgacaaacagcgcc

SEQ ID NO: 3149840 - RNA, 18 nt, Mycobacterium bovis subsp bovis AF2122/97
cgucgacaacaaacccgg

SEQ ID NO: 3149841 - RNA, 20 nt, Mycobacterium bovis subsp bovis AF2122/97
cgucgacaacaaacccggcc

SEQ ID NO: 3149842 - RNA, 16 nt, Mycobacterium bovis subsp bovis AF2122/97
cgucgacaacacgccg

SEQ ID NO: 3149843 - RNA, 19 nt, Mycobacterium bovis subsp bovis AF2122/97
cgucgacaacacgccgucg

SEQ ID NO: 3149844 - RNA, 20 nt, Mycobacterium bovis subsp bovis AF2122/97
cgucgacaacacgccgucga

SEQ ID NO: 3149845 - RNA, 18 nt, Mycobacterium bovis subsp bovis AF2122/97
cgucgacaacgaucgcgc

SEQ ID NO: 3149846 - RNA, 21 nt, Mycobacterium bovis subsp bovis AF2122/97
cgucgacaaucaguagcagcg

SEQ ID NO: 3149847 - RNA, 16 nt, Mycobacterium bovis subsp bovis AF2122/97
cgucgacacacccacc

SEQ ID NO: 3149848 - RNA, 14 nt, Mycobacterium bovis subsp bovis AF2122/97
cgucgacacccgca

SEQ ID NO: 3149849 - RNA, 13 nt, Mycobacterium bovis subsp bovis AF2122/97
cgucgacaccgag

SEQ ID NO: 3149850 - RNA, 14 nt, Mycobacterium bovis subsp bovis AF2122/97
cgucgacaccgagg

SEQ ID NO: 3149851 - RNA, 13 nt, Mycobacterium bovis subsp bovis AF2122/97
cgucgacacggug

SEQ ID NO: 3149852 - RNA, 16 nt, Mycobacterium bovis subsp bovis AF2122/97
cgucgacaguucaacg

SEQ ID NO: 3149853 - RNA, 21 nt, Mycobacterium bovis subsp bovis AF2122/97
cgucgacaucaaagucgaggu

SEQ ID NO: 3149854 - RNA, 15 nt, Mycobacterium bovis subsp bovis AF2122/97
cgucgacaucgccau

SEQ ID NO: 3149855 - RNA, 22 nt, Mycobacterium bovis subsp bovis AF2122/97
cgucgaccacaggcaucggagg

SEQ ID NO: 3149856 - RNA, 11 nt, Mycobacterium bovis subsp bovis AF2122/97
cgucgaccagg

SEQ ID NO: 3149857 - RNA, 18 nt, Mycobacterium bovis subsp bovis AF2122/97
cgucgaccaggccacugc

SEQ ID NO: 3149858 - RNA, 17 nt, Mycobacterium bovis subsp bovis AF2122/97
cgucgaccaugcgaccg

SEQ ID NO: 3149859 - RNA, 18 nt, Mycobacterium bovis subsp bovis AF2122/97
cgucgaccaugcgaccgg

SEQ ID NO: 3149860 - RNA, 20 nt, Mycobacterium bovis subsp bovis AF2122/97
cgucgaccaugcgaccggca

SEQ ID NO: 3149861 - RNA, 22 nt, Mycobacterium bovis subsp bovis AF2122/97
cgucgacccccugccacagcga

SEQ ID NO: 3149862 - RNA, 13 nt, Mycobacterium bovis subsp bovis AF2122/97
cgucgacccgaac

SEQ ID NO: 3149863 - RNA, 15 nt, Mycobacterium bovis subsp bovis AF2122/97
cgucgaccgcggccc

SEQ ID NO: 3149864 - RNA, 13 nt, Mycobacterium bovis subsp bovis AF2122/97
cgucgaccggaac

SEQ ID NO: 3149865 - RNA, 13 nt, Mycobacterium bovis subsp bovis AF2122/97
cgucgaccggcgg

SEQ ID NO: 3149866 - RNA, 14 nt, Mycobacterium bovis subsp bovis AF2122/97
cgucgaccggcggg

SEQ ID NO: 3149867 - RNA, 20 nt, Mycobacterium bovis subsp bovis AF2122/97
cgucgaccgugucaccgccg

SEQ ID NO: 3149868 - RNA, 21 nt, Mycobacterium bovis subsp bovis AF2122/97
cgucgaccgugucaccgccgg

SEQ ID NO: 3149869 - RNA, 12 nt, Mycobacterium bovis subsp bovis AF2122/97
cgucgaccucgc

SEQ ID NO: 3149870 - RNA, 13 nt, Mycobacterium bovis subsp bovis AF2122/97
cgucgaccucgcg

SEQ ID NO: 3149871 - RNA, 21 nt, Mycobacterium bovis subsp bovis AF2122/97
cgucgaccucgcgggcgaucg

SEQ ID NO: 3149872 - RNA, 23 nt, Mycobacterium bovis subsp bovis AF2122/97
cgucgaccucgcgggcgaucggc

SEQ ID NO: 3149873 - RNA, 14 nt, Mycobacterium bovis subsp bovis AF2122/97
cgucgaccucggca

SEQ ID NO: 3149874 - RNA, 22 nt, Mycobacterium bovis subsp bovis AF2122/97
cgucgaccuguugucguggcgg

SEQ ID NO: 3149875 - RNA, 13 nt, Mycobacterium bovis subsp bovis AF2122/97
cgucgacgaucag

SEQ ID NO: 3149876 - RNA, 14 nt, Mycobacterium bovis subsp bovis AF2122/97
cgucgacgaucagc

SEQ ID NO: 3149877 - RNA, 20 nt, Mycobacterium bovis subsp bovis AF2122/97
cgucgacgcccauggcgucg

SEQ ID NO: 3149878 - RNA, 14 nt, Mycobacterium bovis subsp bovis AF2122/97
cgucgacgccgauc

SEQ ID NO: 3149879 - RNA, 15 nt, Mycobacterium bovis subsp bovis AF2122/97
cgucgacgccgaucg

SEQ ID NO: 3149880 - RNA, 18 nt, Mycobacterium bovis subsp bovis AF2122/97
cgucgacgccggccagcg

SEQ ID NO: 3149881 - RNA, 16 nt, Mycobacterium bovis subsp bovis AF2122/97
cgucgacgcggccggc

SEQ ID NO: 3149882 - RNA, 17 nt, Mycobacterium bovis subsp bovis AF2122/97
cgucgacgcggccggcc

SEQ ID NO: 3149883 - RNA, 21 nt, Mycobacterium bovis subsp bovis AF2122/97
cgucgacggccuggggcagcc

SEQ ID NO: 3149884 - RNA, 15 nt, Mycobacterium bovis subsp bovis AF2122/97
cgucgacggcgaugg

SEQ ID NO: 3149885 - RNA, 19 nt, Mycobacterium bovis subsp bovis AF2122/97
cgucgacggcgauggcgcg

SEQ ID NO: 3149886 - RNA, 20 nt, Mycobacterium bovis subsp bovis AF2122/97
cgucgacggcgauggcgcgc

SEQ ID NO: 3149887 - RNA, 15 nt, Mycobacterium bovis subsp bovis AF2122/97
cgucgacggcggccg

SEQ ID NO: 3149888 - RNA, 14 nt, Mycobacterium bovis subsp bovis AF2122/97
cgucgacggcugcg

SEQ ID NO: 3149889 - RNA, 17 nt, Mycobacterium bovis subsp bovis AF2122/97
cgucgacggcugcgccg

SEQ ID NO: 3149890 - RNA, 12 nt, Mycobacterium bovis subsp bovis AF2122/97
cgucgacgucga

SEQ ID NO: 3149891 - RNA, 14 nt, Mycobacterium bovis subsp bovis AF2122/97
cgucgacgucgacg

SEQ ID NO: 3149892 - RNA, 18 nt, Mycobacterium bovis subsp bovis AF2122/97
cgucgacgucgacggcga

SEQ ID NO: 3149893 - RNA, 13 nt, Mycobacterium bovis subsp bovis AF2122/97
cgucgacgucgau

SEQ ID NO: 3149894 - RNA, 20 nt, Mycobacterium bovis subsp bovis AF2122/97
cgucgacgucggcaucggcg

SEQ ID NO: 3149895 - RNA, 18 nt, Mycobacterium bovis subsp bovis AF2122/97
cgucgacgucggcgagcu

SEQ ID NO: 3149896 - RNA, 17 nt, Mycobacterium bovis subsp bovis AF2122/97
cgucgacgucguagacc

SEQ ID NO: 3149897 - RNA, 22 nt, Mycobacterium bovis subsp bovis AF2122/97
cgucgacugcgugccgcaccgc

SEQ ID NO: 3149898 - RNA, 22 nt, Mycobacterium bovis subsp bovis AF2122/97
cgucgacuugcaggcgucccag

SEQ ID NO: 3149899 - RNA, 19 nt, Mycobacterium bovis subsp bovis AF2122/97
cgucgacuuguugggcgcg

SEQ ID NO: 3149900 - RNA, 18 nt, Mycobacterium bovis subsp bovis AF2122/97
cgucgagaaauggcccga

SEQ ID NO: 3149901 - RNA, 14 nt, Mycobacterium bovis subsp bovis AF2122/97
cgucgagacuucgg

SEQ ID NO: 3149902 - RNA, 21 nt, Mycobacterium bovis subsp bovis AF2122/97
cgucgagauagccgacgucgc

SEQ ID NO: 3149903 - RNA, 22 nt, Mycobacterium bovis subsp bovis AF2122/97
cgucgauguccccggcggcagc

SEQ ID NO: 3149904 - RNA, 23 nt, Mycobacterium bovis subsp bovis AF2122/97
cgucgauguccccggcggcagca

SEQ ID NO: 3149905 - RNA, 18 nt, Mycobacterium bovis subsp bovis AF2122/97
cgucgaugucgacgucgc

SEQ ID NO: 3149906 - RNA, 23 nt, Mycobacterium bovis subsp bovis AF2122/97
cgucgauguucgccgcgcggaac

SEQ ID NO: 3149907 - RNA, 16 nt, Mycobacterium bovis subsp bovis AF2122/97
cgucgauuagcccacc

SEQ ID NO: 3149908 - RNA, 17 nt, Mycobacterium bovis subsp bovis AF2122/97
cgucgauuagcccaccc

SEQ ID NO: 3149909 - RNA, 18 nt, Mycobacterium bovis subsp bovis AF2122/97
cgucgauugucaacccgu

SEQ ID NO: 3149910 - RNA, 15 nt, Mycobacterium bovis subsp bovis AF2122/97
cgucgauuucgacga

SEQ ID NO: 3149911 - RNA, 18 nt, Mycobacterium bovis subsp bovis AF2122/97
cgucgauuucggcgaccg

SEQ ID NO: 3149912 - RNA, 15 nt, Mycobacterium bovis subsp bovis AF2122/97
cgucgcaaggcccgc

SEQ ID NO: 3149913 - RNA, 19 nt, Mycobacterium bovis subsp bovis AF2122/97
cgucgcaaggcccgcaccg

SEQ ID NO: 3149914 - RNA, 20 nt, Mycobacterium bovis subsp bovis AF2122/97
cgucgcaaggcccgcaccgc

SEQ ID NO: 3149915 - RNA, 20 nt, Mycobacterium bovis subsp bovis AF2122/97
cgucgcaauaugccacagac

SEQ ID NO: 3149916 - RNA, 21 nt, Mycobacterium bovis subsp bovis AF2122/97
cgucgcaauaugccacagacc

SEQ ID NO: 3149917 - RNA, 22 nt, Mycobacterium bovis subsp bovis AF2122/97
cgucgcacgagccaacaagucg

SEQ ID NO: 3149918 - RNA, 14 nt, Mycobacterium bovis subsp bovis AF2122/97
cgucgcacgcgcgc

SEQ ID NO: 3149919 - RNA, 16 nt, Mycobacterium bovis subsp bovis AF2122/97
cgucgcacgcgcgcag

SEQ ID NO: 3149920 - RNA, 18 nt, Mycobacterium bovis subsp bovis AF2122/97
cgucgcacgcgcgcaggc

SEQ ID NO: 3149921 - RNA, 22 nt, Mycobacterium bovis subsp bovis AF2122/97
cgucgcacgcgcgcaggccgcc

SEQ ID NO: 3149922 - RNA, 23 nt, Mycobacterium bovis subsp bovis AF2122/97
cgucgcacgcgcgcaggccgccg

SEQ ID NO: 3149923 - RNA, 15 nt, Mycobacterium bovis subsp bovis AF2122/97
cgucgcagaaaccau

SEQ ID NO: 3149924 - RNA, 22 nt, Mycobacterium bovis subsp bovis AF2122/97
cgucgcagaaaccauucggcga

SEQ ID NO: 3149925 - RNA, 20 nt, Mycobacterium bovis subsp bovis AF2122/97
cgucgcaggauucccagucg

SEQ ID NO: 3149926 - RNA, 21 nt, Mycobacterium bovis subsp bovis AF2122/97
cgucgcaggauucccagucgc

SEQ ID NO: 3149927 - RNA, 20 nt, Mycobacterium bovis subsp bovis AF2122/97
cgucgcaguauucacagucg

SEQ ID NO: 3149928 - RNA, 15 nt, Mycobacterium bovis subsp bovis AF2122/97
cgucgcaucaccagg

SEQ ID NO: 3149929 - RNA, 18 nt, Mycobacterium bovis subsp bovis AF2122/97
cgucgcaucaccagggug

SEQ ID NO: 3149930 - RNA, 17 nt, Mycobacterium bovis subsp bovis AF2122/97
cgucgccaagcccaggc

SEQ ID NO: 3149931 - RNA, 14 nt, Mycobacterium bovis subsp bovis AF2122/97
cgucgccaaucugc

SEQ ID NO: 3149932 - RNA, 22 nt, Mycobacterium bovis subsp bovis AF2122/97
cgucgccaaucugcgcgagggg

SEQ ID NO: 3149933 - RNA, 15 nt, Mycobacterium bovis subsp bovis AF2122/97
cgucgccaccaucgu

SEQ ID NO: 3149934 - RNA, 13 nt, Mycobacterium bovis subsp bovis AF2122/97
cgucgccaccgau

SEQ ID NO: 3149935 - RNA, 16 nt, Mycobacterium bovis subsp bovis AF2122/97
cgucgccaccgguacc

SEQ ID NO: 3149936 - RNA, 19 nt, Mycobacterium bovis subsp bovis AF2122/97
cgucgccacgaugccggcu

SEQ ID NO: 3149937 - RNA, 18 nt, Mycobacterium bovis subsp bovis AF2122/97
cgucgccacgcccagcgc

SEQ ID NO: 3149938 - RNA, 12 nt, Mycobacterium bovis subsp bovis AF2122/97
cgucgccagggc

SEQ ID NO: 3149939 - RNA, 16 nt, Mycobacterium bovis subsp bovis AF2122/97
cgucgccagggccgcc

SEQ ID NO: 3149940 - RNA, 18 nt, Mycobacterium bovis subsp bovis AF2122/97
cgucgccagggccgccga

SEQ ID NO: 3149941 - RNA, 14 nt, Mycobacterium bovis subsp bovis AF2122/97
cgucgccagggccu

SEQ ID NO: 3149942 - RNA, 17 nt, Mycobacterium bovis subsp bovis AF2122/97
cgucgccagggccuugg

SEQ ID NO: 3149943 - RNA, 13 nt, Mycobacterium bovis subsp bovis AF2122/97
cgucgccaugcug

SEQ ID NO: 3149944 - RNA, 24 nt, Mycobacterium bovis subsp bovis AF2122/97
cgucgccauuccaucgcgcaccgc

SEQ ID NO: 3149945 - RNA, 14 nt, Mycobacterium bovis subsp bovis AF2122/97
cgucgcccagcgug

SEQ ID NO: 3149946 - RNA, 14 nt, Mycobacterium bovis subsp bovis AF2122/97
cgucgcccaggcgu

SEQ ID NO: 3149947 - RNA, 23 nt, Mycobacterium bovis subsp bovis AF2122/97
cgucgcccauuuugaacgcugcc

SEQ ID NO: 3149948 - RNA, 22 nt, Mycobacterium bovis subsp bovis AF2122/97
cgucgcccccggccauggcgcg

SEQ ID NO: 3149949 - RNA, 20 nt, Mycobacterium bovis subsp bovis AF2122/97
cgucgcccgcauugaucucg

SEQ ID NO: 3149950 - RNA, 14 nt, Mycobacterium bovis subsp bovis AF2122/97
cgucgcccgggugg

SEQ ID NO: 3149951 - RNA, 21 nt, Mycobacterium bovis subsp bovis AF2122/97
cgucgcccggguggcgucgau

SEQ ID NO: 3149952 - RNA, 23 nt, Mycobacterium bovis subsp bovis AF2122/97
cgucgcccggguggcgucgaucu

SEQ ID NO: 3149953 - RNA, 23 nt, Mycobacterium bovis subsp bovis AF2122/97
cgucgcccugacacaacaccggc

SEQ ID NO: 3149954 - RNA, 21 nt, Mycobacterium bovis subsp bovis AF2122/97
cgucgcccuuagggucgccgc

SEQ ID NO: 3149955 - RNA, 22 nt, Mycobacterium bovis subsp bovis AF2122/97
cgucgcccuuagggucgccgca

SEQ ID NO: 3149956 - RNA, 19 nt, Mycobacterium bovis subsp bovis AF2122/97
cgucgccgaacagcgacgc

SEQ ID NO: 3149957 - RNA, 22 nt, Mycobacterium bovis subsp bovis AF2122/97
cgucgccgaacagugcgguccc

SEQ ID NO: 3149958 - RNA, 11 nt, Mycobacterium bovis subsp bovis AF2122/97
cgucgccgacg

SEQ ID NO: 3149959 - RNA, 16 nt, Mycobacterium bovis subsp bovis AF2122/97
cgucgccgacgccggu

SEQ ID NO: 3149960 - RNA, 14 nt, Mycobacterium bovis subsp bovis AF2122/97
cgucgccgagcggg

SEQ ID NO: 3149961 - RNA, 21 nt, Mycobacterium bovis subsp bovis AF2122/97
cgucgccgaucagcugcgcau

SEQ ID NO: 3149962 - RNA, 17 nt, Mycobacterium bovis subsp bovis AF2122/97
cgucgccgccauugccg

SEQ ID NO: 3149963 - RNA, 20 nt, Mycobacterium bovis subsp bovis AF2122/97
cgucgccgccauugccgccg

SEQ ID NO: 3149964 - RNA, 13 nt, Mycobacterium bovis subsp bovis AF2122/97
cgucgccgcccgu

SEQ ID NO: 3149965 - RNA, 16 nt, Mycobacterium bovis subsp bovis AF2122/97
cgucgccgcccgugcc

SEQ ID NO: 3149966 - RNA, 19 nt, Mycobacterium bovis subsp bovis AF2122/97
cgucgccgcccgugccgcc

SEQ ID NO: 3149967 - RNA, 15 nt, Mycobacterium bovis subsp bovis AF2122/97
cgucgccgcccuggc

SEQ ID NO: 3149968 - RNA, 17 nt, Mycobacterium bovis subsp bovis AF2122/97
cgucgccgcccuggccg

SEQ ID NO: 3149969 - RNA, 19 nt, Mycobacterium bovis subsp bovis AF2122/97
cgucgccgcccuggccgcc

SEQ ID NO: 3149970 - RNA, 12 nt, Mycobacterium bovis subsp bovis AF2122/97
cgucgccgccgc

SEQ ID NO: 3149971 - RNA, 18 nt, Mycobacterium bovis subsp bovis AF2122/97
cgucgccgccgcgggcgc

SEQ ID NO: 3149972 - RNA, 13 nt, Mycobacterium bovis subsp bovis AF2122/97
cgucgccgccgcu

SEQ ID NO: 3149973 - RNA, 14 nt, Mycobacterium bovis subsp bovis AF2122/97
cgucgccgccgcua

SEQ ID NO: 3149974 - RNA, 16 nt, Mycobacterium bovis subsp bovis AF2122/97
cgucgccgccgcuacc

SEQ ID NO: 3149975 - RNA, 21 nt, Mycobacterium bovis subsp bovis AF2122/97
cgucgccgccgcuaccgccgg

SEQ ID NO: 3149976 - RNA, 15 nt, Mycobacterium bovis subsp bovis AF2122/97
cgucgccgccggcgc

SEQ ID NO: 3149977 - RNA, 16 nt, Mycobacterium bovis subsp bovis AF2122/97
cgucgccgccggcgcc

SEQ ID NO: 3149978 - RNA, 18 nt, Mycobacterium bovis subsp bovis AF2122/97
cgucgccgccggcgccgc

SEQ ID NO: 3149979 - RNA, 20 nt, Mycobacterium bovis subsp bovis AF2122/97
cgucgccgccggcgccgccg

SEQ ID NO: 3149980 - RNA, 14 nt, Mycobacterium bovis subsp bovis AF2122/97
cgucgccgccggcu

SEQ ID NO: 3149981 - RNA, 15 nt, Mycobacterium bovis subsp bovis AF2122/97
cgucgccgccgggca

SEQ ID NO: 3149982 - RNA, 17 nt, Mycobacterium bovis subsp bovis AF2122/97
cgucgccgccgggcagu

SEQ ID NO: 3149983 - RNA, 15 nt, Mycobacterium bovis subsp bovis AF2122/97
cgucgccgccgguga

SEQ ID NO: 3149984 - RNA, 17 nt, Mycobacterium bovis subsp bovis AF2122/97
cgucgccgccgucaccg

SEQ ID NO: 3149985 - RNA, 18 nt, Mycobacterium bovis subsp bovis AF2122/97
cgucgccgccgucaccgc

SEQ ID NO: 3149986 - RNA, 14 nt, Mycobacterium bovis subsp bovis AF2122/97
cgucgccgccguug

SEQ ID NO: 3149987 - RNA, 20 nt, Mycobacterium bovis subsp bovis AF2122/97
cgucgccgccguugccgccg

SEQ ID NO: 3149988 - RNA, 22 nt, Mycobacterium bovis subsp bovis AF2122/97
cgucgccgccguugccgccggc

SEQ ID NO: 3149989 - RNA, 22 nt, Mycobacterium bovis subsp bovis AF2122/97
cgucgcuggccggcaccgugaa

SEQ ID NO: 3149990 - RNA, 19 nt, Mycobacterium bovis subsp bovis AF2122/97
cgucgcugggaggcgcggu

SEQ ID NO: 3149991 - RNA, 22 nt, Mycobacterium bovis subsp bovis AF2122/97
cgucgcuggugggaucgcagcg

SEQ ID NO: 3149992 - RNA, 18 nt, Mycobacterium bovis subsp bovis AF2122/97
cgucgcuguaggccagcc

SEQ ID NO: 3149993 - RNA, 20 nt, Mycobacterium bovis subsp bovis AF2122/97
cgucgcuguaggcgauaucg

SEQ ID NO: 3149994 - RNA, 16 nt, Mycobacterium bovis subsp bovis AF2122/97
cgucgcuucggcaccg

SEQ ID NO: 3149995 - RNA, 21 nt, Mycobacterium bovis subsp bovis AF2122/97
cgucgcuucggcaccgacugc

SEQ ID NO: 3149996 - RNA, 21 nt, Mycobacterium bovis subsp bovis AF2122/97
cgucgcuuggaucgucgcugu

SEQ ID NO: 3149997 - RNA, 19 nt, Mycobacterium bovis subsp bovis AF2122/97
cgucggaacugaccacguc

SEQ ID NO: 3149998 - RNA, 17 nt, Mycobacterium bovis subsp bovis AF2122/97
cgucggaauacaacagc

SEQ ID NO: 3149999 - RNA, 21 nt, Mycobacterium bovis subsp bovis AF2122/97
cgucggaauacaacagcuggg

SEQ ID NO: 3150000 - RNA, 17 nt, Mycobacterium bovis subsp bovis AF2122/97
cgucggacagcuuuccg

SEQ ID NO: 3150001 - RNA, 16 nt, Mycobacterium bovis subsp bovis AF2122/97
cgucggaccagcugcc

SEQ ID NO: 3150002 - RNA, 24 nt, Mycobacterium bovis subsp bovis AF2122/97
cgucggacggcugagacagaccgg

SEQ ID NO: 3150003 - RNA, 18 nt, Mycobacterium bovis subsp bovis AF2122/97
cgucggagaccagcucgu

SEQ ID NO: 3150004 - RNA, 12 nt, Mycobacterium bovis subsp bovis AF2122/97
cgucggagccgg

SEQ ID NO: 3150005 - RNA, 16 nt, Mycobacterium bovis subsp bovis AF2122/97
cgucggagccggccac

SEQ ID NO: 3150006 - RNA, 23 nt, Mycobacterium bovis subsp bovis AF2122/97
cgucggaggugaaccccgccggc

SEQ ID NO: 3150007 - RNA, 20 nt, Mycobacterium bovis subsp bovis AF2122/97
cgucggagucuucgucgucg

SEQ ID NO: 3150008 - RNA, 17 nt, Mycobacterium bovis subsp bovis AF2122/97
cgucggauccgcccgcc

SEQ ID NO: 3150009 - RNA, 22 nt, Mycobacterium bovis subsp bovis AF2122/97
cgucggcaaccaaccgcgcgag

SEQ ID NO: 3150010 - RNA, 24 nt, Mycobacterium bovis subsp bovis AF2122/97
cgucggcaaccaaccgcgcgagcc

SEQ ID NO: 3150011 - RNA, 16 nt, Mycobacterium bovis subsp bovis AF2122/97
cgucggcaccagcagc

SEQ ID NO: 3150012 - RNA, 21 nt, Mycobacterium bovis subsp bovis AF2122/97
cgucggcaccagcagccagcc

SEQ ID NO: 3150013 - RNA, 11 nt, Mycobacterium bovis subsp bovis AF2122/97
cgucggcaccg

SEQ ID NO: 3150014 - RNA, 18 nt, Mycobacterium bovis subsp bovis AF2122/97
cgucggcaccgauccugg

SEQ ID NO: 3150015 - RNA, 23 nt, Mycobacterium bovis subsp bovis AF2122/97
cgucggcaccgguuuucgccggc

SEQ ID NO: 3150016 - RNA, 14 nt, Mycobacterium bovis subsp bovis AF2122/97
cgucggcagcagcg

SEQ ID NO: 3150017 - RNA, 18 nt, Mycobacterium bovis subsp bovis AF2122/97
cgucggcagcagcggugc

SEQ ID NO: 3150018 - RNA, 22 nt, Mycobacterium bovis subsp bovis AF2122/97
cgucggcagcagcggugcagcc

SEQ ID NO: 3150019 - RNA, 15 nt, Mycobacterium bovis subsp bovis AF2122/97
cgucggcaugggccg

SEQ ID NO: 3150020 - RNA, 17 nt, Mycobacterium bovis subsp bovis AF2122/97
cgucggcaugggccggc

SEQ ID NO: 3150021 - RNA, 19 nt, Mycobacterium bovis subsp bovis AF2122/97
cgucggcaugggccggcgc

SEQ ID NO: 3150022 - RNA, 20 nt, Mycobacterium bovis subsp bovis AF2122/97
cgucggcaugggccggcgcc

SEQ ID NO: 3150023 - RNA, 23 nt, Mycobacterium bovis subsp bovis AF2122/97
cgucggccacccgguccaccgac

SEQ ID NO: 3150024 - RNA, 24 nt, Mycobacterium bovis subsp bovis AF2122/97
cgucggccacccgguccaccgacc

SEQ ID NO: 3150025 - RNA, 20 nt, Mycobacterium bovis subsp bovis AF2122/97
cgucggccaccgccugagcg

SEQ ID NO: 3150026 - RNA, 17 nt, Mycobacterium bovis subsp bovis AF2122/97
cgucggccaccgcggcg

SEQ ID NO: 3150027 - RNA, 13 nt, Mycobacterium bovis subsp bovis AF2122/97
cgucggccagcag

SEQ ID NO: 3150028 - RNA, 14 nt, Mycobacterium bovis subsp bovis AF2122/97
cgucggccagcaga

SEQ ID NO: 3150029 - RNA, 17 nt, Mycobacterium bovis subsp bovis AF2122/97
cgucggccagcagauca

SEQ ID NO: 3150030 - RNA, 17 nt, Mycobacterium bovis subsp bovis AF2122/97
cgucggccagcagcaau

SEQ ID NO: 3150031 - RNA, 14 nt, Mycobacterium bovis subsp bovis AF2122/97
cgucggccaggauc

SEQ ID NO: 3150032 - RNA, 20 nt, Mycobacterium bovis subsp bovis AF2122/97
cgucggccaggaucaaccgg

SEQ ID NO: 3150033 - RNA, 12 nt, Mycobacterium bovis subsp bovis AF2122/97
cgucggccagug

SEQ ID NO: 3150034 - RNA, 15 nt, Mycobacterium bovis subsp bovis AF2122/97
cgucggccagugcgc

SEQ ID NO: 3150035 - RNA, 17 nt, Mycobacterium bovis subsp bovis AF2122/97
cgucggccagugcgcgc

SEQ ID NO: 3150036 - RNA, 19 nt, Mycobacterium bovis subsp bovis AF2122/97
cgucggccagugcguggug

SEQ ID NO: 3150037 - RNA, 20 nt, Mycobacterium bovis subsp bovis AF2122/97
cgucggcccauaacagcugg

SEQ ID NO: 3150038 - RNA, 15 nt, Mycobacterium bovis subsp bovis AF2122/97
cgucggcccggugcu

SEQ ID NO: 3150039 - RNA, 12 nt, Mycobacterium bovis subsp bovis AF2122/97
cgucggccgaca

SEQ ID NO: 3150040 - RNA, 13 nt, Mycobacterium bovis subsp bovis AF2122/97
cgucggccgacac

SEQ ID NO: 3150041 - RNA, 15 nt, Mycobacterium bovis subsp bovis AF2122/97
cgucggccgacaccg

SEQ ID NO: 3150042 - RNA, 16 nt, Mycobacterium bovis subsp bovis AF2122/97
cgucggccgacaccgc

SEQ ID NO: 3150043 - RNA, 18 nt, Mycobacterium bovis subsp bovis AF2122/97
cgucggccgacaccgcca

SEQ ID NO: 3150044 - RNA, 21 nt, Mycobacterium bovis subsp bovis AF2122/97
cgucggccgacaccgccacca

SEQ ID NO: 3150045 - RNA, 12 nt, Mycobacterium bovis subsp bovis AF2122/97
cgucggccgcau

SEQ ID NO: 3150046 - RNA, 15 nt, Mycobacterium bovis subsp bovis AF2122/97
cgucggccggcaacg

SEQ ID NO: 3150047 - RNA, 14 nt, Mycobacterium bovis subsp bovis AF2122/97
cgucggccggcacc

SEQ ID NO: 3150048 - RNA, 22 nt, Mycobacterium bovis subsp bovis AF2122/97
cgucggccggcaccccacggcc

SEQ ID NO: 3150049 - RNA, 14 nt, Mycobacterium bovis subsp bovis AF2122/97
cgucggccucggcg

SEQ ID NO: 3150050 - RNA, 14 nt, Mycobacterium bovis subsp bovis AF2122/97
cgucggcgaacgcg

SEQ ID NO: 3150051 - RNA, 22 nt, Mycobacterium bovis subsp bovis AF2122/97
cgucggcgaacgcguccagcgc

SEQ ID NO: 3150052 - RNA, 13 nt, Mycobacterium bovis subsp bovis AF2122/97
cgucggcgaaggg

SEQ ID NO: 3150053 - RNA, 16 nt, Mycobacterium bovis subsp bovis AF2122/97
cgucggcgaagguguc

SEQ ID NO: 3150054 - RNA, 13 nt, Mycobacterium bovis subsp bovis AF2122/97
cgucggcgaccag

SEQ ID NO: 3150055 - RNA, 14 nt, Mycobacterium bovis subsp bovis AF2122/97
cgucggcgaccagg

SEQ ID NO: 3150056 - RNA, 18 nt, Mycobacterium bovis subsp bovis AF2122/97
cgucggcgacggccagcg

SEQ ID NO: 3150057 - RNA, 16 nt, Mycobacterium bovis subsp bovis AF2122/97
cgucggcgacguccag

SEQ ID NO: 3150058 - RNA, 12 nt, Mycobacterium bovis subsp bovis AF2122/97
cgucggcgagca

SEQ ID NO: 3150059 - RNA, 13 nt, Mycobacterium bovis subsp bovis AF2122/97
cgucggcgagcag

SEQ ID NO: 3150060 - RNA, 17 nt, Mycobacterium bovis subsp bovis AF2122/97
cgucggcgagcucggcc

SEQ ID NO: 3150061 - RNA, 19 nt, Mycobacterium bovis subsp bovis AF2122/97
cgucggcgagcucggcccc

SEQ ID NO: 3150062 - RNA, 21 nt, Mycobacterium bovis subsp bovis AF2122/97
cgucggcgagcucggccccgc

SEQ ID NO: 3150063 - RNA, 20 nt, Mycobacterium bovis subsp bovis AF2122/97
cgucggcgauaucggagcgc

SEQ ID NO: 3150064 - RNA, 18 nt, Mycobacterium bovis subsp bovis AF2122/97
cgucggcgauggccagca

SEQ ID NO: 3150065 - RNA, 15 nt, Mycobacterium bovis subsp bovis AF2122/97
cgucggcgcaucacc

SEQ ID NO: 3150066 - RNA, 13 nt, Mycobacterium bovis subsp bovis AF2122/97
cgucggcgcccag

SEQ ID NO: 3150067 - RNA, 12 nt, Mycobacterium bovis subsp bovis AF2122/97
cgucggcgcccg

SEQ ID NO: 3150068 - RNA, 21 nt, Mycobacterium bovis subsp bovis AF2122/97
cgucggcgccgaacaccggcu

SEQ ID NO: 3150069 - RNA, 15 nt, Mycobacterium bovis subsp bovis AF2122/97
cgucggcgcgcaccu

SEQ ID NO: 3150070 - RNA, 13 nt, Mycobacterium bovis subsp bovis AF2122/97
cgucggcgcggcc

SEQ ID NO: 3150071 - RNA, 19 nt, Mycobacterium bovis subsp bovis AF2122/97
cgucggcgcucgucgcggc

SEQ ID NO: 3150072 - RNA, 14 nt, Mycobacterium bovis subsp bovis AF2122/97
cgucggcgcugacg

SEQ ID NO: 3150073 - RNA, 14 nt, Mycobacterium bovis subsp bovis AF2122/97
cgucggcgcugcgc

SEQ ID NO: 3150074 - RNA, 15 nt, Mycobacterium bovis subsp bovis AF2122/97
cgucggcggagagca

SEQ ID NO: 3150075 - RNA, 12 nt, Mycobacterium bovis subsp bovis AF2122/97
cgucggcggcca

SEQ ID NO: 3150076 - RNA, 19 nt, Mycobacterium bovis subsp bovis AF2122/97
cgucguacaccucgagcgc

SEQ ID NO: 3150077 - RNA, 21 nt, Mycobacterium bovis subsp bovis AF2122/97
cgucguacaccucgagcgcgg

SEQ ID NO: 3150078 - RNA, 23 nt, Mycobacterium bovis subsp bovis AF2122/97
cgucguacacgccaugguaugac

SEQ ID NO: 3150079 - RNA, 16 nt, Mycobacterium bovis subsp bovis AF2122/97
cgucguacaugggcag

SEQ ID NO: 3150080 - RNA, 17 nt, Mycobacterium bovis subsp bovis AF2122/97
cgucguaccguucgggc

SEQ ID NO: 3150081 - RNA, 19 nt, Mycobacterium bovis subsp bovis AF2122/97
cgucguaccguucgggccg

SEQ ID NO: 3150082 - RNA, 20 nt, Mycobacterium bovis subsp bovis AF2122/97
cgucguaccguucgggccgu

SEQ ID NO: 3150083 - RNA, 21 nt, Mycobacterium bovis subsp bovis AF2122/97
cgucguaccguucgggccguc

SEQ ID NO: 3150084 - RNA, 18 nt, Mycobacterium bovis subsp bovis AF2122/97
cgucguacucgaccgcga

SEQ ID NO: 3150085 - RNA, 17 nt, Mycobacterium bovis subsp bovis AF2122/97
cgucguacucggcggcc

SEQ ID NO: 3150086 - RNA, 18 nt, Mycobacterium bovis subsp bovis AF2122/97
cgucguacucggcggcca

SEQ ID NO: 3150087 - RNA, 15 nt, Mycobacterium bovis subsp bovis AF2122/97
cgucguagaccucca

SEQ ID NO: 3150088 - RNA, 22 nt, Mycobacterium bovis subsp bovis AF2122/97
cgucguagaccuccagugcggc

SEQ ID NO: 3150089 - RNA, 19 nt, Mycobacterium bovis subsp bovis AF2122/97
cgucguagcuggcgaucug

SEQ ID NO: 3150090 - RNA, 22 nt, Mycobacterium bovis subsp bovis AF2122/97
cgucguagguggccggcuugca

SEQ ID NO: 3150091 - RNA, 18 nt, Mycobacterium bovis subsp bovis AF2122/97
cgucguaguacagcgcga

SEQ ID NO: 3150092 - RNA, 15 nt, Mycobacterium bovis subsp bovis AF2122/97
cgucguaguccaggc

SEQ ID NO: 3150093 - RNA, 16 nt, Mycobacterium bovis subsp bovis AF2122/97
cgucguaguuggugaa

SEQ ID NO: 3150094 - RNA, 18 nt, Mycobacterium bovis subsp bovis AF2122/97
cgucguauugccucacca

SEQ ID NO: 3150095 - RNA, 13 nt, Mycobacterium bovis subsp bovis AF2122/97
cgucgucaacccg

SEQ ID NO: 3150096 - RNA, 16 nt, Mycobacterium bovis subsp bovis AF2122/97
cgucgucaacccggug

SEQ ID NO: 3150097 - RNA, 17 nt, Mycobacterium bovis subsp bovis AF2122/97
cgucgucaacccggugu

SEQ ID NO: 3150098 - RNA, 14 nt, Mycobacterium bovis subsp bovis AF2122/97
cgucgucacgaucg

SEQ ID NO: 3150099 - RNA, 15 nt, Mycobacterium bovis subsp bovis AF2122/97
cgucgucacgaucgu

SEQ ID NO: 3150100 - RNA, 15 nt, Mycobacterium bovis subsp bovis AF2122/97
cgucgucagcgggua

SEQ ID NO: 3150101 - RNA, 14 nt, Mycobacterium bovis subsp bovis AF2122/97
cgucgucagguggc

SEQ ID NO: 3150102 - RNA, 17 nt, Mycobacterium bovis subsp bovis AF2122/97
cgucgucaucgagcggg

SEQ ID NO: 3150103 - RNA, 14 nt, Mycobacterium bovis subsp bovis AF2122/97
cgucguccagcacc

SEQ ID NO: 3150104 - RNA, 15 nt, Mycobacterium bovis subsp bovis AF2122/97
cgucgucccagcgcg

SEQ ID NO: 3150105 - RNA, 16 nt, Mycobacterium bovis subsp bovis AF2122/97
cgucgucccagcgcgg

SEQ ID NO: 3150106 - RNA, 15 nt, Mycobacterium bovis subsp bovis AF2122/97
cgucguccgacgggc

SEQ ID NO: 3150107 - RNA, 13 nt, Mycobacterium bovis subsp bovis AF2122/97
cgucguccgcgcc

SEQ ID NO: 3150108 - RNA, 14 nt, Mycobacterium bovis subsp bovis AF2122/97
cgucguccgcgcca

SEQ ID NO: 3150109 - RNA, 15 nt, Mycobacterium bovis subsp bovis AF2122/97
cgucguccgcgccag

SEQ ID NO: 3150110 - RNA, 23 nt, Mycobacterium bovis subsp bovis AF2122/97
cgucguccgcgccaguggccacc

SEQ ID NO: 3150111 - RNA, 14 nt, Mycobacterium bovis subsp bovis AF2122/97
cgucgucgaaguug

SEQ ID NO: 3150112 - RNA, 22 nt, Mycobacterium bovis subsp bovis AF2122/97
cgucgucgaaguuggcgaagcc

SEQ ID NO: 3150113 - RNA, 19 nt, Mycobacterium bovis subsp bovis AF2122/97
cgucgucgaauccugccgc

SEQ ID NO: 3150114 - RNA, 17 nt, Mycobacterium bovis subsp bovis AF2122/97
cgucgucgacacgguga

SEQ ID NO: 3150115 - RNA, 19 nt, Mycobacterium bovis subsp bovis AF2122/97
cgucgucgacacggugauc

SEQ ID NO: 3150116 - RNA, 15 nt, Mycobacterium bovis subsp bovis AF2122/97
cgucgucgaccacga

SEQ ID NO: 3150117 - RNA, 14 nt, Mycobacterium bovis subsp bovis AF2122/97
cgucgucgacgaca

SEQ ID NO: 3150118 - RNA, 19 nt, Mycobacterium bovis subsp bovis AF2122/97
cgucgucgagaaucggcau

SEQ ID NO: 3150119 - RNA, 20 nt, Mycobacterium bovis subsp bovis AF2122/97
cgucgucgagauagccgacg

SEQ ID NO: 3150120 - RNA, 23 nt, Mycobacterium bovis subsp bovis AF2122/97
cgucgucgagauagccgacgucg

SEQ ID NO: 3150121 - RNA, 15 nt, Mycobacterium bovis subsp bovis AF2122/97
cgucgucgaguuggc

SEQ ID NO: 3150122 - RNA, 17 nt, Mycobacterium bovis subsp bovis AF2122/97
cgucgucgauccagccc

SEQ ID NO: 3150123 - RNA, 12 nt, Mycobacterium bovis subsp bovis AF2122/97
cgucgucgaucg

SEQ ID NO: 3150124 - RNA, 17 nt, Mycobacterium bovis subsp bovis AF2122/97
cgucgucgauuagccca

SEQ ID NO: 3150125 - RNA, 14 nt, Mycobacterium bovis subsp bovis AF2122/97
cgucgucgcccagg

SEQ ID NO: 3150126 - RNA, 21 nt, Mycobacterium bovis subsp bovis AF2122/97
cgucgucgcccaggcgugucg

SEQ ID NO: 3150127 - RNA, 23 nt, Mycobacterium bovis subsp bovis AF2122/97
cgucgucgccgucggugccgccg

SEQ ID NO: 3150128 - RNA, 14 nt, Mycobacterium bovis subsp bovis AF2122/97
cgucgucgcggccg

SEQ ID NO: 3150129 - RNA, 15 nt, Mycobacterium bovis subsp bovis AF2122/97
cgucgucgcggccgc

SEQ ID NO: 3150130 - RNA, 13 nt, Mycobacterium bovis subsp bovis AF2122/97
cgucgucgcggga

SEQ ID NO: 3150131 - RNA, 14 nt, Mycobacterium bovis subsp bovis AF2122/97
cgucgucgcgucgc

SEQ ID NO: 3150132 - RNA, 22 nt, Mycobacterium bovis subsp bovis AF2122/97
cgucgucgcugagcagcgccgc

SEQ ID NO: 3150133 - RNA, 17 nt, Mycobacterium bovis subsp bovis AF2122/97
cgucgucgcugccgcca

SEQ ID NO: 3150134 - RNA, 17 nt, Mycobacterium bovis subsp bovis AF2122/97
cgucgucggaaucggag

SEQ ID NO: 3150135 - RNA, 13 nt, Mycobacterium bovis subsp bovis AF2122/97
cgucgucggcaac

SEQ ID NO: 3150136 - RNA, 22 nt, Mycobacterium bovis subsp bovis AF2122/97
cgucgucggcaaccaaccgcgc

SEQ ID NO: 3150137 - RNA, 15 nt, Mycobacterium bovis subsp bovis AF2122/97
cgucgucggcaggca

SEQ ID NO: 3150138 - RNA, 12 nt, Mycobacterium bovis subsp bovis AF2122/97
cgucgucggcgu

SEQ ID NO: 3150139 - RNA, 14 nt, Mycobacterium bovis subsp bovis AF2122/97
cgucgucggcguag

SEQ ID NO: 3150140 - RNA, 17 nt, Mycobacterium bovis subsp bovis AF2122/97
cgucgucggcguagucg

SEQ ID NO: 3150141 - RNA, 14 nt, Mycobacterium bovis subsp bovis AF2122/97
cgucgucggguucg

SEQ ID NO: 3150142 - RNA, 23 nt, Mycobacterium bovis subsp bovis AF2122/97
cgucgucggucaugucggccacc

SEQ ID NO: 3150143 - RNA, 15 nt, Mycobacterium bovis subsp bovis AF2122/97
cgucgucgucccagg

SEQ ID NO: 3150144 - RNA, 18 nt, Mycobacterium bovis subsp bovis AF2122/97
cgucgucgucgacggccu

SEQ ID NO: 3150145 - RNA, 13 nt, Mycobacterium bovis subsp bovis AF2122/97
cgucgucgucgag

SEQ ID NO: 3150146 - RNA, 15 nt, Mycobacterium bovis subsp bovis AF2122/97
cgucgucgucgcugu

SEQ ID NO: 3150147 - RNA, 14 nt, Mycobacterium bovis subsp bovis AF2122/97
cgucgucgucgggu

SEQ ID NO: 3150148 - RNA, 14 nt, Mycobacterium bovis subsp bovis AF2122/97
cgucgucgugcacg

SEQ ID NO: 3150149 - RNA, 17 nt, Mycobacterium bovis subsp bovis AF2122/97
cgucgucgugcaggcgc

SEQ ID NO: 3150150 - RNA, 15 nt, Mycobacterium bovis subsp bovis AF2122/97
cgucgucuagcggga

SEQ ID NO: 3150151 - RNA, 17 nt, Mycobacterium bovis subsp bovis AF2122/97
cgucgucuucuucgcgg

SEQ ID NO: 3150152 - RNA, 23 nt, Mycobacterium bovis subsp bovis AF2122/97
cgucgucuugaccgcuugcccgc

SEQ ID NO: 3150153 - RNA, 16 nt, Mycobacterium bovis subsp bovis AF2122/97
cgucgugaccgaccgc

SEQ ID NO: 3150154 - RNA, 17 nt, Mycobacterium bovis subsp bovis AF2122/97
cgucgugaccggcggga

SEQ ID NO: 3150155 - RNA, 20 nt, Mycobacterium bovis subsp bovis AF2122/97
cgucgugaccggcgggaccg

SEQ ID NO: 3150156 - RNA, 19 nt, Mycobacterium bovis subsp bovis AF2122/97
cgucgugagucacccggcc

SEQ ID NO: 3150157 - RNA, 20 nt, Mycobacterium bovis subsp bovis AF2122/97
cgucgugaugucaacguguc

SEQ ID NO: 3150158 - RNA, 19 nt, Mycobacterium bovis subsp bovis AF2122/97
cgucgugcacgacgacauc

SEQ ID NO: 3150159 - RNA, 14 nt, Mycobacterium bovis subsp bovis AF2122/97
cgucgugcacggcg

SEQ ID NO: 3150160 - RNA, 19 nt, Mycobacterium bovis subsp bovis AF2122/97
cgucgugcacggcggccag

SEQ ID NO: 3150161 - RNA, 20 nt, Mycobacterium bovis subsp bovis AF2122/97
cgucgugcacggcggccagg

SEQ ID NO: 3150162 - RNA, 22 nt, Mycobacterium bovis subsp bovis AF2122/97
cgucgugcauaagcccgcgagg

SEQ ID NO: 3150163 - RNA, 13 nt, Mycobacterium bovis subsp bovis AF2122/97
cgucugcucggcg

SEQ ID NO: 3150164 - RNA, 15 nt, Mycobacterium bovis subsp bovis AF2122/97
cgucugcucggcgca

SEQ ID NO: 3150165 - RNA, 17 nt, Mycobacterium bovis subsp bovis AF2122/97
cgucugcucggcggccu

SEQ ID NO: 3150166 - RNA, 16 nt, Mycobacterium bovis subsp bovis AF2122/97
cgucugcuggcgcuca

SEQ ID NO: 3150167 - RNA, 21 nt, Mycobacterium bovis subsp bovis AF2122/97
cgucuggaguucgucaccguu

SEQ ID NO: 3150168 - RNA, 14 nt, Mycobacterium bovis subsp bovis AF2122/97
cgucuggccgucgc

SEQ ID NO: 3150169 - RNA, 19 nt, Mycobacterium bovis subsp bovis AF2122/97
cgucugggcaucaucgacg

SEQ ID NO: 3150170 - RNA, 19 nt, Mycobacterium bovis subsp bovis AF2122/97
cgucuggucagccgcggcg

SEQ ID NO: 3150171 - RNA, 22 nt, Mycobacterium bovis subsp bovis AF2122/97
cgucuggucagccgcggcggca

SEQ ID NO: 3150172 - RNA, 15 nt, Mycobacterium bovis subsp bovis AF2122/97
cgucugguggcagcg

SEQ ID NO: 3150173 - RNA, 17 nt, Mycobacterium bovis subsp bovis AF2122/97
cgucugguggcagcgca

SEQ ID NO: 3150174 - RNA, 19 nt, Mycobacterium bovis subsp bovis AF2122/97
cgucugguuggcuggcggg

SEQ ID NO: 3150175 - RNA, 16 nt, Mycobacterium bovis subsp bovis AF2122/97
cgucuguucgccgacg

SEQ ID NO: 3150176 - RNA, 18 nt, Mycobacterium bovis subsp bovis AF2122/97
cgucuuaccugaagccgc

SEQ ID NO: 3150177 - RNA, 21 nt, Mycobacterium bovis subsp bovis AF2122/97
cgucuuaccugaagccgcgcu

SEQ ID NO: 3150178 - RNA, 15 nt, Mycobacterium bovis subsp bovis AF2122/97
cgucuuccagccagg

SEQ ID NO: 3150179 - RNA, 13 nt, Mycobacterium bovis subsp bovis AF2122/97
cgucuucgccgcc

SEQ ID NO: 3150180 - RNA, 15 nt, Mycobacterium bovis subsp bovis AF2122/97
cgucuucgccgccac

SEQ ID NO: 3150181 - RNA, 18 nt, Mycobacterium bovis subsp bovis AF2122/97
cgucuucggucgcggccu

SEQ ID NO: 3150182 - RNA, 21 nt, Mycobacterium bovis subsp bovis AF2122/97
cgucuugcaucagcggcgcca

SEQ ID NO: 3150183 - RNA, 18 nt, Mycobacterium bovis subsp bovis AF2122/97
cgucuugcguccauccgc

SEQ ID NO: 3150184 - RNA, 17 nt, Mycobacterium bovis subsp bovis AF2122/97
cgucuugcuggucgaug

SEQ ID NO: 3150185 - RNA, 23 nt, Mycobacterium bovis subsp bovis AF2122/97
cgucuugggccgggaugaagcca

SEQ ID NO: 3150186 - RNA, 22 nt, Mycobacterium bovis subsp bovis AF2122/97
cgucuuggugcgcgucagccgc

SEQ ID NO: 3150187 - RNA, 21 nt, Mycobacterium bovis subsp bovis AF2122/97
cgugaaaccacaccuucgggg

SEQ ID NO: 3150188 - RNA, 16 nt, Mycobacterium bovis subsp bovis AF2122/97
cgugaacacgucgcgg

SEQ ID NO: 3150189 - RNA, 21 nt, Mycobacterium bovis subsp bovis AF2122/97
cgugaacacgucgcgguaggc

SEQ ID NO: 3150190 - RNA, 14 nt, Mycobacterium bovis subsp bovis AF2122/97
cgugaaccgcccgc

SEQ ID NO: 3150191 - RNA, 21 nt, Mycobacterium bovis subsp bovis AF2122/97
cgugaacggcgcgggccacca

SEQ ID NO: 3150192 - RNA, 23 nt, Mycobacterium bovis subsp bovis AF2122/97
cgugaacuguccgggugggcgcu

SEQ ID NO: 3150193 - RNA, 14 nt, Mycobacterium bovis subsp bovis AF2122/97
cgugaaguggucgu

SEQ ID NO: 3150194 - RNA, 17 nt, Mycobacterium bovis subsp bovis AF2122/97
cgugaaguggucguaga

SEQ ID NO: 3150195 - RNA, 15 nt, Mycobacterium bovis subsp bovis AF2122/97
cgugaaucgagcacc

SEQ ID NO: 3150196 - RNA, 15 nt, Mycobacterium bovis subsp bovis AF2122/97
cgugaauggcagcac

SEQ ID NO: 3150197 - RNA, 18 nt, Mycobacterium bovis subsp bovis AF2122/97
cgugaaugguggugucgg

SEQ ID NO: 3150198 - RNA, 16 nt, Mycobacterium bovis subsp bovis AF2122/97
cgugaauucgccgaac

SEQ ID NO: 3150199 - RNA, 17 nt, Mycobacterium bovis subsp bovis AF2122/97
cgugacaaccaucggug

SEQ ID NO: 3150200 - RNA, 15 nt, Mycobacterium bovis subsp bovis AF2122/97
cgugacaaggugcgc

SEQ ID NO: 3150201 - RNA, 19 nt, Mycobacterium bovis subsp bovis AF2122/97
cgugacagugaccugggcg

SEQ ID NO: 3150202 - RNA, 20 nt, Mycobacterium bovis subsp bovis AF2122/97
cgugacagugaccugggcgc

SEQ ID NO: 3150203 - RNA, 15 nt, Mycobacterium bovis subsp bovis AF2122/97
cgugaccaccgccga

SEQ ID NO: 3150204 - RNA, 16 nt, Mycobacterium bovis subsp bovis AF2122/97
cgugaccaccgccgac

SEQ ID NO: 3150205 - RNA, 11 nt, Mycobacterium bovis subsp bovis AF2122/97
cgugaccagcc

SEQ ID NO: 3150206 - RNA, 21 nt, Mycobacterium bovis subsp bovis AF2122/97
cgugaccagggccugaguguu

SEQ ID NO: 3150207 - RNA, 21 nt, Mycobacterium bovis subsp bovis AF2122/97
cgugacccauucucggccggc

SEQ ID NO: 3150208 - RNA, 13 nt, Mycobacterium bovis subsp bovis AF2122/97
cgugacccgacau

SEQ ID NO: 3150209 - RNA, 19 nt, Mycobacterium bovis subsp bovis AF2122/97
cgugacccgacaugguccg

SEQ ID NO: 3150210 - RNA, 15 nt, Mycobacterium bovis subsp bovis AF2122/97
cgugacccgccggcg

SEQ ID NO: 3150211 - RNA, 16 nt, Mycobacterium bovis subsp bovis AF2122/97
cgugacccgccggcga

SEQ ID NO: 3150212 - RNA, 21 nt, Mycobacterium bovis subsp bovis AF2122/97
cgugacccggauaucgaccac

SEQ ID NO: 3150213 - RNA, 20 nt, Mycobacterium bovis subsp bovis AF2122/97
cgugacccucagcaccgcug

SEQ ID NO: 3150214 - RNA, 21 nt, Mycobacterium bovis subsp bovis AF2122/97
cgugacccugggguugcauca

SEQ ID NO: 3150215 - RNA, 19 nt, Mycobacterium bovis subsp bovis AF2122/97
cgugaccgagaagcccacc

SEQ ID NO: 3150216 - RNA, 17 nt, Mycobacterium bovis subsp bovis AF2122/97
cgugaccgagccgcgau

SEQ ID NO: 3150217 - RNA, 13 nt, Mycobacterium bovis subsp bovis AF2122/97
cgugaccgccgcg

SEQ ID NO: 3150218 - RNA, 15 nt, Mycobacterium bovis subsp bovis AF2122/97
cgugaccgccgcgcc

SEQ ID NO: 3150219 - RNA, 17 nt, Mycobacterium bovis subsp bovis AF2122/97
cgugaccgugccgucgg

SEQ ID NO: 3150220 - RNA, 21 nt, Mycobacterium bovis subsp bovis AF2122/97
cgugaccgugccgucggcgug

SEQ ID NO: 3150221 - RNA, 23 nt, Mycobacterium bovis subsp bovis AF2122/97
cgugaccgugccgucggcgugca

SEQ ID NO: 3150222 - RNA, 16 nt, Mycobacterium bovis subsp bovis AF2122/97
cgugacgaccagcccc

SEQ ID NO: 3150223 - RNA, 18 nt, Mycobacterium bovis subsp bovis AF2122/97
cgugacgaccagccccgc

SEQ ID NO: 3150224 - RNA, 20 nt, Mycobacterium bovis subsp bovis AF2122/97
cgugacgaccagccccgcug

SEQ ID NO: 3150225 - RNA, 21 nt, Mycobacterium bovis subsp bovis AF2122/97
cgugacgaccagccccgcugg

SEQ ID NO: 3150226 - RNA, 17 nt, Mycobacterium bovis subsp bovis AF2122/97
cgugacgaucagcguga

SEQ ID NO: 3150227 - RNA, 17 nt, Mycobacterium bovis subsp bovis AF2122/97
cgugacguagggcagcg

SEQ ID NO: 3150228 - RNA, 20 nt, Mycobacterium bovis subsp bovis AF2122/97
cgugacguagggcagcgcca

SEQ ID NO: 3150229 - RNA, 13 nt, Mycobacterium bovis subsp bovis AF2122/97
cgugacgucgucg

SEQ ID NO: 3150230 - RNA, 13 nt, Mycobacterium bovis subsp bovis AF2122/97
cgugacgucgugg

SEQ ID NO: 3150231 - RNA, 20 nt, Mycobacterium bovis subsp bovis AF2122/97
cgugacgucguggcgcucgg

SEQ ID NO: 3150232 - RNA, 23 nt, Mycobacterium bovis subsp bovis AF2122/97
cgugacgucguggcgcucggcga

SEQ ID NO: 3150233 - RNA, 22 nt, Mycobacterium bovis subsp bovis AF2122/97
cgugacguuguaggagaacguc

SEQ ID NO: 3150234 - RNA, 13 nt, Mycobacterium bovis subsp bovis AF2122/97
cgugacucggccg

SEQ ID NO: 3150235 - RNA, 17 nt, Mycobacterium bovis subsp bovis AF2122/97
cgugacucggccgacga

SEQ ID NO: 3150236 - RNA, 16 nt, Mycobacterium bovis subsp bovis AF2122/97
cgugagacgccgucga

SEQ ID NO: 3150237 - RNA, 18 nt, Mycobacterium bovis subsp bovis AF2122/97
cgugagacgccgucgacg

SEQ ID NO: 3150238 - RNA, 16 nt, Mycobacterium bovis subsp bovis AF2122/97
cgugagacugggcgcu

SEQ ID NO: 3150239 - RNA, 12 nt, Mycobacterium bovis subsp bovis AF2122/97
cgugagaggcca

SEQ ID NO: 3150240 - RNA, 14 nt, Mycobacterium bovis subsp bovis AF2122/97
cgugagcaccagca

SEQ ID NO: 3150241 - RNA, 17 nt, Mycobacterium bovis subsp bovis AF2122/97
cgugagcaccagcagca

SEQ ID NO: 3150242 - RNA, 13 nt, Mycobacterium bovis subsp bovis AF2122/97
cgugagcagacgc

SEQ ID NO: 3150243 - RNA, 23 nt, Mycobacterium bovis subsp bovis AF2122/97
cgugagcaguucguuccagauga

SEQ ID NO: 3150244 - RNA, 19 nt, Mycobacterium bovis subsp bovis AF2122/97
cgugagccagcuugcgcaa

SEQ ID NO: 3150245 - RNA, 21 nt, Mycobacterium bovis subsp bovis AF2122/97
cgugagccaugccgcucggca

SEQ ID NO: 3150246 - RNA, 22 nt, Mycobacterium bovis subsp bovis AF2122/97
cgugagccaugccgcucggcaa

SEQ ID NO: 3150247 - RNA, 13 nt, Mycobacterium bovis subsp bovis AF2122/97
cgugagccccagc

SEQ ID NO: 3150248 - RNA, 16 nt, Mycobacterium bovis subsp bovis AF2122/97
cgugagccccagcgac

SEQ ID NO: 3150249 - RNA, 19 nt, Mycobacterium bovis subsp bovis AF2122/97
cgugcaucgcgauuccggc

SEQ ID NO: 3150250 - RNA, 21 nt, Mycobacterium bovis subsp bovis AF2122/97
cgugcaucgcgauuccggcgg

SEQ ID NO: 3150251 - RNA, 14 nt, Mycobacterium bovis subsp bovis AF2122/97
cgugcaucugugag

SEQ ID NO: 3150252 - RNA, 23 nt, Mycobacterium bovis subsp bovis AF2122/97
cgugcaucugugagauaccgacg

SEQ ID NO: 3150253 - RNA, 14 nt, Mycobacterium bovis subsp bovis AF2122/97
cgugccacagcucg

SEQ ID NO: 3150254 - RNA, 17 nt, Mycobacterium bovis subsp bovis AF2122/97
cgugccacagcucgccg

SEQ ID NO: 3150255 - RNA, 20 nt, Mycobacterium bovis subsp bovis AF2122/97
cgugccacagcucgccguga

SEQ ID NO: 3150256 - RNA, 18 nt, Mycobacterium bovis subsp bovis AF2122/97
cgugccagcacacgccua

SEQ ID NO: 3150257 - RNA, 22 nt, Mycobacterium bovis subsp bovis AF2122/97
cgugccagcagcaaucagccgc

SEQ ID NO: 3150258 - RNA, 23 nt, Mycobacterium bovis subsp bovis AF2122/97
cgugccagcagcaaucagccgcc

SEQ ID NO: 3150259 - RNA, 23 nt, Mycobacterium bovis subsp bovis AF2122/97
cgugccagcaggggacgggcggc

SEQ ID NO: 3150260 - RNA, 13 nt, Mycobacterium bovis subsp bovis AF2122/97
cgugccagcgccc

SEQ ID NO: 3150261 - RNA, 18 nt, Mycobacterium bovis subsp bovis AF2122/97
cgugccagcgccccgcgg

SEQ ID NO: 3150262 - RNA, 17 nt, Mycobacterium bovis subsp bovis AF2122/97
cgugcccaagcucaggg

SEQ ID NO: 3150263 - RNA, 22 nt, Mycobacterium bovis subsp bovis AF2122/97
cgugcccaagcucagggugggc

SEQ ID NO: 3150264 - RNA, 21 nt, Mycobacterium bovis subsp bovis AF2122/97
cgugcccaggccaccggcugc

SEQ ID NO: 3150265 - RNA, 18 nt, Mycobacterium bovis subsp bovis AF2122/97
cgugcccgccaccggcgc

SEQ ID NO: 3150266 - RNA, 20 nt, Mycobacterium bovis subsp bovis AF2122/97
cgugcccgccaccggcgcga

SEQ ID NO: 3150267 - RNA, 13 nt, Mycobacterium bovis subsp bovis AF2122/97
cgugcccgcgcgg

SEQ ID NO: 3150268 - RNA, 14 nt, Mycobacterium bovis subsp bovis AF2122/97
cgugcccgggcggu

SEQ ID NO: 3150269 - RNA, 13 nt, Mycobacterium bovis subsp bovis AF2122/97
cgugcccgguguu

SEQ ID NO: 3150270 - RNA, 15 nt, Mycobacterium bovis subsp bovis AF2122/97
cgugcccgguguuca

SEQ ID NO: 3150271 - RNA, 17 nt, Mycobacterium bovis subsp bovis AF2122/97
cgugcccugggugaugg

SEQ ID NO: 3150272 - RNA, 22 nt, Mycobacterium bovis subsp bovis AF2122/97
cgugcccuguccggcgccgagg

SEQ ID NO: 3150273 - RNA, 15 nt, Mycobacterium bovis subsp bovis AF2122/97
cgugccgaaaaucgc

SEQ ID NO: 3150274 - RNA, 16 nt, Mycobacterium bovis subsp bovis AF2122/97
cgugccgaaaaucgca

SEQ ID NO: 3150275 - RNA, 20 nt, Mycobacterium bovis subsp bovis AF2122/97
cgugccgaaaaucgcagcca

SEQ ID NO: 3150276 - RNA, 22 nt, Mycobacterium bovis subsp bovis AF2122/97
cgugccgaacacgguguauugg

SEQ ID NO: 3150277 - RNA, 13 nt, Mycobacterium bovis subsp bovis AF2122/97
cgugccgaccagc

SEQ ID NO: 3150278 - RNA, 14 nt, Mycobacterium bovis subsp bovis AF2122/97
cgugccgagcgugc

SEQ ID NO: 3150279 - RNA, 22 nt, Mycobacterium bovis subsp bovis AF2122/97
cgugccgagcgugcgcuggugg

SEQ ID NO: 3150280 - RNA, 23 nt, Mycobacterium bovis subsp bovis AF2122/97
cgugccgagcuucagcgcgcugc

SEQ ID NO: 3150281 - RNA, 18 nt, Mycobacterium bovis subsp bovis AF2122/97
cgugccgaugccggcgag

SEQ ID NO: 3150282 - RNA, 23 nt, Mycobacterium bovis subsp bovis AF2122/97
cgugccgcaaccggcgaucgguu

SEQ ID NO: 3150283 - RNA, 17 nt, Mycobacterium bovis subsp bovis AF2122/97
cgugccgcaccgccugc

SEQ ID NO: 3150284 - RNA, 17 nt, Mycobacterium bovis subsp bovis AF2122/97
cgugccgcagcggcggc

SEQ ID NO: 3150285 - RNA, 21 nt, Mycobacterium bovis subsp bovis AF2122/97
cgugccgcagcggcggcaacc

SEQ ID NO: 3150286 - RNA, 14 nt, Mycobacterium bovis subsp bovis AF2122/97
cgugccgcaucacc

SEQ ID NO: 3150287 - RNA, 16 nt, Mycobacterium bovis subsp bovis AF2122/97
cgugccgcccggucgg

SEQ ID NO: 3150288 - RNA, 15 nt, Mycobacterium bovis subsp bovis AF2122/97
cgugccgcccucacc

SEQ ID NO: 3150289 - RNA, 18 nt, Mycobacterium bovis subsp bovis AF2122/97
cgugccgcccucaccgcc

SEQ ID NO: 3150290 - RNA, 12 nt, Mycobacterium bovis subsp bovis AF2122/97
cgugccgcggcg

SEQ ID NO: 3150291 - RNA, 13 nt, Mycobacterium bovis subsp bovis AF2122/97
cgugccggcguuu

SEQ ID NO: 3150292 - RNA, 13 nt, Mycobacterium bovis subsp bovis AF2122/97
cgugccgggaccg

SEQ ID NO: 3150293 - RNA, 17 nt, Mycobacterium bovis subsp bovis AF2122/97
cgugccgggaccggugu

SEQ ID NO: 3150294 - RNA, 16 nt, Mycobacterium bovis subsp bovis AF2122/97
cgugccgggcgacggu

SEQ ID NO: 3150295 - RNA, 17 nt, Mycobacterium bovis subsp bovis AF2122/97
cgugccgggcgacgguu

SEQ ID NO: 3150296 - RNA, 22 nt, Mycobacterium bovis subsp bovis AF2122/97
cgugccggggauaucacgacgc

SEQ ID NO: 3150297 - RNA, 17 nt, Mycobacterium bovis subsp bovis AF2122/97
cgugccggggcugccga

SEQ ID NO: 3150298 - RNA, 14 nt, Mycobacterium bovis subsp bovis AF2122/97
cgugccgggucacc

SEQ ID NO: 3150299 - RNA, 11 nt, Mycobacterium bovis subsp bovis AF2122/97
cgugccgggug

SEQ ID NO: 3150300 - RNA, 14 nt, Mycobacterium bovis subsp bovis AF2122/97
cgugccgguccccc

SEQ ID NO: 3150301 - RNA, 17 nt, Mycobacterium bovis subsp bovis AF2122/97
cgugccguacgcccagg

SEQ ID NO: 3150302 - RNA, 19 nt, Mycobacterium bovis subsp bovis AF2122/97
cgugccgucaacgauggug

SEQ ID NO: 3150303 - RNA, 15 nt, Mycobacterium bovis subsp bovis AF2122/97
cgugccgucgccucc

SEQ ID NO: 3150304 - RNA, 18 nt, Mycobacterium bovis subsp bovis AF2122/97
cgugccgucgccuccagc

SEQ ID NO: 3150305 - RNA, 14 nt, Mycobacterium bovis subsp bovis AF2122/97
cgugccgucggcgu

SEQ ID NO: 3150306 - RNA, 15 nt, Mycobacterium bovis subsp bovis AF2122/97
cgugccgucggcgug

SEQ ID NO: 3150307 - RNA, 16 nt, Mycobacterium bovis subsp bovis AF2122/97
cgugccgucggcgugc

SEQ ID NO: 3150308 - RNA, 21 nt, Mycobacterium bovis subsp bovis AF2122/97
cgugccgucggcgugcagcag

SEQ ID NO: 3150309 - RNA, 22 nt, Mycobacterium bovis subsp bovis AF2122/97
cgugccguugaagcccaacagc

SEQ ID NO: 3150310 - RNA, 23 nt, Mycobacterium bovis subsp bovis AF2122/97
cgugccguugaagcccaacagca

SEQ ID NO: 3150311 - RNA, 21 nt, Mycobacterium bovis subsp bovis AF2122/97
cgugccucgaggacggcguag

SEQ ID NO: 3150312 - RNA, 16 nt, Mycobacterium bovis subsp bovis AF2122/97
cgugccucucgggggc

SEQ ID NO: 3150313 - RNA, 17 nt, Mycobacterium bovis subsp bovis AF2122/97
cgugccucucgggggcc

SEQ ID NO: 3150314 - RNA, 17 nt, Mycobacterium bovis subsp bovis AF2122/97
cgugccuugaucugagc

SEQ ID NO: 3150315 - RNA, 21 nt, Mycobacterium bovis subsp bovis AF2122/97
cgugccuugaucugagcgcgg

SEQ ID NO: 3150316 - RNA, 18 nt, Mycobacterium bovis subsp bovis AF2122/97
cgugcgaaucgagacggc

SEQ ID NO: 3150317 - RNA, 19 nt, Mycobacterium bovis subsp bovis AF2122/97
cgugcgagggcacggcggu

SEQ ID NO: 3150318 - RNA, 23 nt, Mycobacterium bovis subsp bovis AF2122/97
cgugcgagggcacggcggugugu

SEQ ID NO: 3150319 - RNA, 16 nt, Mycobacterium bovis subsp bovis AF2122/97
cgugcgaucaccuccg

SEQ ID NO: 3150320 - RNA, 18 nt, Mycobacterium bovis subsp bovis AF2122/97
cgugcgaucaccuccgcg

SEQ ID NO: 3150321 - RNA, 19 nt, Mycobacterium bovis subsp bovis AF2122/97
cgugcgaucaccuccgcga

SEQ ID NO: 3150322 - RNA, 24 nt, Mycobacterium bovis subsp bovis AF2122/97
cgugcgauucacacucgggcggcu

SEQ ID NO: 3150323 - RNA, 22 nt, Mycobacterium bovis subsp bovis AF2122/97
cgugcgauuuugugucugcucg

SEQ ID NO: 3150324 - RNA, 18 nt, Mycobacterium bovis subsp bovis AF2122/97
cgugcgcacugaggcuca

SEQ ID NO: 3150325 - RNA, 15 nt, Mycobacterium bovis subsp bovis AF2122/97
cgugcgcaucgucga

SEQ ID NO: 3150326 - RNA, 23 nt, Mycobacterium bovis subsp bovis AF2122/97
cgugcgccacuagcccugagcga

SEQ ID NO: 3150327 - RNA, 12 nt, Mycobacterium bovis subsp bovis AF2122/97
cgugcgccgacu

SEQ ID NO: 3150328 - RNA, 14 nt, Mycobacterium bovis subsp bovis AF2122/97
cgugcgcgcgcagc

SEQ ID NO: 3150329 - RNA, 20 nt, Mycobacterium bovis subsp bovis AF2122/97
cgugcgcgucggugucgaug

SEQ ID NO: 3150330 - RNA, 20 nt, Mycobacterium bovis subsp bovis AF2122/97
cgugcgcguuggucaucacc

SEQ ID NO: 3150331 - RNA, 19 nt, Mycobacterium bovis subsp bovis AF2122/97
cgugcgcuggcugacaccg

SEQ ID NO: 3150332 - RNA, 20 nt, Mycobacterium bovis subsp bovis AF2122/97
cgugcgcuuggucgaccgcc

SEQ ID NO: 3150333 - RNA, 18 nt, Mycobacterium bovis subsp bovis AF2122/97
cgugcggacugacgucga

SEQ ID NO: 3150334 - RNA, 21 nt, Mycobacterium bovis subsp bovis AF2122/97
cgugcggacugacgucgaagg

SEQ ID NO: 3150335 - RNA, 22 nt, Mycobacterium bovis subsp bovis AF2122/97
cguggaucaucccgaccagcag

SEQ ID NO: 3150336 - RNA, 15 nt, Mycobacterium bovis subsp bovis AF2122/97
cguggaucggcagcc

SEQ ID NO: 3150337 - RNA, 21 nt, Mycobacterium bovis subsp bovis AF2122/97
cguggaucucuuucggaugca

SEQ ID NO: 3150338 - RNA, 20 nt, Mycobacterium bovis subsp bovis AF2122/97
cguggaucugccucucgacc

SEQ ID NO: 3150339 - RNA, 15 nt, Mycobacterium bovis subsp bovis AF2122/97
cguggaucuuggcca

SEQ ID NO: 3150340 - RNA, 17 nt, Mycobacterium bovis subsp bovis AF2122/97
cguggaucuuggccagc

SEQ ID NO: 3150341 - RNA, 20 nt, Mycobacterium bovis subsp bovis AF2122/97
cguggaucuuggccagcagc

SEQ ID NO: 3150342 - RNA, 14 nt, Mycobacterium bovis subsp bovis AF2122/97
cguggauggccgcc

SEQ ID NO: 3150343 - RNA, 19 nt, Mycobacterium bovis subsp bovis AF2122/97
cguggaugguggugccguc

SEQ ID NO: 3150344 - RNA, 12 nt, Mycobacterium bovis subsp bovis AF2122/97
cguggaugucgc

SEQ ID NO: 3150345 - RNA, 15 nt, Mycobacterium bovis subsp bovis AF2122/97
cguggaugucgcggu

SEQ ID NO: 3150346 - RNA, 20 nt, Mycobacterium bovis subsp bovis AF2122/97
cguggauguguagguggggc

SEQ ID NO: 3150347 - RNA, 23 nt, Mycobacterium bovis subsp bovis AF2122/97
cguggauuucaagucauccuuga

SEQ ID NO: 3150348 - RNA, 17 nt, Mycobacterium bovis subsp bovis AF2122/97
cguggcaccaccaaggu

SEQ ID NO: 3150349 - RNA, 22 nt, Mycobacterium bovis subsp bovis AF2122/97
cguggcacccgcaguggucggc

SEQ ID NO: 3150350 - RNA, 12 nt, Mycobacterium bovis subsp bovis AF2122/97
cguggcacgggu

SEQ ID NO: 3150351 - RNA, 22 nt, Mycobacterium bovis subsp bovis AF2122/97
cguggcacugacgcgcccgacg

SEQ ID NO: 3150352 - RNA, 18 nt, Mycobacterium bovis subsp bovis AF2122/97
cguggcaguacaccggcg

SEQ ID NO: 3150353 - RNA, 20 nt, Mycobacterium bovis subsp bovis AF2122/97
cguggcaguacaccggcgug

SEQ ID NO: 3150354 - RNA, 22 nt, Mycobacterium bovis subsp bovis AF2122/97
cguggcagucgcacggugccgc

SEQ ID NO: 3150355 - RNA, 13 nt, Mycobacterium bovis subsp bovis AF2122/97
cguggcagugcag

SEQ ID NO: 3150356 - RNA, 15 nt, Mycobacterium bovis subsp bovis AF2122/97
cguggcagugcaggc

SEQ ID NO: 3150357 - RNA, 23 nt, Mycobacterium bovis subsp bovis AF2122/97
cguggcagugcaggcggccgcca

SEQ ID NO: 3150358 - RNA, 15 nt, Mycobacterium bovis subsp bovis AF2122/97
cguggcauccagcag

SEQ ID NO: 3150359 - RNA, 17 nt, Mycobacterium bovis subsp bovis AF2122/97
cguggccaauccggcgg

SEQ ID NO: 3150360 - RNA, 19 nt, Mycobacterium bovis subsp bovis AF2122/97
cguggccaauccggcggcg

SEQ ID NO: 3150361 - RNA, 17 nt, Mycobacterium bovis subsp bovis AF2122/97
cguggcccgcucccugc

SEQ ID NO: 3150362 - RNA, 21 nt, Mycobacterium bovis subsp bovis AF2122/97
cguggcccgcucccugcaccc

SEQ ID NO: 3150363 - RNA, 22 nt, Mycobacterium bovis subsp bovis AF2122/97
cguggcccgcucccugcaccca

SEQ ID NO: 3150364 - RNA, 20 nt, Mycobacterium bovis subsp bovis AF2122/97
cguggccgcacugcugguca

SEQ ID NO: 3150365 - RNA, 12 nt, Mycobacterium bovis subsp bovis AF2122/97
cguggccgccgg

SEQ ID NO: 3150366 - RNA, 13 nt, Mycobacterium bovis subsp bovis AF2122/97
cguggccgccggc

SEQ ID NO: 3150367 - RNA, 14 nt, Mycobacterium bovis subsp bovis AF2122/97
cguggccgccggcg

SEQ ID NO: 3150368 - RNA, 14 nt, Mycobacterium bovis subsp bovis AF2122/97
cguggccggaccca

SEQ ID NO: 3150369 - RNA, 21 nt, Mycobacterium bovis subsp bovis AF2122/97
cguggccggucacguccgcgg

SEQ ID NO: 3150370 - RNA, 15 nt, Mycobacterium bovis subsp bovis AF2122/97
cguggccucgauguc

SEQ ID NO: 3150371 - RNA, 22 nt, Mycobacterium bovis subsp bovis AF2122/97
cguggccucgauguccugcgga

SEQ ID NO: 3150372 - RNA, 20 nt, Mycobacterium bovis subsp bovis AF2122/97
cguggccugaaacggcugca

SEQ ID NO: 3150373 - RNA, 18 nt, Mycobacterium bovis subsp bovis AF2122/97
cguggcgaaugacggcca

SEQ ID NO: 3150374 - RNA, 20 nt, Mycobacterium bovis subsp bovis AF2122/97
cguggcgaaugacggccagu

SEQ ID NO: 3150375 - RNA, 22 nt, Mycobacterium bovis subsp bovis AF2122/97
cguggcgaaugacggccaguug

SEQ ID NO: 3150376 - RNA, 24 nt, Mycobacterium bovis subsp bovis AF2122/97
cguggcgaauucgaccacucgccg

SEQ ID NO: 3150377 - RNA, 15 nt, Mycobacterium bovis subsp bovis AF2122/97
cguggcgaccacgau

SEQ ID NO: 3150378 - RNA, 13 nt, Mycobacterium bovis subsp bovis AF2122/97
cguggcgaccggc

SEQ ID NO: 3150379 - RNA, 14 nt, Mycobacterium bovis subsp bovis AF2122/97
cguggcgaccggcg

SEQ ID NO: 3150380 - RNA, 14 nt, Mycobacterium bovis subsp bovis AF2122/97
cguggcgcaccacc

SEQ ID NO: 3150381 - RNA, 16 nt, Mycobacterium bovis subsp bovis AF2122/97
cguggcgcaccaccgc

SEQ ID NO: 3150382 - RNA, 18 nt, Mycobacterium bovis subsp bovis AF2122/97
cguggcgcaccaccgccc

SEQ ID NO: 3150383 - RNA, 20 nt, Mycobacterium bovis subsp bovis AF2122/97
cguggcgcccgucuccagca

SEQ ID NO: 3150384 - RNA, 22 nt, Mycobacterium bovis subsp bovis AF2122/97
cguggcgcccgucuccagcacc

SEQ ID NO: 3150385 - RNA, 15 nt, Mycobacterium bovis subsp bovis AF2122/97
cguggcgcccgugcc

SEQ ID NO: 3150386 - RNA, 17 nt, Mycobacterium bovis subsp bovis AF2122/97
cguggcgcccgugccgc

SEQ ID NO: 3150387 - RNA, 19 nt, Mycobacterium bovis subsp bovis AF2122/97
cguggcgcucggcgagcaa

SEQ ID NO: 3150388 - RNA, 14 nt, Mycobacterium bovis subsp bovis AF2122/97
cguggcggacggcg

SEQ ID NO: 3150389 - RNA, 13 nt, Mycobacterium bovis subsp bovis AF2122/97
cguggcggcagcg

SEQ ID NO: 3150390 - RNA, 16 nt, Mycobacterium bovis subsp bovis AF2122/97
cguggcggccuccucc

SEQ ID NO: 3150391 - RNA, 20 nt, Mycobacterium bovis subsp bovis AF2122/97
cguggcggccuccuccccga

SEQ ID NO: 3150392 - RNA, 15 nt, Mycobacterium bovis subsp bovis AF2122/97
cguggcggcgggccu

SEQ ID NO: 3150393 - RNA, 13 nt, Mycobacterium bovis subsp bovis AF2122/97
cguggcgggggcu

SEQ ID NO: 3150394 - RNA, 15 nt, Mycobacterium bovis subsp bovis AF2122/97
cguggcgucggcguc

SEQ ID NO: 3150395 - RNA, 17 nt, Mycobacterium bovis subsp bovis AF2122/97
cguggcgucgugcgcgg

SEQ ID NO: 3150396 - RNA, 14 nt, Mycobacterium bovis subsp bovis AF2122/97
cguggcguuggcgg

SEQ ID NO: 3150397 - RNA, 19 nt, Mycobacterium bovis subsp bovis AF2122/97
cguggcguugguggucugc

SEQ ID NO: 3150398 - RNA, 16 nt, Mycobacterium bovis subsp bovis AF2122/97
cguggcuaccgcaggu

SEQ ID NO: 3150399 - RNA, 12 nt, Mycobacterium bovis subsp bovis AF2122/97
cguggcucggcg

SEQ ID NO: 3150400 - RNA, 15 nt, Mycobacterium bovis subsp bovis AF2122/97
cguggcucggcgggu

SEQ ID NO: 3150401 - RNA, 18 nt, Mycobacterium bovis subsp bovis AF2122/97
cguggcugccuucggcga

SEQ ID NO: 3150402 - RNA, 21 nt, Mycobacterium bovis subsp bovis AF2122/97
cguggcugccuucggcgagcg

SEQ ID NO: 3150403 - RNA, 22 nt, Mycobacterium bovis subsp bovis AF2122/97
cguggcugcgauuuucggcacg

SEQ ID NO: 3150404 - RNA, 20 nt, Mycobacterium bovis subsp bovis AF2122/97
cguggcugcgcucgcccgcg

SEQ ID NO: 3150405 - RNA, 15 nt, Mycobacterium bovis subsp bovis AF2122/97
cguggcugcguucgc

SEQ ID NO: 3150406 - RNA, 21 nt, Mycobacterium bovis subsp bovis AF2122/97
cguggcuggacccgcauggcg

SEQ ID NO: 3150407 - RNA, 13 nt, Mycobacterium bovis subsp bovis AF2122/97
cguggcuggcacc

SEQ ID NO: 3150408 - RNA, 18 nt, Mycobacterium bovis subsp bovis AF2122/97
cguggcuggcaccucccg

SEQ ID NO: 3150409 - RNA, 18 nt, Mycobacterium bovis subsp bovis AF2122/97
cguggcuggcaugccggc

SEQ ID NO: 3150410 - RNA, 13 nt, Mycobacterium bovis subsp bovis AF2122/97
cguggcuggcggc

SEQ ID NO: 3150411 - RNA, 20 nt, Mycobacterium bovis subsp bovis AF2122/97
cguggcuggcggcgaccguc

SEQ ID NO: 3150412 - RNA, 22 nt, Mycobacterium bovis subsp bovis AF2122/97
cguggcuucacccaaccccgcc

SEQ ID NO: 3150413 - RNA, 21 nt, Mycobacterium bovis subsp bovis AF2122/97
cguggcuugguggucgccacc

SEQ ID NO: 3150414 - RNA, 15 nt, Mycobacterium bovis subsp bovis AF2122/97
cgugggaagagccgg

SEQ ID NO: 3150415 - RNA, 16 nt, Mycobacterium bovis subsp bovis AF2122/97
cgugggaugucgagcg

SEQ ID NO: 3150416 - RNA, 22 nt, Mycobacterium bovis subsp bovis AF2122/97
cgugggcacagccauggugggc

SEQ ID NO: 3150417 - RNA, 17 nt, Mycobacterium bovis subsp bovis AF2122/97
cgugggcaccuuggccg

SEQ ID NO: 3150418 - RNA, 19 nt, Mycobacterium bovis subsp bovis AF2122/97
cgugggcaccuuggccggc

SEQ ID NO: 3150419 - RNA, 19 nt, Mycobacterium bovis subsp bovis AF2122/97
cgugggcacuugcccgucg

SEQ ID NO: 3150420 - RNA, 22 nt, Mycobacterium bovis subsp bovis AF2122/97
cgugggcacuugcccgucggcg

SEQ ID NO: 3150421 - RNA, 22 nt, Mycobacterium bovis subsp bovis AF2122/97
cgugucacgcgaccaccgccga

SEQ ID NO: 3150422 - RNA, 20 nt, Mycobacterium bovis subsp bovis AF2122/97
cguguccaccggaccgacca

SEQ ID NO: 3150423 - RNA, 13 nt, Mycobacterium bovis subsp bovis AF2122/97
cguguccagcaug

SEQ ID NO: 3150424 - RNA, 14 nt, Mycobacterium bovis subsp bovis AF2122/97
cguguccagcaugc

SEQ ID NO: 3150425 - RNA, 22 nt, Mycobacterium bovis subsp bovis AF2122/97
cguguccagcaugcccgccauc

SEQ ID NO: 3150426 - RNA, 18 nt, Mycobacterium bovis subsp bovis AF2122/97
cgugucccaagccugccg

SEQ ID NO: 3150427 - RNA, 19 nt, Mycobacterium bovis subsp bovis AF2122/97
cgugucccaagccugccga

SEQ ID NO: 3150428 - RNA, 22 nt, Mycobacterium bovis subsp bovis AF2122/97
cguguccgccaaguacugggcc

SEQ ID NO: 3150429 - RNA, 24 nt, Mycobacterium bovis subsp bovis AF2122/97
cguguccgccggauagcaccggca

SEQ ID NO: 3150430 - RNA, 12 nt, Mycobacterium bovis subsp bovis AF2122/97
cguguccgccgu

SEQ ID NO: 3150431 - RNA, 16 nt, Mycobacterium bovis subsp bovis AF2122/97
cgugucgacggucauc

SEQ ID NO: 3150432 - RNA, 19 nt, Mycobacterium bovis subsp bovis AF2122/97
cgugucgacuccgaucggg

SEQ ID NO: 3150433 - RNA, 16 nt, Mycobacterium bovis subsp bovis AF2122/97
cgugucgccgccacca

SEQ ID NO: 3150434 - RNA, 13 nt, Mycobacterium bovis subsp bovis AF2122/97
cgugucgccggcg

SEQ ID NO: 3150435 - RNA, 14 nt, Mycobacterium bovis subsp bovis AF2122/97
cgugucgccggcga

SEQ ID NO: 3150436 - RNA, 15 nt, Mycobacterium bovis subsp bovis AF2122/97
cgugucgccggcgaa

SEQ ID NO: 3150437 - RNA, 15 nt, Mycobacterium bovis subsp bovis AF2122/97
cgugucgcugcggcg

SEQ ID NO: 3150438 - RNA, 16 nt, Mycobacterium bovis subsp bovis AF2122/97
cgugucgcugcggcgc

SEQ ID NO: 3150439 - RNA, 19 nt, Mycobacterium bovis subsp bovis AF2122/97
cgugucgcugcggcgcugg

SEQ ID NO: 3150440 - RNA, 23 nt, Mycobacterium bovis subsp bovis AF2122/97
cgugucggccggccagguguuga

SEQ ID NO: 3150441 - RNA, 16 nt, Mycobacterium bovis subsp bovis AF2122/97
cgugucggugcgcgca

SEQ ID NO: 3150442 - RNA, 19 nt, Mycobacterium bovis subsp bovis AF2122/97
cgugucguaacugcccgcg

SEQ ID NO: 3150443 - RNA, 16 nt, Mycobacterium bovis subsp bovis AF2122/97
cgugucgucgcggccg

SEQ ID NO: 3150444 - RNA, 19 nt, Mycobacterium bovis subsp bovis AF2122/97
cgugucuggcgaacaguga

SEQ ID NO: 3150445 - RNA, 24 nt, Mycobacterium bovis subsp bovis AF2122/97
cgugucuuccaauugauaggcccc

SEQ ID NO: 3150446 - RNA, 17 nt, Mycobacterium bovis subsp bovis AF2122/97
cgugucuugucgcgcag

SEQ ID NO: 3150447 - RNA, 22 nt, Mycobacterium bovis subsp bovis AF2122/97
cgugugaggccuucgccgacua

SEQ ID NO: 3150448 - RNA, 22 nt, Mycobacterium bovis subsp bovis AF2122/97
cgugugagggccggguggccac

SEQ ID NO: 3150449 - RNA, 15 nt, Mycobacterium bovis subsp bovis AF2122/97
cgugugcaccaucau

SEQ ID NO: 3150450 - RNA, 19 nt, Mycobacterium bovis subsp bovis AF2122/97
cgugugcaccaucaucacc

SEQ ID NO: 3150451 - RNA, 20 nt, Mycobacterium bovis subsp bovis AF2122/97
cgugugcaccaucaucaccu

SEQ ID NO: 3150452 - RNA, 21 nt, Mycobacterium bovis subsp bovis AF2122/97
cgugugccacggggcaggucc

SEQ ID NO: 3150453 - RNA, 23 nt, Mycobacterium bovis subsp bovis AF2122/97
cgugugcggaagcaucggcugcg

SEQ ID NO: 3150454 - RNA, 14 nt, Mycobacterium bovis subsp bovis AF2122/97
cgugugcgggcaca

SEQ ID NO: 3150455 - RNA, 22 nt, Mycobacterium bovis subsp bovis AF2122/97
cgugugcucuugcgccacggcg

SEQ ID NO: 3150456 - RNA, 19 nt, Mycobacterium bovis subsp bovis AF2122/97
cgugugcuucgagcaccga

SEQ ID NO: 3150457 - RNA, 19 nt, Mycobacterium bovis subsp bovis AF2122/97
cguguggcacguggcgacc

SEQ ID NO: 3150458 - RNA, 22 nt, Mycobacterium bovis subsp bovis AF2122/97
cguguggcacguggcgaccggc

SEQ ID NO: 3150459 - RNA, 15 nt, Mycobacterium bovis subsp bovis AF2122/97
cguguggcagaugug

SEQ ID NO: 3150460 - RNA, 14 nt, Mycobacterium bovis subsp bovis AF2122/97
cguguggcgcaacc

SEQ ID NO: 3150461 - RNA, 19 nt, Mycobacterium bovis subsp bovis AF2122/97
cguguggguguugucgucg

SEQ ID NO: 3150462 - RNA, 17 nt, Mycobacterium bovis subsp bovis AF2122/97
cguguggucccggcacg

SEQ ID NO: 3150463 - RNA, 16 nt, Mycobacterium bovis subsp bovis AF2122/97
cgugugugcgccuccg

SEQ ID NO: 3150464 - RNA, 13 nt, Mycobacterium bovis subsp bovis AF2122/97
cguguuaaccggg

SEQ ID NO: 3150465 - RNA, 14 nt, Mycobacterium bovis subsp bovis AF2122/97
cguguuaaccgggc

SEQ ID NO: 3150466 - RNA, 22 nt, Mycobacterium bovis subsp bovis AF2122/97
cguguucgaccaucaucucggu

SEQ ID NO: 3150467 - RNA, 20 nt, Mycobacterium bovis subsp bovis AF2122/97
cguguucgauagcggcggcg

SEQ ID NO: 3150468 - RNA, 19 nt, Mycobacterium bovis subsp bovis AF2122/97
cguguucgggggcggucgc

SEQ ID NO: 3150469 - RNA, 20 nt, Mycobacterium bovis subsp bovis AF2122/97
cguguucgucacgggcguug

SEQ ID NO: 3150470 - RNA, 18 nt, Mycobacterium bovis subsp bovis AF2122/97
cguguugcacguacgggc

SEQ ID NO: 3150471 - RNA, 19 nt, Mycobacterium bovis subsp bovis AF2122/97
cguguugcugucgaaguug

SEQ ID NO: 3150472 - RNA, 13 nt, Mycobacterium bovis subsp bovis AF2122/97
cguguuggccggg

SEQ ID NO: 3150473 - RNA, 18 nt, Mycobacterium bovis subsp bovis AF2122/97
cguguuguuagccccgca

SEQ ID NO: 3150474 - RNA, 14 nt, Mycobacterium bovis subsp bovis AF2122/97
cguuaagacggcga

SEQ ID NO: 3150475 - RNA, 18 nt, Mycobacterium bovis subsp bovis AF2122/97
cguuaccaccgucaccgc

SEQ ID NO: 3150476 - RNA, 15 nt, Mycobacterium bovis subsp bovis AF2122/97
cguuaccccaccgga

SEQ ID NO: 3150477 - RNA, 15 nt, Mycobacterium bovis subsp bovis AF2122/97
cguuaccgacgccgg

SEQ ID NO: 3150478 - RNA, 12 nt, Mycobacterium bovis subsp bovis AF2122/97
cguuaccgccaa

SEQ ID NO: 3150479 - RNA, 12 nt, Mycobacterium bovis subsp bovis AF2122/97
cguuaccgccgc

SEQ ID NO: 3150480 - RNA, 14 nt, Mycobacterium bovis subsp bovis AF2122/97
cguuaccgccgcug

SEQ ID NO: 3150481 - RNA, 15 nt, Mycobacterium bovis subsp bovis AF2122/97
cguuaccgccgcugc

SEQ ID NO: 3150482 - RNA, 17 nt, Mycobacterium bovis subsp bovis AF2122/97
cguuaccgccgcugccg

SEQ ID NO: 3150483 - RNA, 18 nt, Mycobacterium bovis subsp bovis AF2122/97
cguuaccgccgcugccga

SEQ ID NO: 3150484 - RNA, 15 nt, Mycobacterium bovis subsp bovis AF2122/97
cguuaccgccguugc

SEQ ID NO: 3150485 - RNA, 15 nt, Mycobacterium bovis subsp bovis AF2122/97
cguuacgccgagcac

SEQ ID NO: 3150486 - RNA, 13 nt, Mycobacterium bovis subsp bovis AF2122/97
cguuacgccgcga

SEQ ID NO: 3150487 - RNA, 22 nt, Mycobacterium bovis subsp bovis AF2122/97
cguuacgccgcgagagccggcg

SEQ ID NO: 3150488 - RNA, 21 nt, Mycobacterium bovis subsp bovis AF2122/97
cguuagaguaggccaccacug

SEQ ID NO: 3150489 - RNA, 21 nt, Mycobacterium bovis subsp bovis AF2122/97
cguuagcauugaguucggcca

SEQ ID NO: 3150490 - RNA, 19 nt, Mycobacterium bovis subsp bovis AF2122/97
cguuagcguagcccgaguu

SEQ ID NO: 3150491 - RNA, 14 nt, Mycobacterium bovis subsp bovis AF2122/97
cguuagggccgcca

SEQ ID NO: 3150492 - RNA, 15 nt, Mycobacterium bovis subsp bovis AF2122/97
cguuagggccgccau

SEQ ID NO: 3150493 - RNA, 17 nt, Mycobacterium bovis subsp bovis AF2122/97
cguuaggucgccggcug

SEQ ID NO: 3150494 - RNA, 17 nt, Mycobacterium bovis subsp bovis AF2122/97
cguuaucgaccgccgcg

SEQ ID NO: 3150495 - RNA, 21 nt, Mycobacterium bovis subsp bovis AF2122/97
cguuaucgucggcuugcugcc

SEQ ID NO: 3150496 - RNA, 16 nt, Mycobacterium bovis subsp bovis AF2122/97
cguuaugcgccgccca

SEQ ID NO: 3150497 - RNA, 18 nt, Mycobacterium bovis subsp bovis AF2122/97
cguucaacaccgccgacc

SEQ ID NO: 3150498 - RNA, 15 nt, Mycobacterium bovis subsp bovis AF2122/97
cguucaaccggacgc

SEQ ID NO: 3150499 - RNA, 14 nt, Mycobacterium bovis subsp bovis AF2122/97
cguucaacgacggc

SEQ ID NO: 3150500 - RNA, 13 nt, Mycobacterium bovis subsp bovis AF2122/97
cguucaaggucuc

SEQ ID NO: 3150501 - RNA, 22 nt, Mycobacterium bovis subsp bovis AF2122/97
cguucaaugucguugcccgcga

SEQ ID NO: 3150502 - RNA, 22 nt, Mycobacterium bovis subsp bovis AF2122/97
cguucaccacgaucgcgagccc

SEQ ID NO: 3150503 - RNA, 19 nt, Mycobacterium bovis subsp bovis AF2122/97
cguucaccgcgcgcucgcc

SEQ ID NO: 3150504 - RNA, 22 nt, Mycobacterium bovis subsp bovis AF2122/97
cguucaccgcgcgcucgcccag

SEQ ID NO: 3150505 - RNA, 20 nt, Mycobacterium bovis subsp bovis AF2122/97
cguucaccgucugcggaccg

SEQ ID NO: 3150506 - RNA, 23 nt, Mycobacterium bovis subsp bovis AF2122/97
cguucacgccagucccacugggc

SEQ ID NO: 3150507 - RNA, 21 nt, Mycobacterium bovis subsp bovis AF2122/97
cguucucgauugucgccgcgc

SEQ ID NO: 3150508 - RNA, 22 nt, Mycobacterium bovis subsp bovis AF2122/97
cguucucgcccacccgcugcga

SEQ ID NO: 3150509 - RNA, 16 nt, Mycobacterium bovis subsp bovis AF2122/97
cguucucggcacccuc

SEQ ID NO: 3150510 - RNA, 20 nt, Mycobacterium bovis subsp bovis AF2122/97
cguucucggcacccucagcg

SEQ ID NO: 3150511 - RNA, 15 nt, Mycobacterium bovis subsp bovis AF2122/97
cguucugcccaggca

SEQ ID NO: 3150512 - RNA, 22 nt, Mycobacterium bovis subsp bovis AF2122/97
cguucugcccaggcaaaccgau

SEQ ID NO: 3150513 - RNA, 13 nt, Mycobacterium bovis subsp bovis AF2122/97
cguucugcgcccg

SEQ ID NO: 3150514 - RNA, 20 nt, Mycobacterium bovis subsp bovis AF2122/97
cguucugucccggcgcgcca

SEQ ID NO: 3150515 - RNA, 17 nt, Mycobacterium bovis subsp bovis AF2122/97
cguucuugcggguuuuc

SEQ ID NO: 3150516 - RNA, 17 nt, Mycobacterium bovis subsp bovis AF2122/97
cguucuugggaccgacu

SEQ ID NO: 3150517 - RNA, 17 nt, Mycobacterium bovis subsp bovis AF2122/97
cguugaacggcaccagc

SEQ ID NO: 3150518 - RNA, 13 nt, Mycobacterium bovis subsp bovis AF2122/97
cguugaacucgag

SEQ ID NO: 3150519 - RNA, 15 nt, Mycobacterium bovis subsp bovis AF2122/97
cguugaacugugcgg

SEQ ID NO: 3150520 - RNA, 22 nt, Mycobacterium bovis subsp bovis AF2122/97
cguugaacugugcggcagcccc

SEQ ID NO: 3150521 - RNA, 17 nt, Mycobacterium bovis subsp bovis AF2122/97
cguugaagcccaacagc

SEQ ID NO: 3150522 - RNA, 14 nt, Mycobacterium bovis subsp bovis AF2122/97
cguugaaggcgccg

SEQ ID NO: 3150523 - RNA, 15 nt, Mycobacterium bovis subsp bovis AF2122/97
cguugaagucgccgg

SEQ ID NO: 3150524 - RNA, 21 nt, Mycobacterium bovis subsp bovis AF2122/97
cguugaccagaaccuggagcc

SEQ ID NO: 3150525 - RNA, 19 nt, Mycobacterium bovis subsp bovis AF2122/97
cguugacccagaccggcuc

SEQ ID NO: 3150526 - RNA, 20 nt, Mycobacterium bovis subsp bovis AF2122/97
cguugaccgaacgcacgucg

SEQ ID NO: 3150527 - RNA, 21 nt, Mycobacterium bovis subsp bovis AF2122/97
cguugaccgcaucgucgagcc

SEQ ID NO: 3150528 - RNA, 23 nt, Mycobacterium bovis subsp bovis AF2122/97
cguugaccgcaucgucgagccac

SEQ ID NO: 3150529 - RNA, 12 nt, Mycobacterium bovis subsp bovis AF2122/97
cguugaccgcgg

SEQ ID NO: 3150530 - RNA, 15 nt, Mycobacterium bovis subsp bovis AF2122/97
cguugaccgggucgc

SEQ ID NO: 3150531 - RNA, 21 nt, Mycobacterium bovis subsp bovis AF2122/97
cguugaccgggucgccgauga

SEQ ID NO: 3150532 - RNA, 23 nt, Mycobacterium bovis subsp bovis AF2122/97
cguugaccgugauaucagagggc

SEQ ID NO: 3150533 - RNA, 19 nt, Mycobacterium bovis subsp bovis AF2122/97
cguugacgaacaccucggg

SEQ ID NO: 3150534 - RNA, 21 nt, Mycobacterium bovis subsp bovis AF2122/97
cguugacgccguugccaccgu

SEQ ID NO: 3150535 - RNA, 21 nt, Mycobacterium bovis subsp bovis AF2122/97
cguugacggcgaacccgccga

SEQ ID NO: 3150536 - RNA, 23 nt, Mycobacterium bovis subsp bovis AF2122/97
cguugacggcgaacccgccgaug

SEQ ID NO: 3150537 - RNA, 23 nt, Mycobacterium bovis subsp bovis AF2122/97
cguugacggugucuugccaccac

SEQ ID NO: 3150538 - RNA, 12 nt, Mycobacterium bovis subsp bovis AF2122/97
cguugacgucaa

SEQ ID NO: 3150539 - RNA, 18 nt, Mycobacterium bovis subsp bovis AF2122/97
cguugacguccaacagcg

SEQ ID NO: 3150540 - RNA, 18 nt, Mycobacterium bovis subsp bovis AF2122/97
cguugacgucgagcagcg

SEQ ID NO: 3150541 - RNA, 18 nt, Mycobacterium bovis subsp bovis AF2122/97
cguugacgucggucaucg

SEQ ID NO: 3150542 - RNA, 19 nt, Mycobacterium bovis subsp bovis AF2122/97
cguugacucugcguccacc

SEQ ID NO: 3150543 - RNA, 20 nt, Mycobacterium bovis subsp bovis AF2122/97
cguugacucugcguccacca

SEQ ID NO: 3150544 - RNA, 23 nt, Mycobacterium bovis subsp bovis AF2122/97
cguugagcaagugggugccggca

SEQ ID NO: 3150545 - RNA, 13 nt, Mycobacterium bovis subsp bovis AF2122/97
cguugagcagcac

SEQ ID NO: 3150546 - RNA, 16 nt, Mycobacterium bovis subsp bovis AF2122/97
cguugagcagcaccca

SEQ ID NO: 3150547 - RNA, 11 nt, Mycobacterium bovis subsp bovis AF2122/97
cguugaggccg

SEQ ID NO: 3150548 - RNA, 21 nt, Mycobacterium bovis subsp bovis AF2122/97
cguugagguucuucugcgcca

SEQ ID NO: 3150549 - RNA, 22 nt, Mycobacterium bovis subsp bovis AF2122/97
cguugagguucuucugcgccac

SEQ ID NO: 3150550 - RNA, 20 nt, Mycobacterium bovis subsp bovis AF2122/97
cguugaguggaugcgccgca

SEQ ID NO: 3150551 - RNA, 17 nt, Mycobacterium bovis subsp bovis AF2122/97
cguugauacgcgucgau

SEQ ID NO: 3150552 - RNA, 22 nt, Mycobacterium bovis subsp bovis AF2122/97
cguugaucaagaaggccagcgc

SEQ ID NO: 3150553 - RNA, 16 nt, Mycobacterium bovis subsp bovis AF2122/97
cguugauccccagcuc

SEQ ID NO: 3150554 - RNA, 22 nt, Mycobacterium bovis subsp bovis AF2122/97
cguugaugaccaggucggucag

SEQ ID NO: 3150555 - RNA, 16 nt, Mycobacterium bovis subsp bovis AF2122/97
cguugaugaccgccgc

SEQ ID NO: 3150556 - RNA, 20 nt, Mycobacterium bovis subsp bovis AF2122/97
cguugaugaugccggcguug

SEQ ID NO: 3150557 - RNA, 24 nt, Mycobacterium bovis subsp bovis AF2122/97
cguugaugccgccggagucgaaca

SEQ ID NO: 3150558 - RNA, 16 nt, Mycobacterium bovis subsp bovis AF2122/97
cguugaugucggcagg

SEQ ID NO: 3150559 - RNA, 18 nt, Mycobacterium bovis subsp bovis AF2122/97
cguugauucggccgccga

SEQ ID NO: 3150560 - RNA, 15 nt, Mycobacterium bovis subsp bovis AF2122/97
cguugcacagcuugg

SEQ ID NO: 3150561 - RNA, 15 nt, Mycobacterium bovis subsp bovis AF2122/97
cguugcagccggcau

SEQ ID NO: 3150562 - RNA, 20 nt, Mycobacterium bovis subsp bovis AF2122/97
cguugcaggugaacaacagc

SEQ ID NO: 3150563 - RNA, 15 nt, Mycobacterium bovis subsp bovis AF2122/97
cguugcaucagcacg

SEQ ID NO: 3150564 - RNA, 20 nt, Mycobacterium bovis subsp bovis AF2122/97
cguugccaacaacaucagcg

SEQ ID NO: 3150565 - RNA, 20 nt, Mycobacterium bovis subsp bovis AF2122/97
cguugccaccggugccggcg

SEQ ID NO: 3150566 - RNA, 22 nt, Mycobacterium bovis subsp bovis AF2122/97
cguugccaccggugccggcgac

SEQ ID NO: 3150567 - RNA, 12 nt, Mycobacterium bovis subsp bovis AF2122/97
cguugccaccgu

SEQ ID NO: 3150568 - RNA, 18 nt, Mycobacterium bovis subsp bovis AF2122/97
cguugccaccguugccgc

SEQ ID NO: 3150569 - RNA, 21 nt, Mycobacterium bovis subsp bovis AF2122/97
cguugccaccguugccgccgu

SEQ ID NO: 3150570 - RNA, 13 nt, Mycobacterium bovis subsp bovis AF2122/97
cguugccauugcc

SEQ ID NO: 3150571 - RNA, 16 nt, Mycobacterium bovis subsp bovis AF2122/97
cguugcccccauugcc

SEQ ID NO: 3150572 - RNA, 20 nt, Mycobacterium bovis subsp bovis AF2122/97
cguugcccgacccgccgacg

SEQ ID NO: 3150573 - RNA, 13 nt, Mycobacterium bovis subsp bovis AF2122/97
cguugccgaacgu

SEQ ID NO: 3150574 - RNA, 22 nt, Mycobacterium bovis subsp bovis AF2122/97
cguugccgaacgucgcggccag

SEQ ID NO: 3150575 - RNA, 22 nt, Mycobacterium bovis subsp bovis AF2122/97
cguugccgaccgauacaccgac

SEQ ID NO: 3150576 - RNA, 23 nt, Mycobacterium bovis subsp bovis AF2122/97
cguugccgaccgauacaccgacg

SEQ ID NO: 3150577 - RNA, 14 nt, Mycobacterium bovis subsp bovis AF2122/97
cguugccgaucacc

SEQ ID NO: 3150578 - RNA, 20 nt, Mycobacterium bovis subsp bovis AF2122/97
cguugccgaucagcccggcc

SEQ ID NO: 3150579 - RNA, 21 nt, Mycobacterium bovis subsp bovis AF2122/97
cguugccgaucgcuccggccc

SEQ ID NO: 3150580 - RNA, 22 nt, Mycobacterium bovis subsp bovis AF2122/97
cguugccgaucgcuccggcccu

SEQ ID NO: 3150581 - RNA, 18 nt, Mycobacterium bovis subsp bovis AF2122/97
cguugccgauggugaugg

SEQ ID NO: 3150582 - RNA, 15 nt, Mycobacterium bovis subsp bovis AF2122/97
cguugccgccaucac

SEQ ID NO: 3150583 - RNA, 18 nt, Mycobacterium bovis subsp bovis AF2122/97
cguugccgccaucaccgc

SEQ ID NO: 3150584 - RNA, 23 nt, Mycobacterium bovis subsp bovis AF2122/97
cguugccgccaucaccgccguua

SEQ ID NO: 3150585 - RNA, 14 nt, Mycobacterium bovis subsp bovis AF2122/97
cguugccgcccacu

SEQ ID NO: 3150586 - RNA, 19 nt, Mycobacterium bovis subsp bovis AF2122/97
cguugccgcccacuagcag

SEQ ID NO: 3150587 - RNA, 12 nt, Mycobacterium bovis subsp bovis AF2122/97
cguugccgccga

SEQ ID NO: 3150588 - RNA, 18 nt, Mycobacterium bovis subsp bovis AF2122/97
cguugccgccgaagccga

SEQ ID NO: 3150589 - RNA, 18 nt, Mycobacterium bovis subsp bovis AF2122/97
cguugccgccgccuccgc

SEQ ID NO: 3150590 - RNA, 12 nt, Mycobacterium bovis subsp bovis AF2122/97
cguugccgccgg

SEQ ID NO: 3150591 - RNA, 18 nt, Mycobacterium bovis subsp bovis AF2122/97
cguugccgccggcgccgc

SEQ ID NO: 3150592 - RNA, 12 nt, Mycobacterium bovis subsp bovis AF2122/97
cguugccgccgu

SEQ ID NO: 3150593 - RNA, 19 nt, Mycobacterium bovis subsp bovis AF2122/97
cguugggaucccagcgcag

SEQ ID NO: 3150594 - RNA, 21 nt, Mycobacterium bovis subsp bovis AF2122/97
cguugggaucccagcgcagcg

SEQ ID NO: 3150595 - RNA, 22 nt, Mycobacterium bovis subsp bovis AF2122/97
cguugggaucccagcgcagcgg

SEQ ID NO: 3150596 - RNA, 18 nt, Mycobacterium bovis subsp bovis AF2122/97
cguugggaucgcgcagcg

SEQ ID NO: 3150597 - RNA, 19 nt, Mycobacterium bovis subsp bovis AF2122/97
cguugggaucgcgcagcgc

SEQ ID NO: 3150598 - RNA, 21 nt, Mycobacterium bovis subsp bovis AF2122/97
cguugggcaugucgccgaacg

SEQ ID NO: 3150599 - RNA, 17 nt, Mycobacterium bovis subsp bovis AF2122/97
cguugggccaccggcgc

SEQ ID NO: 3150600 - RNA, 18 nt, Mycobacterium bovis subsp bovis AF2122/97
cguugggccaccggcgcc

SEQ ID NO: 3150601 - RNA, 21 nt, Mycobacterium bovis subsp bovis AF2122/97
cguugggcgggauggccgccg

SEQ ID NO: 3150602 - RNA, 23 nt, Mycobacterium bovis subsp bovis AF2122/97
cguugggcgggauggccgccgac

SEQ ID NO: 3150603 - RNA, 21 nt, Mycobacterium bovis subsp bovis AF2122/97
cguuggggccguucaaccgga

SEQ ID NO: 3150604 - RNA, 16 nt, Mycobacterium bovis subsp bovis AF2122/97
cguugguagccagggc

SEQ ID NO: 3150605 - RNA, 22 nt, Mycobacterium bovis subsp bovis AF2122/97
cguugguagccggugaccgcga

SEQ ID NO: 3150606 - RNA, 21 nt, Mycobacterium bovis subsp bovis AF2122/97
cguuggucagcguggacgccc

SEQ ID NO: 3150607 - RNA, 23 nt, Mycobacterium bovis subsp bovis AF2122/97
cguugguccgcugcagcaccgca

SEQ ID NO: 3150608 - RNA, 18 nt, Mycobacterium bovis subsp bovis AF2122/97
cguuggugaggccccccg

SEQ ID NO: 3150609 - RNA, 14 nt, Mycobacterium bovis subsp bovis AF2122/97
cguugguggucggc

SEQ ID NO: 3150610 - RNA, 13 nt, Mycobacterium bovis subsp bovis AF2122/97
cguuguagacggc

SEQ ID NO: 3150611 - RNA, 17 nt, Mycobacterium bovis subsp bovis AF2122/97
cguuguagacggcggca

SEQ ID NO: 3150612 - RNA, 18 nt, Mycobacterium bovis subsp bovis AF2122/97
cguuguaguccugcgggc

SEQ ID NO: 3150613 - RNA, 20 nt, Mycobacterium bovis subsp bovis AF2122/97
cguuguaguugcccacguug

SEQ ID NO: 3150614 - RNA, 20 nt, Mycobacterium bovis subsp bovis AF2122/97
cguuguaugcguuacgccgc

SEQ ID NO: 3150615 - RNA, 21 nt, Mycobacterium bovis subsp bovis AF2122/97
cguuguaugcguuacgccgcg

SEQ ID NO: 3150616 - RNA, 22 nt, Mycobacterium bovis subsp bovis AF2122/97
cguugucagcgaacggccagga

SEQ ID NO: 3150617 - RNA, 13 nt, Mycobacterium bovis subsp bovis AF2122/97
cguuguccaccgc

SEQ ID NO: 3150618 - RNA, 16 nt, Mycobacterium bovis subsp bovis AF2122/97
cguuguccagaacggc

SEQ ID NO: 3150619 - RNA, 15 nt, Mycobacterium bovis subsp bovis AF2122/97
cguuguccagcgcga

SEQ ID NO: 3150620 - RNA, 18 nt, Mycobacterium bovis subsp bovis AF2122/97
cguugucgaccuccucga

SEQ ID NO: 3150621 - RNA, 17 nt, Mycobacterium bovis subsp bovis AF2122/97
cguugucgcccacccac

SEQ ID NO: 3150622 - RNA, 16 nt, Mycobacterium bovis subsp bovis AF2122/97
cguugucggcuggacg

SEQ ID NO: 3150623 - RNA, 19 nt, Mycobacterium bovis subsp bovis AF2122/97
cguugucgggcaacacgau

SEQ ID NO: 3150624 - RNA, 14 nt, Mycobacterium bovis subsp bovis AF2122/97
cguugugauccggu

SEQ ID NO: 3150625 - RNA, 15 nt, Mycobacterium bovis subsp bovis AF2122/97
cguugugcagcgcgu

SEQ ID NO: 3150626 - RNA, 18 nt, Mycobacterium bovis subsp bovis AF2122/97
cguugugcccgccggccc

SEQ ID NO: 3150627 - RNA, 21 nt, Mycobacterium bovis subsp bovis AF2122/97
cguugugcgccuugaccacag

SEQ ID NO: 3150628 - RNA, 18 nt, Mycobacterium bovis subsp bovis AF2122/97
cguugugugccagcgugg

SEQ ID NO: 3150629 - RNA, 18 nt, Mycobacterium bovis subsp bovis AF2122/97
cguuguucaccgacgcga

SEQ ID NO: 3150630 - RNA, 13 nt, Mycobacterium bovis subsp bovis AF2122/97
cguuguugaggau

SEQ ID NO: 3150631 - RNA, 21 nt, Mycobacterium bovis subsp bovis AF2122/97
cguuguuggauccggccacca

SEQ ID NO: 3150632 - RNA, 12 nt, Mycobacterium bovis subsp bovis AF2122/97
cguuguugucgc

SEQ ID NO: 3150633 - RNA, 20 nt, Mycobacterium bovis subsp bovis AF2122/97
cguuuacauagaccaccggc

SEQ ID NO: 3150634 - RNA, 19 nt, Mycobacterium bovis subsp bovis AF2122/97
cguuuacggcccggcaccc

SEQ ID NO: 3150635 - RNA, 15 nt, Mycobacterium bovis subsp bovis AF2122/97
cguuuagucuccggc

SEQ ID NO: 3150636 - RNA, 22 nt, Mycobacterium bovis subsp bovis AF2122/97
cguuucccggguccuggaucag

SEQ ID NO: 3150637 - RNA, 19 nt, Mycobacterium bovis subsp bovis AF2122/97
cguuucccuggccgccgcc

SEQ ID NO: 3150638 - RNA, 13 nt, Mycobacterium bovis subsp bovis AF2122/97
cguuuccgccgcc

SEQ ID NO: 3150639 - RNA, 19 nt, Mycobacterium bovis subsp bovis AF2122/97
cguuuccucagcugcucgu

SEQ ID NO: 3150640 - RNA, 20 nt, Mycobacterium bovis subsp bovis AF2122/97
cguuuccucagcugcucguc

SEQ ID NO: 3150641 - RNA, 21 nt, Mycobacterium bovis subsp bovis AF2122/97
cguuucgccagccggccgcga

SEQ ID NO: 3150642 - RNA, 16 nt, Mycobacterium bovis subsp bovis AF2122/97
cguuucgccggcgcgc

SEQ ID NO: 3150643 - RNA, 23 nt, Mycobacterium bovis subsp bovis AF2122/97
cguuucgcgaugugcgccaccuc

SEQ ID NO: 3150644 - RNA, 12 nt, Mycobacterium bovis subsp bovis AF2122/97
cguuucgcuguc

SEQ ID NO: 3150645 - RNA, 12 nt, Mycobacterium bovis subsp bovis AF2122/97
cguuucggcgcc

SEQ ID NO: 3150646 - RNA, 17 nt, Mycobacterium bovis subsp bovis AF2122/97
cguuucuccgccgccca

SEQ ID NO: 3150647 - RNA, 14 nt, Mycobacterium bovis subsp bovis AF2122/97
cguuugccggccga

SEQ ID NO: 3150648 - RNA, 15 nt, Mycobacterium bovis subsp bovis AF2122/97
cguuugcgaagccca

SEQ ID NO: 3150649 - RNA, 16 nt, Mycobacterium bovis subsp bovis AF2122/97
cguuugcgaagcccac

SEQ ID NO: 3150650 - RNA, 20 nt, Mycobacterium bovis subsp bovis AF2122/97
cguuugcgccguugcccccg

SEQ ID NO: 3150651 - RNA, 18 nt, Mycobacterium bovis subsp bovis AF2122/97
cguuuggcagagccgacu

SEQ ID NO: 3150652 - RNA, 13 nt, Mycobacterium bovis subsp bovis AF2122/97
cguuuggcugccg

SEQ ID NO: 3150653 - RNA, 14 nt, Mycobacterium bovis subsp bovis AF2122/97
cguuugggucaucg

SEQ ID NO: 3150654 - RNA, 18 nt, Mycobacterium bovis subsp bovis AF2122/97
cguuuggugugauacagc

SEQ ID NO: 3150655 - RNA, 17 nt, Mycobacterium bovis subsp bovis AF2122/97
cguuugguuuucccggc

SEQ ID NO: 3150656 - RNA, 22 nt, Mycobacterium bovis subsp bovis AF2122/97
cguuuguguugaacgcguagag

SEQ ID NO: 3150657 - RNA, 14 nt, Mycobacterium bovis subsp bovis AF2122/97
cguuuuccagccga

SEQ ID NO: 3150658 - RNA, 16 nt, Mycobacterium bovis subsp bovis AF2122/97
cguuuuccugaucgcg

SEQ ID NO: 3150659 - RNA, 20 nt, Mycobacterium bovis subsp bovis AF2122/97
cguuuuccugaucgcgcaga

SEQ ID NO: 3150660 - RNA, 16 nt, Mycobacterium bovis subsp bovis AF2122/97
cguuuucgucacccca

SEQ ID NO: 3150661 - RNA, 14 nt, Mycobacterium bovis subsp bovis AF2122/97
cguuuugcggcccg

SEQ ID NO: 3150662 - RNA, 15 nt, Mycobacterium bovis subsp bovis AF2122/97
cuaaacaggccgcca

SEQ ID NO: 3150663 - RNA, 18 nt, Mycobacterium bovis subsp bovis AF2122/97
cuaaacaggccgccaccg

SEQ ID NO: 3150664 - RNA, 16 nt, Mycobacterium bovis subsp bovis AF2122/97
cuaaacuccgugccga

SEQ ID NO: 3150665 - RNA, 22 nt, Mycobacterium bovis subsp bovis AF2122/97
cuaaagcgugucgaugcgggcu

SEQ ID NO: 3150666 - RNA, 20 nt, Mycobacterium bovis subsp bovis AF2122/97
cuaaagcgugucgcccuguu

SEQ ID NO: 3150667 - RNA, 14 nt, Mycobacterium bovis subsp bovis AF2122/97
cuaacaacaccacc

SEQ ID NO: 3150668 - RNA, 16 nt, Mycobacterium bovis subsp bovis AF2122/97
cuaacaacaccaccag

SEQ ID NO: 3150669 - RNA, 14 nt, Mycobacterium bovis subsp bovis AF2122/97
cuaacccgcaccgg

SEQ ID NO: 3150670 - RNA, 15 nt, Mycobacterium bovis subsp bovis AF2122/97
cuaacccgcaccgga

SEQ ID NO: 3150671 - RNA, 20 nt, Mycobacterium bovis subsp bovis AF2122/97
cuaacccgcaccuacccugc

SEQ ID NO: 3150672 - RNA, 15 nt, Mycobacterium bovis subsp bovis AF2122/97
cuaacccgcgccggc

SEQ ID NO: 3150673 - RNA, 19 nt, Mycobacterium bovis subsp bovis AF2122/97
cuaacgcaccugcgcgcgg

SEQ ID NO: 3150674 - RNA, 16 nt, Mycobacterium bovis subsp bovis AF2122/97
cuaacggcagccaccg

SEQ ID NO: 3150675 - RNA, 17 nt, Mycobacterium bovis subsp bovis AF2122/97
cuaacggcagccaccgu

SEQ ID NO: 3150676 - RNA, 14 nt, Mycobacterium bovis subsp bovis AF2122/97
cuaacggucagcuu

SEQ ID NO: 3150677 - RNA, 20 nt, Mycobacterium bovis subsp bovis AF2122/97
cuaacgucgaucucggcgca

SEQ ID NO: 3150678 - RNA, 22 nt, Mycobacterium bovis subsp bovis AF2122/97
cuaacucgacccguaauugguu

SEQ ID NO: 3150679 - RNA, 20 nt, Mycobacterium bovis subsp bovis AF2122/97
cuacuaggccccuggccgcc

SEQ ID NO: 3150680 - RNA, 23 nt, Mycobacterium bovis subsp bovis AF2122/97
cuacucauccagaagccggccac

SEQ ID NO: 3150681 - RNA, 19 nt, Mycobacterium bovis subsp bovis AF2122/97
cuacuccaacugaucccgu

SEQ ID NO: 3150682 - RNA, 14 nt, Mycobacterium bovis subsp bovis AF2122/97
cuacucccccgcga

SEQ ID NO: 3150683 - RNA, 15 nt, Mycobacterium bovis subsp bovis AF2122/97
cuacuccggucccgc

SEQ ID NO: 3150684 - RNA, 16 nt, Mycobacterium bovis subsp bovis AF2122/97
cuacucgaaacccaug

SEQ ID NO: 3150685 - RNA, 12 nt, Mycobacterium bovis subsp bovis AF2122/97
cuacucgcggcc

SEQ ID NO: 3150686 - RNA, 15 nt, Mycobacterium bovis subsp bovis AF2122/97
cuacucgcggccggc

SEQ ID NO: 3150687 - RNA, 20 nt, Mycobacterium bovis subsp bovis AF2122/97
cuacucgcggccggcgucgg

SEQ ID NO: 3150688 - RNA, 17 nt, Mycobacterium bovis subsp bovis AF2122/97
cuacucuguuuuuggug

SEQ ID NO: 3150689 - RNA, 18 nt, Mycobacterium bovis subsp bovis AF2122/97
cuacugauagacccuggg

SEQ ID NO: 3150690 - RNA, 13 nt, Mycobacterium bovis subsp bovis AF2122/97
cuacugcgaucgc

SEQ ID NO: 3150691 - RNA, 15 nt, Mycobacterium bovis subsp bovis AF2122/97
cuacuuuuccacccg

SEQ ID NO: 3150692 - RNA, 17 nt, Mycobacterium bovis subsp bovis AF2122/97
cuagaccgggcgguugg

SEQ ID NO: 3150693 - RNA, 19 nt, Mycobacterium bovis subsp bovis AF2122/97
cuagacgccgccgcugccg

SEQ ID NO: 3150694 - RNA, 20 nt, Mycobacterium bovis subsp bovis AF2122/97
cuagacgccgccgcugccgc

SEQ ID NO: 3150695 - RNA, 13 nt, Mycobacterium bovis subsp bovis AF2122/97
cuagcaccgcgcc

SEQ ID NO: 3150696 - RNA, 16 nt, Mycobacterium bovis subsp bovis AF2122/97
cuagcagagacaugcc

SEQ ID NO: 3150697 - RNA, 20 nt, Mycobacterium bovis subsp bovis AF2122/97
cuagcagagacaugccggcg

SEQ ID NO: 3150698 - RNA, 15 nt, Mycobacterium bovis subsp bovis AF2122/97
cuagcagcgggcugc

SEQ ID NO: 3150699 - RNA, 21 nt, Mycobacterium bovis subsp bovis AF2122/97
cuagcagggugccggcgccgc

SEQ ID NO: 3150700 - RNA, 20 nt, Mycobacterium bovis subsp bovis AF2122/97
cuagccaccaggcggucagg

SEQ ID NO: 3150701 - RNA, 22 nt, Mycobacterium bovis subsp bovis AF2122/97
cuagccaccaggcggucagguc

SEQ ID NO: 3150702 - RNA, 23 nt, Mycobacterium bovis subsp bovis AF2122/97
cuagccagggaucagccgugcgg

SEQ ID NO: 3150703 - RNA, 13 nt, Mycobacterium bovis subsp bovis AF2122/97
cuagcccaccacu

SEQ ID NO: 3150704 - RNA, 17 nt, Mycobacterium bovis subsp bovis AF2122/97
cuagcccgaccggucca

SEQ ID NO: 3150705 - RNA, 14 nt, Mycobacterium bovis subsp bovis AF2122/97
cuagcccggcagca

SEQ ID NO: 3150706 - RNA, 16 nt, Mycobacterium bovis subsp bovis AF2122/97
cuagcccggcagcacg

SEQ ID NO: 3150707 - RNA, 23 nt, Mycobacterium bovis subsp bovis AF2122/97
cuagcccgguaucgucccggcga

SEQ ID NO: 3150708 - RNA, 17 nt, Mycobacterium bovis subsp bovis AF2122/97
cuagcccucagcuagcg

SEQ ID NO: 3150709 - RNA, 19 nt, Mycobacterium bovis subsp bovis AF2122/97
cuagccgacagcucaucga

SEQ ID NO: 3150710 - RNA, 17 nt, Mycobacterium bovis subsp bovis AF2122/97
cuagccgauccagcagg

SEQ ID NO: 3150711 - RNA, 13 nt, Mycobacterium bovis subsp bovis AF2122/97
cuagccgauggcu

SEQ ID NO: 3150712 - RNA, 14 nt, Mycobacterium bovis subsp bovis AF2122/97
cuagccgcggcacc

SEQ ID NO: 3150713 - RNA, 19 nt, Mycobacterium bovis subsp bovis AF2122/97
cuagccgcggcaccgccga

SEQ ID NO: 3150714 - RNA, 20 nt, Mycobacterium bovis subsp bovis AF2122/97
cuagccgcggcaccgccgag

SEQ ID NO: 3150715 - RNA, 22 nt, Mycobacterium bovis subsp bovis AF2122/97
cuagccgcggcaccgccgagca

SEQ ID NO: 3150716 - RNA, 22 nt, Mycobacterium bovis subsp bovis AF2122/97
cuagccggcgcgccccaccgcg

SEQ ID NO: 3150717 - RNA, 16 nt, Mycobacterium bovis subsp bovis AF2122/97
cuagccgggcgcgccg

SEQ ID NO: 3150718 - RNA, 19 nt, Mycobacterium bovis subsp bovis AF2122/97
cuagccgggcgcgccggcc

SEQ ID NO: 3150719 - RNA, 17 nt, Mycobacterium bovis subsp bovis AF2122/97
cuagccguucggcugcc

SEQ ID NO: 3150720 - RNA, 23 nt, Mycobacterium bovis subsp bovis AF2122/97
cuagccguucggcugccgcgcgc

SEQ ID NO: 3150721 - RNA, 17 nt, Mycobacterium bovis subsp bovis AF2122/97
cuagcgagccggcgccg

SEQ ID NO: 3150722 - RNA, 19 nt, Mycobacterium bovis subsp bovis AF2122/97
cuagcgagcgcacaccggc

SEQ ID NO: 3150723 - RNA, 16 nt, Mycobacterium bovis subsp bovis AF2122/97
cuagcgccaaauccgg

SEQ ID NO: 3150724 - RNA, 21 nt, Mycobacterium bovis subsp bovis AF2122/97
cuagcgccucgccggccaccc

SEQ ID NO: 3150725 - RNA, 17 nt, Mycobacterium bovis subsp bovis AF2122/97
cuagcgcgggcucggug

SEQ ID NO: 3150726 - RNA, 18 nt, Mycobacterium bovis subsp bovis AF2122/97
cuagcgcuauaggccgca

SEQ ID NO: 3150727 - RNA, 20 nt, Mycobacterium bovis subsp bovis AF2122/97
cuagcgcuugcgaccccggc

SEQ ID NO: 3150728 - RNA, 17 nt, Mycobacterium bovis subsp bovis AF2122/97
cuagcggcucaccgcgc

SEQ ID NO: 3150729 - RNA, 18 nt, Mycobacterium bovis subsp bovis AF2122/97
cuagcggucgcuugcugu

SEQ ID NO: 3150730 - RNA, 21 nt, Mycobacterium bovis subsp bovis AF2122/97
cuagcgguggaaaaagcccga

SEQ ID NO: 3150731 - RNA, 17 nt, Mycobacterium bovis subsp bovis AF2122/97
cuagcuuggcggccagc

SEQ ID NO: 3150732 - RNA, 20 nt, Mycobacterium bovis subsp bovis AF2122/97
cuagcuuggcggccagcgug

SEQ ID NO: 3150733 - RNA, 13 nt, Mycobacterium bovis subsp bovis AF2122/97
cuaggaacgccac

SEQ ID NO: 3150734 - RNA, 15 nt, Mycobacterium bovis subsp bovis AF2122/97
cuaggaccaccagcg

SEQ ID NO: 3150735 - RNA, 21 nt, Mycobacterium bovis subsp bovis AF2122/97
cuaggaccaccagcgcuccag

SEQ ID NO: 3150736 - RNA, 22 nt, Mycobacterium bovis subsp bovis AF2122/97
cuaggaccaccagcgcuccagc

SEQ ID NO: 3150737 - RNA, 14 nt, Mycobacterium bovis subsp bovis AF2122/97
cuaggacggcgcga

SEQ ID NO: 3150738 - RNA, 18 nt, Mycobacterium bovis subsp bovis AF2122/97
cuaggacggcgcgagccg

SEQ ID NO: 3150739 - RNA, 19 nt, Mycobacterium bovis subsp bovis AF2122/97
cuaggacggcgcgagccgc

SEQ ID NO: 3150740 - RNA, 20 nt, Mycobacterium bovis subsp bovis AF2122/97
cuaggcaccagcggaucgca

SEQ ID NO: 3150741 - RNA, 13 nt, Mycobacterium bovis subsp bovis AF2122/97
cuaggcaugccac

SEQ ID NO: 3150742 - RNA, 17 nt, Mycobacterium bovis subsp bovis AF2122/97
cuaggcaugccacacac

SEQ ID NO: 3150743 - RNA, 20 nt, Mycobacterium bovis subsp bovis AF2122/97
cuaggccaaaccccugcacg

SEQ ID NO: 3150744 - RNA, 12 nt, Mycobacterium bovis subsp bovis AF2122/97
cuaggccaagcc

SEQ ID NO: 3150745 - RNA, 19 nt, Mycobacterium bovis subsp bovis AF2122/97
cuaggccaccggcgaccga

SEQ ID NO: 3150746 - RNA, 13 nt, Mycobacterium bovis subsp bovis AF2122/97
cuaggccagcacg

SEQ ID NO: 3150747 - RNA, 14 nt, Mycobacterium bovis subsp bovis AF2122/97
cuaggccagcacgg

SEQ ID NO: 3150748 - RNA, 14 nt, Mycobacterium bovis subsp bovis AF2122/97
cuaggcccagcacg

SEQ ID NO: 3150749 - RNA, 15 nt, Mycobacterium bovis subsp bovis AF2122/97
cuaggcccagcacgg

SEQ ID NO: 3150750 - RNA, 18 nt, Mycobacterium bovis subsp bovis AF2122/97
cuaggccccuggccgccg

SEQ ID NO: 3150751 - RNA, 20 nt, Mycobacterium bovis subsp bovis AF2122/97
cuaggccccuggccgccgca

SEQ ID NO: 3150752 - RNA, 14 nt, Mycobacterium bovis subsp bovis AF2122/97
cuaggccggccgga

SEQ ID NO: 3150753 - RNA, 19 nt, Mycobacterium bovis subsp bovis AF2122/97
cuagggcagcagcccgggc

SEQ ID NO: 3150754 - RNA, 14 nt, Mycobacterium bovis subsp bovis AF2122/97
cuaggucagcgggc

SEQ ID NO: 3150755 - RNA, 17 nt, Mycobacterium bovis subsp bovis AF2122/97
cuagguccgaucgugug

SEQ ID NO: 3150756 - RNA, 15 nt, Mycobacterium bovis subsp bovis AF2122/97
cuaggucgacgccga

SEQ ID NO: 3150757 - RNA, 17 nt, Mycobacterium bovis subsp bovis AF2122/97
cuaggucgcgcugaagg

SEQ ID NO: 3150758 - RNA, 19 nt, Mycobacterium bovis subsp bovis AF2122/97
cuaggugacgccgccagca

SEQ ID NO: 3150759 - RNA, 19 nt, Mycobacterium bovis subsp bovis AF2122/97
cuaggugcaacaggcgcgu

SEQ ID NO: 3150760 - RNA, 18 nt, Mycobacterium bovis subsp bovis AF2122/97
cuaggugugcgacgacgg

SEQ ID NO: 3150761 - RNA, 23 nt, Mycobacterium bovis subsp bovis AF2122/97
cuaggugugcgacgacggcgccg

SEQ ID NO: 3150762 - RNA, 11 nt, Mycobacterium bovis subsp bovis AF2122/97
cuagguucagu

SEQ ID NO: 3150763 - RNA, 21 nt, Mycobacterium bovis subsp bovis AF2122/97
cuagguucaguuccaccgcgc

SEQ ID NO: 3150764 - RNA, 19 nt, Mycobacterium bovis subsp bovis AF2122/97
cuagguucgaguccuggua

SEQ ID NO: 3150765 - RNA, 20 nt, Mycobacterium bovis subsp bovis AF2122/97
cucaccgcgcaucaucgccc

SEQ ID NO: 3150766 - RNA, 20 nt, Mycobacterium bovis subsp bovis AF2122/97
cucaccggcgcccagcgccu

SEQ ID NO: 3150767 - RNA, 16 nt, Mycobacterium bovis subsp bovis AF2122/97
cucaccggcgcgagca

SEQ ID NO: 3150768 - RNA, 13 nt, Mycobacterium bovis subsp bovis AF2122/97
cucaccggcgcgg

SEQ ID NO: 3150769 - RNA, 19 nt, Mycobacterium bovis subsp bovis AF2122/97
cucaccggcgucguaggag

SEQ ID NO: 3150770 - RNA, 13 nt, Mycobacterium bovis subsp bovis AF2122/97
cucaccggcuggu

SEQ ID NO: 3150771 - RNA, 16 nt, Mycobacterium bovis subsp bovis AF2122/97
cucaccggcuggugcc

SEQ ID NO: 3150772 - RNA, 17 nt, Mycobacterium bovis subsp bovis AF2122/97
cucaccggcuggugcca

SEQ ID NO: 3150773 - RNA, 23 nt, Mycobacterium bovis subsp bovis AF2122/97
cucaccgggagcgugcacgggga

SEQ ID NO: 3150774 - RNA, 16 nt, Mycobacterium bovis subsp bovis AF2122/97
cucaccgggcccgacg

SEQ ID NO: 3150775 - RNA, 20 nt, Mycobacterium bovis subsp bovis AF2122/97
cucaccgggcccgacgacga

SEQ ID NO: 3150776 - RNA, 22 nt, Mycobacterium bovis subsp bovis AF2122/97
cucaccggguuggaagccgcac

SEQ ID NO: 3150777 - RNA, 23 nt, Mycobacterium bovis subsp bovis AF2122/97
cucaccggguuggaagccgcacc

SEQ ID NO: 3150778 - RNA, 22 nt, Mycobacterium bovis subsp bovis AF2122/97
cucaccucggcuuugccgcugu

SEQ ID NO: 3150779 - RNA, 20 nt, Mycobacterium bovis subsp bovis AF2122/97
cucaccugacacgcccgcga

SEQ ID NO: 3150780 - RNA, 15 nt, Mycobacterium bovis subsp bovis AF2122/97
cucaccugcgggugc

SEQ ID NO: 3150781 - RNA, 22 nt, Mycobacterium bovis subsp bovis AF2122/97
cucaccugcgggugcgucgaug

SEQ ID NO: 3150782 - RNA, 19 nt, Mycobacterium bovis subsp bovis AF2122/97
cucaccuuccucgaaaucg

SEQ ID NO: 3150783 - RNA, 21 nt, Mycobacterium bovis subsp bovis AF2122/97
cucaccuuuggccgcgaccgg

SEQ ID NO: 3150784 - RNA, 13 nt, Mycobacterium bovis subsp bovis AF2122/97
cucacgacgccgu

SEQ ID NO: 3150785 - RNA, 16 nt, Mycobacterium bovis subsp bovis AF2122/97
cucacgagcggcggug

SEQ ID NO: 3150786 - RNA, 21 nt, Mycobacterium bovis subsp bovis AF2122/97
cucacgaggcacaaucaccgc

SEQ ID NO: 3150787 - RNA, 23 nt, Mycobacterium bovis subsp bovis AF2122/97
cucacgaggcacaaucaccgccg

SEQ ID NO: 3150788 - RNA, 14 nt, Mycobacterium bovis subsp bovis AF2122/97
cucacgcagcgcca

SEQ ID NO: 3150789 - RNA, 21 nt, Mycobacterium bovis subsp bovis AF2122/97
cucacgcaggaaaaccccggc

SEQ ID NO: 3150790 - RNA, 22 nt, Mycobacterium bovis subsp bovis AF2122/97
cucacgcaggaaaaccccggcc

SEQ ID NO: 3150791 - RNA, 19 nt, Mycobacterium bovis subsp bovis AF2122/97
cucacgccaaguccgcuca

SEQ ID NO: 3150792 - RNA, 19 nt, Mycobacterium bovis subsp bovis AF2122/97
cucacgccguccggugugg

SEQ ID NO: 3150793 - RNA, 15 nt, Mycobacterium bovis subsp bovis AF2122/97
cucacgcuccgccgg

SEQ ID NO: 3150794 - RNA, 18 nt, Mycobacterium bovis subsp bovis AF2122/97
cucacggacgcugggcgg

SEQ ID NO: 3150795 - RNA, 12 nt, Mycobacterium bovis subsp bovis AF2122/97
cucacggcggcg

SEQ ID NO: 3150796 - RNA, 19 nt, Mycobacterium bovis subsp bovis AF2122/97
cucacgggugcuggcagga

SEQ ID NO: 3150797 - RNA, 21 nt, Mycobacterium bovis subsp bovis AF2122/97
cucacgugcccgcgcggcgca

SEQ ID NO: 3150798 - RNA, 21 nt, Mycobacterium bovis subsp bovis AF2122/97
cucacguggacugaccucguc

SEQ ID NO: 3150799 - RNA, 23 nt, Mycobacterium bovis subsp bovis AF2122/97
cucacguuugaggaccuugccgg

SEQ ID NO: 3150800 - RNA, 16 nt, Mycobacterium bovis subsp bovis AF2122/97
cucacuacccgcaacg

SEQ ID NO: 3150801 - RNA, 22 nt, Mycobacterium bovis subsp bovis AF2122/97
cucacucgccgaaucgcugacc

SEQ ID NO: 3150802 - RNA, 12 nt, Mycobacterium bovis subsp bovis AF2122/97
cucacugcggcg

SEQ ID NO: 3150803 - RNA, 14 nt, Mycobacterium bovis subsp bovis AF2122/97
cucacugcggcgcc

SEQ ID NO: 3150804 - RNA, 18 nt, Mycobacterium bovis subsp bovis AF2122/97
cucacuggugacccugau

SEQ ID NO: 3150805 - RNA, 13 nt, Mycobacterium bovis subsp bovis AF2122/97
cucagaccggaaa

SEQ ID NO: 3150806 - RNA, 15 nt, Mycobacterium bovis subsp bovis AF2122/97
cucagacgacgaucg

SEQ ID NO: 3150807 - RNA, 19 nt, Mycobacterium bovis subsp bovis AF2122/97
cucagacuuucgcccaguc

SEQ ID NO: 3150808 - RNA, 14 nt, Mycobacterium bovis subsp bovis AF2122/97
cucagcaccgcugg

SEQ ID NO: 3150809 - RNA, 19 nt, Mycobacterium bovis subsp bovis AF2122/97
cucagcaccgcuggcagcg

SEQ ID NO: 3150810 - RNA, 17 nt, Mycobacterium bovis subsp bovis AF2122/97
cucagcagcgccgcgcg

SEQ ID NO: 3150811 - RNA, 15 nt, Mycobacterium bovis subsp bovis AF2122/97
cucagcauucaccaa

SEQ ID NO: 3150812 - RNA, 19 nt, Mycobacterium bovis subsp bovis AF2122/97
cucagcauucaccaaaccg

SEQ ID NO: 3150813 - RNA, 12 nt, Mycobacterium bovis subsp bovis AF2122/97
cucagccaccgc

SEQ ID NO: 3150814 - RNA, 22 nt, Mycobacterium bovis subsp bovis AF2122/97
cucagccaccgggcgugcggcg

SEQ ID NO: 3150815 - RNA, 23 nt, Mycobacterium bovis subsp bovis AF2122/97
cucagcccggcacugaccgcgau

SEQ ID NO: 3150816 - RNA, 15 nt, Mycobacterium bovis subsp bovis AF2122/97
cucagcccggccagc

SEQ ID NO: 3150817 - RNA, 14 nt, Mycobacterium bovis subsp bovis AF2122/97
cucagccgcgccgg

SEQ ID NO: 3150818 - RNA, 18 nt, Mycobacterium bovis subsp bovis AF2122/97
cucagccgcgccgggucc

SEQ ID NO: 3150819 - RNA, 14 nt, Mycobacterium bovis subsp bovis AF2122/97
cucagccgcggcca

SEQ ID NO: 3150820 - RNA, 15 nt, Mycobacterium bovis subsp bovis AF2122/97
cucagccgcggccac

SEQ ID NO: 3150821 - RNA, 13 nt, Mycobacterium bovis subsp bovis AF2122/97
cucagccgcucgg

SEQ ID NO: 3150822 - RNA, 13 nt, Mycobacterium bovis subsp bovis AF2122/97
cucagccguccgg

SEQ ID NO: 3150823 - RNA, 19 nt, Mycobacterium bovis subsp bovis AF2122/97
cucagccguccgggcggcc

SEQ ID NO: 3150824 - RNA, 16 nt, Mycobacterium bovis subsp bovis AF2122/97
cucagccgugcccagg

SEQ ID NO: 3150825 - RNA, 17 nt, Mycobacterium bovis subsp bovis AF2122/97
cucagccgugcccaggc

SEQ ID NO: 3150826 - RNA, 16 nt, Mycobacterium bovis subsp bovis AF2122/97
cucagcgaugcggccc

SEQ ID NO: 3150827 - RNA, 14 nt, Mycobacterium bovis subsp bovis AF2122/97
cucagcgaugcuca

SEQ ID NO: 3150828 - RNA, 13 nt, Mycobacterium bovis subsp bovis AF2122/97
cucagcgcgcgcc

SEQ ID NO: 3150829 - RNA, 13 nt, Mycobacterium bovis subsp bovis AF2122/97
cucagcgcggccc

SEQ ID NO: 3150830 - RNA, 19 nt, Mycobacterium bovis subsp bovis AF2122/97
cucagcggcgaccgcaucc

SEQ ID NO: 3150831 - RNA, 15 nt, Mycobacterium bovis subsp bovis AF2122/97
cucagcggcucgccu

SEQ ID NO: 3150832 - RNA, 14 nt, Mycobacterium bovis subsp bovis AF2122/97
cucagcgguagagc

SEQ ID NO: 3150833 - RNA, 18 nt, Mycobacterium bovis subsp bovis AF2122/97
cucagcgguagagcucug

SEQ ID NO: 3150834 - RNA, 13 nt, Mycobacterium bovis subsp bovis AF2122/97
cucagcgguggcg

SEQ ID NO: 3150835 - RNA, 14 nt, Mycobacterium bovis subsp bovis AF2122/97
cucagcuccggcga

SEQ ID NO: 3150836 - RNA, 13 nt, Mycobacterium bovis subsp bovis AF2122/97
cucagcugcucgu

SEQ ID NO: 3150837 - RNA, 18 nt, Mycobacterium bovis subsp bovis AF2122/97
cucagcugguggcggcgg

SEQ ID NO: 3150838 - RNA, 18 nt, Mycobacterium bovis subsp bovis AF2122/97
cucaggaucccgguggca

SEQ ID NO: 3150839 - RNA, 18 nt, Mycobacterium bovis subsp bovis AF2122/97
cucaggcaaucgcgggcg

SEQ ID NO: 3150840 - RNA, 19 nt, Mycobacterium bovis subsp bovis AF2122/97
cucaggcgguaguggcgau

SEQ ID NO: 3150841 - RNA, 17 nt, Mycobacterium bovis subsp bovis AF2122/97
cucagggugcgccgcag

SEQ ID NO: 3150842 - RNA, 20 nt, Mycobacterium bovis subsp bovis AF2122/97
cucagguacggcgggcggcc

SEQ ID NO: 3150843 - RNA, 23 nt, Mycobacterium bovis subsp bovis AF2122/97
cucagguacggcgggcggccgcu

SEQ ID NO: 3150844 - RNA, 19 nt, Mycobacterium bovis subsp bovis AF2122/97
cucaggucgacaggugcca

SEQ ID NO: 3150845 - RNA, 16 nt, Mycobacterium bovis subsp bovis AF2122/97
cucaggucggugcggu

SEQ ID NO: 3150846 - RNA, 14 nt, Mycobacterium bovis subsp bovis AF2122/97
cucagucacgcacu

SEQ ID NO: 3150847 - RNA, 16 nt, Mycobacterium bovis subsp bovis AF2122/97
cucagucacgcacucc

SEQ ID NO: 3150848 - RNA, 16 nt, Mycobacterium bovis subsp bovis AF2122/97
cucaguguacaccgcg

SEQ ID NO: 3150849 - RNA, 17 nt, Mycobacterium bovis subsp bovis AF2122/97
cucaguguacaccgcgc

SEQ ID NO: 3150850 - RNA, 19 nt, Mycobacterium bovis subsp bovis AF2122/97
cucaguguacaccgcgccc

SEQ ID NO: 3150851 - RNA, 18 nt, Mycobacterium bovis subsp bovis AF2122/97
cucaguguuccgccaccc

SEQ ID NO: 3150852 - RNA, 23 nt, Mycobacterium bovis subsp bovis AF2122/97
cuccagaaccgaagccucggcau

SEQ ID NO: 3150853 - RNA, 14 nt, Mycobacterium bovis subsp bovis AF2122/97
cuccagacguucca

SEQ ID NO: 3150854 - RNA, 17 nt, Mycobacterium bovis subsp bovis AF2122/97
cuccagagacagcgcca

SEQ ID NO: 3150855 - RNA, 23 nt, Mycobacterium bovis subsp bovis AF2122/97
cuccagagacagcgccaugcccu

SEQ ID NO: 3150856 - RNA, 20 nt, Mycobacterium bovis subsp bovis AF2122/97
cuccagauccacgccgacca

SEQ ID NO: 3150857 - RNA, 15 nt, Mycobacterium bovis subsp bovis AF2122/97
cuccagauucgccgc

SEQ ID NO: 3150858 - RNA, 20 nt, Mycobacterium bovis subsp bovis AF2122/97
cuccagcaaaacccgcucca

SEQ ID NO: 3150859 - RNA, 14 nt, Mycobacterium bovis subsp bovis AF2122/97
cuccagcaccaccg

SEQ ID NO: 3150860 - RNA, 15 nt, Mycobacterium bovis subsp bovis AF2122/97
cuccagcaccaccgg

SEQ ID NO: 3150861 - RNA, 22 nt, Mycobacterium bovis subsp bovis AF2122/97
cuccagcaccacggcgcgcgcg

SEQ ID NO: 3150862 - RNA, 15 nt, Mycobacterium bovis subsp bovis AF2122/97
cuccagcaccagcac

SEQ ID NO: 3150863 - RNA, 17 nt, Mycobacterium bovis subsp bovis AF2122/97
cuccagcaccagcacgg

SEQ ID NO: 3150864 - RNA, 17 nt, Mycobacterium bovis subsp bovis AF2122/97
cuccagcacccgcugca

SEQ ID NO: 3150865 - RNA, 13 nt, Mycobacterium bovis subsp bovis AF2122/97
cuccagcaccgug

SEQ ID NO: 3150866 - RNA, 17 nt, Mycobacterium bovis subsp bovis AF2122/97
cuccagcagcccggugg

SEQ ID NO: 3150867 - RNA, 16 nt, Mycobacterium bovis subsp bovis AF2122/97
cuccagcagcgacggu

SEQ ID NO: 3150868 - RNA, 15 nt, Mycobacterium bovis subsp bovis AF2122/97
cuccagcagcucgcc

SEQ ID NO: 3150869 - RNA, 17 nt, Mycobacterium bovis subsp bovis AF2122/97
cuccagcagcucgccgg

SEQ ID NO: 3150870 - RNA, 19 nt, Mycobacterium bovis subsp bovis AF2122/97
cuccagcagcucgccggca

SEQ ID NO: 3150871 - RNA, 22 nt, Mycobacterium bovis subsp bovis AF2122/97
cuccagcagguccgcggccgcg

SEQ ID NO: 3150872 - RNA, 18 nt, Mycobacterium bovis subsp bovis AF2122/97
cuccagcaugggcgagaa

SEQ ID NO: 3150873 - RNA, 14 nt, Mycobacterium bovis subsp bovis AF2122/97
cuccagcgaaccga

SEQ ID NO: 3150874 - RNA, 20 nt, Mycobacterium bovis subsp bovis AF2122/97
cuccagcgaaccgacccggc

SEQ ID NO: 3150875 - RNA, 23 nt, Mycobacterium bovis subsp bovis AF2122/97
cuccagcgaaccgacccggccgc

SEQ ID NO: 3150876 - RNA, 15 nt, Mycobacterium bovis subsp bovis AF2122/97
cuccagcgcacuacu

SEQ ID NO: 3150877 - RNA, 11 nt, Mycobacterium bovis subsp bovis AF2122/97
cuccagcgcgc

SEQ ID NO: 3150878 - RNA, 19 nt, Mycobacterium bovis subsp bovis AF2122/97
cuccagcgguucggugauc

SEQ ID NO: 3150879 - RNA, 23 nt, Mycobacterium bovis subsp bovis AF2122/97
cuccagcgguucggugaucgggc

SEQ ID NO: 3150880 - RNA, 17 nt, Mycobacterium bovis subsp bovis AF2122/97
cuccagcucgaacaggu

SEQ ID NO: 3150881 - RNA, 13 nt, Mycobacterium bovis subsp bovis AF2122/97
cuccagcucggcc

SEQ ID NO: 3150882 - RNA, 14 nt, Mycobacterium bovis subsp bovis AF2122/97
cuccagcucggcca

SEQ ID NO: 3150883 - RNA, 15 nt, Mycobacterium bovis subsp bovis AF2122/97
cuccagcucggcggg

SEQ ID NO: 3150884 - RNA, 21 nt, Mycobacterium bovis subsp bovis AF2122/97
cuccagcugcgcgggcgagua

SEQ ID NO: 3150885 - RNA, 16 nt, Mycobacterium bovis subsp bovis AF2122/97
cuccagcugggugacc

SEQ ID NO: 3150886 - RNA, 18 nt, Mycobacterium bovis subsp bovis AF2122/97
cuccagcugggugaccuc

SEQ ID NO: 3150887 - RNA, 22 nt, Mycobacterium bovis subsp bovis AF2122/97
cuccagcugggugaccucgucg

SEQ ID NO: 3150888 - RNA, 15 nt, Mycobacterium bovis subsp bovis AF2122/97
cuccaggaucgccgc

SEQ ID NO: 3150889 - RNA, 21 nt, Mycobacterium bovis subsp bovis AF2122/97
cuccaggaucucuucucggcu

SEQ ID NO: 3150890 - RNA, 15 nt, Mycobacterium bovis subsp bovis AF2122/97
cuccaggcgccaccc

SEQ ID NO: 3150891 - RNA, 14 nt, Mycobacterium bovis subsp bovis AF2122/97
cuccaggcgcgccg

SEQ ID NO: 3150892 - RNA, 22 nt, Mycobacterium bovis subsp bovis AF2122/97
cuccaggcugaaaccuugcggc

SEQ ID NO: 3150893 - RNA, 12 nt, Mycobacterium bovis subsp bovis AF2122/97
cuccagggcccu

SEQ ID NO: 3150894 - RNA, 17 nt, Mycobacterium bovis subsp bovis AF2122/97
cuccaggggcuggugcu

SEQ ID NO: 3150895 - RNA, 15 nt, Mycobacterium bovis subsp bovis AF2122/97
cuccaggguccggac

SEQ ID NO: 3150896 - RNA, 15 nt, Mycobacterium bovis subsp bovis AF2122/97
cuccagguuccaggu

SEQ ID NO: 3150897 - RNA, 17 nt, Mycobacterium bovis subsp bovis AF2122/97
cuccaguacgguccggc

SEQ ID NO: 3150898 - RNA, 21 nt, Mycobacterium bovis subsp bovis AF2122/97
cuccaguagccggugccggcg

SEQ ID NO: 3150899 - RNA, 23 nt, Mycobacterium bovis subsp bovis AF2122/97
cuccaguagccggugccggcgca

SEQ ID NO: 3150900 - RNA, 16 nt, Mycobacterium bovis subsp bovis AF2122/97
cuccaguggcgccagg

SEQ ID NO: 3150901 - RNA, 18 nt, Mycobacterium bovis subsp bovis AF2122/97
cuccaguggcgccagggc

SEQ ID NO: 3150902 - RNA, 20 nt, Mycobacterium bovis subsp bovis AF2122/97
cuccaguggcgccagggccu

SEQ ID NO: 3150903 - RNA, 18 nt, Mycobacterium bovis subsp bovis AF2122/97
cuccaucaaccgcgcugu

SEQ ID NO: 3150904 - RNA, 13 nt, Mycobacterium bovis subsp bovis AF2122/97
cuccaucaacugc

SEQ ID NO: 3150905 - RNA, 15 nt, Mycobacterium bovis subsp bovis AF2122/97
cuccaucaccacacc

SEQ ID NO: 3150906 - RNA, 19 nt, Mycobacterium bovis subsp bovis AF2122/97
cuccaucaccacaccggca

SEQ ID NO: 3150907 - RNA, 13 nt, Mycobacterium bovis subsp bovis AF2122/97
cuccaucagcgcg

SEQ ID NO: 3150908 - RNA, 17 nt, Mycobacterium bovis subsp bovis AF2122/97
cuccaucagcgcgaccg

SEQ ID NO: 3150909 - RNA, 18 nt, Mycobacterium bovis subsp bovis AF2122/97
cuccaucagcgcgaccga

SEQ ID NO: 3150910 - RNA, 18 nt, Mycobacterium bovis subsp bovis AF2122/97
cuccaucgucugguggca

SEQ ID NO: 3150911 - RNA, 20 nt, Mycobacterium bovis subsp bovis AF2122/97
cuccaugacaaaccugcaug

SEQ ID NO: 3150912 - RNA, 21 nt, Mycobacterium bovis subsp bovis AF2122/97
cuccaugcggaauuugcuugg

SEQ ID NO: 3150913 - RNA, 16 nt, Mycobacterium bovis subsp bovis AF2122/97
cuccauggcauugcuc

SEQ ID NO: 3150914 - RNA, 19 nt, Mycobacterium bovis subsp bovis AF2122/97
cuccauggcauugcuccgg

SEQ ID NO: 3150915 - RNA, 22 nt, Mycobacterium bovis subsp bovis AF2122/97
cuccauggcauugcuccgguug

SEQ ID NO: 3150916 - RNA, 18 nt, Mycobacterium bovis subsp bovis AF2122/97
cuccauggccugauucca

SEQ ID NO: 3150917 - RNA, 13 nt, Mycobacterium bovis subsp bovis AF2122/97
cuccauguuggcg

SEQ ID NO: 3150918 - RNA, 18 nt, Mycobacterium bovis subsp bovis AF2122/97
cuccauugccggauuugu

SEQ ID NO: 3150919 - RNA, 15 nt, Mycobacterium bovis subsp bovis AF2122/97
cucccaagaaggaca

SEQ ID NO: 3150920 - RNA, 22 nt, Mycobacterium bovis subsp bovis AF2122/97
cucccacagguagaccgucucc

SEQ ID NO: 3150921 - RNA, 18 nt, Mycobacterium bovis subsp bovis AF2122/97
cucccacucccgccccgc

SEQ ID NO: 3150922 - RNA, 15 nt, Mycobacterium bovis subsp bovis AF2122/97
cucccagaacgccgu

SEQ ID NO: 3150923 - RNA, 22 nt, Mycobacterium bovis subsp bovis AF2122/97
cucccagaacgccguccacgcc

SEQ ID NO: 3150924 - RNA, 23 nt, Mycobacterium bovis subsp bovis AF2122/97
cucccagcacgguggcuucgacg

SEQ ID NO: 3150925 - RNA, 14 nt, Mycobacterium bovis subsp bovis AF2122/97
cucccagccaaccc

SEQ ID NO: 3150926 - RNA, 16 nt, Mycobacterium bovis subsp bovis AF2122/97
cucccagccaacccgu

SEQ ID NO: 3150927 - RNA, 11 nt, Mycobacterium bovis subsp bovis AF2122/97
cucccagccca

SEQ ID NO: 3150928 - RNA, 13 nt, Mycobacterium bovis subsp bovis AF2122/97
cucccaggccgcc

SEQ ID NO: 3150929 - RNA, 15 nt, Mycobacterium bovis subsp bovis AF2122/97
cucccaggccgccgc

SEQ ID NO: 3150930 - RNA, 17 nt, Mycobacterium bovis subsp bovis AF2122/97
cucccaggcguuuggcg

SEQ ID NO: 3150931 - RNA, 16 nt, Mycobacterium bovis subsp bovis AF2122/97
cucccagggcucggcg

SEQ ID NO: 3150932 - RNA, 21 nt, Mycobacterium bovis subsp bovis AF2122/97
cucccagggcucggcggcccg

SEQ ID NO: 3150933 - RNA, 22 nt, Mycobacterium bovis subsp bovis AF2122/97
cucccagggcucggcggcccgg

SEQ ID NO: 3150934 - RNA, 20 nt, Mycobacterium bovis subsp bovis AF2122/97
cucccauucccaacacagcc

SEQ ID NO: 3150935 - RNA, 14 nt, Mycobacterium bovis subsp bovis AF2122/97
cuccccagagcugg

SEQ ID NO: 3150936 - RNA, 12 nt, Mycobacterium bovis subsp bovis AF2122/97
cuccccagcccc

SEQ ID NO: 3150937 - RNA, 18 nt, Mycobacterium bovis subsp bovis AF2122/97
cuccccagcgaaucaccc

SEQ ID NO: 3150938 - RNA, 21 nt, Mycobacterium bovis subsp bovis AF2122/97
cuccccgaccgaaccgucagc

SEQ ID NO: 3150939 - RNA, 14 nt, Mycobacterium bovis subsp bovis AF2122/97
cuccgcgcucgucu

SEQ ID NO: 3150940 - RNA, 17 nt, Mycobacterium bovis subsp bovis AF2122/97
cuccgcggaacccagca

SEQ ID NO: 3150941 - RNA, 14 nt, Mycobacterium bovis subsp bovis AF2122/97
cuccgcggcgaacc

SEQ ID NO: 3150942 - RNA, 19 nt, Mycobacterium bovis subsp bovis AF2122/97
cuccgcggcgcagcacggc

SEQ ID NO: 3150943 - RNA, 14 nt, Mycobacterium bovis subsp bovis AF2122/97
cuccgcggcgcgca

SEQ ID NO: 3150944 - RNA, 19 nt, Mycobacterium bovis subsp bovis AF2122/97
cuccgcggcgcgcaacaca

SEQ ID NO: 3150945 - RNA, 22 nt, Mycobacterium bovis subsp bovis AF2122/97
cuccgcgggguugauugacccg

SEQ ID NO: 3150946 - RNA, 18 nt, Mycobacterium bovis subsp bovis AF2122/97
cuccgcgguuguuucggc

SEQ ID NO: 3150947 - RNA, 22 nt, Mycobacterium bovis subsp bovis AF2122/97
cuccgcgguuguuucggcguga

SEQ ID NO: 3150948 - RNA, 21 nt, Mycobacterium bovis subsp bovis AF2122/97
cuccgcguagaguguccccgg

SEQ ID NO: 3150949 - RNA, 13 nt, Mycobacterium bovis subsp bovis AF2122/97
cuccgcugccgcc

SEQ ID NO: 3150950 - RNA, 14 nt, Mycobacterium bovis subsp bovis AF2122/97
cuccgcugccgccc

SEQ ID NO: 3150951 - RNA, 16 nt, Mycobacterium bovis subsp bovis AF2122/97
cuccgcugccgcccgc

SEQ ID NO: 3150952 - RNA, 19 nt, Mycobacterium bovis subsp bovis AF2122/97
cuccgcugccgcccgcgcc

SEQ ID NO: 3150953 - RNA, 16 nt, Mycobacterium bovis subsp bovis AF2122/97
cuccggaaagcucucg

SEQ ID NO: 3150954 - RNA, 22 nt, Mycobacterium bovis subsp bovis AF2122/97
cuccggaaagcucucggcaccc

SEQ ID NO: 3150955 - RNA, 13 nt, Mycobacterium bovis subsp bovis AF2122/97
cuccggaaccacu

SEQ ID NO: 3150956 - RNA, 15 nt, Mycobacterium bovis subsp bovis AF2122/97
cuccggaaucgcccg

SEQ ID NO: 3150957 - RNA, 16 nt, Mycobacterium bovis subsp bovis AF2122/97
cuccggaaucgcccgg

SEQ ID NO: 3150958 - RNA, 20 nt, Mycobacterium bovis subsp bovis AF2122/97
cuccggaaucgcccgggcgg

SEQ ID NO: 3150959 - RNA, 20 nt, Mycobacterium bovis subsp bovis AF2122/97
cuccggacccacccgcaccg

SEQ ID NO: 3150960 - RNA, 22 nt, Mycobacterium bovis subsp bovis AF2122/97
cuccggacccacccgcaccgcc

SEQ ID NO: 3150961 - RNA, 21 nt, Mycobacterium bovis subsp bovis AF2122/97
cuccggagcccacacgcucac

SEQ ID NO: 3150962 - RNA, 18 nt, Mycobacterium bovis subsp bovis AF2122/97
cuccggauaacccagcgg

SEQ ID NO: 3150963 - RNA, 19 nt, Mycobacterium bovis subsp bovis AF2122/97
cuccggauaacccagcggc

SEQ ID NO: 3150964 - RNA, 20 nt, Mycobacterium bovis subsp bovis AF2122/97
cuccggauaacccagcggcg

SEQ ID NO: 3150965 - RNA, 23 nt, Mycobacterium bovis subsp bovis AF2122/97
cuccggauaacccagcggcgcca

SEQ ID NO: 3150966 - RNA, 13 nt, Mycobacterium bovis subsp bovis AF2122/97
cuccggaucgccg

SEQ ID NO: 3150967 - RNA, 17 nt, Mycobacterium bovis subsp bovis AF2122/97
cuccggcaacagcacca

SEQ ID NO: 3150968 - RNA, 21 nt, Mycobacterium bovis subsp bovis AF2122/97
cuccggcaacagcaccagugu

SEQ ID NO: 3150969 - RNA, 20 nt, Mycobacterium bovis subsp bovis AF2122/97
cuccggcaagcacaccgcca

SEQ ID NO: 3150970 - RNA, 22 nt, Mycobacterium bovis subsp bovis AF2122/97
cuccggcaagcacaccgccagc

SEQ ID NO: 3150971 - RNA, 16 nt, Mycobacterium bovis subsp bovis AF2122/97
cuccggcaccaacgcc

SEQ ID NO: 3150972 - RNA, 19 nt, Mycobacterium bovis subsp bovis AF2122/97
cuccggcaccaacgccacc

SEQ ID NO: 3150973 - RNA, 20 nt, Mycobacterium bovis subsp bovis AF2122/97
cuccggcaccaacgccaccg

SEQ ID NO: 3150974 - RNA, 23 nt, Mycobacterium bovis subsp bovis AF2122/97
cuccggcaccaacgccaccgucg

SEQ ID NO: 3150975 - RNA, 14 nt, Mycobacterium bovis subsp bovis AF2122/97
cuccggcaccgguc

SEQ ID NO: 3150976 - RNA, 22 nt, Mycobacterium bovis subsp bovis AF2122/97
cuccggcaccuccagcaccacc

SEQ ID NO: 3150977 - RNA, 23 nt, Mycobacterium bovis subsp bovis AF2122/97
cuccggcaccuccagcaccaccg

SEQ ID NO: 3150978 - RNA, 15 nt, Mycobacterium bovis subsp bovis AF2122/97
cuccggcagcagcaa

SEQ ID NO: 3150979 - RNA, 16 nt, Mycobacterium bovis subsp bovis AF2122/97
cuccggcagcagcaaa

SEQ ID NO: 3150980 - RNA, 14 nt, Mycobacterium bovis subsp bovis AF2122/97
cuccggcaggcccg

SEQ ID NO: 3150981 - RNA, 16 nt, Mycobacterium bovis subsp bovis AF2122/97
cuccggcccugccgcc

SEQ ID NO: 3150982 - RNA, 21 nt, Mycobacterium bovis subsp bovis AF2122/97
cuccggcccugccgccggccc

SEQ ID NO: 3150983 - RNA, 12 nt, Mycobacterium bovis subsp bovis AF2122/97
cuccggccgcac

SEQ ID NO: 3150984 - RNA, 16 nt, Mycobacterium bovis subsp bovis AF2122/97
cuccggccgcacgccu

SEQ ID NO: 3150985 - RNA, 19 nt, Mycobacterium bovis subsp bovis AF2122/97
cuccggccgcacgccuacg

SEQ ID NO: 3150986 - RNA, 22 nt, Mycobacterium bovis subsp bovis AF2122/97
cuccggcgacgaucucgccgcc

SEQ ID NO: 3150987 - RNA, 22 nt, Mycobacterium bovis subsp bovis AF2122/97
cuccggcgcaccugggcugccg

SEQ ID NO: 3150988 - RNA, 16 nt, Mycobacterium bovis subsp bovis AF2122/97
cuccggcgcagcgacc

SEQ ID NO: 3150989 - RNA, 15 nt, Mycobacterium bovis subsp bovis AF2122/97
cuccggcgccaccgc

SEQ ID NO: 3150990 - RNA, 17 nt, Mycobacterium bovis subsp bovis AF2122/97
cuccggcgccaccgccg

SEQ ID NO: 3150991 - RNA, 15 nt, Mycobacterium bovis subsp bovis AF2122/97
cuccggcgcgacgcc

SEQ ID NO: 3150992 - RNA, 16 nt, Mycobacterium bovis subsp bovis AF2122/97
cuccggcgcgacgccc

SEQ ID NO: 3150993 - RNA, 23 nt, Mycobacterium bovis subsp bovis AF2122/97
cuccggcgcuccacugaccaggu

SEQ ID NO: 3150994 - RNA, 19 nt, Mycobacterium bovis subsp bovis AF2122/97
cuccggcggcagcggcgcc

SEQ ID NO: 3150995 - RNA, 20 nt, Mycobacterium bovis subsp bovis AF2122/97
cuccggcggugccgucgccg

SEQ ID NO: 3150996 - RNA, 22 nt, Mycobacterium bovis subsp bovis AF2122/97
cuccggcggugccgucgccgcc

SEQ ID NO: 3150997 - RNA, 15 nt, Mycobacterium bovis subsp bovis AF2122/97
cuccggcguugacga

SEQ ID NO: 3150998 - RNA, 21 nt, Mycobacterium bovis subsp bovis AF2122/97
cuccggcguugacgaucaguc

SEQ ID NO: 3150999 - RNA, 13 nt, Mycobacterium bovis subsp bovis AF2122/97
cuccggcucgaca

SEQ ID NO: 3151000 - RNA, 18 nt, Mycobacterium bovis subsp bovis AF2122/97
cuccggcucgacaacauc

SEQ ID NO: 3151001 - RNA, 17 nt, Mycobacterium bovis subsp bovis AF2122/97
cuccgggaauggcgacc

SEQ ID NO: 3151002 - RNA, 18 nt, Mycobacterium bovis subsp bovis AF2122/97
cuccgggaauggcgacca

SEQ ID NO: 3151003 - RNA, 21 nt, Mycobacterium bovis subsp bovis AF2122/97
cuccgggaauggcgaccaccc

SEQ ID NO: 3151004 - RNA, 14 nt, Mycobacterium bovis subsp bovis AF2122/97
cuccgggaccaggc

SEQ ID NO: 3151005 - RNA, 14 nt, Mycobacterium bovis subsp bovis AF2122/97
cuccgggacgguga

SEQ ID NO: 3151006 - RNA, 16 nt, Mycobacterium bovis subsp bovis AF2122/97
cuccgggaugaagcuc

SEQ ID NO: 3151007 - RNA, 18 nt, Mycobacterium bovis subsp bovis AF2122/97
cuccgggcccaucgcccg

SEQ ID NO: 3151008 - RNA, 19 nt, Mycobacterium bovis subsp bovis AF2122/97
cuccgggcccaucgcccgg

SEQ ID NO: 3151009 - RNA, 19 nt, Mycobacterium bovis subsp bovis AF2122/97
cuccgggcgcaccaagacg

SEQ ID NO: 3151010 - RNA, 22 nt, Mycobacterium bovis subsp bovis AF2122/97
cuccgggcucggcgucgccgcc

SEQ ID NO: 3151011 - RNA, 19 nt, Mycobacterium bovis subsp bovis AF2122/97
cuccggguauggcggcgac

SEQ ID NO: 3151012 - RNA, 19 nt, Mycobacterium bovis subsp bovis AF2122/97
cuccgggucgacgacgucg

SEQ ID NO: 3151013 - RNA, 20 nt, Mycobacterium bovis subsp bovis AF2122/97
cuccgggucgaugucggggc

SEQ ID NO: 3151014 - RNA, 16 nt, Mycobacterium bovis subsp bovis AF2122/97
cuccggguuggcgacg

SEQ ID NO: 3151015 - RNA, 17 nt, Mycobacterium bovis subsp bovis AF2122/97
cuccggguuggcgacga

SEQ ID NO: 3151016 - RNA, 15 nt, Mycobacterium bovis subsp bovis AF2122/97
cuccgguaggcgaga

SEQ ID NO: 3151017 - RNA, 18 nt, Mycobacterium bovis subsp bovis AF2122/97
cuccgguaucggcgacca

SEQ ID NO: 3151018 - RNA, 23 nt, Mycobacterium bovis subsp bovis AF2122/97
cuccgguaucggcgaccagcugu

SEQ ID NO: 3151019 - RNA, 23 nt, Mycobacterium bovis subsp bovis AF2122/97
cuccggucaacacccgcccgggc

SEQ ID NO: 3151020 - RNA, 16 nt, Mycobacterium bovis subsp bovis AF2122/97
cuccggucccgcauac

SEQ ID NO: 3151021 - RNA, 15 nt, Mycobacterium bovis subsp bovis AF2122/97
cuccggugaucaccg

SEQ ID NO: 3151022 - RNA, 21 nt, Mycobacterium bovis subsp bovis AF2122/97
cuccggugaucaccgacaccg

SEQ ID NO: 3151023 - RNA, 14 nt, Mycobacterium bovis subsp bovis AF2122/97
cuccggugcgcagc

SEQ ID NO: 3151024 - RNA, 18 nt, Mycobacterium bovis subsp bovis AF2122/97
cuccgguggccaacaccg

SEQ ID NO: 3151025 - RNA, 14 nt, Mycobacterium bovis subsp bovis AF2122/97
cucgagcaugccca

SEQ ID NO: 3151026 - RNA, 15 nt, Mycobacterium bovis subsp bovis AF2122/97
cucgagcaugcccag

SEQ ID NO: 3151027 - RNA, 19 nt, Mycobacterium bovis subsp bovis AF2122/97
cucgagcaugcccagcgaa

SEQ ID NO: 3151028 - RNA, 18 nt, Mycobacterium bovis subsp bovis AF2122/97
cucgagcccucguuaucg

SEQ ID NO: 3151029 - RNA, 21 nt, Mycobacterium bovis subsp bovis AF2122/97
cucgagcccucguuaucgacc

SEQ ID NO: 3151030 - RNA, 13 nt, Mycobacterium bovis subsp bovis AF2122/97
cucgagccgcccg

SEQ ID NO: 3151031 - RNA, 14 nt, Mycobacterium bovis subsp bovis AF2122/97
cucgagccgcccgu

SEQ ID NO: 3151032 - RNA, 17 nt, Mycobacterium bovis subsp bovis AF2122/97
cucgagccgccggaucg

SEQ ID NO: 3151033 - RNA, 15 nt, Mycobacterium bovis subsp bovis AF2122/97
cucgagccgcggcaa

SEQ ID NO: 3151034 - RNA, 23 nt, Mycobacterium bovis subsp bovis AF2122/97
cucgagcgccucgggaggcagcg

SEQ ID NO: 3151035 - RNA, 13 nt, Mycobacterium bovis subsp bovis AF2122/97
cucgagcgcgccg

SEQ ID NO: 3151036 - RNA, 14 nt, Mycobacterium bovis subsp bovis AF2122/97
cucgagcgcgccgc

SEQ ID NO: 3151037 - RNA, 13 nt, Mycobacterium bovis subsp bovis AF2122/97
cucgagcggcaga

SEQ ID NO: 3151038 - RNA, 20 nt, Mycobacterium bovis subsp bovis AF2122/97
cucgagcguggcaacgagca

SEQ ID NO: 3151039 - RNA, 13 nt, Mycobacterium bovis subsp bovis AF2122/97
cucgagcucggcg

SEQ ID NO: 3151040 - RNA, 13 nt, Mycobacterium bovis subsp bovis AF2122/97
cucgagcugcugg

SEQ ID NO: 3151041 - RNA, 15 nt, Mycobacterium bovis subsp bovis AF2122/97
cucgagcugcuggcg

SEQ ID NO: 3151042 - RNA, 17 nt, Mycobacterium bovis subsp bovis AF2122/97
cucgagcugcuggcgcg

SEQ ID NO: 3151043 - RNA, 20 nt, Mycobacterium bovis subsp bovis AF2122/97
cucgagcugcuggcgcgccu

SEQ ID NO: 3151044 - RNA, 16 nt, Mycobacterium bovis subsp bovis AF2122/97
cucgagcuugccgucg

SEQ ID NO: 3151045 - RNA, 13 nt, Mycobacterium bovis subsp bovis AF2122/97
cucgaggaccacc

SEQ ID NO: 3151046 - RNA, 14 nt, Mycobacterium bovis subsp bovis AF2122/97
cucgaggaccacca

SEQ ID NO: 3151047 - RNA, 21 nt, Mycobacterium bovis subsp bovis AF2122/97
cucgaggaccaccuggucgcg

SEQ ID NO: 3151048 - RNA, 13 nt, Mycobacterium bovis subsp bovis AF2122/97
cucgaggaccugc

SEQ ID NO: 3151049 - RNA, 16 nt, Mycobacterium bovis subsp bovis AF2122/97
cucgagguccucgucg

SEQ ID NO: 3151050 - RNA, 15 nt, Mycobacterium bovis subsp bovis AF2122/97
cucgaggucgagcgc

SEQ ID NO: 3151051 - RNA, 20 nt, Mycobacterium bovis subsp bovis AF2122/97
cucgaggucgagcgccgcgg

SEQ ID NO: 3151052 - RNA, 21 nt, Mycobacterium bovis subsp bovis AF2122/97
cucgaggucgagcgccgcgga

SEQ ID NO: 3151053 - RNA, 23 nt, Mycobacterium bovis subsp bovis AF2122/97
cucgagguggucucgguaggcgg

SEQ ID NO: 3151054 - RNA, 16 nt, Mycobacterium bovis subsp bovis AF2122/97
cucgaguacccaaccg

SEQ ID NO: 3151055 - RNA, 13 nt, Mycobacterium bovis subsp bovis AF2122/97
cucgaguagucgc

SEQ ID NO: 3151056 - RNA, 22 nt, Mycobacterium bovis subsp bovis AF2122/97
cucgaguccguacuugccaccc

SEQ ID NO: 3151057 - RNA, 15 nt, Mycobacterium bovis subsp bovis AF2122/97
cucgagugccgccgu

SEQ ID NO: 3151058 - RNA, 21 nt, Mycobacterium bovis subsp bovis AF2122/97
cucgaguucgggcugcggcag

SEQ ID NO: 3151059 - RNA, 16 nt, Mycobacterium bovis subsp bovis AF2122/97
cucgaguugcgcggca

SEQ ID NO: 3151060 - RNA, 16 nt, Mycobacterium bovis subsp bovis AF2122/97
cucgaguuuggccagu

SEQ ID NO: 3151061 - RNA, 23 nt, Mycobacterium bovis subsp bovis AF2122/97
cucgaguuuggccaguucgguga

SEQ ID NO: 3151062 - RNA, 16 nt, Mycobacterium bovis subsp bovis AF2122/97
cucgauacccaggaug

SEQ ID NO: 3151063 - RNA, 15 nt, Mycobacterium bovis subsp bovis AF2122/97
cucgauagcggcgcc

SEQ ID NO: 3151064 - RNA, 23 nt, Mycobacterium bovis subsp bovis AF2122/97
cucgauauaacccggcuccagca

SEQ ID NO: 3151065 - RNA, 20 nt, Mycobacterium bovis subsp bovis AF2122/97
cucgauaucguuggcgacca

SEQ ID NO: 3151066 - RNA, 23 nt, Mycobacterium bovis subsp bovis AF2122/97
cucgauaucguuggcgaccaccg

SEQ ID NO: 3151067 - RNA, 22 nt, Mycobacterium bovis subsp bovis AF2122/97
cucgauauggguugccagcgac

SEQ ID NO: 3151068 - RNA, 21 nt, Mycobacterium bovis subsp bovis AF2122/97
cucgaucaccucgcgggugcu

SEQ ID NO: 3151069 - RNA, 15 nt, Mycobacterium bovis subsp bovis AF2122/97
cucgaucacggcggc

SEQ ID NO: 3151070 - RNA, 17 nt, Mycobacterium bovis subsp bovis AF2122/97
cucgaucacggcggccc

SEQ ID NO: 3151071 - RNA, 19 nt, Mycobacterium bovis subsp bovis AF2122/97
cucgaucacggcggccccg

SEQ ID NO: 3151072 - RNA, 19 nt, Mycobacterium bovis subsp bovis AF2122/97
cucgaucagaucgucacuc

SEQ ID NO: 3151073 - RNA, 14 nt, Mycobacterium bovis subsp bovis AF2122/97
cucgaucagcgccg

SEQ ID NO: 3151074 - RNA, 16 nt, Mycobacterium bovis subsp bovis AF2122/97
cucgaucagcgccgga

SEQ ID NO: 3151075 - RNA, 21 nt, Mycobacterium bovis subsp bovis AF2122/97
cucgaucaucaugucggcgca

SEQ ID NO: 3151076 - RNA, 19 nt, Mycobacterium bovis subsp bovis AF2122/97
cucgaucaucgggagccgc

SEQ ID NO: 3151077 - RNA, 15 nt, Mycobacterium bovis subsp bovis AF2122/97
cucgauccacugccg

SEQ ID NO: 3151078 - RNA, 19 nt, Mycobacterium bovis subsp bovis AF2122/97
cucgauccacugccgcgcg

SEQ ID NO: 3151079 - RNA, 21 nt, Mycobacterium bovis subsp bovis AF2122/97
cucgauccgcaacaacgccgc

SEQ ID NO: 3151080 - RNA, 16 nt, Mycobacterium bovis subsp bovis AF2122/97
cucgauccgcagaaug

SEQ ID NO: 3151081 - RNA, 21 nt, Mycobacterium bovis subsp bovis AF2122/97
cucgauccggauucagaucuc

SEQ ID NO: 3151082 - RNA, 14 nt, Mycobacterium bovis subsp bovis AF2122/97
cucgauccgggcgu

SEQ ID NO: 3151083 - RNA, 12 nt, Mycobacterium bovis subsp bovis AF2122/97
cucgaucgucga

SEQ ID NO: 3151084 - RNA, 15 nt, Mycobacterium bovis subsp bovis AF2122/97
cucgaucgucgacgc

SEQ ID NO: 3151085 - RNA, 15 nt, Mycobacterium bovis subsp bovis AF2122/97
cucgaucugcccggu

SEQ ID NO: 3151086 - RNA, 17 nt, Mycobacterium bovis subsp bovis AF2122/97
cucgaucugucgcgccg

SEQ ID NO: 3151087 - RNA, 19 nt, Mycobacterium bovis subsp bovis AF2122/97
cucgaucuugggccacgcu

SEQ ID NO: 3151088 - RNA, 22 nt, Mycobacterium bovis subsp bovis AF2122/97
cucgaugaaugagcggucagcg

SEQ ID NO: 3151089 - RNA, 21 nt, Mycobacterium bovis subsp bovis AF2122/97
cucgaugacaucggucagcgg

SEQ ID NO: 3151090 - RNA, 12 nt, Mycobacterium bovis subsp bovis AF2122/97
cucgaugcgauc

SEQ ID NO: 3151091 - RNA, 15 nt, Mycobacterium bovis subsp bovis AF2122/97
cucgaugcgaucgac

SEQ ID NO: 3151092 - RNA, 13 nt, Mycobacterium bovis subsp bovis AF2122/97
cucgaugcgggcg

SEQ ID NO: 3151093 - RNA, 20 nt, Mycobacterium bovis subsp bovis AF2122/97
cucgaugcgggcgccccacc

SEQ ID NO: 3151094 - RNA, 14 nt, Mycobacterium bovis subsp bovis AF2122/97
cucgauggccuugu

SEQ ID NO: 3151095 - RNA, 16 nt, Mycobacterium bovis subsp bovis AF2122/97
cucgauggcggccacc

SEQ ID NO: 3151096 - RNA, 17 nt, Mycobacterium bovis subsp bovis AF2122/97
cucgauggcggccacca

SEQ ID NO: 3151097 - RNA, 20 nt, Mycobacterium bovis subsp bovis AF2122/97
cucgauggcggccaccagcg

SEQ ID NO: 3151098 - RNA, 16 nt, Mycobacterium bovis subsp bovis AF2122/97
cucgauggcgguggcg

SEQ ID NO: 3151099 - RNA, 18 nt, Mycobacterium bovis subsp bovis AF2122/97
cucgauggcgguggcgag

SEQ ID NO: 3151100 - RNA, 20 nt, Mycobacterium bovis subsp bovis AF2122/97
cucgauggcguagggcuguc

SEQ ID NO: 3151101 - RNA, 15 nt, Mycobacterium bovis subsp bovis AF2122/97
cucgauguacagcgg

SEQ ID NO: 3151102 - RNA, 18 nt, Mycobacterium bovis subsp bovis AF2122/97
cucgauguacagcgggau

SEQ ID NO: 3151103 - RNA, 14 nt, Mycobacterium bovis subsp bovis AF2122/97
cucgaugucagcgg

SEQ ID NO: 3151104 - RNA, 17 nt, Mycobacterium bovis subsp bovis AF2122/97
cucgaugucagcggccg

SEQ ID NO: 3151105 - RNA, 16 nt, Mycobacterium bovis subsp bovis AF2122/97
cucgaugucccgagcc

SEQ ID NO: 3151106 - RNA, 19 nt, Mycobacterium bovis subsp bovis AF2122/97
cucgauguccucgauccgg

SEQ ID NO: 3151107 - RNA, 21 nt, Mycobacterium bovis subsp bovis AF2122/97
cucgauuaucgcgcgcaaccg

SEQ ID NO: 3151108 - RNA, 22 nt, Mycobacterium bovis subsp bovis AF2122/97
cucgcacaauggcggcgccguc

SEQ ID NO: 3151109 - RNA, 15 nt, Mycobacterium bovis subsp bovis AF2122/97
cucgcacagcaccac

SEQ ID NO: 3151110 - RNA, 16 nt, Mycobacterium bovis subsp bovis AF2122/97
cucgcacagcaccacg

SEQ ID NO: 3151111 - RNA, 13 nt, Mycobacterium bovis subsp bovis AF2122/97
cucgcacagccgc

SEQ ID NO: 3151112 - RNA, 22 nt, Mycobacterium bovis subsp bovis AF2122/97
cucgccgguguccuuggccgcc

SEQ ID NO: 3151113 - RNA, 17 nt, Mycobacterium bovis subsp bovis AF2122/97
cucgccguaagcaccag

SEQ ID NO: 3151114 - RNA, 18 nt, Mycobacterium bovis subsp bovis AF2122/97
cucgccguaagcaccagc

SEQ ID NO: 3151115 - RNA, 21 nt, Mycobacterium bovis subsp bovis AF2122/97
cucgccguaagcaccagccag

SEQ ID NO: 3151116 - RNA, 21 nt, Mycobacterium bovis subsp bovis AF2122/97
cucgccguacaucagcgcgaa

SEQ ID NO: 3151117 - RNA, 13 nt, Mycobacterium bovis subsp bovis AF2122/97
cucgccgugacca

SEQ ID NO: 3151118 - RNA, 14 nt, Mycobacterium bovis subsp bovis AF2122/97
cucgccguugaugu

SEQ ID NO: 3151119 - RNA, 20 nt, Mycobacterium bovis subsp bovis AF2122/97
cucgccguugaugucggcag

SEQ ID NO: 3151120 - RNA, 11 nt, Mycobacterium bovis subsp bovis AF2122/97
cucgccguugg

SEQ ID NO: 3151121 - RNA, 15 nt, Mycobacterium bovis subsp bovis AF2122/97
cucgccugcacgccc

SEQ ID NO: 3151122 - RNA, 19 nt, Mycobacterium bovis subsp bovis AF2122/97
cucgccugcacgcccggcg

SEQ ID NO: 3151123 - RNA, 16 nt, Mycobacterium bovis subsp bovis AF2122/97
cucgccugugggugcu

SEQ ID NO: 3151124 - RNA, 15 nt, Mycobacterium bovis subsp bovis AF2122/97
cucgcgacaucaccg

SEQ ID NO: 3151125 - RNA, 16 nt, Mycobacterium bovis subsp bovis AF2122/97
cucgcgacaucaccga

SEQ ID NO: 3151126 - RNA, 23 nt, Mycobacterium bovis subsp bovis AF2122/97
cucgcgacaucaccgaacggcga

SEQ ID NO: 3151127 - RNA, 15 nt, Mycobacterium bovis subsp bovis AF2122/97
cucgcgacgaguugc

SEQ ID NO: 3151128 - RNA, 19 nt, Mycobacterium bovis subsp bovis AF2122/97
cucgcgaucgcagugagca

SEQ ID NO: 3151129 - RNA, 23 nt, Mycobacterium bovis subsp bovis AF2122/97
cucgcgaucgcagugagcagccg

SEQ ID NO: 3151130 - RNA, 22 nt, Mycobacterium bovis subsp bovis AF2122/97
cucgcgaucugcucguagcggc

SEQ ID NO: 3151131 - RNA, 18 nt, Mycobacterium bovis subsp bovis AF2122/97
cucgcgcaaggcgccgca

SEQ ID NO: 3151132 - RNA, 19 nt, Mycobacterium bovis subsp bovis AF2122/97
cucgcgcaaggcgccgcag

SEQ ID NO: 3151133 - RNA, 18 nt, Mycobacterium bovis subsp bovis AF2122/97
cucgcgcacccugcgugc

SEQ ID NO: 3151134 - RNA, 18 nt, Mycobacterium bovis subsp bovis AF2122/97
cucgcgcagggaucgcag

SEQ ID NO: 3151135 - RNA, 19 nt, Mycobacterium bovis subsp bovis AF2122/97
cucgcgcaggucgccuucu

SEQ ID NO: 3151136 - RNA, 13 nt, Mycobacterium bovis subsp bovis AF2122/97
cucgcgccgguga

SEQ ID NO: 3151137 - RNA, 17 nt, Mycobacterium bovis subsp bovis AF2122/97
cucgcgcgcggcgacga

SEQ ID NO: 3151138 - RNA, 14 nt, Mycobacterium bovis subsp bovis AF2122/97
cucgcgcgucgcga

SEQ ID NO: 3151139 - RNA, 14 nt, Mycobacterium bovis subsp bovis AF2122/97
cucgcgcucgccgg

SEQ ID NO: 3151140 - RNA, 19 nt, Mycobacterium bovis subsp bovis AF2122/97
cucgcgcucgcucacgccg

SEQ ID NO: 3151141 - RNA, 19 nt, Mycobacterium bovis subsp bovis AF2122/97
cucgcggaugagcucggcc

SEQ ID NO: 3151142 - RNA, 16 nt, Mycobacterium bovis subsp bovis AF2122/97
cucgcggccggcgucg

SEQ ID NO: 3151143 - RNA, 14 nt, Mycobacterium bovis subsp bovis AF2122/97
cucgcggcgaccau

SEQ ID NO: 3151144 - RNA, 21 nt, Mycobacterium bovis subsp bovis AF2122/97
cucgcggcgaccauauucagc

SEQ ID NO: 3151145 - RNA, 18 nt, Mycobacterium bovis subsp bovis AF2122/97
cucgcggcgcggccgcag

SEQ ID NO: 3151146 - RNA, 23 nt, Mycobacterium bovis subsp bovis AF2122/97
cucgcggcggcgcuggcgggcag

SEQ ID NO: 3151147 - RNA, 22 nt, Mycobacterium bovis subsp bovis AF2122/97
cucgcggcuucaguccggcccc

SEQ ID NO: 3151148 - RNA, 17 nt, Mycobacterium bovis subsp bovis AF2122/97
cucgcgggcccgcgcgg

SEQ ID NO: 3151149 - RNA, 19 nt, Mycobacterium bovis subsp bovis AF2122/97
cucgcgggcccgcgcggcg

SEQ ID NO: 3151150 - RNA, 15 nt, Mycobacterium bovis subsp bovis AF2122/97
cucgcgggccgcguc

SEQ ID NO: 3151151 - RNA, 16 nt, Mycobacterium bovis subsp bovis AF2122/97
cucgcgggccgcgucg

SEQ ID NO: 3151152 - RNA, 14 nt, Mycobacterium bovis subsp bovis AF2122/97
cucgcgggcgacca

SEQ ID NO: 3151153 - RNA, 14 nt, Mycobacterium bovis subsp bovis AF2122/97
cucgcgggcgaucg

SEQ ID NO: 3151154 - RNA, 18 nt, Mycobacterium bovis subsp bovis AF2122/97
cucgcgggcgaucggcau

SEQ ID NO: 3151155 - RNA, 16 nt, Mycobacterium bovis subsp bovis AF2122/97
cucgcgggcggcgugg

SEQ ID NO: 3151156 - RNA, 21 nt, Mycobacterium bovis subsp bovis AF2122/97
cucgcgggcuuaugcacgacg

SEQ ID NO: 3151157 - RNA, 22 nt, Mycobacterium bovis subsp bovis AF2122/97
cucgcgggugcuggucaacagc

SEQ ID NO: 3151158 - RNA, 18 nt, Mycobacterium bovis subsp bovis AF2122/97
cucgcgguaguugucccg

SEQ ID NO: 3151159 - RNA, 15 nt, Mycobacterium bovis subsp bovis AF2122/97
cucgcggugcggcaa

SEQ ID NO: 3151160 - RNA, 22 nt, Mycobacterium bovis subsp bovis AF2122/97
cucgcggugcggcaacagcgcc

SEQ ID NO: 3151161 - RNA, 12 nt, Mycobacterium bovis subsp bovis AF2122/97
cucgcgguggcc

SEQ ID NO: 3151162 - RNA, 16 nt, Mycobacterium bovis subsp bovis AF2122/97
cucgcggugggcuucc

SEQ ID NO: 3151163 - RNA, 19 nt, Mycobacterium bovis subsp bovis AF2122/97
cucgcguagggccagcgcc

SEQ ID NO: 3151164 - RNA, 20 nt, Mycobacterium bovis subsp bovis AF2122/97
cucgcguagggccagcgccu

SEQ ID NO: 3151165 - RNA, 19 nt, Mycobacterium bovis subsp bovis AF2122/97
cucgcguccucggggaggu

SEQ ID NO: 3151166 - RNA, 16 nt, Mycobacterium bovis subsp bovis AF2122/97
cucgcguggcaccgac

SEQ ID NO: 3151167 - RNA, 20 nt, Mycobacterium bovis subsp bovis AF2122/97
cucgcguggcaccgacagca

SEQ ID NO: 3151168 - RNA, 15 nt, Mycobacterium bovis subsp bovis AF2122/97
cucgcguggccgccg

SEQ ID NO: 3151169 - RNA, 16 nt, Mycobacterium bovis subsp bovis AF2122/97
cucgcuaauugcggcc

SEQ ID NO: 3151170 - RNA, 19 nt, Mycobacterium bovis subsp bovis AF2122/97
cucgcuaauugcggccgcc

SEQ ID NO: 3151171 - RNA, 15 nt, Mycobacterium bovis subsp bovis AF2122/97
cucgcucacgccguc

SEQ ID NO: 3151172 - RNA, 19 nt, Mycobacterium bovis subsp bovis AF2122/97
cucgcuccgaccgguggcg

SEQ ID NO: 3151173 - RNA, 12 nt, Mycobacterium bovis subsp bovis AF2122/97
cucgcucgacgu

SEQ ID NO: 3151174 - RNA, 20 nt, Mycobacterium bovis subsp bovis AF2122/97
cucgcucgacguacagcgcg

SEQ ID NO: 3151175 - RNA, 15 nt, Mycobacterium bovis subsp bovis AF2122/97
cucgcucgccgagcu

SEQ ID NO: 3151176 - RNA, 21 nt, Mycobacterium bovis subsp bovis AF2122/97
cucgcucgccgagcugugcgc

SEQ ID NO: 3151177 - RNA, 16 nt, Mycobacterium bovis subsp bovis AF2122/97
cucgcucugcgcggcu

SEQ ID NO: 3151178 - RNA, 19 nt, Mycobacterium bovis subsp bovis AF2122/97
cucgcucugcgcggcuucg

SEQ ID NO: 3151179 - RNA, 15 nt, Mycobacterium bovis subsp bovis AF2122/97
cucgcugcaccagcu

SEQ ID NO: 3151180 - RNA, 18 nt, Mycobacterium bovis subsp bovis AF2122/97
cucgcugcaccagcugcu

SEQ ID NO: 3151181 - RNA, 19 nt, Mycobacterium bovis subsp bovis AF2122/97
cucgcugcaccagcugcuc

SEQ ID NO: 3151182 - RNA, 13 nt, Mycobacterium bovis subsp bovis AF2122/97
cucgcugcagcag

SEQ ID NO: 3151183 - RNA, 14 nt, Mycobacterium bovis subsp bovis AF2122/97
cucgcugcagcagg

SEQ ID NO: 3151184 - RNA, 20 nt, Mycobacterium bovis subsp bovis AF2122/97
cucgcugcagcagggcuucg

SEQ ID NO: 3151185 - RNA, 13 nt, Mycobacterium bovis subsp bovis AF2122/97
cucgcuggccgca

SEQ ID NO: 3151186 - RNA, 14 nt, Mycobacterium bovis subsp bovis AF2122/97
cucgcuggccgcac

SEQ ID NO: 3151187 - RNA, 20 nt, Mycobacterium bovis subsp bovis AF2122/97
cucgcugggaaaucccgacc

SEQ ID NO: 3151188 - RNA, 17 nt, Mycobacterium bovis subsp bovis AF2122/97
cucgcugggcucauggc

SEQ ID NO: 3151189 - RNA, 22 nt, Mycobacterium bovis subsp bovis AF2122/97
cucgcuggugaaccacucggug

SEQ ID NO: 3151190 - RNA, 19 nt, Mycobacterium bovis subsp bovis AF2122/97
cucgcuguugaagccgccc

SEQ ID NO: 3151191 - RNA, 20 nt, Mycobacterium bovis subsp bovis AF2122/97
cucgcuguugaagccgcccg

SEQ ID NO: 3151192 - RNA, 16 nt, Mycobacterium bovis subsp bovis AF2122/97
cucgcuguuggccggu

SEQ ID NO: 3151193 - RNA, 15 nt, Mycobacterium bovis subsp bovis AF2122/97
cucgcuucaggcacc

SEQ ID NO: 3151194 - RNA, 18 nt, Mycobacterium bovis subsp bovis AF2122/97
cucgcuucaggcaccgga

SEQ ID NO: 3151195 - RNA, 16 nt, Mycobacterium bovis subsp bovis AF2122/97
cucggaaaccgccccg

SEQ ID NO: 3151196 - RNA, 17 nt, Mycobacterium bovis subsp bovis AF2122/97
cucggaaacggaccucc

SEQ ID NO: 3151197 - RNA, 16 nt, Mycobacterium bovis subsp bovis AF2122/97
cucggaauucggcguc

SEQ ID NO: 3151198 - RNA, 23 nt, Mycobacterium bovis subsp bovis AF2122/97
cucggacaaagccgucgcgacgu

SEQ ID NO: 3151199 - RNA, 14 nt, Mycobacterium bovis subsp bovis AF2122/97
cucggcgacugcgu

SEQ ID NO: 3151200 - RNA, 19 nt, Mycobacterium bovis subsp bovis AF2122/97
cucggcgacugcgucggcg

SEQ ID NO: 3151201 - RNA, 22 nt, Mycobacterium bovis subsp bovis AF2122/97
cucggcgacugcgucggcggcu

SEQ ID NO: 3151202 - RNA, 16 nt, Mycobacterium bovis subsp bovis AF2122/97
cucggcgagcaacacg

SEQ ID NO: 3151203 - RNA, 15 nt, Mycobacterium bovis subsp bovis AF2122/97
cucggcgagcaccgu

SEQ ID NO: 3151204 - RNA, 20 nt, Mycobacterium bovis subsp bovis AF2122/97
cucggcgagcacgucacgcg

SEQ ID NO: 3151205 - RNA, 12 nt, Mycobacterium bovis subsp bovis AF2122/97
cucggcgagccg

SEQ ID NO: 3151206 - RNA, 14 nt, Mycobacterium bovis subsp bovis AF2122/97
cucggcgagcucag

SEQ ID NO: 3151207 - RNA, 17 nt, Mycobacterium bovis subsp bovis AF2122/97
cucggcgagcucaguga

SEQ ID NO: 3151208 - RNA, 22 nt, Mycobacterium bovis subsp bovis AF2122/97
cucggcgaggaacuggaccggu

SEQ ID NO: 3151209 - RNA, 17 nt, Mycobacterium bovis subsp bovis AF2122/97
cucggcgaguucggcag

SEQ ID NO: 3151210 - RNA, 16 nt, Mycobacterium bovis subsp bovis AF2122/97
cucggcgaucaagccu

SEQ ID NO: 3151211 - RNA, 22 nt, Mycobacterium bovis subsp bovis AF2122/97
cucggcgaucaauugcccggca

SEQ ID NO: 3151212 - RNA, 21 nt, Mycobacterium bovis subsp bovis AF2122/97
cucggcgaugaacgggaucga

SEQ ID NO: 3151213 - RNA, 14 nt, Mycobacterium bovis subsp bovis AF2122/97
cucggcgaugcuga

SEQ ID NO: 3151214 - RNA, 13 nt, Mycobacterium bovis subsp bovis AF2122/97
cucggcgcagcac

SEQ ID NO: 3151215 - RNA, 22 nt, Mycobacterium bovis subsp bovis AF2122/97
cucggcgcagcacauccugcag

SEQ ID NO: 3151216 - RNA, 23 nt, Mycobacterium bovis subsp bovis AF2122/97
cucggcgcagcacauccugcagc

SEQ ID NO: 3151217 - RNA, 12 nt, Mycobacterium bovis subsp bovis AF2122/97
cucggcgcagcc

SEQ ID NO: 3151218 - RNA, 13 nt, Mycobacterium bovis subsp bovis AF2122/97
cucggcgcagccg

SEQ ID NO: 3151219 - RNA, 16 nt, Mycobacterium bovis subsp bovis AF2122/97
cucggcgcagcuaacc

SEQ ID NO: 3151220 - RNA, 21 nt, Mycobacterium bovis subsp bovis AF2122/97
cucggcgccacggugucgcga

SEQ ID NO: 3151221 - RNA, 14 nt, Mycobacterium bovis subsp bovis AF2122/97
cucggcgcccagcu

SEQ ID NO: 3151222 - RNA, 13 nt, Mycobacterium bovis subsp bovis AF2122/97
cucggcgccgaac

SEQ ID NO: 3151223 - RNA, 14 nt, Mycobacterium bovis subsp bovis AF2122/97
cucggcgccgaacu

SEQ ID NO: 3151224 - RNA, 21 nt, Mycobacterium bovis subsp bovis AF2122/97
cucggcgccgaacucaacgac

SEQ ID NO: 3151225 - RNA, 15 nt, Mycobacterium bovis subsp bovis AF2122/97
cucggcgccgcccag

SEQ ID NO: 3151226 - RNA, 14 nt, Mycobacterium bovis subsp bovis AF2122/97
cucggcgcgcagcg

SEQ ID NO: 3151227 - RNA, 21 nt, Mycobacterium bovis subsp bovis AF2122/97
cucggcgcuagcugcugaugc

SEQ ID NO: 3151228 - RNA, 22 nt, Mycobacterium bovis subsp bovis AF2122/97
cucggcgcucaugggcgccauc

SEQ ID NO: 3151229 - RNA, 16 nt, Mycobacterium bovis subsp bovis AF2122/97
cucggcgcugcgcacc

SEQ ID NO: 3151230 - RNA, 19 nt, Mycobacterium bovis subsp bovis AF2122/97
cucggcgcugcgcaccgcc

SEQ ID NO: 3151231 - RNA, 20 nt, Mycobacterium bovis subsp bovis AF2122/97
cucggcggaagaccggaucg

SEQ ID NO: 3151232 - RNA, 15 nt, Mycobacterium bovis subsp bovis AF2122/97
cucggcggagaaaag

SEQ ID NO: 3151233 - RNA, 20 nt, Mycobacterium bovis subsp bovis AF2122/97
cucggcggagaaaagcgcgc

SEQ ID NO: 3151234 - RNA, 13 nt, Mycobacterium bovis subsp bovis AF2122/97
cucggcggcagcg

SEQ ID NO: 3151235 - RNA, 15 nt, Mycobacterium bovis subsp bovis AF2122/97
cucggcggcagcggc

SEQ ID NO: 3151236 - RNA, 14 nt, Mycobacterium bovis subsp bovis AF2122/97
cucggcggccacca

SEQ ID NO: 3151237 - RNA, 12 nt, Mycobacterium bovis subsp bovis AF2122/97
cucggcggccag

SEQ ID NO: 3151238 - RNA, 19 nt, Mycobacterium bovis subsp bovis AF2122/97
cucggcggccagcucggcc

SEQ ID NO: 3151239 - RNA, 13 nt, Mycobacterium bovis subsp bovis AF2122/97
cucggcggccgcg

SEQ ID NO: 3151240 - RNA, 21 nt, Mycobacterium bovis subsp bovis AF2122/97
cucggcggccucgcugcucag

SEQ ID NO: 3151241 - RNA, 13 nt, Mycobacterium bovis subsp bovis AF2122/97
cucggcggcgccg

SEQ ID NO: 3151242 - RNA, 12 nt, Mycobacterium bovis subsp bovis AF2122/97
cucggcggcgcg

SEQ ID NO: 3151243 - RNA, 20 nt, Mycobacterium bovis subsp bovis AF2122/97
cucggcggcgcggucgaagc

SEQ ID NO: 3151244 - RNA, 22 nt, Mycobacterium bovis subsp bovis AF2122/97
cucggcggcgcgugcgguggcg

SEQ ID NO: 3151245 - RNA, 21 nt, Mycobacterium bovis subsp bovis AF2122/97
cucggcggcggcacgcugacc

SEQ ID NO: 3151246 - RNA, 14 nt, Mycobacterium bovis subsp bovis AF2122/97
cucggcggcggcuu

SEQ ID NO: 3151247 - RNA, 15 nt, Mycobacterium bovis subsp bovis AF2122/97
cucggcggcggcuuc

SEQ ID NO: 3151248 - RNA, 13 nt, Mycobacterium bovis subsp bovis AF2122/97
cucggcggcguug

SEQ ID NO: 3151249 - RNA, 21 nt, Mycobacterium bovis subsp bovis AF2122/97
cucggcgggauccucgaaggc

SEQ ID NO: 3151250 - RNA, 17 nt, Mycobacterium bovis subsp bovis AF2122/97
cucggcggggaccgcgg

SEQ ID NO: 3151251 - RNA, 21 nt, Mycobacterium bovis subsp bovis AF2122/97
cucggcgggggaccccgccag

SEQ ID NO: 3151252 - RNA, 23 nt, Mycobacterium bovis subsp bovis AF2122/97
cucggcggguauauggugcgcca

SEQ ID NO: 3151253 - RNA, 17 nt, Mycobacterium bovis subsp bovis AF2122/97
cucggcgguaaaugccu

SEQ ID NO: 3151254 - RNA, 24 nt, Mycobacterium bovis subsp bovis AF2122/97
cucggcgguaaaugccugcccacc

SEQ ID NO: 3151255 - RNA, 22 nt, Mycobacterium bovis subsp bovis AF2122/97
cucggcggucuuggcgcgccca

SEQ ID NO: 3151256 - RNA, 21 nt, Mycobacterium bovis subsp bovis AF2122/97
cucggcggugcaguggcuacg

SEQ ID NO: 3151257 - RNA, 23 nt, Mycobacterium bovis subsp bovis AF2122/97
cucggcggugccgcggcuaggcc

SEQ ID NO: 3151258 - RNA, 14 nt, Mycobacterium bovis subsp bovis AF2122/97
cucggcguccgccc

SEQ ID NO: 3151259 - RNA, 18 nt, Mycobacterium bovis subsp bovis AF2122/97
cucggcguccgcccagca

SEQ ID NO: 3151260 - RNA, 20 nt, Mycobacterium bovis subsp bovis AF2122/97
cucggcguccgcccagcacc

SEQ ID NO: 3151261 - RNA, 12 nt, Mycobacterium bovis subsp bovis AF2122/97
cucggcgucgac

SEQ ID NO: 3151262 - RNA, 17 nt, Mycobacterium bovis subsp bovis AF2122/97
cucggcgucgaccaguu

SEQ ID NO: 3151263 - RNA, 19 nt, Mycobacterium bovis subsp bovis AF2122/97
cucggcgucgaccaguucg

SEQ ID NO: 3151264 - RNA, 14 nt, Mycobacterium bovis subsp bovis AF2122/97
cucggcgucgccgc

SEQ ID NO: 3151265 - RNA, 22 nt, Mycobacterium bovis subsp bovis AF2122/97
cucggcgucgugguggccacgg

SEQ ID NO: 3151266 - RNA, 15 nt, Mycobacterium bovis subsp bovis AF2122/97
cucggcgugcucggc

SEQ ID NO: 3151267 - RNA, 23 nt, Mycobacterium bovis subsp bovis AF2122/97
cucggcguggcaguacaccggcg

SEQ ID NO: 3151268 - RNA, 16 nt, Mycobacterium bovis subsp bovis AF2122/97
cucggcguguccgccg

SEQ ID NO: 3151269 - RNA, 16 nt, Mycobacterium bovis subsp bovis AF2122/97
cucggcguugccgccg

SEQ ID NO: 3151270 - RNA, 19 nt, Mycobacterium bovis subsp bovis AF2122/97
cucggcguuuucggugagc

SEQ ID NO: 3151271 - RNA, 23 nt, Mycobacterium bovis subsp bovis AF2122/97
cucggcugcucgacggcuccgau

SEQ ID NO: 3151272 - RNA, 13 nt, Mycobacterium bovis subsp bovis AF2122/97
cucggcuucggag

SEQ ID NO: 3151273 - RNA, 22 nt, Mycobacterium bovis subsp bovis AF2122/97
cucggcuucggagccgacaacg

SEQ ID NO: 3151274 - RNA, 17 nt, Mycobacterium bovis subsp bovis AF2122/97
cucggcuuugccgcugu

SEQ ID NO: 3151275 - RNA, 19 nt, Mycobacterium bovis subsp bovis AF2122/97
cucgggacucccgcgcggg

SEQ ID NO: 3151276 - RNA, 15 nt, Mycobacterium bovis subsp bovis AF2122/97
cucgggaggcagcgc

SEQ ID NO: 3151277 - RNA, 18 nt, Mycobacterium bovis subsp bovis AF2122/97
cucgggcaacucggugac

SEQ ID NO: 3151278 - RNA, 14 nt, Mycobacterium bovis subsp bovis AF2122/97
cucgggcaaugucg

SEQ ID NO: 3151279 - RNA, 18 nt, Mycobacterium bovis subsp bovis AF2122/97
cucgggcaaugucgacac

SEQ ID NO: 3151280 - RNA, 14 nt, Mycobacterium bovis subsp bovis AF2122/97
cucgggcagcgcgg

SEQ ID NO: 3151281 - RNA, 22 nt, Mycobacterium bovis subsp bovis AF2122/97
cucgggcagcgcggccagugcu

SEQ ID NO: 3151282 - RNA, 16 nt, Mycobacterium bovis subsp bovis AF2122/97
cucgggcagcgucacc

SEQ ID NO: 3151283 - RNA, 12 nt, Mycobacterium bovis subsp bovis AF2122/97
cucgggcagcuu

SEQ ID NO: 3151284 - RNA, 20 nt, Mycobacterium bovis subsp bovis AF2122/97
cucgggcagcuucaacaccg

SEQ ID NO: 3151285 - RNA, 22 nt, Mycobacterium bovis subsp bovis AF2122/97
cucgggcagcuucaacaccggc

SEQ ID NO: 3151286 - RNA, 23 nt, Mycobacterium bovis subsp bovis AF2122/97
cucgguuugacgagacgacgacc

SEQ ID NO: 3151287 - RNA, 19 nt, Mycobacterium bovis subsp bovis AF2122/97
cucgguuugcguccuggug

SEQ ID NO: 3151288 - RNA, 22 nt, Mycobacterium bovis subsp bovis AF2122/97
cucgguuugggaauccgcaucu

SEQ ID NO: 3151289 - RNA, 13 nt, Mycobacterium bovis subsp bovis AF2122/97
cucguacccggcc

SEQ ID NO: 3151290 - RNA, 19 nt, Mycobacterium bovis subsp bovis AF2122/97
cucguacggaccgucgccg

SEQ ID NO: 3151291 - RNA, 23 nt, Mycobacterium bovis subsp bovis AF2122/97
cucguacggaccgucgccgguga

SEQ ID NO: 3151292 - RNA, 17 nt, Mycobacterium bovis subsp bovis AF2122/97
cucguagaaucggcuca

SEQ ID NO: 3151293 - RNA, 18 nt, Mycobacterium bovis subsp bovis AF2122/97
cucguagaaucggcucag

SEQ ID NO: 3151294 - RNA, 17 nt, Mycobacterium bovis subsp bovis AF2122/97
cucguagacuugcugcu

SEQ ID NO: 3151295 - RNA, 14 nt, Mycobacterium bovis subsp bovis AF2122/97
cucguagagcaccg

SEQ ID NO: 3151296 - RNA, 19 nt, Mycobacterium bovis subsp bovis AF2122/97
cucguaggcguacaccagg

SEQ ID NO: 3151297 - RNA, 20 nt, Mycobacterium bovis subsp bovis AF2122/97
cucguauacccgggcggucg

SEQ ID NO: 3151298 - RNA, 19 nt, Mycobacterium bovis subsp bovis AF2122/97
cucgucaaccugcgcauca

SEQ ID NO: 3151299 - RNA, 20 nt, Mycobacterium bovis subsp bovis AF2122/97
cucgucaaucaccaccgcca

SEQ ID NO: 3151300 - RNA, 16 nt, Mycobacterium bovis subsp bovis AF2122/97
cucguccaagccggcc

SEQ ID NO: 3151301 - RNA, 17 nt, Mycobacterium bovis subsp bovis AF2122/97
cucguccaagccggcca

SEQ ID NO: 3151302 - RNA, 21 nt, Mycobacterium bovis subsp bovis AF2122/97
cucguccaccacaccugcggc

SEQ ID NO: 3151303 - RNA, 13 nt, Mycobacterium bovis subsp bovis AF2122/97
cucguccagcaac

SEQ ID NO: 3151304 - RNA, 16 nt, Mycobacterium bovis subsp bovis AF2122/97
cucguccagcagugcg

SEQ ID NO: 3151305 - RNA, 19 nt, Mycobacterium bovis subsp bovis AF2122/97
cucguccaggucggccgcc

SEQ ID NO: 3151306 - RNA, 21 nt, Mycobacterium bovis subsp bovis AF2122/97
cucguccaggucggccgccuc

SEQ ID NO: 3151307 - RNA, 16 nt, Mycobacterium bovis subsp bovis AF2122/97
cucguccggugcgauc

SEQ ID NO: 3151308 - RNA, 21 nt, Mycobacterium bovis subsp bovis AF2122/97
cucguccggugcgaucccacc

SEQ ID NO: 3151309 - RNA, 23 nt, Mycobacterium bovis subsp bovis AF2122/97
cucguccugacgguacagcucca

SEQ ID NO: 3151310 - RNA, 16 nt, Mycobacterium bovis subsp bovis AF2122/97
cucguccuggaaccaa

SEQ ID NO: 3151311 - RNA, 18 nt, Mycobacterium bovis subsp bovis AF2122/97
cucgucgaacauggcacg

SEQ ID NO: 3151312 - RNA, 18 nt, Mycobacterium bovis subsp bovis AF2122/97
cucgucgagccgaccgcg

SEQ ID NO: 3151313 - RNA, 21 nt, Mycobacterium bovis subsp bovis AF2122/97
cucgucgaggaagaucaccuc

SEQ ID NO: 3151314 - RNA, 18 nt, Mycobacterium bovis subsp bovis AF2122/97
cucgucgaggcugaccgu

SEQ ID NO: 3151315 - RNA, 18 nt, Mycobacterium bovis subsp bovis AF2122/97
cucgucgaggucagcucc

SEQ ID NO: 3151316 - RNA, 13 nt, Mycobacterium bovis subsp bovis AF2122/97
cucgucgaggucc

SEQ ID NO: 3151317 - RNA, 20 nt, Mycobacterium bovis subsp bovis AF2122/97
cucgucgaucgccgcgaugg

SEQ ID NO: 3151318 - RNA, 17 nt, Mycobacterium bovis subsp bovis AF2122/97
cucgucgaucucgaucg

SEQ ID NO: 3151319 - RNA, 12 nt, Mycobacterium bovis subsp bovis AF2122/97
cucgucgaugcc

SEQ ID NO: 3151320 - RNA, 16 nt, Mycobacterium bovis subsp bovis AF2122/97
cucgucgaugcggugg

SEQ ID NO: 3151321 - RNA, 19 nt, Mycobacterium bovis subsp bovis AF2122/97
cucgucgaugcggugguag

SEQ ID NO: 3151322 - RNA, 20 nt, Mycobacterium bovis subsp bovis AF2122/97
cucgucgaugucguuggcca

SEQ ID NO: 3151323 - RNA, 18 nt, Mycobacterium bovis subsp bovis AF2122/97
cucgucgauugucaaccc

SEQ ID NO: 3151324 - RNA, 14 nt, Mycobacterium bovis subsp bovis AF2122/97
cucgucgccccguu

SEQ ID NO: 3151325 - RNA, 16 nt, Mycobacterium bovis subsp bovis AF2122/97
cucgucgccgcgguag

SEQ ID NO: 3151326 - RNA, 16 nt, Mycobacterium bovis subsp bovis AF2122/97
cucgucgccgguggca

SEQ ID NO: 3151327 - RNA, 20 nt, Mycobacterium bovis subsp bovis AF2122/97
cucgucgccuagccgcuccg

SEQ ID NO: 3151328 - RNA, 12 nt, Mycobacterium bovis subsp bovis AF2122/97
cucgucgcggcc

SEQ ID NO: 3151329 - RNA, 18 nt, Mycobacterium bovis subsp bovis AF2122/97
cucgucgcgggccaccgc

SEQ ID NO: 3151330 - RNA, 17 nt, Mycobacterium bovis subsp bovis AF2122/97
cucgucgcgggcgaugg

SEQ ID NO: 3151331 - RNA, 13 nt, Mycobacterium bovis subsp bovis AF2122/97
cucgucgcgucgc

SEQ ID NO: 3151332 - RNA, 16 nt, Mycobacterium bovis subsp bovis AF2122/97
cucgucggccaccgcg

SEQ ID NO: 3151333 - RNA, 14 nt, Mycobacterium bovis subsp bovis AF2122/97
cucgucggccagug

SEQ ID NO: 3151334 - RNA, 16 nt, Mycobacterium bovis subsp bovis AF2122/97
cucgucggccgacacc

SEQ ID NO: 3151335 - RNA, 21 nt, Mycobacterium bovis subsp bovis AF2122/97
cucgucggccgacaccgccac

SEQ ID NO: 3151336 - RNA, 23 nt, Mycobacterium bovis subsp bovis AF2122/97
cucgucggccgacaccgccacca

SEQ ID NO: 3151337 - RNA, 24 nt, Mycobacterium bovis subsp bovis AF2122/97
cucgucggccugguacucccgcga

SEQ ID NO: 3151338 - RNA, 19 nt, Mycobacterium bovis subsp bovis AF2122/97
cucgucggcgacggccagc

SEQ ID NO: 3151339 - RNA, 21 nt, Mycobacterium bovis subsp bovis AF2122/97
cucgucggcgauggccagcac

SEQ ID NO: 3151340 - RNA, 19 nt, Mycobacterium bovis subsp bovis AF2122/97
cucgucggcgccggcggcc

SEQ ID NO: 3151341 - RNA, 18 nt, Mycobacterium bovis subsp bovis AF2122/97
cucgucggcuuuggacag

SEQ ID NO: 3151342 - RNA, 22 nt, Mycobacterium bovis subsp bovis AF2122/97
cucgucgggaucggcguccauc

SEQ ID NO: 3151343 - RNA, 17 nt, Mycobacterium bovis subsp bovis AF2122/97
cucgucgggguugaugu

SEQ ID NO: 3151344 - RNA, 15 nt, Mycobacterium bovis subsp bovis AF2122/97
cucgucggugcgcgc

SEQ ID NO: 3151345 - RNA, 15 nt, Mycobacterium bovis subsp bovis AF2122/97
cucgucggugucggu

SEQ ID NO: 3151346 - RNA, 22 nt, Mycobacterium bovis subsp bovis AF2122/97
cucgucggugucgguucggucg

SEQ ID NO: 3151347 - RNA, 15 nt, Mycobacterium bovis subsp bovis AF2122/97
cucgucguccggcca

SEQ ID NO: 3151348 - RNA, 19 nt, Mycobacterium bovis subsp bovis AF2122/97
cucgucgucgaaguuggcg

SEQ ID NO: 3151349 - RNA, 16 nt, Mycobacterium bovis subsp bovis AF2122/97
cucgucgucgauccag

SEQ ID NO: 3151350 - RNA, 19 nt, Mycobacterium bovis subsp bovis AF2122/97
cucgucgucgauccagccc

SEQ ID NO: 3151351 - RNA, 20 nt, Mycobacterium bovis subsp bovis AF2122/97
cucgucgucgauccagccca

SEQ ID NO: 3151352 - RNA, 22 nt, Mycobacterium bovis subsp bovis AF2122/97
cucgucgucgauuagcccaccc

SEQ ID NO: 3151353 - RNA, 23 nt, Mycobacterium bovis subsp bovis AF2122/97
cucgucgugagacugggcgcugg

SEQ ID NO: 3151354 - RNA, 21 nt, Mycobacterium bovis subsp bovis AF2122/97
cucgucuugggccgggaugaa

SEQ ID NO: 3151355 - RNA, 18 nt, Mycobacterium bovis subsp bovis AF2122/97
cucgugagccccagcgac

SEQ ID NO: 3151356 - RNA, 13 nt, Mycobacterium bovis subsp bovis AF2122/97
cucgugcacgcac

SEQ ID NO: 3151357 - RNA, 21 nt, Mycobacterium bovis subsp bovis AF2122/97
cucgugcacgcacagcccgau

SEQ ID NO: 3151358 - RNA, 18 nt, Mycobacterium bovis subsp bovis AF2122/97
cucgugcaggaccagcac

SEQ ID NO: 3151359 - RNA, 22 nt, Mycobacterium bovis subsp bovis AF2122/97
cucgugcaggaccagcaccgcc

SEQ ID NO: 3151360 - RNA, 23 nt, Mycobacterium bovis subsp bovis AF2122/97
cucgugcgcuuggucgaccgccg

SEQ ID NO: 3151361 - RNA, 19 nt, Mycobacterium bovis subsp bovis AF2122/97
cucgugcgugggcgcggcg

SEQ ID NO: 3151362 - RNA, 16 nt, Mycobacterium bovis subsp bovis AF2122/97
cucguggaucugccuc

SEQ ID NO: 3151363 - RNA, 17 nt, Mycobacterium bovis subsp bovis AF2122/97
cucguggaucugccucu

SEQ ID NO: 3151364 - RNA, 16 nt, Mycobacterium bovis subsp bovis AF2122/97
cucguggucgacguga

SEQ ID NO: 3151365 - RNA, 16 nt, Mycobacterium bovis subsp bovis AF2122/97
cucguguaccggagcg

SEQ ID NO: 3151366 - RNA, 20 nt, Mycobacterium bovis subsp bovis AF2122/97
cucguguccggggaccucgg

SEQ ID NO: 3151367 - RNA, 16 nt, Mycobacterium bovis subsp bovis AF2122/97
cucguuaucgaccgcc

SEQ ID NO: 3151368 - RNA, 17 nt, Mycobacterium bovis subsp bovis AF2122/97
cucguucaacuuggggu

SEQ ID NO: 3151369 - RNA, 15 nt, Mycobacterium bovis subsp bovis AF2122/97
cucguugaccggccg

SEQ ID NO: 3151370 - RNA, 22 nt, Mycobacterium bovis subsp bovis AF2122/97
cucguugagcagcuggaccacc

SEQ ID NO: 3151371 - RNA, 17 nt, Mycobacterium bovis subsp bovis AF2122/97
cucguugaugcggcuau

SEQ ID NO: 3151372 - RNA, 22 nt, Mycobacterium bovis subsp bovis AF2122/97
cucguugcguugcaucagcacg

SEQ ID NO: 3151373 - RNA, 13 nt, Mycobacterium bovis subsp bovis AF2122/97
cucguuguagccg

SEQ ID NO: 3151374 - RNA, 17 nt, Mycobacterium bovis subsp bovis AF2122/97
cucuacacccggacugc

SEQ ID NO: 3151375 - RNA, 17 nt, Mycobacterium bovis subsp bovis AF2122/97
cucuaccagccgccccg

SEQ ID NO: 3151376 - RNA, 20 nt, Mycobacterium bovis subsp bovis AF2122/97
cucuaccgguccgucaccac

SEQ ID NO: 3151377 - RNA, 23 nt, Mycobacterium bovis subsp bovis AF2122/97
cucuaccgguccgucaccaccgc

SEQ ID NO: 3151378 - RNA, 16 nt, Mycobacterium bovis subsp bovis AF2122/97
cucuaccggugguagc

SEQ ID NO: 3151379 - RNA, 17 nt, Mycobacterium bovis subsp bovis AF2122/97
cucuaccuccgccaacu

SEQ ID NO: 3151380 - RNA, 18 nt, Mycobacterium bovis subsp bovis AF2122/97
cucuagauauggaccgcc

SEQ ID NO: 3151381 - RNA, 22 nt, Mycobacterium bovis subsp bovis AF2122/97
cucuagauauggaccgccgccg

SEQ ID NO: 3151382 - RNA, 23 nt, Mycobacterium bovis subsp bovis AF2122/97
cucuagauauggaccgccgccga

SEQ ID NO: 3151383 - RNA, 15 nt, Mycobacterium bovis subsp bovis AF2122/97
cucuagcaaagccag

SEQ ID NO: 3151384 - RNA, 18 nt, Mycobacterium bovis subsp bovis AF2122/97
cucuagcaaagccagcgc

SEQ ID NO: 3151385 - RNA, 21 nt, Mycobacterium bovis subsp bovis AF2122/97
cucuagcaaagccagcgcagc

SEQ ID NO: 3151386 - RNA, 19 nt, Mycobacterium bovis subsp bovis AF2122/97
cucuaucagacgauucggc

SEQ ID NO: 3151387 - RNA, 19 nt, Mycobacterium bovis subsp bovis AF2122/97
cucuccggugaucaccgac

SEQ ID NO: 3151388 - RNA, 20 nt, Mycobacterium bovis subsp bovis AF2122/97
cucuccggugaucaccgaca

SEQ ID NO: 3151389 - RNA, 13 nt, Mycobacterium bovis subsp bovis AF2122/97
cucuccguccucg

SEQ ID NO: 3151390 - RNA, 19 nt, Mycobacterium bovis subsp bovis AF2122/97
cucuccguccucgucccag

SEQ ID NO: 3151391 - RNA, 18 nt, Mycobacterium bovis subsp bovis AF2122/97
cucuccgucgcgcacggc

SEQ ID NO: 3151392 - RNA, 18 nt, Mycobacterium bovis subsp bovis AF2122/97
cucuccuggaaaggacgg

SEQ ID NO: 3151393 - RNA, 19 nt, Mycobacterium bovis subsp bovis AF2122/97
cucuccuggaaaggacggc

SEQ ID NO: 3151394 - RNA, 20 nt, Mycobacterium bovis subsp bovis AF2122/97
cucucgcagcauguccgcag

SEQ ID NO: 3151395 - RNA, 14 nt, Mycobacterium bovis subsp bovis AF2122/97
cucucgccacgccg

SEQ ID NO: 3151396 - RNA, 17 nt, Mycobacterium bovis subsp bovis AF2122/97
cucucggcacccggcag

SEQ ID NO: 3151397 - RNA, 14 nt, Mycobacterium bovis subsp bovis AF2122/97
cucucgggggccga

SEQ ID NO: 3151398 - RNA, 18 nt, Mycobacterium bovis subsp bovis AF2122/97
cucucgggggccgagccg

SEQ ID NO: 3151399 - RNA, 17 nt, Mycobacterium bovis subsp bovis AF2122/97
cucucggucaguuccuc

SEQ ID NO: 3151400 - RNA, 17 nt, Mycobacterium bovis subsp bovis AF2122/97
cucucggucugcaugcg

SEQ ID NO: 3151401 - RNA, 21 nt, Mycobacterium bovis subsp bovis AF2122/97
cucucggugaacgccgccccg

SEQ ID NO: 3151402 - RNA, 15 nt, Mycobacterium bovis subsp bovis AF2122/97
cucucuucgcgcgcu

SEQ ID NO: 3151403 - RNA, 21 nt, Mycobacterium bovis subsp bovis AF2122/97
cucucuucgcgcgcugggcgc

SEQ ID NO: 3151404 - RNA, 16 nt, Mycobacterium bovis subsp bovis AF2122/97
cucucuuugagcaggu

SEQ ID NO: 3151405 - RNA, 15 nt, Mycobacterium bovis subsp bovis AF2122/97
cucugaaccagcuga

SEQ ID NO: 3151406 - RNA, 17 nt, Mycobacterium bovis subsp bovis AF2122/97
cucugaccagccggucu

SEQ ID NO: 3151407 - RNA, 15 nt, Mycobacterium bovis subsp bovis AF2122/97
cucugagcuuggucg

SEQ ID NO: 3151408 - RNA, 13 nt, Mycobacterium bovis subsp bovis AF2122/97
cucugcaaugccu

SEQ ID NO: 3151409 - RNA, 22 nt, Mycobacterium bovis subsp bovis AF2122/97
cucugccacgcguuccuccagc

SEQ ID NO: 3151410 - RNA, 15 nt, Mycobacterium bovis subsp bovis AF2122/97
cucugcgaucaguuc

SEQ ID NO: 3151411 - RNA, 14 nt, Mycobacterium bovis subsp bovis AF2122/97
cucugcgccaggcg

SEQ ID NO: 3151412 - RNA, 16 nt, Mycobacterium bovis subsp bovis AF2122/97
cucuggaucacgucga

SEQ ID NO: 3151413 - RNA, 18 nt, Mycobacterium bovis subsp bovis AF2122/97
cucuggaucacgucgaug

SEQ ID NO: 3151414 - RNA, 22 nt, Mycobacterium bovis subsp bovis AF2122/97
cucuggaucacgucgaugugac

SEQ ID NO: 3151415 - RNA, 23 nt, Mycobacterium bovis subsp bovis AF2122/97
cucuggcggcgggggcggcggcu

SEQ ID NO: 3151416 - RNA, 12 nt, Mycobacterium bovis subsp bovis AF2122/97
cucuggucgucg

SEQ ID NO: 3151417 - RNA, 22 nt, Mycobacterium bovis subsp bovis AF2122/97
cucuggucgucgaacggcagcc

SEQ ID NO: 3151418 - RNA, 20 nt, Mycobacterium bovis subsp bovis AF2122/97
cucugguggcgcugaagccg

SEQ ID NO: 3151419 - RNA, 14 nt, Mycobacterium bovis subsp bovis AF2122/97
cucuggugucgucg

SEQ ID NO: 3151420 - RNA, 21 nt, Mycobacterium bovis subsp bovis AF2122/97
cucugguuuuacacaccagcg

SEQ ID NO: 3151421 - RNA, 17 nt, Mycobacterium bovis subsp bovis AF2122/97
cucuguggugucgauug

SEQ ID NO: 3151422 - RNA, 20 nt, Mycobacterium bovis subsp bovis AF2122/97
cucuucagcuaccuccgcca

SEQ ID NO: 3151423 - RNA, 12 nt, Mycobacterium bovis subsp bovis AF2122/97
cucuucaggccc

SEQ ID NO: 3151424 - RNA, 17 nt, Mycobacterium bovis subsp bovis AF2122/97
cucuucccaaccgcccg

SEQ ID NO: 3151425 - RNA, 23 nt, Mycobacterium bovis subsp bovis AF2122/97
cucuucgcgcgcugggcgcgcuc

SEQ ID NO: 3151426 - RNA, 16 nt, Mycobacterium bovis subsp bovis AF2122/97
cucuucggaggugacc

SEQ ID NO: 3151427 - RNA, 21 nt, Mycobacterium bovis subsp bovis AF2122/97
cucuucggcaccaccgcgacc

SEQ ID NO: 3151428 - RNA, 22 nt, Mycobacterium bovis subsp bovis AF2122/97
cucuucggcggacaggcccggu

SEQ ID NO: 3151429 - RNA, 17 nt, Mycobacterium bovis subsp bovis AF2122/97
cucuucgggugcagcca

SEQ ID NO: 3151430 - RNA, 18 nt, Mycobacterium bovis subsp bovis AF2122/97
cucuucgggugcagccag

SEQ ID NO: 3151431 - RNA, 20 nt, Mycobacterium bovis subsp bovis AF2122/97
cucuucggucagggugggcu

SEQ ID NO: 3151432 - RNA, 21 nt, Mycobacterium bovis subsp bovis AF2122/97
cucuucggucagggugggcuc

SEQ ID NO: 3151433 - RNA, 13 nt, Mycobacterium bovis subsp bovis AF2122/97
cucuugcaccagg

SEQ ID NO: 3151434 - RNA, 16 nt, Mycobacterium bovis subsp bovis AF2122/97
cucuugcaccagggcc

SEQ ID NO: 3151435 - RNA, 17 nt, Mycobacterium bovis subsp bovis AF2122/97
cucuugcacucggcgcc

SEQ ID NO: 3151436 - RNA, 19 nt, Mycobacterium bovis subsp bovis AF2122/97
cucuugcacucggcgcccu

SEQ ID NO: 3151437 - RNA, 13 nt, Mycobacterium bovis subsp bovis AF2122/97
cucuugcccuucu

SEQ ID NO: 3151438 - RNA, 13 nt, Mycobacterium bovis subsp bovis AF2122/97
cucuugcgccacg

SEQ ID NO: 3151439 - RNA, 14 nt, Mycobacterium bovis subsp bovis AF2122/97
cucuugcgggcagc

SEQ ID NO: 3151440 - RNA, 21 nt, Mycobacterium bovis subsp bovis AF2122/97
cucuugcgggcagccgcccgc

SEQ ID NO: 3151441 - RNA, 17 nt, Mycobacterium bovis subsp bovis AF2122/97
cugaaaacaccgcacgg

SEQ ID NO: 3151442 - RNA, 21 nt, Mycobacterium bovis subsp bovis AF2122/97
cugaaaacaccgcacggugcu

SEQ ID NO: 3151443 - RNA, 16 nt, Mycobacterium bovis subsp bovis AF2122/97
cugaaaauugaccccc

SEQ ID NO: 3151444 - RNA, 21 nt, Mycobacterium bovis subsp bovis AF2122/97
cugaaaccuugcggcagacca

SEQ ID NO: 3151445 - RNA, 20 nt, Mycobacterium bovis subsp bovis AF2122/97
cugaaacgauugcugcggcu

SEQ ID NO: 3151446 - RNA, 19 nt, Mycobacterium bovis subsp bovis AF2122/97
cugaaacgcuuggcccugg

SEQ ID NO: 3151447 - RNA, 22 nt, Mycobacterium bovis subsp bovis AF2122/97
cugaaaucgguggccaccaccg

SEQ ID NO: 3151448 - RNA, 14 nt, Mycobacterium bovis subsp bovis AF2122/97
cugaacaaccagca

SEQ ID NO: 3151449 - RNA, 16 nt, Mycobacterium bovis subsp bovis AF2122/97
cugaacaccgugggcg

SEQ ID NO: 3151450 - RNA, 15 nt, Mycobacterium bovis subsp bovis AF2122/97
cugaacacgcagccg

SEQ ID NO: 3151451 - RNA, 13 nt, Mycobacterium bovis subsp bovis AF2122/97
cugaaccacgcgu

SEQ ID NO: 3151452 - RNA, 17 nt, Mycobacterium bovis subsp bovis AF2122/97
cugaaccgcugggacaa

SEQ ID NO: 3151453 - RNA, 18 nt, Mycobacterium bovis subsp bovis AF2122/97
cugaaccggccgcgacga

SEQ ID NO: 3151454 - RNA, 22 nt, Mycobacterium bovis subsp bovis AF2122/97
cugaaccgguugacacccgggc

SEQ ID NO: 3151455 - RNA, 16 nt, Mycobacterium bovis subsp bovis AF2122/97
cugaaccguagcgccc

SEQ ID NO: 3151456 - RNA, 19 nt, Mycobacterium bovis subsp bovis AF2122/97
cugaacgcgagcaacacca

SEQ ID NO: 3151457 - RNA, 16 nt, Mycobacterium bovis subsp bovis AF2122/97
cugaacgguuucuuuc

SEQ ID NO: 3151458 - RNA, 14 nt, Mycobacterium bovis subsp bovis AF2122/97
cugacgacugggcg

SEQ ID NO: 3151459 - RNA, 15 nt, Mycobacterium bovis subsp bovis AF2122/97
cugacgacugggcgc

SEQ ID NO: 3151460 - RNA, 20 nt, Mycobacterium bovis subsp bovis AF2122/97
cugacgacugggcgcccaag

SEQ ID NO: 3151461 - RNA, 21 nt, Mycobacterium bovis subsp bovis AF2122/97
cugacgagcagcuagcccggc

SEQ ID NO: 3151462 - RNA, 13 nt, Mycobacterium bovis subsp bovis AF2122/97
cugacgaguugau

SEQ ID NO: 3151463 - RNA, 21 nt, Mycobacterium bovis subsp bovis AF2122/97
cugacgaucuccacccgccgg

SEQ ID NO: 3151464 - RNA, 13 nt, Mycobacterium bovis subsp bovis AF2122/97
cugacgccauuca

SEQ ID NO: 3151465 - RNA, 15 nt, Mycobacterium bovis subsp bovis AF2122/97
cugacgccauucauc

SEQ ID NO: 3151466 - RNA, 17 nt, Mycobacterium bovis subsp bovis AF2122/97
cugacgcccucauaggc

SEQ ID NO: 3151467 - RNA, 16 nt, Mycobacterium bovis subsp bovis AF2122/97
cugacgccgagcuggu

SEQ ID NO: 3151468 - RNA, 19 nt, Mycobacterium bovis subsp bovis AF2122/97
cugacgccgagcugguuga

SEQ ID NO: 3151469 - RNA, 15 nt, Mycobacterium bovis subsp bovis AF2122/97
cugacgcgcccgacg

SEQ ID NO: 3151470 - RNA, 14 nt, Mycobacterium bovis subsp bovis AF2122/97
cugacgcggccggg

SEQ ID NO: 3151471 - RNA, 16 nt, Mycobacterium bovis subsp bovis AF2122/97
cugacgcgucagcggc

SEQ ID NO: 3151472 - RNA, 21 nt, Mycobacterium bovis subsp bovis AF2122/97
cugacgcgucagcggcgagca

SEQ ID NO: 3151473 - RNA, 17 nt, Mycobacterium bovis subsp bovis AF2122/97
cugacgcucggucgcca

SEQ ID NO: 3151474 - RNA, 19 nt, Mycobacterium bovis subsp bovis AF2122/97
cugacgcucggucgccacc

SEQ ID NO: 3151475 - RNA, 20 nt, Mycobacterium bovis subsp bovis AF2122/97
cugacgcucggucgccaccg

SEQ ID NO: 3151476 - RNA, 21 nt, Mycobacterium bovis subsp bovis AF2122/97
cugacgcucggucgccaccgc

SEQ ID NO: 3151477 - RNA, 12 nt, Mycobacterium bovis subsp bovis AF2122/97
cugacgcugcag

SEQ ID NO: 3151478 - RNA, 19 nt, Mycobacterium bovis subsp bovis AF2122/97
cugacgcuuggccagguca

SEQ ID NO: 3151479 - RNA, 22 nt, Mycobacterium bovis subsp bovis AF2122/97
cugacggaaguacuccauggca

SEQ ID NO: 3151480 - RNA, 18 nt, Mycobacterium bovis subsp bovis AF2122/97
cugacggcgcaacaccuc

SEQ ID NO: 3151481 - RNA, 14 nt, Mycobacterium bovis subsp bovis AF2122/97
cugacggcgccguc

SEQ ID NO: 3151482 - RNA, 13 nt, Mycobacterium bovis subsp bovis AF2122/97
cugacgggccgcu

SEQ ID NO: 3151483 - RNA, 16 nt, Mycobacterium bovis subsp bovis AF2122/97
cugacgguacagcucc

SEQ ID NO: 3151484 - RNA, 21 nt, Mycobacterium bovis subsp bovis AF2122/97
cugacggucauuuucuguaac

SEQ ID NO: 3151485 - RNA, 15 nt, Mycobacterium bovis subsp bovis AF2122/97
cugacgguggggaug

SEQ ID NO: 3151486 - RNA, 19 nt, Mycobacterium bovis subsp bovis AF2122/97
cugacgguggggauggcgc

SEQ ID NO: 3151487 - RNA, 20 nt, Mycobacterium bovis subsp bovis AF2122/97
cugacgguggggauggcgcc

SEQ ID NO: 3151488 - RNA, 22 nt, Mycobacterium bovis subsp bovis AF2122/97
cugacgguggggauggcgccca

SEQ ID NO: 3151489 - RNA, 21 nt, Mycobacterium bovis subsp bovis AF2122/97
cugacgguggugaccgcgggc

SEQ ID NO: 3151490 - RNA, 12 nt, Mycobacterium bovis subsp bovis AF2122/97
cugacgucacca

SEQ ID NO: 3151491 - RNA, 17 nt, Mycobacterium bovis subsp bovis AF2122/97
cugacgucacguucggc

SEQ ID NO: 3151492 - RNA, 20 nt, Mycobacterium bovis subsp bovis AF2122/97
cugacgucuuggaacacggc

SEQ ID NO: 3151493 - RNA, 21 nt, Mycobacterium bovis subsp bovis AF2122/97
cugacgucuuggaacacggcc

SEQ ID NO: 3151494 - RNA, 15 nt, Mycobacterium bovis subsp bovis AF2122/97
cugacgugcggcgcg

SEQ ID NO: 3151495 - RNA, 19 nt, Mycobacterium bovis subsp bovis AF2122/97
cugacgugcggcgcggcga

SEQ ID NO: 3151496 - RNA, 14 nt, Mycobacterium bovis subsp bovis AF2122/97
cugacgugucggcu

SEQ ID NO: 3151497 - RNA, 16 nt, Mycobacterium bovis subsp bovis AF2122/97
cugacuagggucaccg

SEQ ID NO: 3151498 - RNA, 19 nt, Mycobacterium bovis subsp bovis AF2122/97
cugacuaucucgcucgacg

SEQ ID NO: 3151499 - RNA, 17 nt, Mycobacterium bovis subsp bovis AF2122/97
cugacuccugcggcacc

SEQ ID NO: 3151500 - RNA, 18 nt, Mycobacterium bovis subsp bovis AF2122/97
cugacuccugcggcaccg

SEQ ID NO: 3151501 - RNA, 18 nt, Mycobacterium bovis subsp bovis AF2122/97
cugacuuugggucggcga

SEQ ID NO: 3151502 - RNA, 23 nt, Mycobacterium bovis subsp bovis AF2122/97
cugacuuugggucggcgauggcg

SEQ ID NO: 3151503 - RNA, 18 nt, Mycobacterium bovis subsp bovis AF2122/97
cugagaacacguucggcg

SEQ ID NO: 3151504 - RNA, 20 nt, Mycobacterium bovis subsp bovis AF2122/97
cugagacacgauuuucgggg

SEQ ID NO: 3151505 - RNA, 18 nt, Mycobacterium bovis subsp bovis AF2122/97
cugagacagaccgggccc

SEQ ID NO: 3151506 - RNA, 22 nt, Mycobacterium bovis subsp bovis AF2122/97
cugagacagaccgggcccggcg

SEQ ID NO: 3151507 - RNA, 21 nt, Mycobacterium bovis subsp bovis AF2122/97
cugagacgguguugcucgccg

SEQ ID NO: 3151508 - RNA, 23 nt, Mycobacterium bovis subsp bovis AF2122/97
cugagacucgucgaugcgguggu

SEQ ID NO: 3151509 - RNA, 14 nt, Mycobacterium bovis subsp bovis AF2122/97
cugagacugccgcc

SEQ ID NO: 3151510 - RNA, 16 nt, Mycobacterium bovis subsp bovis AF2122/97
cugagacugccgccgc

SEQ ID NO: 3151511 - RNA, 15 nt, Mycobacterium bovis subsp bovis AF2122/97
cugagcacggcgcgg

SEQ ID NO: 3151512 - RNA, 17 nt, Mycobacterium bovis subsp bovis AF2122/97
cugagcacggcgcggcg

SEQ ID NO: 3151513 - RNA, 19 nt, Mycobacterium bovis subsp bovis AF2122/97
cugagcacguucaccgcgc

SEQ ID NO: 3151514 - RNA, 13 nt, Mycobacterium bovis subsp bovis AF2122/97
cugagcagcgcgg

SEQ ID NO: 3151515 - RNA, 16 nt, Mycobacterium bovis subsp bovis AF2122/97
cugagcagcgcggcca

SEQ ID NO: 3151516 - RNA, 23 nt, Mycobacterium bovis subsp bovis AF2122/97
cugagcagcgcggccagagccgc

SEQ ID NO: 3151517 - RNA, 18 nt, Mycobacterium bovis subsp bovis AF2122/97
cugagccaccaacaccgc

SEQ ID NO: 3151518 - RNA, 15 nt, Mycobacterium bovis subsp bovis AF2122/97
cugagcccgccgcga

SEQ ID NO: 3151519 - RNA, 21 nt, Mycobacterium bovis subsp bovis AF2122/97
cugagccgcaucuggccggcg

SEQ ID NO: 3151520 - RNA, 14 nt, Mycobacterium bovis subsp bovis AF2122/97
cugagccggucaua

SEQ ID NO: 3151521 - RNA, 21 nt, Mycobacterium bovis subsp bovis AF2122/97
cugagcgaagugucgcugcaa

SEQ ID NO: 3151522 - RNA, 14 nt, Mycobacterium bovis subsp bovis AF2122/97
cugagcgacugcag

SEQ ID NO: 3151523 - RNA, 16 nt, Mycobacterium bovis subsp bovis AF2122/97
cugagcgacugcagcg

SEQ ID NO: 3151524 - RNA, 21 nt, Mycobacterium bovis subsp bovis AF2122/97
cugagcgacugcagcggcgca

SEQ ID NO: 3151525 - RNA, 15 nt, Mycobacterium bovis subsp bovis AF2122/97
cugagcgccaggccg

SEQ ID NO: 3151526 - RNA, 16 nt, Mycobacterium bovis subsp bovis AF2122/97
cugagcgccaggccgc

SEQ ID NO: 3151527 - RNA, 17 nt, Mycobacterium bovis subsp bovis AF2122/97
cugagcgccaggccgca

SEQ ID NO: 3151528 - RNA, 16 nt, Mycobacterium bovis subsp bovis AF2122/97
cugagcgccggcaucg

SEQ ID NO: 3151529 - RNA, 19 nt, Mycobacterium bovis subsp bovis AF2122/97
cugagcgccggcaucgcgc

SEQ ID NO: 3151530 - RNA, 18 nt, Mycobacterium bovis subsp bovis AF2122/97
cugagcgcgcgcggugcg

SEQ ID NO: 3151531 - RNA, 19 nt, Mycobacterium bovis subsp bovis AF2122/97
cugagcgcgcgcggugcgg

SEQ ID NO: 3151532 - RNA, 21 nt, Mycobacterium bovis subsp bovis AF2122/97
cugagcgcgcgcggugcggcc

SEQ ID NO: 3151533 - RNA, 19 nt, Mycobacterium bovis subsp bovis AF2122/97
cugagcgcgcggguggcgg

SEQ ID NO: 3151534 - RNA, 15 nt, Mycobacterium bovis subsp bovis AF2122/97
cugagcgcgcuggcc

SEQ ID NO: 3151535 - RNA, 22 nt, Mycobacterium bovis subsp bovis AF2122/97
cugagcgcgcuggccagcccgg

SEQ ID NO: 3151536 - RNA, 16 nt, Mycobacterium bovis subsp bovis AF2122/97
cugagcgcggguggca

SEQ ID NO: 3151537 - RNA, 20 nt, Mycobacterium bovis subsp bovis AF2122/97
cugagcgggcaacugcagca

SEQ ID NO: 3151538 - RNA, 16 nt, Mycobacterium bovis subsp bovis AF2122/97
cugagcgggcgggccu

SEQ ID NO: 3151539 - RNA, 18 nt, Mycobacterium bovis subsp bovis AF2122/97
cugagcgggcgggccugc

SEQ ID NO: 3151540 - RNA, 18 nt, Mycobacterium bovis subsp bovis AF2122/97
cugagcguccgacaacga

SEQ ID NO: 3151541 - RNA, 22 nt, Mycobacterium bovis subsp bovis AF2122/97
cugagcguccgacaacgacugc

SEQ ID NO: 3151542 - RNA, 16 nt, Mycobacterium bovis subsp bovis AF2122/97
cugagcgugcggugau

SEQ ID NO: 3151543 - RNA, 14 nt, Mycobacterium bovis subsp bovis AF2122/97
cugagcugccgagc

SEQ ID NO: 3151544 - RNA, 19 nt, Mycobacterium bovis subsp bovis AF2122/97
cugauuggcccaccgccgu

SEQ ID NO: 3151545 - RNA, 21 nt, Mycobacterium bovis subsp bovis AF2122/97
cugauuucuuuaaaccccugg

SEQ ID NO: 3151546 - RNA, 23 nt, Mycobacterium bovis subsp bovis AF2122/97
cugauuuucguguaacgccgacu

SEQ ID NO: 3151547 - RNA, 13 nt, Mycobacterium bovis subsp bovis AF2122/97
cugcaaccgccgg

SEQ ID NO: 3151548 - RNA, 18 nt, Mycobacterium bovis subsp bovis AF2122/97
cugcaaccgccggugccg

SEQ ID NO: 3151549 - RNA, 21 nt, Mycobacterium bovis subsp bovis AF2122/97
cugcaaccuucgugucuauga

SEQ ID NO: 3151550 - RNA, 18 nt, Mycobacterium bovis subsp bovis AF2122/97
cugcaacggagcgagcuc

SEQ ID NO: 3151551 - RNA, 20 nt, Mycobacterium bovis subsp bovis AF2122/97
cugcaacgucacucccuggc

SEQ ID NO: 3151552 - RNA, 20 nt, Mycobacterium bovis subsp bovis AF2122/97
cugcaagacaaagccgucga

SEQ ID NO: 3151553 - RNA, 23 nt, Mycobacterium bovis subsp bovis AF2122/97
cugcaagacaaagccgucgacgc

SEQ ID NO: 3151554 - RNA, 14 nt, Mycobacterium bovis subsp bovis AF2122/97
cugcacacaggacu

SEQ ID NO: 3151555 - RNA, 12 nt, Mycobacterium bovis subsp bovis AF2122/97
cugcacaccacc

SEQ ID NO: 3151556 - RNA, 14 nt, Mycobacterium bovis subsp bovis AF2122/97
cugcacaccaccgc

SEQ ID NO: 3151557 - RNA, 16 nt, Mycobacterium bovis subsp bovis AF2122/97
cugcacaccaccgccg

SEQ ID NO: 3151558 - RNA, 13 nt, Mycobacterium bovis subsp bovis AF2122/97
cugcacagcagcg

SEQ ID NO: 3151559 - RNA, 21 nt, Mycobacterium bovis subsp bovis AF2122/97
cugcacagcagcgucaucagg

SEQ ID NO: 3151560 - RNA, 13 nt, Mycobacterium bovis subsp bovis AF2122/97
cugcacagcaggc

SEQ ID NO: 3151561 - RNA, 15 nt, Mycobacterium bovis subsp bovis AF2122/97
cugcacagcaggcuc

SEQ ID NO: 3151562 - RNA, 20 nt, Mycobacterium bovis subsp bovis AF2122/97
cugcacagugcggccccgac

SEQ ID NO: 3151563 - RNA, 17 nt, Mycobacterium bovis subsp bovis AF2122/97
cugcacauucagcgccg

SEQ ID NO: 3151564 - RNA, 13 nt, Mycobacterium bovis subsp bovis AF2122/97
cugcaccaagucg

SEQ ID NO: 3151565 - RNA, 15 nt, Mycobacterium bovis subsp bovis AF2122/97
cugcaccacggcggc

SEQ ID NO: 3151566 - RNA, 20 nt, Mycobacterium bovis subsp bovis AF2122/97
cugcaccacggcggccaccu

SEQ ID NO: 3151567 - RNA, 23 nt, Mycobacterium bovis subsp bovis AF2122/97
cugcaccagcgaguugagcaugu

SEQ ID NO: 3151568 - RNA, 14 nt, Mycobacterium bovis subsp bovis AF2122/97
cugcacccagccgu

SEQ ID NO: 3151569 - RNA, 23 nt, Mycobacterium bovis subsp bovis AF2122/97
cugcacccaggcaucggugagcc

SEQ ID NO: 3151570 - RNA, 19 nt, Mycobacterium bovis subsp bovis AF2122/97
cugcacccgacccgaugcg

SEQ ID NO: 3151571 - RNA, 11 nt, Mycobacterium bovis subsp bovis AF2122/97
cugcacccgcc

SEQ ID NO: 3151572 - RNA, 20 nt, Mycobacterium bovis subsp bovis AF2122/97
cugcacccggagaaucgguc

SEQ ID NO: 3151573 - RNA, 13 nt, Mycobacterium bovis subsp bovis AF2122/97
cugcacccggcga

SEQ ID NO: 3151574 - RNA, 14 nt, Mycobacterium bovis subsp bovis AF2122/97
cugcacccggcgau

SEQ ID NO: 3151575 - RNA, 14 nt, Mycobacterium bovis subsp bovis AF2122/97
cugcaccgauucgg

SEQ ID NO: 3151576 - RNA, 22 nt, Mycobacterium bovis subsp bovis AF2122/97
cugcaccgcauuguugaagaaa

SEQ ID NO: 3151577 - RNA, 14 nt, Mycobacterium bovis subsp bovis AF2122/97
cugcaccgccgccg

SEQ ID NO: 3151578 - RNA, 16 nt, Mycobacterium bovis subsp bovis AF2122/97
cugcaccggcaggcgg

SEQ ID NO: 3151579 - RNA, 22 nt, Mycobacterium bovis subsp bovis AF2122/97
cugcaccggcuugggccaggcc

SEQ ID NO: 3151580 - RNA, 15 nt, Mycobacterium bovis subsp bovis AF2122/97
cugcaccgucacguc

SEQ ID NO: 3151581 - RNA, 18 nt, Mycobacterium bovis subsp bovis AF2122/97
cugcaccuccgacggccg

SEQ ID NO: 3151582 - RNA, 19 nt, Mycobacterium bovis subsp bovis AF2122/97
cugcaccuccgacggccgc

SEQ ID NO: 3151583 - RNA, 13 nt, Mycobacterium bovis subsp bovis AF2122/97
cugcaccuggccg

SEQ ID NO: 3151584 - RNA, 17 nt, Mycobacterium bovis subsp bovis AF2122/97
cugcaccuggccgcccg

SEQ ID NO: 3151585 - RNA, 16 nt, Mycobacterium bovis subsp bovis AF2122/97
cugcaccuggcgcagc

SEQ ID NO: 3151586 - RNA, 23 nt, Mycobacterium bovis subsp bovis AF2122/97
cugcacgaacgccugcucgucgg

SEQ ID NO: 3151587 - RNA, 22 nt, Mycobacterium bovis subsp bovis AF2122/97
cugcacgacaucgucgcgacga

SEQ ID NO: 3151588 - RNA, 14 nt, Mycobacterium bovis subsp bovis AF2122/97
cugcacgccggcgc

SEQ ID NO: 3151589 - RNA, 15 nt, Mycobacterium bovis subsp bovis AF2122/97
cugcacgccggcgcu

SEQ ID NO: 3151590 - RNA, 12 nt, Mycobacterium bovis subsp bovis AF2122/97
cugcacgccguc

SEQ ID NO: 3151591 - RNA, 14 nt, Mycobacterium bovis subsp bovis AF2122/97
cugcacgccucaaa

SEQ ID NO: 3151592 - RNA, 16 nt, Mycobacterium bovis subsp bovis AF2122/97
cugcacgcgcucgcgc

SEQ ID NO: 3151593 - RNA, 17 nt, Mycobacterium bovis subsp bovis AF2122/97
cugcacgcgcucgcgca

SEQ ID NO: 3151594 - RNA, 20 nt, Mycobacterium bovis subsp bovis AF2122/97
cugcacggagccgccggcgg

SEQ ID NO: 3151595 - RNA, 21 nt, Mycobacterium bovis subsp bovis AF2122/97
cugcacggagccgccggcggu

SEQ ID NO: 3151596 - RNA, 22 nt, Mycobacterium bovis subsp bovis AF2122/97
cugcacggucaauugugcggcc

SEQ ID NO: 3151597 - RNA, 19 nt, Mycobacterium bovis subsp bovis AF2122/97
cugcacggugcccagggcg

SEQ ID NO: 3151598 - RNA, 18 nt, Mycobacterium bovis subsp bovis AF2122/97
cugcacgugacccugggg

SEQ ID NO: 3151599 - RNA, 16 nt, Mycobacterium bovis subsp bovis AF2122/97
cugcacugcgcgugcu

SEQ ID NO: 3151600 - RNA, 23 nt, Mycobacterium bovis subsp bovis AF2122/97
cugcagaaacagccgcagcggcc

SEQ ID NO: 3151601 - RNA, 19 nt, Mycobacterium bovis subsp bovis AF2122/97
cugcagaaaggccaacugg

SEQ ID NO: 3151602 - RNA, 18 nt, Mycobacterium bovis subsp bovis AF2122/97
cugcagaccuguccggca

SEQ ID NO: 3151603 - RNA, 19 nt, Mycobacterium bovis subsp bovis AF2122/97
cugcagacggguggcccga

SEQ ID NO: 3151604 - RNA, 16 nt, Mycobacterium bovis subsp bovis AF2122/97
cugcagacgguccgcu

SEQ ID NO: 3151605 - RNA, 17 nt, Mycobacterium bovis subsp bovis AF2122/97
cugcagcaccgcagcga

SEQ ID NO: 3151606 - RNA, 19 nt, Mycobacterium bovis subsp bovis AF2122/97
cugcagcacgacgugcguc

SEQ ID NO: 3151607 - RNA, 19 nt, Mycobacterium bovis subsp bovis AF2122/97
cugcagcacucggugucgg

SEQ ID NO: 3151608 - RNA, 16 nt, Mycobacterium bovis subsp bovis AF2122/97
cugcagcagacccggu

SEQ ID NO: 3151609 - RNA, 20 nt, Mycobacterium bovis subsp bovis AF2122/97
cugcagcagacccgguggcg

SEQ ID NO: 3151610 - RNA, 13 nt, Mycobacterium bovis subsp bovis AF2122/97
cugcagcagcgca

SEQ ID NO: 3151611 - RNA, 17 nt, Mycobacterium bovis subsp bovis AF2122/97
cugcagcagggcuucgu

SEQ ID NO: 3151612 - RNA, 15 nt, Mycobacterium bovis subsp bovis AF2122/97
cugcagcccaugggc

SEQ ID NO: 3151613 - RNA, 15 nt, Mycobacterium bovis subsp bovis AF2122/97
cugcagcccugcgca

SEQ ID NO: 3151614 - RNA, 15 nt, Mycobacterium bovis subsp bovis AF2122/97
cugcagccgaugcuc

SEQ ID NO: 3151615 - RNA, 18 nt, Mycobacterium bovis subsp bovis AF2122/97
cugcagcgaaacaccggc

SEQ ID NO: 3151616 - RNA, 15 nt, Mycobacterium bovis subsp bovis AF2122/97
cugcagcgaugacga

SEQ ID NO: 3151617 - RNA, 19 nt, Mycobacterium bovis subsp bovis AF2122/97
cugcagcgaugacgaccaa

SEQ ID NO: 3151618 - RNA, 15 nt, Mycobacterium bovis subsp bovis AF2122/97
cugcagcgaugcggc

SEQ ID NO: 3151619 - RNA, 18 nt, Mycobacterium bovis subsp bovis AF2122/97
cugcagcgccucgauccg

SEQ ID NO: 3151620 - RNA, 14 nt, Mycobacterium bovis subsp bovis AF2122/97
cugcagcgcgaccc

SEQ ID NO: 3151621 - RNA, 11 nt, Mycobacterium bovis subsp bovis AF2122/97
cugcagcgcgg

SEQ ID NO: 3151622 - RNA, 14 nt, Mycobacterium bovis subsp bovis AF2122/97
cugcagcgcggccg

SEQ ID NO: 3151623 - RNA, 23 nt, Mycobacterium bovis subsp bovis AF2122/97
cugcagcgcgguggucagcaccg

SEQ ID NO: 3151624 - RNA, 13 nt, Mycobacterium bovis subsp bovis AF2122/97
cugcagcggcgca

SEQ ID NO: 3151625 - RNA, 18 nt, Mycobacterium bovis subsp bovis AF2122/97
cugcagcucgggcaggga

SEQ ID NO: 3151626 - RNA, 15 nt, Mycobacterium bovis subsp bovis AF2122/97
cugcaggaaggcuuc

SEQ ID NO: 3151627 - RNA, 19 nt, Mycobacterium bovis subsp bovis AF2122/97
cugcaggaaguacgcgacg

SEQ ID NO: 3151628 - RNA, 21 nt, Mycobacterium bovis subsp bovis AF2122/97
cugcaggcccaggcuguccga

SEQ ID NO: 3151629 - RNA, 22 nt, Mycobacterium bovis subsp bovis AF2122/97
cugcaggccgccggccagcguc

SEQ ID NO: 3151630 - RNA, 14 nt, Mycobacterium bovis subsp bovis AF2122/97
cugcaggcggccga

SEQ ID NO: 3151631 - RNA, 13 nt, Mycobacterium bovis subsp bovis AF2122/97
cugcccccgccgg

SEQ ID NO: 3151632 - RNA, 14 nt, Mycobacterium bovis subsp bovis AF2122/97
cugcccccgcgcgc

SEQ ID NO: 3151633 - RNA, 15 nt, Mycobacterium bovis subsp bovis AF2122/97
cugcccccgcgcgca

SEQ ID NO: 3151634 - RNA, 19 nt, Mycobacterium bovis subsp bovis AF2122/97
cugcccccgcgcgcacggc

SEQ ID NO: 3151635 - RNA, 16 nt, Mycobacterium bovis subsp bovis AF2122/97
cugcccccggcgcggc

SEQ ID NO: 3151636 - RNA, 20 nt, Mycobacterium bovis subsp bovis AF2122/97
cugcccccguucuggaaccc

SEQ ID NO: 3151637 - RNA, 23 nt, Mycobacterium bovis subsp bovis AF2122/97
cugcccccguucuggaaccccga

SEQ ID NO: 3151638 - RNA, 23 nt, Mycobacterium bovis subsp bovis AF2122/97
cugccccgcaucgcccaagccgu

SEQ ID NO: 3151639 - RNA, 14 nt, Mycobacterium bovis subsp bovis AF2122/97
cugccccgccaccu

SEQ ID NO: 3151640 - RNA, 21 nt, Mycobacterium bovis subsp bovis AF2122/97
cugccccgccaccucgccggc

SEQ ID NO: 3151641 - RNA, 14 nt, Mycobacterium bovis subsp bovis AF2122/97
cugccccuccgggc

SEQ ID NO: 3151642 - RNA, 16 nt, Mycobacterium bovis subsp bovis AF2122/97
cugcccgacgaccauu

SEQ ID NO: 3151643 - RNA, 23 nt, Mycobacterium bovis subsp bovis AF2122/97
cugcccgagaucgcgugcgacga

SEQ ID NO: 3151644 - RNA, 18 nt, Mycobacterium bovis subsp bovis AF2122/97
cugcccgagguccgcccu

SEQ ID NO: 3151645 - RNA, 21 nt, Mycobacterium bovis subsp bovis AF2122/97
cugcccgauacccggugaugg

SEQ ID NO: 3151646 - RNA, 21 nt, Mycobacterium bovis subsp bovis AF2122/97
cugcccgauguuacggcccca

SEQ ID NO: 3151647 - RNA, 15 nt, Mycobacterium bovis subsp bovis AF2122/97
cugcccgccagcgcc

SEQ ID NO: 3151648 - RNA, 16 nt, Mycobacterium bovis subsp bovis AF2122/97
cugcccgccagcgccg

SEQ ID NO: 3151649 - RNA, 18 nt, Mycobacterium bovis subsp bovis AF2122/97
cugcccgccagcgccgcc

SEQ ID NO: 3151650 - RNA, 13 nt, Mycobacterium bovis subsp bovis AF2122/97
cugcccgccguua

SEQ ID NO: 3151651 - RNA, 21 nt, Mycobacterium bovis subsp bovis AF2122/97
cugcccgcgcggccaaucagc

SEQ ID NO: 3151652 - RNA, 16 nt, Mycobacterium bovis subsp bovis AF2122/97
cugcccgcggacgugc

SEQ ID NO: 3151653 - RNA, 18 nt, Mycobacterium bovis subsp bovis AF2122/97
cugcccgcggacgugccg

SEQ ID NO: 3151654 - RNA, 13 nt, Mycobacterium bovis subsp bovis AF2122/97
cugcccgcggcgg

SEQ ID NO: 3151655 - RNA, 19 nt, Mycobacterium bovis subsp bovis AF2122/97
cugcccggcccgcucagcc

SEQ ID NO: 3151656 - RNA, 12 nt, Mycobacterium bovis subsp bovis AF2122/97
cugcccggcgcc

SEQ ID NO: 3151657 - RNA, 17 nt, Mycobacterium bovis subsp bovis AF2122/97
cugcccgggcugccgcc

SEQ ID NO: 3151658 - RNA, 16 nt, Mycobacterium bovis subsp bovis AF2122/97
cugcccgucccgcucg

SEQ ID NO: 3151659 - RNA, 14 nt, Mycobacterium bovis subsp bovis AF2122/97
cugcccgucgucgg

SEQ ID NO: 3151660 - RNA, 16 nt, Mycobacterium bovis subsp bovis AF2122/97
cugcccgucgucggca

SEQ ID NO: 3151661 - RNA, 18 nt, Mycobacterium bovis subsp bovis AF2122/97
cugcccgucgucggcaac

SEQ ID NO: 3151662 - RNA, 20 nt, Mycobacterium bovis subsp bovis AF2122/97
cugcccgucgucggcaacca

SEQ ID NO: 3151663 - RNA, 22 nt, Mycobacterium bovis subsp bovis AF2122/97
cugcccuccgugggcagcgcgc

SEQ ID NO: 3151664 - RNA, 16 nt, Mycobacterium bovis subsp bovis AF2122/97
cugcccugauugaagc

SEQ ID NO: 3151665 - RNA, 13 nt, Mycobacterium bovis subsp bovis AF2122/97
cugcccugguugg

SEQ ID NO: 3151666 - RNA, 21 nt, Mycobacterium bovis subsp bovis AF2122/97
cugcccuguucguagucucga

SEQ ID NO: 3151667 - RNA, 18 nt, Mycobacterium bovis subsp bovis AF2122/97
cugccgaaacgccgaccg

SEQ ID NO: 3151668 - RNA, 23 nt, Mycobacterium bovis subsp bovis AF2122/97
cugccgaaacgccgaccgcgccg

SEQ ID NO: 3151669 - RNA, 19 nt, Mycobacterium bovis subsp bovis AF2122/97
cugccgaacaguucggcga

SEQ ID NO: 3151670 - RNA, 16 nt, Mycobacterium bovis subsp bovis AF2122/97
cugccgaagcggccac

SEQ ID NO: 3151671 - RNA, 19 nt, Mycobacterium bovis subsp bovis AF2122/97
cugccgaagcggccaccgc

SEQ ID NO: 3151672 - RNA, 20 nt, Mycobacterium bovis subsp bovis AF2122/97
cugccgaaguugaagaagcc

SEQ ID NO: 3151673 - RNA, 21 nt, Mycobacterium bovis subsp bovis AF2122/97
cugccgacaguuuaccgugcc

SEQ ID NO: 3151674 - RNA, 23 nt, Mycobacterium bovis subsp bovis AF2122/97
cugccgacaguuuaccgugccgc

SEQ ID NO: 3151675 - RNA, 15 nt, Mycobacterium bovis subsp bovis AF2122/97
cugccgaccagcgcg

SEQ ID NO: 3151676 - RNA, 19 nt, Mycobacterium bovis subsp bovis AF2122/97
cugccgacgaggggcgcgg

SEQ ID NO: 3151677 - RNA, 14 nt, Mycobacterium bovis subsp bovis AF2122/97
cugccgacgcucca

SEQ ID NO: 3151678 - RNA, 17 nt, Mycobacterium bovis subsp bovis AF2122/97
cugccgacucaucggcc

SEQ ID NO: 3151679 - RNA, 18 nt, Mycobacterium bovis subsp bovis AF2122/97
cugccgacucaucggccg

SEQ ID NO: 3151680 - RNA, 21 nt, Mycobacterium bovis subsp bovis AF2122/97
cugccgacuccucguccugga

SEQ ID NO: 3151681 - RNA, 22 nt, Mycobacterium bovis subsp bovis AF2122/97
cugccgacuccucguccuggaa

SEQ ID NO: 3151682 - RNA, 15 nt, Mycobacterium bovis subsp bovis AF2122/97
cugccgauagcgcgg

SEQ ID NO: 3151683 - RNA, 18 nt, Mycobacterium bovis subsp bovis AF2122/97
cugccgaucccguggugg

SEQ ID NO: 3151684 - RNA, 21 nt, Mycobacterium bovis subsp bovis AF2122/97
cugccgcaaacgcggcgucga

SEQ ID NO: 3151685 - RNA, 18 nt, Mycobacterium bovis subsp bovis AF2122/97
cugccgcaccaaggccgc

SEQ ID NO: 3151686 - RNA, 16 nt, Mycobacterium bovis subsp bovis AF2122/97
cugccgcacccccucc

SEQ ID NO: 3151687 - RNA, 12 nt, Mycobacterium bovis subsp bovis AF2122/97
cugccgcacccg

SEQ ID NO: 3151688 - RNA, 15 nt, Mycobacterium bovis subsp bovis AF2122/97
cugccgcacccgguc

SEQ ID NO: 3151689 - RNA, 16 nt, Mycobacterium bovis subsp bovis AF2122/97
cugccgcacccggucg

SEQ ID NO: 3151690 - RNA, 17 nt, Mycobacterium bovis subsp bovis AF2122/97
cugccgcacgggcccag

SEQ ID NO: 3151691 - RNA, 16 nt, Mycobacterium bovis subsp bovis AF2122/97
cugccgcacguucggc

SEQ ID NO: 3151692 - RNA, 21 nt, Mycobacterium bovis subsp bovis AF2122/97
cugccgcacguucggcgauga

SEQ ID NO: 3151693 - RNA, 15 nt, Mycobacterium bovis subsp bovis AF2122/97
cugccgcacugggcg

SEQ ID NO: 3151694 - RNA, 20 nt, Mycobacterium bovis subsp bovis AF2122/97
cugccgcagcucagcauccc

SEQ ID NO: 3151695 - RNA, 18 nt, Mycobacterium bovis subsp bovis AF2122/97
cugccgcaucggcaaggc

SEQ ID NO: 3151696 - RNA, 15 nt, Mycobacterium bovis subsp bovis AF2122/97
cugccgccaggcucg

SEQ ID NO: 3151697 - RNA, 19 nt, Mycobacterium bovis subsp bovis AF2122/97
cugccgcccuugccgcccg

SEQ ID NO: 3151698 - RNA, 20 nt, Mycobacterium bovis subsp bovis AF2122/97
cugccgcccuugccgcccgc

SEQ ID NO: 3151699 - RNA, 15 nt, Mycobacterium bovis subsp bovis AF2122/97
cugccgccgagcugg

SEQ ID NO: 3151700 - RNA, 16 nt, Mycobacterium bovis subsp bovis AF2122/97
cugccgccgccgccgg

SEQ ID NO: 3151701 - RNA, 17 nt, Mycobacterium bovis subsp bovis AF2122/97
cugccgccgccgccggc

SEQ ID NO: 3151702 - RNA, 21 nt, Mycobacterium bovis subsp bovis AF2122/97
cugccgccgcggccacaaccu

SEQ ID NO: 3151703 - RNA, 18 nt, Mycobacterium bovis subsp bovis AF2122/97
cugccgccgcuccaugac

SEQ ID NO: 3151704 - RNA, 19 nt, Mycobacterium bovis subsp bovis AF2122/97
cugccgccgcuccaugaca

SEQ ID NO: 3151705 - RNA, 13 nt, Mycobacterium bovis subsp bovis AF2122/97
cugccgccggccc

SEQ ID NO: 3151706 - RNA, 14 nt, Mycobacterium bovis subsp bovis AF2122/97
cugccgccggcccc

SEQ ID NO: 3151707 - RNA, 18 nt, Mycobacterium bovis subsp bovis AF2122/97
cugccgccggccccgccg

SEQ ID NO: 3151708 - RNA, 22 nt, Mycobacterium bovis subsp bovis AF2122/97
cugccgccggugccgccggugc

SEQ ID NO: 3151709 - RNA, 15 nt, Mycobacterium bovis subsp bovis AF2122/97
cugccgccgucgccg

SEQ ID NO: 3151710 - RNA, 15 nt, Mycobacterium bovis subsp bovis AF2122/97
cugccgccguugccg

SEQ ID NO: 3151711 - RNA, 14 nt, Mycobacterium bovis subsp bovis AF2122/97
cugccgcgaugagc

SEQ ID NO: 3151712 - RNA, 22 nt, Mycobacterium bovis subsp bovis AF2122/97
cugccgcgaugagcggcgcggc

SEQ ID NO: 3151713 - RNA, 23 nt, Mycobacterium bovis subsp bovis AF2122/97
cugccgcgcaacuaucgcaccuc

SEQ ID NO: 3151714 - RNA, 15 nt, Mycobacterium bovis subsp bovis AF2122/97
cugccgcgcgcccgc

SEQ ID NO: 3151715 - RNA, 13 nt, Mycobacterium bovis subsp bovis AF2122/97
cugccgcgcggcg

SEQ ID NO: 3151716 - RNA, 17 nt, Mycobacterium bovis subsp bovis AF2122/97
cugccgcggcugccauc

SEQ ID NO: 3151717 - RNA, 19 nt, Mycobacterium bovis subsp bovis AF2122/97
cugcgacuggugccugccg

SEQ ID NO: 3151718 - RNA, 16 nt, Mycobacterium bovis subsp bovis AF2122/97
cugcgacugugaaucu

SEQ ID NO: 3151719 - RNA, 21 nt, Mycobacterium bovis subsp bovis AF2122/97
cugcgagacuuggugauccga

SEQ ID NO: 3151720 - RNA, 16 nt, Mycobacterium bovis subsp bovis AF2122/97
cugcgagagcaccgac

SEQ ID NO: 3151721 - RNA, 19 nt, Mycobacterium bovis subsp bovis AF2122/97
cugcgagaggugcugcacc

SEQ ID NO: 3151722 - RNA, 21 nt, Mycobacterium bovis subsp bovis AF2122/97
cugcgagaucggauggugugu

SEQ ID NO: 3151723 - RNA, 19 nt, Mycobacterium bovis subsp bovis AF2122/97
cugcgagauguccucccau

SEQ ID NO: 3151724 - RNA, 20 nt, Mycobacterium bovis subsp bovis AF2122/97
cugcgagggcacgcgcacag

SEQ ID NO: 3151725 - RNA, 17 nt, Mycobacterium bovis subsp bovis AF2122/97
cugcgagugcggcacga

SEQ ID NO: 3151726 - RNA, 17 nt, Mycobacterium bovis subsp bovis AF2122/97
cugcgauauggucacca

SEQ ID NO: 3151727 - RNA, 14 nt, Mycobacterium bovis subsp bovis AF2122/97
cugcgaucgccgcg

SEQ ID NO: 3151728 - RNA, 17 nt, Mycobacterium bovis subsp bovis AF2122/97
cugcgaucgccgcgcug

SEQ ID NO: 3151729 - RNA, 21 nt, Mycobacterium bovis subsp bovis AF2122/97
cugcgaucgccgcgcuggucg

SEQ ID NO: 3151730 - RNA, 16 nt, Mycobacterium bovis subsp bovis AF2122/97
cugcgaucgcgagcga

SEQ ID NO: 3151731 - RNA, 16 nt, Mycobacterium bovis subsp bovis AF2122/97
cugcgaucggccgccg

SEQ ID NO: 3151732 - RNA, 18 nt, Mycobacterium bovis subsp bovis AF2122/97
cugcgaugcugaucaccg

SEQ ID NO: 3151733 - RNA, 20 nt, Mycobacterium bovis subsp bovis AF2122/97
cugcgaugcugaucaccguc

SEQ ID NO: 3151734 - RNA, 20 nt, Mycobacterium bovis subsp bovis AF2122/97
cugcgcaaauugcaacagag

SEQ ID NO: 3151735 - RNA, 15 nt, Mycobacterium bovis subsp bovis AF2122/97
cugcgcaaauuugaa

SEQ ID NO: 3151736 - RNA, 14 nt, Mycobacterium bovis subsp bovis AF2122/97
cugcgcaacaccau

SEQ ID NO: 3151737 - RNA, 23 nt, Mycobacterium bovis subsp bovis AF2122/97
cugcgcaacaccgugcaccagcu

SEQ ID NO: 3151738 - RNA, 18 nt, Mycobacterium bovis subsp bovis AF2122/97
cugcgcaaccgagcgguc

SEQ ID NO: 3151739 - RNA, 18 nt, Mycobacterium bovis subsp bovis AF2122/97
cugcgcaauagcgacagc

SEQ ID NO: 3151740 - RNA, 20 nt, Mycobacterium bovis subsp bovis AF2122/97
cugcgcaauagcgacagcag

SEQ ID NO: 3151741 - RNA, 17 nt, Mycobacterium bovis subsp bovis AF2122/97
cugcgcacgucgggccc

SEQ ID NO: 3151742 - RNA, 15 nt, Mycobacterium bovis subsp bovis AF2122/97
cugcgcagccgccuc

SEQ ID NO: 3151743 - RNA, 18 nt, Mycobacterium bovis subsp bovis AF2122/97
cugcgcagccgccucaau

SEQ ID NO: 3151744 - RNA, 12 nt, Mycobacterium bovis subsp bovis AF2122/97
cugcgcagcgca

SEQ ID NO: 3151745 - RNA, 14 nt, Mycobacterium bovis subsp bovis AF2122/97
cugcgcagcgcaaa

SEQ ID NO: 3151746 - RNA, 22 nt, Mycobacterium bovis subsp bovis AF2122/97
cugcgcagcgccugcggcagca

SEQ ID NO: 3151747 - RNA, 22 nt, Mycobacterium bovis subsp bovis AF2122/97
cugcgcagguggucgaucaggu

SEQ ID NO: 3151748 - RNA, 21 nt, Mycobacterium bovis subsp bovis AF2122/97
cugcgcagugaauugcccaag

SEQ ID NO: 3151749 - RNA, 23 nt, Mycobacterium bovis subsp bovis AF2122/97
cugcgcagugaauugcccaagcg

SEQ ID NO: 3151750 - RNA, 14 nt, Mycobacterium bovis subsp bovis AF2122/97
cugcgcaucaccac

SEQ ID NO: 3151751 - RNA, 17 nt, Mycobacterium bovis subsp bovis AF2122/97
cugcgcaucaccacugg

SEQ ID NO: 3151752 - RNA, 21 nt, Mycobacterium bovis subsp bovis AF2122/97
cugcgcaucgccaccaucacc

SEQ ID NO: 3151753 - RNA, 19 nt, Mycobacterium bovis subsp bovis AF2122/97
cugcgcaucgguccaaagc

SEQ ID NO: 3151754 - RNA, 20 nt, Mycobacterium bovis subsp bovis AF2122/97
cugcgcaucgguccaaagca

SEQ ID NO: 3151755 - RNA, 22 nt, Mycobacterium bovis subsp bovis AF2122/97
cugcgccaaaauccgcccaccg

SEQ ID NO: 3151756 - RNA, 17 nt, Mycobacterium bovis subsp bovis AF2122/97
cugcgccacacccggca

SEQ ID NO: 3151757 - RNA, 16 nt, Mycobacterium bovis subsp bovis AF2122/97
cugcgccacagcagcg

SEQ ID NO: 3151758 - RNA, 18 nt, Mycobacterium bovis subsp bovis AF2122/97
cugcgccacagcagcguu

SEQ ID NO: 3151759 - RNA, 18 nt, Mycobacterium bovis subsp bovis AF2122/97
cugcgccacccgcggugc

SEQ ID NO: 3151760 - RNA, 17 nt, Mycobacterium bovis subsp bovis AF2122/97
cugcgccacgucgacgg

SEQ ID NO: 3151761 - RNA, 14 nt, Mycobacterium bovis subsp bovis AF2122/97
cugcgccaggcggc

SEQ ID NO: 3151762 - RNA, 15 nt, Mycobacterium bovis subsp bovis AF2122/97
cugcgccaggcggca

SEQ ID NO: 3151763 - RNA, 17 nt, Mycobacterium bovis subsp bovis AF2122/97
cugcgccaggggcacca

SEQ ID NO: 3151764 - RNA, 23 nt, Mycobacterium bovis subsp bovis AF2122/97
cugcgccaguaggcuucgaccgu

SEQ ID NO: 3151765 - RNA, 13 nt, Mycobacterium bovis subsp bovis AF2122/97
cugcgccaucaca

SEQ ID NO: 3151766 - RNA, 14 nt, Mycobacterium bovis subsp bovis AF2122/97
cugcgcccauagcu

SEQ ID NO: 3151767 - RNA, 17 nt, Mycobacterium bovis subsp bovis AF2122/97
cugcgcccauagcugcc

SEQ ID NO: 3151768 - RNA, 19 nt, Mycobacterium bovis subsp bovis AF2122/97
cugcgcccauagcugccgg

SEQ ID NO: 3151769 - RNA, 14 nt, Mycobacterium bovis subsp bovis AF2122/97
cugcgcccgccacg

SEQ ID NO: 3151770 - RNA, 14 nt, Mycobacterium bovis subsp bovis AF2122/97
cugcgcccggacca

SEQ ID NO: 3151771 - RNA, 16 nt, Mycobacterium bovis subsp bovis AF2122/97
cugcgcccggaccacu

SEQ ID NO: 3151772 - RNA, 18 nt, Mycobacterium bovis subsp bovis AF2122/97
cugcgcccguccgcgcgc

SEQ ID NO: 3151773 - RNA, 19 nt, Mycobacterium bovis subsp bovis AF2122/97
cugcgcccguccgcgcgcc

SEQ ID NO: 3151774 - RNA, 16 nt, Mycobacterium bovis subsp bovis AF2122/97
cugcgccgaacaccac

SEQ ID NO: 3151775 - RNA, 19 nt, Mycobacterium bovis subsp bovis AF2122/97
cugcgccgaacaccacacc

SEQ ID NO: 3151776 - RNA, 20 nt, Mycobacterium bovis subsp bovis AF2122/97
cugcgccgaacgcuccaggc

SEQ ID NO: 3151777 - RNA, 12 nt, Mycobacterium bovis subsp bovis AF2122/97
cugcgccgaccc

SEQ ID NO: 3151778 - RNA, 19 nt, Mycobacterium bovis subsp bovis AF2122/97
cugcgccgacccgcgcgcc

SEQ ID NO: 3151779 - RNA, 19 nt, Mycobacterium bovis subsp bovis AF2122/97
cugcgccgauacccagcgg

SEQ ID NO: 3151780 - RNA, 16 nt, Mycobacterium bovis subsp bovis AF2122/97
cugcgccgauacguga

SEQ ID NO: 3151781 - RNA, 18 nt, Mycobacterium bovis subsp bovis AF2122/97
cugcgccgcacgccgacc

SEQ ID NO: 3151782 - RNA, 15 nt, Mycobacterium bovis subsp bovis AF2122/97
cugcgccgccacagc

SEQ ID NO: 3151783 - RNA, 16 nt, Mycobacterium bovis subsp bovis AF2122/97
cugcgccgccacagca

SEQ ID NO: 3151784 - RNA, 19 nt, Mycobacterium bovis subsp bovis AF2122/97
cugcgccgccacagcaccc

SEQ ID NO: 3151785 - RNA, 20 nt, Mycobacterium bovis subsp bovis AF2122/97
cugcgccgccacagcaccca

SEQ ID NO: 3151786 - RNA, 13 nt, Mycobacterium bovis subsp bovis AF2122/97
cugcgccgccagc

SEQ ID NO: 3151787 - RNA, 15 nt, Mycobacterium bovis subsp bovis AF2122/97
cugcgccgccagcgc

SEQ ID NO: 3151788 - RNA, 16 nt, Mycobacterium bovis subsp bovis AF2122/97
cugcgccgccagcgcc

SEQ ID NO: 3151789 - RNA, 21 nt, Mycobacterium bovis subsp bovis AF2122/97
cugcgccgccagcgccgccgg

SEQ ID NO: 3151790 - RNA, 19 nt, Mycobacterium bovis subsp bovis AF2122/97
cugcgccgcccgcgccacc

SEQ ID NO: 3151791 - RNA, 21 nt, Mycobacterium bovis subsp bovis AF2122/97
cugcgccgcccgcgccaccga

SEQ ID NO: 3151792 - RNA, 12 nt, Mycobacterium bovis subsp bovis AF2122/97
cugcgccgccgg

SEQ ID NO: 3151793 - RNA, 12 nt, Mycobacterium bovis subsp bovis AF2122/97
cugcgccgcgcg

SEQ ID NO: 3151794 - RNA, 16 nt, Mycobacterium bovis subsp bovis AF2122/97
cugcgccgcgcgcggc

SEQ ID NO: 3151795 - RNA, 12 nt, Mycobacterium bovis subsp bovis AF2122/97
cugcgccggccg

SEQ ID NO: 3151796 - RNA, 21 nt, Mycobacterium bovis subsp bovis AF2122/97
cugcgccggugccggccaucg

SEQ ID NO: 3151797 - RNA, 18 nt, Mycobacterium bovis subsp bovis AF2122/97
cugcgccgucaacaccau

SEQ ID NO: 3151798 - RNA, 23 nt, Mycobacterium bovis subsp bovis AF2122/97
cugcgccgucaacaccauggugg

SEQ ID NO: 3151799 - RNA, 15 nt, Mycobacterium bovis subsp bovis AF2122/97
cugcgccgucgcagc

SEQ ID NO: 3151800 - RNA, 16 nt, Mycobacterium bovis subsp bovis AF2122/97
cugcgccgucgcagcc

SEQ ID NO: 3151801 - RNA, 18 nt, Mycobacterium bovis subsp bovis AF2122/97
cugcgccgucgcagccag

SEQ ID NO: 3151802 - RNA, 21 nt, Mycobacterium bovis subsp bovis AF2122/97
cugcgccguucgcucccccgc

SEQ ID NO: 3151803 - RNA, 15 nt, Mycobacterium bovis subsp bovis AF2122/97
cugcggccgcgaggu

SEQ ID NO: 3151804 - RNA, 18 nt, Mycobacterium bovis subsp bovis AF2122/97
cugcggccgcgugccgcc

SEQ ID NO: 3151805 - RNA, 23 nt, Mycobacterium bovis subsp bovis AF2122/97
cugcggccugcucgaccaugccg

SEQ ID NO: 3151806 - RNA, 15 nt, Mycobacterium bovis subsp bovis AF2122/97
cugcggcgcccgguc

SEQ ID NO: 3151807 - RNA, 16 nt, Mycobacterium bovis subsp bovis AF2122/97
cugcggcgcccggucg

SEQ ID NO: 3151808 - RNA, 17 nt, Mycobacterium bovis subsp bovis AF2122/97
cugcggcgcccggucga

SEQ ID NO: 3151809 - RNA, 17 nt, Mycobacterium bovis subsp bovis AF2122/97
cugcggcgcuggccagc

SEQ ID NO: 3151810 - RNA, 11 nt, Mycobacterium bovis subsp bovis AF2122/97
cugcggcggcu

SEQ ID NO: 3151811 - RNA, 20 nt, Mycobacterium bovis subsp bovis AF2122/97
cugcggcggcuuuggccgcc

SEQ ID NO: 3151812 - RNA, 21 nt, Mycobacterium bovis subsp bovis AF2122/97
cugcggcggcuuuggccgccg

SEQ ID NO: 3151813 - RNA, 15 nt, Mycobacterium bovis subsp bovis AF2122/97
cugcggcggucaugg

SEQ ID NO: 3151814 - RNA, 16 nt, Mycobacterium bovis subsp bovis AF2122/97
cugcggcucagaaccc

SEQ ID NO: 3151815 - RNA, 13 nt, Mycobacterium bovis subsp bovis AF2122/97
cugcggcuccggc

SEQ ID NO: 3151816 - RNA, 16 nt, Mycobacterium bovis subsp bovis AF2122/97
cugcggcuccggcggc

SEQ ID NO: 3151817 - RNA, 17 nt, Mycobacterium bovis subsp bovis AF2122/97
cugcggcuccggcggca

SEQ ID NO: 3151818 - RNA, 18 nt, Mycobacterium bovis subsp bovis AF2122/97
cugcggcucgcugaucug

SEQ ID NO: 3151819 - RNA, 12 nt, Mycobacterium bovis subsp bovis AF2122/97
cugcggcugcuu

SEQ ID NO: 3151820 - RNA, 17 nt, Mycobacterium bovis subsp bovis AF2122/97
cugcggcuuggccauca

SEQ ID NO: 3151821 - RNA, 19 nt, Mycobacterium bovis subsp bovis AF2122/97
cugcggcuuggccaucacg

SEQ ID NO: 3151822 - RNA, 22 nt, Mycobacterium bovis subsp bovis AF2122/97
cugcgggaaguugcccagguga

SEQ ID NO: 3151823 - RNA, 14 nt, Mycobacterium bovis subsp bovis AF2122/97
cugcgggacgucgu

SEQ ID NO: 3151824 - RNA, 14 nt, Mycobacterium bovis subsp bovis AF2122/97
cugcgggaucgccg

SEQ ID NO: 3151825 - RNA, 18 nt, Mycobacterium bovis subsp bovis AF2122/97
cugcgggccgagaucacg

SEQ ID NO: 3151826 - RNA, 13 nt, Mycobacterium bovis subsp bovis AF2122/97
cugcgggccggca

SEQ ID NO: 3151827 - RNA, 13 nt, Mycobacterium bovis subsp bovis AF2122/97
cugcgggccguag

SEQ ID NO: 3151828 - RNA, 19 nt, Mycobacterium bovis subsp bovis AF2122/97
cugcgggcgggucugggug

SEQ ID NO: 3151829 - RNA, 14 nt, Mycobacterium bovis subsp bovis AF2122/97
cugcgggcggucca

SEQ ID NO: 3151830 - RNA, 14 nt, Mycobacterium bovis subsp bovis AF2122/97
cugcggggagcugu

SEQ ID NO: 3151831 - RNA, 17 nt, Mycobacterium bovis subsp bovis AF2122/97
cugcggggcgaucccca

SEQ ID NO: 3151832 - RNA, 21 nt, Mycobacterium bovis subsp bovis AF2122/97
cugcggggcgauccccagcac

SEQ ID NO: 3151833 - RNA, 23 nt, Mycobacterium bovis subsp bovis AF2122/97
cugcggguagccgucgaucccgg

SEQ ID NO: 3151834 - RNA, 24 nt, Mycobacterium bovis subsp bovis AF2122/97
cugcggguaggugacgacgucguu

SEQ ID NO: 3151835 - RNA, 17 nt, Mycobacterium bovis subsp bovis AF2122/97
cugcgggucagcgccga

SEQ ID NO: 3151836 - RNA, 15 nt, Mycobacterium bovis subsp bovis AF2122/97
cugcgggucgaagcg

SEQ ID NO: 3151837 - RNA, 22 nt, Mycobacterium bovis subsp bovis AF2122/97
cugcgggucgcguuucgcagcc

SEQ ID NO: 3151838 - RNA, 21 nt, Mycobacterium bovis subsp bovis AF2122/97
cugcgggucgugccccggcgc

SEQ ID NO: 3151839 - RNA, 15 nt, Mycobacterium bovis subsp bovis AF2122/97
cugcgggucucgccg

SEQ ID NO: 3151840 - RNA, 17 nt, Mycobacterium bovis subsp bovis AF2122/97
cugcgggucucgccgac

SEQ ID NO: 3151841 - RNA, 19 nt, Mycobacterium bovis subsp bovis AF2122/97
cugcgggugauugagcuca

SEQ ID NO: 3151842 - RNA, 15 nt, Mycobacterium bovis subsp bovis AF2122/97
cugcgggugcgucga

SEQ ID NO: 3151843 - RNA, 16 nt, Mycobacterium bovis subsp bovis AF2122/97
cugcgggugcgucgau

SEQ ID NO: 3151844 - RNA, 20 nt, Mycobacterium bovis subsp bovis AF2122/97
cugcggguucacuuccgggc

SEQ ID NO: 3151845 - RNA, 23 nt, Mycobacterium bovis subsp bovis AF2122/97
cugcggguucacuuccgggcagc

SEQ ID NO: 3151846 - RNA, 17 nt, Mycobacterium bovis subsp bovis AF2122/97
cugcgguaaucgccacc

SEQ ID NO: 3151847 - RNA, 20 nt, Mycobacterium bovis subsp bovis AF2122/97
cugcgguaaucgccaccgca

SEQ ID NO: 3151848 - RNA, 23 nt, Mycobacterium bovis subsp bovis AF2122/97
cugcggucaauguggcgcuucgg

SEQ ID NO: 3151849 - RNA, 13 nt, Mycobacterium bovis subsp bovis AF2122/97
cugcggucaucgc

SEQ ID NO: 3151850 - RNA, 21 nt, Mycobacterium bovis subsp bovis AF2122/97
cugcggucaucgccucggcgu

SEQ ID NO: 3151851 - RNA, 17 nt, Mycobacterium bovis subsp bovis AF2122/97
cugcgguccgcugccau

SEQ ID NO: 3151852 - RNA, 15 nt, Mycobacterium bovis subsp bovis AF2122/97
cugcggucgcccagg

SEQ ID NO: 3151853 - RNA, 16 nt, Mycobacterium bovis subsp bovis AF2122/97
cugcggucgcccaggc

SEQ ID NO: 3151854 - RNA, 18 nt, Mycobacterium bovis subsp bovis AF2122/97
cugcggucgguccgguga

SEQ ID NO: 3151855 - RNA, 21 nt, Mycobacterium bovis subsp bovis AF2122/97
cugcggucuggacaucggccg

SEQ ID NO: 3151856 - RNA, 17 nt, Mycobacterium bovis subsp bovis AF2122/97
cugcggugccacgguga

SEQ ID NO: 3151857 - RNA, 13 nt, Mycobacterium bovis subsp bovis AF2122/97
cugcggugccggc

SEQ ID NO: 3151858 - RNA, 16 nt, Mycobacterium bovis subsp bovis AF2122/97
cugcgguggccugucg

SEQ ID NO: 3151859 - RNA, 21 nt, Mycobacterium bovis subsp bovis AF2122/97
cugcgguuuccaguaugaggu

SEQ ID NO: 3151860 - RNA, 18 nt, Mycobacterium bovis subsp bovis AF2122/97
cugcgucaucgcggguga

SEQ ID NO: 3151861 - RNA, 14 nt, Mycobacterium bovis subsp bovis AF2122/97
cugcguccaccacg

SEQ ID NO: 3151862 - RNA, 14 nt, Mycobacterium bovis subsp bovis AF2122/97
cugcguccaccgga

SEQ ID NO: 3151863 - RNA, 15 nt, Mycobacterium bovis subsp bovis AF2122/97
cugcguccaccggac

SEQ ID NO: 3151864 - RNA, 20 nt, Mycobacterium bovis subsp bovis AF2122/97
cugcguccagaucucgauua

SEQ ID NO: 3151865 - RNA, 22 nt, Mycobacterium bovis subsp bovis AF2122/97
cugcguccagcaaaugcggcgc

SEQ ID NO: 3151866 - RNA, 17 nt, Mycobacterium bovis subsp bovis AF2122/97
cugcgucggcccgcggu

SEQ ID NO: 3151867 - RNA, 13 nt, Mycobacterium bovis subsp bovis AF2122/97
cugcgucugcucg

SEQ ID NO: 3151868 - RNA, 15 nt, Mycobacterium bovis subsp bovis AF2122/97
cugcgucugcucgcc

SEQ ID NO: 3151869 - RNA, 19 nt, Mycobacterium bovis subsp bovis AF2122/97
cugcgucugcucgccagcc

SEQ ID NO: 3151870 - RNA, 20 nt, Mycobacterium bovis subsp bovis AF2122/97
cugcgucugcucgccagccg

SEQ ID NO: 3151871 - RNA, 21 nt, Mycobacterium bovis subsp bovis AF2122/97
cugcgucugcucgccagccgg

SEQ ID NO: 3151872 - RNA, 23 nt, Mycobacterium bovis subsp bovis AF2122/97
cugcgucugcucgccguggugga

SEQ ID NO: 3151873 - RNA, 17 nt, Mycobacterium bovis subsp bovis AF2122/97
cugcgucugcucgcgca

SEQ ID NO: 3151874 - RNA, 14 nt, Mycobacterium bovis subsp bovis AF2122/97
cugcgucugcucgg

SEQ ID NO: 3151875 - RNA, 16 nt, Mycobacterium bovis subsp bovis AF2122/97
cugcgucugcucggcg

SEQ ID NO: 3151876 - RNA, 18 nt, Mycobacterium bovis subsp bovis AF2122/97
cugcgucugcucggcgcg

SEQ ID NO: 3151877 - RNA, 17 nt, Mycobacterium bovis subsp bovis AF2122/97
cugcgugccgcaccgcc

SEQ ID NO: 3151878 - RNA, 13 nt, Mycobacterium bovis subsp bovis AF2122/97
cugcguucgccgg

SEQ ID NO: 3151879 - RNA, 14 nt, Mycobacterium bovis subsp bovis AF2122/97
cugcguugacguca

SEQ ID NO: 3151880 - RNA, 17 nt, Mycobacterium bovis subsp bovis AF2122/97
cugcguuggcuggugca

SEQ ID NO: 3151881 - RNA, 14 nt, Mycobacterium bovis subsp bovis AF2122/97
cugcguugggaucc

SEQ ID NO: 3151882 - RNA, 21 nt, Mycobacterium bovis subsp bovis AF2122/97
cugcguugggaucccagcgca

SEQ ID NO: 3151883 - RNA, 22 nt, Mycobacterium bovis subsp bovis AF2122/97
cugcguugggaucccagcgcag

SEQ ID NO: 3151884 - RNA, 18 nt, Mycobacterium bovis subsp bovis AF2122/97
cugcuaccagagccgcga

SEQ ID NO: 3151885 - RNA, 14 nt, Mycobacterium bovis subsp bovis AF2122/97
cugcuacccgagcc

SEQ ID NO: 3151886 - RNA, 21 nt, Mycobacterium bovis subsp bovis AF2122/97
cugcuacccgagccggcacgc

SEQ ID NO: 3151887 - RNA, 23 nt, Mycobacterium bovis subsp bovis AF2122/97
cugcuagcagcagcccgacagug

SEQ ID NO: 3151888 - RNA, 18 nt, Mycobacterium bovis subsp bovis AF2122/97
cugcuagccagucggcca

SEQ ID NO: 3151889 - RNA, 18 nt, Mycobacterium bovis subsp bovis AF2122/97
cugcuagcuuggcggcca

SEQ ID NO: 3151890 - RNA, 16 nt, Mycobacterium bovis subsp bovis AF2122/97
cugcugcagcgaugcg

SEQ ID NO: 3151891 - RNA, 23 nt, Mycobacterium bovis subsp bovis AF2122/97
cugcugcagggccuggccacacu

SEQ ID NO: 3151892 - RNA, 23 nt, Mycobacterium bovis subsp bovis AF2122/97
cugcugcauguuaugggugacga

SEQ ID NO: 3151893 - RNA, 18 nt, Mycobacterium bovis subsp bovis AF2122/97
cugcugccauugccgaug

SEQ ID NO: 3151894 - RNA, 13 nt, Mycobacterium bovis subsp bovis AF2122/97
cugcugccgaccu

SEQ ID NO: 3151895 - RNA, 22 nt, Mycobacterium bovis subsp bovis AF2122/97
cugcugccgaccuuccguuggc

SEQ ID NO: 3151896 - RNA, 16 nt, Mycobacterium bovis subsp bovis AF2122/97
cugcugccguggcggc

SEQ ID NO: 3151897 - RNA, 19 nt, Mycobacterium bovis subsp bovis AF2122/97
cugcugccguggcggcagc

SEQ ID NO: 3151898 - RNA, 15 nt, Mycobacterium bovis subsp bovis AF2122/97
cugcugcgaucgccg

SEQ ID NO: 3151899 - RNA, 16 nt, Mycobacterium bovis subsp bovis AF2122/97
cugcugcggcagcgcg

SEQ ID NO: 3151900 - RNA, 19 nt, Mycobacterium bovis subsp bovis AF2122/97
cugcugcggcagcgcggcc

SEQ ID NO: 3151901 - RNA, 24 nt, Mycobacterium bovis subsp bovis AF2122/97
cugcugcucgaucaucgggagccg

SEQ ID NO: 3151902 - RNA, 11 nt, Mycobacterium bovis subsp bovis AF2122/97
cugcugcucgg

SEQ ID NO: 3151903 - RNA, 16 nt, Mycobacterium bovis subsp bovis AF2122/97
cugcugcucggccugg

SEQ ID NO: 3151904 - RNA, 20 nt, Mycobacterium bovis subsp bovis AF2122/97
cugcuggaucgucucgcgca

SEQ ID NO: 3151905 - RNA, 11 nt, Mycobacterium bovis subsp bovis AF2122/97
cugcuggaugu

SEQ ID NO: 3151906 - RNA, 20 nt, Mycobacterium bovis subsp bovis AF2122/97
cugcuggaugucgucgacga

SEQ ID NO: 3151907 - RNA, 18 nt, Mycobacterium bovis subsp bovis AF2122/97
cugcuggcagaccaacgc

SEQ ID NO: 3151908 - RNA, 13 nt, Mycobacterium bovis subsp bovis AF2122/97
cugcuggcccugc

SEQ ID NO: 3151909 - RNA, 20 nt, Mycobacterium bovis subsp bovis AF2122/97
cugcuggccgaugugggcgg

SEQ ID NO: 3151910 - RNA, 14 nt, Mycobacterium bovis subsp bovis AF2122/97
cugcuggccgcggc

SEQ ID NO: 3151911 - RNA, 15 nt, Mycobacterium bovis subsp bovis AF2122/97
cugcuggccgcggcc

SEQ ID NO: 3151912 - RNA, 12 nt, Mycobacterium bovis subsp bovis AF2122/97
cugcuggccggg

SEQ ID NO: 3151913 - RNA, 14 nt, Mycobacterium bovis subsp bovis AF2122/97
cugcuggcgcacga

SEQ ID NO: 3151914 - RNA, 18 nt, Mycobacterium bovis subsp bovis AF2122/97
cugcuggcgcacgaaccc

SEQ ID NO: 3151915 - RNA, 12 nt, Mycobacterium bovis subsp bovis AF2122/97
cugcuggcgcuc

SEQ ID NO: 3151916 - RNA, 20 nt, Mycobacterium bovis subsp bovis AF2122/97
cugcugggagggaccacccg

SEQ ID NO: 3151917 - RNA, 15 nt, Mycobacterium bovis subsp bovis AF2122/97
cugcugggcuucgag

SEQ ID NO: 3151918 - RNA, 16 nt, Mycobacterium bovis subsp bovis AF2122/97
cugcugguaccgggcu

SEQ ID NO: 3151919 - RNA, 13 nt, Mycobacterium bovis subsp bovis AF2122/97
cugcuggugacga

SEQ ID NO: 3151920 - RNA, 17 nt, Mycobacterium bovis subsp bovis AF2122/97
cugcuggugucggcucg

SEQ ID NO: 3151921 - RNA, 18 nt, Mycobacterium bovis subsp bovis AF2122/97
cugcugucaccgcaaccg

SEQ ID NO: 3151922 - RNA, 20 nt, Mycobacterium bovis subsp bovis AF2122/97
cugcuguggaucgacaccga

SEQ ID NO: 3151923 - RNA, 21 nt, Mycobacterium bovis subsp bovis AF2122/97
cugcuguggaucgacaccgac

SEQ ID NO: 3151924 - RNA, 16 nt, Mycobacterium bovis subsp bovis AF2122/97
cugcugugggauucgg

SEQ ID NO: 3151925 - RNA, 20 nt, Mycobacterium bovis subsp bovis AF2122/97
cugcugugucguacccggca

SEQ ID NO: 3151926 - RNA, 17 nt, Mycobacterium bovis subsp bovis AF2122/97
cugcuguuucggcagga

SEQ ID NO: 3151927 - RNA, 19 nt, Mycobacterium bovis subsp bovis AF2122/97
cugcuuccggaacaaaggc

SEQ ID NO: 3151928 - RNA, 20 nt, Mycobacterium bovis subsp bovis AF2122/97
cugcuucuucggacagcagc

SEQ ID NO: 3151929 - RNA, 16 nt, Mycobacterium bovis subsp bovis AF2122/97
cugcuugacuccgcgc

SEQ ID NO: 3151930 - RNA, 19 nt, Mycobacterium bovis subsp bovis AF2122/97
cugcuugacuccgcgcgcu

SEQ ID NO: 3151931 - RNA, 21 nt, Mycobacterium bovis subsp bovis AF2122/97
cugcuugagcucgcugaucag

SEQ ID NO: 3151932 - RNA, 23 nt, Mycobacterium bovis subsp bovis AF2122/97
cugcuugaugguguccucgucga

SEQ ID NO: 3151933 - RNA, 17 nt, Mycobacterium bovis subsp bovis AF2122/97
cugcuugcgcccggccu

SEQ ID NO: 3151934 - RNA, 23 nt, Mycobacterium bovis subsp bovis AF2122/97
cugcuuggucgcccagccacuga

SEQ ID NO: 3151935 - RNA, 23 nt, Mycobacterium bovis subsp bovis AF2122/97
cugcuugucgaggcgcaggucaa

SEQ ID NO: 3151936 - RNA, 20 nt, Mycobacterium bovis subsp bovis AF2122/97
cugcuuugccuuagcccggc

SEQ ID NO: 3151937 - RNA, 23 nt, Mycobacterium bovis subsp bovis AF2122/97
cugcuuugccuuagcccggccgc

SEQ ID NO: 3151938 - RNA, 14 nt, Mycobacterium bovis subsp bovis AF2122/97
cuggaaaacccagg

SEQ ID NO: 3151939 - RNA, 16 nt, Mycobacterium bovis subsp bovis AF2122/97
cuggaaaccucuucgg

SEQ ID NO: 3151940 - RNA, 21 nt, Mycobacterium bovis subsp bovis AF2122/97
cuggaaagcagcagcggcggc

SEQ ID NO: 3151941 - RNA, 18 nt, Mycobacterium bovis subsp bovis AF2122/97
cuggaaaggacggccggc

SEQ ID NO: 3151942 - RNA, 15 nt, Mycobacterium bovis subsp bovis AF2122/97
cuggaaagggccgcc

SEQ ID NO: 3151943 - RNA, 19 nt, Mycobacterium bovis subsp bovis AF2122/97
cuggaaccaaaccugggcg

SEQ ID NO: 3151944 - RNA, 14 nt, Mycobacterium bovis subsp bovis AF2122/97
cuggaaccccgagc

SEQ ID NO: 3151945 - RNA, 22 nt, Mycobacterium bovis subsp bovis AF2122/97
cuggaagacggugcgggcuagg

SEQ ID NO: 3151946 - RNA, 13 nt, Mycobacterium bovis subsp bovis AF2122/97
cuggaagccgucu

SEQ ID NO: 3151947 - RNA, 20 nt, Mycobacterium bovis subsp bovis AF2122/97
cuggaaggcgggcaguugac

SEQ ID NO: 3151948 - RNA, 15 nt, Mycobacterium bovis subsp bovis AF2122/97
cuggaaugccgccac

SEQ ID NO: 3151949 - RNA, 15 nt, Mycobacterium bovis subsp bovis AF2122/97
cuggacaagcuccuc

SEQ ID NO: 3151950 - RNA, 20 nt, Mycobacterium bovis subsp bovis AF2122/97
cuggacauaccggcccgggu

SEQ ID NO: 3151951 - RNA, 19 nt, Mycobacterium bovis subsp bovis AF2122/97
cuggaccacagccgcgccg

SEQ ID NO: 3151952 - RNA, 17 nt, Mycobacterium bovis subsp bovis AF2122/97
cuggaccacucgccggc

SEQ ID NO: 3151953 - RNA, 18 nt, Mycobacterium bovis subsp bovis AF2122/97
cuggaccacucgccggcg

SEQ ID NO: 3151954 - RNA, 19 nt, Mycobacterium bovis subsp bovis AF2122/97
cuggaccacucgccggcgg

SEQ ID NO: 3151955 - RNA, 18 nt, Mycobacterium bovis subsp bovis AF2122/97
cuggaccagcgggcggcc

SEQ ID NO: 3151956 - RNA, 16 nt, Mycobacterium bovis subsp bovis AF2122/97
cuggacccgcauggcg

SEQ ID NO: 3151957 - RNA, 13 nt, Mycobacterium bovis subsp bovis AF2122/97
cuggaccgcggug

SEQ ID NO: 3151958 - RNA, 20 nt, Mycobacterium bovis subsp bovis AF2122/97
cuggaccgcggugacccgga

SEQ ID NO: 3151959 - RNA, 13 nt, Mycobacterium bovis subsp bovis AF2122/97
cuggaccuccgac

SEQ ID NO: 3151960 - RNA, 23 nt, Mycobacterium bovis subsp bovis AF2122/97
cuggaccucguugcugccggcgu

SEQ ID NO: 3151961 - RNA, 15 nt, Mycobacterium bovis subsp bovis AF2122/97
cuggacgcuccggga

SEQ ID NO: 3151962 - RNA, 19 nt, Mycobacterium bovis subsp bovis AF2122/97
cuggacggcgggccgcgcg

SEQ ID NO: 3151963 - RNA, 20 nt, Mycobacterium bovis subsp bovis AF2122/97
cuggacggcgggccgcgcgg

SEQ ID NO: 3151964 - RNA, 19 nt, Mycobacterium bovis subsp bovis AF2122/97
cuggacuccggucagcgcg

SEQ ID NO: 3151965 - RNA, 20 nt, Mycobacterium bovis subsp bovis AF2122/97
cuggacuccggucagcgcgg

SEQ ID NO: 3151966 - RNA, 17 nt, Mycobacterium bovis subsp bovis AF2122/97
cuggacugcagcccugc

SEQ ID NO: 3151967 - RNA, 23 nt, Mycobacterium bovis subsp bovis AF2122/97
cuggacugcagcccugcgcagcc

SEQ ID NO: 3151968 - RNA, 15 nt, Mycobacterium bovis subsp bovis AF2122/97
cuggacugcagcgcc

SEQ ID NO: 3151969 - RNA, 16 nt, Mycobacterium bovis subsp bovis AF2122/97
cuggagaaaccacugg

SEQ ID NO: 3151970 - RNA, 18 nt, Mycobacterium bovis subsp bovis AF2122/97
cuggagaucacgccgacg

SEQ ID NO: 3151971 - RNA, 15 nt, Mycobacterium bovis subsp bovis AF2122/97
cuggagccgugcggu

SEQ ID NO: 3151972 - RNA, 13 nt, Mycobacterium bovis subsp bovis AF2122/97
cuggaggccacca

SEQ ID NO: 3151973 - RNA, 17 nt, Mycobacterium bovis subsp bovis AF2122/97
cuggaggcuccuggucg

SEQ ID NO: 3151974 - RNA, 21 nt, Mycobacterium bovis subsp bovis AF2122/97
cuggaggugaacucguucagc

SEQ ID NO: 3151975 - RNA, 22 nt, Mycobacterium bovis subsp bovis AF2122/97
cuggaggugaacucguucagcg

SEQ ID NO: 3151976 - RNA, 15 nt, Mycobacterium bovis subsp bovis AF2122/97
cuggcccgucggcgu

SEQ ID NO: 3151977 - RNA, 15 nt, Mycobacterium bovis subsp bovis AF2122/97
cuggcccugcuccuc

SEQ ID NO: 3151978 - RNA, 14 nt, Mycobacterium bovis subsp bovis AF2122/97
cuggccgaagcccg

SEQ ID NO: 3151979 - RNA, 23 nt, Mycobacterium bovis subsp bovis AF2122/97
cuggccgaauaacagcaggcauu

SEQ ID NO: 3151980 - RNA, 20 nt, Mycobacterium bovis subsp bovis AF2122/97
cuggccgauggcgucaagca

SEQ ID NO: 3151981 - RNA, 13 nt, Mycobacterium bovis subsp bovis AF2122/97
cuggccgccaccg

SEQ ID NO: 3151982 - RNA, 16 nt, Mycobacterium bovis subsp bovis AF2122/97
cuggccgccaccgcac

SEQ ID NO: 3151983 - RNA, 13 nt, Mycobacterium bovis subsp bovis AF2122/97
cuggccgccagau

SEQ ID NO: 3151984 - RNA, 19 nt, Mycobacterium bovis subsp bovis AF2122/97
cuggccgcccagaccgccg

SEQ ID NO: 3151985 - RNA, 20 nt, Mycobacterium bovis subsp bovis AF2122/97
cuggccgcccagaccgccga

SEQ ID NO: 3151986 - RNA, 22 nt, Mycobacterium bovis subsp bovis AF2122/97
cuggccgcccagaccgccgacg

SEQ ID NO: 3151987 - RNA, 14 nt, Mycobacterium bovis subsp bovis AF2122/97
cuggccgcccgcug

SEQ ID NO: 3151988 - RNA, 13 nt, Mycobacterium bovis subsp bovis AF2122/97
cuggccgcccggc

SEQ ID NO: 3151989 - RNA, 15 nt, Mycobacterium bovis subsp bovis AF2122/97
cuggccgcccggcga

SEQ ID NO: 3151990 - RNA, 16 nt, Mycobacterium bovis subsp bovis AF2122/97
cuggccgcccggcgag

SEQ ID NO: 3151991 - RNA, 22 nt, Mycobacterium bovis subsp bovis AF2122/97
cuggccgcccggcgagcagggc

SEQ ID NO: 3151992 - RNA, 16 nt, Mycobacterium bovis subsp bovis AF2122/97
cuggccgcccuggccg

SEQ ID NO: 3151993 - RNA, 20 nt, Mycobacterium bovis subsp bovis AF2122/97
cuggccgcccuggccgccca

SEQ ID NO: 3151994 - RNA, 21 nt, Mycobacterium bovis subsp bovis AF2122/97
cuggccgcccuggccgcccag

SEQ ID NO: 3151995 - RNA, 15 nt, Mycobacterium bovis subsp bovis AF2122/97
cuggccgccggcccc

SEQ ID NO: 3151996 - RNA, 16 nt, Mycobacterium bovis subsp bovis AF2122/97
cuggccgccggcgccg

SEQ ID NO: 3151997 - RNA, 11 nt, Mycobacterium bovis subsp bovis AF2122/97
cuggccgcgau

SEQ ID NO: 3151998 - RNA, 13 nt, Mycobacterium bovis subsp bovis AF2122/97
cuggccgcgccgg

SEQ ID NO: 3151999 - RNA, 14 nt, Mycobacterium bovis subsp bovis AF2122/97
cuggccgcgccggg

SEQ ID NO: 3152000 - RNA, 12 nt, Mycobacterium bovis subsp bovis AF2122/97
cuggccgcgccu

SEQ ID NO: 3152001 - RNA, 16 nt, Mycobacterium bovis subsp bovis AF2122/97
cuggccgcgccucggu

SEQ ID NO: 3152002 - RNA, 22 nt, Mycobacterium bovis subsp bovis AF2122/97
cuggccgcgccucggucugcuc

SEQ ID NO: 3152003 - RNA, 18 nt, Mycobacterium bovis subsp bovis AF2122/97
cuggccgcgggcgcggcc

SEQ ID NO: 3152004 - RNA, 23 nt, Mycobacterium bovis subsp bovis AF2122/97
cuggccgcuuugcgcggucagcc

SEQ ID NO: 3152005 - RNA, 18 nt, Mycobacterium bovis subsp bovis AF2122/97
cuggccggcgguguugcc

SEQ ID NO: 3152006 - RNA, 16 nt, Mycobacterium bovis subsp bovis AF2122/97
cuggccgggaccgccc

SEQ ID NO: 3152007 - RNA, 21 nt, Mycobacterium bovis subsp bovis AF2122/97
cuggccgggaccgccccggcc

SEQ ID NO: 3152008 - RNA, 19 nt, Mycobacterium bovis subsp bovis AF2122/97
cuggccggguuccagcggc

SEQ ID NO: 3152009 - RNA, 21 nt, Mycobacterium bovis subsp bovis AF2122/97
cuggccggguuccagcggcac

SEQ ID NO: 3152010 - RNA, 20 nt, Mycobacterium bovis subsp bovis AF2122/97
cuggccggugcgcagguacg

SEQ ID NO: 3152011 - RNA, 19 nt, Mycobacterium bovis subsp bovis AF2122/97
cuggccguaacgcggaucg

SEQ ID NO: 3152012 - RNA, 19 nt, Mycobacterium bovis subsp bovis AF2122/97
cuggccgucagcgucggcg

SEQ ID NO: 3152013 - RNA, 16 nt, Mycobacterium bovis subsp bovis AF2122/97
cuggccgucccaccag

SEQ ID NO: 3152014 - RNA, 23 nt, Mycobacterium bovis subsp bovis AF2122/97
cuggccguccuaccgaugaacca

SEQ ID NO: 3152015 - RNA, 14 nt, Mycobacterium bovis subsp bovis AF2122/97
cuggccgucggcgu

SEQ ID NO: 3152016 - RNA, 16 nt, Mycobacterium bovis subsp bovis AF2122/97
cuggccgucggcguga

SEQ ID NO: 3152017 - RNA, 20 nt, Mycobacterium bovis subsp bovis AF2122/97
cuggccguugcccgacucgg

SEQ ID NO: 3152018 - RNA, 12 nt, Mycobacterium bovis subsp bovis AF2122/97
cuggccuccagc

SEQ ID NO: 3152019 - RNA, 13 nt, Mycobacterium bovis subsp bovis AF2122/97
cuggccuccagcu

SEQ ID NO: 3152020 - RNA, 23 nt, Mycobacterium bovis subsp bovis AF2122/97
cuggccuccuggaaggaggccgg

SEQ ID NO: 3152021 - RNA, 12 nt, Mycobacterium bovis subsp bovis AF2122/97
cuggccucgucg

SEQ ID NO: 3152022 - RNA, 22 nt, Mycobacterium bovis subsp bovis AF2122/97
cuggccugauuguugagccacg

SEQ ID NO: 3152023 - RNA, 21 nt, Mycobacterium bovis subsp bovis AF2122/97
cuggccugcccagcaccaccg

SEQ ID NO: 3152024 - RNA, 15 nt, Mycobacterium bovis subsp bovis AF2122/97
cuggccugccccaga

SEQ ID NO: 3152025 - RNA, 15 nt, Mycobacterium bovis subsp bovis AF2122/97
cuggccugcggcagg

SEQ ID NO: 3152026 - RNA, 16 nt, Mycobacterium bovis subsp bovis AF2122/97
cuggccuuggcagucc

SEQ ID NO: 3152027 - RNA, 20 nt, Mycobacterium bovis subsp bovis AF2122/97
cuggccuuggcaguccagcc

SEQ ID NO: 3152028 - RNA, 17 nt, Mycobacterium bovis subsp bovis AF2122/97
cuggccuuugagcgcgg

SEQ ID NO: 3152029 - RNA, 22 nt, Mycobacterium bovis subsp bovis AF2122/97
cuggccuuugagcgcggccacc

SEQ ID NO: 3152030 - RNA, 23 nt, Mycobacterium bovis subsp bovis AF2122/97
cuggccuuugagcgcggccacca

SEQ ID NO: 3152031 - RNA, 14 nt, Mycobacterium bovis subsp bovis AF2122/97
cuggcgaacaguga

SEQ ID NO: 3152032 - RNA, 21 nt, Mycobacterium bovis subsp bovis AF2122/97
cuggcgaacagugacgccacg

SEQ ID NO: 3152033 - RNA, 15 nt, Mycobacterium bovis subsp bovis AF2122/97
cuggcgaaccagagu

SEQ ID NO: 3152034 - RNA, 17 nt, Mycobacterium bovis subsp bovis AF2122/97
cuggcgaacucgcgcag

SEQ ID NO: 3152035 - RNA, 21 nt, Mycobacterium bovis subsp bovis AF2122/97
cuggcgaacucgcgcaggaag

SEQ ID NO: 3152036 - RNA, 16 nt, Mycobacterium bovis subsp bovis AF2122/97
cuggcgaaggacaaca

SEQ ID NO: 3152037 - RNA, 22 nt, Mycobacterium bovis subsp bovis AF2122/97
cuggcgaaggacaacagccgcu

SEQ ID NO: 3152038 - RNA, 19 nt, Mycobacterium bovis subsp bovis AF2122/97
cuggcgaaugcgggccucc

SEQ ID NO: 3152039 - RNA, 15 nt, Mycobacterium bovis subsp bovis AF2122/97
cuggcgacgcgacac

SEQ ID NO: 3152040 - RNA, 18 nt, Mycobacterium bovis subsp bovis AF2122/97
cuggcgacgcgacacacg

SEQ ID NO: 3152041 - RNA, 22 nt, Mycobacterium bovis subsp bovis AF2122/97
cuggcgacgcgacacacgccgc

SEQ ID NO: 3152042 - RNA, 22 nt, Mycobacterium bovis subsp bovis AF2122/97
cuggcgacggugcgcuggaugu

SEQ ID NO: 3152043 - RNA, 20 nt, Mycobacterium bovis subsp bovis AF2122/97
cuggcgacucgugucugccu

SEQ ID NO: 3152044 - RNA, 17 nt, Mycobacterium bovis subsp bovis AF2122/97
cuggcgagcagacgcaa

SEQ ID NO: 3152045 - RNA, 18 nt, Mycobacterium bovis subsp bovis AF2122/97
cuggcgagggcuaccggc

SEQ ID NO: 3152046 - RNA, 20 nt, Mycobacterium bovis subsp bovis AF2122/97
cuggcgagggcuaccggcgc

SEQ ID NO: 3152047 - RNA, 22 nt, Mycobacterium bovis subsp bovis AF2122/97
cuggcgagggcuaccggcgccg

SEQ ID NO: 3152048 - RNA, 23 nt, Mycobacterium bovis subsp bovis AF2122/97
cuggcgagggcuaccggcgccgc

SEQ ID NO: 3152049 - RNA, 17 nt, Mycobacterium bovis subsp bovis AF2122/97
cuggcgauacagcgaca

SEQ ID NO: 3152050 - RNA, 15 nt, Mycobacterium bovis subsp bovis AF2122/97
cuggcgaucgcgacg

SEQ ID NO: 3152051 - RNA, 19 nt, Mycobacterium bovis subsp bovis AF2122/97
cuggcgaucucuaccagcc

SEQ ID NO: 3152052 - RNA, 23 nt, Mycobacterium bovis subsp bovis AF2122/97
cuggcgaugacgaucgcguccgc

SEQ ID NO: 3152053 - RNA, 18 nt, Mycobacterium bovis subsp bovis AF2122/97
cuggcgauggccguccga

SEQ ID NO: 3152054 - RNA, 18 nt, Mycobacterium bovis subsp bovis AF2122/97
cuggcgcagcaacucgac

SEQ ID NO: 3152055 - RNA, 19 nt, Mycobacterium bovis subsp bovis AF2122/97
cuggcgcagcaacucgacg

SEQ ID NO: 3152056 - RNA, 21 nt, Mycobacterium bovis subsp bovis AF2122/97
cuggcgcagccugccgaugac

SEQ ID NO: 3152057 - RNA, 19 nt, Mycobacterium bovis subsp bovis AF2122/97
cuggcgcagcucaccgacg

SEQ ID NO: 3152058 - RNA, 14 nt, Mycobacterium bovis subsp bovis AF2122/97
cuggcgcccccgac

SEQ ID NO: 3152059 - RNA, 14 nt, Mycobacterium bovis subsp bovis AF2122/97
cuggcgcccccgcc

SEQ ID NO: 3152060 - RNA, 19 nt, Mycobacterium bovis subsp bovis AF2122/97
cuggcgcccgggucccggc

SEQ ID NO: 3152061 - RNA, 21 nt, Mycobacterium bovis subsp bovis AF2122/97
cuggcgcccuugccggcgaga

SEQ ID NO: 3152062 - RNA, 21 nt, Mycobacterium bovis subsp bovis AF2122/97
cugggcaucaccgccgcggcc

SEQ ID NO: 3152063 - RNA, 19 nt, Mycobacterium bovis subsp bovis AF2122/97
cugggcaucaucagcggcg

SEQ ID NO: 3152064 - RNA, 21 nt, Mycobacterium bovis subsp bovis AF2122/97
cugggccaaagcgcgggcggu

SEQ ID NO: 3152065 - RNA, 15 nt, Mycobacterium bovis subsp bovis AF2122/97
cugggccaggguguu

SEQ ID NO: 3152066 - RNA, 19 nt, Mycobacterium bovis subsp bovis AF2122/97
cugggcccgagcgcgcgcu

SEQ ID NO: 3152067 - RNA, 19 nt, Mycobacterium bovis subsp bovis AF2122/97
cugggcccgccgucaccgc

SEQ ID NO: 3152068 - RNA, 17 nt, Mycobacterium bovis subsp bovis AF2122/97
cugggccgacgggacaa

SEQ ID NO: 3152069 - RNA, 16 nt, Mycobacterium bovis subsp bovis AF2122/97
cugggccgagcgcgcc

SEQ ID NO: 3152070 - RNA, 14 nt, Mycobacterium bovis subsp bovis AF2122/97
cugggccgccgccc

SEQ ID NO: 3152071 - RNA, 16 nt, Mycobacterium bovis subsp bovis AF2122/97
cugggccgccgcccug

SEQ ID NO: 3152072 - RNA, 22 nt, Mycobacterium bovis subsp bovis AF2122/97
cugggccgcuccaccacgaccg

SEQ ID NO: 3152073 - RNA, 19 nt, Mycobacterium bovis subsp bovis AF2122/97
cugggccggggaggcuagg

SEQ ID NO: 3152074 - RNA, 22 nt, Mycobacterium bovis subsp bovis AF2122/97
cugggccggugcgaauggugca

SEQ ID NO: 3152075 - RNA, 14 nt, Mycobacterium bovis subsp bovis AF2122/97
cugggccugcggca

SEQ ID NO: 3152076 - RNA, 23 nt, Mycobacterium bovis subsp bovis AF2122/97
cugggcgaagcccagaucuugca

SEQ ID NO: 3152077 - RNA, 15 nt, Mycobacterium bovis subsp bovis AF2122/97
cugggcgagacggcg

SEQ ID NO: 3152078 - RNA, 20 nt, Mycobacterium bovis subsp bovis AF2122/97
cugggcgauauuggacgcgc

SEQ ID NO: 3152079 - RNA, 16 nt, Mycobacterium bovis subsp bovis AF2122/97
cugggcgaucgacacc

SEQ ID NO: 3152080 - RNA, 21 nt, Mycobacterium bovis subsp bovis AF2122/97
cugggcgaugacgccaucgau

SEQ ID NO: 3152081 - RNA, 14 nt, Mycobacterium bovis subsp bovis AF2122/97
cugggcgccaccau

SEQ ID NO: 3152082 - RNA, 21 nt, Mycobacterium bovis subsp bovis AF2122/97
cugggcgccaugcgccaaccc

SEQ ID NO: 3152083 - RNA, 18 nt, Mycobacterium bovis subsp bovis AF2122/97
cugggcgcccgcgguccg

SEQ ID NO: 3152084 - RNA, 22 nt, Mycobacterium bovis subsp bovis AF2122/97
cugggcgcccgcgguccggcga

SEQ ID NO: 3152085 - RNA, 14 nt, Mycobacterium bovis subsp bovis AF2122/97
cugggcgccgcgcu

SEQ ID NO: 3152086 - RNA, 20 nt, Mycobacterium bovis subsp bovis AF2122/97
cugggcgcgaccccaggcgc

SEQ ID NO: 3152087 - RNA, 22 nt, Mycobacterium bovis subsp bovis AF2122/97
cugggcgcgaccccaggcgcuc

SEQ ID NO: 3152088 - RNA, 18 nt, Mycobacterium bovis subsp bovis AF2122/97
cugggcgcgcucaucgac

SEQ ID NO: 3152089 - RNA, 19 nt, Mycobacterium bovis subsp bovis AF2122/97
cugggcgcgcucaucgacc

SEQ ID NO: 3152090 - RNA, 21 nt, Mycobacterium bovis subsp bovis AF2122/97
cugggcgcgcuggcgggcggc

SEQ ID NO: 3152091 - RNA, 10 nt, Mycobacterium bovis subsp bovis AF2122/97
cugggcggcc

SEQ ID NO: 3152092 - RNA, 13 nt, Mycobacterium bovis subsp bovis AF2122/97
cugggcggccggg

SEQ ID NO: 3152093 - RNA, 17 nt, Mycobacterium bovis subsp bovis AF2122/97
cugggcggccuuuuccg

SEQ ID NO: 3152094 - RNA, 24 nt, Mycobacterium bovis subsp bovis AF2122/97
cugggcgguagcuuccgcgacgcu

SEQ ID NO: 3152095 - RNA, 17 nt, Mycobacterium bovis subsp bovis AF2122/97
cugggcggugaaggccc

SEQ ID NO: 3152096 - RNA, 22 nt, Mycobacterium bovis subsp bovis AF2122/97
cugggcggugaaggccccgccg

SEQ ID NO: 3152097 - RNA, 18 nt, Mycobacterium bovis subsp bovis AF2122/97
cugggcguaaaccguggc

SEQ ID NO: 3152098 - RNA, 16 nt, Mycobacterium bovis subsp bovis AF2122/97
cugggcugcggccgcg

SEQ ID NO: 3152099 - RNA, 14 nt, Mycobacterium bovis subsp bovis AF2122/97
cugggcuggccagc

SEQ ID NO: 3152100 - RNA, 17 nt, Mycobacterium bovis subsp bovis AF2122/97
cugggcuggcugaccga

SEQ ID NO: 3152101 - RNA, 16 nt, Mycobacterium bovis subsp bovis AF2122/97
cugggcuuggcgacga

SEQ ID NO: 3152102 - RNA, 18 nt, Mycobacterium bovis subsp bovis AF2122/97
cugggcuugugggccggu

SEQ ID NO: 3152103 - RNA, 15 nt, Mycobacterium bovis subsp bovis AF2122/97
cugggcuuucagcac

SEQ ID NO: 3152104 - RNA, 17 nt, Mycobacterium bovis subsp bovis AF2122/97
cugggcuuucagcaccg

SEQ ID NO: 3152105 - RNA, 17 nt, Mycobacterium bovis subsp bovis AF2122/97
cugggcuuugcagcguu

SEQ ID NO: 3152106 - RNA, 18 nt, Mycobacterium bovis subsp bovis AF2122/97
cuggggaacagcagcgca

SEQ ID NO: 3152107 - RNA, 15 nt, Mycobacterium bovis subsp bovis AF2122/97
cuggggaggccaacc

SEQ ID NO: 3152108 - RNA, 19 nt, Mycobacterium bovis subsp bovis AF2122/97
cuggggauaaacugccgcg

SEQ ID NO: 3152109 - RNA, 16 nt, Mycobacterium bovis subsp bovis AF2122/97
cuggggcagccgggcg

SEQ ID NO: 3152110 - RNA, 17 nt, Mycobacterium bovis subsp bovis AF2122/97
cuggggcagccgggcgu

SEQ ID NO: 3152111 - RNA, 16 nt, Mycobacterium bovis subsp bovis AF2122/97
cuggggccccgcgccg

SEQ ID NO: 3152112 - RNA, 17 nt, Mycobacterium bovis subsp bovis AF2122/97
cuggggccccgcgccgg

SEQ ID NO: 3152113 - RNA, 18 nt, Mycobacterium bovis subsp bovis AF2122/97
cuggggccccgcgccggc

SEQ ID NO: 3152114 - RNA, 16 nt, Mycobacterium bovis subsp bovis AF2122/97
cuggggccguccggcu

SEQ ID NO: 3152115 - RNA, 17 nt, Mycobacterium bovis subsp bovis AF2122/97
cuggggcgccaccaccc

SEQ ID NO: 3152116 - RNA, 18 nt, Mycobacterium bovis subsp bovis AF2122/97
cuggggcgccaccacccg

SEQ ID NO: 3152117 - RNA, 21 nt, Mycobacterium bovis subsp bovis AF2122/97
cuggggcgcccgagaccgggc

SEQ ID NO: 3152118 - RNA, 19 nt, Mycobacterium bovis subsp bovis AF2122/97
cuggggcggauaugaugau

SEQ ID NO: 3152119 - RNA, 22 nt, Mycobacterium bovis subsp bovis AF2122/97
cuggggcggauaugaugaucgg

SEQ ID NO: 3152120 - RNA, 21 nt, Mycobacterium bovis subsp bovis AF2122/97
cuggggcggcaugcucaccga

SEQ ID NO: 3152121 - RNA, 14 nt, Mycobacterium bovis subsp bovis AF2122/97
cugggggccggcac

SEQ ID NO: 3152122 - RNA, 18 nt, Mycobacterium bovis subsp bovis AF2122/97
cugggggccggcacugcc

SEQ ID NO: 3152123 - RNA, 20 nt, Mycobacterium bovis subsp bovis AF2122/97
cuggggguagccgccggcgc

SEQ ID NO: 3152124 - RNA, 20 nt, Mycobacterium bovis subsp bovis AF2122/97
cuggggguggcagcgcggcc

SEQ ID NO: 3152125 - RNA, 18 nt, Mycobacterium bovis subsp bovis AF2122/97
cuggggugcucgggcggc

SEQ ID NO: 3152126 - RNA, 13 nt, Mycobacterium bovis subsp bovis AF2122/97
cuggggugcugcg

SEQ ID NO: 3152127 - RNA, 19 nt, Mycobacterium bovis subsp bovis AF2122/97
cugggguuggcucggcgca

SEQ ID NO: 3152128 - RNA, 16 nt, Mycobacterium bovis subsp bovis AF2122/97
cuggguauccaccgcg

SEQ ID NO: 3152129 - RNA, 16 nt, Mycobacterium bovis subsp bovis AF2122/97
cuggguccacgcgcuc

SEQ ID NO: 3152130 - RNA, 24 nt, Mycobacterium bovis subsp bovis AF2122/97
cuggguccacgcgcucggugccgc

SEQ ID NO: 3152131 - RNA, 17 nt, Mycobacterium bovis subsp bovis AF2122/97
cugggucggcacgggaa

SEQ ID NO: 3152132 - RNA, 14 nt, Mycobacterium bovis subsp bovis AF2122/97
cugggugaccagga

SEQ ID NO: 3152133 - RNA, 16 nt, Mycobacterium bovis subsp bovis AF2122/97
cugggugaccucgucg

SEQ ID NO: 3152134 - RNA, 19 nt, Mycobacterium bovis subsp bovis AF2122/97
cugggugaccucgucgacc

SEQ ID NO: 3152135 - RNA, 23 nt, Mycobacterium bovis subsp bovis AF2122/97
cugggugagcaccugggcgcgcu

SEQ ID NO: 3152136 - RNA, 15 nt, Mycobacterium bovis subsp bovis AF2122/97
cugggugccgcagcu

SEQ ID NO: 3152137 - RNA, 19 nt, Mycobacterium bovis subsp bovis AF2122/97
cugggugccggcagcggcg

SEQ ID NO: 3152138 - RNA, 20 nt, Mycobacterium bovis subsp bovis AF2122/97
cuggguggacaggucgggcc

SEQ ID NO: 3152139 - RNA, 15 nt, Mycobacterium bovis subsp bovis AF2122/97
cuggguggccaacca

SEQ ID NO: 3152140 - RNA, 18 nt, Mycobacterium bovis subsp bovis AF2122/97
cuggguggccaaccaacc

SEQ ID NO: 3152141 - RNA, 16 nt, Mycobacterium bovis subsp bovis AF2122/97
cuggguggcgucgcgg

SEQ ID NO: 3152142 - RNA, 18 nt, Mycobacterium bovis subsp bovis AF2122/97
cuggguugaccgccaccc

SEQ ID NO: 3152143 - RNA, 23 nt, Mycobacterium bovis subsp bovis AF2122/97
cuggguugaggaucccggccggg

SEQ ID NO: 3152144 - RNA, 17 nt, Mycobacterium bovis subsp bovis AF2122/97
cuggguugcguagucgu

SEQ ID NO: 3152145 - RNA, 14 nt, Mycobacterium bovis subsp bovis AF2122/97
cuggguuggcaucc

SEQ ID NO: 3152146 - RNA, 16 nt, Mycobacterium bovis subsp bovis AF2122/97
cuggguuugcacggcg

SEQ ID NO: 3152147 - RNA, 15 nt, Mycobacterium bovis subsp bovis AF2122/97
cugguaaggccggcc

SEQ ID NO: 3152148 - RNA, 17 nt, Mycobacterium bovis subsp bovis AF2122/97
cuggugcgggacgccga

SEQ ID NO: 3152149 - RNA, 13 nt, Mycobacterium bovis subsp bovis AF2122/97
cuggugcguagcc

SEQ ID NO: 3152150 - RNA, 19 nt, Mycobacterium bovis subsp bovis AF2122/97
cuggugcguagcccacccg

SEQ ID NO: 3152151 - RNA, 21 nt, Mycobacterium bovis subsp bovis AF2122/97
cuggugcguagcccacccggg

SEQ ID NO: 3152152 - RNA, 22 nt, Mycobacterium bovis subsp bovis AF2122/97
cuggugcguagcccacccgggu

SEQ ID NO: 3152153 - RNA, 23 nt, Mycobacterium bovis subsp bovis AF2122/97
cuggugcucaacggcgacaucgg

SEQ ID NO: 3152154 - RNA, 17 nt, Mycobacterium bovis subsp bovis AF2122/97
cugguggacucgggcgc

SEQ ID NO: 3152155 - RNA, 22 nt, Mycobacterium bovis subsp bovis AF2122/97
cugguggacucgggcgcugaug

SEQ ID NO: 3152156 - RNA, 15 nt, Mycobacterium bovis subsp bovis AF2122/97
cugguggcagacaug

SEQ ID NO: 3152157 - RNA, 21 nt, Mycobacterium bovis subsp bovis AF2122/97
cugguggcgccauccccgccg

SEQ ID NO: 3152158 - RNA, 22 nt, Mycobacterium bovis subsp bovis AF2122/97
cugguggcgcugaagccgacga

SEQ ID NO: 3152159 - RNA, 14 nt, Mycobacterium bovis subsp bovis AF2122/97
cugguggcggcacu

SEQ ID NO: 3152160 - RNA, 19 nt, Mycobacterium bovis subsp bovis AF2122/97
cugguggcggcacuggccc

SEQ ID NO: 3152161 - RNA, 20 nt, Mycobacterium bovis subsp bovis AF2122/97
cugguggcggcacuggcccc

SEQ ID NO: 3152162 - RNA, 16 nt, Mycobacterium bovis subsp bovis AF2122/97
cugguggcggcgacac

SEQ ID NO: 3152163 - RNA, 19 nt, Mycobacterium bovis subsp bovis AF2122/97
cugguggcggucaccacgc

SEQ ID NO: 3152164 - RNA, 14 nt, Mycobacterium bovis subsp bovis AF2122/97
cuggugggacgcgg

SEQ ID NO: 3152165 - RNA, 23 nt, Mycobacterium bovis subsp bovis AF2122/97
cuggugggaggggacccagcggc

SEQ ID NO: 3152166 - RNA, 13 nt, Mycobacterium bovis subsp bovis AF2122/97
cuggugggccauc

SEQ ID NO: 3152167 - RNA, 17 nt, Mycobacterium bovis subsp bovis AF2122/97
cuggugggggagcggcc

SEQ ID NO: 3152168 - RNA, 20 nt, Mycobacterium bovis subsp bovis AF2122/97
cuggugggggagcggccgcc

SEQ ID NO: 3152169 - RNA, 22 nt, Mycobacterium bovis subsp bovis AF2122/97
cuggugggggagcggccgccgc

SEQ ID NO: 3152170 - RNA, 17 nt, Mycobacterium bovis subsp bovis AF2122/97
cugguggggggugugga

SEQ ID NO: 3152171 - RNA, 16 nt, Mycobacterium bovis subsp bovis AF2122/97
cugguggucggcgacg

SEQ ID NO: 3152172 - RNA, 20 nt, Mycobacterium bovis subsp bovis AF2122/97
cugguguacacacccgccuc

SEQ ID NO: 3152173 - RNA, 20 nt, Mycobacterium bovis subsp bovis AF2122/97
cugguguagaccgaaauggu

SEQ ID NO: 3152174 - RNA, 17 nt, Mycobacterium bovis subsp bovis AF2122/97
cugguguagccgagcac

SEQ ID NO: 3152175 - RNA, 19 nt, Mycobacterium bovis subsp bovis AF2122/97
cugguguccaccgcaaagg

SEQ ID NO: 3152176 - RNA, 23 nt, Mycobacterium bovis subsp bovis AF2122/97
cuggugucguuuauuguccugcc

SEQ ID NO: 3152177 - RNA, 20 nt, Mycobacterium bovis subsp bovis AF2122/97
cuggugugacgauccccauu

SEQ ID NO: 3152178 - RNA, 13 nt, Mycobacterium bovis subsp bovis AF2122/97
cuggugugucccg

SEQ ID NO: 3152179 - RNA, 17 nt, Mycobacterium bovis subsp bovis AF2122/97
cugguguugaucgucgg

SEQ ID NO: 3152180 - RNA, 16 nt, Mycobacterium bovis subsp bovis AF2122/97
cugguuaccgaagguc

SEQ ID NO: 3152181 - RNA, 20 nt, Mycobacterium bovis subsp bovis AF2122/97
cugguuaccgaaggucauca

SEQ ID NO: 3152182 - RNA, 20 nt, Mycobacterium bovis subsp bovis AF2122/97
cugguucagccauucuaggu

SEQ ID NO: 3152183 - RNA, 21 nt, Mycobacterium bovis subsp bovis AF2122/97
cugguugaaccgguacaaccc

SEQ ID NO: 3152184 - RNA, 17 nt, Mycobacterium bovis subsp bovis AF2122/97
cugguugaccucgguga

SEQ ID NO: 3152185 - RNA, 15 nt, Mycobacterium bovis subsp bovis AF2122/97
cugguugacggcgaa

SEQ ID NO: 3152186 - RNA, 22 nt, Mycobacterium bovis subsp bovis AF2122/97
cugguugccuuugcggcgggca

SEQ ID NO: 3152187 - RNA, 20 nt, Mycobacterium bovis subsp bovis AF2122/97
cugguugcgcucacccgguu

SEQ ID NO: 3152188 - RNA, 16 nt, Mycobacterium bovis subsp bovis AF2122/97
cugguuggccugccgu

SEQ ID NO: 3152189 - RNA, 13 nt, Mycobacterium bovis subsp bovis AF2122/97
cugguuggcuggc

SEQ ID NO: 3152190 - RNA, 14 nt, Mycobacterium bovis subsp bovis AF2122/97
cugguugggcgaga

SEQ ID NO: 3152191 - RNA, 17 nt, Mycobacterium bovis subsp bovis AF2122/97
cugguuguugccgacga

SEQ ID NO: 3152192 - RNA, 13 nt, Mycobacterium bovis subsp bovis AF2122/97
cugguuucggccg

SEQ ID NO: 3152193 - RNA, 18 nt, Mycobacterium bovis subsp bovis AF2122/97
cugguuugcuucucccgc

SEQ ID NO: 3152194 - RNA, 18 nt, Mycobacterium bovis subsp bovis AF2122/97
cuguaacacccggccgcc

SEQ ID NO: 3152195 - RNA, 19 nt, Mycobacterium bovis subsp bovis AF2122/97
cuguaacacccggccgccg

SEQ ID NO: 3152196 - RNA, 14 nt, Mycobacterium bovis subsp bovis AF2122/97
cuguacaacgccgu

SEQ ID NO: 3152197 - RNA, 21 nt, Mycobacterium bovis subsp bovis AF2122/97
cuguacauacucugcgacacc

SEQ ID NO: 3152198 - RNA, 17 nt, Mycobacterium bovis subsp bovis AF2122/97
cuguacccgaccagcac

SEQ ID NO: 3152199 - RNA, 17 nt, Mycobacterium bovis subsp bovis AF2122/97
cuguacggaucaggccc

SEQ ID NO: 3152200 - RNA, 14 nt, Mycobacterium bovis subsp bovis AF2122/97
cuguagaccuggcc

SEQ ID NO: 3152201 - RNA, 22 nt, Mycobacterium bovis subsp bovis AF2122/97
cuguagaucagcagcggcgacc

SEQ ID NO: 3152202 - RNA, 12 nt, Mycobacterium bovis subsp bovis AF2122/97
cuguagcgaaug

SEQ ID NO: 3152203 - RNA, 21 nt, Mycobacterium bovis subsp bovis AF2122/97
cuguagcgaaugaucuugcca

SEQ ID NO: 3152204 - RNA, 22 nt, Mycobacterium bovis subsp bovis AF2122/97
cuguaggccagcccggcgugca

SEQ ID NO: 3152205 - RNA, 16 nt, Mycobacterium bovis subsp bovis AF2122/97
cuguagggccggugac

SEQ ID NO: 3152206 - RNA, 19 nt, Mycobacterium bovis subsp bovis AF2122/97
cuguagggccggugacuca

SEQ ID NO: 3152207 - RNA, 14 nt, Mycobacterium bovis subsp bovis AF2122/97
cuguagggcuucca

SEQ ID NO: 3152208 - RNA, 20 nt, Mycobacterium bovis subsp bovis AF2122/97
cuguaggucacagcugcgca

SEQ ID NO: 3152209 - RNA, 22 nt, Mycobacterium bovis subsp bovis AF2122/97
cuguagucccucaucaccucuc

SEQ ID NO: 3152210 - RNA, 13 nt, Mycobacterium bovis subsp bovis AF2122/97
cuguagucgaugu

SEQ ID NO: 3152211 - RNA, 18 nt, Mycobacterium bovis subsp bovis AF2122/97
cuguaguucgaugacuga

SEQ ID NO: 3152212 - RNA, 15 nt, Mycobacterium bovis subsp bovis AF2122/97
cugucaacgccgcgg

SEQ ID NO: 3152213 - RNA, 17 nt, Mycobacterium bovis subsp bovis AF2122/97
cugucaagcgggcuggc

SEQ ID NO: 3152214 - RNA, 17 nt, Mycobacterium bovis subsp bovis AF2122/97
cugucagcgcggcgcgc

SEQ ID NO: 3152215 - RNA, 18 nt, Mycobacterium bovis subsp bovis AF2122/97
cugucagcgcggcgcgca

SEQ ID NO: 3152216 - RNA, 17 nt, Mycobacterium bovis subsp bovis AF2122/97
cugucaggcggcggacc

SEQ ID NO: 3152217 - RNA, 21 nt, Mycobacterium bovis subsp bovis AF2122/97
cugucaggcucacacucggcc

SEQ ID NO: 3152218 - RNA, 18 nt, Mycobacterium bovis subsp bovis AF2122/97
cugucauccccggccagc

SEQ ID NO: 3152219 - RNA, 17 nt, Mycobacterium bovis subsp bovis AF2122/97
cugucauguccugggcc

SEQ ID NO: 3152220 - RNA, 20 nt, Mycobacterium bovis subsp bovis AF2122/97
cugucauguccugggccgcc

SEQ ID NO: 3152221 - RNA, 22 nt, Mycobacterium bovis subsp bovis AF2122/97
cugucauguccugggccgccgc

SEQ ID NO: 3152222 - RNA, 22 nt, Mycobacterium bovis subsp bovis AF2122/97
cuguccaccgaggccugacuga

SEQ ID NO: 3152223 - RNA, 18 nt, Mycobacterium bovis subsp bovis AF2122/97
cuguccacugccaccgcg

SEQ ID NO: 3152224 - RNA, 19 nt, Mycobacterium bovis subsp bovis AF2122/97
cuguccacugccaccgcga

SEQ ID NO: 3152225 - RNA, 17 nt, Mycobacterium bovis subsp bovis AF2122/97
cugucccaccagguacg

SEQ ID NO: 3152226 - RNA, 15 nt, Mycobacterium bovis subsp bovis AF2122/97
cugucccagcccggc

SEQ ID NO: 3152227 - RNA, 17 nt, Mycobacterium bovis subsp bovis AF2122/97
cugucccagcccggccc

SEQ ID NO: 3152228 - RNA, 13 nt, Mycobacterium bovis subsp bovis AF2122/97
cugucccgccggc

SEQ ID NO: 3152229 - RNA, 15 nt, Mycobacterium bovis subsp bovis AF2122/97
cugucccgccggccc

SEQ ID NO: 3152230 - RNA, 21 nt, Mycobacterium bovis subsp bovis AF2122/97
cugucccgccggccccgccga

SEQ ID NO: 3152231 - RNA, 13 nt, Mycobacterium bovis subsp bovis AF2122/97
cugucccggcgcg

SEQ ID NO: 3152232 - RNA, 14 nt, Mycobacterium bovis subsp bovis AF2122/97
cugucccggcgcgc

SEQ ID NO: 3152233 - RNA, 21 nt, Mycobacterium bovis subsp bovis AF2122/97
cugucccucgggaucaccgau

SEQ ID NO: 3152234 - RNA, 15 nt, Mycobacterium bovis subsp bovis AF2122/97
cuguucggccaaccc

SEQ ID NO: 3152235 - RNA, 21 nt, Mycobacterium bovis subsp bovis AF2122/97
cuguucggccaacccgggccg

SEQ ID NO: 3152236 - RNA, 21 nt, Mycobacterium bovis subsp bovis AF2122/97
cuguucggccauggcggcgcc

SEQ ID NO: 3152237 - RNA, 22 nt, Mycobacterium bovis subsp bovis AF2122/97
cuguucggccauggcggcgccg

SEQ ID NO: 3152238 - RNA, 16 nt, Mycobacterium bovis subsp bovis AF2122/97
cuguucggucuugccg

SEQ ID NO: 3152239 - RNA, 19 nt, Mycobacterium bovis subsp bovis AF2122/97
cuguucugcuggcuguggc

SEQ ID NO: 3152240 - RNA, 21 nt, Mycobacterium bovis subsp bovis AF2122/97
cuguucuuggugaccaaugcg

SEQ ID NO: 3152241 - RNA, 15 nt, Mycobacterium bovis subsp bovis AF2122/97
cuguugaagaagccc

SEQ ID NO: 3152242 - RNA, 17 nt, Mycobacterium bovis subsp bovis AF2122/97
cuguugaagaagcccga

SEQ ID NO: 3152243 - RNA, 20 nt, Mycobacterium bovis subsp bovis AF2122/97
cuguugaagccgcccgaguu

SEQ ID NO: 3152244 - RNA, 17 nt, Mycobacterium bovis subsp bovis AF2122/97
cuguugacuaccaccgc

SEQ ID NO: 3152245 - RNA, 19 nt, Mycobacterium bovis subsp bovis AF2122/97
cuguugacuaccaccgcgu

SEQ ID NO: 3152246 - RNA, 18 nt, Mycobacterium bovis subsp bovis AF2122/97
cuguugaucugcccuguu

SEQ ID NO: 3152247 - RNA, 21 nt, Mycobacterium bovis subsp bovis AF2122/97
cuguugccagucgaucgcggc

SEQ ID NO: 3152248 - RNA, 15 nt, Mycobacterium bovis subsp bovis AF2122/97
cuguugccaucgacg

SEQ ID NO: 3152249 - RNA, 20 nt, Mycobacterium bovis subsp bovis AF2122/97
cuguugcccaauucgacugc

SEQ ID NO: 3152250 - RNA, 14 nt, Mycobacterium bovis subsp bovis AF2122/97
cuguugcggcggcg

SEQ ID NO: 3152251 - RNA, 15 nt, Mycobacterium bovis subsp bovis AF2122/97
cuguugcguagcgcg

SEQ ID NO: 3152252 - RNA, 18 nt, Mycobacterium bovis subsp bovis AF2122/97
cuguuggcaugccgcccg

SEQ ID NO: 3152253 - RNA, 22 nt, Mycobacterium bovis subsp bovis AF2122/97
cuguuggcguggaucuuggcca

SEQ ID NO: 3152254 - RNA, 18 nt, Mycobacterium bovis subsp bovis AF2122/97
cuguuggugccgccacca

SEQ ID NO: 3152255 - RNA, 20 nt, Mycobacterium bovis subsp bovis AF2122/97
cuguuggugccgccaccacc

SEQ ID NO: 3152256 - RNA, 13 nt, Mycobacterium bovis subsp bovis AF2122/97
cuguugguuuugu

SEQ ID NO: 3152257 - RNA, 21 nt, Mycobacterium bovis subsp bovis AF2122/97
cuguugugagauuggcagacc

SEQ ID NO: 3152258 - RNA, 20 nt, Mycobacterium bovis subsp bovis AF2122/97
cuguuguggaacaccgcggc

SEQ ID NO: 3152259 - RNA, 14 nt, Mycobacterium bovis subsp bovis AF2122/97
cuguuguugccccg

SEQ ID NO: 3152260 - RNA, 23 nt, Mycobacterium bovis subsp bovis AF2122/97
cuguuucggcaggaaugccgcgg

SEQ ID NO: 3152261 - RNA, 16 nt, Mycobacterium bovis subsp bovis AF2122/97
cuguuucugagcgcgc

SEQ ID NO: 3152262 - RNA, 17 nt, Mycobacterium bovis subsp bovis AF2122/97
cuguuuggggcugugca

SEQ ID NO: 3152263 - RNA, 22 nt, Mycobacterium bovis subsp bovis AF2122/97
cuuaagcgaacccgagccgccg

SEQ ID NO: 3152264 - RNA, 23 nt, Mycobacterium bovis subsp bovis AF2122/97
cuuaagcgaacccgagccgccgu

SEQ ID NO: 3152265 - RNA, 19 nt, Mycobacterium bovis subsp bovis AF2122/97
cuuaaggcccuggccgcgc

SEQ ID NO: 3152266 - RNA, 18 nt, Mycobacterium bovis subsp bovis AF2122/97
cuuacacgccuggcuacg

SEQ ID NO: 3152267 - RNA, 14 nt, Mycobacterium bovis subsp bovis AF2122/97
cuuaccggcgggcg

SEQ ID NO: 3152268 - RNA, 18 nt, Mycobacterium bovis subsp bovis AF2122/97
cuuacuugaucucggcga

SEQ ID NO: 3152269 - RNA, 15 nt, Mycobacterium bovis subsp bovis AF2122/97
cuuagcccggccgcg

SEQ ID NO: 3152270 - RNA, 17 nt, Mycobacterium bovis subsp bovis AF2122/97
cuuagcggaaaacccag

SEQ ID NO: 3152271 - RNA, 20 nt, Mycobacterium bovis subsp bovis AF2122/97
cuuagcgucgcugcccgcgg

SEQ ID NO: 3152272 - RNA, 14 nt, Mycobacterium bovis subsp bovis AF2122/97
cuuagcugccgucg

SEQ ID NO: 3152273 - RNA, 16 nt, Mycobacterium bovis subsp bovis AF2122/97
cuuaggcacucccgga

SEQ ID NO: 3152274 - RNA, 18 nt, Mycobacterium bovis subsp bovis AF2122/97
cuuagggcgcccgccccg

SEQ ID NO: 3152275 - RNA, 18 nt, Mycobacterium bovis subsp bovis AF2122/97
cuuauccggccagugaca

SEQ ID NO: 3152276 - RNA, 14 nt, Mycobacterium bovis subsp bovis AF2122/97
cuuaugcacgacgg

SEQ ID NO: 3152277 - RNA, 18 nt, Mycobacterium bovis subsp bovis AF2122/97
cuuaugcgucugcucgcc

SEQ ID NO: 3152278 - RNA, 22 nt, Mycobacterium bovis subsp bovis AF2122/97
cuucaacuuacgcgacgccguc

SEQ ID NO: 3152279 - RNA, 21 nt, Mycobacterium bovis subsp bovis AF2122/97
cuucaagauuaccgaagcccg

SEQ ID NO: 3152280 - RNA, 15 nt, Mycobacterium bovis subsp bovis AF2122/97
cuucaccacccuguu

SEQ ID NO: 3152281 - RNA, 15 nt, Mycobacterium bovis subsp bovis AF2122/97
cuucaccagccaccc

SEQ ID NO: 3152282 - RNA, 14 nt, Mycobacterium bovis subsp bovis AF2122/97
cuucaccagcugcg

SEQ ID NO: 3152283 - RNA, 17 nt, Mycobacterium bovis subsp bovis AF2122/97
cuucacccaaccccgcc

SEQ ID NO: 3152284 - RNA, 15 nt, Mycobacterium bovis subsp bovis AF2122/97
cuucaccccacuggc

SEQ ID NO: 3152285 - RNA, 14 nt, Mycobacterium bovis subsp bovis AF2122/97
cuucaccgccuugg

SEQ ID NO: 3152286 - RNA, 24 nt, Mycobacterium bovis subsp bovis AF2122/97
cuucaccuggaaggucagcgcccu

SEQ ID NO: 3152287 - RNA, 21 nt, Mycobacterium bovis subsp bovis AF2122/97
cuucacgcuggccuccagcuu

SEQ ID NO: 3152288 - RNA, 18 nt, Mycobacterium bovis subsp bovis AF2122/97
cuucacgggccguccagg

SEQ ID NO: 3152289 - RNA, 18 nt, Mycobacterium bovis subsp bovis AF2122/97
cuucacggucgacgauga

SEQ ID NO: 3152290 - RNA, 21 nt, Mycobacterium bovis subsp bovis AF2122/97
cuucacucguugaccggccgg

SEQ ID NO: 3152291 - RNA, 14 nt, Mycobacterium bovis subsp bovis AF2122/97
cuucacugcgaccg

SEQ ID NO: 3152292 - RNA, 14 nt, Mycobacterium bovis subsp bovis AF2122/97
cuucacuggcgaac

SEQ ID NO: 3152293 - RNA, 20 nt, Mycobacterium bovis subsp bovis AF2122/97
cuucacuguugcccuuggga

SEQ ID NO: 3152294 - RNA, 17 nt, Mycobacterium bovis subsp bovis AF2122/97
cuucagcaagccaaccc

SEQ ID NO: 3152295 - RNA, 24 nt, Mycobacterium bovis subsp bovis AF2122/97
cuucagcacgguguacgcccgcuc

SEQ ID NO: 3152296 - RNA, 14 nt, Mycobacterium bovis subsp bovis AF2122/97
cuucagcagcggcg

SEQ ID NO: 3152297 - RNA, 18 nt, Mycobacterium bovis subsp bovis AF2122/97
cuucagccaguccagcgc

SEQ ID NO: 3152298 - RNA, 19 nt, Mycobacterium bovis subsp bovis AF2122/97
cuucagccaguccagcgcg

SEQ ID NO: 3152299 - RNA, 13 nt, Mycobacterium bovis subsp bovis AF2122/97
cuucagcgcggca

SEQ ID NO: 3152300 - RNA, 14 nt, Mycobacterium bovis subsp bovis AF2122/97
cuucagcgcggcac

SEQ ID NO: 3152301 - RNA, 13 nt, Mycobacterium bovis subsp bovis AF2122/97
cuucagcguccug

SEQ ID NO: 3152302 - RNA, 17 nt, Mycobacterium bovis subsp bovis AF2122/97
cuucagcguccugguga

SEQ ID NO: 3152303 - RNA, 17 nt, Mycobacterium bovis subsp bovis AF2122/97
cuucagcuaccuccgcc

SEQ ID NO: 3152304 - RNA, 23 nt, Mycobacterium bovis subsp bovis AF2122/97
cuucagcugcggauacagccgcc

SEQ ID NO: 3152305 - RNA, 16 nt, Mycobacterium bovis subsp bovis AF2122/97
cuucaggcaccggaug

SEQ ID NO: 3152306 - RNA, 17 nt, Mycobacterium bovis subsp bovis AF2122/97
cuucaggcaucaccgga

SEQ ID NO: 3152307 - RNA, 15 nt, Mycobacterium bovis subsp bovis AF2122/97
cuucaggccgcgcau

SEQ ID NO: 3152308 - RNA, 15 nt, Mycobacterium bovis subsp bovis AF2122/97
cuucaggcgccacug

SEQ ID NO: 3152309 - RNA, 15 nt, Mycobacterium bovis subsp bovis AF2122/97
cuucagggcgucgaa

SEQ ID NO: 3152310 - RNA, 14 nt, Mycobacterium bovis subsp bovis AF2122/97
cuucagguccaccg

SEQ ID NO: 3152311 - RNA, 22 nt, Mycobacterium bovis subsp bovis AF2122/97
cuucagguccaccgcugccggc

SEQ ID NO: 3152312 - RNA, 15 nt, Mycobacterium bovis subsp bovis AF2122/97
cuucaguccggcccc

SEQ ID NO: 3152313 - RNA, 18 nt, Mycobacterium bovis subsp bovis AF2122/97
cuucaguccggcccccga

SEQ ID NO: 3152314 - RNA, 12 nt, Mycobacterium bovis subsp bovis AF2122/97
cuucauagcgcc

SEQ ID NO: 3152315 - RNA, 14 nt, Mycobacterium bovis subsp bovis AF2122/97
cuucaucggcgaua

SEQ ID NO: 3152316 - RNA, 23 nt, Mycobacterium bovis subsp bovis AF2122/97
cuucaucuucgaggucugguaga

SEQ ID NO: 3152317 - RNA, 16 nt, Mycobacterium bovis subsp bovis AF2122/97
cuucaucuugccgcga

SEQ ID NO: 3152318 - RNA, 16 nt, Mycobacterium bovis subsp bovis AF2122/97
cuucaugccggacugc

SEQ ID NO: 3152319 - RNA, 14 nt, Mycobacterium bovis subsp bovis AF2122/97
cuuccaacaggccg

SEQ ID NO: 3152320 - RNA, 18 nt, Mycobacterium bovis subsp bovis AF2122/97
cuucgccgaguugaccgc

SEQ ID NO: 3152321 - RNA, 13 nt, Mycobacterium bovis subsp bovis AF2122/97
cuucgccgcggga

SEQ ID NO: 3152322 - RNA, 16 nt, Mycobacterium bovis subsp bovis AF2122/97
cuucgccggcgccagc

SEQ ID NO: 3152323 - RNA, 19 nt, Mycobacterium bovis subsp bovis AF2122/97
cuucgccgucggcgacucc

SEQ ID NO: 3152324 - RNA, 16 nt, Mycobacterium bovis subsp bovis AF2122/97
cuucgcgaagaacgac

SEQ ID NO: 3152325 - RNA, 20 nt, Mycobacterium bovis subsp bovis AF2122/97
cuucgcgaagaacgacgcca

SEQ ID NO: 3152326 - RNA, 22 nt, Mycobacterium bovis subsp bovis AF2122/97
cuucgcgaagaacgacgccacc

SEQ ID NO: 3152327 - RNA, 18 nt, Mycobacterium bovis subsp bovis AF2122/97
cuucgcgcaaccagccca

SEQ ID NO: 3152328 - RNA, 15 nt, Mycobacterium bovis subsp bovis AF2122/97
cuucgcgcagccgcc

SEQ ID NO: 3152329 - RNA, 16 nt, Mycobacterium bovis subsp bovis AF2122/97
cuucgcgcagccgccg

SEQ ID NO: 3152330 - RNA, 13 nt, Mycobacterium bovis subsp bovis AF2122/97
cuucgcgcgcugg

SEQ ID NO: 3152331 - RNA, 16 nt, Mycobacterium bovis subsp bovis AF2122/97
cuucgcgcgcugggcg

SEQ ID NO: 3152332 - RNA, 21 nt, Mycobacterium bovis subsp bovis AF2122/97
cuucgcgcgcugggcgcgcuc

SEQ ID NO: 3152333 - RNA, 22 nt, Mycobacterium bovis subsp bovis AF2122/97
cuucgcgggacgcgacucggcg

SEQ ID NO: 3152334 - RNA, 23 nt, Mycobacterium bovis subsp bovis AF2122/97
cuucgcgggacgcgacucggcgg

SEQ ID NO: 3152335 - RNA, 20 nt, Mycobacterium bovis subsp bovis AF2122/97
cuucgcggugugcggcagcc

SEQ ID NO: 3152336 - RNA, 21 nt, Mycobacterium bovis subsp bovis AF2122/97
cuucgcggugugcggcagccc

SEQ ID NO: 3152337 - RNA, 22 nt, Mycobacterium bovis subsp bovis AF2122/97
cuucgcggugugcggcagcccg

SEQ ID NO: 3152338 - RNA, 23 nt, Mycobacterium bovis subsp bovis AF2122/97
cuucgcggugugcggcagcccgc

SEQ ID NO: 3152339 - RNA, 21 nt, Mycobacterium bovis subsp bovis AF2122/97
cuucgcgguuggcggcgaugg

SEQ ID NO: 3152340 - RNA, 18 nt, Mycobacterium bovis subsp bovis AF2122/97
cuucgcucgggucaucuu

SEQ ID NO: 3152341 - RNA, 21 nt, Mycobacterium bovis subsp bovis AF2122/97
cuucgcuggaaaccucuucgg

SEQ ID NO: 3152342 - RNA, 20 nt, Mycobacterium bovis subsp bovis AF2122/97
cuucgcugguauagcucacg

SEQ ID NO: 3152343 - RNA, 17 nt, Mycobacterium bovis subsp bovis AF2122/97
cuucgcuuucccgucgg

SEQ ID NO: 3152344 - RNA, 18 nt, Mycobacterium bovis subsp bovis AF2122/97
cuucggacagcagccggc

SEQ ID NO: 3152345 - RNA, 12 nt, Mycobacterium bovis subsp bovis AF2122/97
cuucggaccggc

SEQ ID NO: 3152346 - RNA, 19 nt, Mycobacterium bovis subsp bovis AF2122/97
cuucggagaccgccucguc

SEQ ID NO: 3152347 - RNA, 22 nt, Mycobacterium bovis subsp bovis AF2122/97
cuucggcagaccggcaucgauc

SEQ ID NO: 3152348 - RNA, 22 nt, Mycobacterium bovis subsp bovis AF2122/97
cuucggcauucgcaccaccugg

SEQ ID NO: 3152349 - RNA, 18 nt, Mycobacterium bovis subsp bovis AF2122/97
cuucggccaaccaugcug

SEQ ID NO: 3152350 - RNA, 15 nt, Mycobacterium bovis subsp bovis AF2122/97
cuucggccagaucac

SEQ ID NO: 3152351 - RNA, 16 nt, Mycobacterium bovis subsp bovis AF2122/97
cuucggccgaccgggc

SEQ ID NO: 3152352 - RNA, 12 nt, Mycobacterium bovis subsp bovis AF2122/97
cuucggccgcac

SEQ ID NO: 3152353 - RNA, 12 nt, Mycobacterium bovis subsp bovis AF2122/97
cuucggccggcg

SEQ ID NO: 3152354 - RNA, 16 nt, Mycobacterium bovis subsp bovis AF2122/97
cuucggccggcguguu

SEQ ID NO: 3152355 - RNA, 15 nt, Mycobacterium bovis subsp bovis AF2122/97
cuucggccuucuuga

SEQ ID NO: 3152356 - RNA, 14 nt, Mycobacterium bovis subsp bovis AF2122/97
cuucggcgacaggc

SEQ ID NO: 3152357 - RNA, 17 nt, Mycobacterium bovis subsp bovis AF2122/97
cuucggcgacaggccga

SEQ ID NO: 3152358 - RNA, 20 nt, Mycobacterium bovis subsp bovis AF2122/97
cuucggcgagcgcaucggcc

SEQ ID NO: 3152359 - RNA, 18 nt, Mycobacterium bovis subsp bovis AF2122/97
cuucggcgagcggugauu

SEQ ID NO: 3152360 - RNA, 14 nt, Mycobacterium bovis subsp bovis AF2122/97
cuucggcgccgcgc

SEQ ID NO: 3152361 - RNA, 16 nt, Mycobacterium bovis subsp bovis AF2122/97
cuucggcgccgcgccg

SEQ ID NO: 3152362 - RNA, 18 nt, Mycobacterium bovis subsp bovis AF2122/97
cuucggcgccgcgccguc

SEQ ID NO: 3152363 - RNA, 22 nt, Mycobacterium bovis subsp bovis AF2122/97
cuucggcgccgucucgaucgcg

SEQ ID NO: 3152364 - RNA, 15 nt, Mycobacterium bovis subsp bovis AF2122/97
cuucggcggacaggc

SEQ ID NO: 3152365 - RNA, 20 nt, Mycobacterium bovis subsp bovis AF2122/97
cuucggcggccgagcgcacc

SEQ ID NO: 3152366 - RNA, 17 nt, Mycobacterium bovis subsp bovis AF2122/97
cuucggcggucagcggc

SEQ ID NO: 3152367 - RNA, 23 nt, Mycobacterium bovis subsp bovis AF2122/97
cuucggcggucagcggcugggcg

SEQ ID NO: 3152368 - RNA, 15 nt, Mycobacterium bovis subsp bovis AF2122/97
cuucggcggucgccg

SEQ ID NO: 3152369 - RNA, 16 nt, Mycobacterium bovis subsp bovis AF2122/97
cuucggcggucgccgc

SEQ ID NO: 3152370 - RNA, 20 nt, Mycobacterium bovis subsp bovis AF2122/97
cuucggcggucgccgcgcgu

SEQ ID NO: 3152371 - RNA, 18 nt, Mycobacterium bovis subsp bovis AF2122/97
cuucggcggugccaccag

SEQ ID NO: 3152372 - RNA, 19 nt, Mycobacterium bovis subsp bovis AF2122/97
cuucggcggugcccagcag

SEQ ID NO: 3152373 - RNA, 14 nt, Mycobacterium bovis subsp bovis AF2122/97
cuucggcuagguca

SEQ ID NO: 3152374 - RNA, 17 nt, Mycobacterium bovis subsp bovis AF2122/97
cuucggcuggcgugcug

SEQ ID NO: 3152375 - RNA, 17 nt, Mycobacterium bovis subsp bovis AF2122/97
cuucgggaacgcucguc

SEQ ID NO: 3152376 - RNA, 12 nt, Mycobacterium bovis subsp bovis AF2122/97
cuucgggcggcg

SEQ ID NO: 3152377 - RNA, 20 nt, Mycobacterium bovis subsp bovis AF2122/97
cuucgggcucguccagcaac

SEQ ID NO: 3152378 - RNA, 16 nt, Mycobacterium bovis subsp bovis AF2122/97
cuucggggucaccggc

SEQ ID NO: 3152379 - RNA, 18 nt, Mycobacterium bovis subsp bovis AF2122/97
cuucggggugcacgcgga

SEQ ID NO: 3152380 - RNA, 17 nt, Mycobacterium bovis subsp bovis AF2122/97
cuucgggugcagccaga

SEQ ID NO: 3152381 - RNA, 15 nt, Mycobacterium bovis subsp bovis AF2122/97
cuucgguaggcaggc

SEQ ID NO: 3152382 - RNA, 17 nt, Mycobacterium bovis subsp bovis AF2122/97
cuucggucaccucgaug

SEQ ID NO: 3152383 - RNA, 16 nt, Mycobacterium bovis subsp bovis AF2122/97
cuucggucgcggccuc

SEQ ID NO: 3152384 - RNA, 18 nt, Mycobacterium bovis subsp bovis AF2122/97
cuucggugacccgggcgg

SEQ ID NO: 3152385 - RNA, 12 nt, Mycobacterium bovis subsp bovis AF2122/97
cuucggugaucu

SEQ ID NO: 3152386 - RNA, 14 nt, Mycobacterium bovis subsp bovis AF2122/97
cuucgguggcgggc

SEQ ID NO: 3152387 - RNA, 15 nt, Mycobacterium bovis subsp bovis AF2122/97
cuucgguggcgggcu

SEQ ID NO: 3152388 - RNA, 23 nt, Mycobacterium bovis subsp bovis AF2122/97
cuucgguggcgggcuugccgucu

SEQ ID NO: 3152389 - RNA, 19 nt, Mycobacterium bovis subsp bovis AF2122/97
cuucgguggggucgcugcc

SEQ ID NO: 3152390 - RNA, 22 nt, Mycobacterium bovis subsp bovis AF2122/97
cuucgguggggucgcugccgcc

SEQ ID NO: 3152391 - RNA, 18 nt, Mycobacterium bovis subsp bovis AF2122/97
cuucgguguagcccagcc

SEQ ID NO: 3152392 - RNA, 14 nt, Mycobacterium bovis subsp bovis AF2122/97
cuucggugucgccg

SEQ ID NO: 3152393 - RNA, 16 nt, Mycobacterium bovis subsp bovis AF2122/97
cuucguaaccacgacg

SEQ ID NO: 3152394 - RNA, 16 nt, Mycobacterium bovis subsp bovis AF2122/97
cuucguagcggccgca

SEQ ID NO: 3152395 - RNA, 15 nt, Mycobacterium bovis subsp bovis AF2122/97
cuucgucaaccacca

SEQ ID NO: 3152396 - RNA, 18 nt, Mycobacterium bovis subsp bovis AF2122/97
cuucgucaaccaccagga

SEQ ID NO: 3152397 - RNA, 17 nt, Mycobacterium bovis subsp bovis AF2122/97
cuucgucauggccggcc

SEQ ID NO: 3152398 - RNA, 18 nt, Mycobacterium bovis subsp bovis AF2122/97
cuucgucauggccggcca

SEQ ID NO: 3152399 - RNA, 21 nt, Mycobacterium bovis subsp bovis AF2122/97
cuucgucgccgaacagcgacg

SEQ ID NO: 3152400 - RNA, 22 nt, Mycobacterium bovis subsp bovis AF2122/97
cuucgucgccgaacagcgacgc

SEQ ID NO: 3152401 - RNA, 12 nt, Mycobacterium bovis subsp bovis AF2122/97
cuucgucggccg

SEQ ID NO: 3152402 - RNA, 16 nt, Mycobacterium bovis subsp bovis AF2122/97
cuucgucggccggcac

SEQ ID NO: 3152403 - RNA, 20 nt, Mycobacterium bovis subsp bovis AF2122/97
cuucgucggccggcacccca

SEQ ID NO: 3152404 - RNA, 16 nt, Mycobacterium bovis subsp bovis AF2122/97
cuucuaccccggugac

SEQ ID NO: 3152405 - RNA, 13 nt, Mycobacterium bovis subsp bovis AF2122/97
cuucuccaccacc

SEQ ID NO: 3152406 - RNA, 14 nt, Mycobacterium bovis subsp bovis AF2122/97
cuugccaccacgca

SEQ ID NO: 3152407 - RNA, 23 nt, Mycobacterium bovis subsp bovis AF2122/97
cuugcccaagaucucgcgggccc

SEQ ID NO: 3152408 - RNA, 17 nt, Mycobacterium bovis subsp bovis AF2122/97
cuugcccacggcgacca

SEQ ID NO: 3152409 - RNA, 16 nt, Mycobacterium bovis subsp bovis AF2122/97
cuugcccagcgacaug

SEQ ID NO: 3152410 - RNA, 12 nt, Mycobacterium bovis subsp bovis AF2122/97
cuugccccgccg

SEQ ID NO: 3152411 - RNA, 13 nt, Mycobacterium bovis subsp bovis AF2122/97
cuugcccgacggc

SEQ ID NO: 3152412 - RNA, 17 nt, Mycobacterium bovis subsp bovis AF2122/97
cuugcccgagcccagcc

SEQ ID NO: 3152413 - RNA, 16 nt, Mycobacterium bovis subsp bovis AF2122/97
cuugcccgcgcagcac

SEQ ID NO: 3152414 - RNA, 14 nt, Mycobacterium bovis subsp bovis AF2122/97
cuugcccgucggcg

SEQ ID NO: 3152415 - RNA, 14 nt, Mycobacterium bovis subsp bovis AF2122/97
cuugcccuccgggu

SEQ ID NO: 3152416 - RNA, 17 nt, Mycobacterium bovis subsp bovis AF2122/97
cuugccgaaauccuuga

SEQ ID NO: 3152417 - RNA, 13 nt, Mycobacterium bovis subsp bovis AF2122/97
cuugccgaucagc

SEQ ID NO: 3152418 - RNA, 16 nt, Mycobacterium bovis subsp bovis AF2122/97
cuugccgaugacgaug

SEQ ID NO: 3152419 - RNA, 13 nt, Mycobacterium bovis subsp bovis AF2122/97
cuugccgauuccg

SEQ ID NO: 3152420 - RNA, 14 nt, Mycobacterium bovis subsp bovis AF2122/97
cuugccgccagccc

SEQ ID NO: 3152421 - RNA, 18 nt, Mycobacterium bovis subsp bovis AF2122/97
cuugccgccagccccagc

SEQ ID NO: 3152422 - RNA, 22 nt, Mycobacterium bovis subsp bovis AF2122/97
cuugccgccauuccagccggug

SEQ ID NO: 3152423 - RNA, 16 nt, Mycobacterium bovis subsp bovis AF2122/97
cuugccgcccgcuccg

SEQ ID NO: 3152424 - RNA, 18 nt, Mycobacterium bovis subsp bovis AF2122/97
cuugccgcccgcuccgcc

SEQ ID NO: 3152425 - RNA, 14 nt, Mycobacterium bovis subsp bovis AF2122/97
cuugccgccggccc

SEQ ID NO: 3152426 - RNA, 16 nt, Mycobacterium bovis subsp bovis AF2122/97
cuugccgccggccccg

SEQ ID NO: 3152427 - RNA, 19 nt, Mycobacterium bovis subsp bovis AF2122/97
cuugccgccggccccgccg

SEQ ID NO: 3152428 - RNA, 22 nt, Mycobacterium bovis subsp bovis AF2122/97
cuugccgccggccccgccggcg

SEQ ID NO: 3152429 - RNA, 13 nt, Mycobacterium bovis subsp bovis AF2122/97
cuugccgccggcg

SEQ ID NO: 3152430 - RNA, 15 nt, Mycobacterium bovis subsp bovis AF2122/97
cuugccgccggcgcc

SEQ ID NO: 3152431 - RNA, 17 nt, Mycobacterium bovis subsp bovis AF2122/97
cuugccgccguugauga

SEQ ID NO: 3152432 - RNA, 16 nt, Mycobacterium bovis subsp bovis AF2122/97
cuugccgccuuggccc

SEQ ID NO: 3152433 - RNA, 17 nt, Mycobacterium bovis subsp bovis AF2122/97
cuugccgccuuggcccc

SEQ ID NO: 3152434 - RNA, 11 nt, Mycobacterium bovis subsp bovis AF2122/97
cuugccgcgca

SEQ ID NO: 3152435 - RNA, 17 nt, Mycobacterium bovis subsp bovis AF2122/97
cuugccgcugagcccug

SEQ ID NO: 3152436 - RNA, 21 nt, Mycobacterium bovis subsp bovis AF2122/97
cuugccgcugagcccugcgcc

SEQ ID NO: 3152437 - RNA, 13 nt, Mycobacterium bovis subsp bovis AF2122/97
cuugccggugcgc

SEQ ID NO: 3152438 - RNA, 15 nt, Mycobacterium bovis subsp bovis AF2122/97
cuugccgucgcugac

SEQ ID NO: 3152439 - RNA, 16 nt, Mycobacterium bovis subsp bovis AF2122/97
cuugccgucgcugacg

SEQ ID NO: 3152440 - RNA, 23 nt, Mycobacterium bovis subsp bovis AF2122/97
cuugccgucgcugacgcccuccu

SEQ ID NO: 3152441 - RNA, 16 nt, Mycobacterium bovis subsp bovis AF2122/97
cuugccgucggccggc

SEQ ID NO: 3152442 - RNA, 19 nt, Mycobacterium bovis subsp bovis AF2122/97
cuugccgucuucgccgcca

SEQ ID NO: 3152443 - RNA, 22 nt, Mycobacterium bovis subsp bovis AF2122/97
cuugccgucuucgccgccaccg

SEQ ID NO: 3152444 - RNA, 16 nt, Mycobacterium bovis subsp bovis AF2122/97
cuugccguugggaacc

SEQ ID NO: 3152445 - RNA, 22 nt, Mycobacterium bovis subsp bovis AF2122/97
cuugccguuguagacggcggca

SEQ ID NO: 3152446 - RNA, 15 nt, Mycobacterium bovis subsp bovis AF2122/97
cuugccuagccgcag

SEQ ID NO: 3152447 - RNA, 19 nt, Mycobacterium bovis subsp bovis AF2122/97
cuugcgaccccggcugcgc

SEQ ID NO: 3152448 - RNA, 22 nt, Mycobacterium bovis subsp bovis AF2122/97
cuugcgacguucuugggaccga

SEQ ID NO: 3152449 - RNA, 17 nt, Mycobacterium bovis subsp bovis AF2122/97
cuugcgcaaugccgacg

SEQ ID NO: 3152450 - RNA, 14 nt, Mycobacterium bovis subsp bovis AF2122/97
cuugcgcagcagcg

SEQ ID NO: 3152451 - RNA, 21 nt, Mycobacterium bovis subsp bovis AF2122/97
cuugcgcagccgcagccgguu

SEQ ID NO: 3152452 - RNA, 16 nt, Mycobacterium bovis subsp bovis AF2122/97
cuugcgcaucgccgac

SEQ ID NO: 3152453 - RNA, 17 nt, Mycobacterium bovis subsp bovis AF2122/97
cuugcgcaucgccgaca

SEQ ID NO: 3152454 - RNA, 18 nt, Mycobacterium bovis subsp bovis AF2122/97
cuugcgcaucgccgacag

SEQ ID NO: 3152455 - RNA, 14 nt, Mycobacterium bovis subsp bovis AF2122/97
cuugcgcccggccu

SEQ ID NO: 3152456 - RNA, 14 nt, Mycobacterium bovis subsp bovis AF2122/97
cuugcgccgcagcg

SEQ ID NO: 3152457 - RNA, 15 nt, Mycobacterium bovis subsp bovis AF2122/97
cuugcgccgcagcga

SEQ ID NO: 3152458 - RNA, 22 nt, Mycobacterium bovis subsp bovis AF2122/97
cuugcgccgcccaugccuccag

SEQ ID NO: 3152459 - RNA, 20 nt, Mycobacterium bovis subsp bovis AF2122/97
cuugcgccggaugacaccga

SEQ ID NO: 3152460 - RNA, 23 nt, Mycobacterium bovis subsp bovis AF2122/97
cuugcgccggaugacaccgaccg

SEQ ID NO: 3152461 - RNA, 16 nt, Mycobacterium bovis subsp bovis AF2122/97
cuugcgcggcuugggc

SEQ ID NO: 3152462 - RNA, 18 nt, Mycobacterium bovis subsp bovis AF2122/97
cuugcggaagaagugcuc

SEQ ID NO: 3152463 - RNA, 14 nt, Mycobacterium bovis subsp bovis AF2122/97
cuugcggaccuggc

SEQ ID NO: 3152464 - RNA, 22 nt, Mycobacterium bovis subsp bovis AF2122/97
cuugcggaccuggcggcgguag

SEQ ID NO: 3152465 - RNA, 15 nt, Mycobacterium bovis subsp bovis AF2122/97
cuugcggagccgccg

SEQ ID NO: 3152466 - RNA, 13 nt, Mycobacterium bovis subsp bovis AF2122/97
cuugcggcaccca

SEQ ID NO: 3152467 - RNA, 19 nt, Mycobacterium bovis subsp bovis AF2122/97
cuugcggcacccagucggc

SEQ ID NO: 3152468 - RNA, 19 nt, Mycobacterium bovis subsp bovis AF2122/97
cuugcgggcagccgcccgc

SEQ ID NO: 3152469 - RNA, 14 nt, Mycobacterium bovis subsp bovis AF2122/97
cuugcggggccggg

SEQ ID NO: 3152470 - RNA, 16 nt, Mycobacterium bovis subsp bovis AF2122/97
cuugcgguaggcggug

SEQ ID NO: 3152471 - RNA, 17 nt, Mycobacterium bovis subsp bovis AF2122/97
cuugcgguaggcgguga

SEQ ID NO: 3152472 - RNA, 20 nt, Mycobacterium bovis subsp bovis AF2122/97
cuugcgguucggacacacag

SEQ ID NO: 3152473 - RNA, 23 nt, Mycobacterium bovis subsp bovis AF2122/97
cuugcuagcgcuauaggccgcau

SEQ ID NO: 3152474 - RNA, 14 nt, Mycobacterium bovis subsp bovis AF2122/97
cuugcucagccggc

SEQ ID NO: 3152475 - RNA, 15 nt, Mycobacterium bovis subsp bovis AF2122/97
cuugcucagccggcc

SEQ ID NO: 3152476 - RNA, 14 nt, Mycobacterium bovis subsp bovis AF2122/97
cuugcuccacaucg

SEQ ID NO: 3152477 - RNA, 16 nt, Mycobacterium bovis subsp bovis AF2122/97
cuugcucguccagguc

SEQ ID NO: 3152478 - RNA, 16 nt, Mycobacterium bovis subsp bovis AF2122/97
cuugcucucgcagcau

SEQ ID NO: 3152479 - RNA, 15 nt, Mycobacterium bovis subsp bovis AF2122/97
cuuggaaggcgcgcg

SEQ ID NO: 3152480 - RNA, 19 nt, Mycobacterium bovis subsp bovis AF2122/97
cuuggacaccaguaaugcc

SEQ ID NO: 3152481 - RNA, 12 nt, Mycobacterium bovis subsp bovis AF2122/97
cuuggaccagcg

SEQ ID NO: 3152482 - RNA, 15 nt, Mycobacterium bovis subsp bovis AF2122/97
cuuggacccugcgcc

SEQ ID NO: 3152483 - RNA, 18 nt, Mycobacterium bovis subsp bovis AF2122/97
cuuggacccugcgccgcc

SEQ ID NO: 3152484 - RNA, 15 nt, Mycobacterium bovis subsp bovis AF2122/97
cuuggacgacccggg

SEQ ID NO: 3152485 - RNA, 15 nt, Mycobacterium bovis subsp bovis AF2122/97
cuuggacucggcggg

SEQ ID NO: 3152486 - RNA, 19 nt, Mycobacterium bovis subsp bovis AF2122/97
cuuggacugucccaccagg

SEQ ID NO: 3152487 - RNA, 14 nt, Mycobacterium bovis subsp bovis AF2122/97
cuuggaucgguugg

SEQ ID NO: 3152488 - RNA, 21 nt, Mycobacterium bovis subsp bovis AF2122/97
cuuggaucgucgcuguggcuu

SEQ ID NO: 3152489 - RNA, 14 nt, Mycobacterium bovis subsp bovis AF2122/97
cuuggcaagccaag

SEQ ID NO: 3152490 - RNA, 13 nt, Mycobacterium bovis subsp bovis AF2122/97
cuuggcagcccag

SEQ ID NO: 3152491 - RNA, 18 nt, Mycobacterium bovis subsp bovis AF2122/97
cuuggcaggugccuucuu

SEQ ID NO: 3152492 - RNA, 22 nt, Mycobacterium bovis subsp bovis AF2122/97
cuuggcaggugccuucuucgcu

SEQ ID NO: 3152493 - RNA, 14 nt, Mycobacterium bovis subsp bovis AF2122/97
cuuguagcgcaucg

SEQ ID NO: 3152494 - RNA, 21 nt, Mycobacterium bovis subsp bovis AF2122/97
cuuguaucccucggggaacac

SEQ ID NO: 3152495 - RNA, 16 nt, Mycobacterium bovis subsp bovis AF2122/97
cuugucaaaggugcac

SEQ ID NO: 3152496 - RNA, 14 nt, Mycobacterium bovis subsp bovis AF2122/97
cuugucagccgcga

SEQ ID NO: 3152497 - RNA, 14 nt, Mycobacterium bovis subsp bovis AF2122/97
cuuguccaccgugc

SEQ ID NO: 3152498 - RNA, 14 nt, Mycobacterium bovis subsp bovis AF2122/97
cuuguccagggugg

SEQ ID NO: 3152499 - RNA, 24 nt, Mycobacterium bovis subsp bovis AF2122/97
cuuguccaucacauccacgcacuc

SEQ ID NO: 3152500 - RNA, 14 nt, Mycobacterium bovis subsp bovis AF2122/97
cuuguccggcccgu

SEQ ID NO: 3152501 - RNA, 17 nt, Mycobacterium bovis subsp bovis AF2122/97
cuuguccgggccccacg

SEQ ID NO: 3152502 - RNA, 22 nt, Mycobacterium bovis subsp bovis AF2122/97
cuuguccggugguggcgacccc

SEQ ID NO: 3152503 - RNA, 14 nt, Mycobacterium bovis subsp bovis AF2122/97
cuuguccuccgcgg

SEQ ID NO: 3152504 - RNA, 24 nt, Mycobacterium bovis subsp bovis AF2122/97
cuuguccuuauuggacugcagcgu

SEQ ID NO: 3152505 - RNA, 15 nt, Mycobacterium bovis subsp bovis AF2122/97
cuugucgaccccuga

SEQ ID NO: 3152506 - RNA, 21 nt, Mycobacterium bovis subsp bovis AF2122/97
cuugucgagcaccucgaaggc

SEQ ID NO: 3152507 - RNA, 20 nt, Mycobacterium bovis subsp bovis AF2122/97
cuugucgaggcgcaggucaa

SEQ ID NO: 3152508 - RNA, 14 nt, Mycobacterium bovis subsp bovis AF2122/97
cuugucgccggcau

SEQ ID NO: 3152509 - RNA, 21 nt, Mycobacterium bovis subsp bovis AF2122/97
cuugucggagcuagacccguc

SEQ ID NO: 3152510 - RNA, 17 nt, Mycobacterium bovis subsp bovis AF2122/97
cuugucggccccggccg

SEQ ID NO: 3152511 - RNA, 23 nt, Mycobacterium bovis subsp bovis AF2122/97
cuugucgggcaccgguuugacgu

SEQ ID NO: 3152512 - RNA, 19 nt, Mycobacterium bovis subsp bovis AF2122/97
cuugucggggugcacaccg

SEQ ID NO: 3152513 - RNA, 19 nt, Mycobacterium bovis subsp bovis AF2122/97
cuugugcagaucagcgucc

SEQ ID NO: 3152514 - RNA, 15 nt, Mycobacterium bovis subsp bovis AF2122/97
cuugugccccgagcu

SEQ ID NO: 3152515 - RNA, 22 nt, Mycobacterium bovis subsp bovis AF2122/97
cuugugcugcaaggaauuccgg

SEQ ID NO: 3152516 - RNA, 14 nt, Mycobacterium bovis subsp bovis AF2122/97
cuuguggaaaucgg

SEQ ID NO: 3152517 - RNA, 23 nt, Mycobacterium bovis subsp bovis AF2122/97
cuugugucaacaggaccuaucgc

SEQ ID NO: 3152518 - RNA, 20 nt, Mycobacterium bovis subsp bovis AF2122/97
cuuguuagccuccagauucg

SEQ ID NO: 3152519 - RNA, 16 nt, Mycobacterium bovis subsp bovis AF2122/97
cuuguucaucaucugg

SEQ ID NO: 3152520 - RNA, 17 nt, Mycobacterium bovis subsp bovis AF2122/97
cuuguuccagcgcaucg

SEQ ID NO: 3152521 - RNA, 19 nt, Mycobacterium bovis subsp bovis AF2122/97
cuuguucccgaaacccgau

SEQ ID NO: 3152522 - RNA, 15 nt, Mycobacterium bovis subsp bovis AF2122/97
cuuguugaagccgau

SEQ ID NO: 3152523 - RNA, 15 nt, Mycobacterium bovis subsp bovis AF2122/97
cuuguugaccaccac

SEQ ID NO: 3152524 - RNA, 18 nt, Mycobacterium bovis subsp bovis AF2122/97
cuuguugacgaacccacc

SEQ ID NO: 3152525 - RNA, 15 nt, Mycobacterium bovis subsp bovis AF2122/97
cuuguugccgcgcca

SEQ ID NO: 3152526 - RNA, 18 nt, Mycobacterium bovis subsp bovis AF2122/97
cuuguugcgcgacgccgc

SEQ ID NO: 3152527 - RNA, 24 nt, Mycobacterium bovis subsp bovis AF2122/97
cuuguuggcgaagucgucgagguc

SEQ ID NO: 3152528 - RNA, 15 nt, Mycobacterium bovis subsp bovis AF2122/97
cuuguugucgugcaa

SEQ ID NO: 3152529 - RNA, 13 nt, Mycobacterium bovis subsp bovis AF2122/97
cuuguuguggugg

SEQ ID NO: 3152530 - RNA, 14 nt, Mycobacterium bovis subsp bovis AF2122/97
cuuuaaaccccugg

SEQ ID NO: 3152531 - RNA, 19 nt, Mycobacterium bovis subsp bovis AF2122/97
cuuuaaaccgaacccaccc

SEQ ID NO: 3152532 - RNA, 20 nt, Mycobacterium bovis subsp bovis AF2122/97
cuuuacguacagggugguga

SEQ ID NO: 3152533 - RNA, 20 nt, Mycobacterium bovis subsp bovis AF2122/97
cuuucacaagccccgcgcgu

SEQ ID NO: 3152534 - RNA, 16 nt, Mycobacterium bovis subsp bovis AF2122/97
cuuucacaugcgccga

SEQ ID NO: 3152535 - RNA, 21 nt, Mycobacterium bovis subsp bovis AF2122/97
cuuucagaucgaucugcgggc

SEQ ID NO: 3152536 - RNA, 11 nt, Mycobacterium bovis subsp bovis AF2122/97
cuuucagcgcu

SEQ ID NO: 3152537 - RNA, 13 nt, Mycobacterium bovis subsp bovis AF2122/97
cuuucagcgcuuc

SEQ ID NO: 3152538 - RNA, 19 nt, Mycobacterium bovis subsp bovis AF2122/97
cuuuccaccugaacggcaa

SEQ ID NO: 3152539 - RNA, 14 nt, Mycobacterium bovis subsp bovis AF2122/97
cuuuccagaguucc

SEQ ID NO: 3152540 - RNA, 17 nt, Mycobacterium bovis subsp bovis AF2122/97
cuuucccggcuggggcc

SEQ ID NO: 3152541 - RNA, 22 nt, Mycobacterium bovis subsp bovis AF2122/97
cuuuccgcgaaucaacaggacc

SEQ ID NO: 3152542 - RNA, 16 nt, Mycobacterium bovis subsp bovis AF2122/97
cuuuccggccgccugc

SEQ ID NO: 3152543 - RNA, 19 nt, Mycobacterium bovis subsp bovis AF2122/97
cuuucgaauccccgcggcg

SEQ ID NO: 3152544 - RNA, 16 nt, Mycobacterium bovis subsp bovis AF2122/97
cuuucgacccgcggcg

SEQ ID NO: 3152545 - RNA, 14 nt, Mycobacterium bovis subsp bovis AF2122/97
cuuucgaugauggg

SEQ ID NO: 3152546 - RNA, 19 nt, Mycobacterium bovis subsp bovis AF2122/97
cuuucgcgugcggcugcca

SEQ ID NO: 3152547 - RNA, 19 nt, Mycobacterium bovis subsp bovis AF2122/97
cuuucggaaaaccgcaccg

SEQ ID NO: 3152548 - RNA, 22 nt, Mycobacterium bovis subsp bovis AF2122/97
cuuucggcagacccgagcgcuc

SEQ ID NO: 3152549 - RNA, 18 nt, Mycobacterium bovis subsp bovis AF2122/97
cuuucguauucggccgcg

SEQ ID NO: 3152550 - RNA, 17 nt, Mycobacterium bovis subsp bovis AF2122/97
cuuucugcgcgugggca

SEQ ID NO: 3152551 - RNA, 19 nt, Mycobacterium bovis subsp bovis AF2122/97
cuuucuuggcgggcgccuu

SEQ ID NO: 3152552 - RNA, 17 nt, Mycobacterium bovis subsp bovis AF2122/97
cuuugaauugcgcgccc

SEQ ID NO: 3152553 - RNA, 19 nt, Mycobacterium bovis subsp bovis AF2122/97
cuuugacaccggucggcag

SEQ ID NO: 3152554 - RNA, 20 nt, Mycobacterium bovis subsp bovis AF2122/97
cuuugacccguuccacgccg

SEQ ID NO: 3152555 - RNA, 19 nt, Mycobacterium bovis subsp bovis AF2122/97
cuuugacgcccucggcgac

SEQ ID NO: 3152556 - RNA, 14 nt, Mycobacterium bovis subsp bovis AF2122/97
cuuugagcgcggcc

SEQ ID NO: 3152557 - RNA, 22 nt, Mycobacterium bovis subsp bovis AF2122/97
cuuugagucguuggacggcacc

SEQ ID NO: 3152558 - RNA, 14 nt, Mycobacterium bovis subsp bovis AF2122/97
cuuugaucgcccgg

SEQ ID NO: 3152559 - RNA, 20 nt, Mycobacterium bovis subsp bovis AF2122/97
cuuugaucgcccgguucagc

SEQ ID NO: 3152560 - RNA, 20 nt, Mycobacterium bovis subsp bovis AF2122/97
cuuugaugccgaugucgaug

SEQ ID NO: 3152561 - RNA, 14 nt, Mycobacterium bovis subsp bovis AF2122/97
cuuugcacagcggc

SEQ ID NO: 3152562 - RNA, 15 nt, Mycobacterium bovis subsp bovis AF2122/97
cuuugcacagcggca

SEQ ID NO: 3152563 - RNA, 14 nt, Mycobacterium bovis subsp bovis AF2122/97
cuuugcccgccacg

SEQ ID NO: 3152564 - RNA, 14 nt, Mycobacterium bovis subsp bovis AF2122/97
cuuugcccgccgcg

SEQ ID NO: 3152565 - RNA, 18 nt, Mycobacterium bovis subsp bovis AF2122/97
cuuugcgguaagccggcg

SEQ ID NO: 3152566 - RNA, 15 nt, Mycobacterium bovis subsp bovis AF2122/97
cuuugcucucggucu

SEQ ID NO: 3152567 - RNA, 19 nt, Mycobacterium bovis subsp bovis AF2122/97
cuuugcucucggucugcau

SEQ ID NO: 3152568 - RNA, 21 nt, Mycobacterium bovis subsp bovis AF2122/97
cuuugcucucggucugcaugc

SEQ ID NO: 3152569 - RNA, 23 nt, Mycobacterium bovis subsp bovis AF2122/97
cuuuggacgaugaaccgggcagc

SEQ ID NO: 3152570 - RNA, 17 nt, Mycobacterium bovis subsp bovis AF2122/97
cuuuggccgcgaccggc

SEQ ID NO: 3152571 - RNA, 14 nt, Mycobacterium bovis subsp bovis AF2122/97
cuuuggcggccgca

SEQ ID NO: 3152572 - RNA, 14 nt, Mycobacterium bovis subsp bovis AF2122/97
cuuuggcggugaug

SEQ ID NO: 3152573 - RNA, 22 nt, Mycobacterium bovis subsp bovis AF2122/97
cuuuggcggugaugguggcaac

SEQ ID NO: 3152574 - RNA, 19 nt, Mycobacterium bovis subsp bovis AF2122/97
cuuuggguagcaaaccccg

SEQ ID NO: 3152575 - RNA, 23 nt, Mycobacterium bovis subsp bovis AF2122/97
cuuuggucgccggaccagagcca

SEQ ID NO: 3152576 - RNA, 13 nt, Mycobacterium bovis subsp bovis AF2122/97
cuuuggugucgcu

SEQ ID NO: 3152577 - RNA, 21 nt, Mycobacterium bovis subsp bovis AF2122/97
cuuugguugcccgcauugcca

SEQ ID NO: 3152578 - RNA, 22 nt, Mycobacterium bovis subsp bovis AF2122/97
cuuugguuguuggugccagccg

SEQ ID NO: 3152579 - RNA, 13 nt, Mycobacterium bovis subsp bovis AF2122/97
gaaacucgacgug

SEQ ID NO: 3152580 - RNA, 17 nt, Mycobacterium bovis subsp bovis AF2122/97
gaaacugaugucgccga

SEQ ID NO: 3152581 - RNA, 22 nt, Mycobacterium bovis subsp bovis AF2122/97
gaaacugcucggauccggccag

SEQ ID NO: 3152582 - RNA, 22 nt, Mycobacterium bovis subsp bovis AF2122/97
gaaacuggggguuguucaacuc

SEQ ID NO: 3152583 - RNA, 16 nt, Mycobacterium bovis subsp bovis AF2122/97
gaaagacgcuguccag

SEQ ID NO: 3152584 - RNA, 17 nt, Mycobacterium bovis subsp bovis AF2122/97
gaaagcaccgaugcuga

SEQ ID NO: 3152585 - RNA, 15 nt, Mycobacterium bovis subsp bovis AF2122/97
gaaagcagcagcggc

SEQ ID NO: 3152586 - RNA, 21 nt, Mycobacterium bovis subsp bovis AF2122/97
gaaagccgcagccgcaggcca

SEQ ID NO: 3152587 - RNA, 14 nt, Mycobacterium bovis subsp bovis AF2122/97
gaaagccggcguuu

SEQ ID NO: 3152588 - RNA, 23 nt, Mycobacterium bovis subsp bovis AF2122/97
gaaagccuaguccuggcucggca

SEQ ID NO: 3152589 - RNA, 17 nt, Mycobacterium bovis subsp bovis AF2122/97
gaaagcgccgaaacagc

SEQ ID NO: 3152590 - RNA, 21 nt, Mycobacterium bovis subsp bovis AF2122/97
gaaagcgccgaaacagcaccc

SEQ ID NO: 3152591 - RNA, 17 nt, Mycobacterium bovis subsp bovis AF2122/97
gaaagcgucgagcugau

SEQ ID NO: 3152592 - RNA, 22 nt, Mycobacterium bovis subsp bovis AF2122/97
gaaagcgucgaucaccugccag

SEQ ID NO: 3152593 - RNA, 16 nt, Mycobacterium bovis subsp bovis AF2122/97
gaaagcuaccgaucgc

SEQ ID NO: 3152594 - RNA, 13 nt, Mycobacterium bovis subsp bovis AF2122/97
gaaaggcuuccgc

SEQ ID NO: 3152595 - RNA, 21 nt, Mycobacterium bovis subsp bovis AF2122/97
gaaaggucucuucggagauac

SEQ ID NO: 3152596 - RNA, 17 nt, Mycobacterium bovis subsp bovis AF2122/97
gaaaguagcgugcgaca

SEQ ID NO: 3152597 - RNA, 18 nt, Mycobacterium bovis subsp bovis AF2122/97
gaaagucgcgcgcgaaca

SEQ ID NO: 3152598 - RNA, 22 nt, Mycobacterium bovis subsp bovis AF2122/97
gaaaguguggaauggaccagcg

SEQ ID NO: 3152599 - RNA, 16 nt, Mycobacterium bovis subsp bovis AF2122/97
gaaaguuguaucgcag

SEQ ID NO: 3152600 - RNA, 19 nt, Mycobacterium bovis subsp bovis AF2122/97
gaaauaacggagcggccua

SEQ ID NO: 3152601 - RNA, 20 nt, Mycobacterium bovis subsp bovis AF2122/97
gaaauacccagcgcagcagc

SEQ ID NO: 3152602 - RNA, 19 nt, Mycobacterium bovis subsp bovis AF2122/97
gaaauagauucccggcucg

SEQ ID NO: 3152603 - RNA, 23 nt, Mycobacterium bovis subsp bovis AF2122/97
gaaauagauucccggcucgaugg

SEQ ID NO: 3152604 - RNA, 15 nt, Mycobacterium bovis subsp bovis AF2122/97
gaaaucaccucacca

SEQ ID NO: 3152605 - RNA, 16 nt, Mycobacterium bovis subsp bovis AF2122/97
gaaaucaccucaccag

SEQ ID NO: 3152606 - RNA, 21 nt, Mycobacterium bovis subsp bovis AF2122/97
gaaauccagauaauccuggua

SEQ ID NO: 3152607 - RNA, 18 nt, Mycobacterium bovis subsp bovis AF2122/97
gaaauccccugcgcugca

SEQ ID NO: 3152608 - RNA, 21 nt, Mycobacterium bovis subsp bovis AF2122/97
gaaauccccugcgcugcagcu

SEQ ID NO: 3152609 - RNA, 16 nt, Mycobacterium bovis subsp bovis AF2122/97
gaaauccgagccgcga

SEQ ID NO: 3152610 - RNA, 16 nt, Mycobacterium bovis subsp bovis AF2122/97
gaaauccuccuccgca

SEQ ID NO: 3152611 - RNA, 17 nt, Mycobacterium bovis subsp bovis AF2122/97
gaaaucgcacagcgcga

SEQ ID NO: 3152612 - RNA, 19 nt, Mycobacterium bovis subsp bovis AF2122/97
gaaaucgcccugacccgga

SEQ ID NO: 3152613 - RNA, 14 nt, Mycobacterium bovis subsp bovis AF2122/97
gaaaucggccagcu

SEQ ID NO: 3152614 - RNA, 14 nt, Mycobacterium bovis subsp bovis AF2122/97
gaaaucggcggcgu

SEQ ID NO: 3152615 - RNA, 22 nt, Mycobacterium bovis subsp bovis AF2122/97
gaaaucgggaucugcgccgcgc

SEQ ID NO: 3152616 - RNA, 17 nt, Mycobacterium bovis subsp bovis AF2122/97
gaaaucggugcacaacg

SEQ ID NO: 3152617 - RNA, 19 nt, Mycobacterium bovis subsp bovis AF2122/97
gaaaucgguggccaccacc

SEQ ID NO: 3152618 - RNA, 21 nt, Mycobacterium bovis subsp bovis AF2122/97
gaaaucgucggguaccagcac

SEQ ID NO: 3152619 - RNA, 14 nt, Mycobacterium bovis subsp bovis AF2122/97
gaaaugacggcuga

SEQ ID NO: 3152620 - RNA, 15 nt, Mycobacterium bovis subsp bovis AF2122/97
gaaaugccggugccg

SEQ ID NO: 3152621 - RNA, 14 nt, Mycobacterium bovis subsp bovis AF2122/97
gaaaugccugcgcg

SEQ ID NO: 3152622 - RNA, 18 nt, Mycobacterium bovis subsp bovis AF2122/97
gaaauggauugcggcacg

SEQ ID NO: 3152623 - RNA, 14 nt, Mycobacterium bovis subsp bovis AF2122/97
gaaauuccggcgcg

SEQ ID NO: 3152624 - RNA, 16 nt, Mycobacterium bovis subsp bovis AF2122/97
gaaauuccgggccugg

SEQ ID NO: 3152625 - RNA, 18 nt, Mycobacterium bovis subsp bovis AF2122/97
gaaauuccgggccuggcc

SEQ ID NO: 3152626 - RNA, 15 nt, Mycobacterium bovis subsp bovis AF2122/97
gaaauucgcggcggu

SEQ ID NO: 3152627 - RNA, 13 nt, Mycobacterium bovis subsp bovis AF2122/97
gaaauugagccgg

SEQ ID NO: 3152628 - RNA, 18 nt, Mycobacterium bovis subsp bovis AF2122/97
gaaauugaugaucugcag

SEQ ID NO: 3152629 - RNA, 18 nt, Mycobacterium bovis subsp bovis AF2122/97
gaaauugcccuagcagca

SEQ ID NO: 3152630 - RNA, 14 nt, Mycobacterium bovis subsp bovis AF2122/97
gaaauugccgccgc

SEQ ID NO: 3152631 - RNA, 15 nt, Mycobacterium bovis subsp bovis AF2122/97
gaacaaccugccggu

SEQ ID NO: 3152632 - RNA, 22 nt, Mycobacterium bovis subsp bovis AF2122/97
gaacaacgcggacuucguuccg

SEQ ID NO: 3152633 - RNA, 22 nt, Mycobacterium bovis subsp bovis AF2122/97
gaacaacggcgcggcaagggcu

SEQ ID NO: 3152634 - RNA, 14 nt, Mycobacterium bovis subsp bovis AF2122/97
gaacaagaaaagca

SEQ ID NO: 3152635 - RNA, 21 nt, Mycobacterium bovis subsp bovis AF2122/97
gaacaagguauggccggagcg

SEQ ID NO: 3152636 - RNA, 15 nt, Mycobacterium bovis subsp bovis AF2122/97
gaacaauucacgcac

SEQ ID NO: 3152637 - RNA, 20 nt, Mycobacterium bovis subsp bovis AF2122/97
gaacaauuucugcagcccau

SEQ ID NO: 3152638 - RNA, 12 nt, Mycobacterium bovis subsp bovis AF2122/97
gaacacaccgca

SEQ ID NO: 3152639 - RNA, 22 nt, Mycobacterium bovis subsp bovis AF2122/97
gaacacaccgggcgggcuggug

SEQ ID NO: 3152640 - RNA, 21 nt, Mycobacterium bovis subsp bovis AF2122/97
gaacacauccgcuugcggggc

SEQ ID NO: 3152641 - RNA, 13 nt, Mycobacterium bovis subsp bovis AF2122/97
gaacaccacaccg

SEQ ID NO: 3152642 - RNA, 15 nt, Mycobacterium bovis subsp bovis AF2122/97
gaacaccacaccgag

SEQ ID NO: 3152643 - RNA, 23 nt, Mycobacterium bovis subsp bovis AF2122/97
gaacaccacaccgagcaccugac

SEQ ID NO: 3152644 - RNA, 14 nt, Mycobacterium bovis subsp bovis AF2122/97
gaacaccaccaggc

SEQ ID NO: 3152645 - RNA, 16 nt, Mycobacterium bovis subsp bovis AF2122/97
gaacaccaccgccaga

SEQ ID NO: 3152646 - RNA, 14 nt, Mycobacterium bovis subsp bovis AF2122/97
gaacaccacgcagu

SEQ ID NO: 3152647 - RNA, 18 nt, Mycobacterium bovis subsp bovis AF2122/97
gaacaccagauggcucuc

SEQ ID NO: 3152648 - RNA, 13 nt, Mycobacterium bovis subsp bovis AF2122/97
gaacaccagcgcg

SEQ ID NO: 3152649 - RNA, 19 nt, Mycobacterium bovis subsp bovis AF2122/97
gaacacccgaagccggcgc

SEQ ID NO: 3152650 - RNA, 17 nt, Mycobacterium bovis subsp bovis AF2122/97
gaacaccgaggcgaccg

SEQ ID NO: 3152651 - RNA, 15 nt, Mycobacterium bovis subsp bovis AF2122/97
gaacaccgcccggcc

SEQ ID NO: 3152652 - RNA, 13 nt, Mycobacterium bovis subsp bovis AF2122/97
gaacaccgcggca

SEQ ID NO: 3152653 - RNA, 23 nt, Mycobacterium bovis subsp bovis AF2122/97
gaacaccggccaacagucgcagc

SEQ ID NO: 3152654 - RNA, 23 nt, Mycobacterium bovis subsp bovis AF2122/97
gaacaccggccaggccggcggcg

SEQ ID NO: 3152655 - RNA, 19 nt, Mycobacterium bovis subsp bovis AF2122/97
gaacaccggcgccucaucg

SEQ ID NO: 3152656 - RNA, 13 nt, Mycobacterium bovis subsp bovis AF2122/97
gaacaccucggca

SEQ ID NO: 3152657 - RNA, 14 nt, Mycobacterium bovis subsp bovis AF2122/97
gaacaccucggcac

SEQ ID NO: 3152658 - RNA, 17 nt, Mycobacterium bovis subsp bovis AF2122/97
gaacaccuugggcagcu

SEQ ID NO: 3152659 - RNA, 17 nt, Mycobacterium bovis subsp bovis AF2122/97
gaacacgaugcgcggug

SEQ ID NO: 3152660 - RNA, 23 nt, Mycobacterium bovis subsp bovis AF2122/97
gaacacggccggauacggcgaca

SEQ ID NO: 3152661 - RNA, 13 nt, Mycobacterium bovis subsp bovis AF2122/97
gaacacggcgucu

SEQ ID NO: 3152662 - RNA, 13 nt, Mycobacterium bovis subsp bovis AF2122/97
gaacacgucggcc

SEQ ID NO: 3152663 - RNA, 21 nt, Mycobacterium bovis subsp bovis AF2122/97
gaacacgugauagcuugcguc

SEQ ID NO: 3152664 - RNA, 20 nt, Mycobacterium bovis subsp bovis AF2122/97
gaacacguuauucaugccca

SEQ ID NO: 3152665 - RNA, 16 nt, Mycobacterium bovis subsp bovis AF2122/97
gaaccccgagcugcca

SEQ ID NO: 3152666 - RNA, 16 nt, Mycobacterium bovis subsp bovis AF2122/97
gaacccgagccgccgu

SEQ ID NO: 3152667 - RNA, 21 nt, Mycobacterium bovis subsp bovis AF2122/97
gaacccgauaacaaggccgcc

SEQ ID NO: 3152668 - RNA, 23 nt, Mycobacterium bovis subsp bovis AF2122/97
gaacccgauaacaaggccgccgc

SEQ ID NO: 3152669 - RNA, 18 nt, Mycobacterium bovis subsp bovis AF2122/97
gaacccgaucgucgagcc

SEQ ID NO: 3152670 - RNA, 19 nt, Mycobacterium bovis subsp bovis AF2122/97
gaacccgaucgucgagccg

SEQ ID NO: 3152671 - RNA, 12 nt, Mycobacterium bovis subsp bovis AF2122/97
gaacccgccacc

SEQ ID NO: 3152672 - RNA, 21 nt, Mycobacterium bovis subsp bovis AF2122/97
gaacccgccgaugcugccgcc

SEQ ID NO: 3152673 - RNA, 13 nt, Mycobacterium bovis subsp bovis AF2122/97
gaacccgccggca

SEQ ID NO: 3152674 - RNA, 22 nt, Mycobacterium bovis subsp bovis AF2122/97
gaacccgcgagguugaccacca

SEQ ID NO: 3152675 - RNA, 20 nt, Mycobacterium bovis subsp bovis AF2122/97
gaacccgcguugaaggcgcc

SEQ ID NO: 3152676 - RNA, 17 nt, Mycobacterium bovis subsp bovis AF2122/97
gaacccggcggacgacg

SEQ ID NO: 3152677 - RNA, 16 nt, Mycobacterium bovis subsp bovis AF2122/97
gaacccguguucugcg

SEQ ID NO: 3152678 - RNA, 17 nt, Mycobacterium bovis subsp bovis AF2122/97
gaacccucagccgcgcc

SEQ ID NO: 3152679 - RNA, 14 nt, Mycobacterium bovis subsp bovis AF2122/97
gaacccuccgcagc

SEQ ID NO: 3152680 - RNA, 15 nt, Mycobacterium bovis subsp bovis AF2122/97
gaacccuccgcagcu

SEQ ID NO: 3152681 - RNA, 16 nt, Mycobacterium bovis subsp bovis AF2122/97
gaaccgaagccgucga

SEQ ID NO: 3152682 - RNA, 16 nt, Mycobacterium bovis subsp bovis AF2122/97
gaaccgacaccugucg

SEQ ID NO: 3152683 - RNA, 17 nt, Mycobacterium bovis subsp bovis AF2122/97
gaaccgacccggccgcu

SEQ ID NO: 3152684 - RNA, 20 nt, Mycobacterium bovis subsp bovis AF2122/97
gaaccgacccggccgcugac

SEQ ID NO: 3152685 - RNA, 18 nt, Mycobacterium bovis subsp bovis AF2122/97
gaaccgcacggugaccac

SEQ ID NO: 3152686 - RNA, 17 nt, Mycobacterium bovis subsp bovis AF2122/97
gaaccgcagucaacgca

SEQ ID NO: 3152687 - RNA, 11 nt, Mycobacterium bovis subsp bovis AF2122/97
gaaccgcccgc

SEQ ID NO: 3152688 - RNA, 13 nt, Mycobacterium bovis subsp bovis AF2122/97
gaaccgccgacgg

SEQ ID NO: 3152689 - RNA, 13 nt, Mycobacterium bovis subsp bovis AF2122/97
gaaccgccgccgc

SEQ ID NO: 3152690 - RNA, 20 nt, Mycobacterium bovis subsp bovis AF2122/97
gaaccgccgcugccgcgcgg

SEQ ID NO: 3152691 - RNA, 23 nt, Mycobacterium bovis subsp bovis AF2122/97
gaaccgccgcugccgcgcggcga

SEQ ID NO: 3152692 - RNA, 15 nt, Mycobacterium bovis subsp bovis AF2122/97
gaaccgccggcaccg

SEQ ID NO: 3152693 - RNA, 13 nt, Mycobacterium bovis subsp bovis AF2122/97
gaaccgccggcug

SEQ ID NO: 3152694 - RNA, 19 nt, Mycobacterium bovis subsp bovis AF2122/97
gaaccgccggcugcgccag

SEQ ID NO: 3152695 - RNA, 13 nt, Mycobacterium bovis subsp bovis AF2122/97
gaaccgcgcggcg

SEQ ID NO: 3152696 - RNA, 14 nt, Mycobacterium bovis subsp bovis AF2122/97
gaaccgcggaucga

SEQ ID NO: 3152697 - RNA, 20 nt, Mycobacterium bovis subsp bovis AF2122/97
gaaccgcguuaugccaggcg

SEQ ID NO: 3152698 - RNA, 16 nt, Mycobacterium bovis subsp bovis AF2122/97
gaaccgcucagcgcag

SEQ ID NO: 3152699 - RNA, 18 nt, Mycobacterium bovis subsp bovis AF2122/97
gaaccgcucagcgcagca

SEQ ID NO: 3152700 - RNA, 13 nt, Mycobacterium bovis subsp bovis AF2122/97
gaaccgcucguca

SEQ ID NO: 3152701 - RNA, 18 nt, Mycobacterium bovis subsp bovis AF2122/97
gaaccggaucaucgccgc

SEQ ID NO: 3152702 - RNA, 18 nt, Mycobacterium bovis subsp bovis AF2122/97
gaaccggcaccagcggca

SEQ ID NO: 3152703 - RNA, 21 nt, Mycobacterium bovis subsp bovis AF2122/97
gaaccggcaccagcggcaccg

SEQ ID NO: 3152704 - RNA, 13 nt, Mycobacterium bovis subsp bovis AF2122/97
gaaccggccgacg

SEQ ID NO: 3152705 - RNA, 19 nt, Mycobacterium bovis subsp bovis AF2122/97
gaaccggccgacgaacagc

SEQ ID NO: 3152706 - RNA, 13 nt, Mycobacterium bovis subsp bovis AF2122/97
gaaccggccgcga

SEQ ID NO: 3152707 - RNA, 16 nt, Mycobacterium bovis subsp bovis AF2122/97
gaaccggccgcgacga

SEQ ID NO: 3152708 - RNA, 22 nt, Mycobacterium bovis subsp bovis AF2122/97
gaaccggccgcgacgacacgcc

SEQ ID NO: 3152709 - RNA, 14 nt, Mycobacterium bovis subsp bovis AF2122/97
gaaccggccgucga

SEQ ID NO: 3152710 - RNA, 18 nt, Mycobacterium bovis subsp bovis AF2122/97
gaaccggcgugcagcacu

SEQ ID NO: 3152711 - RNA, 22 nt, Mycobacterium bovis subsp bovis AF2122/97
gaaccggcucaaggacgcaccg

SEQ ID NO: 3152712 - RNA, 23 nt, Mycobacterium bovis subsp bovis AF2122/97
gaaccggcucaaggacgcaccgc

SEQ ID NO: 3152713 - RNA, 20 nt, Mycobacterium bovis subsp bovis AF2122/97
gaaccggcugggcgccacca

SEQ ID NO: 3152714 - RNA, 14 nt, Mycobacterium bovis subsp bovis AF2122/97
gaaccgggacacca

SEQ ID NO: 3152715 - RNA, 15 nt, Mycobacterium bovis subsp bovis AF2122/97
gaaccgggcaccacu

SEQ ID NO: 3152716 - RNA, 23 nt, Mycobacterium bovis subsp bovis AF2122/97
gaaccgggucacuccggcggcuu

SEQ ID NO: 3152717 - RNA, 16 nt, Mycobacterium bovis subsp bovis AF2122/97
gaaccgguaucgccaa

SEQ ID NO: 3152718 - RNA, 15 nt, Mycobacterium bovis subsp bovis AF2122/97
gaaccggucgauccc

SEQ ID NO: 3152719 - RNA, 14 nt, Mycobacterium bovis subsp bovis AF2122/97
gaaccgguugacac

SEQ ID NO: 3152720 - RNA, 15 nt, Mycobacterium bovis subsp bovis AF2122/97
gaaccgucagcggca

SEQ ID NO: 3152721 - RNA, 18 nt, Mycobacterium bovis subsp bovis AF2122/97
gaaccgucucgcccccuc

SEQ ID NO: 3152722 - RNA, 16 nt, Mycobacterium bovis subsp bovis AF2122/97
gaaccgucucggcgac

SEQ ID NO: 3152723 - RNA, 17 nt, Mycobacterium bovis subsp bovis AF2122/97
gaaccgucucggcgacc

SEQ ID NO: 3152724 - RNA, 18 nt, Mycobacterium bovis subsp bovis AF2122/97
gaaccgucucggcgaccg

SEQ ID NO: 3152725 - RNA, 15 nt, Mycobacterium bovis subsp bovis AF2122/97
gaaccguucgaccca

SEQ ID NO: 3152726 - RNA, 17 nt, Mycobacterium bovis subsp bovis AF2122/97
gaaccguucgacccagc

SEQ ID NO: 3152727 - RNA, 18 nt, Mycobacterium bovis subsp bovis AF2122/97
gaaccguucgacccagcg

SEQ ID NO: 3152728 - RNA, 21 nt, Mycobacterium bovis subsp bovis AF2122/97
gaaccguucggcgacagcgcg

SEQ ID NO: 3152729 - RNA, 22 nt, Mycobacterium bovis subsp bovis AF2122/97
gaaccguucggcgacagcgcgg

SEQ ID NO: 3152730 - RNA, 23 nt, Mycobacterium bovis subsp bovis AF2122/97
gaaccguucggcgacagcgcggc

SEQ ID NO: 3152731 - RNA, 21 nt, Mycobacterium bovis subsp bovis AF2122/97
gaaccguuugacgcgcucgcg

SEQ ID NO: 3152732 - RNA, 19 nt, Mycobacterium bovis subsp bovis AF2122/97
gaaccucaccugacacgcc

SEQ ID NO: 3152733 - RNA, 22 nt, Mycobacterium bovis subsp bovis AF2122/97
gaaccuccucggguucgucagu

SEQ ID NO: 3152734 - RNA, 17 nt, Mycobacterium bovis subsp bovis AF2122/97
gaaccucgaccgucacc

SEQ ID NO: 3152735 - RNA, 12 nt, Mycobacterium bovis subsp bovis AF2122/97
gaaccucggcgg

SEQ ID NO: 3152736 - RNA, 18 nt, Mycobacterium bovis subsp bovis AF2122/97
gaaccuggcgacgcgaca

SEQ ID NO: 3152737 - RNA, 23 nt, Mycobacterium bovis subsp bovis AF2122/97
gaaccugucgaucacggccgucg

SEQ ID NO: 3152738 - RNA, 20 nt, Mycobacterium bovis subsp bovis AF2122/97
gaacgaaagucuccggaacc

SEQ ID NO: 3152739 - RNA, 23 nt, Mycobacterium bovis subsp bovis AF2122/97
gaacgacagcagaaucucggguc

SEQ ID NO: 3152740 - RNA, 14 nt, Mycobacterium bovis subsp bovis AF2122/97
gaacgacauccggc

SEQ ID NO: 3152741 - RNA, 11 nt, Mycobacterium bovis subsp bovis AF2122/97
gaacgaccucu

SEQ ID NO: 3152742 - RNA, 12 nt, Mycobacterium bovis subsp bovis AF2122/97
gaacgacgccac

SEQ ID NO: 3152743 - RNA, 23 nt, Mycobacterium bovis subsp bovis AF2122/97
gaacgacgcuuucccgaugacga

SEQ ID NO: 3152744 - RNA, 14 nt, Mycobacterium bovis subsp bovis AF2122/97
gaacgacucgacgu

SEQ ID NO: 3152745 - RNA, 17 nt, Mycobacterium bovis subsp bovis AF2122/97
gaacgaguacgggcagg

SEQ ID NO: 3152746 - RNA, 23 nt, Mycobacterium bovis subsp bovis AF2122/97
gaacgaguagccggucggcacca

SEQ ID NO: 3152747 - RNA, 22 nt, Mycobacterium bovis subsp bovis AF2122/97
gaacgaucccgccgaucgaacc

SEQ ID NO: 3152748 - RNA, 19 nt, Mycobacterium bovis subsp bovis AF2122/97
gaacgaucggaccaccagg

SEQ ID NO: 3152749 - RNA, 16 nt, Mycobacterium bovis subsp bovis AF2122/97
gaacgaugccgccggc

SEQ ID NO: 3152750 - RNA, 18 nt, Mycobacterium bovis subsp bovis AF2122/97
gaacgauguccgcgcgaa

SEQ ID NO: 3152751 - RNA, 20 nt, Mycobacterium bovis subsp bovis AF2122/97
gaacgguucggccggggcga

SEQ ID NO: 3152752 - RNA, 14 nt, Mycobacterium bovis subsp bovis AF2122/97
gaacguagcgccca

SEQ ID NO: 3152753 - RNA, 20 nt, Mycobacterium bovis subsp bovis AF2122/97
gaacgucauacccagcucgu

SEQ ID NO: 3152754 - RNA, 22 nt, Mycobacterium bovis subsp bovis AF2122/97
gaacgucauacccagcucgucg

SEQ ID NO: 3152755 - RNA, 17 nt, Mycobacterium bovis subsp bovis AF2122/97
gaacguccagccguggc

SEQ ID NO: 3152756 - RNA, 12 nt, Mycobacterium bovis subsp bovis AF2122/97
gaacguccgcgc

SEQ ID NO: 3152757 - RNA, 13 nt, Mycobacterium bovis subsp bovis AF2122/97
gaacguccgcgcc

SEQ ID NO: 3152758 - RNA, 16 nt, Mycobacterium bovis subsp bovis AF2122/97
gaacgucgcggccagc

SEQ ID NO: 3152759 - RNA, 17 nt, Mycobacterium bovis subsp bovis AF2122/97
gaacgucgcggccagca

SEQ ID NO: 3152760 - RNA, 19 nt, Mycobacterium bovis subsp bovis AF2122/97
gaacgugaacucacggcgg

SEQ ID NO: 3152761 - RNA, 20 nt, Mycobacterium bovis subsp bovis AF2122/97
gaacgugaacugagggcgga

SEQ ID NO: 3152762 - RNA, 16 nt, Mycobacterium bovis subsp bovis AF2122/97
gaacgugaccgacgcc

SEQ ID NO: 3152763 - RNA, 14 nt, Mycobacterium bovis subsp bovis AF2122/97
gaacgugacggucc

SEQ ID NO: 3152764 - RNA, 18 nt, Mycobacterium bovis subsp bovis AF2122/97
gaacgugcaaccacggcg

SEQ ID NO: 3152765 - RNA, 19 nt, Mycobacterium bovis subsp bovis AF2122/97
gaacgugcaaccacggcgg

SEQ ID NO: 3152766 - RNA, 20 nt, Mycobacterium bovis subsp bovis AF2122/97
gaacgugcaaccacggcggc

SEQ ID NO: 3152767 - RNA, 20 nt, Mycobacterium bovis subsp bovis AF2122/97
gaacgugccuuccucgccgg

SEQ ID NO: 3152768 - RNA, 22 nt, Mycobacterium bovis subsp bovis AF2122/97
gaacgugccuuccucgccggaa

SEQ ID NO: 3152769 - RNA, 14 nt, Mycobacterium bovis subsp bovis AF2122/97
gaacgugcgguggc

SEQ ID NO: 3152770 - RNA, 15 nt, Mycobacterium bovis subsp bovis AF2122/97
gaacguggcucggcg

SEQ ID NO: 3152771 - RNA, 16 nt, Mycobacterium bovis subsp bovis AF2122/97
gaacguggcucggcgg

SEQ ID NO: 3152772 - RNA, 14 nt, Mycobacterium bovis subsp bovis AF2122/97
gaacgugucgggug

SEQ ID NO: 3152773 - RNA, 16 nt, Mycobacterium bovis subsp bovis AF2122/97
gaacguucacgccagu

SEQ ID NO: 3152774 - RNA, 24 nt, Mycobacterium bovis subsp bovis AF2122/97
gaacguucuuaaacgggcucuucg

SEQ ID NO: 3152775 - RNA, 22 nt, Mycobacterium bovis subsp bovis AF2122/97
gaacguuuucgucaccccacca

SEQ ID NO: 3152776 - RNA, 17 nt, Mycobacterium bovis subsp bovis AF2122/97
gaacuacccgccagcaa

SEQ ID NO: 3152777 - RNA, 17 nt, Mycobacterium bovis subsp bovis AF2122/97
gaacuacugcgaucgcg

SEQ ID NO: 3152778 - RNA, 21 nt, Mycobacterium bovis subsp bovis AF2122/97
gaacuacugcgaucgcgagcg

SEQ ID NO: 3152779 - RNA, 22 nt, Mycobacterium bovis subsp bovis AF2122/97
gaacuagaucgucgucaacccg

SEQ ID NO: 3152780 - RNA, 16 nt, Mycobacterium bovis subsp bovis AF2122/97
gaacucaacaccagca

SEQ ID NO: 3152781 - RNA, 22 nt, Mycobacterium bovis subsp bovis AF2122/97
gaacucaauaguguguuuggug

SEQ ID NO: 3152782 - RNA, 15 nt, Mycobacterium bovis subsp bovis AF2122/97
gaacucaccgacgga

SEQ ID NO: 3152783 - RNA, 13 nt, Mycobacterium bovis subsp bovis AF2122/97
gaacuccagcagc

SEQ ID NO: 3152784 - RNA, 14 nt, Mycobacterium bovis subsp bovis AF2122/97
gaacuccagcagcc

SEQ ID NO: 3152785 - RNA, 17 nt, Mycobacterium bovis subsp bovis AF2122/97
gaacuccaucaccacac

SEQ ID NO: 3152786 - RNA, 18 nt, Mycobacterium bovis subsp bovis AF2122/97
gaacuccccggucgccgc

SEQ ID NO: 3152787 - RNA, 19 nt, Mycobacterium bovis subsp bovis AF2122/97
gaacuccccggucgccgcg

SEQ ID NO: 3152788 - RNA, 19 nt, Mycobacterium bovis subsp bovis AF2122/97
gaacuccgccgcgaucucc

SEQ ID NO: 3152789 - RNA, 15 nt, Mycobacterium bovis subsp bovis AF2122/97
gaacuccgcgauccg

SEQ ID NO: 3152790 - RNA, 20 nt, Mycobacterium bovis subsp bovis AF2122/97
gaacuccgcgauccgcugcg

SEQ ID NO: 3152791 - RNA, 17 nt, Mycobacterium bovis subsp bovis AF2122/97
gaacuccgcggaaccca

SEQ ID NO: 3152792 - RNA, 18 nt, Mycobacterium bovis subsp bovis AF2122/97
gaacuccgcggaacccag

SEQ ID NO: 3152793 - RNA, 18 nt, Mycobacterium bovis subsp bovis AF2122/97
gaacuccgggaccaggcc

SEQ ID NO: 3152794 - RNA, 23 nt, Mycobacterium bovis subsp bovis AF2122/97
gaacuccucgcugucgaucagcg

SEQ ID NO: 3152795 - RNA, 23 nt, Mycobacterium bovis subsp bovis AF2122/97
gaacuccuuaucgucgacgccga

SEQ ID NO: 3152796 - RNA, 15 nt, Mycobacterium bovis subsp bovis AF2122/97
gaacucgaccaccgc

SEQ ID NO: 3152797 - RNA, 16 nt, Mycobacterium bovis subsp bovis AF2122/97
gaacucgaccaccgcc

SEQ ID NO: 3152798 - RNA, 23 nt, Mycobacterium bovis subsp bovis AF2122/97
gaacucgaccaccgccggcccgc

SEQ ID NO: 3152799 - RNA, 18 nt, Mycobacterium bovis subsp bovis AF2122/97
gaacucgcgccgagccag

SEQ ID NO: 3152800 - RNA, 19 nt, Mycobacterium bovis subsp bovis AF2122/97
gaacucgcgcgucgucgcg

SEQ ID NO: 3152801 - RNA, 19 nt, Mycobacterium bovis subsp bovis AF2122/97
gaacucgcgggcgaccacc

SEQ ID NO: 3152802 - RNA, 22 nt, Mycobacterium bovis subsp bovis AF2122/97
gaacucgcgggcgaccaccgcg

SEQ ID NO: 3152803 - RNA, 17 nt, Mycobacterium bovis subsp bovis AF2122/97
gaacucgcguaucccgu

SEQ ID NO: 3152804 - RNA, 16 nt, Mycobacterium bovis subsp bovis AF2122/97
gaacucggacccaccc

SEQ ID NO: 3152805 - RNA, 14 nt, Mycobacterium bovis subsp bovis AF2122/97
gaacucggccgggc

SEQ ID NO: 3152806 - RNA, 16 nt, Mycobacterium bovis subsp bovis AF2122/97
gaacucggcgaucucg

SEQ ID NO: 3152807 - RNA, 13 nt, Mycobacterium bovis subsp bovis AF2122/97
gaacucggcgucg

SEQ ID NO: 3152808 - RNA, 17 nt, Mycobacterium bovis subsp bovis AF2122/97
gaacucgggcaaugucg

SEQ ID NO: 3152809 - RNA, 23 nt, Mycobacterium bovis subsp bovis AF2122/97
gaacucgggcaaugucgacaccg

SEQ ID NO: 3152810 - RNA, 17 nt, Mycobacterium bovis subsp bovis AF2122/97
gaacucggugcccccac

SEQ ID NO: 3152811 - RNA, 15 nt, Mycobacterium bovis subsp bovis AF2122/97
gaacucgucgcugcc

SEQ ID NO: 3152812 - RNA, 20 nt, Mycobacterium bovis subsp bovis AF2122/97
gaacucguugagcagcugga

SEQ ID NO: 3152813 - RNA, 20 nt, Mycobacterium bovis subsp bovis AF2122/97
gaacucuggauucuucagcg

SEQ ID NO: 3152814 - RNA, 17 nt, Mycobacterium bovis subsp bovis AF2122/97
gaacucuggugacggug

SEQ ID NO: 3152815 - RNA, 22 nt, Mycobacterium bovis subsp bovis AF2122/97
gaacugaaacgcuuggcccugg

SEQ ID NO: 3152816 - RNA, 14 nt, Mycobacterium bovis subsp bovis AF2122/97
gaacugagggcgga

SEQ ID NO: 3152817 - RNA, 15 nt, Mycobacterium bovis subsp bovis AF2122/97
gaacugaucgaccgc

SEQ ID NO: 3152818 - RNA, 15 nt, Mycobacterium bovis subsp bovis AF2122/97
gaacugaugaaccac

SEQ ID NO: 3152819 - RNA, 20 nt, Mycobacterium bovis subsp bovis AF2122/97
gaacugcaucauggccguga

SEQ ID NO: 3152820 - RNA, 22 nt, Mycobacterium bovis subsp bovis AF2122/97
gaacugcaugguggcgccgacc

SEQ ID NO: 3152821 - RNA, 11 nt, Mycobacterium bovis subsp bovis AF2122/97
gaacugcgcaa

SEQ ID NO: 3152822 - RNA, 22 nt, Mycobacterium bovis subsp bovis AF2122/97
gaacugcgcaacaccgugcacc

SEQ ID NO: 3152823 - RNA, 16 nt, Mycobacterium bovis subsp bovis AF2122/97
gaacugcucgauccgc

SEQ ID NO: 3152824 - RNA, 21 nt, Mycobacterium bovis subsp bovis AF2122/97
gaacuggacaagcuccucgcg

SEQ ID NO: 3152825 - RNA, 18 nt, Mycobacterium bovis subsp bovis AF2122/97
gaacuggaccacagccgc

SEQ ID NO: 3152826 - RNA, 22 nt, Mycobacterium bovis subsp bovis AF2122/97
gaacuggacggggaagcccggc

SEQ ID NO: 3152827 - RNA, 23 nt, Mycobacterium bovis subsp bovis AF2122/97
gaacuggcggugcagugccucgg

SEQ ID NO: 3152828 - RNA, 12 nt, Mycobacterium bovis subsp bovis AF2122/97
gaacuggcuggu

SEQ ID NO: 3152829 - RNA, 19 nt, Mycobacterium bovis subsp bovis AF2122/97
gaacuggcugguggcgugc

SEQ ID NO: 3152830 - RNA, 24 nt, Mycobacterium bovis subsp bovis AF2122/97
gaacugggcccccaaucagugcag

SEQ ID NO: 3152831 - RNA, 13 nt, Mycobacterium bovis subsp bovis AF2122/97
gaacugggccuca

SEQ ID NO: 3152832 - RNA, 18 nt, Mycobacterium bovis subsp bovis AF2122/97
gaacugggcgcccgcggu

SEQ ID NO: 3152833 - RNA, 14 nt, Mycobacterium bovis subsp bovis AF2122/97
gaacugguagcccg

SEQ ID NO: 3152834 - RNA, 18 nt, Mycobacterium bovis subsp bovis AF2122/97
gaacuggucgacgccgag

SEQ ID NO: 3152835 - RNA, 20 nt, Mycobacterium bovis subsp bovis AF2122/97
gaacuggugcuuccacacgg

SEQ ID NO: 3152836 - RNA, 16 nt, Mycobacterium bovis subsp bovis AF2122/97
gaacugguuggugacg

SEQ ID NO: 3152837 - RNA, 22 nt, Mycobacterium bovis subsp bovis AF2122/97
gaagcccccgacguugcuggcu

SEQ ID NO: 3152838 - RNA, 14 nt, Mycobacterium bovis subsp bovis AF2122/97
gaagcccgacuggu

SEQ ID NO: 3152839 - RNA, 13 nt, Mycobacterium bovis subsp bovis AF2122/97
gaagcccgagacg

SEQ ID NO: 3152840 - RNA, 14 nt, Mycobacterium bovis subsp bovis AF2122/97
gaagcccgagcucg

SEQ ID NO: 3152841 - RNA, 13 nt, Mycobacterium bovis subsp bovis AF2122/97
gaagcccgucgcg

SEQ ID NO: 3152842 - RNA, 15 nt, Mycobacterium bovis subsp bovis AF2122/97
gaagcccgucgcggc

SEQ ID NO: 3152843 - RNA, 13 nt, Mycobacterium bovis subsp bovis AF2122/97
gaagcccucgucg

SEQ ID NO: 3152844 - RNA, 15 nt, Mycobacterium bovis subsp bovis AF2122/97
gaagcccucgucggg

SEQ ID NO: 3152845 - RNA, 19 nt, Mycobacterium bovis subsp bovis AF2122/97
gaagcccuuguagcacacc

SEQ ID NO: 3152846 - RNA, 24 nt, Mycobacterium bovis subsp bovis AF2122/97
gaagcccuuguagcacaccgacau

SEQ ID NO: 3152847 - RNA, 14 nt, Mycobacterium bovis subsp bovis AF2122/97
gaagccgaccaccg

SEQ ID NO: 3152848 - RNA, 18 nt, Mycobacterium bovis subsp bovis AF2122/97
gaagccgaccaccgccgg

SEQ ID NO: 3152849 - RNA, 19 nt, Mycobacterium bovis subsp bovis AF2122/97
gaagccgaccaccgccggg

SEQ ID NO: 3152850 - RNA, 19 nt, Mycobacterium bovis subsp bovis AF2122/97
gaagccgacgaccagcaga

SEQ ID NO: 3152851 - RNA, 20 nt, Mycobacterium bovis subsp bovis AF2122/97
gaagccgacgauccacggcg

SEQ ID NO: 3152852 - RNA, 19 nt, Mycobacterium bovis subsp bovis AF2122/97
gaagccgacguugaagccg

SEQ ID NO: 3152853 - RNA, 22 nt, Mycobacterium bovis subsp bovis AF2122/97
gaagccgacguugaagccgccg

SEQ ID NO: 3152854 - RNA, 15 nt, Mycobacterium bovis subsp bovis AF2122/97
gaagccgagaccacg

SEQ ID NO: 3152855 - RNA, 17 nt, Mycobacterium bovis subsp bovis AF2122/97
gaagccgagaccacgcg

SEQ ID NO: 3152856 - RNA, 15 nt, Mycobacterium bovis subsp bovis AF2122/97
gaagccgagcaucag

SEQ ID NO: 3152857 - RNA, 14 nt, Mycobacterium bovis subsp bovis AF2122/97
gaagccgcaccgcu

SEQ ID NO: 3152858 - RNA, 17 nt, Mycobacterium bovis subsp bovis AF2122/97
gaagccgcaucuggcug

SEQ ID NO: 3152859 - RNA, 18 nt, Mycobacterium bovis subsp bovis AF2122/97
gaagccgcaucuggcugu

SEQ ID NO: 3152860 - RNA, 13 nt, Mycobacterium bovis subsp bovis AF2122/97
gaagccgcccgag

SEQ ID NO: 3152861 - RNA, 15 nt, Mycobacterium bovis subsp bovis AF2122/97
gaagccgccgggcau

SEQ ID NO: 3152862 - RNA, 14 nt, Mycobacterium bovis subsp bovis AF2122/97
gaagccgcgcugcg

SEQ ID NO: 3152863 - RNA, 22 nt, Mycobacterium bovis subsp bovis AF2122/97
gaagccggccgggaaccucgcg

SEQ ID NO: 3152864 - RNA, 17 nt, Mycobacterium bovis subsp bovis AF2122/97
gaagccggcgccggcuu

SEQ ID NO: 3152865 - RNA, 20 nt, Mycobacterium bovis subsp bovis AF2122/97
gaagccgggucucggugcgg

SEQ ID NO: 3152866 - RNA, 18 nt, Mycobacterium bovis subsp bovis AF2122/97
gaagccgggucuguuggu

SEQ ID NO: 3152867 - RNA, 16 nt, Mycobacterium bovis subsp bovis AF2122/97
gaagccguuugcgcug

SEQ ID NO: 3152868 - RNA, 21 nt, Mycobacterium bovis subsp bovis AF2122/97
gaagccugcgggccggcaucg

SEQ ID NO: 3152869 - RNA, 18 nt, Mycobacterium bovis subsp bovis AF2122/97
gaagccuguagucccuca

SEQ ID NO: 3152870 - RNA, 16 nt, Mycobacterium bovis subsp bovis AF2122/97
gaagccuugcagcgcc

SEQ ID NO: 3152871 - RNA, 13 nt, Mycobacterium bovis subsp bovis AF2122/97
gaagcgauccggc

SEQ ID NO: 3152872 - RNA, 17 nt, Mycobacterium bovis subsp bovis AF2122/97
gaagcgcaaugcgcgac

SEQ ID NO: 3152873 - RNA, 17 nt, Mycobacterium bovis subsp bovis AF2122/97
gaagcgccggccgaucg

SEQ ID NO: 3152874 - RNA, 18 nt, Mycobacterium bovis subsp bovis AF2122/97
gaagcgcucggcagccgg

SEQ ID NO: 3152875 - RNA, 20 nt, Mycobacterium bovis subsp bovis AF2122/97
gaagcgcucggcagccggcu

SEQ ID NO: 3152876 - RNA, 14 nt, Mycobacterium bovis subsp bovis AF2122/97
gaagcggaccagcg

SEQ ID NO: 3152877 - RNA, 15 nt, Mycobacterium bovis subsp bovis AF2122/97
gaagcggaccagcga

SEQ ID NO: 3152878 - RNA, 23 nt, Mycobacterium bovis subsp bovis AF2122/97
gaagcggacccgacagccgcugc

SEQ ID NO: 3152879 - RNA, 14 nt, Mycobacterium bovis subsp bovis AF2122/97
gaagcggaucuggc

SEQ ID NO: 3152880 - RNA, 13 nt, Mycobacterium bovis subsp bovis AF2122/97
gaagcggccaccg

SEQ ID NO: 3152881 - RNA, 14 nt, Mycobacterium bovis subsp bovis AF2122/97
gaagcggccaccgc

SEQ ID NO: 3152882 - RNA, 19 nt, Mycobacterium bovis subsp bovis AF2122/97
gaagcggccaccgccgccg

SEQ ID NO: 3152883 - RNA, 13 nt, Mycobacterium bovis subsp bovis AF2122/97
gaagcggcugcug

SEQ ID NO: 3152884 - RNA, 21 nt, Mycobacterium bovis subsp bovis AF2122/97
gaagcggcugcugcgcggugc

SEQ ID NO: 3152885 - RNA, 20 nt, Mycobacterium bovis subsp bovis AF2122/97
gaagcgggaaggcucaccac

SEQ ID NO: 3152886 - RNA, 21 nt, Mycobacterium bovis subsp bovis AF2122/97
gaagcgggacugcagcgcggu

SEQ ID NO: 3152887 - RNA, 22 nt, Mycobacterium bovis subsp bovis AF2122/97
gaagcgggauugccgagaacac

SEQ ID NO: 3152888 - RNA, 21 nt, Mycobacterium bovis subsp bovis AF2122/97
gaagcgggcuugagcgccgau

SEQ ID NO: 3152889 - RNA, 22 nt, Mycobacterium bovis subsp bovis AF2122/97
gaagcgguggccucccacggcg

SEQ ID NO: 3152890 - RNA, 20 nt, Mycobacterium bovis subsp bovis AF2122/97
gaagcgucgcuucggcaccg

SEQ ID NO: 3152891 - RNA, 19 nt, Mycobacterium bovis subsp bovis AF2122/97
gaagcgucguugcucgguc

SEQ ID NO: 3152892 - RNA, 23 nt, Mycobacterium bovis subsp bovis AF2122/97
gaagcgucuggucagccgcggcg

SEQ ID NO: 3152893 - RNA, 16 nt, Mycobacterium bovis subsp bovis AF2122/97
gaagcgugcgccgacu

SEQ ID NO: 3152894 - RNA, 19 nt, Mycobacterium bovis subsp bovis AF2122/97
gaagcgugcgccgacuuug

SEQ ID NO: 3152895 - RNA, 14 nt, Mycobacterium bovis subsp bovis AF2122/97
gaagcuagcgcccg

SEQ ID NO: 3152896 - RNA, 20 nt, Mycobacterium bovis subsp bovis AF2122/97
gaagcucaauuccaugcagu

SEQ ID NO: 3152897 - RNA, 16 nt, Mycobacterium bovis subsp bovis AF2122/97
gaagcucgaccgcccg

SEQ ID NO: 3152898 - RNA, 16 nt, Mycobacterium bovis subsp bovis AF2122/97
gaagcucgcgcugugc

SEQ ID NO: 3152899 - RNA, 15 nt, Mycobacterium bovis subsp bovis AF2122/97
gaagcugcccaaccg

SEQ ID NO: 3152900 - RNA, 15 nt, Mycobacterium bovis subsp bovis AF2122/97
gaagcuggccaccgc

SEQ ID NO: 3152901 - RNA, 19 nt, Mycobacterium bovis subsp bovis AF2122/97
gaagcuggcgugcagcagg

SEQ ID NO: 3152902 - RNA, 17 nt, Mycobacterium bovis subsp bovis AF2122/97
gaagcuguagaccuggc

SEQ ID NO: 3152903 - RNA, 19 nt, Mycobacterium bovis subsp bovis AF2122/97
gaagcuguagaccuggccg

SEQ ID NO: 3152904 - RNA, 17 nt, Mycobacterium bovis subsp bovis AF2122/97
gaagcuguaggcgacca

SEQ ID NO: 3152905 - RNA, 19 nt, Mycobacterium bovis subsp bovis AF2122/97
gaagcugugcccggcgccc

SEQ ID NO: 3152906 - RNA, 19 nt, Mycobacterium bovis subsp bovis AF2122/97
gaagcuucgggaaccagau

SEQ ID NO: 3152907 - RNA, 20 nt, Mycobacterium bovis subsp bovis AF2122/97
gaaggaaccgggcaaaucaa

SEQ ID NO: 3152908 - RNA, 23 nt, Mycobacterium bovis subsp bovis AF2122/97
gaaggacaucacgaaggcguucg

SEQ ID NO: 3152909 - RNA, 15 nt, Mycobacterium bovis subsp bovis AF2122/97
gaaggaccgcucguc

SEQ ID NO: 3152910 - RNA, 22 nt, Mycobacterium bovis subsp bovis AF2122/97
gaaggagaucccccaggcgaac

SEQ ID NO: 3152911 - RNA, 23 nt, Mycobacterium bovis subsp bovis AF2122/97
gaaggagauccuuaucgcucucg

SEQ ID NO: 3152912 - RNA, 18 nt, Mycobacterium bovis subsp bovis AF2122/97
gaaggaucagcgcacugg

SEQ ID NO: 3152913 - RNA, 23 nt, Mycobacterium bovis subsp bovis AF2122/97
gaaggaucagcgcacuggccgcu

SEQ ID NO: 3152914 - RNA, 20 nt, Mycobacterium bovis subsp bovis AF2122/97
gaaggauucgaagccgagcu

SEQ ID NO: 3152915 - RNA, 21 nt, Mycobacterium bovis subsp bovis AF2122/97
gaaggauuuggagcuuuuugc

SEQ ID NO: 3152916 - RNA, 16 nt, Mycobacterium bovis subsp bovis AF2122/97
gaaggcaaacaccagc

SEQ ID NO: 3152917 - RNA, 17 nt, Mycobacterium bovis subsp bovis AF2122/97
gaaggcaaacaccagcc

SEQ ID NO: 3152918 - RNA, 20 nt, Mycobacterium bovis subsp bovis AF2122/97
gaaggcaaacaccagcccgg

SEQ ID NO: 3152919 - RNA, 22 nt, Mycobacterium bovis subsp bovis AF2122/97
gaaggcaccgaaaaacaccagc

SEQ ID NO: 3152920 - RNA, 22 nt, Mycobacterium bovis subsp bovis AF2122/97
gaaggccacccgcgaagccgcc

SEQ ID NO: 3152921 - RNA, 23 nt, Mycobacterium bovis subsp bovis AF2122/97
gaaggccagccaacgcgucccgc

SEQ ID NO: 3152922 - RNA, 17 nt, Mycobacterium bovis subsp bovis AF2122/97
gaaggccagcgaaucgc

SEQ ID NO: 3152923 - RNA, 18 nt, Mycobacterium bovis subsp bovis AF2122/97
gaauacccgcuggcccgc

SEQ ID NO: 3152924 - RNA, 17 nt, Mycobacterium bovis subsp bovis AF2122/97
gaauaccgguggcagcc

SEQ ID NO: 3152925 - RNA, 12 nt, Mycobacterium bovis subsp bovis AF2122/97
gaauacgcgccg

SEQ ID NO: 3152926 - RNA, 15 nt, Mycobacterium bovis subsp bovis AF2122/97
gaauacgcgccgccg

SEQ ID NO: 3152927 - RNA, 16 nt, Mycobacterium bovis subsp bovis AF2122/97
gaauacgcgccgccgg

SEQ ID NO: 3152928 - RNA, 19 nt, Mycobacterium bovis subsp bovis AF2122/97
gaauacgcgccgccggcuc

SEQ ID NO: 3152929 - RNA, 22 nt, Mycobacterium bovis subsp bovis AF2122/97
gaauacugaucuuggcccgggc

SEQ ID NO: 3152930 - RNA, 22 nt, Mycobacterium bovis subsp bovis AF2122/97
gaauagguccggaagcggcguu

SEQ ID NO: 3152931 - RNA, 19 nt, Mycobacterium bovis subsp bovis AF2122/97
gaauauggcggccgggucg

SEQ ID NO: 3152932 - RNA, 16 nt, Mycobacterium bovis subsp bovis AF2122/97
gaaucaccccggcggc

SEQ ID NO: 3152933 - RNA, 17 nt, Mycobacterium bovis subsp bovis AF2122/97
gaaucaccccggcggcc

SEQ ID NO: 3152934 - RNA, 19 nt, Mycobacterium bovis subsp bovis AF2122/97
gaaucacguggaccacggc

SEQ ID NO: 3152935 - RNA, 15 nt, Mycobacterium bovis subsp bovis AF2122/97
gaaucagcaccccau

SEQ ID NO: 3152936 - RNA, 21 nt, Mycobacterium bovis subsp bovis AF2122/97
gaaucagcaccccauggccac

SEQ ID NO: 3152937 - RNA, 13 nt, Mycobacterium bovis subsp bovis AF2122/97
gaaucagcagcag

SEQ ID NO: 3152938 - RNA, 15 nt, Mycobacterium bovis subsp bovis AF2122/97
gaaucagcagcagcg

SEQ ID NO: 3152939 - RNA, 21 nt, Mycobacterium bovis subsp bovis AF2122/97
gaaucagcagcagcgugacca

SEQ ID NO: 3152940 - RNA, 17 nt, Mycobacterium bovis subsp bovis AF2122/97
gaaucagggucugcgcc

SEQ ID NO: 3152941 - RNA, 15 nt, Mycobacterium bovis subsp bovis AF2122/97
gaaucagugaagaca

SEQ ID NO: 3152942 - RNA, 22 nt, Mycobacterium bovis subsp bovis AF2122/97
gaaucagugaagacaccaggcc

SEQ ID NO: 3152943 - RNA, 16 nt, Mycobacterium bovis subsp bovis AF2122/97
gaauccaccagccggu

SEQ ID NO: 3152944 - RNA, 22 nt, Mycobacterium bovis subsp bovis AF2122/97
gaauccaccagccgguagccgg

SEQ ID NO: 3152945 - RNA, 16 nt, Mycobacterium bovis subsp bovis AF2122/97
gaauccaggagcccca

SEQ ID NO: 3152946 - RNA, 13 nt, Mycobacterium bovis subsp bovis AF2122/97
gaaucccaacucc

SEQ ID NO: 3152947 - RNA, 17 nt, Mycobacterium bovis subsp bovis AF2122/97
gaaucccaacuccucca

SEQ ID NO: 3152948 - RNA, 19 nt, Mycobacterium bovis subsp bovis AF2122/97
gaaucccacagcaggagaa

SEQ ID NO: 3152949 - RNA, 17 nt, Mycobacterium bovis subsp bovis AF2122/97
gaaucccgcgcccggcc

SEQ ID NO: 3152950 - RNA, 20 nt, Mycobacterium bovis subsp bovis AF2122/97
gaaucccucggccgcaggcu

SEQ ID NO: 3152951 - RNA, 19 nt, Mycobacterium bovis subsp bovis AF2122/97
gaauccgaucaccucggcg

SEQ ID NO: 3152952 - RNA, 13 nt, Mycobacterium bovis subsp bovis AF2122/97
gaauccggccaga

SEQ ID NO: 3152953 - RNA, 21 nt, Mycobacterium bovis subsp bovis AF2122/97
gaauccggcccaccggucgcg

SEQ ID NO: 3152954 - RNA, 23 nt, Mycobacterium bovis subsp bovis AF2122/97
gaauccggucgaugaccucguca

SEQ ID NO: 3152955 - RNA, 14 nt, Mycobacterium bovis subsp bovis AF2122/97
gaauccggucggcc

SEQ ID NO: 3152956 - RNA, 16 nt, Mycobacterium bovis subsp bovis AF2122/97
gaauccguucgacgag

SEQ ID NO: 3152957 - RNA, 21 nt, Mycobacterium bovis subsp bovis AF2122/97
gaauccucgcgaaaccgccgu

SEQ ID NO: 3152958 - RNA, 20 nt, Mycobacterium bovis subsp bovis AF2122/97
gaauccugccgcacgggccc

SEQ ID NO: 3152959 - RNA, 13 nt, Mycobacterium bovis subsp bovis AF2122/97
gaauccugcgcug

SEQ ID NO: 3152960 - RNA, 16 nt, Mycobacterium bovis subsp bovis AF2122/97
gaauccuggccgccgc

SEQ ID NO: 3152961 - RNA, 19 nt, Mycobacterium bovis subsp bovis AF2122/97
gaaucgaagcccggcggca

SEQ ID NO: 3152962 - RNA, 14 nt, Mycobacterium bovis subsp bovis AF2122/97
gaaucgacaccgcc

SEQ ID NO: 3152963 - RNA, 16 nt, Mycobacterium bovis subsp bovis AF2122/97
gaaucgaccgccgcua

SEQ ID NO: 3152964 - RNA, 22 nt, Mycobacterium bovis subsp bovis AF2122/97
gaaucgagacgguagccaagcg

SEQ ID NO: 3152965 - RNA, 14 nt, Mycobacterium bovis subsp bovis AF2122/97
gaaucgagcaccgc

SEQ ID NO: 3152966 - RNA, 17 nt, Mycobacterium bovis subsp bovis AF2122/97
gaaucgcacgacgcgac

SEQ ID NO: 3152967 - RNA, 22 nt, Mycobacterium bovis subsp bovis AF2122/97
gaaucgcacgcgaaaugccugc

SEQ ID NO: 3152968 - RNA, 19 nt, Mycobacterium bovis subsp bovis AF2122/97
gaaucgcccauuucggcac

SEQ ID NO: 3152969 - RNA, 11 nt, Mycobacterium bovis subsp bovis AF2122/97
gaaucgcccgg

SEQ ID NO: 3152970 - RNA, 17 nt, Mycobacterium bovis subsp bovis AF2122/97
gaaucgccuaccggccu

SEQ ID NO: 3152971 - RNA, 21 nt, Mycobacterium bovis subsp bovis AF2122/97
gaaucgcgagcuuggccggca

SEQ ID NO: 3152972 - RNA, 18 nt, Mycobacterium bovis subsp bovis AF2122/97
gaaucgcggagccaggac

SEQ ID NO: 3152973 - RNA, 14 nt, Mycobacterium bovis subsp bovis AF2122/97
gaaucgcuggugaa

SEQ ID NO: 3152974 - RNA, 19 nt, Mycobacterium bovis subsp bovis AF2122/97
gaaucggcaccgugcgggg

SEQ ID NO: 3152975 - RNA, 16 nt, Mycobacterium bovis subsp bovis AF2122/97
gaaucggcaguugaac

SEQ ID NO: 3152976 - RNA, 14 nt, Mycobacterium bovis subsp bovis AF2122/97
gaaucggcucagca

SEQ ID NO: 3152977 - RNA, 13 nt, Mycobacterium bovis subsp bovis AF2122/97
gaaucgggauagc

SEQ ID NO: 3152978 - RNA, 15 nt, Mycobacterium bovis subsp bovis AF2122/97
gaaucgggccgaaua

SEQ ID NO: 3152979 - RNA, 14 nt, Mycobacterium bovis subsp bovis AF2122/97
gaaucgguucggcc

SEQ ID NO: 3152980 - RNA, 20 nt, Mycobacterium bovis subsp bovis AF2122/97
gaaucgguucggccagaacg

SEQ ID NO: 3152981 - RNA, 17 nt, Mycobacterium bovis subsp bovis AF2122/97
gaaucgguuucgaccug

SEQ ID NO: 3152982 - RNA, 18 nt, Mycobacterium bovis subsp bovis AF2122/97
gaaucgguuucgaccugc

SEQ ID NO: 3152983 - RNA, 17 nt, Mycobacterium bovis subsp bovis AF2122/97
gaaucgucggcgcggcu

SEQ ID NO: 3152984 - RNA, 14 nt, Mycobacterium bovis subsp bovis AF2122/97
gaaucgucugacga

SEQ ID NO: 3152985 - RNA, 16 nt, Mycobacterium bovis subsp bovis AF2122/97
gaaucgugcggcgacc

SEQ ID NO: 3152986 - RNA, 21 nt, Mycobacterium bovis subsp bovis AF2122/97
gaaucuaauucgccucgccug

SEQ ID NO: 3152987 - RNA, 21 nt, Mycobacterium bovis subsp bovis AF2122/97
gaaucucaccgucaacgccug

SEQ ID NO: 3152988 - RNA, 15 nt, Mycobacterium bovis subsp bovis AF2122/97
gaaucuccaaguagc

SEQ ID NO: 3152989 - RNA, 20 nt, Mycobacterium bovis subsp bovis AF2122/97
gaaucuccgccgugaguuca

SEQ ID NO: 3152990 - RNA, 17 nt, Mycobacterium bovis subsp bovis AF2122/97
gaaucuccggcuggccc

SEQ ID NO: 3152991 - RNA, 15 nt, Mycobacterium bovis subsp bovis AF2122/97
gaaucucgcccccag

SEQ ID NO: 3152992 - RNA, 22 nt, Mycobacterium bovis subsp bovis AF2122/97
gaaucugaagggcaagaacccg

SEQ ID NO: 3152993 - RNA, 13 nt, Mycobacterium bovis subsp bovis AF2122/97
gaaucugccucuc

SEQ ID NO: 3152994 - RNA, 23 nt, Mycobacterium bovis subsp bovis AF2122/97
gaaucuucugagacugccgccgc

SEQ ID NO: 3152995 - RNA, 22 nt, Mycobacterium bovis subsp bovis AF2122/97
gaaucuuguuguucgccaccgc

SEQ ID NO: 3152996 - RNA, 17 nt, Mycobacterium bovis subsp bovis AF2122/97
gaaugaccuugcccugc

SEQ ID NO: 3152997 - RNA, 13 nt, Mycobacterium bovis subsp bovis AF2122/97
gaaugacgaucca

SEQ ID NO: 3152998 - RNA, 20 nt, Mycobacterium bovis subsp bovis AF2122/97
gaaugaucguuccgauccgg

SEQ ID NO: 3152999 - RNA, 22 nt, Mycobacterium bovis subsp bovis AF2122/97
gaaugcauuggcggugcgcacc

SEQ ID NO: 3153000 - RNA, 19 nt, Mycobacterium bovis subsp bovis AF2122/97
gaaugccauaaccgguggg

SEQ ID NO: 3153001 - RNA, 15 nt, Mycobacterium bovis subsp bovis AF2122/97
gaaugccgccgacgg

SEQ ID NO: 3153002 - RNA, 23 nt, Mycobacterium bovis subsp bovis AF2122/97
gaaugccgcggggaucagcgucg

SEQ ID NO: 3153003 - RNA, 14 nt, Mycobacterium bovis subsp bovis AF2122/97
gaaugccgucgccg

SEQ ID NO: 3153004 - RNA, 22 nt, Mycobacterium bovis subsp bovis AF2122/97
gaaugccgucgccggucaggcc

SEQ ID NO: 3153005 - RNA, 15 nt, Mycobacterium bovis subsp bovis AF2122/97
gaaugccuggcccgu

SEQ ID NO: 3153006 - RNA, 21 nt, Mycobacterium bovis subsp bovis AF2122/97
gaaugcgccgucggugggugc

SEQ ID NO: 3153007 - RNA, 14 nt, Mycobacterium bovis subsp bovis AF2122/97
gaaugcgggccucc

SEQ ID NO: 3153008 - RNA, 18 nt, Mycobacterium bovis subsp bovis AF2122/97
gaaugcgggucugcgguc

SEQ ID NO: 3153009 - RNA, 23 nt, Mycobacterium bovis subsp bovis AF2122/97
gacaacggguugucguugcuggu

SEQ ID NO: 3153010 - RNA, 16 nt, Mycobacterium bovis subsp bovis AF2122/97
gacaacgugccgaacg

SEQ ID NO: 3153011 - RNA, 16 nt, Mycobacterium bovis subsp bovis AF2122/97
gacaacguugguccgc

SEQ ID NO: 3153012 - RNA, 19 nt, Mycobacterium bovis subsp bovis AF2122/97
gacaacuaucgucgugucg

SEQ ID NO: 3153013 - RNA, 23 nt, Mycobacterium bovis subsp bovis AF2122/97
gacaacuaucgucgugucgccgc

SEQ ID NO: 3153014 - RNA, 19 nt, Mycobacterium bovis subsp bovis AF2122/97
gacaacucgcguggcaccg

SEQ ID NO: 3153015 - RNA, 17 nt, Mycobacterium bovis subsp bovis AF2122/97
gacaagcacagcgaaca

SEQ ID NO: 3153016 - RNA, 16 nt, Mycobacterium bovis subsp bovis AF2122/97
gacaagcccgcugcca

SEQ ID NO: 3153017 - RNA, 13 nt, Mycobacterium bovis subsp bovis AF2122/97
gacaagccgcuga

SEQ ID NO: 3153018 - RNA, 16 nt, Mycobacterium bovis subsp bovis AF2122/97
gacaaggccaagcgcc

SEQ ID NO: 3153019 - RNA, 23 nt, Mycobacterium bovis subsp bovis AF2122/97
gacaaggcgauugucggggccgc

SEQ ID NO: 3153020 - RNA, 17 nt, Mycobacterium bovis subsp bovis AF2122/97
gacaaggugcgcugggu

SEQ ID NO: 3153021 - RNA, 13 nt, Mycobacterium bovis subsp bovis AF2122/97
gacaagucaagau

SEQ ID NO: 3153022 - RNA, 13 nt, Mycobacterium bovis subsp bovis AF2122/97
gacaagucggcgc

SEQ ID NO: 3153023 - RNA, 19 nt, Mycobacterium bovis subsp bovis AF2122/97
gacaagugccggcgcggag

SEQ ID NO: 3153024 - RNA, 16 nt, Mycobacterium bovis subsp bovis AF2122/97
gacaauccgccgccgg

SEQ ID NO: 3153025 - RNA, 12 nt, Mycobacterium bovis subsp bovis AF2122/97
gacaaucgcacg

SEQ ID NO: 3153026 - RNA, 19 nt, Mycobacterium bovis subsp bovis AF2122/97
gacaaucguccacccgagc

SEQ ID NO: 3153027 - RNA, 13 nt, Mycobacterium bovis subsp bovis AF2122/97
gacaauggacacc

SEQ ID NO: 3153028 - RNA, 17 nt, Mycobacterium bovis subsp bovis AF2122/97
gacaaugucggcgaugc

SEQ ID NO: 3153029 - RNA, 14 nt, Mycobacterium bovis subsp bovis AF2122/97
gacaauucacgagg

SEQ ID NO: 3153030 - RNA, 17 nt, Mycobacterium bovis subsp bovis AF2122/97
gacaauuuucgcaccua

SEQ ID NO: 3153031 - RNA, 16 nt, Mycobacterium bovis subsp bovis AF2122/97
gacacaauccacgucg

SEQ ID NO: 3153032 - RNA, 12 nt, Mycobacterium bovis subsp bovis AF2122/97
gacacacaggcg

SEQ ID NO: 3153033 - RNA, 15 nt, Mycobacterium bovis subsp bovis AF2122/97
gacacacgccgccgg

SEQ ID NO: 3153034 - RNA, 21 nt, Mycobacterium bovis subsp bovis AF2122/97
gacacagcccacaggcggcgc

SEQ ID NO: 3153035 - RNA, 14 nt, Mycobacterium bovis subsp bovis AF2122/97
gacacauugaccag

SEQ ID NO: 3153036 - RNA, 15 nt, Mycobacterium bovis subsp bovis AF2122/97
gacacauugaccagg

SEQ ID NO: 3153037 - RNA, 18 nt, Mycobacterium bovis subsp bovis AF2122/97
gacaccaacaccgguggc

SEQ ID NO: 3153038 - RNA, 21 nt, Mycobacterium bovis subsp bovis AF2122/97
gacaccaccgaggucgagcga

SEQ ID NO: 3153039 - RNA, 14 nt, Mycobacterium bovis subsp bovis AF2122/97
gacaccaccggcgc

SEQ ID NO: 3153040 - RNA, 20 nt, Mycobacterium bovis subsp bovis AF2122/97
gacaccaccggcgccgccgu

SEQ ID NO: 3153041 - RNA, 13 nt, Mycobacterium bovis subsp bovis AF2122/97
gacaccagagcga

SEQ ID NO: 3153042 - RNA, 12 nt, Mycobacterium bovis subsp bovis AF2122/97
gacaccaggccc

SEQ ID NO: 3153043 - RNA, 18 nt, Mycobacterium bovis subsp bovis AF2122/97
gacaccaguaaugcccau

SEQ ID NO: 3153044 - RNA, 19 nt, Mycobacterium bovis subsp bovis AF2122/97
gacaccauaggccgacggg

SEQ ID NO: 3153045 - RNA, 23 nt, Mycobacterium bovis subsp bovis AF2122/97
gacaccaucuccgccgucgccac

SEQ ID NO: 3153046 - RNA, 14 nt, Mycobacterium bovis subsp bovis AF2122/97
gacacccagccgca

SEQ ID NO: 3153047 - RNA, 15 nt, Mycobacterium bovis subsp bovis AF2122/97
gacacccaucgaccg

SEQ ID NO: 3153048 - RNA, 22 nt, Mycobacterium bovis subsp bovis AF2122/97
gacacccaucgaccgcccgcca

SEQ ID NO: 3153049 - RNA, 18 nt, Mycobacterium bovis subsp bovis AF2122/97
gacaccccggaaucccca

SEQ ID NO: 3153050 - RNA, 16 nt, Mycobacterium bovis subsp bovis AF2122/97
gacacccgagggccug

SEQ ID NO: 3153051 - RNA, 20 nt, Mycobacterium bovis subsp bovis AF2122/97
gacacccgcacgaagccggc

SEQ ID NO: 3153052 - RNA, 21 nt, Mycobacterium bovis subsp bovis AF2122/97
gacacccgcauggcagcggcg

SEQ ID NO: 3153053 - RNA, 23 nt, Mycobacterium bovis subsp bovis AF2122/97
gacacccgcauggcagcggcggu

SEQ ID NO: 3153054 - RNA, 18 nt, Mycobacterium bovis subsp bovis AF2122/97
gacacccgccaggccgcg

SEQ ID NO: 3153055 - RNA, 21 nt, Mycobacterium bovis subsp bovis AF2122/97
gacacccgccaggccgcgcga

SEQ ID NO: 3153056 - RNA, 14 nt, Mycobacterium bovis subsp bovis AF2122/97
gacacccgcucggc

SEQ ID NO: 3153057 - RNA, 22 nt, Mycobacterium bovis subsp bovis AF2122/97
gacacccgggccaccccgagcu

SEQ ID NO: 3153058 - RNA, 23 nt, Mycobacterium bovis subsp bovis AF2122/97
gacacccguugagcauaugacgu

SEQ ID NO: 3153059 - RNA, 16 nt, Mycobacterium bovis subsp bovis AF2122/97
gacacccugggugccg

SEQ ID NO: 3153060 - RNA, 22 nt, Mycobacterium bovis subsp bovis AF2122/97
gacacccugggugccggcagcg

SEQ ID NO: 3153061 - RNA, 16 nt, Mycobacterium bovis subsp bovis AF2122/97
gacaccgaaccgccgc

SEQ ID NO: 3153062 - RNA, 14 nt, Mycobacterium bovis subsp bovis AF2122/97
gacaccgaccgggu

SEQ ID NO: 3153063 - RNA, 17 nt, Mycobacterium bovis subsp bovis AF2122/97
gacaccgaccgggucgc

SEQ ID NO: 3153064 - RNA, 15 nt, Mycobacterium bovis subsp bovis AF2122/97
gacaccgagaugcgc

SEQ ID NO: 3153065 - RNA, 16 nt, Mycobacterium bovis subsp bovis AF2122/97
gacaccgagccacgac

SEQ ID NO: 3153066 - RNA, 20 nt, Mycobacterium bovis subsp bovis AF2122/97
gacaccgagccacgacccag

SEQ ID NO: 3153067 - RNA, 22 nt, Mycobacterium bovis subsp bovis AF2122/97
gacaccgagccacgacccagca

SEQ ID NO: 3153068 - RNA, 22 nt, Mycobacterium bovis subsp bovis AF2122/97
gacaccgaggaccucgucaccg

SEQ ID NO: 3153069 - RNA, 17 nt, Mycobacterium bovis subsp bovis AF2122/97
gacaccgaggucggcca

SEQ ID NO: 3153070 - RNA, 19 nt, Mycobacterium bovis subsp bovis AF2122/97
gacaccgauccggccgccg

SEQ ID NO: 3153071 - RNA, 20 nt, Mycobacterium bovis subsp bovis AF2122/97
gacaccgaucggacgucgug

SEQ ID NO: 3153072 - RNA, 17 nt, Mycobacterium bovis subsp bovis AF2122/97
gacaccgcagcgggcgg

SEQ ID NO: 3153073 - RNA, 16 nt, Mycobacterium bovis subsp bovis AF2122/97
gacaccgccaccacgc

SEQ ID NO: 3153074 - RNA, 19 nt, Mycobacterium bovis subsp bovis AF2122/97
gacaccgccaccacgccgu

SEQ ID NO: 3153075 - RNA, 23 nt, Mycobacterium bovis subsp bovis AF2122/97
gacaccgcccgacccaucaccag

SEQ ID NO: 3153076 - RNA, 18 nt, Mycobacterium bovis subsp bovis AF2122/97
gacaccgcggcgaucugc

SEQ ID NO: 3153077 - RNA, 21 nt, Mycobacterium bovis subsp bovis AF2122/97
gacaccgcggcgaucugcgac

SEQ ID NO: 3153078 - RNA, 14 nt, Mycobacterium bovis subsp bovis AF2122/97
gacaccggccacca

SEQ ID NO: 3153079 - RNA, 15 nt, Mycobacterium bovis subsp bovis AF2122/97
gacaccggccaccag

SEQ ID NO: 3153080 - RNA, 17 nt, Mycobacterium bovis subsp bovis AF2122/97
gacaccggccaccagcc

SEQ ID NO: 3153081 - RNA, 15 nt, Mycobacterium bovis subsp bovis AF2122/97
gacaccggccgcgac

SEQ ID NO: 3153082 - RNA, 16 nt, Mycobacterium bovis subsp bovis AF2122/97
gacaccggccgcgacg

SEQ ID NO: 3153083 - RNA, 19 nt, Mycobacterium bovis subsp bovis AF2122/97
gacaccggccgcgacggau

SEQ ID NO: 3153084 - RNA, 14 nt, Mycobacterium bovis subsp bovis AF2122/97
gacaccggccugcg

SEQ ID NO: 3153085 - RNA, 20 nt, Mycobacterium bovis subsp bovis AF2122/97
gacaccggccugcgcgaccg

SEQ ID NO: 3153086 - RNA, 12 nt, Mycobacterium bovis subsp bovis AF2122/97
gacaccggcggc

SEQ ID NO: 3153087 - RNA, 15 nt, Mycobacterium bovis subsp bovis AF2122/97
gacaccggcggcauc

SEQ ID NO: 3153088 - RNA, 22 nt, Mycobacterium bovis subsp bovis AF2122/97
gacaccggcuauaucccgcccc

SEQ ID NO: 3153089 - RNA, 23 nt, Mycobacterium bovis subsp bovis AF2122/97
gacaccggcuauaucccgccccg

SEQ ID NO: 3153090 - RNA, 14 nt, Mycobacterium bovis subsp bovis AF2122/97
gacaccggcugacc

SEQ ID NO: 3153091 - RNA, 14 nt, Mycobacterium bovis subsp bovis AF2122/97
gacaccggucggca

SEQ ID NO: 3153092 - RNA, 16 nt, Mycobacterium bovis subsp bovis AF2122/97
gacaccguccagcagc

SEQ ID NO: 3153093 - RNA, 17 nt, Mycobacterium bovis subsp bovis AF2122/97
gacaccgugaccgccgc

SEQ ID NO: 3153094 - RNA, 19 nt, Mycobacterium bovis subsp bovis AF2122/97
gacaccguggaucggcagc

SEQ ID NO: 3153095 - RNA, 13 nt, Mycobacterium bovis subsp bovis AF2122/97
gacaggcggcggc

SEQ ID NO: 3153096 - RNA, 21 nt, Mycobacterium bovis subsp bovis AF2122/97
gacaggcuuggcaugcggauc

SEQ ID NO: 3153097 - RNA, 17 nt, Mycobacterium bovis subsp bovis AF2122/97
gacagggccgcucgccu

SEQ ID NO: 3153098 - RNA, 22 nt, Mycobacterium bovis subsp bovis AF2122/97
gacagggcggcaaccucaugca

SEQ ID NO: 3153099 - RNA, 15 nt, Mycobacterium bovis subsp bovis AF2122/97
gacagggcggcaacg

SEQ ID NO: 3153100 - RNA, 17 nt, Mycobacterium bovis subsp bovis AF2122/97
gacagggcggcaacggc

SEQ ID NO: 3153101 - RNA, 21 nt, Mycobacterium bovis subsp bovis AF2122/97
gacagggcggcaacggcggca

SEQ ID NO: 3153102 - RNA, 14 nt, Mycobacterium bovis subsp bovis AF2122/97
gacagggcggcgag

SEQ ID NO: 3153103 - RNA, 23 nt, Mycobacterium bovis subsp bovis AF2122/97
gacagggugcgcuugcggccgcg

SEQ ID NO: 3153104 - RNA, 22 nt, Mycobacterium bovis subsp bovis AF2122/97
gacagggugggggcaucagggu

SEQ ID NO: 3153105 - RNA, 22 nt, Mycobacterium bovis subsp bovis AF2122/97
gacaggucgcccaacaccgcgc

SEQ ID NO: 3153106 - RNA, 13 nt, Mycobacterium bovis subsp bovis AF2122/97
gacaggucggcau

SEQ ID NO: 3153107 - RNA, 18 nt, Mycobacterium bovis subsp bovis AF2122/97
gacaggucgggcagcacu

SEQ ID NO: 3153108 - RNA, 18 nt, Mycobacterium bovis subsp bovis AF2122/97
gacaggucgggcccccgg

SEQ ID NO: 3153109 - RNA, 22 nt, Mycobacterium bovis subsp bovis AF2122/97
gacaggucggggcgucguucgc

SEQ ID NO: 3153110 - RNA, 18 nt, Mycobacterium bovis subsp bovis AF2122/97
gacaggugccagaccagg

SEQ ID NO: 3153111 - RNA, 15 nt, Mycobacterium bovis subsp bovis AF2122/97
gacagucaacagggc

SEQ ID NO: 3153112 - RNA, 17 nt, Mycobacterium bovis subsp bovis AF2122/97
gacagucaacagggcca

SEQ ID NO: 3153113 - RNA, 14 nt, Mycobacterium bovis subsp bovis AF2122/97
gacaguggcgacgg

SEQ ID NO: 3153114 - RNA, 20 nt, Mycobacterium bovis subsp bovis AF2122/97
gacaguucguuaccacauac

SEQ ID NO: 3153115 - RNA, 17 nt, Mycobacterium bovis subsp bovis AF2122/97
gacaguuggcagcgcug

SEQ ID NO: 3153116 - RNA, 19 nt, Mycobacterium bovis subsp bovis AF2122/97
gacaguuggcagcgcuggc

SEQ ID NO: 3153117 - RNA, 20 nt, Mycobacterium bovis subsp bovis AF2122/97
gacaguuggcagcgcuggcu

SEQ ID NO: 3153118 - RNA, 16 nt, Mycobacterium bovis subsp bovis AF2122/97
gacaguuuucaccgcg

SEQ ID NO: 3153119 - RNA, 18 nt, Mycobacterium bovis subsp bovis AF2122/97
gacaguuuucaccgcgaa

SEQ ID NO: 3153120 - RNA, 18 nt, Mycobacterium bovis subsp bovis AF2122/97
gacauacgagcagugacc

SEQ ID NO: 3153121 - RNA, 19 nt, Mycobacterium bovis subsp bovis AF2122/97
gacauaggccaccuccgag

SEQ ID NO: 3153122 - RNA, 18 nt, Mycobacterium bovis subsp bovis AF2122/97
gacauaguuggcgcccga

SEQ ID NO: 3153123 - RNA, 13 nt, Mycobacterium bovis subsp bovis AF2122/97
gacauaugacggg

SEQ ID NO: 3153124 - RNA, 22 nt, Mycobacterium bovis subsp bovis AF2122/97
gacaucaccaccgaccuggacg

SEQ ID NO: 3153125 - RNA, 15 nt, Mycobacterium bovis subsp bovis AF2122/97
gacaucaccaccgcc

SEQ ID NO: 3153126 - RNA, 20 nt, Mycobacterium bovis subsp bovis AF2122/97
gacaucaccaccgccggggu

SEQ ID NO: 3153127 - RNA, 17 nt, Mycobacterium bovis subsp bovis AF2122/97
gacaucaccgaccaacg

SEQ ID NO: 3153128 - RNA, 17 nt, Mycobacterium bovis subsp bovis AF2122/97
gacaucagugcgccggc

SEQ ID NO: 3153129 - RNA, 12 nt, Mycobacterium bovis subsp bovis AF2122/97
gacauccagauc

SEQ ID NO: 3153130 - RNA, 19 nt, Mycobacterium bovis subsp bovis AF2122/97
gacauccagaugcccagca

SEQ ID NO: 3153131 - RNA, 21 nt, Mycobacterium bovis subsp bovis AF2122/97
gacauccagaugcccagcagg

SEQ ID NO: 3153132 - RNA, 21 nt, Mycobacterium bovis subsp bovis AF2122/97
gacauccagggccgagcagcu

SEQ ID NO: 3153133 - RNA, 15 nt, Mycobacterium bovis subsp bovis AF2122/97
gacauccgcuuacgg

SEQ ID NO: 3153134 - RNA, 23 nt, Mycobacterium bovis subsp bovis AF2122/97
gacaucgcgaggcgucaccccgg

SEQ ID NO: 3153135 - RNA, 16 nt, Mycobacterium bovis subsp bovis AF2122/97
gacaucgcugcgacug

SEQ ID NO: 3153136 - RNA, 19 nt, Mycobacterium bovis subsp bovis AF2122/97
gacaucggcccgaucacca

SEQ ID NO: 3153137 - RNA, 19 nt, Mycobacterium bovis subsp bovis AF2122/97
gacaucgggccgccgagcu

SEQ ID NO: 3153138 - RNA, 18 nt, Mycobacterium bovis subsp bovis AF2122/97
gacaucgggcggcaccgc

SEQ ID NO: 3153139 - RNA, 21 nt, Mycobacterium bovis subsp bovis AF2122/97
gacaucggucagcgggcacgc

SEQ ID NO: 3153140 - RNA, 16 nt, Mycobacterium bovis subsp bovis AF2122/97
gacaucgguggcccgg

SEQ ID NO: 3153141 - RNA, 16 nt, Mycobacterium bovis subsp bovis AF2122/97
gacaucgguggcggcc

SEQ ID NO: 3153142 - RNA, 20 nt, Mycobacterium bovis subsp bovis AF2122/97
gacaucgguggcggccuccg

SEQ ID NO: 3153143 - RNA, 23 nt, Mycobacterium bovis subsp bovis AF2122/97
gacaucgguggcggccuccgagg

SEQ ID NO: 3153144 - RNA, 14 nt, Mycobacterium bovis subsp bovis AF2122/97
gacaucguaggccg

SEQ ID NO: 3153145 - RNA, 18 nt, Mycobacterium bovis subsp bovis AF2122/97
gacaucguaggccggcau

SEQ ID NO: 3153146 - RNA, 17 nt, Mycobacterium bovis subsp bovis AF2122/97
gacaucgucaucagcgc

SEQ ID NO: 3153147 - RNA, 16 nt, Mycobacterium bovis subsp bovis AF2122/97
gacaucgucgccaggg

SEQ ID NO: 3153148 - RNA, 23 nt, Mycobacterium bovis subsp bovis AF2122/97
gacaucgucgccagggccgccga

SEQ ID NO: 3153149 - RNA, 17 nt, Mycobacterium bovis subsp bovis AF2122/97
gacaucguugacccggc

SEQ ID NO: 3153150 - RNA, 22 nt, Mycobacterium bovis subsp bovis AF2122/97
gacaucugcccagcgguugccg

SEQ ID NO: 3153151 - RNA, 19 nt, Mycobacterium bovis subsp bovis AF2122/97
gacaugacagccccgccgc

SEQ ID NO: 3153152 - RNA, 20 nt, Mycobacterium bovis subsp bovis AF2122/97
gacaugagcgccacgccgag

SEQ ID NO: 3153153 - RNA, 22 nt, Mycobacterium bovis subsp bovis AF2122/97
gacaugagcgccacgccgaggc

SEQ ID NO: 3153154 - RNA, 19 nt, Mycobacterium bovis subsp bovis AF2122/97
gacaugaucugccaccgcg

SEQ ID NO: 3153155 - RNA, 23 nt, Mycobacterium bovis subsp bovis AF2122/97
gacaugccauaugggggaaagcu

SEQ ID NO: 3153156 - RNA, 12 nt, Mycobacterium bovis subsp bovis AF2122/97
gacaugcgccga

SEQ ID NO: 3153157 - RNA, 16 nt, Mycobacterium bovis subsp bovis AF2122/97
gacaugcgggcagcac

SEQ ID NO: 3153158 - RNA, 18 nt, Mycobacterium bovis subsp bovis AF2122/97
gacaugguccgaccagcg

SEQ ID NO: 3153159 - RNA, 20 nt, Mycobacterium bovis subsp bovis AF2122/97
gacaugguccgaccagcggc

SEQ ID NO: 3153160 - RNA, 23 nt, Mycobacterium bovis subsp bovis AF2122/97
gacaugguccgaccagcggccga

SEQ ID NO: 3153161 - RNA, 15 nt, Mycobacterium bovis subsp bovis AF2122/97
gacaugucaggccgu

SEQ ID NO: 3153162 - RNA, 20 nt, Mycobacterium bovis subsp bovis AF2122/97
gacaugucaggccgucaccg

SEQ ID NO: 3153163 - RNA, 21 nt, Mycobacterium bovis subsp bovis AF2122/97
gacaugucgaacgccccccac

SEQ ID NO: 3153164 - RNA, 17 nt, Mycobacterium bovis subsp bovis AF2122/97
gacaugucgcugccgcc

SEQ ID NO: 3153165 - RNA, 19 nt, Mycobacterium bovis subsp bovis AF2122/97
gacaugucgcugccgccgc

SEQ ID NO: 3153166 - RNA, 21 nt, Mycobacterium bovis subsp bovis AF2122/97
gacauucccgaguugcccucu

SEQ ID NO: 3153167 - RNA, 15 nt, Mycobacterium bovis subsp bovis AF2122/97
gacauugccacggcg

SEQ ID NO: 3153168 - RNA, 15 nt, Mycobacterium bovis subsp bovis AF2122/97
gacauuggagacgac

SEQ ID NO: 3153169 - RNA, 15 nt, Mycobacterium bovis subsp bovis AF2122/97
gacauugggcgcggu

SEQ ID NO: 3153170 - RNA, 14 nt, Mycobacterium bovis subsp bovis AF2122/97
gacauuggugcuga

SEQ ID NO: 3153171 - RNA, 24 nt, Mycobacterium bovis subsp bovis AF2122/97
gaccaaaccgcuguaaccgguaac

SEQ ID NO: 3153172 - RNA, 13 nt, Mycobacterium bovis subsp bovis AF2122/97
gaccaacaccccc

SEQ ID NO: 3153173 - RNA, 23 nt, Mycobacterium bovis subsp bovis AF2122/97
gaccaacacccccccccccaccc

SEQ ID NO: 3153174 - RNA, 13 nt, Mycobacterium bovis subsp bovis AF2122/97
gaccaacccggcu

SEQ ID NO: 3153175 - RNA, 14 nt, Mycobacterium bovis subsp bovis AF2122/97
gaccaacccggcuc

SEQ ID NO: 3153176 - RNA, 13 nt, Mycobacterium bovis subsp bovis AF2122/97
gaccaacgcggug

SEQ ID NO: 3153177 - RNA, 16 nt, Mycobacterium bovis subsp bovis AF2122/97
gaccaacucguggaac

SEQ ID NO: 3153178 - RNA, 20 nt, Mycobacterium bovis subsp bovis AF2122/97
gaccaagguguccagcaccu

SEQ ID NO: 3153179 - RNA, 22 nt, Mycobacterium bovis subsp bovis AF2122/97
gaccaaguccggucgcggcggu

SEQ ID NO: 3153180 - RNA, 20 nt, Mycobacterium bovis subsp bovis AF2122/97
gaccaagugucgccgcucgg

SEQ ID NO: 3153181 - RNA, 13 nt, Mycobacterium bovis subsp bovis AF2122/97
gaccagcaaccac

SEQ ID NO: 3153182 - RNA, 13 nt, Mycobacterium bovis subsp bovis AF2122/97
gaccagcacaccg

SEQ ID NO: 3153183 - RNA, 14 nt, Mycobacterium bovis subsp bovis AF2122/97
gaccagcacaccgc

SEQ ID NO: 3153184 - RNA, 13 nt, Mycobacterium bovis subsp bovis AF2122/97
gaccagcacccgc

SEQ ID NO: 3153185 - RNA, 22 nt, Mycobacterium bovis subsp bovis AF2122/97
gaccagcacccgcucggccgcc

SEQ ID NO: 3153186 - RNA, 16 nt, Mycobacterium bovis subsp bovis AF2122/97
gaccagcagaccaagc

SEQ ID NO: 3153187 - RNA, 19 nt, Mycobacterium bovis subsp bovis AF2122/97
gaccagcagauccaggcgu

SEQ ID NO: 3153188 - RNA, 23 nt, Mycobacterium bovis subsp bovis AF2122/97
gaccagcaggccgggcgcaagca

SEQ ID NO: 3153189 - RNA, 15 nt, Mycobacterium bovis subsp bovis AF2122/97
gaccagccagcgagg

SEQ ID NO: 3153190 - RNA, 18 nt, Mycobacterium bovis subsp bovis AF2122/97
gaccagccgaucaucacc

SEQ ID NO: 3153191 - RNA, 18 nt, Mycobacterium bovis subsp bovis AF2122/97
gaccagccguggugguug

SEQ ID NO: 3153192 - RNA, 14 nt, Mycobacterium bovis subsp bovis AF2122/97
gaccagcgccccgg

SEQ ID NO: 3153193 - RNA, 23 nt, Mycobacterium bovis subsp bovis AF2122/97
gaccagcgccccggcgcguucca

SEQ ID NO: 3153194 - RNA, 17 nt, Mycobacterium bovis subsp bovis AF2122/97
gaccagcgccgauacca

SEQ ID NO: 3153195 - RNA, 21 nt, Mycobacterium bovis subsp bovis AF2122/97
gaccagcgccgauaccagcca

SEQ ID NO: 3153196 - RNA, 16 nt, Mycobacterium bovis subsp bovis AF2122/97
gaccagcgccggaccg

SEQ ID NO: 3153197 - RNA, 16 nt, Mycobacterium bovis subsp bovis AF2122/97
gaccagcgcuagcggu

SEQ ID NO: 3153198 - RNA, 12 nt, Mycobacterium bovis subsp bovis AF2122/97
gaccagcggccg

SEQ ID NO: 3153199 - RNA, 15 nt, Mycobacterium bovis subsp bovis AF2122/97
gaccagcgggcggcc

SEQ ID NO: 3153200 - RNA, 15 nt, Mycobacterium bovis subsp bovis AF2122/97
gaccagcguccagcc

SEQ ID NO: 3153201 - RNA, 18 nt, Mycobacterium bovis subsp bovis AF2122/97
gaccagcguccagccgcc

SEQ ID NO: 3153202 - RNA, 22 nt, Mycobacterium bovis subsp bovis AF2122/97
gaccagcguccagccgcccucg

SEQ ID NO: 3153203 - RNA, 19 nt, Mycobacterium bovis subsp bovis AF2122/97
gaccagcguggggccgcca

SEQ ID NO: 3153204 - RNA, 22 nt, Mycobacterium bovis subsp bovis AF2122/97
gaccagcguggggccgccacca

SEQ ID NO: 3153205 - RNA, 23 nt, Mycobacterium bovis subsp bovis AF2122/97
gaccagcguggggccgccaccag

SEQ ID NO: 3153206 - RNA, 17 nt, Mycobacterium bovis subsp bovis AF2122/97
gaccagcucagcugcgg

SEQ ID NO: 3153207 - RNA, 18 nt, Mycobacterium bovis subsp bovis AF2122/97
gaccagcugagcuggcag

SEQ ID NO: 3153208 - RNA, 16 nt, Mycobacterium bovis subsp bovis AF2122/97
gaccagcugccggcga

SEQ ID NO: 3153209 - RNA, 18 nt, Mycobacterium bovis subsp bovis AF2122/97
gaccagcugccggcgacc

SEQ ID NO: 3153210 - RNA, 21 nt, Mycobacterium bovis subsp bovis AF2122/97
gaccagcuggccguacucguc

SEQ ID NO: 3153211 - RNA, 21 nt, Mycobacterium bovis subsp bovis AF2122/97
gaccagcuucggcuggcgugc

SEQ ID NO: 3153212 - RNA, 20 nt, Mycobacterium bovis subsp bovis AF2122/97
gaccagcuugaccgaccacg

SEQ ID NO: 3153213 - RNA, 20 nt, Mycobacterium bovis subsp bovis AF2122/97
gaccaggaacggcucggccg

SEQ ID NO: 3153214 - RNA, 22 nt, Mycobacterium bovis subsp bovis AF2122/97
gaccaggaaguagaugagcaga

SEQ ID NO: 3153215 - RNA, 15 nt, Mycobacterium bovis subsp bovis AF2122/97
gaccaggaccaccgc

SEQ ID NO: 3153216 - RNA, 18 nt, Mycobacterium bovis subsp bovis AF2122/97
gaccaggaccaccgcaua

SEQ ID NO: 3153217 - RNA, 17 nt, Mycobacterium bovis subsp bovis AF2122/97
gaccaggaccggcugca

SEQ ID NO: 3153218 - RNA, 22 nt, Mycobacterium bovis subsp bovis AF2122/97
gaccaggacgguugguccgccg

SEQ ID NO: 3153219 - RNA, 15 nt, Mycobacterium bovis subsp bovis AF2122/97
gaccaggcgcggcga

SEQ ID NO: 3153220 - RNA, 15 nt, Mycobacterium bovis subsp bovis AF2122/97
gaccaggcggacgcc

SEQ ID NO: 3153221 - RNA, 19 nt, Mycobacterium bovis subsp bovis AF2122/97
gaccaggcggacgccgcgc

SEQ ID NO: 3153222 - RNA, 20 nt, Mycobacterium bovis subsp bovis AF2122/97
gaccaggcggacgccgcgcc

SEQ ID NO: 3153223 - RNA, 23 nt, Mycobacterium bovis subsp bovis AF2122/97
gaccaggcggcgcgggucggcga

SEQ ID NO: 3153224 - RNA, 14 nt, Mycobacterium bovis subsp bovis AF2122/97
gaccaggcuccggc

SEQ ID NO: 3153225 - RNA, 23 nt, Mycobacterium bovis subsp bovis AF2122/97
gaccaggcuccggccggccagca

SEQ ID NO: 3153226 - RNA, 17 nt, Mycobacterium bovis subsp bovis AF2122/97
gaccagggaucgauuug

SEQ ID NO: 3153227 - RNA, 14 nt, Mycobacterium bovis subsp bovis AF2122/97
gaccagggcagcgg

SEQ ID NO: 3153228 - RNA, 16 nt, Mycobacterium bovis subsp bovis AF2122/97
gaccagggcagcggcc

SEQ ID NO: 3153229 - RNA, 15 nt, Mycobacterium bovis subsp bovis AF2122/97
gaccagggucugcuc

SEQ ID NO: 3153230 - RNA, 16 nt, Mycobacterium bovis subsp bovis AF2122/97
gaccagggucugcuca

SEQ ID NO: 3153231 - RNA, 15 nt, Mycobacterium bovis subsp bovis AF2122/97
gaccagguaauggug

SEQ ID NO: 3153232 - RNA, 19 nt, Mycobacterium bovis subsp bovis AF2122/97
gaccaggucgccagcucgg

SEQ ID NO: 3153233 - RNA, 17 nt, Mycobacterium bovis subsp bovis AF2122/97
gaccaggucggcuucga

SEQ ID NO: 3153234 - RNA, 17 nt, Mycobacterium bovis subsp bovis AF2122/97
gaccagguucucggucg

SEQ ID NO: 3153235 - RNA, 14 nt, Mycobacterium bovis subsp bovis AF2122/97
gaccagucgacguc

SEQ ID NO: 3153236 - RNA, 21 nt, Mycobacterium bovis subsp bovis AF2122/97
gaccagucgacgucucuggug

SEQ ID NO: 3153237 - RNA, 17 nt, Mycobacterium bovis subsp bovis AF2122/97
gaccagucgcggcguuc

SEQ ID NO: 3153238 - RNA, 23 nt, Mycobacterium bovis subsp bovis AF2122/97
gaccagugaucagcgcaucgccg

SEQ ID NO: 3153239 - RNA, 22 nt, Mycobacterium bovis subsp bovis AF2122/97
gaccauaaaacucgggggcugc

SEQ ID NO: 3153240 - RNA, 17 nt, Mycobacterium bovis subsp bovis AF2122/97
gaccauaaaccgcugcu

SEQ ID NO: 3153241 - RNA, 13 nt, Mycobacterium bovis subsp bovis AF2122/97
gaccauacccgcg

SEQ ID NO: 3153242 - RNA, 22 nt, Mycobacterium bovis subsp bovis AF2122/97
gaccauacuaauggcgccaccg

SEQ ID NO: 3153243 - RNA, 16 nt, Mycobacterium bovis subsp bovis AF2122/97
gaccauagccugcgcc

SEQ ID NO: 3153244 - RNA, 18 nt, Mycobacterium bovis subsp bovis AF2122/97
gaccauagccugcgccga

SEQ ID NO: 3153245 - RNA, 20 nt, Mycobacterium bovis subsp bovis AF2122/97
gaccauagucgccgucgugc

SEQ ID NO: 3153246 - RNA, 19 nt, Mycobacterium bovis subsp bovis AF2122/97
gaccauauuggcgcggccg

SEQ ID NO: 3153247 - RNA, 19 nt, Mycobacterium bovis subsp bovis AF2122/97
gaccaucacacccaucacc

SEQ ID NO: 3153248 - RNA, 16 nt, Mycobacterium bovis subsp bovis AF2122/97
gaccaucaccacggcc

SEQ ID NO: 3153249 - RNA, 16 nt, Mycobacterium bovis subsp bovis AF2122/97
gaccaucacgcccugu

SEQ ID NO: 3153250 - RNA, 19 nt, Mycobacterium bovis subsp bovis AF2122/97
gaccaucagcgucgacguc

SEQ ID NO: 3153251 - RNA, 23 nt, Mycobacterium bovis subsp bovis AF2122/97
gaccauccgaguugucgccggag

SEQ ID NO: 3153252 - RNA, 18 nt, Mycobacterium bovis subsp bovis AF2122/97
gaccaucgccaggcccug

SEQ ID NO: 3153253 - RNA, 22 nt, Mycobacterium bovis subsp bovis AF2122/97
gaccaucguguacuggucugga

SEQ ID NO: 3153254 - RNA, 17 nt, Mycobacterium bovis subsp bovis AF2122/97
gaccaucucaccgggcc

SEQ ID NO: 3153255 - RNA, 15 nt, Mycobacterium bovis subsp bovis AF2122/97
gaccaucugcugugg

SEQ ID NO: 3153256 - RNA, 20 nt, Mycobacterium bovis subsp bovis AF2122/97
gaccaucuuaacgucggcaa

SEQ ID NO: 3153257 - RNA, 19 nt, Mycobacterium bovis subsp bovis AF2122/97
gaccaugagccggcgccgc

SEQ ID NO: 3153258 - RNA, 18 nt, Mycobacterium bovis subsp bovis AF2122/97
gaccaugaugccuaccgg

SEQ ID NO: 3153259 - RNA, 21 nt, Mycobacterium bovis subsp bovis AF2122/97
gaccaugcuccuaucacugga

SEQ ID NO: 3153260 - RNA, 14 nt, Mycobacterium bovis subsp bovis AF2122/97
gacccaacgaccac

SEQ ID NO: 3153261 - RNA, 16 nt, Mycobacterium bovis subsp bovis AF2122/97
gacccaacgaccacca

SEQ ID NO: 3153262 - RNA, 16 nt, Mycobacterium bovis subsp bovis AF2122/97
gacccaagucgccgag

SEQ ID NO: 3153263 - RNA, 22 nt, Mycobacterium bovis subsp bovis AF2122/97
gacccaauguggucacccgcag

SEQ ID NO: 3153264 - RNA, 16 nt, Mycobacterium bovis subsp bovis AF2122/97
gacccacagucgccgg

SEQ ID NO: 3153265 - RNA, 20 nt, Mycobacterium bovis subsp bovis AF2122/97
gacccacaucaggucggcga

SEQ ID NO: 3153266 - RNA, 22 nt, Mycobacterium bovis subsp bovis AF2122/97
gacccacauuccguagccggcg

SEQ ID NO: 3153267 - RNA, 23 nt, Mycobacterium bovis subsp bovis AF2122/97
gacccgcugccacccaucgcacg

SEQ ID NO: 3153268 - RNA, 16 nt, Mycobacterium bovis subsp bovis AF2122/97
gacccgcugggccgca

SEQ ID NO: 3153269 - RNA, 21 nt, Mycobacterium bovis subsp bovis AF2122/97
gacccgcuggucgaugccuuc

SEQ ID NO: 3153270 - RNA, 16 nt, Mycobacterium bovis subsp bovis AF2122/97
gacccggaaucccgag

SEQ ID NO: 3153271 - RNA, 18 nt, Mycobacterium bovis subsp bovis AF2122/97
gacccggaaucccgaguc

SEQ ID NO: 3153272 - RNA, 18 nt, Mycobacterium bovis subsp bovis AF2122/97
gacccggaccugggcgac

SEQ ID NO: 3153273 - RNA, 14 nt, Mycobacterium bovis subsp bovis AF2122/97
gacccggagccgcc

SEQ ID NO: 3153274 - RNA, 14 nt, Mycobacterium bovis subsp bovis AF2122/97
gacccggaugucgu

SEQ ID NO: 3153275 - RNA, 15 nt, Mycobacterium bovis subsp bovis AF2122/97
gacccggcagcccgg

SEQ ID NO: 3153276 - RNA, 19 nt, Mycobacterium bovis subsp bovis AF2122/97
gacccggcagcccggcggc

SEQ ID NO: 3153277 - RNA, 17 nt, Mycobacterium bovis subsp bovis AF2122/97
gacccggccaagggugc

SEQ ID NO: 3153278 - RNA, 16 nt, Mycobacterium bovis subsp bovis AF2122/97
gacccggcccagcgcc

SEQ ID NO: 3153279 - RNA, 23 nt, Mycobacterium bovis subsp bovis AF2122/97
gacccggcccagcgcccccagca

SEQ ID NO: 3153280 - RNA, 16 nt, Mycobacterium bovis subsp bovis AF2122/97
gacccggccgauggug

SEQ ID NO: 3153281 - RNA, 16 nt, Mycobacterium bovis subsp bovis AF2122/97
gacccggccggcccgg

SEQ ID NO: 3153282 - RNA, 19 nt, Mycobacterium bovis subsp bovis AF2122/97
gacccggcgaugcagccgg

SEQ ID NO: 3153283 - RNA, 15 nt, Mycobacterium bovis subsp bovis AF2122/97
gacccggcgccgucg

SEQ ID NO: 3153284 - RNA, 21 nt, Mycobacterium bovis subsp bovis AF2122/97
gacccgggaaggaaccgggca

SEQ ID NO: 3153285 - RNA, 16 nt, Mycobacterium bovis subsp bovis AF2122/97
gacccgggccggucgg

SEQ ID NO: 3153286 - RNA, 21 nt, Mycobacterium bovis subsp bovis AF2122/97
gacccgggcgagcgcggccug

SEQ ID NO: 3153287 - RNA, 16 nt, Mycobacterium bovis subsp bovis AF2122/97
gacccgggcggcguug

SEQ ID NO: 3153288 - RNA, 18 nt, Mycobacterium bovis subsp bovis AF2122/97
gacccggggccguuggug

SEQ ID NO: 3153289 - RNA, 17 nt, Mycobacterium bovis subsp bovis AF2122/97
gacccgggggcgcccgg

SEQ ID NO: 3153290 - RNA, 14 nt, Mycobacterium bovis subsp bovis AF2122/97
gacccgggucggca

SEQ ID NO: 3153291 - RNA, 21 nt, Mycobacterium bovis subsp bovis AF2122/97
gacccggucgacgggucggcg

SEQ ID NO: 3153292 - RNA, 14 nt, Mycobacterium bovis subsp bovis AF2122/97
gacccggucgccgg

SEQ ID NO: 3153293 - RNA, 19 nt, Mycobacterium bovis subsp bovis AF2122/97
gacccggugacccgcuggg

SEQ ID NO: 3153294 - RNA, 20 nt, Mycobacterium bovis subsp bovis AF2122/97
gacccggugacccgcugggc

SEQ ID NO: 3153295 - RNA, 21 nt, Mycobacterium bovis subsp bovis AF2122/97
gacccgguggcguggucucgg

SEQ ID NO: 3153296 - RNA, 14 nt, Mycobacterium bovis subsp bovis AF2122/97
gacccguaccagcc

SEQ ID NO: 3153297 - RNA, 15 nt, Mycobacterium bovis subsp bovis AF2122/97
gacccguacccacga

SEQ ID NO: 3153298 - RNA, 21 nt, Mycobacterium bovis subsp bovis AF2122/97
gacccguccaacuacgccagc

SEQ ID NO: 3153299 - RNA, 24 nt, Mycobacterium bovis subsp bovis AF2122/97
gacccguccaacuacgccagccgc

SEQ ID NO: 3153300 - RNA, 14 nt, Mycobacterium bovis subsp bovis AF2122/97
gacccgucgaacgc

SEQ ID NO: 3153301 - RNA, 15 nt, Mycobacterium bovis subsp bovis AF2122/97
gacccgucgaacgcg

SEQ ID NO: 3153302 - RNA, 15 nt, Mycobacterium bovis subsp bovis AF2122/97
gacccgugcacgauc

SEQ ID NO: 3153303 - RNA, 18 nt, Mycobacterium bovis subsp bovis AF2122/97
gacccguucagcgacggc

SEQ ID NO: 3153304 - RNA, 23 nt, Mycobacterium bovis subsp bovis AF2122/97
gacccguucagcgacggccgcca

SEQ ID NO: 3153305 - RNA, 15 nt, Mycobacterium bovis subsp bovis AF2122/97
gacccguuccacgcc

SEQ ID NO: 3153306 - RNA, 18 nt, Mycobacterium bovis subsp bovis AF2122/97
gacccguuccacgccggc

SEQ ID NO: 3153307 - RNA, 21 nt, Mycobacterium bovis subsp bovis AF2122/97
gacccguuccacgccggcauc

SEQ ID NO: 3153308 - RNA, 22 nt, Mycobacterium bovis subsp bovis AF2122/97
gacccguuccacgccggcaucg

SEQ ID NO: 3153309 - RNA, 21 nt, Mycobacterium bovis subsp bovis AF2122/97
gacccguugaacucgaagacc

SEQ ID NO: 3153310 - RNA, 20 nt, Mycobacterium bovis subsp bovis AF2122/97
gacccuagauaugcacccgc

SEQ ID NO: 3153311 - RNA, 17 nt, Mycobacterium bovis subsp bovis AF2122/97
gacccucagcaccgcug

SEQ ID NO: 3153312 - RNA, 14 nt, Mycobacterium bovis subsp bovis AF2122/97
gacccuccagcacg

SEQ ID NO: 3153313 - RNA, 18 nt, Mycobacterium bovis subsp bovis AF2122/97
gacccucgggucgucgcg

SEQ ID NO: 3153314 - RNA, 16 nt, Mycobacterium bovis subsp bovis AF2122/97
gacccugaugaucguc

SEQ ID NO: 3153315 - RNA, 21 nt, Mycobacterium bovis subsp bovis AF2122/97
gacccugaugaucguccagcc

SEQ ID NO: 3153316 - RNA, 16 nt, Mycobacterium bovis subsp bovis AF2122/97
gacccugcgccgccac

SEQ ID NO: 3153317 - RNA, 19 nt, Mycobacterium bovis subsp bovis AF2122/97
gacccugcgccgccacagc

SEQ ID NO: 3153318 - RNA, 18 nt, Mycobacterium bovis subsp bovis AF2122/97
gacccugcugcagggccu

SEQ ID NO: 3153319 - RNA, 20 nt, Mycobacterium bovis subsp bovis AF2122/97
gacccugcugcagggccugg

SEQ ID NO: 3153320 - RNA, 14 nt, Mycobacterium bovis subsp bovis AF2122/97
gacccuggccgucc

SEQ ID NO: 3153321 - RNA, 19 nt, Mycobacterium bovis subsp bovis AF2122/97
gacccuggccgucccacca

SEQ ID NO: 3153322 - RNA, 22 nt, Mycobacterium bovis subsp bovis AF2122/97
gacccuuccgccgccgccgggu

SEQ ID NO: 3153323 - RNA, 22 nt, Mycobacterium bovis subsp bovis AF2122/97
gaccgaaacggggcgacguccg

SEQ ID NO: 3153324 - RNA, 12 nt, Mycobacterium bovis subsp bovis AF2122/97
gaccgaaagccg

SEQ ID NO: 3153325 - RNA, 14 nt, Mycobacterium bovis subsp bovis AF2122/97
gaccgaaagccgca

SEQ ID NO: 3153326 - RNA, 18 nt, Mycobacterium bovis subsp bovis AF2122/97
gaccgaaagccgcaccag

SEQ ID NO: 3153327 - RNA, 22 nt, Mycobacterium bovis subsp bovis AF2122/97
gaccgaaauggucguucccgcc

SEQ ID NO: 3153328 - RNA, 15 nt, Mycobacterium bovis subsp bovis AF2122/97
gaccgaacagcaccg

SEQ ID NO: 3153329 - RNA, 18 nt, Mycobacterium bovis subsp bovis AF2122/97
gaccgaacagcaccgaac

SEQ ID NO: 3153330 - RNA, 13 nt, Mycobacterium bovis subsp bovis AF2122/97
gaccgaacagcgg

SEQ ID NO: 3153331 - RNA, 15 nt, Mycobacterium bovis subsp bovis AF2122/97
gaccgaaccgucagc

SEQ ID NO: 3153332 - RNA, 13 nt, Mycobacterium bovis subsp bovis AF2122/97
gaccgaaccuggu

SEQ ID NO: 3153333 - RNA, 18 nt, Mycobacterium bovis subsp bovis AF2122/97
gaccgaaccuggucuuga

SEQ ID NO: 3153334 - RNA, 13 nt, Mycobacterium bovis subsp bovis AF2122/97
gaccgaagaagcc

SEQ ID NO: 3153335 - RNA, 18 nt, Mycobacterium bovis subsp bovis AF2122/97
gaccgaagaagcccgacu

SEQ ID NO: 3153336 - RNA, 20 nt, Mycobacterium bovis subsp bovis AF2122/97
gaccgaagucugcagacggu

SEQ ID NO: 3153337 - RNA, 23 nt, Mycobacterium bovis subsp bovis AF2122/97
gaccgaaucgggucggccgcugg

SEQ ID NO: 3153338 - RNA, 17 nt, Mycobacterium bovis subsp bovis AF2122/97
gaccgaauggccgccgc

SEQ ID NO: 3153339 - RNA, 20 nt, Mycobacterium bovis subsp bovis AF2122/97
gaccgaauggccgccgcagc

SEQ ID NO: 3153340 - RNA, 21 nt, Mycobacterium bovis subsp bovis AF2122/97
gaccgaauggccgccgcagcu

SEQ ID NO: 3153341 - RNA, 22 nt, Mycobacterium bovis subsp bovis AF2122/97
gaccgaaugugaaaugcgcgau

SEQ ID NO: 3153342 - RNA, 12 nt, Mycobacterium bovis subsp bovis AF2122/97
gaccgacaccac

SEQ ID NO: 3153343 - RNA, 14 nt, Mycobacterium bovis subsp bovis AF2122/97
gaccgacagcggca

SEQ ID NO: 3153344 - RNA, 17 nt, Mycobacterium bovis subsp bovis AF2122/97
gaccgacagcggcaccg

SEQ ID NO: 3153345 - RNA, 18 nt, Mycobacterium bovis subsp bovis AF2122/97
gaccgacagcggcaccgg

SEQ ID NO: 3153346 - RNA, 22 nt, Mycobacterium bovis subsp bovis AF2122/97
gaccgacaggugcucgucaucc

SEQ ID NO: 3153347 - RNA, 17 nt, Mycobacterium bovis subsp bovis AF2122/97
gaccgaccaccgcgaaa

SEQ ID NO: 3153348 - RNA, 15 nt, Mycobacterium bovis subsp bovis AF2122/97
gaccgacccggaccu

SEQ ID NO: 3153349 - RNA, 20 nt, Mycobacterium bovis subsp bovis AF2122/97
gaccgaccgcacgaccagcu

SEQ ID NO: 3153350 - RNA, 17 nt, Mycobacterium bovis subsp bovis AF2122/97
gaccgaccgcauggugg

SEQ ID NO: 3153351 - RNA, 13 nt, Mycobacterium bovis subsp bovis AF2122/97
gaccgaccucggc

SEQ ID NO: 3153352 - RNA, 16 nt, Mycobacterium bovis subsp bovis AF2122/97
gaccgaccucggcgac

SEQ ID NO: 3153353 - RNA, 16 nt, Mycobacterium bovis subsp bovis AF2122/97
gaccgcgaacagcggg

SEQ ID NO: 3153354 - RNA, 15 nt, Mycobacterium bovis subsp bovis AF2122/97
gaccgcgacaacaac

SEQ ID NO: 3153355 - RNA, 15 nt, Mycobacterium bovis subsp bovis AF2122/97
gaccgcgacccggcc

SEQ ID NO: 3153356 - RNA, 17 nt, Mycobacterium bovis subsp bovis AF2122/97
gaccgcgacccggccca

SEQ ID NO: 3153357 - RNA, 14 nt, Mycobacterium bovis subsp bovis AF2122/97
gaccgcgaccgcau

SEQ ID NO: 3153358 - RNA, 13 nt, Mycobacterium bovis subsp bovis AF2122/97
gaccgcgacggca

SEQ ID NO: 3153359 - RNA, 14 nt, Mycobacterium bovis subsp bovis AF2122/97
gaccgcgacggcgc

SEQ ID NO: 3153360 - RNA, 19 nt, Mycobacterium bovis subsp bovis AF2122/97
gaccgcgacggcgccggca

SEQ ID NO: 3153361 - RNA, 15 nt, Mycobacterium bovis subsp bovis AF2122/97
gaccgcgauccccac

SEQ ID NO: 3153362 - RNA, 20 nt, Mycobacterium bovis subsp bovis AF2122/97
gaccgcgaucgccgacgcca

SEQ ID NO: 3153363 - RNA, 20 nt, Mycobacterium bovis subsp bovis AF2122/97
gaccgcgaugaucgcaucga

SEQ ID NO: 3153364 - RNA, 13 nt, Mycobacterium bovis subsp bovis AF2122/97
gaccgcgccaaca

SEQ ID NO: 3153365 - RNA, 20 nt, Mycobacterium bovis subsp bovis AF2122/97
gaccgcgccaacagaugcca

SEQ ID NO: 3153366 - RNA, 19 nt, Mycobacterium bovis subsp bovis AF2122/97
gaccgcgccaacuccgauc

SEQ ID NO: 3153367 - RNA, 23 nt, Mycobacterium bovis subsp bovis AF2122/97
gaccgcgccagguacucggugca

SEQ ID NO: 3153368 - RNA, 15 nt, Mycobacterium bovis subsp bovis AF2122/97
gaccgcgcccagacc

SEQ ID NO: 3153369 - RNA, 21 nt, Mycobacterium bovis subsp bovis AF2122/97
gaccgcgcccagaccgacccg

SEQ ID NO: 3153370 - RNA, 16 nt, Mycobacterium bovis subsp bovis AF2122/97
gaccgcgccgaucacc

SEQ ID NO: 3153371 - RNA, 17 nt, Mycobacterium bovis subsp bovis AF2122/97
gaccgcgccgaucacca

SEQ ID NO: 3153372 - RNA, 15 nt, Mycobacterium bovis subsp bovis AF2122/97
gaccgcgccgcauca

SEQ ID NO: 3153373 - RNA, 16 nt, Mycobacterium bovis subsp bovis AF2122/97
gaccgcgccggacagc

SEQ ID NO: 3153374 - RNA, 13 nt, Mycobacterium bovis subsp bovis AF2122/97
gaccgcgcggcac

SEQ ID NO: 3153375 - RNA, 14 nt, Mycobacterium bovis subsp bovis AF2122/97
gaccgcgcggcacu

SEQ ID NO: 3153376 - RNA, 15 nt, Mycobacterium bovis subsp bovis AF2122/97
gaccgcgcggcccgc

SEQ ID NO: 3153377 - RNA, 15 nt, Mycobacterium bovis subsp bovis AF2122/97
gaccgcggcccggac

SEQ ID NO: 3153378 - RNA, 12 nt, Mycobacterium bovis subsp bovis AF2122/97
gaccgcggccgc

SEQ ID NO: 3153379 - RNA, 13 nt, Mycobacterium bovis subsp bovis AF2122/97
gaccgcggccgcu

SEQ ID NO: 3153380 - RNA, 21 nt, Mycobacterium bovis subsp bovis AF2122/97
gaccgcggccggguggcccgg

SEQ ID NO: 3153381 - RNA, 15 nt, Mycobacterium bovis subsp bovis AF2122/97
gaccgcggccuuggc

SEQ ID NO: 3153382 - RNA, 21 nt, Mycobacterium bovis subsp bovis AF2122/97
gaccgcggcgcguccgggcuc

SEQ ID NO: 3153383 - RNA, 15 nt, Mycobacterium bovis subsp bovis AF2122/97
gaccgcggcggccga

SEQ ID NO: 3153384 - RNA, 16 nt, Mycobacterium bovis subsp bovis AF2122/97
gaccgcgggccgacgc

SEQ ID NO: 3153385 - RNA, 14 nt, Mycobacterium bovis subsp bovis AF2122/97
gaccgcgggcgccu

SEQ ID NO: 3153386 - RNA, 18 nt, Mycobacterium bovis subsp bovis AF2122/97
gaccgcgggcgccuucca

SEQ ID NO: 3153387 - RNA, 12 nt, Mycobacterium bovis subsp bovis AF2122/97
gaccgcggggca

SEQ ID NO: 3153388 - RNA, 14 nt, Mycobacterium bovis subsp bovis AF2122/97
gaccgcggggcagc

SEQ ID NO: 3153389 - RNA, 20 nt, Mycobacterium bovis subsp bovis AF2122/97
gaccgcggggcagcgggccg

SEQ ID NO: 3153390 - RNA, 19 nt, Mycobacterium bovis subsp bovis AF2122/97
gaccgcgggucgugccagc

SEQ ID NO: 3153391 - RNA, 19 nt, Mycobacterium bovis subsp bovis AF2122/97
gaccgcggucauggcgacg

SEQ ID NO: 3153392 - RNA, 20 nt, Mycobacterium bovis subsp bovis AF2122/97
gaccgcggucauggcgacgg

SEQ ID NO: 3153393 - RNA, 21 nt, Mycobacterium bovis subsp bovis AF2122/97
gaccgcggucugcgcgucgcg

SEQ ID NO: 3153394 - RNA, 23 nt, Mycobacterium bovis subsp bovis AF2122/97
gaccgcggucuucuucaccgccu

SEQ ID NO: 3153395 - RNA, 16 nt, Mycobacterium bovis subsp bovis AF2122/97
gaccgcggugacccgg

SEQ ID NO: 3153396 - RNA, 21 nt, Mycobacterium bovis subsp bovis AF2122/97
gaccgcggugacucggccucc

SEQ ID NO: 3153397 - RNA, 23 nt, Mycobacterium bovis subsp bovis AF2122/97
gaccgcggugacucggccuccgc

SEQ ID NO: 3153398 - RNA, 17 nt, Mycobacterium bovis subsp bovis AF2122/97
gaccgcguacaggccgg

SEQ ID NO: 3153399 - RNA, 21 nt, Mycobacterium bovis subsp bovis AF2122/97
gaccgcguacaggccggccac

SEQ ID NO: 3153400 - RNA, 18 nt, Mycobacterium bovis subsp bovis AF2122/97
gaccgcguagagcagcag

SEQ ID NO: 3153401 - RNA, 19 nt, Mycobacterium bovis subsp bovis AF2122/97
gaccgcguagagcagcaga

SEQ ID NO: 3153402 - RNA, 13 nt, Mycobacterium bovis subsp bovis AF2122/97
gaccgcgucggcg

SEQ ID NO: 3153403 - RNA, 18 nt, Mycobacterium bovis subsp bovis AF2122/97
gaccgcgucggcggccag

SEQ ID NO: 3153404 - RNA, 17 nt, Mycobacterium bovis subsp bovis AF2122/97
gaccgcgucgucccagu

SEQ ID NO: 3153405 - RNA, 18 nt, Mycobacterium bovis subsp bovis AF2122/97
gaccgcgugagcagacgc

SEQ ID NO: 3153406 - RNA, 22 nt, Mycobacterium bovis subsp bovis AF2122/97
gaccgcgugcucgagcaccucg

SEQ ID NO: 3153407 - RNA, 17 nt, Mycobacterium bovis subsp bovis AF2122/97
gaccgcguggucggcga

SEQ ID NO: 3153408 - RNA, 19 nt, Mycobacterium bovis subsp bovis AF2122/97
gaccgcguggucggcgaac

SEQ ID NO: 3153409 - RNA, 19 nt, Mycobacterium bovis subsp bovis AF2122/97
gaccgcguuguccgcggcc

SEQ ID NO: 3153410 - RNA, 23 nt, Mycobacterium bovis subsp bovis AF2122/97
gaccgcguuguccgcggccaacg

SEQ ID NO: 3153411 - RNA, 22 nt, Mycobacterium bovis subsp bovis AF2122/97
gaccgcguuuugcaggcccgag

SEQ ID NO: 3153412 - RNA, 12 nt, Mycobacterium bovis subsp bovis AF2122/97
gaccgcuaccag

SEQ ID NO: 3153413 - RNA, 17 nt, Mycobacterium bovis subsp bovis AF2122/97
gaccgcuaccagcuggg

SEQ ID NO: 3153414 - RNA, 21 nt, Mycobacterium bovis subsp bovis AF2122/97
gaccgcuaccagcugggcgac

SEQ ID NO: 3153415 - RNA, 18 nt, Mycobacterium bovis subsp bovis AF2122/97
gaccgcuaugaugccgcc

SEQ ID NO: 3153416 - RNA, 21 nt, Mycobacterium bovis subsp bovis AF2122/97
gaccgcucgucgccgguggca

SEQ ID NO: 3153417 - RNA, 23 nt, Mycobacterium bovis subsp bovis AF2122/97
gaccgcucgucgccgguggcacc

SEQ ID NO: 3153418 - RNA, 16 nt, Mycobacterium bovis subsp bovis AF2122/97
gaccgcucugcggcca

SEQ ID NO: 3153419 - RNA, 21 nt, Mycobacterium bovis subsp bovis AF2122/97
gaccgcucugcggccacgccg

SEQ ID NO: 3153420 - RNA, 22 nt, Mycobacterium bovis subsp bovis AF2122/97
gaccgcucugcggccacgccga

SEQ ID NO: 3153421 - RNA, 22 nt, Mycobacterium bovis subsp bovis AF2122/97
gaccgcugagguauugggcgcg

SEQ ID NO: 3153422 - RNA, 13 nt, Mycobacterium bovis subsp bovis AF2122/97
gaccgcugcccag

SEQ ID NO: 3153423 - RNA, 14 nt, Mycobacterium bovis subsp bovis AF2122/97
gaccgcugcccagu

SEQ ID NO: 3153424 - RNA, 15 nt, Mycobacterium bovis subsp bovis AF2122/97
gaccgcugccugccg

SEQ ID NO: 3153425 - RNA, 23 nt, Mycobacterium bovis subsp bovis AF2122/97
gaccgcugccugccgcguagaac

SEQ ID NO: 3153426 - RNA, 22 nt, Mycobacterium bovis subsp bovis AF2122/97
gaccgcuggugugucccggggu

SEQ ID NO: 3153427 - RNA, 22 nt, Mycobacterium bovis subsp bovis AF2122/97
gaccgcugguucucgcuguuga

SEQ ID NO: 3153428 - RNA, 19 nt, Mycobacterium bovis subsp bovis AF2122/97
gaccgcuucgacgucguug

SEQ ID NO: 3153429 - RNA, 20 nt, Mycobacterium bovis subsp bovis AF2122/97
gaccggaaacagcauggcga

SEQ ID NO: 3153430 - RNA, 18 nt, Mycobacterium bovis subsp bovis AF2122/97
gaccggaaaccacagcgc

SEQ ID NO: 3153431 - RNA, 19 nt, Mycobacterium bovis subsp bovis AF2122/97
gaccggaaaccacagcgcc

SEQ ID NO: 3153432 - RNA, 21 nt, Mycobacterium bovis subsp bovis AF2122/97
gaccggaaaugucuccuccgg

SEQ ID NO: 3153433 - RNA, 13 nt, Mycobacterium bovis subsp bovis AF2122/97
gaccggaaccagc

SEQ ID NO: 3153434 - RNA, 18 nt, Mycobacterium bovis subsp bovis AF2122/97
gaccggaacguuccugca

SEQ ID NO: 3153435 - RNA, 19 nt, Mycobacterium bovis subsp bovis AF2122/97
gaccggaacuguggugccu

SEQ ID NO: 3153436 - RNA, 23 nt, Mycobacterium bovis subsp bovis AF2122/97
gaccggacaaacaucgcacccac

SEQ ID NO: 3153437 - RNA, 19 nt, Mycobacterium bovis subsp bovis AF2122/97
gaccggaguucagugcgcg

SEQ ID NO: 3153438 - RNA, 20 nt, Mycobacterium bovis subsp bovis AF2122/97
gaccggaguucagugcgcgu

SEQ ID NO: 3153439 - RNA, 17 nt, Mycobacterium bovis subsp bovis AF2122/97
gaccgucgucgugcagg

SEQ ID NO: 3153440 - RNA, 18 nt, Mycobacterium bovis subsp bovis AF2122/97
gaccgucguggcgguggc

SEQ ID NO: 3153441 - RNA, 18 nt, Mycobacterium bovis subsp bovis AF2122/97
gaccgucugcgacccggg

SEQ ID NO: 3153442 - RNA, 17 nt, Mycobacterium bovis subsp bovis AF2122/97
gaccgucuuuggugccg

SEQ ID NO: 3153443 - RNA, 21 nt, Mycobacterium bovis subsp bovis AF2122/97
gaccgucuuuggugccgagca

SEQ ID NO: 3153444 - RNA, 23 nt, Mycobacterium bovis subsp bovis AF2122/97
gaccgugacguagggcagcgcca

SEQ ID NO: 3153445 - RNA, 13 nt, Mycobacterium bovis subsp bovis AF2122/97
gaccgugaucagc

SEQ ID NO: 3153446 - RNA, 16 nt, Mycobacterium bovis subsp bovis AF2122/97
gaccgugaucagcgcg

SEQ ID NO: 3153447 - RNA, 17 nt, Mycobacterium bovis subsp bovis AF2122/97
gaccgugaucagcgcgu

SEQ ID NO: 3153448 - RNA, 14 nt, Mycobacterium bovis subsp bovis AF2122/97
gaccgugccgucgg

SEQ ID NO: 3153449 - RNA, 20 nt, Mycobacterium bovis subsp bovis AF2122/97
gaccgugccgucggcgugca

SEQ ID NO: 3153450 - RNA, 19 nt, Mycobacterium bovis subsp bovis AF2122/97
gaccgugcgucgauggcgu

SEQ ID NO: 3153451 - RNA, 18 nt, Mycobacterium bovis subsp bovis AF2122/97
gaccguggauaacgacug

SEQ ID NO: 3153452 - RNA, 13 nt, Mycobacterium bovis subsp bovis AF2122/97
gaccguggcgccg

SEQ ID NO: 3153453 - RNA, 17 nt, Mycobacterium bovis subsp bovis AF2122/97
gaccguggcgccggucg

SEQ ID NO: 3153454 - RNA, 15 nt, Mycobacterium bovis subsp bovis AF2122/97
gaccguggcggccuc

SEQ ID NO: 3153455 - RNA, 23 nt, Mycobacterium bovis subsp bovis AF2122/97
gaccguggcggggaaaccggcca

SEQ ID NO: 3153456 - RNA, 13 nt, Mycobacterium bovis subsp bovis AF2122/97
gaccguguaacca

SEQ ID NO: 3153457 - RNA, 17 nt, Mycobacterium bovis subsp bovis AF2122/97
gaccgugucaccgccgg

SEQ ID NO: 3153458 - RNA, 12 nt, Mycobacterium bovis subsp bovis AF2122/97
gaccguucggcg

SEQ ID NO: 3153459 - RNA, 15 nt, Mycobacterium bovis subsp bovis AF2122/97
gaccguucggcgguc

SEQ ID NO: 3153460 - RNA, 21 nt, Mycobacterium bovis subsp bovis AF2122/97
gaccguucguucccgcucggg

SEQ ID NO: 3153461 - RNA, 17 nt, Mycobacterium bovis subsp bovis AF2122/97
gaccguugccgauggug

SEQ ID NO: 3153462 - RNA, 15 nt, Mycobacterium bovis subsp bovis AF2122/97
gaccguugccgucgg

SEQ ID NO: 3153463 - RNA, 21 nt, Mycobacterium bovis subsp bovis AF2122/97
gaccguuucgaucucgagcag

SEQ ID NO: 3153464 - RNA, 13 nt, Mycobacterium bovis subsp bovis AF2122/97
gaccguuucgucg

SEQ ID NO: 3153465 - RNA, 13 nt, Mycobacterium bovis subsp bovis AF2122/97
gaccguuucuccg

SEQ ID NO: 3153466 - RNA, 21 nt, Mycobacterium bovis subsp bovis AF2122/97
gaccguuugaauuuggacguc

SEQ ID NO: 3153467 - RNA, 21 nt, Mycobacterium bovis subsp bovis AF2122/97
gaccuaccgucgaccacuagc

SEQ ID NO: 3153468 - RNA, 16 nt, Mycobacterium bovis subsp bovis AF2122/97
gaccuaccuccucggc

SEQ ID NO: 3153469 - RNA, 15 nt, Mycobacterium bovis subsp bovis AF2122/97
gaccuagcagcgcug

SEQ ID NO: 3153470 - RNA, 21 nt, Mycobacterium bovis subsp bovis AF2122/97
gaccuagucaccuugaccggg

SEQ ID NO: 3153471 - RNA, 23 nt, Mycobacterium bovis subsp bovis AF2122/97
gaccuauuggucgcucgcgguca

SEQ ID NO: 3153472 - RNA, 23 nt, Mycobacterium bovis subsp bovis AF2122/97
gaccucaauguuuguguucgccg

SEQ ID NO: 3153473 - RNA, 19 nt, Mycobacterium bovis subsp bovis AF2122/97
gaccucaauuggcucggcg

SEQ ID NO: 3153474 - RNA, 16 nt, Mycobacterium bovis subsp bovis AF2122/97
gaccucauguccgccg

SEQ ID NO: 3153475 - RNA, 17 nt, Mycobacterium bovis subsp bovis AF2122/97
gaccuccagugcggccu

SEQ ID NO: 3153476 - RNA, 18 nt, Mycobacterium bovis subsp bovis AF2122/97
gaccuccagugcggccuu

SEQ ID NO: 3153477 - RNA, 19 nt, Mycobacterium bovis subsp bovis AF2122/97
gaccuccagugcggccuug

SEQ ID NO: 3153478 - RNA, 15 nt, Mycobacterium bovis subsp bovis AF2122/97
gaccuccgacgugcc

SEQ ID NO: 3153479 - RNA, 15 nt, Mycobacterium bovis subsp bovis AF2122/97
gaccuccucgaccag

SEQ ID NO: 3153480 - RNA, 23 nt, Mycobacterium bovis subsp bovis AF2122/97
gaccuccucgaccagagccgcga

SEQ ID NO: 3153481 - RNA, 15 nt, Mycobacterium bovis subsp bovis AF2122/97
gaccuccucgcccau

SEQ ID NO: 3153482 - RNA, 16 nt, Mycobacterium bovis subsp bovis AF2122/97
gaccucgaagcccagc

SEQ ID NO: 3153483 - RNA, 13 nt, Mycobacterium bovis subsp bovis AF2122/97
gaccucgaccugg

SEQ ID NO: 3153484 - RNA, 15 nt, Mycobacterium bovis subsp bovis AF2122/97
gaccucgacgcccca

SEQ ID NO: 3153485 - RNA, 17 nt, Mycobacterium bovis subsp bovis AF2122/97
gaccucgacguugggcg

SEQ ID NO: 3153486 - RNA, 20 nt, Mycobacterium bovis subsp bovis AF2122/97
gaccucgagcuugccgucgc

SEQ ID NO: 3153487 - RNA, 23 nt, Mycobacterium bovis subsp bovis AF2122/97
gaccucgagcuugccgucgcuga

SEQ ID NO: 3153488 - RNA, 20 nt, Mycobacterium bovis subsp bovis AF2122/97
gaccucgccgcgcgugacag

SEQ ID NO: 3153489 - RNA, 14 nt, Mycobacterium bovis subsp bovis AF2122/97
gaccucgccgcggc

SEQ ID NO: 3153490 - RNA, 17 nt, Mycobacterium bovis subsp bovis AF2122/97
gaccucgccgcggcgga

SEQ ID NO: 3153491 - RNA, 15 nt, Mycobacterium bovis subsp bovis AF2122/97
gaccucgcgcaccgg

SEQ ID NO: 3153492 - RNA, 18 nt, Mycobacterium bovis subsp bovis AF2122/97
gaccucggcaaccaccuc

SEQ ID NO: 3153493 - RNA, 20 nt, Mycobacterium bovis subsp bovis AF2122/97
gaccucggcaaccaccucgu

SEQ ID NO: 3153494 - RNA, 21 nt, Mycobacterium bovis subsp bovis AF2122/97
gaccucggcaacgacugcaug

SEQ ID NO: 3153495 - RNA, 14 nt, Mycobacterium bovis subsp bovis AF2122/97
gaccucggcgacga

SEQ ID NO: 3153496 - RNA, 13 nt, Mycobacterium bovis subsp bovis AF2122/97
gaccucggcgaug

SEQ ID NO: 3153497 - RNA, 13 nt, Mycobacterium bovis subsp bovis AF2122/97
gaccucggcggcg

SEQ ID NO: 3153498 - RNA, 14 nt, Mycobacterium bovis subsp bovis AF2122/97
gaccucggcggcgg

SEQ ID NO: 3153499 - RNA, 18 nt, Mycobacterium bovis subsp bovis AF2122/97
gaccucggcggcggcacg

SEQ ID NO: 3153500 - RNA, 21 nt, Mycobacterium bovis subsp bovis AF2122/97
gaccucgucaaucaccaccgc

SEQ ID NO: 3153501 - RNA, 14 nt, Mycobacterium bovis subsp bovis AF2122/97
gaccucgucgcguc

SEQ ID NO: 3153502 - RNA, 17 nt, Mycobacterium bovis subsp bovis AF2122/97
gaccucgucgcgucgcc

SEQ ID NO: 3153503 - RNA, 20 nt, Mycobacterium bovis subsp bovis AF2122/97
gaccucgugguucugcaggu

SEQ ID NO: 3153504 - RNA, 17 nt, Mycobacterium bovis subsp bovis AF2122/97
gaccucguucgucacca

SEQ ID NO: 3153505 - RNA, 17 nt, Mycobacterium bovis subsp bovis AF2122/97
gaccucguugcugccgg

SEQ ID NO: 3153506 - RNA, 18 nt, Mycobacterium bovis subsp bovis AF2122/97
gaccucguugcugccggc

SEQ ID NO: 3153507 - RNA, 16 nt, Mycobacterium bovis subsp bovis AF2122/97
gaccucucugcgccag

SEQ ID NO: 3153508 - RNA, 21 nt, Mycobacterium bovis subsp bovis AF2122/97
gaccucucugcgccaggcggc

SEQ ID NO: 3153509 - RNA, 22 nt, Mycobacterium bovis subsp bovis AF2122/97
gaccucucugcgccaggcggca

SEQ ID NO: 3153510 - RNA, 16 nt, Mycobacterium bovis subsp bovis AF2122/97
gaccucugcguccagc

SEQ ID NO: 3153511 - RNA, 16 nt, Mycobacterium bovis subsp bovis AF2122/97
gaccucuucgggcagc

SEQ ID NO: 3153512 - RNA, 20 nt, Mycobacterium bovis subsp bovis AF2122/97
gaccucuucgggcagcgcgu

SEQ ID NO: 3153513 - RNA, 13 nt, Mycobacterium bovis subsp bovis AF2122/97
gaccucuugcccu

SEQ ID NO: 3153514 - RNA, 20 nt, Mycobacterium bovis subsp bovis AF2122/97
gaccugaccgguggccaucg

SEQ ID NO: 3153515 - RNA, 15 nt, Mycobacterium bovis subsp bovis AF2122/97
gaccugacgcucggu

SEQ ID NO: 3153516 - RNA, 18 nt, Mycobacterium bovis subsp bovis AF2122/97
gaccugaggcaccucggc

SEQ ID NO: 3153517 - RNA, 17 nt, Mycobacterium bovis subsp bovis AF2122/97
gaccugauccggccggu

SEQ ID NO: 3153518 - RNA, 20 nt, Mycobacterium bovis subsp bovis AF2122/97
gaccugaugagcucaccggg

SEQ ID NO: 3153519 - RNA, 23 nt, Mycobacterium bovis subsp bovis AF2122/97
gaccugauggcgcugcaccguag

SEQ ID NO: 3153520 - RNA, 15 nt, Mycobacterium bovis subsp bovis AF2122/97
gaccugcaagacgcc

SEQ ID NO: 3153521 - RNA, 22 nt, Mycobacterium bovis subsp bovis AF2122/97
gaccugcccgucccgcucgagc

SEQ ID NO: 3153522 - RNA, 14 nt, Mycobacterium bovis subsp bovis AF2122/97
gaccugccggaccg

SEQ ID NO: 3153523 - RNA, 16 nt, Mycobacterium bovis subsp bovis AF2122/97
gaccugccggaccgcg

SEQ ID NO: 3153524 - RNA, 17 nt, Mycobacterium bovis subsp bovis AF2122/97
gaccugcgagaucggau

SEQ ID NO: 3153525 - RNA, 16 nt, Mycobacterium bovis subsp bovis AF2122/97
gaccugcgcgagguug

SEQ ID NO: 3153526 - RNA, 18 nt, Mycobacterium bovis subsp bovis AF2122/97
gacgacaacaggccgucg

SEQ ID NO: 3153527 - RNA, 16 nt, Mycobacterium bovis subsp bovis AF2122/97
gacgacaaccggccag

SEQ ID NO: 3153528 - RNA, 16 nt, Mycobacterium bovis subsp bovis AF2122/97
gacgacaagugcccgg

SEQ ID NO: 3153529 - RNA, 15 nt, Mycobacterium bovis subsp bovis AF2122/97
gacgacaccagagcg

SEQ ID NO: 3153530 - RNA, 13 nt, Mycobacterium bovis subsp bovis AF2122/97
gacgacaccgcga

SEQ ID NO: 3153531 - RNA, 19 nt, Mycobacterium bovis subsp bovis AF2122/97
gacgacacguugaccguga

SEQ ID NO: 3153532 - RNA, 15 nt, Mycobacterium bovis subsp bovis AF2122/97
gacgacaucgguggc

SEQ ID NO: 3153533 - RNA, 14 nt, Mycobacterium bovis subsp bovis AF2122/97
gacgaccaaccacc

SEQ ID NO: 3153534 - RNA, 20 nt, Mycobacterium bovis subsp bovis AF2122/97
gacgaccacaccacgauggc

SEQ ID NO: 3153535 - RNA, 22 nt, Mycobacterium bovis subsp bovis AF2122/97
gacgaccaccuucugacgcggc

SEQ ID NO: 3153536 - RNA, 15 nt, Mycobacterium bovis subsp bovis AF2122/97
gacgaccagccccgc

SEQ ID NO: 3153537 - RNA, 23 nt, Mycobacterium bovis subsp bovis AF2122/97
gacgaccauacuaauggcgccac

SEQ ID NO: 3153538 - RNA, 19 nt, Mycobacterium bovis subsp bovis AF2122/97
gacgaccaugccgaucggc

SEQ ID NO: 3153539 - RNA, 11 nt, Mycobacterium bovis subsp bovis AF2122/97
gacgacccggg

SEQ ID NO: 3153540 - RNA, 12 nt, Mycobacterium bovis subsp bovis AF2122/97
gacgaccgcgcg

SEQ ID NO: 3153541 - RNA, 14 nt, Mycobacterium bovis subsp bovis AF2122/97
gacgaccgcgcggc

SEQ ID NO: 3153542 - RNA, 15 nt, Mycobacterium bovis subsp bovis AF2122/97
gacgaccgcgcggca

SEQ ID NO: 3153543 - RNA, 12 nt, Mycobacterium bovis subsp bovis AF2122/97
gacgaccggcua

SEQ ID NO: 3153544 - RNA, 17 nt, Mycobacterium bovis subsp bovis AF2122/97
gacgaccgugcugggcg

SEQ ID NO: 3153545 - RNA, 19 nt, Mycobacterium bovis subsp bovis AF2122/97
gacgacgagggccagcagc

SEQ ID NO: 3153546 - RNA, 16 nt, Mycobacterium bovis subsp bovis AF2122/97
gacgacgagggcggga

SEQ ID NO: 3153547 - RNA, 15 nt, Mycobacterium bovis subsp bovis AF2122/97
gacgacgaucaagcc

SEQ ID NO: 3153548 - RNA, 14 nt, Mycobacterium bovis subsp bovis AF2122/97
gacgacgcccucac

SEQ ID NO: 3153549 - RNA, 20 nt, Mycobacterium bovis subsp bovis AF2122/97
gacgacgccgacgaugacgc

SEQ ID NO: 3153550 - RNA, 22 nt, Mycobacterium bovis subsp bovis AF2122/97
gacgacgcgcgcgauggacaac

SEQ ID NO: 3153551 - RNA, 18 nt, Mycobacterium bovis subsp bovis AF2122/97
gacgacggcgacggcgcc

SEQ ID NO: 3153552 - RNA, 22 nt, Mycobacterium bovis subsp bovis AF2122/97
gacgacguagaugguggucacc

SEQ ID NO: 3153553 - RNA, 20 nt, Mycobacterium bovis subsp bovis AF2122/97
gacgacguauucguuggggc

SEQ ID NO: 3153554 - RNA, 16 nt, Mycobacterium bovis subsp bovis AF2122/97
gacgacgucgccgccg

SEQ ID NO: 3153555 - RNA, 13 nt, Mycobacterium bovis subsp bovis AF2122/97
gacgacgucgcgc

SEQ ID NO: 3153556 - RNA, 18 nt, Mycobacterium bovis subsp bovis AF2122/97
gacgacgucggccgcauc

SEQ ID NO: 3153557 - RNA, 17 nt, Mycobacterium bovis subsp bovis AF2122/97
gacgacuccggcaagca

SEQ ID NO: 3153558 - RNA, 15 nt, Mycobacterium bovis subsp bovis AF2122/97
gacgacugggcgccc

SEQ ID NO: 3153559 - RNA, 17 nt, Mycobacterium bovis subsp bovis AF2122/97
gacgagaagacaccgcg

SEQ ID NO: 3153560 - RNA, 15 nt, Mycobacterium bovis subsp bovis AF2122/97
gacgagacggcagga

SEQ ID NO: 3153561 - RNA, 18 nt, Mycobacterium bovis subsp bovis AF2122/97
gacgagauacggccacca

SEQ ID NO: 3153562 - RNA, 20 nt, Mycobacterium bovis subsp bovis AF2122/97
gacgagauagcauccgcccg

SEQ ID NO: 3153563 - RNA, 22 nt, Mycobacterium bovis subsp bovis AF2122/97
gacgagauagcauccgcccgag

SEQ ID NO: 3153564 - RNA, 13 nt, Mycobacterium bovis subsp bovis AF2122/97
gacgagaucagcc

SEQ ID NO: 3153565 - RNA, 17 nt, Mycobacterium bovis subsp bovis AF2122/97
gacgagaucagccucgc

SEQ ID NO: 3153566 - RNA, 18 nt, Mycobacterium bovis subsp bovis AF2122/97
gacgagaucugcgauggg

SEQ ID NO: 3153567 - RNA, 21 nt, Mycobacterium bovis subsp bovis AF2122/97
gacgagauugccgggccgccg

SEQ ID NO: 3153568 - RNA, 18 nt, Mycobacterium bovis subsp bovis AF2122/97
gacgagcaacgccacccg

SEQ ID NO: 3153569 - RNA, 17 nt, Mycobacterium bovis subsp bovis AF2122/97
gacgagcacaugcucga

SEQ ID NO: 3153570 - RNA, 20 nt, Mycobacterium bovis subsp bovis AF2122/97
gacgagcacaugcucgacgc

SEQ ID NO: 3153571 - RNA, 15 nt, Mycobacterium bovis subsp bovis AF2122/97
gacgagccaccaccg

SEQ ID NO: 3153572 - RNA, 21 nt, Mycobacterium bovis subsp bovis AF2122/97
gacgagccaccaccgccgacc

SEQ ID NO: 3153573 - RNA, 22 nt, Mycobacterium bovis subsp bovis AF2122/97
gacgagccaccaccgccgaccc

SEQ ID NO: 3153574 - RNA, 17 nt, Mycobacterium bovis subsp bovis AF2122/97
gacgagcccaccgucgc

SEQ ID NO: 3153575 - RNA, 13 nt, Mycobacterium bovis subsp bovis AF2122/97
gacgagccgcggu

SEQ ID NO: 3153576 - RNA, 19 nt, Mycobacterium bovis subsp bovis AF2122/97
gacgagccgcggucggcgu

SEQ ID NO: 3153577 - RNA, 21 nt, Mycobacterium bovis subsp bovis AF2122/97
gacgagccgcggucggcgugc

SEQ ID NO: 3153578 - RNA, 14 nt, Mycobacterium bovis subsp bovis AF2122/97
gacgagcgauacgu

SEQ ID NO: 3153579 - RNA, 23 nt, Mycobacterium bovis subsp bovis AF2122/97
gacgagcgccucaagcucgccgg

SEQ ID NO: 3153580 - RNA, 20 nt, Mycobacterium bovis subsp bovis AF2122/97
gacgagcgucagauccggcc

SEQ ID NO: 3153581 - RNA, 20 nt, Mycobacterium bovis subsp bovis AF2122/97
gacgaggcaaugcgagcacc

SEQ ID NO: 3153582 - RNA, 13 nt, Mycobacterium bovis subsp bovis AF2122/97
gacgaggccacgg

SEQ ID NO: 3153583 - RNA, 16 nt, Mycobacterium bovis subsp bovis AF2122/97
gacgaggccacgggga

SEQ ID NO: 3153584 - RNA, 13 nt, Mycobacterium bovis subsp bovis AF2122/97
gacgaggcgagcg

SEQ ID NO: 3153585 - RNA, 16 nt, Mycobacterium bovis subsp bovis AF2122/97
gacgagggccagcagc

SEQ ID NO: 3153586 - RNA, 15 nt, Mycobacterium bovis subsp bovis AF2122/97
gacgagggcgggacc

SEQ ID NO: 3153587 - RNA, 17 nt, Mycobacterium bovis subsp bovis AF2122/97
gacgaggggcgcgggug

SEQ ID NO: 3153588 - RNA, 15 nt, Mycobacterium bovis subsp bovis AF2122/97
gacgaggucagcggu

SEQ ID NO: 3153589 - RNA, 17 nt, Mycobacterium bovis subsp bovis AF2122/97
gacgaggucagcgguug

SEQ ID NO: 3153590 - RNA, 16 nt, Mycobacterium bovis subsp bovis AF2122/97
gacgagguugccgcac

SEQ ID NO: 3153591 - RNA, 16 nt, Mycobacterium bovis subsp bovis AF2122/97
gacgagucgccgcggg

SEQ ID NO: 3153592 - RNA, 20 nt, Mycobacterium bovis subsp bovis AF2122/97
gacgagucgccgcgggcagc

SEQ ID NO: 3153593 - RNA, 16 nt, Mycobacterium bovis subsp bovis AF2122/97
gacgagucggcgggcg

SEQ ID NO: 3153594 - RNA, 18 nt, Mycobacterium bovis subsp bovis AF2122/97
gacgagugguccggcggc

SEQ ID NO: 3153595 - RNA, 24 nt, Mycobacterium bovis subsp bovis AF2122/97
gacgagugguccggcggccgguag

SEQ ID NO: 3153596 - RNA, 21 nt, Mycobacterium bovis subsp bovis AF2122/97
gacgaguuccgugcagaaacc

SEQ ID NO: 3153597 - RNA, 18 nt, Mycobacterium bovis subsp bovis AF2122/97
gacgauagcggcccgauc

SEQ ID NO: 3153598 - RNA, 21 nt, Mycobacterium bovis subsp bovis AF2122/97
gacgauaucgggagcggcugc

SEQ ID NO: 3153599 - RNA, 18 nt, Mycobacterium bovis subsp bovis AF2122/97
gacgaucaagcuggcccg

SEQ ID NO: 3153600 - RNA, 18 nt, Mycobacterium bovis subsp bovis AF2122/97
gacgaucacaugcaagcc

SEQ ID NO: 3153601 - RNA, 13 nt, Mycobacterium bovis subsp bovis AF2122/97
gacgaucaccccg

SEQ ID NO: 3153602 - RNA, 16 nt, Mycobacterium bovis subsp bovis AF2122/97
gacgaucaccccgcca

SEQ ID NO: 3153603 - RNA, 18 nt, Mycobacterium bovis subsp bovis AF2122/97
gacgaucaccccgccaug

SEQ ID NO: 3153604 - RNA, 14 nt, Mycobacterium bovis subsp bovis AF2122/97
gacgaucagcgagu

SEQ ID NO: 3153605 - RNA, 24 nt, Mycobacterium bovis subsp bovis AF2122/97
gacgaucagcgugaucugcagggc

SEQ ID NO: 3153606 - RNA, 18 nt, Mycobacterium bovis subsp bovis AF2122/97
gacgaucaggccgucgcc

SEQ ID NO: 3153607 - RNA, 22 nt, Mycobacterium bovis subsp bovis AF2122/97
gacgaucagggugucgaagagc

SEQ ID NO: 3153608 - RNA, 22 nt, Mycobacterium bovis subsp bovis AF2122/97
gacgaucaguccgauugguguc

SEQ ID NO: 3153609 - RNA, 19 nt, Mycobacterium bovis subsp bovis AF2122/97
gacgaucauauggccgccg

SEQ ID NO: 3153610 - RNA, 22 nt, Mycobacterium bovis subsp bovis AF2122/97
gacgaucauugcacccaccccg

SEQ ID NO: 3153611 - RNA, 15 nt, Mycobacterium bovis subsp bovis AF2122/97
gacgauccacggcga

SEQ ID NO: 3153612 - RNA, 17 nt, Mycobacterium bovis subsp bovis AF2122/97
gacgccaaugccgcgga

SEQ ID NO: 3153613 - RNA, 13 nt, Mycobacterium bovis subsp bovis AF2122/97
gacgccaccgcca

SEQ ID NO: 3153614 - RNA, 16 nt, Mycobacterium bovis subsp bovis AF2122/97
gacgccaccgccacca

SEQ ID NO: 3153615 - RNA, 17 nt, Mycobacterium bovis subsp bovis AF2122/97
gacgccaccgccaccac

SEQ ID NO: 3153616 - RNA, 23 nt, Mycobacterium bovis subsp bovis AF2122/97
gacgccaccgccaccacccaggc

SEQ ID NO: 3153617 - RNA, 13 nt, Mycobacterium bovis subsp bovis AF2122/97
gacgccaccgcga

SEQ ID NO: 3153618 - RNA, 21 nt, Mycobacterium bovis subsp bovis AF2122/97
gacgccaccugacgugcggcg

SEQ ID NO: 3153619 - RNA, 23 nt, Mycobacterium bovis subsp bovis AF2122/97
gacgccacgcgucuucggucgcg

SEQ ID NO: 3153620 - RNA, 19 nt, Mycobacterium bovis subsp bovis AF2122/97
gacgccagcugcccgacgu

SEQ ID NO: 3153621 - RNA, 20 nt, Mycobacterium bovis subsp bovis AF2122/97
gacgccagcugcccgacguu

SEQ ID NO: 3153622 - RNA, 21 nt, Mycobacterium bovis subsp bovis AF2122/97
gacgccaugagcgcgcccaac

SEQ ID NO: 3153623 - RNA, 21 nt, Mycobacterium bovis subsp bovis AF2122/97
gacgccaugcacguugccgaa

SEQ ID NO: 3153624 - RNA, 14 nt, Mycobacterium bovis subsp bovis AF2122/97
gacgccaugcccgc

SEQ ID NO: 3153625 - RNA, 16 nt, Mycobacterium bovis subsp bovis AF2122/97
gacgccaugcccgcac

SEQ ID NO: 3153626 - RNA, 17 nt, Mycobacterium bovis subsp bovis AF2122/97
gacgccaugcccgcacg

SEQ ID NO: 3153627 - RNA, 17 nt, Mycobacterium bovis subsp bovis AF2122/97
gacgccaugucgauguc

SEQ ID NO: 3153628 - RNA, 17 nt, Mycobacterium bovis subsp bovis AF2122/97
gacgccauucaucggca

SEQ ID NO: 3153629 - RNA, 20 nt, Mycobacterium bovis subsp bovis AF2122/97
gacgccauucaucggcaucg

SEQ ID NO: 3153630 - RNA, 20 nt, Mycobacterium bovis subsp bovis AF2122/97
gacgccauuguugggccgcc

SEQ ID NO: 3153631 - RNA, 14 nt, Mycobacterium bovis subsp bovis AF2122/97
gacgcccaccgaca

SEQ ID NO: 3153632 - RNA, 20 nt, Mycobacterium bovis subsp bovis AF2122/97
gacgcccaguugccgguugc

SEQ ID NO: 3153633 - RNA, 18 nt, Mycobacterium bovis subsp bovis AF2122/97
gacgccccgaucggccac

SEQ ID NO: 3153634 - RNA, 22 nt, Mycobacterium bovis subsp bovis AF2122/97
gacgccccgucuggcaugaccg

SEQ ID NO: 3153635 - RNA, 19 nt, Mycobacterium bovis subsp bovis AF2122/97
gacgcccgauacgccaccg

SEQ ID NO: 3153636 - RNA, 14 nt, Mycobacterium bovis subsp bovis AF2122/97
gacgcccgcccgca

SEQ ID NO: 3153637 - RNA, 17 nt, Mycobacterium bovis subsp bovis AF2122/97
gacgcccgcuccgcggc

SEQ ID NO: 3153638 - RNA, 14 nt, Mycobacterium bovis subsp bovis AF2122/97
gacgcccggcaccc

SEQ ID NO: 3153639 - RNA, 15 nt, Mycobacterium bovis subsp bovis AF2122/97
gacgcccggcgcacc

SEQ ID NO: 3153640 - RNA, 18 nt, Mycobacterium bovis subsp bovis AF2122/97
gacgcccggcgcaccauc

SEQ ID NO: 3153641 - RNA, 17 nt, Mycobacterium bovis subsp bovis AF2122/97
gacgcccgggcaccggc

SEQ ID NO: 3153642 - RNA, 14 nt, Mycobacterium bovis subsp bovis AF2122/97
gacgcccucacgcc

SEQ ID NO: 3153643 - RNA, 22 nt, Mycobacterium bovis subsp bovis AF2122/97
gacgcccuccuggcggguggcg

SEQ ID NO: 3153644 - RNA, 14 nt, Mycobacterium bovis subsp bovis AF2122/97
gacgcccucggggu

SEQ ID NO: 3153645 - RNA, 19 nt, Mycobacterium bovis subsp bovis AF2122/97
gacgccgaaaaugccgccc

SEQ ID NO: 3153646 - RNA, 20 nt, Mycobacterium bovis subsp bovis AF2122/97
gacgccgaaaaugccgccca

SEQ ID NO: 3153647 - RNA, 20 nt, Mycobacterium bovis subsp bovis AF2122/97
gacgccgaauacggcugccu

SEQ ID NO: 3153648 - RNA, 16 nt, Mycobacterium bovis subsp bovis AF2122/97
gacgccgaccacccgg

SEQ ID NO: 3153649 - RNA, 14 nt, Mycobacterium bovis subsp bovis AF2122/97
gacgccgacgauga

SEQ ID NO: 3153650 - RNA, 17 nt, Mycobacterium bovis subsp bovis AF2122/97
gacgccgacgaugacgc

SEQ ID NO: 3153651 - RNA, 17 nt, Mycobacterium bovis subsp bovis AF2122/97
gacgccgagaccgccgc

SEQ ID NO: 3153652 - RNA, 22 nt, Mycobacterium bovis subsp bovis AF2122/97
gacgccgagaccgccgcugccg

SEQ ID NO: 3153653 - RNA, 22 nt, Mycobacterium bovis subsp bovis AF2122/97
gacgccgauacuaaacaggccg

SEQ ID NO: 3153654 - RNA, 17 nt, Mycobacterium bovis subsp bovis AF2122/97
gacgccgauccgguggc

SEQ ID NO: 3153655 - RNA, 18 nt, Mycobacterium bovis subsp bovis AF2122/97
gacgccgaucgcggcggc

SEQ ID NO: 3153656 - RNA, 19 nt, Mycobacterium bovis subsp bovis AF2122/97
gacgccgaugugcucgguu

SEQ ID NO: 3153657 - RNA, 19 nt, Mycobacterium bovis subsp bovis AF2122/97
gacgccgccacccggcggg

SEQ ID NO: 3153658 - RNA, 20 nt, Mycobacterium bovis subsp bovis AF2122/97
gacgccgccacccggcgggc

SEQ ID NO: 3153659 - RNA, 21 nt, Mycobacterium bovis subsp bovis AF2122/97
gacgccgccacccggcgggcg

SEQ ID NO: 3153660 - RNA, 16 nt, Mycobacterium bovis subsp bovis AF2122/97
gacgccgccagcaccu

SEQ ID NO: 3153661 - RNA, 20 nt, Mycobacterium bovis subsp bovis AF2122/97
gacgccgccagguccgccgg

SEQ ID NO: 3153662 - RNA, 14 nt, Mycobacterium bovis subsp bovis AF2122/97
gacgccgcccccgu

SEQ ID NO: 3153663 - RNA, 17 nt, Mycobacterium bovis subsp bovis AF2122/97
gacgccgcccccguggg

SEQ ID NO: 3153664 - RNA, 21 nt, Mycobacterium bovis subsp bovis AF2122/97
gacgccgccgcugccgcccuu

SEQ ID NO: 3153665 - RNA, 11 nt, Mycobacterium bovis subsp bovis AF2122/97
gacgccgccgg

SEQ ID NO: 3153666 - RNA, 15 nt, Mycobacterium bovis subsp bovis AF2122/97
gacgccgccggcccc

SEQ ID NO: 3153667 - RNA, 19 nt, Mycobacterium bovis subsp bovis AF2122/97
gacgccgccggccccgccg

SEQ ID NO: 3153668 - RNA, 14 nt, Mycobacterium bovis subsp bovis AF2122/97
gacgccgccggcgc

SEQ ID NO: 3153669 - RNA, 13 nt, Mycobacterium bovis subsp bovis AF2122/97
gacgccgccguug

SEQ ID NO: 3153670 - RNA, 24 nt, Mycobacterium bovis subsp bovis AF2122/97
gacgccgccguuguugaggaugac

SEQ ID NO: 3153671 - RNA, 16 nt, Mycobacterium bovis subsp bovis AF2122/97
gacgccgcgcagccgg

SEQ ID NO: 3153672 - RNA, 20 nt, Mycobacterium bovis subsp bovis AF2122/97
gacgccgcgcagccggcccg

SEQ ID NO: 3153673 - RNA, 19 nt, Mycobacterium bovis subsp bovis AF2122/97
gacgccgcgccggcgggcg

SEQ ID NO: 3153674 - RNA, 16 nt, Mycobacterium bovis subsp bovis AF2122/97
gacgccgcggcgccgg

SEQ ID NO: 3153675 - RNA, 16 nt, Mycobacterium bovis subsp bovis AF2122/97
gacgccggccagcggc

SEQ ID NO: 3153676 - RNA, 15 nt, Mycobacterium bovis subsp bovis AF2122/97
gacgccggcccgacg

SEQ ID NO: 3153677 - RNA, 20 nt, Mycobacterium bovis subsp bovis AF2122/97
gacgccggccuggccgccag

SEQ ID NO: 3153678 - RNA, 15 nt, Mycobacterium bovis subsp bovis AF2122/97
gacgccggcgccgcc

SEQ ID NO: 3153679 - RNA, 16 nt, Mycobacterium bovis subsp bovis AF2122/97
gacgccggcgccgcca

SEQ ID NO: 3153680 - RNA, 22 nt, Mycobacterium bovis subsp bovis AF2122/97
gacgccggcggguggcccccgc

SEQ ID NO: 3153681 - RNA, 23 nt, Mycobacterium bovis subsp bovis AF2122/97
gacgccggggaaccuugaccgac

SEQ ID NO: 3153682 - RNA, 16 nt, Mycobacterium bovis subsp bovis AF2122/97
gacgccggucacggca

SEQ ID NO: 3153683 - RNA, 12 nt, Mycobacterium bovis subsp bovis AF2122/97
gacgccgguccc

SEQ ID NO: 3153684 - RNA, 14 nt, Mycobacterium bovis subsp bovis AF2122/97
gacgccggugccgg

SEQ ID NO: 3153685 - RNA, 22 nt, Mycobacterium bovis subsp bovis AF2122/97
gacgccgguggcagagccgccg

SEQ ID NO: 3153686 - RNA, 22 nt, Mycobacterium bovis subsp bovis AF2122/97
gacgccggugucggcuggucgc

SEQ ID NO: 3153687 - RNA, 16 nt, Mycobacterium bovis subsp bovis AF2122/97
gacgccguaucggcgu

SEQ ID NO: 3153688 - RNA, 15 nt, Mycobacterium bovis subsp bovis AF2122/97
gacgccgucagcggc

SEQ ID NO: 3153689 - RNA, 13 nt, Mycobacterium bovis subsp bovis AF2122/97
gacgccguccucg

SEQ ID NO: 3153690 - RNA, 15 nt, Mycobacterium bovis subsp bovis AF2122/97
gacgccguccucgcu

SEQ ID NO: 3153691 - RNA, 12 nt, Mycobacterium bovis subsp bovis AF2122/97
gacgccgucgac

SEQ ID NO: 3153692 - RNA, 13 nt, Mycobacterium bovis subsp bovis AF2122/97
gacgccgucggac

SEQ ID NO: 3153693 - RNA, 13 nt, Mycobacterium bovis subsp bovis AF2122/97
gacgccgucggcg

SEQ ID NO: 3153694 - RNA, 14 nt, Mycobacterium bovis subsp bovis AF2122/97
gacgccgucggcgc

SEQ ID NO: 3153695 - RNA, 19 nt, Mycobacterium bovis subsp bovis AF2122/97
gacgccgucggcgccggca

SEQ ID NO: 3153696 - RNA, 20 nt, Mycobacterium bovis subsp bovis AF2122/97
gacgccgucggcgccggcau

SEQ ID NO: 3153697 - RNA, 17 nt, Mycobacterium bovis subsp bovis AF2122/97
gacgccgucggcgcgca

SEQ ID NO: 3153698 - RNA, 21 nt, Mycobacterium bovis subsp bovis AF2122/97
gacgccgucggcgcgcaccuc

SEQ ID NO: 3153699 - RNA, 20 nt, Mycobacterium bovis subsp bovis AF2122/97
gacggaccaucuccggugug

SEQ ID NO: 3153700 - RNA, 22 nt, Mycobacterium bovis subsp bovis AF2122/97
gacggacucccucgaucacggc

SEQ ID NO: 3153701 - RNA, 20 nt, Mycobacterium bovis subsp bovis AF2122/97
gacggaggucggagcgggcu

SEQ ID NO: 3153702 - RNA, 18 nt, Mycobacterium bovis subsp bovis AF2122/97
gacggagguguggucgag

SEQ ID NO: 3153703 - RNA, 20 nt, Mycobacterium bovis subsp bovis AF2122/97
gacggagguguggucgagcg

SEQ ID NO: 3153704 - RNA, 15 nt, Mycobacterium bovis subsp bovis AF2122/97
gacggaguuggcccg

SEQ ID NO: 3153705 - RNA, 18 nt, Mycobacterium bovis subsp bovis AF2122/97
gacggaguuggcccgacg

SEQ ID NO: 3153706 - RNA, 22 nt, Mycobacterium bovis subsp bovis AF2122/97
gacggaguuggcccgacgcagc

SEQ ID NO: 3153707 - RNA, 15 nt, Mycobacterium bovis subsp bovis AF2122/97
gacggaugaucagcg

SEQ ID NO: 3153708 - RNA, 16 nt, Mycobacterium bovis subsp bovis AF2122/97
gacggaugaucagcga

SEQ ID NO: 3153709 - RNA, 21 nt, Mycobacterium bovis subsp bovis AF2122/97
gacggcaaaacacaccgaaca

SEQ ID NO: 3153710 - RNA, 19 nt, Mycobacterium bovis subsp bovis AF2122/97
gacggcaaaccaguuggcg

SEQ ID NO: 3153711 - RNA, 23 nt, Mycobacterium bovis subsp bovis AF2122/97
gacggcaaaccaguuggcgauca

SEQ ID NO: 3153712 - RNA, 14 nt, Mycobacterium bovis subsp bovis AF2122/97
gacggcaagggcau

SEQ ID NO: 3153713 - RNA, 19 nt, Mycobacterium bovis subsp bovis AF2122/97
gacggcaagggcauacagc

SEQ ID NO: 3153714 - RNA, 16 nt, Mycobacterium bovis subsp bovis AF2122/97
gacggcaaugcggggc

SEQ ID NO: 3153715 - RNA, 17 nt, Mycobacterium bovis subsp bovis AF2122/97
gacggcacccccgacga

SEQ ID NO: 3153716 - RNA, 15 nt, Mycobacterium bovis subsp bovis AF2122/97
gacggcacccgacuc

SEQ ID NO: 3153717 - RNA, 12 nt, Mycobacterium bovis subsp bovis AF2122/97
gacggcaccggc

SEQ ID NO: 3153718 - RNA, 16 nt, Mycobacterium bovis subsp bovis AF2122/97
gacggcaccggcccag

SEQ ID NO: 3153719 - RNA, 17 nt, Mycobacterium bovis subsp bovis AF2122/97
gacggcaccggcccaga

SEQ ID NO: 3153720 - RNA, 15 nt, Mycobacterium bovis subsp bovis AF2122/97
gacggcagccaccag

SEQ ID NO: 3153721 - RNA, 17 nt, Mycobacterium bovis subsp bovis AF2122/97
gacggcagccaccagcg

SEQ ID NO: 3153722 - RNA, 13 nt, Mycobacterium bovis subsp bovis AF2122/97
gacggcagccagc

SEQ ID NO: 3153723 - RNA, 15 nt, Mycobacterium bovis subsp bovis AF2122/97
gacggcagccagcca

SEQ ID NO: 3153724 - RNA, 14 nt, Mycobacterium bovis subsp bovis AF2122/97
gacggcaggcucgg

SEQ ID NO: 3153725 - RNA, 16 nt, Mycobacterium bovis subsp bovis AF2122/97
gacggcaggcucgggc

SEQ ID NO: 3153726 - RNA, 15 nt, Mycobacterium bovis subsp bovis AF2122/97
gacggcaggcuggcg

SEQ ID NO: 3153727 - RNA, 13 nt, Mycobacterium bovis subsp bovis AF2122/97
gacggcagugcug

SEQ ID NO: 3153728 - RNA, 17 nt, Mycobacterium bovis subsp bovis AF2122/97
gacggcagugcugcaga

SEQ ID NO: 3153729 - RNA, 19 nt, Mycobacterium bovis subsp bovis AF2122/97
gacggcauagcagccagcg

SEQ ID NO: 3153730 - RNA, 22 nt, Mycobacterium bovis subsp bovis AF2122/97
gacggcauagcagccagcgucc

SEQ ID NO: 3153731 - RNA, 19 nt, Mycobacterium bovis subsp bovis AF2122/97
gacggcaucaacgcgggcg

SEQ ID NO: 3153732 - RNA, 22 nt, Mycobacterium bovis subsp bovis AF2122/97
gacggcauguaccgaccgcguu

SEQ ID NO: 3153733 - RNA, 18 nt, Mycobacterium bovis subsp bovis AF2122/97
gacggcauuucagcgcgc

SEQ ID NO: 3153734 - RNA, 19 nt, Mycobacterium bovis subsp bovis AF2122/97
gacggcauuucagcgcgcc

SEQ ID NO: 3153735 - RNA, 23 nt, Mycobacterium bovis subsp bovis AF2122/97
gacggcauuucagcgcgccgcgu

SEQ ID NO: 3153736 - RNA, 14 nt, Mycobacterium bovis subsp bovis AF2122/97
gacggccacaugga

SEQ ID NO: 3153737 - RNA, 15 nt, Mycobacterium bovis subsp bovis AF2122/97
gacggccaccggggu

SEQ ID NO: 3153738 - RNA, 22 nt, Mycobacterium bovis subsp bovis AF2122/97
gacggccacguaagcgguuguc

SEQ ID NO: 3153739 - RNA, 20 nt, Mycobacterium bovis subsp bovis AF2122/97
gacggccagcaagacgauga

SEQ ID NO: 3153740 - RNA, 16 nt, Mycobacterium bovis subsp bovis AF2122/97
gacggccagcccagca

SEQ ID NO: 3153741 - RNA, 13 nt, Mycobacterium bovis subsp bovis AF2122/97
gacggccagcgcg

SEQ ID NO: 3153742 - RNA, 17 nt, Mycobacterium bovis subsp bovis AF2122/97
gacggccagugcgcaga

SEQ ID NO: 3153743 - RNA, 23 nt, Mycobacterium bovis subsp bovis AF2122/97
gacggccaucgccagccugugcu

SEQ ID NO: 3153744 - RNA, 17 nt, Mycobacterium bovis subsp bovis AF2122/97
gacggccauggacgcca

SEQ ID NO: 3153745 - RNA, 12 nt, Mycobacterium bovis subsp bovis AF2122/97
gacggcccgauc

SEQ ID NO: 3153746 - RNA, 14 nt, Mycobacterium bovis subsp bovis AF2122/97
gacggcccgccguc

SEQ ID NO: 3153747 - RNA, 20 nt, Mycobacterium bovis subsp bovis AF2122/97
gacggcccucgagcagcgug

SEQ ID NO: 3153748 - RNA, 16 nt, Mycobacterium bovis subsp bovis AF2122/97
gacggccgccagcagc

SEQ ID NO: 3153749 - RNA, 22 nt, Mycobacterium bovis subsp bovis AF2122/97
gacggccgccagcagcuucucg

SEQ ID NO: 3153750 - RNA, 15 nt, Mycobacterium bovis subsp bovis AF2122/97
gacggccgcggcguc

SEQ ID NO: 3153751 - RNA, 17 nt, Mycobacterium bovis subsp bovis AF2122/97
gacggccggcggucggg

SEQ ID NO: 3153752 - RNA, 12 nt, Mycobacterium bovis subsp bovis AF2122/97
gacggccgggac

SEQ ID NO: 3153753 - RNA, 14 nt, Mycobacterium bovis subsp bovis AF2122/97
gacggccgucgccc

SEQ ID NO: 3153754 - RNA, 23 nt, Mycobacterium bovis subsp bovis AF2122/97
gacggccucgucgauguucgccg

SEQ ID NO: 3153755 - RNA, 19 nt, Mycobacterium bovis subsp bovis AF2122/97
gacggccuggggcagccgg

SEQ ID NO: 3153756 - RNA, 22 nt, Mycobacterium bovis subsp bovis AF2122/97
gacggccuggggcagccgggcg

SEQ ID NO: 3153757 - RNA, 17 nt, Mycobacterium bovis subsp bovis AF2122/97
gacggcgaaaaucccgc

SEQ ID NO: 3153758 - RNA, 22 nt, Mycobacterium bovis subsp bovis AF2122/97
gacggcgaaaaucccgcucccc

SEQ ID NO: 3153759 - RNA, 15 nt, Mycobacterium bovis subsp bovis AF2122/97
gacggcgaacccgcc

SEQ ID NO: 3153760 - RNA, 17 nt, Mycobacterium bovis subsp bovis AF2122/97
gacggcgaacccgccga

SEQ ID NO: 3153761 - RNA, 18 nt, Mycobacterium bovis subsp bovis AF2122/97
gacggcgaacccgccgau

SEQ ID NO: 3153762 - RNA, 21 nt, Mycobacterium bovis subsp bovis AF2122/97
gacggcgacgaugucgacucg

SEQ ID NO: 3153763 - RNA, 15 nt, Mycobacterium bovis subsp bovis AF2122/97
gacggcgacggcgcc

SEQ ID NO: 3153764 - RNA, 16 nt, Mycobacterium bovis subsp bovis AF2122/97
gacggcgacggcgccc

SEQ ID NO: 3153765 - RNA, 17 nt, Mycobacterium bovis subsp bovis AF2122/97
gacggcgauauaggacg

SEQ ID NO: 3153766 - RNA, 14 nt, Mycobacterium bovis subsp bovis AF2122/97
gacggcgauggcgc

SEQ ID NO: 3153767 - RNA, 15 nt, Mycobacterium bovis subsp bovis AF2122/97
gacggcgauggcgcg

SEQ ID NO: 3153768 - RNA, 16 nt, Mycobacterium bovis subsp bovis AF2122/97
gacggcgauggcgcgc

SEQ ID NO: 3153769 - RNA, 17 nt, Mycobacterium bovis subsp bovis AF2122/97
gacggcgauggcgcgca

SEQ ID NO: 3153770 - RNA, 18 nt, Mycobacterium bovis subsp bovis AF2122/97
gacggcgcaacaccucgu

SEQ ID NO: 3153771 - RNA, 14 nt, Mycobacterium bovis subsp bovis AF2122/97
gacggcgccaggca

SEQ ID NO: 3153772 - RNA, 18 nt, Mycobacterium bovis subsp bovis AF2122/97
gacggcgccaggcaccac

SEQ ID NO: 3153773 - RNA, 19 nt, Mycobacterium bovis subsp bovis AF2122/97
gacggcgccauuggcgucc

SEQ ID NO: 3153774 - RNA, 22 nt, Mycobacterium bovis subsp bovis AF2122/97
gacggcgccauuggcgucccgc

SEQ ID NO: 3153775 - RNA, 24 nt, Mycobacterium bovis subsp bovis AF2122/97
gacggcgcccgcccgagccgcugc

SEQ ID NO: 3153776 - RNA, 14 nt, Mycobacterium bovis subsp bovis AF2122/97
gacggcgccgaacc

SEQ ID NO: 3153777 - RNA, 13 nt, Mycobacterium bovis subsp bovis AF2122/97
gacggcgccgccc

SEQ ID NO: 3153778 - RNA, 16 nt, Mycobacterium bovis subsp bovis AF2122/97
gacggcgccgucgaaa

SEQ ID NO: 3153779 - RNA, 17 nt, Mycobacterium bovis subsp bovis AF2122/97
gacggcgcgagccgcac

SEQ ID NO: 3153780 - RNA, 19 nt, Mycobacterium bovis subsp bovis AF2122/97
gacggcgcgagccgcacga

SEQ ID NO: 3153781 - RNA, 12 nt, Mycobacterium bovis subsp bovis AF2122/97
gacggcgcucgg

SEQ ID NO: 3153782 - RNA, 15 nt, Mycobacterium bovis subsp bovis AF2122/97
gacggcgcucggcga

SEQ ID NO: 3153783 - RNA, 17 nt, Mycobacterium bovis subsp bovis AF2122/97
gacggcgcucggcgagc

SEQ ID NO: 3153784 - RNA, 18 nt, Mycobacterium bovis subsp bovis AF2122/97
gacggcgcucggcgagcu

SEQ ID NO: 3153785 - RNA, 16 nt, Mycobacterium bovis subsp bovis AF2122/97
gacggcgcuguggcgg

SEQ ID NO: 3153786 - RNA, 17 nt, Mycobacterium bovis subsp bovis AF2122/97
gacgggucucgcgagcg

SEQ ID NO: 3153787 - RNA, 18 nt, Mycobacterium bovis subsp bovis AF2122/97
gacgggugcagcgcaacc

SEQ ID NO: 3153788 - RNA, 16 nt, Mycobacterium bovis subsp bovis AF2122/97
gacgggugcgggccga

SEQ ID NO: 3153789 - RNA, 16 nt, Mycobacterium bovis subsp bovis AF2122/97
gacggguggcccgacc

SEQ ID NO: 3153790 - RNA, 15 nt, Mycobacterium bovis subsp bovis AF2122/97
gacggguucacccug

SEQ ID NO: 3153791 - RNA, 18 nt, Mycobacterium bovis subsp bovis AF2122/97
gacgguaaaugucgaaca

SEQ ID NO: 3153792 - RNA, 20 nt, Mycobacterium bovis subsp bovis AF2122/97
gacgguaggcccgcgcgaga

SEQ ID NO: 3153793 - RNA, 12 nt, Mycobacterium bovis subsp bovis AF2122/97
gacggucaacga

SEQ ID NO: 3153794 - RNA, 16 nt, Mycobacterium bovis subsp bovis AF2122/97
gacggucaacgacauu

SEQ ID NO: 3153795 - RNA, 17 nt, Mycobacterium bovis subsp bovis AF2122/97
gacggucaaggugcgcc

SEQ ID NO: 3153796 - RNA, 20 nt, Mycobacterium bovis subsp bovis AF2122/97
gacggucaaggugcgccgcc

SEQ ID NO: 3153797 - RNA, 21 nt, Mycobacterium bovis subsp bovis AF2122/97
gacggucaaggugcgccgcca

SEQ ID NO: 3153798 - RNA, 18 nt, Mycobacterium bovis subsp bovis AF2122/97
gacggucacggugguguc

SEQ ID NO: 3153799 - RNA, 16 nt, Mycobacterium bovis subsp bovis AF2122/97
gacggucagccgcggg

SEQ ID NO: 3153800 - RNA, 17 nt, Mycobacterium bovis subsp bovis AF2122/97
gacggucagccgcgggg

SEQ ID NO: 3153801 - RNA, 18 nt, Mycobacterium bovis subsp bovis AF2122/97
gacggucagccgcggggc

SEQ ID NO: 3153802 - RNA, 23 nt, Mycobacterium bovis subsp bovis AF2122/97
gacggucaucgcuguaggcagcc

SEQ ID NO: 3153803 - RNA, 20 nt, Mycobacterium bovis subsp bovis AF2122/97
gacgguccacgacgucgagc

SEQ ID NO: 3153804 - RNA, 13 nt, Mycobacterium bovis subsp bovis AF2122/97
gacgguccguucg

SEQ ID NO: 3153805 - RNA, 21 nt, Mycobacterium bovis subsp bovis AF2122/97
gacgguccguucgaugccagu

SEQ ID NO: 3153806 - RNA, 16 nt, Mycobacterium bovis subsp bovis AF2122/97
gacgguccuggcccgc

SEQ ID NO: 3153807 - RNA, 18 nt, Mycobacterium bovis subsp bovis AF2122/97
gacgguccuggcccgcug

SEQ ID NO: 3153808 - RNA, 16 nt, Mycobacterium bovis subsp bovis AF2122/97
gacggucggcggaaac

SEQ ID NO: 3153809 - RNA, 14 nt, Mycobacterium bovis subsp bovis AF2122/97
gacggucgucgauc

SEQ ID NO: 3153810 - RNA, 15 nt, Mycobacterium bovis subsp bovis AF2122/97
gacggugaaaccggc

SEQ ID NO: 3153811 - RNA, 16 nt, Mycobacterium bovis subsp bovis AF2122/97
gacggugaaccaccac

SEQ ID NO: 3153812 - RNA, 17 nt, Mycobacterium bovis subsp bovis AF2122/97
gacggugaagccgagcg

SEQ ID NO: 3153813 - RNA, 17 nt, Mycobacterium bovis subsp bovis AF2122/97
gacggugaagccguuug

SEQ ID NO: 3153814 - RNA, 12 nt, Mycobacterium bovis subsp bovis AF2122/97
gacggugaccgg

SEQ ID NO: 3153815 - RNA, 13 nt, Mycobacterium bovis subsp bovis AF2122/97
gacggugacgacc

SEQ ID NO: 3153816 - RNA, 14 nt, Mycobacterium bovis subsp bovis AF2122/97
gacggugacgacca

SEQ ID NO: 3153817 - RNA, 16 nt, Mycobacterium bovis subsp bovis AF2122/97
gacggugacgaccacg

SEQ ID NO: 3153818 - RNA, 22 nt, Mycobacterium bovis subsp bovis AF2122/97
gacggugacgaucaggccgucg

SEQ ID NO: 3153819 - RNA, 16 nt, Mycobacterium bovis subsp bovis AF2122/97
gacggugagggcgucg

SEQ ID NO: 3153820 - RNA, 21 nt, Mycobacterium bovis subsp bovis AF2122/97
gacggugagggcgucgucgag

SEQ ID NO: 3153821 - RNA, 14 nt, Mycobacterium bovis subsp bovis AF2122/97
gacggugauggggg

SEQ ID NO: 3153822 - RNA, 24 nt, Mycobacterium bovis subsp bovis AF2122/97
gacggugcagcuccccgccggaac

SEQ ID NO: 3153823 - RNA, 21 nt, Mycobacterium bovis subsp bovis AF2122/97
gacggugccgucggugccgcg

SEQ ID NO: 3153824 - RNA, 20 nt, Mycobacterium bovis subsp bovis AF2122/97
gacggugcgcagggccugga

SEQ ID NO: 3153825 - RNA, 15 nt, Mycobacterium bovis subsp bovis AF2122/97
gacggugcgcuggau

SEQ ID NO: 3153826 - RNA, 20 nt, Mycobacterium bovis subsp bovis AF2122/97
gacggugcgggcuaggcggc

SEQ ID NO: 3153827 - RNA, 13 nt, Mycobacterium bovis subsp bovis AF2122/97
gacgguggccggc

SEQ ID NO: 3153828 - RNA, 14 nt, Mycobacterium bovis subsp bovis AF2122/97
gacgguggccggca

SEQ ID NO: 3153829 - RNA, 16 nt, Mycobacterium bovis subsp bovis AF2122/97
gacgguggcgccgucg

SEQ ID NO: 3153830 - RNA, 21 nt, Mycobacterium bovis subsp bovis AF2122/97
gacgguggcgccgucggccga

SEQ ID NO: 3153831 - RNA, 18 nt, Mycobacterium bovis subsp bovis AF2122/97
gacgguggggauggcgcc

SEQ ID NO: 3153832 - RNA, 18 nt, Mycobacterium bovis subsp bovis AF2122/97
gacgguggggucgccguc

SEQ ID NO: 3153833 - RNA, 14 nt, Mycobacterium bovis subsp bovis AF2122/97
gacggugguccuga

SEQ ID NO: 3153834 - RNA, 22 nt, Mycobacterium bovis subsp bovis AF2122/97
gacgguggugaccgcgggcgcc

SEQ ID NO: 3153835 - RNA, 19 nt, Mycobacterium bovis subsp bovis AF2122/97
gacgguguagccgccggca

SEQ ID NO: 3153836 - RNA, 19 nt, Mycobacterium bovis subsp bovis AF2122/97
gacggugucaugaacgacc

SEQ ID NO: 3153837 - RNA, 20 nt, Mycobacterium bovis subsp bovis AF2122/97
gacggugucuugggcguccu

SEQ ID NO: 3153838 - RNA, 17 nt, Mycobacterium bovis subsp bovis AF2122/97
gacgguguggaaaccgc

SEQ ID NO: 3153839 - RNA, 18 nt, Mycobacterium bovis subsp bovis AF2122/97
gacgguguggaaaccgcg

SEQ ID NO: 3153840 - RNA, 17 nt, Mycobacterium bovis subsp bovis AF2122/97
gacgguguugguggcgg

SEQ ID NO: 3153841 - RNA, 21 nt, Mycobacterium bovis subsp bovis AF2122/97
gacgguucauccacuccgcca

SEQ ID NO: 3153842 - RNA, 16 nt, Mycobacterium bovis subsp bovis AF2122/97
gacgguuccgccaccg

SEQ ID NO: 3153843 - RNA, 17 nt, Mycobacterium bovis subsp bovis AF2122/97
gacgguuccgccaccgg

SEQ ID NO: 3153844 - RNA, 19 nt, Mycobacterium bovis subsp bovis AF2122/97
gacgguuccgccaccggac

SEQ ID NO: 3153845 - RNA, 15 nt, Mycobacterium bovis subsp bovis AF2122/97
gacgguucggucggg

SEQ ID NO: 3153846 - RNA, 19 nt, Mycobacterium bovis subsp bovis AF2122/97
gacgguugccccggcgacc

SEQ ID NO: 3153847 - RNA, 16 nt, Mycobacterium bovis subsp bovis AF2122/97
gacgguuucgaccacc

SEQ ID NO: 3153848 - RNA, 19 nt, Mycobacterium bovis subsp bovis AF2122/97
gacguaaaagcccccauuu

SEQ ID NO: 3153849 - RNA, 16 nt, Mycobacterium bovis subsp bovis AF2122/97
gacguaaccgcuggcc

SEQ ID NO: 3153850 - RNA, 21 nt, Mycobacterium bovis subsp bovis AF2122/97
gacguaaugcgcugccgccgu

SEQ ID NO: 3153851 - RNA, 16 nt, Mycobacterium bovis subsp bovis AF2122/97
gacguacagcgcggcg

SEQ ID NO: 3153852 - RNA, 14 nt, Mycobacterium bovis subsp bovis AF2122/97
gacguaccacggcg

SEQ ID NO: 3153853 - RNA, 15 nt, Mycobacterium bovis subsp bovis AF2122/97
gacguaccacggcga

SEQ ID NO: 3153854 - RNA, 19 nt, Mycobacterium bovis subsp bovis AF2122/97
gacguacggggucgccggc

SEQ ID NO: 3153855 - RNA, 18 nt, Mycobacterium bovis subsp bovis AF2122/97
gacguagaaugcgccguc

SEQ ID NO: 3153856 - RNA, 21 nt, Mycobacterium bovis subsp bovis AF2122/97
gacguagaccacgccggugac

SEQ ID NO: 3153857 - RNA, 15 nt, Mycobacterium bovis subsp bovis AF2122/97
gacguagaccgucga

SEQ ID NO: 3153858 - RNA, 21 nt, Mycobacterium bovis subsp bovis AF2122/97
gacguagaccgucgauccguc

SEQ ID NO: 3153859 - RNA, 11 nt, Mycobacterium bovis subsp bovis AF2122/97
gacguagacga

SEQ ID NO: 3153860 - RNA, 11 nt, Mycobacterium bovis subsp bovis AF2122/97
gacguagacgg

SEQ ID NO: 3153861 - RNA, 21 nt, Mycobacterium bovis subsp bovis AF2122/97
gacguagaugguggucaccac

SEQ ID NO: 3153862 - RNA, 22 nt, Mycobacterium bovis subsp bovis AF2122/97
gacguagaugguggucaccacc

SEQ ID NO: 3153863 - RNA, 19 nt, Mycobacterium bovis subsp bovis AF2122/97
gacguagauguugccgccc

SEQ ID NO: 3153864 - RNA, 20 nt, Mycobacterium bovis subsp bovis AF2122/97
gacguagauguugccgccug

SEQ ID NO: 3153865 - RNA, 18 nt, Mycobacterium bovis subsp bovis AF2122/97
gacguaggacugccagcg

SEQ ID NO: 3153866 - RNA, 15 nt, Mycobacterium bovis subsp bovis AF2122/97
gacguaggcggcggc

SEQ ID NO: 3153867 - RNA, 21 nt, Mycobacterium bovis subsp bovis AF2122/97
gacguaggcggcggcccgcag

SEQ ID NO: 3153868 - RNA, 23 nt, Mycobacterium bovis subsp bovis AF2122/97
gacguaguugccggcuucggcga

SEQ ID NO: 3153869 - RNA, 12 nt, Mycobacterium bovis subsp bovis AF2122/97
gacguaucgccg

SEQ ID NO: 3153870 - RNA, 14 nt, Mycobacterium bovis subsp bovis AF2122/97
gacguauuggcgca

SEQ ID NO: 3153871 - RNA, 17 nt, Mycobacterium bovis subsp bovis AF2122/97
gacguauuggcgcagca

SEQ ID NO: 3153872 - RNA, 17 nt, Mycobacterium bovis subsp bovis AF2122/97
gacgucaccacgaucgc

SEQ ID NO: 3153873 - RNA, 23 nt, Mycobacterium bovis subsp bovis AF2122/97
gacguuccagcaguacaccgccc

SEQ ID NO: 3153874 - RNA, 16 nt, Mycobacterium bovis subsp bovis AF2122/97
gacguucgacgacagc

SEQ ID NO: 3153875 - RNA, 18 nt, Mycobacterium bovis subsp bovis AF2122/97
gacguucgacgacagcac

SEQ ID NO: 3153876 - RNA, 15 nt, Mycobacterium bovis subsp bovis AF2122/97
gacguucgguggcga

SEQ ID NO: 3153877 - RNA, 15 nt, Mycobacterium bovis subsp bovis AF2122/97
gacguucuugggacc

SEQ ID NO: 3153878 - RNA, 13 nt, Mycobacterium bovis subsp bovis AF2122/97
gacguugaagccg

SEQ ID NO: 3153879 - RNA, 15 nt, Mycobacterium bovis subsp bovis AF2122/97
gacguugaagccgcc

SEQ ID NO: 3153880 - RNA, 17 nt, Mycobacterium bovis subsp bovis AF2122/97
gacguugaagccgccgg

SEQ ID NO: 3153881 - RNA, 23 nt, Mycobacterium bovis subsp bovis AF2122/97
gacguugagguucuucugcgcca

SEQ ID NO: 3153882 - RNA, 14 nt, Mycobacterium bovis subsp bovis AF2122/97
gacguugcagccgg

SEQ ID NO: 3153883 - RNA, 17 nt, Mycobacterium bovis subsp bovis AF2122/97
gacguugccgaagccgg

SEQ ID NO: 3153884 - RNA, 17 nt, Mycobacterium bovis subsp bovis AF2122/97
gacguugccgggcuugu

SEQ ID NO: 3153885 - RNA, 19 nt, Mycobacterium bovis subsp bovis AF2122/97
gacguugcgaggccgcacg

SEQ ID NO: 3153886 - RNA, 20 nt, Mycobacterium bovis subsp bovis AF2122/97
gacguugcuggcuggguggc

SEQ ID NO: 3153887 - RNA, 14 nt, Mycobacterium bovis subsp bovis AF2122/97
gacguuggcgcggu

SEQ ID NO: 3153888 - RNA, 17 nt, Mycobacterium bovis subsp bovis AF2122/97
gacguuggcgcgguugc

SEQ ID NO: 3153889 - RNA, 18 nt, Mycobacterium bovis subsp bovis AF2122/97
gacguuguccaccgccac

SEQ ID NO: 3153890 - RNA, 22 nt, Mycobacterium bovis subsp bovis AF2122/97
gacguuguccaccgccaccacg

SEQ ID NO: 3153891 - RNA, 23 nt, Mycobacterium bovis subsp bovis AF2122/97
gacguuguccaccgccaccacgg

SEQ ID NO: 3153892 - RNA, 21 nt, Mycobacterium bovis subsp bovis AF2122/97
gacguuguuggauccggccac

SEQ ID NO: 3153893 - RNA, 15 nt, Mycobacterium bovis subsp bovis AF2122/97
gacuaccacccgcag

SEQ ID NO: 3153894 - RNA, 16 nt, Mycobacterium bovis subsp bovis AF2122/97
gacuaccacccgcagg

SEQ ID NO: 3153895 - RNA, 15 nt, Mycobacterium bovis subsp bovis AF2122/97
gacuaccaccgcguu

SEQ ID NO: 3153896 - RNA, 17 nt, Mycobacterium bovis subsp bovis AF2122/97
gacuaccaucgccgccc

SEQ ID NO: 3153897 - RNA, 20 nt, Mycobacterium bovis subsp bovis AF2122/97
gacuacccagccagccgcga

SEQ ID NO: 3153898 - RNA, 18 nt, Mycobacterium bovis subsp bovis AF2122/97
gacuaccgccggcggcgg

SEQ ID NO: 3153899 - RNA, 20 nt, Mycobacterium bovis subsp bovis AF2122/97
gacuaccgccggcggcggcc

SEQ ID NO: 3153900 - RNA, 23 nt, Mycobacterium bovis subsp bovis AF2122/97
gacuaccgccggcggcggccgca

SEQ ID NO: 3153901 - RNA, 16 nt, Mycobacterium bovis subsp bovis AF2122/97
gacuagacgccgccgc

SEQ ID NO: 3153902 - RNA, 16 nt, Mycobacterium bovis subsp bovis AF2122/97
gacuaucggccgccgg

SEQ ID NO: 3153903 - RNA, 23 nt, Mycobacterium bovis subsp bovis AF2122/97
gacuaucggccgccggaucagga

SEQ ID NO: 3153904 - RNA, 18 nt, Mycobacterium bovis subsp bovis AF2122/97
gacucacccacccgcacc

SEQ ID NO: 3153905 - RNA, 22 nt, Mycobacterium bovis subsp bovis AF2122/97
gacucaccgugaaccgcccgcc

SEQ ID NO: 3153906 - RNA, 13 nt, Mycobacterium bovis subsp bovis AF2122/97
gacucacgaggca

SEQ ID NO: 3153907 - RNA, 15 nt, Mycobacterium bovis subsp bovis AF2122/97
gacucacgcagcgcc

SEQ ID NO: 3153908 - RNA, 17 nt, Mycobacterium bovis subsp bovis AF2122/97
gacucagcccggcacug

SEQ ID NO: 3153909 - RNA, 17 nt, Mycobacterium bovis subsp bovis AF2122/97
gacucaucccgagauca

SEQ ID NO: 3153910 - RNA, 16 nt, Mycobacterium bovis subsp bovis AF2122/97
gacucaucggccgcgg

SEQ ID NO: 3153911 - RNA, 15 nt, Mycobacterium bovis subsp bovis AF2122/97
gacucaugccgagcg

SEQ ID NO: 3153912 - RNA, 22 nt, Mycobacterium bovis subsp bovis AF2122/97
gacuccaaagccgugccagccc

SEQ ID NO: 3153913 - RNA, 20 nt, Mycobacterium bovis subsp bovis AF2122/97
gacuccagcaaggccagcac

SEQ ID NO: 3153914 - RNA, 20 nt, Mycobacterium bovis subsp bovis AF2122/97
gacuccagcaccagcacggc

SEQ ID NO: 3153915 - RNA, 22 nt, Mycobacterium bovis subsp bovis AF2122/97
gacucccccucuaccuccgcca

SEQ ID NO: 3153916 - RNA, 22 nt, Mycobacterium bovis subsp bovis AF2122/97
gacuccgaucgggcccaccgcu

SEQ ID NO: 3153917 - RNA, 19 nt, Mycobacterium bovis subsp bovis AF2122/97
gacuccgccuugcagcgcg

SEQ ID NO: 3153918 - RNA, 17 nt, Mycobacterium bovis subsp bovis AF2122/97
gacuccgcgcgcugggc

SEQ ID NO: 3153919 - RNA, 13 nt, Mycobacterium bovis subsp bovis AF2122/97
gacuccggcaagc

SEQ ID NO: 3153920 - RNA, 16 nt, Mycobacterium bovis subsp bovis AF2122/97
gacuccggcaagcaca

SEQ ID NO: 3153921 - RNA, 16 nt, Mycobacterium bovis subsp bovis AF2122/97
gacuccggccgcacgc

SEQ ID NO: 3153922 - RNA, 19 nt, Mycobacterium bovis subsp bovis AF2122/97
gacuccggccgcacgccga

SEQ ID NO: 3153923 - RNA, 20 nt, Mycobacterium bovis subsp bovis AF2122/97
gacuccggccgcacgccgac

SEQ ID NO: 3153924 - RNA, 21 nt, Mycobacterium bovis subsp bovis AF2122/97
gacuccggccgcacgccgacc

SEQ ID NO: 3153925 - RNA, 23 nt, Mycobacterium bovis subsp bovis AF2122/97
gacuccggcuggaagcggcgacu

SEQ ID NO: 3153926 - RNA, 22 nt, Mycobacterium bovis subsp bovis AF2122/97
gacuccggucagcgcggcgacc

SEQ ID NO: 3153927 - RNA, 20 nt, Mycobacterium bovis subsp bovis AF2122/97
gacuccguugccaccuuggu

SEQ ID NO: 3153928 - RNA, 16 nt, Mycobacterium bovis subsp bovis AF2122/97
gacuccugcggcaccg

SEQ ID NO: 3153929 - RNA, 17 nt, Mycobacterium bovis subsp bovis AF2122/97
gacuccugcggcaccgc

SEQ ID NO: 3153930 - RNA, 18 nt, Mycobacterium bovis subsp bovis AF2122/97
gacuccugcggcaccgcu

SEQ ID NO: 3153931 - RNA, 20 nt, Mycobacterium bovis subsp bovis AF2122/97
gacuccugcggcaccgcuga

SEQ ID NO: 3153932 - RNA, 21 nt, Mycobacterium bovis subsp bovis AF2122/97
gacuccugugcggagccgcca

SEQ ID NO: 3153933 - RNA, 18 nt, Mycobacterium bovis subsp bovis AF2122/97
gacucgaccgcgacggca

SEQ ID NO: 3153934 - RNA, 15 nt, Mycobacterium bovis subsp bovis AF2122/97
gacucgaggaccugc

SEQ ID NO: 3153935 - RNA, 17 nt, Mycobacterium bovis subsp bovis AF2122/97
gacucgagucugcgcag

SEQ ID NO: 3153936 - RNA, 20 nt, Mycobacterium bovis subsp bovis AF2122/97
gacucgauauaacccggcuc

SEQ ID NO: 3153937 - RNA, 21 nt, Mycobacterium bovis subsp bovis AF2122/97
gacucgcaauugcucguagcc

SEQ ID NO: 3153938 - RNA, 14 nt, Mycobacterium bovis subsp bovis AF2122/97
gacucgccaccgcg

SEQ ID NO: 3153939 - RNA, 13 nt, Mycobacterium bovis subsp bovis AF2122/97
gacucgcgguggc

SEQ ID NO: 3153940 - RNA, 19 nt, Mycobacterium bovis subsp bovis AF2122/97
gacucgcgguggccgaaca

SEQ ID NO: 3153941 - RNA, 16 nt, Mycobacterium bovis subsp bovis AF2122/97
gacucgcuccgaccgg

SEQ ID NO: 3153942 - RNA, 17 nt, Mycobacterium bovis subsp bovis AF2122/97
gacucgcuccgaccggu

SEQ ID NO: 3153943 - RNA, 18 nt, Mycobacterium bovis subsp bovis AF2122/97
gacucggaauucggcguc

SEQ ID NO: 3153944 - RNA, 16 nt, Mycobacterium bovis subsp bovis AF2122/97
gacucggcaccgcggc

SEQ ID NO: 3153945 - RNA, 12 nt, Mycobacterium bovis subsp bovis AF2122/97
gacucggcaccu

SEQ ID NO: 3153946 - RNA, 14 nt, Mycobacterium bovis subsp bovis AF2122/97
gacucggccgacga

SEQ ID NO: 3153947 - RNA, 14 nt, Mycobacterium bovis subsp bovis AF2122/97
gacucggccgcacc

SEQ ID NO: 3153948 - RNA, 18 nt, Mycobacterium bovis subsp bovis AF2122/97
gacucggccgugaccgag

SEQ ID NO: 3153949 - RNA, 21 nt, Mycobacterium bovis subsp bovis AF2122/97
gacucggccgugaccgagccg

SEQ ID NO: 3153950 - RNA, 17 nt, Mycobacterium bovis subsp bovis AF2122/97
gacucggccuccgccga

SEQ ID NO: 3153951 - RNA, 14 nt, Mycobacterium bovis subsp bovis AF2122/97
gacucggcggucuu

SEQ ID NO: 3153952 - RNA, 23 nt, Mycobacterium bovis subsp bovis AF2122/97
gacucggcggucuuggcgcgccc

SEQ ID NO: 3153953 - RNA, 18 nt, Mycobacterium bovis subsp bovis AF2122/97
gacucgggcaggccccac

SEQ ID NO: 3153954 - RNA, 23 nt, Mycobacterium bovis subsp bovis AF2122/97
gacucgggcaggccccacuggug

SEQ ID NO: 3153955 - RNA, 15 nt, Mycobacterium bovis subsp bovis AF2122/97
gacucggugcgguga

SEQ ID NO: 3153956 - RNA, 20 nt, Mycobacterium bovis subsp bovis AF2122/97
gacucgguugaggacgaggu

SEQ ID NO: 3153957 - RNA, 19 nt, Mycobacterium bovis subsp bovis AF2122/97
gacucgucgaugcgguggu

SEQ ID NO: 3153958 - RNA, 18 nt, Mycobacterium bovis subsp bovis AF2122/97
gacucgucgcaucaccag

SEQ ID NO: 3153959 - RNA, 15 nt, Mycobacterium bovis subsp bovis AF2122/97
gagagccucggccau

SEQ ID NO: 3153960 - RNA, 18 nt, Mycobacterium bovis subsp bovis AF2122/97
gagagccugcucgcagcg

SEQ ID NO: 3153961 - RNA, 22 nt, Mycobacterium bovis subsp bovis AF2122/97
gagagccugcucgcagcgggcg

SEQ ID NO: 3153962 - RNA, 20 nt, Mycobacterium bovis subsp bovis AF2122/97
gagagcgaucaacggaucga

SEQ ID NO: 3153963 - RNA, 15 nt, Mycobacterium bovis subsp bovis AF2122/97
gagaggcggugcagc

SEQ ID NO: 3153964 - RNA, 13 nt, Mycobacterium bovis subsp bovis AF2122/97
gagagggcggggc

SEQ ID NO: 3153965 - RNA, 13 nt, Mycobacterium bovis subsp bovis AF2122/97
gagaguggccucg

SEQ ID NO: 3153966 - RNA, 14 nt, Mycobacterium bovis subsp bovis AF2122/97
gagaguucgcaugc

SEQ ID NO: 3153967 - RNA, 19 nt, Mycobacterium bovis subsp bovis AF2122/97
gagaguuugauccuggcuc

SEQ ID NO: 3153968 - RNA, 13 nt, Mycobacterium bovis subsp bovis AF2122/97
gagauaccccgag

SEQ ID NO: 3153969 - RNA, 14 nt, Mycobacterium bovis subsp bovis AF2122/97
gagauaccgaccau

SEQ ID NO: 3153970 - RNA, 20 nt, Mycobacterium bovis subsp bovis AF2122/97
gagauaccgaccaucgggac

SEQ ID NO: 3153971 - RNA, 22 nt, Mycobacterium bovis subsp bovis AF2122/97
gagauaccgacgcgcucggcga

SEQ ID NO: 3153972 - RNA, 17 nt, Mycobacterium bovis subsp bovis AF2122/97
gagauacggccaccagg

SEQ ID NO: 3153973 - RNA, 15 nt, Mycobacterium bovis subsp bovis AF2122/97
gagauacgggccacc

SEQ ID NO: 3153974 - RNA, 22 nt, Mycobacterium bovis subsp bovis AF2122/97
gagauagucggccggcggucgc

SEQ ID NO: 3153975 - RNA, 22 nt, Mycobacterium bovis subsp bovis AF2122/97
gagauauugcgcgccugcgcca

SEQ ID NO: 3153976 - RNA, 13 nt, Mycobacterium bovis subsp bovis AF2122/97
gagaucaccgcca

SEQ ID NO: 3153977 - RNA, 15 nt, Mycobacterium bovis subsp bovis AF2122/97
gagaucaccgccacc

SEQ ID NO: 3153978 - RNA, 24 nt, Mycobacterium bovis subsp bovis AF2122/97
gagaucaccuugccuagccgcagc

SEQ ID NO: 3153979 - RNA, 20 nt, Mycobacterium bovis subsp bovis AF2122/97
gagaucaccuuggcaagcac

SEQ ID NO: 3153980 - RNA, 16 nt, Mycobacterium bovis subsp bovis AF2122/97
gagaucacgccgacga

SEQ ID NO: 3153981 - RNA, 21 nt, Mycobacterium bovis subsp bovis AF2122/97
gagaucagcaccgugacagcg

SEQ ID NO: 3153982 - RNA, 14 nt, Mycobacterium bovis subsp bovis AF2122/97
gagaucagccucgc

SEQ ID NO: 3153983 - RNA, 16 nt, Mycobacterium bovis subsp bovis AF2122/97
gagaucagccucgcgg

SEQ ID NO: 3153984 - RNA, 15 nt, Mycobacterium bovis subsp bovis AF2122/97
gagaucaugagguga

SEQ ID NO: 3153985 - RNA, 22 nt, Mycobacterium bovis subsp bovis AF2122/97
gagaucauggcgagcguuugga

SEQ ID NO: 3153986 - RNA, 14 nt, Mycobacterium bovis subsp bovis AF2122/97
gagauccagggagc

SEQ ID NO: 3153987 - RNA, 14 nt, Mycobacterium bovis subsp bovis AF2122/97
gagauccagggccu

SEQ ID NO: 3153988 - RNA, 15 nt, Mycobacterium bovis subsp bovis AF2122/97
gagauccagggccuu

SEQ ID NO: 3153989 - RNA, 17 nt, Mycobacterium bovis subsp bovis AF2122/97
gagauccaggugugccc

SEQ ID NO: 3153990 - RNA, 17 nt, Mycobacterium bovis subsp bovis AF2122/97
gagaucccccaggcgaa

SEQ ID NO: 3153991 - RNA, 20 nt, Mycobacterium bovis subsp bovis AF2122/97
gagauccugguaaggccggc

SEQ ID NO: 3153992 - RNA, 13 nt, Mycobacterium bovis subsp bovis AF2122/97
gagauccuucgcg

SEQ ID NO: 3153993 - RNA, 22 nt, Mycobacterium bovis subsp bovis AF2122/97
gagaucgacuucauagcgccgg

SEQ ID NO: 3153994 - RNA, 15 nt, Mycobacterium bovis subsp bovis AF2122/97
gagaucgaucgacag

SEQ ID NO: 3153995 - RNA, 20 nt, Mycobacterium bovis subsp bovis AF2122/97
gagaucgaucgacagcggga

SEQ ID NO: 3153996 - RNA, 14 nt, Mycobacterium bovis subsp bovis AF2122/97
gagaucgccgccgg

SEQ ID NO: 3153997 - RNA, 19 nt, Mycobacterium bovis subsp bovis AF2122/97
gagaucgccguugccggcg

SEQ ID NO: 3153998 - RNA, 16 nt, Mycobacterium bovis subsp bovis AF2122/97
gagaucguagggacgc

SEQ ID NO: 3153999 - RNA, 17 nt, Mycobacterium bovis subsp bovis AF2122/97
gagaucgucgacccacc

SEQ ID NO: 3154000 - RNA, 13 nt, Mycobacterium bovis subsp bovis AF2122/97
gagaucgucgcga

SEQ ID NO: 3154001 - RNA, 22 nt, Mycobacterium bovis subsp bovis AF2122/97
gagaucgucgcgaccuugcccg

SEQ ID NO: 3154002 - RNA, 17 nt, Mycobacterium bovis subsp bovis AF2122/97
gagaucucacgugcccg

SEQ ID NO: 3154003 - RNA, 23 nt, Mycobacterium bovis subsp bovis AF2122/97
gagaucucacgugcccgcgcggc

SEQ ID NO: 3154004 - RNA, 17 nt, Mycobacterium bovis subsp bovis AF2122/97
gagaucugcgaugggga

SEQ ID NO: 3154005 - RNA, 16 nt, Mycobacterium bovis subsp bovis AF2122/97
gagaugccaucgguga

SEQ ID NO: 3154006 - RNA, 21 nt, Mycobacterium bovis subsp bovis AF2122/97
gagaugccaucggugaugagu

SEQ ID NO: 3154007 - RNA, 21 nt, Mycobacterium bovis subsp bovis AF2122/97
gagaugccgcgaucgugcagg

SEQ ID NO: 3154008 - RNA, 15 nt, Mycobacterium bovis subsp bovis AF2122/97
gagaugccggcgagc

SEQ ID NO: 3154009 - RNA, 18 nt, Mycobacterium bovis subsp bovis AF2122/97
gagauggucgggcggcgu

SEQ ID NO: 3154010 - RNA, 19 nt, Mycobacterium bovis subsp bovis AF2122/97
gagauggucgggcggcguc

SEQ ID NO: 3154011 - RNA, 19 nt, Mycobacterium bovis subsp bovis AF2122/97
gagaugucggugaucacgg

SEQ ID NO: 3154012 - RNA, 19 nt, Mycobacterium bovis subsp bovis AF2122/97
gagauucggagucaccagc

SEQ ID NO: 3154013 - RNA, 19 nt, Mycobacterium bovis subsp bovis AF2122/97
gagauugggcugggauagc

SEQ ID NO: 3154014 - RNA, 16 nt, Mycobacterium bovis subsp bovis AF2122/97
gagauuggguccagcg

SEQ ID NO: 3154015 - RNA, 15 nt, Mycobacterium bovis subsp bovis AF2122/97
gagauuggugcagac

SEQ ID NO: 3154016 - RNA, 19 nt, Mycobacterium bovis subsp bovis AF2122/97
gagcaaaauggccaccggc

SEQ ID NO: 3154017 - RNA, 22 nt, Mycobacterium bovis subsp bovis AF2122/97
gagcaaaauggccaccggcggu

SEQ ID NO: 3154018 - RNA, 21 nt, Mycobacterium bovis subsp bovis AF2122/97
gagcaaaccagauugccgagc

SEQ ID NO: 3154019 - RNA, 20 nt, Mycobacterium bovis subsp bovis AF2122/97
gagcaacaccagggccucca

SEQ ID NO: 3154020 - RNA, 20 nt, Mycobacterium bovis subsp bovis AF2122/97
gagcaacaccccuggguuga

SEQ ID NO: 3154021 - RNA, 15 nt, Mycobacterium bovis subsp bovis AF2122/97
gagcaacaccgucgg

SEQ ID NO: 3154022 - RNA, 22 nt, Mycobacterium bovis subsp bovis AF2122/97
gagcaacaccgucggcagcagc

SEQ ID NO: 3154023 - RNA, 23 nt, Mycobacterium bovis subsp bovis AF2122/97
gagcaacaccgucggcagcagcg

SEQ ID NO: 3154024 - RNA, 15 nt, Mycobacterium bovis subsp bovis AF2122/97
gagcaacacgagcgc

SEQ ID NO: 3154025 - RNA, 13 nt, Mycobacterium bovis subsp bovis AF2122/97
gagcaacggcggc

SEQ ID NO: 3154026 - RNA, 17 nt, Mycobacterium bovis subsp bovis AF2122/97
gagcaacggcggcaggc

SEQ ID NO: 3154027 - RNA, 18 nt, Mycobacterium bovis subsp bovis AF2122/97
gagcaaugacccgcgggu

SEQ ID NO: 3154028 - RNA, 13 nt, Mycobacterium bovis subsp bovis AF2122/97
gagcaauggcgcg

SEQ ID NO: 3154029 - RNA, 17 nt, Mycobacterium bovis subsp bovis AF2122/97
gagcacaagauccgcca

SEQ ID NO: 3154030 - RNA, 14 nt, Mycobacterium bovis subsp bovis AF2122/97
gagcaccaccccag

SEQ ID NO: 3154031 - RNA, 20 nt, Mycobacterium bovis subsp bovis AF2122/97
gagcaccaccccagcggcca

SEQ ID NO: 3154032 - RNA, 23 nt, Mycobacterium bovis subsp bovis AF2122/97
gagcaccacccgggccucggcgc

SEQ ID NO: 3154033 - RNA, 12 nt, Mycobacterium bovis subsp bovis AF2122/97
gagcaccagcag

SEQ ID NO: 3154034 - RNA, 13 nt, Mycobacterium bovis subsp bovis AF2122/97
gagcaccagcagc

SEQ ID NO: 3154035 - RNA, 14 nt, Mycobacterium bovis subsp bovis AF2122/97
gagcaccagcagca

SEQ ID NO: 3154036 - RNA, 13 nt, Mycobacterium bovis subsp bovis AF2122/97
gagcaccccgacg

SEQ ID NO: 3154037 - RNA, 14 nt, Mycobacterium bovis subsp bovis AF2122/97
gagcaccgacaccg

SEQ ID NO: 3154038 - RNA, 15 nt, Mycobacterium bovis subsp bovis AF2122/97
gagcaccgacaccgg

SEQ ID NO: 3154039 - RNA, 19 nt, Mycobacterium bovis subsp bovis AF2122/97
gagcaccgacaccggccgc

SEQ ID NO: 3154040 - RNA, 14 nt, Mycobacterium bovis subsp bovis AF2122/97
gagcaccgaccagg

SEQ ID NO: 3154041 - RNA, 23 nt, Mycobacterium bovis subsp bovis AF2122/97
gagcaccgcgcccuucagcacgg

SEQ ID NO: 3154042 - RNA, 13 nt, Mycobacterium bovis subsp bovis AF2122/97
gagcaccggcugc

SEQ ID NO: 3154043 - RNA, 15 nt, Mycobacterium bovis subsp bovis AF2122/97
gagcaccggcugcgg

SEQ ID NO: 3154044 - RNA, 22 nt, Mycobacterium bovis subsp bovis AF2122/97
gagcaccuccagauacaggaac

SEQ ID NO: 3154045 - RNA, 24 nt, Mycobacterium bovis subsp bovis AF2122/97
gagcaccucggccucgucgugcac

SEQ ID NO: 3154046 - RNA, 17 nt, Mycobacterium bovis subsp bovis AF2122/97
gagcagugccucggcga

SEQ ID NO: 3154047 - RNA, 15 nt, Mycobacterium bovis subsp bovis AF2122/97
gagcaguggccgccg

SEQ ID NO: 3154048 - RNA, 17 nt, Mycobacterium bovis subsp bovis AF2122/97
gagcaguggccgccggg

SEQ ID NO: 3154049 - RNA, 16 nt, Mycobacterium bovis subsp bovis AF2122/97
gagcaguuccagcucg

SEQ ID NO: 3154050 - RNA, 17 nt, Mycobacterium bovis subsp bovis AF2122/97
gagcaguuccagcucgc

SEQ ID NO: 3154051 - RNA, 21 nt, Mycobacterium bovis subsp bovis AF2122/97
gagcaguucucggucccgccg

SEQ ID NO: 3154052 - RNA, 14 nt, Mycobacterium bovis subsp bovis AF2122/97
gagcauaccgccgc

SEQ ID NO: 3154053 - RNA, 14 nt, Mycobacterium bovis subsp bovis AF2122/97
gagcauaugacguc

SEQ ID NO: 3154054 - RNA, 12 nt, Mycobacterium bovis subsp bovis AF2122/97
gagcauccaccc

SEQ ID NO: 3154055 - RNA, 18 nt, Mycobacterium bovis subsp bovis AF2122/97
gagcaucuccucgccugc

SEQ ID NO: 3154056 - RNA, 18 nt, Mycobacterium bovis subsp bovis AF2122/97
gagcaucucgacaucggc

SEQ ID NO: 3154057 - RNA, 20 nt, Mycobacterium bovis subsp bovis AF2122/97
gagcaucucgacaucggcca

SEQ ID NO: 3154058 - RNA, 14 nt, Mycobacterium bovis subsp bovis AF2122/97
gagcaucucgucgg

SEQ ID NO: 3154059 - RNA, 14 nt, Mycobacterium bovis subsp bovis AF2122/97
gagcaugauguccu

SEQ ID NO: 3154060 - RNA, 16 nt, Mycobacterium bovis subsp bovis AF2122/97
gagcaugauguccucc

SEQ ID NO: 3154061 - RNA, 19 nt, Mycobacterium bovis subsp bovis AF2122/97
gagcaugcccagcgcacgg

SEQ ID NO: 3154062 - RNA, 16 nt, Mycobacterium bovis subsp bovis AF2122/97
gagcaugccgcccgcg

SEQ ID NO: 3154063 - RNA, 18 nt, Mycobacterium bovis subsp bovis AF2122/97
gagcaugccgcccgcgcc

SEQ ID NO: 3154064 - RNA, 22 nt, Mycobacterium bovis subsp bovis AF2122/97
gagcaugccgcccgcgccgccg

SEQ ID NO: 3154065 - RNA, 23 nt, Mycobacterium bovis subsp bovis AF2122/97
gagcaugccgcccgcgccgccgg

SEQ ID NO: 3154066 - RNA, 16 nt, Mycobacterium bovis subsp bovis AF2122/97
gagcaugccguugaca

SEQ ID NO: 3154067 - RNA, 17 nt, Mycobacterium bovis subsp bovis AF2122/97
gagcaugcgacgucagg

SEQ ID NO: 3154068 - RNA, 18 nt, Mycobacterium bovis subsp bovis AF2122/97
gagcaugcgacgucaggg

SEQ ID NO: 3154069 - RNA, 19 nt, Mycobacterium bovis subsp bovis AF2122/97
gagcauggcuagggcgaug

SEQ ID NO: 3154070 - RNA, 18 nt, Mycobacterium bovis subsp bovis AF2122/97
gagcauuucggaugccgc

SEQ ID NO: 3154071 - RNA, 15 nt, Mycobacterium bovis subsp bovis AF2122/97
gagccaacgcgcaga

SEQ ID NO: 3154072 - RNA, 20 nt, Mycobacterium bovis subsp bovis AF2122/97
gagccaacuccacccaacgc

SEQ ID NO: 3154073 - RNA, 13 nt, Mycobacterium bovis subsp bovis AF2122/97
gagccaacucccg

SEQ ID NO: 3154074 - RNA, 13 nt, Mycobacterium bovis subsp bovis AF2122/97
gagccaccaacac

SEQ ID NO: 3154075 - RNA, 14 nt, Mycobacterium bovis subsp bovis AF2122/97
gagccaccaccgcc

SEQ ID NO: 3154076 - RNA, 16 nt, Mycobacterium bovis subsp bovis AF2122/97
gagccaccaccgccga

SEQ ID NO: 3154077 - RNA, 23 nt, Mycobacterium bovis subsp bovis AF2122/97
gagccaccccggguacgccgggc

SEQ ID NO: 3154078 - RNA, 13 nt, Mycobacterium bovis subsp bovis AF2122/97
gagccaccggcgu

SEQ ID NO: 3154079 - RNA, 18 nt, Mycobacterium bovis subsp bovis AF2122/97
gagccaccggcgucgacg

SEQ ID NO: 3154080 - RNA, 21 nt, Mycobacterium bovis subsp bovis AF2122/97
gagccaccggcgucgacgucg

SEQ ID NO: 3154081 - RNA, 23 nt, Mycobacterium bovis subsp bovis AF2122/97
gagccacggcacuggguccacgc

SEQ ID NO: 3154082 - RNA, 15 nt, Mycobacterium bovis subsp bovis AF2122/97
gagccacguucgcgg

SEQ ID NO: 3154083 - RNA, 16 nt, Mycobacterium bovis subsp bovis AF2122/97
gagccacguucgcggc

SEQ ID NO: 3154084 - RNA, 16 nt, Mycobacterium bovis subsp bovis AF2122/97
gagccacucggcccgg

SEQ ID NO: 3154085 - RNA, 16 nt, Mycobacterium bovis subsp bovis AF2122/97
gagccacugcggcaug

SEQ ID NO: 3154086 - RNA, 18 nt, Mycobacterium bovis subsp bovis AF2122/97
gagccacugcggcauggc

SEQ ID NO: 3154087 - RNA, 15 nt, Mycobacterium bovis subsp bovis AF2122/97
gagccagcacccgca

SEQ ID NO: 3154088 - RNA, 19 nt, Mycobacterium bovis subsp bovis AF2122/97
gagccagcuucccgcuggu

SEQ ID NO: 3154089 - RNA, 17 nt, Mycobacterium bovis subsp bovis AF2122/97
gagccagggaggggccg

SEQ ID NO: 3154090 - RNA, 14 nt, Mycobacterium bovis subsp bovis AF2122/97
gagccaucaccgca

SEQ ID NO: 3154091 - RNA, 15 nt, Mycobacterium bovis subsp bovis AF2122/97
gagccaugccgcucg

SEQ ID NO: 3154092 - RNA, 14 nt, Mycobacterium bovis subsp bovis AF2122/97
gagcccaaggggca

SEQ ID NO: 3154093 - RNA, 17 nt, Mycobacterium bovis subsp bovis AF2122/97
gagcccaaggggcagcg

SEQ ID NO: 3154094 - RNA, 17 nt, Mycobacterium bovis subsp bovis AF2122/97
gagcccagccgcgggcc

SEQ ID NO: 3154095 - RNA, 20 nt, Mycobacterium bovis subsp bovis AF2122/97
gagcccagccgcgggccgcg

SEQ ID NO: 3154096 - RNA, 19 nt, Mycobacterium bovis subsp bovis AF2122/97
gagcccagccgggcacccu

SEQ ID NO: 3154097 - RNA, 12 nt, Mycobacterium bovis subsp bovis AF2122/97
gagcccagcgcc

SEQ ID NO: 3154098 - RNA, 13 nt, Mycobacterium bovis subsp bovis AF2122/97
gagcccagguggu

SEQ ID NO: 3154099 - RNA, 16 nt, Mycobacterium bovis subsp bovis AF2122/97
gagcccaguaagccac

SEQ ID NO: 3154100 - RNA, 13 nt, Mycobacterium bovis subsp bovis AF2122/97
gagccccagcgac

SEQ ID NO: 3154101 - RNA, 18 nt, Mycobacterium bovis subsp bovis AF2122/97
gagccccgaccagcagac

SEQ ID NO: 3154102 - RNA, 16 nt, Mycobacterium bovis subsp bovis AF2122/97
gagccccugucaacgc

SEQ ID NO: 3154103 - RNA, 16 nt, Mycobacterium bovis subsp bovis AF2122/97
gagcccgaaggcggcu

SEQ ID NO: 3154104 - RNA, 20 nt, Mycobacterium bovis subsp bovis AF2122/97
gagcccgagcucaccgcaca

SEQ ID NO: 3154105 - RNA, 13 nt, Mycobacterium bovis subsp bovis AF2122/97
gagcccgaucgcg

SEQ ID NO: 3154106 - RNA, 20 nt, Mycobacterium bovis subsp bovis AF2122/97
gagcccgaucgcggcccggc

SEQ ID NO: 3154107 - RNA, 13 nt, Mycobacterium bovis subsp bovis AF2122/97
gagcccgcaucgc

SEQ ID NO: 3154108 - RNA, 12 nt, Mycobacterium bovis subsp bovis AF2122/97
gagcccgcugcg

SEQ ID NO: 3154109 - RNA, 16 nt, Mycobacterium bovis subsp bovis AF2122/97
gagcccgcugcgccgg

SEQ ID NO: 3154110 - RNA, 22 nt, Mycobacterium bovis subsp bovis AF2122/97
gagcccggucccuuuguggggc

SEQ ID NO: 3154111 - RNA, 12 nt, Mycobacterium bovis subsp bovis AF2122/97
gagcccggugcu

SEQ ID NO: 3154112 - RNA, 21 nt, Mycobacterium bovis subsp bovis AF2122/97
gagcccgucagcuccccgucg

SEQ ID NO: 3154113 - RNA, 14 nt, Mycobacterium bovis subsp bovis AF2122/97
gagcccguccaggc

SEQ ID NO: 3154114 - RNA, 15 nt, Mycobacterium bovis subsp bovis AF2122/97
gagccgacaacgacg

SEQ ID NO: 3154115 - RNA, 19 nt, Mycobacterium bovis subsp bovis AF2122/97
gagccgacaacgacgucgc

SEQ ID NO: 3154116 - RNA, 15 nt, Mycobacterium bovis subsp bovis AF2122/97
gagccgacccgacgc

SEQ ID NO: 3154117 - RNA, 15 nt, Mycobacterium bovis subsp bovis AF2122/97
gagccgaccggcggc

SEQ ID NO: 3154118 - RNA, 18 nt, Mycobacterium bovis subsp bovis AF2122/97
gagccgacgugcggcggc

SEQ ID NO: 3154119 - RNA, 22 nt, Mycobacterium bovis subsp bovis AF2122/97
gagccgacuuugagucguugga

SEQ ID NO: 3154120 - RNA, 13 nt, Mycobacterium bovis subsp bovis AF2122/97
gagccgagccgau

SEQ ID NO: 3154121 - RNA, 18 nt, Mycobacterium bovis subsp bovis AF2122/97
gagccgaggaauacucuc

SEQ ID NO: 3154122 - RNA, 23 nt, Mycobacterium bovis subsp bovis AF2122/97
gagccgaggaauacucucgcgac

SEQ ID NO: 3154123 - RNA, 15 nt, Mycobacterium bovis subsp bovis AF2122/97
gagccgaggcgggaa

SEQ ID NO: 3154124 - RNA, 18 nt, Mycobacterium bovis subsp bovis AF2122/97
gagccgauauaccagggc

SEQ ID NO: 3154125 - RNA, 14 nt, Mycobacterium bovis subsp bovis AF2122/97
gagccgaucaccgc

SEQ ID NO: 3154126 - RNA, 15 nt, Mycobacterium bovis subsp bovis AF2122/97
gagccgaucaccgcc

SEQ ID NO: 3154127 - RNA, 14 nt, Mycobacterium bovis subsp bovis AF2122/97
gagccgaucgcccg

SEQ ID NO: 3154128 - RNA, 16 nt, Mycobacterium bovis subsp bovis AF2122/97
gagccgaugaccugcc

SEQ ID NO: 3154129 - RNA, 19 nt, Mycobacterium bovis subsp bovis AF2122/97
gagccgcagcaccucgucg

SEQ ID NO: 3154130 - RNA, 16 nt, Mycobacterium bovis subsp bovis AF2122/97
gagccgcaucuggccg

SEQ ID NO: 3154131 - RNA, 12 nt, Mycobacterium bovis subsp bovis AF2122/97
gagccgccaggu

SEQ ID NO: 3154132 - RNA, 12 nt, Mycobacterium bovis subsp bovis AF2122/97
gagccgccccgg

SEQ ID NO: 3154133 - RNA, 12 nt, Mycobacterium bovis subsp bovis AF2122/97
gagcgaccuggg

SEQ ID NO: 3154134 - RNA, 17 nt, Mycobacterium bovis subsp bovis AF2122/97
gagcgacgucggugaag

SEQ ID NO: 3154135 - RNA, 19 nt, Mycobacterium bovis subsp bovis AF2122/97
gagcgacugcagcggcgca

SEQ ID NO: 3154136 - RNA, 13 nt, Mycobacterium bovis subsp bovis AF2122/97
gagcgagccaacu

SEQ ID NO: 3154137 - RNA, 14 nt, Mycobacterium bovis subsp bovis AF2122/97
gagcgagccaacuc

SEQ ID NO: 3154138 - RNA, 18 nt, Mycobacterium bovis subsp bovis AF2122/97
gagcgaggcucccccacc

SEQ ID NO: 3154139 - RNA, 18 nt, Mycobacterium bovis subsp bovis AF2122/97
gagcgaguugcagucgcg

SEQ ID NO: 3154140 - RNA, 15 nt, Mycobacterium bovis subsp bovis AF2122/97
gagcgauacgucguc

SEQ ID NO: 3154141 - RNA, 13 nt, Mycobacterium bovis subsp bovis AF2122/97
gagcgaucaacgg

SEQ ID NO: 3154142 - RNA, 15 nt, Mycobacterium bovis subsp bovis AF2122/97
gagcgaucgggugca

SEQ ID NO: 3154143 - RNA, 23 nt, Mycobacterium bovis subsp bovis AF2122/97
gagcgcaaccagcaaugccgacu

SEQ ID NO: 3154144 - RNA, 13 nt, Mycobacterium bovis subsp bovis AF2122/97
gagcgcaacuccc

SEQ ID NO: 3154145 - RNA, 18 nt, Mycobacterium bovis subsp bovis AF2122/97
gagcgcaagagccguccg

SEQ ID NO: 3154146 - RNA, 16 nt, Mycobacterium bovis subsp bovis AF2122/97
gagcgcaccacggcgg

SEQ ID NO: 3154147 - RNA, 17 nt, Mycobacterium bovis subsp bovis AF2122/97
gagcgcaccacggcggu

SEQ ID NO: 3154148 - RNA, 13 nt, Mycobacterium bovis subsp bovis AF2122/97
gagcgcaccgcga

SEQ ID NO: 3154149 - RNA, 12 nt, Mycobacterium bovis subsp bovis AF2122/97
gagcgcaccgcu

SEQ ID NO: 3154150 - RNA, 20 nt, Mycobacterium bovis subsp bovis AF2122/97
gagcgcaccgcugaccgcaa

SEQ ID NO: 3154151 - RNA, 13 nt, Mycobacterium bovis subsp bovis AF2122/97
gagcgcaccugaa

SEQ ID NO: 3154152 - RNA, 21 nt, Mycobacterium bovis subsp bovis AF2122/97
gagcgcaccugaaggcggcga

SEQ ID NO: 3154153 - RNA, 15 nt, Mycobacterium bovis subsp bovis AF2122/97
gagcgcacucaccuu

SEQ ID NO: 3154154 - RNA, 16 nt, Mycobacterium bovis subsp bovis AF2122/97
gagcgcaucgauggcc

SEQ ID NO: 3154155 - RNA, 18 nt, Mycobacterium bovis subsp bovis AF2122/97
gagcgcaucgauggccgc

SEQ ID NO: 3154156 - RNA, 14 nt, Mycobacterium bovis subsp bovis AF2122/97
gagcgcaucggcca

SEQ ID NO: 3154157 - RNA, 22 nt, Mycobacterium bovis subsp bovis AF2122/97
gagcgccacgccgaggcguucg

SEQ ID NO: 3154158 - RNA, 20 nt, Mycobacterium bovis subsp bovis AF2122/97
gagcgccagccgcugccaca

SEQ ID NO: 3154159 - RNA, 15 nt, Mycobacterium bovis subsp bovis AF2122/97
gagcgccaggccgca

SEQ ID NO: 3154160 - RNA, 22 nt, Mycobacterium bovis subsp bovis AF2122/97
gagcgccaggccgcacagcacc

SEQ ID NO: 3154161 - RNA, 14 nt, Mycobacterium bovis subsp bovis AF2122/97
gagcgccaggucag

SEQ ID NO: 3154162 - RNA, 20 nt, Mycobacterium bovis subsp bovis AF2122/97
gagcgccgagcucggcgccc

SEQ ID NO: 3154163 - RNA, 20 nt, Mycobacterium bovis subsp bovis AF2122/97
gagcgccgcggacucgggca

SEQ ID NO: 3154164 - RNA, 12 nt, Mycobacterium bovis subsp bovis AF2122/97
gagcgccgcggc

SEQ ID NO: 3154165 - RNA, 15 nt, Mycobacterium bovis subsp bovis AF2122/97
gagcgccgcggcgga

SEQ ID NO: 3154166 - RNA, 23 nt, Mycobacterium bovis subsp bovis AF2122/97
gagcgccggcaucgcgcaaccgg

SEQ ID NO: 3154167 - RNA, 13 nt, Mycobacterium bovis subsp bovis AF2122/97
gagcgccggccgc

SEQ ID NO: 3154168 - RNA, 16 nt, Mycobacterium bovis subsp bovis AF2122/97
gagcgccucgggaggc

SEQ ID NO: 3154169 - RNA, 21 nt, Mycobacterium bovis subsp bovis AF2122/97
gagcgccucgggaggcagcgc

SEQ ID NO: 3154170 - RNA, 19 nt, Mycobacterium bovis subsp bovis AF2122/97
gagcgccuuucggucacgc

SEQ ID NO: 3154171 - RNA, 20 nt, Mycobacterium bovis subsp bovis AF2122/97
gagcgcgaaguacgacgacc

SEQ ID NO: 3154172 - RNA, 14 nt, Mycobacterium bovis subsp bovis AF2122/97
gagcgcgcccaacc

SEQ ID NO: 3154173 - RNA, 18 nt, Mycobacterium bovis subsp bovis AF2122/97
gagcgcgccgaaggccgc

SEQ ID NO: 3154174 - RNA, 19 nt, Mycobacterium bovis subsp bovis AF2122/97
gagcgcgccgcgcucgccg

SEQ ID NO: 3154175 - RNA, 22 nt, Mycobacterium bovis subsp bovis AF2122/97
gagcgcgccgcgcucgccgaua

SEQ ID NO: 3154176 - RNA, 13 nt, Mycobacterium bovis subsp bovis AF2122/97
gagcgcgccguug

SEQ ID NO: 3154177 - RNA, 23 nt, Mycobacterium bovis subsp bovis AF2122/97
gagcgcgccguugccgcccacgc

SEQ ID NO: 3154178 - RNA, 22 nt, Mycobacterium bovis subsp bovis AF2122/97
gagcgcgcgcaacccugccgcg

SEQ ID NO: 3154179 - RNA, 18 nt, Mycobacterium bovis subsp bovis AF2122/97
gagcgcgcguagcggggg

SEQ ID NO: 3154180 - RNA, 16 nt, Mycobacterium bovis subsp bovis AF2122/97
gagcgcgcucagguca

SEQ ID NO: 3154181 - RNA, 16 nt, Mycobacterium bovis subsp bovis AF2122/97
gagcgcgcuggccagc

SEQ ID NO: 3154182 - RNA, 13 nt, Mycobacterium bovis subsp bovis AF2122/97
gagcgcggcaacc

SEQ ID NO: 3154183 - RNA, 16 nt, Mycobacterium bovis subsp bovis AF2122/97
gagcgcggccaccaga

SEQ ID NO: 3154184 - RNA, 15 nt, Mycobacterium bovis subsp bovis AF2122/97
gagcgcggcccgccu

SEQ ID NO: 3154185 - RNA, 12 nt, Mycobacterium bovis subsp bovis AF2122/97
gagcgcggccug

SEQ ID NO: 3154186 - RNA, 21 nt, Mycobacterium bovis subsp bovis AF2122/97
gagcgcggcggagccggguga

SEQ ID NO: 3154187 - RNA, 14 nt, Mycobacterium bovis subsp bovis AF2122/97
gagcgcggcggcgg

SEQ ID NO: 3154188 - RNA, 18 nt, Mycobacterium bovis subsp bovis AF2122/97
gagcgcggcggcggaggc

SEQ ID NO: 3154189 - RNA, 19 nt, Mycobacterium bovis subsp bovis AF2122/97
gagcgcggguggcagcggc

SEQ ID NO: 3154190 - RNA, 22 nt, Mycobacterium bovis subsp bovis AF2122/97
gagcgcgucgcgggauugcgcg

SEQ ID NO: 3154191 - RNA, 14 nt, Mycobacterium bovis subsp bovis AF2122/97
gagcgcuaucaccg

SEQ ID NO: 3154192 - RNA, 16 nt, Mycobacterium bovis subsp bovis AF2122/97
gagcgcuaucaccgcc

SEQ ID NO: 3154193 - RNA, 17 nt, Mycobacterium bovis subsp bovis AF2122/97
gagcgcuaucaccgccu

SEQ ID NO: 3154194 - RNA, 19 nt, Mycobacterium bovis subsp bovis AF2122/97
gagcgcucgaucacggcgg

SEQ ID NO: 3154195 - RNA, 15 nt, Mycobacterium bovis subsp bovis AF2122/97
gagcgcucgggcaac

SEQ ID NO: 3154196 - RNA, 20 nt, Mycobacterium bovis subsp bovis AF2122/97
gagcgcucgggcaaccggag

SEQ ID NO: 3154197 - RNA, 17 nt, Mycobacterium bovis subsp bovis AF2122/97
gagcgcugguuggccug

SEQ ID NO: 3154198 - RNA, 13 nt, Mycobacterium bovis subsp bovis AF2122/97
gagcgcuucgucg

SEQ ID NO: 3154199 - RNA, 15 nt, Mycobacterium bovis subsp bovis AF2122/97
gagcgcuucgucgcc

SEQ ID NO: 3154200 - RNA, 18 nt, Mycobacterium bovis subsp bovis AF2122/97
gagcgcuucugcgucagc

SEQ ID NO: 3154201 - RNA, 13 nt, Mycobacterium bovis subsp bovis AF2122/97
gagcgcuugguca

SEQ ID NO: 3154202 - RNA, 20 nt, Mycobacterium bovis subsp bovis AF2122/97
gagcgcuuggucaaaaagcu

SEQ ID NO: 3154203 - RNA, 15 nt, Mycobacterium bovis subsp bovis AF2122/97
gagcggaaaaucacc

SEQ ID NO: 3154204 - RNA, 20 nt, Mycobacterium bovis subsp bovis AF2122/97
gagcggaauggaggccgccg

SEQ ID NO: 3154205 - RNA, 21 nt, Mycobacterium bovis subsp bovis AF2122/97
gagcggaauggaggccgccga

SEQ ID NO: 3154206 - RNA, 20 nt, Mycobacterium bovis subsp bovis AF2122/97
gagcggacacauaagccccc

SEQ ID NO: 3154207 - RNA, 18 nt, Mycobacterium bovis subsp bovis AF2122/97
gagcggaccaccgcucgc

SEQ ID NO: 3154208 - RNA, 15 nt, Mycobacterium bovis subsp bovis AF2122/97
gagcggagccgccga

SEQ ID NO: 3154209 - RNA, 19 nt, Mycobacterium bovis subsp bovis AF2122/97
gagcggagccgccgacucg

SEQ ID NO: 3154210 - RNA, 15 nt, Mycobacterium bovis subsp bovis AF2122/97
gagcggagccggcgc

SEQ ID NO: 3154211 - RNA, 22 nt, Mycobacterium bovis subsp bovis AF2122/97
gagcggauccgugucgcagauc

SEQ ID NO: 3154212 - RNA, 13 nt, Mycobacterium bovis subsp bovis AF2122/97
gagcggaucgucg

SEQ ID NO: 3154213 - RNA, 19 nt, Mycobacterium bovis subsp bovis AF2122/97
gagcggaucgucgucgugu

SEQ ID NO: 3154214 - RNA, 18 nt, Mycobacterium bovis subsp bovis AF2122/97
gagcggcaccagaucaac

SEQ ID NO: 3154215 - RNA, 15 nt, Mycobacterium bovis subsp bovis AF2122/97
gagcggcaucgguca

SEQ ID NO: 3154216 - RNA, 10 nt, Mycobacterium bovis subsp bovis AF2122/97
gagcggcaug

SEQ ID NO: 3154217 - RNA, 13 nt, Mycobacterium bovis subsp bovis AF2122/97
gagcggccaccgu

SEQ ID NO: 3154218 - RNA, 22 nt, Mycobacterium bovis subsp bovis AF2122/97
gagcggccaccguagccagcag

SEQ ID NO: 3154219 - RNA, 12 nt, Mycobacterium bovis subsp bovis AF2122/97
gagcggccggca

SEQ ID NO: 3154220 - RNA, 16 nt, Mycobacterium bovis subsp bovis AF2122/97
gagcugccaacgcccg

SEQ ID NO: 3154221 - RNA, 21 nt, Mycobacterium bovis subsp bovis AF2122/97
gagcugccgagcggucaacga

SEQ ID NO: 3154222 - RNA, 24 nt, Mycobacterium bovis subsp bovis AF2122/97
gagcugcgacgaugccgccuggug

SEQ ID NO: 3154223 - RNA, 13 nt, Mycobacterium bovis subsp bovis AF2122/97
gagcugcggcggc

SEQ ID NO: 3154224 - RNA, 14 nt, Mycobacterium bovis subsp bovis AF2122/97
gagcugcggcggcc

SEQ ID NO: 3154225 - RNA, 11 nt, Mycobacterium bovis subsp bovis AF2122/97
gagcugcucgc

SEQ ID NO: 3154226 - RNA, 12 nt, Mycobacterium bovis subsp bovis AF2122/97
gagcugcucgcc

SEQ ID NO: 3154227 - RNA, 14 nt, Mycobacterium bovis subsp bovis AF2122/97
gagcugcucgccgg

SEQ ID NO: 3154228 - RNA, 19 nt, Mycobacterium bovis subsp bovis AF2122/97
gagcugcuggcgcgccugu

SEQ ID NO: 3154229 - RNA, 13 nt, Mycobacterium bovis subsp bovis AF2122/97
gagcuggaaucga

SEQ ID NO: 3154230 - RNA, 15 nt, Mycobacterium bovis subsp bovis AF2122/97
gagcuggaccuccga

SEQ ID NO: 3154231 - RNA, 13 nt, Mycobacterium bovis subsp bovis AF2122/97
gagcuggcagcuc

SEQ ID NO: 3154232 - RNA, 14 nt, Mycobacterium bovis subsp bovis AF2122/97
gagcuggcagcucc

SEQ ID NO: 3154233 - RNA, 15 nt, Mycobacterium bovis subsp bovis AF2122/97
gagcuggcgaccugg

SEQ ID NO: 3154234 - RNA, 22 nt, Mycobacterium bovis subsp bovis AF2122/97
gagcuggcgcgcgggguggcgg

SEQ ID NO: 3154235 - RNA, 15 nt, Mycobacterium bovis subsp bovis AF2122/97
gagcugggcugaugg

SEQ ID NO: 3154236 - RNA, 16 nt, Mycobacterium bovis subsp bovis AF2122/97
gagcugguaaacgggu

SEQ ID NO: 3154237 - RNA, 23 nt, Mycobacterium bovis subsp bovis AF2122/97
gagcuggugcagaauucggcgcg

SEQ ID NO: 3154238 - RNA, 16 nt, Mycobacterium bovis subsp bovis AF2122/97
gagcugguugacggcg

SEQ ID NO: 3154239 - RNA, 15 nt, Mycobacterium bovis subsp bovis AF2122/97
gagcuguaggucagc

SEQ ID NO: 3154240 - RNA, 20 nt, Mycobacterium bovis subsp bovis AF2122/97
gagcugucgcaacgcaucga

SEQ ID NO: 3154241 - RNA, 14 nt, Mycobacterium bovis subsp bovis AF2122/97
gagcugugcgcaga

SEQ ID NO: 3154242 - RNA, 19 nt, Mycobacterium bovis subsp bovis AF2122/97
gagcuguggucacccgugu

SEQ ID NO: 3154243 - RNA, 17 nt, Mycobacterium bovis subsp bovis AF2122/97
gagcuucaucccggagc

SEQ ID NO: 3154244 - RNA, 16 nt, Mycobacterium bovis subsp bovis AF2122/97
gagcuuccacgccgga

SEQ ID NO: 3154245 - RNA, 12 nt, Mycobacterium bovis subsp bovis AF2122/97
gagcuucgccgc

SEQ ID NO: 3154246 - RNA, 22 nt, Mycobacterium bovis subsp bovis AF2122/97
gagcuucucgucggugcgcgcg

SEQ ID NO: 3154247 - RNA, 16 nt, Mycobacterium bovis subsp bovis AF2122/97
gagcuuggccagcagc

SEQ ID NO: 3154248 - RNA, 17 nt, Mycobacterium bovis subsp bovis AF2122/97
gagcuuggccagcagca

SEQ ID NO: 3154249 - RNA, 14 nt, Mycobacterium bovis subsp bovis AF2122/97
gagcuuggccgccg

SEQ ID NO: 3154250 - RNA, 22 nt, Mycobacterium bovis subsp bovis AF2122/97
gagcuugggccggugcagcacg

SEQ ID NO: 3154251 - RNA, 13 nt, Mycobacterium bovis subsp bovis AF2122/97
gagcuuggucgcc

SEQ ID NO: 3154252 - RNA, 15 nt, Mycobacterium bovis subsp bovis AF2122/97
gagcuuggucgccau

SEQ ID NO: 3154253 - RNA, 21 nt, Mycobacterium bovis subsp bovis AF2122/97
gagcuuggucgccaugucggc

SEQ ID NO: 3154254 - RNA, 15 nt, Mycobacterium bovis subsp bovis AF2122/97
gagcuuggucgccgg

SEQ ID NO: 3154255 - RNA, 20 nt, Mycobacterium bovis subsp bovis AF2122/97
gagcuuuuugcgucuguucg

SEQ ID NO: 3154256 - RNA, 23 nt, Mycobacterium bovis subsp bovis AF2122/97
gaggaaauacuuuggaugcccgu

SEQ ID NO: 3154257 - RNA, 19 nt, Mycobacterium bovis subsp bovis AF2122/97
gaggaacucggacccaccc

SEQ ID NO: 3154258 - RNA, 22 nt, Mycobacterium bovis subsp bovis AF2122/97
gaggaagccguuggcgacguug

SEQ ID NO: 3154259 - RNA, 14 nt, Mycobacterium bovis subsp bovis AF2122/97
gaggaagcggcggc

SEQ ID NO: 3154260 - RNA, 23 nt, Mycobacterium bovis subsp bovis AF2122/97
gaggaaggugugcgucuccagcu

SEQ ID NO: 3154261 - RNA, 13 nt, Mycobacterium bovis subsp bovis AF2122/97
gaggaaguccagc

SEQ ID NO: 3154262 - RNA, 23 nt, Mycobacterium bovis subsp bovis AF2122/97
gaggaauacagcuugaucgccga

SEQ ID NO: 3154263 - RNA, 18 nt, Mycobacterium bovis subsp bovis AF2122/97
gaggaaucguucggggug

SEQ ID NO: 3154264 - RNA, 20 nt, Mycobacterium bovis subsp bovis AF2122/97
gaggaccaccuggucgcguc

SEQ ID NO: 3154265 - RNA, 22 nt, Mycobacterium bovis subsp bovis AF2122/97
gaggaccagaggcgcuucgcca

SEQ ID NO: 3154266 - RNA, 22 nt, Mycobacterium bovis subsp bovis AF2122/97
gaggacccgugcacgaucgcgg

SEQ ID NO: 3154267 - RNA, 14 nt, Mycobacterium bovis subsp bovis AF2122/97
gaggaccugcucgg

SEQ ID NO: 3154268 - RNA, 20 nt, Mycobacterium bovis subsp bovis AF2122/97
gaggacgcugauccacgaua

SEQ ID NO: 3154269 - RNA, 12 nt, Mycobacterium bovis subsp bovis AF2122/97
gaggacggcuug

SEQ ID NO: 3154270 - RNA, 15 nt, Mycobacterium bovis subsp bovis AF2122/97
gaggacuggaaagca

SEQ ID NO: 3154271 - RNA, 18 nt, Mycobacterium bovis subsp bovis AF2122/97
gaggagaugccgacgaac

SEQ ID NO: 3154272 - RNA, 19 nt, Mycobacterium bovis subsp bovis AF2122/97
gaggaggcuuacaugcccu

SEQ ID NO: 3154273 - RNA, 20 nt, Mycobacterium bovis subsp bovis AF2122/97
gaggagggccgcgaucgacg

SEQ ID NO: 3154274 - RNA, 22 nt, Mycobacterium bovis subsp bovis AF2122/97
gaggauauggaucaacgcacgg

SEQ ID NO: 3154275 - RNA, 19 nt, Mycobacterium bovis subsp bovis AF2122/97
gaggauccgcugcggcccg

SEQ ID NO: 3154276 - RNA, 19 nt, Mycobacterium bovis subsp bovis AF2122/97
gaggaucgcguccgccucg

SEQ ID NO: 3154277 - RNA, 22 nt, Mycobacterium bovis subsp bovis AF2122/97
gaggaugacgacggugaccggg

SEQ ID NO: 3154278 - RNA, 18 nt, Mycobacterium bovis subsp bovis AF2122/97
gaggaugcugagcgccag

SEQ ID NO: 3154279 - RNA, 19 nt, Mycobacterium bovis subsp bovis AF2122/97
gaggauguaguuggugaug

SEQ ID NO: 3154280 - RNA, 20 nt, Mycobacterium bovis subsp bovis AF2122/97
gaggaugucgagcccgucga

SEQ ID NO: 3154281 - RNA, 18 nt, Mycobacterium bovis subsp bovis AF2122/97
gaggauguugugccgauc

SEQ ID NO: 3154282 - RNA, 22 nt, Mycobacterium bovis subsp bovis AF2122/97
gaggauucggccguaucgucga

SEQ ID NO: 3154283 - RNA, 13 nt, Mycobacterium bovis subsp bovis AF2122/97
gaggcaacaagca

SEQ ID NO: 3154284 - RNA, 12 nt, Mycobacterium bovis subsp bovis AF2122/97
gaggcaaccagg

SEQ ID NO: 3154285 - RNA, 17 nt, Mycobacterium bovis subsp bovis AF2122/97
gaggcaauccgaucugg

SEQ ID NO: 3154286 - RNA, 16 nt, Mycobacterium bovis subsp bovis AF2122/97
gaggcacaaucaccgc

SEQ ID NO: 3154287 - RNA, 20 nt, Mycobacterium bovis subsp bovis AF2122/97
gaggcacaaucaccgccgcg

SEQ ID NO: 3154288 - RNA, 22 nt, Mycobacterium bovis subsp bovis AF2122/97
gaggcacaaucaccgccgcgac

SEQ ID NO: 3154289 - RNA, 16 nt, Mycobacterium bovis subsp bovis AF2122/97
gaggcaccgacaucgu

SEQ ID NO: 3154290 - RNA, 21 nt, Mycobacterium bovis subsp bovis AF2122/97
gaggcaggccucggcgccgcc

SEQ ID NO: 3154291 - RNA, 23 nt, Mycobacterium bovis subsp bovis AF2122/97
gaggcaggccucggcgccgccca

SEQ ID NO: 3154292 - RNA, 19 nt, Mycobacterium bovis subsp bovis AF2122/97
gaggcagucguugaugcuu

SEQ ID NO: 3154293 - RNA, 15 nt, Mycobacterium bovis subsp bovis AF2122/97
gaggcauucucccgg

SEQ ID NO: 3154294 - RNA, 16 nt, Mycobacterium bovis subsp bovis AF2122/97
gaggccaagauggcgc

SEQ ID NO: 3154295 - RNA, 18 nt, Mycobacterium bovis subsp bovis AF2122/97
gaggccaaguugcagcgg

SEQ ID NO: 3154296 - RNA, 20 nt, Mycobacterium bovis subsp bovis AF2122/97
gaggccaaguugcagcgggc

SEQ ID NO: 3154297 - RNA, 21 nt, Mycobacterium bovis subsp bovis AF2122/97
gaggccaaguugcagcgggcc

SEQ ID NO: 3154298 - RNA, 14 nt, Mycobacterium bovis subsp bovis AF2122/97
gaggccacgccagc

SEQ ID NO: 3154299 - RNA, 16 nt, Mycobacterium bovis subsp bovis AF2122/97
gaggccaugcucgcca

SEQ ID NO: 3154300 - RNA, 12 nt, Mycobacterium bovis subsp bovis AF2122/97
gaggccccccgc

SEQ ID NO: 3154301 - RNA, 19 nt, Mycobacterium bovis subsp bovis AF2122/97
gaggcccgaaaugccgggc

SEQ ID NO: 3154302 - RNA, 23 nt, Mycobacterium bovis subsp bovis AF2122/97
gaggcccgccacaacggcggcgc

SEQ ID NO: 3154303 - RNA, 15 nt, Mycobacterium bovis subsp bovis AF2122/97
gaggcccgcggugga

SEQ ID NO: 3154304 - RNA, 19 nt, Mycobacterium bovis subsp bovis AF2122/97
gaggcccgucacaaugccc

SEQ ID NO: 3154305 - RNA, 22 nt, Mycobacterium bovis subsp bovis AF2122/97
gaggccgacgacauugggcgcg

SEQ ID NO: 3154306 - RNA, 22 nt, Mycobacterium bovis subsp bovis AF2122/97
gagguagaccugguugaccucg

SEQ ID NO: 3154307 - RNA, 14 nt, Mycobacterium bovis subsp bovis AF2122/97
gagguagccgacga

SEQ ID NO: 3154308 - RNA, 19 nt, Mycobacterium bovis subsp bovis AF2122/97
gagguaggucgccgccgcc

SEQ ID NO: 3154309 - RNA, 18 nt, Mycobacterium bovis subsp bovis AF2122/97
gagguauaaacgcggcgc

SEQ ID NO: 3154310 - RNA, 19 nt, Mycobacterium bovis subsp bovis AF2122/97
gagguauaaacgcggcgcg

SEQ ID NO: 3154311 - RNA, 18 nt, Mycobacterium bovis subsp bovis AF2122/97
gaggucaaaaucagggug

SEQ ID NO: 3154312 - RNA, 16 nt, Mycobacterium bovis subsp bovis AF2122/97
gaggucaacgccacgc

SEQ ID NO: 3154313 - RNA, 19 nt, Mycobacterium bovis subsp bovis AF2122/97
gaggucaacgccacgccga

SEQ ID NO: 3154314 - RNA, 22 nt, Mycobacterium bovis subsp bovis AF2122/97
gaggucacccaucaacgccggc

SEQ ID NO: 3154315 - RNA, 14 nt, Mycobacterium bovis subsp bovis AF2122/97
gaggucacccggua

SEQ ID NO: 3154316 - RNA, 14 nt, Mycobacterium bovis subsp bovis AF2122/97
gaggucaccggcga

SEQ ID NO: 3154317 - RNA, 19 nt, Mycobacterium bovis subsp bovis AF2122/97
gaggucacgcagcacccug

SEQ ID NO: 3154318 - RNA, 14 nt, Mycobacterium bovis subsp bovis AF2122/97
gaggucagcucccg

SEQ ID NO: 3154319 - RNA, 14 nt, Mycobacterium bovis subsp bovis AF2122/97
gagguccaccaccc

SEQ ID NO: 3154320 - RNA, 12 nt, Mycobacterium bovis subsp bovis AF2122/97
gaggucccggcc

SEQ ID NO: 3154321 - RNA, 13 nt, Mycobacterium bovis subsp bovis AF2122/97
gagguccggugga

SEQ ID NO: 3154322 - RNA, 23 nt, Mycobacterium bovis subsp bovis AF2122/97
gagguccgguggacgaucuggca

SEQ ID NO: 3154323 - RNA, 17 nt, Mycobacterium bovis subsp bovis AF2122/97
gagguccucagcgaugc

SEQ ID NO: 3154324 - RNA, 19 nt, Mycobacterium bovis subsp bovis AF2122/97
gagguccucgucggcgucg

SEQ ID NO: 3154325 - RNA, 22 nt, Mycobacterium bovis subsp bovis AF2122/97
gaggucgaaccgccggcugcgc

SEQ ID NO: 3154326 - RNA, 22 nt, Mycobacterium bovis subsp bovis AF2122/97
gaggucgaucaggggcccaccc

SEQ ID NO: 3154327 - RNA, 17 nt, Mycobacterium bovis subsp bovis AF2122/97
gaggucgccaacccgau

SEQ ID NO: 3154328 - RNA, 16 nt, Mycobacterium bovis subsp bovis AF2122/97
gaggucggccagcagc

SEQ ID NO: 3154329 - RNA, 13 nt, Mycobacterium bovis subsp bovis AF2122/97
gaggucggcggcg

SEQ ID NO: 3154330 - RNA, 22 nt, Mycobacterium bovis subsp bovis AF2122/97
gaggucgguucggccggagccg

SEQ ID NO: 3154331 - RNA, 24 nt, Mycobacterium bovis subsp bovis AF2122/97
gaggucguaguucuucucucgggc

SEQ ID NO: 3154332 - RNA, 23 nt, Mycobacterium bovis subsp bovis AF2122/97
gaggucguuucccuggccgccgc

SEQ ID NO: 3154333 - RNA, 13 nt, Mycobacterium bovis subsp bovis AF2122/97
gaggucuacuucg

SEQ ID NO: 3154334 - RNA, 21 nt, Mycobacterium bovis subsp bovis AF2122/97
gaggucugguagagguugucg

SEQ ID NO: 3154335 - RNA, 14 nt, Mycobacterium bovis subsp bovis AF2122/97
gaggugaagccgag

SEQ ID NO: 3154336 - RNA, 22 nt, Mycobacterium bovis subsp bovis AF2122/97
gaggugauguuggccgccacac

SEQ ID NO: 3154337 - RNA, 19 nt, Mycobacterium bovis subsp bovis AF2122/97
gaggugcccaaggccagga

SEQ ID NO: 3154338 - RNA, 13 nt, Mycobacterium bovis subsp bovis AF2122/97
gaggugccgcgca

SEQ ID NO: 3154339 - RNA, 17 nt, Mycobacterium bovis subsp bovis AF2122/97
gaggugccgcgcagcug

SEQ ID NO: 3154340 - RNA, 18 nt, Mycobacterium bovis subsp bovis AF2122/97
gaggugccgcgcagcugc

SEQ ID NO: 3154341 - RNA, 19 nt, Mycobacterium bovis subsp bovis AF2122/97
gaggugccgcgcagcugcc

SEQ ID NO: 3154342 - RNA, 14 nt, Mycobacterium bovis subsp bovis AF2122/97
gaggugccggcgcc

SEQ ID NO: 3154343 - RNA, 20 nt, Mycobacterium bovis subsp bovis AF2122/97
gaggugccgggguggcgcgc

SEQ ID NO: 3154344 - RNA, 20 nt, Mycobacterium bovis subsp bovis AF2122/97
gaggugcucggaucggcucg

SEQ ID NO: 3154345 - RNA, 21 nt, Mycobacterium bovis subsp bovis AF2122/97
gaggugcucggaucggcucgc

SEQ ID NO: 3154346 - RNA, 14 nt, Mycobacterium bovis subsp bovis AF2122/97
gaggugcugcaccu

SEQ ID NO: 3154347 - RNA, 19 nt, Mycobacterium bovis subsp bovis AF2122/97
gaggugcuuggggucaccc

SEQ ID NO: 3154348 - RNA, 15 nt, Mycobacterium bovis subsp bovis AF2122/97
gagguggcgcggggc

SEQ ID NO: 3154349 - RNA, 12 nt, Mycobacterium bovis subsp bovis AF2122/97
gagguggcgggc

SEQ ID NO: 3154350 - RNA, 16 nt, Mycobacterium bovis subsp bovis AF2122/97
gagguggcggugcggc

SEQ ID NO: 3154351 - RNA, 14 nt, Mycobacterium bovis subsp bovis AF2122/97
gagguggggcagga

SEQ ID NO: 3154352 - RNA, 15 nt, Mycobacterium bovis subsp bovis AF2122/97
gagguggucagccgg

SEQ ID NO: 3154353 - RNA, 16 nt, Mycobacterium bovis subsp bovis AF2122/97
gaggugguucacgggg

SEQ ID NO: 3154354 - RNA, 20 nt, Mycobacterium bovis subsp bovis AF2122/97
gaggugguucacggggacca

SEQ ID NO: 3154355 - RNA, 15 nt, Mycobacterium bovis subsp bovis AF2122/97
gagguguagcccucc

SEQ ID NO: 3154356 - RNA, 17 nt, Mycobacterium bovis subsp bovis AF2122/97
gagguguggucgagcgg

SEQ ID NO: 3154357 - RNA, 14 nt, Mycobacterium bovis subsp bovis AF2122/97
gagguucugccgcg

SEQ ID NO: 3154358 - RNA, 15 nt, Mycobacterium bovis subsp bovis AF2122/97
gagguugccgcacca

SEQ ID NO: 3154359 - RNA, 18 nt, Mycobacterium bovis subsp bovis AF2122/97
gagguuggagcgccagcc

SEQ ID NO: 3154360 - RNA, 13 nt, Mycobacterium bovis subsp bovis AF2122/97
gagguuggcggcc

SEQ ID NO: 3154361 - RNA, 15 nt, Mycobacterium bovis subsp bovis AF2122/97
gagguugggaacagc

SEQ ID NO: 3154362 - RNA, 17 nt, Mycobacterium bovis subsp bovis AF2122/97
gaguaacacguggguga

SEQ ID NO: 3154363 - RNA, 15 nt, Mycobacterium bovis subsp bovis AF2122/97
gaguacaaaccucgg

SEQ ID NO: 3154364 - RNA, 18 nt, Mycobacterium bovis subsp bovis AF2122/97
gaguacaacagcgucugg

SEQ ID NO: 3154365 - RNA, 13 nt, Mycobacterium bovis subsp bovis AF2122/97
gaguacaggcgca

SEQ ID NO: 3154366 - RNA, 20 nt, Mycobacterium bovis subsp bovis AF2122/97
gaguaccagcccaccggcgc

SEQ ID NO: 3154367 - RNA, 22 nt, Mycobacterium bovis subsp bovis AF2122/97
gaguaccagcccaccggcgccg

SEQ ID NO: 3154368 - RNA, 15 nt, Mycobacterium bovis subsp bovis AF2122/97
gaguaccggccagcc

SEQ ID NO: 3154369 - RNA, 20 nt, Mycobacterium bovis subsp bovis AF2122/97
gaguaccggccagccgcggc

SEQ ID NO: 3154370 - RNA, 21 nt, Mycobacterium bovis subsp bovis AF2122/97
gaguacggccugccgcucgcc

SEQ ID NO: 3154371 - RNA, 16 nt, Mycobacterium bovis subsp bovis AF2122/97
gaguacggcgaugcgg

SEQ ID NO: 3154372 - RNA, 18 nt, Mycobacterium bovis subsp bovis AF2122/97
gaguacggcgaugcgguc

SEQ ID NO: 3154373 - RNA, 13 nt, Mycobacterium bovis subsp bovis AF2122/97
gaguacuccagcc

SEQ ID NO: 3154374 - RNA, 16 nt, Mycobacterium bovis subsp bovis AF2122/97
gaguacuccagccgca

SEQ ID NO: 3154375 - RNA, 17 nt, Mycobacterium bovis subsp bovis AF2122/97
gaguacuccagccgcaa

SEQ ID NO: 3154376 - RNA, 16 nt, Mycobacterium bovis subsp bovis AF2122/97
gaguagaagauggcac

SEQ ID NO: 3154377 - RNA, 17 nt, Mycobacterium bovis subsp bovis AF2122/97
gaguagaagauggcacc

SEQ ID NO: 3154378 - RNA, 18 nt, Mycobacterium bovis subsp bovis AF2122/97
gaguagccgcagcugagc

SEQ ID NO: 3154379 - RNA, 14 nt, Mycobacterium bovis subsp bovis AF2122/97
gaguagccggucgg

SEQ ID NO: 3154380 - RNA, 15 nt, Mycobacterium bovis subsp bovis AF2122/97
gaguagccggucggc

SEQ ID NO: 3154381 - RNA, 14 nt, Mycobacterium bovis subsp bovis AF2122/97
gaguagucgacguc

SEQ ID NO: 3154382 - RNA, 15 nt, Mycobacterium bovis subsp bovis AF2122/97
gaguagucgcuggcc

SEQ ID NO: 3154383 - RNA, 20 nt, Mycobacterium bovis subsp bovis AF2122/97
gaguauuggucgguggggua

SEQ ID NO: 3154384 - RNA, 20 nt, Mycobacterium bovis subsp bovis AF2122/97
gagucacccggccguugggc

SEQ ID NO: 3154385 - RNA, 14 nt, Mycobacterium bovis subsp bovis AF2122/97
gaguccagccggcg

SEQ ID NO: 3154386 - RNA, 14 nt, Mycobacterium bovis subsp bovis AF2122/97
gaguccaggccggc

SEQ ID NO: 3154387 - RNA, 19 nt, Mycobacterium bovis subsp bovis AF2122/97
gagucccacgccagcgcga

SEQ ID NO: 3154388 - RNA, 21 nt, Mycobacterium bovis subsp bovis AF2122/97
gagucccgucacucaccccaa

SEQ ID NO: 3154389 - RNA, 20 nt, Mycobacterium bovis subsp bovis AF2122/97
gaguccgacaguccgcgccg

SEQ ID NO: 3154390 - RNA, 21 nt, Mycobacterium bovis subsp bovis AF2122/97
gaguccgacaguccgcgccgg

SEQ ID NO: 3154391 - RNA, 17 nt, Mycobacterium bovis subsp bovis AF2122/97
gaguccgcugagcgggc

SEQ ID NO: 3154392 - RNA, 19 nt, Mycobacterium bovis subsp bovis AF2122/97
gaguccgcugagcgggcaa

SEQ ID NO: 3154393 - RNA, 17 nt, Mycobacterium bovis subsp bovis AF2122/97
gaguucguagucggcau

SEQ ID NO: 3154394 - RNA, 17 nt, Mycobacterium bovis subsp bovis AF2122/97
gaguucgucaccguugg

SEQ ID NO: 3154395 - RNA, 19 nt, Mycobacterium bovis subsp bovis AF2122/97
gaguucucgcugaucagca

SEQ ID NO: 3154396 - RNA, 18 nt, Mycobacterium bovis subsp bovis AF2122/97
gaguucuggaauccggcc

SEQ ID NO: 3154397 - RNA, 22 nt, Mycobacterium bovis subsp bovis AF2122/97
gaguucuggaauccggccagac

SEQ ID NO: 3154398 - RNA, 20 nt, Mycobacterium bovis subsp bovis AF2122/97
gaguugaacaauccgguguu

SEQ ID NO: 3154399 - RNA, 22 nt, Mycobacterium bovis subsp bovis AF2122/97
gaguugaacaauccgguguuga

SEQ ID NO: 3154400 - RNA, 12 nt, Mycobacterium bovis subsp bovis AF2122/97
gaguugaagaag

SEQ ID NO: 3154401 - RNA, 15 nt, Mycobacterium bovis subsp bovis AF2122/97
gaguugaagaagccc

SEQ ID NO: 3154402 - RNA, 22 nt, Mycobacterium bovis subsp bovis AF2122/97
gaguugaagaaucccgggcucu

SEQ ID NO: 3154403 - RNA, 22 nt, Mycobacterium bovis subsp bovis AF2122/97
gaguugaucuccacggcggugc

SEQ ID NO: 3154404 - RNA, 13 nt, Mycobacterium bovis subsp bovis AF2122/97
gaguugcagaccg

SEQ ID NO: 3154405 - RNA, 14 nt, Mycobacterium bovis subsp bovis AF2122/97
gaguugcagucgcg

SEQ ID NO: 3154406 - RNA, 20 nt, Mycobacterium bovis subsp bovis AF2122/97
gaguugcagucgcgagguga

SEQ ID NO: 3154407 - RNA, 20 nt, Mycobacterium bovis subsp bovis AF2122/97
gaguugcccucuggcucgcg

SEQ ID NO: 3154408 - RNA, 16 nt, Mycobacterium bovis subsp bovis AF2122/97
gaguugcuugcagggc

SEQ ID NO: 3154409 - RNA, 14 nt, Mycobacterium bovis subsp bovis AF2122/97
gaguuggccguggc

SEQ ID NO: 3154410 - RNA, 13 nt, Mycobacterium bovis subsp bovis AF2122/97
gaguuggcugccg

SEQ ID NO: 3154411 - RNA, 14 nt, Mycobacterium bovis subsp bovis AF2122/97
gaguuggcugccgg

SEQ ID NO: 3154412 - RNA, 16 nt, Mycobacterium bovis subsp bovis AF2122/97
gaguuggugcagcgac

SEQ ID NO: 3154413 - RNA, 20 nt, Mycobacterium bovis subsp bovis AF2122/97
gaguugucgacggccacccc

SEQ ID NO: 3154414 - RNA, 22 nt, Mycobacterium bovis subsp bovis AF2122/97
gaguuguggacgcccgaguuga

SEQ ID NO: 3154415 - RNA, 16 nt, Mycobacterium bovis subsp bovis AF2122/97
gaguuguucagcccgu

SEQ ID NO: 3154416 - RNA, 22 nt, Mycobacterium bovis subsp bovis AF2122/97
gaguuguucgcccacaugccgg

SEQ ID NO: 3154417 - RNA, 15 nt, Mycobacterium bovis subsp bovis AF2122/97
gaguuuaugcccggc

SEQ ID NO: 3154418 - RNA, 12 nt, Mycobacterium bovis subsp bovis AF2122/97
gaguuucugcuc

SEQ ID NO: 3154419 - RNA, 12 nt, Mycobacterium bovis subsp bovis AF2122/97
gaguuuuucggg

SEQ ID NO: 3154420 - RNA, 18 nt, Mycobacterium bovis subsp bovis AF2122/97
gauaaaaaccacccccac

SEQ ID NO: 3154421 - RNA, 14 nt, Mycobacterium bovis subsp bovis AF2122/97
gauaaacccggcga

SEQ ID NO: 3154422 - RNA, 16 nt, Mycobacterium bovis subsp bovis AF2122/97
gauaaacugccgcggc

SEQ ID NO: 3154423 - RNA, 15 nt, Mycobacterium bovis subsp bovis AF2122/97
gauaaagccgcugaa

SEQ ID NO: 3154424 - RNA, 14 nt, Mycobacterium bovis subsp bovis AF2122/97
gauaaccaccaucu

SEQ ID NO: 3154425 - RNA, 15 nt, Mycobacterium bovis subsp bovis AF2122/97
gauaaccaccaucug

SEQ ID NO: 3154426 - RNA, 22 nt, Mycobacterium bovis subsp bovis AF2122/97
gauaacccaaccgcgccaccuc

SEQ ID NO: 3154427 - RNA, 15 nt, Mycobacterium bovis subsp bovis AF2122/97
gauaacccagcacca

SEQ ID NO: 3154428 - RNA, 17 nt, Mycobacterium bovis subsp bovis AF2122/97
gauaacccagcaccaca

SEQ ID NO: 3154429 - RNA, 17 nt, Mycobacterium bovis subsp bovis AF2122/97
gauaacccagcggcgcc

SEQ ID NO: 3154430 - RNA, 22 nt, Mycobacterium bovis subsp bovis AF2122/97
gauaaccgcgaccagcuggccg

SEQ ID NO: 3154431 - RNA, 17 nt, Mycobacterium bovis subsp bovis AF2122/97
gauaaccucagcgcggu

SEQ ID NO: 3154432 - RNA, 23 nt, Mycobacterium bovis subsp bovis AF2122/97
gauaacgacgucggcgcguccgc

SEQ ID NO: 3154433 - RNA, 16 nt, Mycobacterium bovis subsp bovis AF2122/97
gauaacggcgaccgcc

SEQ ID NO: 3154434 - RNA, 17 nt, Mycobacterium bovis subsp bovis AF2122/97
gauaacggcgaccgcca

SEQ ID NO: 3154435 - RNA, 14 nt, Mycobacterium bovis subsp bovis AF2122/97
gauaaggaccgcgc

SEQ ID NO: 3154436 - RNA, 13 nt, Mycobacterium bovis subsp bovis AF2122/97
gauaaggaucaga

SEQ ID NO: 3154437 - RNA, 16 nt, Mycobacterium bovis subsp bovis AF2122/97
gauaaggaugcaucgc

SEQ ID NO: 3154438 - RNA, 21 nt, Mycobacterium bovis subsp bovis AF2122/97
gauaaucauccgagcgguggu

SEQ ID NO: 3154439 - RNA, 16 nt, Mycobacterium bovis subsp bovis AF2122/97
gauaaucguuuucggc

SEQ ID NO: 3154440 - RNA, 19 nt, Mycobacterium bovis subsp bovis AF2122/97
gauaaugaucucggcaagg

SEQ ID NO: 3154441 - RNA, 23 nt, Mycobacterium bovis subsp bovis AF2122/97
gauaauggccgaguccggcaaga

SEQ ID NO: 3154442 - RNA, 16 nt, Mycobacterium bovis subsp bovis AF2122/97
gauaauucaacagcac

SEQ ID NO: 3154443 - RNA, 16 nt, Mycobacterium bovis subsp bovis AF2122/97
gauacaccgacgggau

SEQ ID NO: 3154444 - RNA, 14 nt, Mycobacterium bovis subsp bovis AF2122/97
gauacacggcggcg

SEQ ID NO: 3154445 - RNA, 20 nt, Mycobacterium bovis subsp bovis AF2122/97
gauacagacggggaucgguc

SEQ ID NO: 3154446 - RNA, 18 nt, Mycobacterium bovis subsp bovis AF2122/97
gauacagcacauccagcc

SEQ ID NO: 3154447 - RNA, 15 nt, Mycobacterium bovis subsp bovis AF2122/97
gauacagccgccgcc

SEQ ID NO: 3154448 - RNA, 19 nt, Mycobacterium bovis subsp bovis AF2122/97
gauacagccgccgccggca

SEQ ID NO: 3154449 - RNA, 16 nt, Mycobacterium bovis subsp bovis AF2122/97
gauacagcgccagggg

SEQ ID NO: 3154450 - RNA, 19 nt, Mycobacterium bovis subsp bovis AF2122/97
gauacagcgccaggggugu

SEQ ID NO: 3154451 - RNA, 12 nt, Mycobacterium bovis subsp bovis AF2122/97
gauacagcucgg

SEQ ID NO: 3154452 - RNA, 19 nt, Mycobacterium bovis subsp bovis AF2122/97
gauacagcucggugcacgg

SEQ ID NO: 3154453 - RNA, 21 nt, Mycobacterium bovis subsp bovis AF2122/97
gauacagcucggugcacggcg

SEQ ID NO: 3154454 - RNA, 24 nt, Mycobacterium bovis subsp bovis AF2122/97
gauacaugguccggccgcggaccg

SEQ ID NO: 3154455 - RNA, 15 nt, Mycobacterium bovis subsp bovis AF2122/97
gauacauuucccagu

SEQ ID NO: 3154456 - RNA, 13 nt, Mycobacterium bovis subsp bovis AF2122/97
gauaccaccgccg

SEQ ID NO: 3154457 - RNA, 23 nt, Mycobacterium bovis subsp bovis AF2122/97
gauacccaccguuugggcgccgg

SEQ ID NO: 3154458 - RNA, 13 nt, Mycobacterium bovis subsp bovis AF2122/97
gauacccagcgcc

SEQ ID NO: 3154459 - RNA, 15 nt, Mycobacterium bovis subsp bovis AF2122/97
gauacccagcgcccg

SEQ ID NO: 3154460 - RNA, 19 nt, Mycobacterium bovis subsp bovis AF2122/97
gauacccagcgggucgcgg

SEQ ID NO: 3154461 - RNA, 18 nt, Mycobacterium bovis subsp bovis AF2122/97
gauaccccuccgaucacg

SEQ ID NO: 3154462 - RNA, 14 nt, Mycobacterium bovis subsp bovis AF2122/97
gauaccgaccaucg

SEQ ID NO: 3154463 - RNA, 15 nt, Mycobacterium bovis subsp bovis AF2122/97
gauaccgaccaucgg

SEQ ID NO: 3154464 - RNA, 19 nt, Mycobacterium bovis subsp bovis AF2122/97
gauaccgacgcgcucggcg

SEQ ID NO: 3154465 - RNA, 22 nt, Mycobacterium bovis subsp bovis AF2122/97
gauaccgccggccccaccggug

SEQ ID NO: 3154466 - RNA, 12 nt, Mycobacterium bovis subsp bovis AF2122/97
gauaccgcuggg

SEQ ID NO: 3154467 - RNA, 15 nt, Mycobacterium bovis subsp bovis AF2122/97
gauaccggcgugcag

SEQ ID NO: 3154468 - RNA, 15 nt, Mycobacterium bovis subsp bovis AF2122/97
gauaccggucagcac

SEQ ID NO: 3154469 - RNA, 23 nt, Mycobacterium bovis subsp bovis AF2122/97
gauaccgguugcggucaucggcg

SEQ ID NO: 3154470 - RNA, 15 nt, Mycobacterium bovis subsp bovis AF2122/97
gauaccgucagcgcc

SEQ ID NO: 3154471 - RNA, 16 nt, Mycobacterium bovis subsp bovis AF2122/97
gauaccgucagcgccg

SEQ ID NO: 3154472 - RNA, 14 nt, Mycobacterium bovis subsp bovis AF2122/97
gauaccucgccauc

SEQ ID NO: 3154473 - RNA, 19 nt, Mycobacterium bovis subsp bovis AF2122/97
gauaccugcccacgcggau

SEQ ID NO: 3154474 - RNA, 22 nt, Mycobacterium bovis subsp bovis AF2122/97
gauacgaagccgccgcgaccaa

SEQ ID NO: 3154475 - RNA, 20 nt, Mycobacterium bovis subsp bovis AF2122/97
gauacgccccugguccaccc

SEQ ID NO: 3154476 - RNA, 19 nt, Mycobacterium bovis subsp bovis AF2122/97
gauacgcgcaccguggcgg

SEQ ID NO: 3154477 - RNA, 16 nt, Mycobacterium bovis subsp bovis AF2122/97
gauacgcgucgaucaa

SEQ ID NO: 3154478 - RNA, 13 nt, Mycobacterium bovis subsp bovis AF2122/97
gauacggccacca

SEQ ID NO: 3154479 - RNA, 15 nt, Mycobacterium bovis subsp bovis AF2122/97
gauacgggccaccgu

SEQ ID NO: 3154480 - RNA, 22 nt, Mycobacterium bovis subsp bovis AF2122/97
gaucaagcgcacaaacgacucg

SEQ ID NO: 3154481 - RNA, 21 nt, Mycobacterium bovis subsp bovis AF2122/97
gaucaaggcgcucccggagca

SEQ ID NO: 3154482 - RNA, 20 nt, Mycobacterium bovis subsp bovis AF2122/97
gaucaaugcugcguccugga

SEQ ID NO: 3154483 - RNA, 17 nt, Mycobacterium bovis subsp bovis AF2122/97
gaucacaccccaggcac

SEQ ID NO: 3154484 - RNA, 15 nt, Mycobacterium bovis subsp bovis AF2122/97
gaucacaccgcugcu

SEQ ID NO: 3154485 - RNA, 18 nt, Mycobacterium bovis subsp bovis AF2122/97
gaucacacuggccugcuc

SEQ ID NO: 3154486 - RNA, 20 nt, Mycobacterium bovis subsp bovis AF2122/97
gaucacauaggucacaaacg

SEQ ID NO: 3154487 - RNA, 17 nt, Mycobacterium bovis subsp bovis AF2122/97
gaucaccagucgcugau

SEQ ID NO: 3154488 - RNA, 19 nt, Mycobacterium bovis subsp bovis AF2122/97
gaucaccauccagcccauc

SEQ ID NO: 3154489 - RNA, 22 nt, Mycobacterium bovis subsp bovis AF2122/97
gaucaccauccagcccaucccg

SEQ ID NO: 3154490 - RNA, 15 nt, Mycobacterium bovis subsp bovis AF2122/97
gaucaccaucgccgc

SEQ ID NO: 3154491 - RNA, 23 nt, Mycobacterium bovis subsp bovis AF2122/97
gaucaccaugaucagcgccgugg

SEQ ID NO: 3154492 - RNA, 16 nt, Mycobacterium bovis subsp bovis AF2122/97
gaucacccacucgacg

SEQ ID NO: 3154493 - RNA, 22 nt, Mycobacterium bovis subsp bovis AF2122/97
gaucacccacucgacgucgucg

SEQ ID NO: 3154494 - RNA, 15 nt, Mycobacterium bovis subsp bovis AF2122/97
gaucaccccggccgg

SEQ ID NO: 3154495 - RNA, 17 nt, Mycobacterium bovis subsp bovis AF2122/97
gaucaccccggucggcc

SEQ ID NO: 3154496 - RNA, 14 nt, Mycobacterium bovis subsp bovis AF2122/97
gaucacccgcagcc

SEQ ID NO: 3154497 - RNA, 21 nt, Mycobacterium bovis subsp bovis AF2122/97
gaucacccgcaucggcacgcc

SEQ ID NO: 3154498 - RNA, 22 nt, Mycobacterium bovis subsp bovis AF2122/97
gaucacccgccgcgugcugcgg

SEQ ID NO: 3154499 - RNA, 19 nt, Mycobacterium bovis subsp bovis AF2122/97
gaucaccgacaccgugucg

SEQ ID NO: 3154500 - RNA, 19 nt, Mycobacterium bovis subsp bovis AF2122/97
gaucaccgacaccguguug

SEQ ID NO: 3154501 - RNA, 13 nt, Mycobacterium bovis subsp bovis AF2122/97
gaucaccgagucg

SEQ ID NO: 3154502 - RNA, 20 nt, Mycobacterium bovis subsp bovis AF2122/97
gaucaccgagucgacggcca

SEQ ID NO: 3154503 - RNA, 20 nt, Mycobacterium bovis subsp bovis AF2122/97
gaucaccgccggggcuggug

SEQ ID NO: 3154504 - RNA, 13 nt, Mycobacterium bovis subsp bovis AF2122/97
gaucaccgcgccg

SEQ ID NO: 3154505 - RNA, 16 nt, Mycobacterium bovis subsp bovis AF2122/97
gaucaccgcggcgguc

SEQ ID NO: 3154506 - RNA, 23 nt, Mycobacterium bovis subsp bovis AF2122/97
gaucaccgcguaguccaggccgu

SEQ ID NO: 3154507 - RNA, 13 nt, Mycobacterium bovis subsp bovis AF2122/97
gaucaccgcugug

SEQ ID NO: 3154508 - RNA, 12 nt, Mycobacterium bovis subsp bovis AF2122/97
gaucaccggcau

SEQ ID NO: 3154509 - RNA, 21 nt, Mycobacterium bovis subsp bovis AF2122/97
gaucaccgucguacucggcgg

SEQ ID NO: 3154510 - RNA, 23 nt, Mycobacterium bovis subsp bovis AF2122/97
gaucaccguugcguuggcgccac

SEQ ID NO: 3154511 - RNA, 14 nt, Mycobacterium bovis subsp bovis AF2122/97
gaucaccucggcga

SEQ ID NO: 3154512 - RNA, 16 nt, Mycobacterium bovis subsp bovis AF2122/97
gaucaccucggugccg

SEQ ID NO: 3154513 - RNA, 21 nt, Mycobacterium bovis subsp bovis AF2122/97
gaucaccucggugccggccgc

SEQ ID NO: 3154514 - RNA, 13 nt, Mycobacterium bovis subsp bovis AF2122/97
gaucaccugcagc

SEQ ID NO: 3154515 - RNA, 14 nt, Mycobacterium bovis subsp bovis AF2122/97
gaucaccugcagca

SEQ ID NO: 3154516 - RNA, 22 nt, Mycobacterium bovis subsp bovis AF2122/97
gaucaccuucggccgaccgggc

SEQ ID NO: 3154517 - RNA, 20 nt, Mycobacterium bovis subsp bovis AF2122/97
gaucaccuucgucgcggccg

SEQ ID NO: 3154518 - RNA, 21 nt, Mycobacterium bovis subsp bovis AF2122/97
gaucaccuugccuagccgcag

SEQ ID NO: 3154519 - RNA, 20 nt, Mycobacterium bovis subsp bovis AF2122/97
gaucaccuuggcaagcacgc

SEQ ID NO: 3154520 - RNA, 14 nt, Mycobacterium bovis subsp bovis AF2122/97
gaucacgaccgcgc

SEQ ID NO: 3154521 - RNA, 23 nt, Mycobacterium bovis subsp bovis AF2122/97
gaucacgaugcgguucucgagcu

SEQ ID NO: 3154522 - RNA, 15 nt, Mycobacterium bovis subsp bovis AF2122/97
gaucacgccaccauc

SEQ ID NO: 3154523 - RNA, 15 nt, Mycobacterium bovis subsp bovis AF2122/97
gaucacgccgacgau

SEQ ID NO: 3154524 - RNA, 12 nt, Mycobacterium bovis subsp bovis AF2122/97
gaucacgccgcc

SEQ ID NO: 3154525 - RNA, 14 nt, Mycobacterium bovis subsp bovis AF2122/97
gaucacgccgccgg

SEQ ID NO: 3154526 - RNA, 19 nt, Mycobacterium bovis subsp bovis AF2122/97
gaucacgccgccggcgaag

SEQ ID NO: 3154527 - RNA, 16 nt, Mycobacterium bovis subsp bovis AF2122/97
gaucacggccgucgau

SEQ ID NO: 3154528 - RNA, 12 nt, Mycobacterium bovis subsp bovis AF2122/97
gaucacggcggc

SEQ ID NO: 3154529 - RNA, 16 nt, Mycobacterium bovis subsp bovis AF2122/97
gaucacggcggccccg

SEQ ID NO: 3154530 - RNA, 23 nt, Mycobacterium bovis subsp bovis AF2122/97
gaucacggcgggaugcagcugcc

SEQ ID NO: 3154531 - RNA, 14 nt, Mycobacterium bovis subsp bovis AF2122/97
gaucacggucggcg

SEQ ID NO: 3154532 - RNA, 20 nt, Mycobacterium bovis subsp bovis AF2122/97
gaucacguacgccgccgauc

SEQ ID NO: 3154533 - RNA, 21 nt, Mycobacterium bovis subsp bovis AF2122/97
gaucacguacgccgccgauca

SEQ ID NO: 3154534 - RNA, 23 nt, Mycobacterium bovis subsp bovis AF2122/97
gaucacguacgccgccgaucacc

SEQ ID NO: 3154535 - RNA, 13 nt, Mycobacterium bovis subsp bovis AF2122/97
gaucacgucggcg

SEQ ID NO: 3154536 - RNA, 22 nt, Mycobacterium bovis subsp bovis AF2122/97
gaucacucccccacacacccga

SEQ ID NO: 3154537 - RNA, 12 nt, Mycobacterium bovis subsp bovis AF2122/97
gaucacugucgg

SEQ ID NO: 3154538 - RNA, 16 nt, Mycobacterium bovis subsp bovis AF2122/97
gaucagaaucugccuc

SEQ ID NO: 3154539 - RNA, 16 nt, Mycobacterium bovis subsp bovis AF2122/97
gaucagacccagcgcg

SEQ ID NO: 3154540 - RNA, 16 nt, Mycobacterium bovis subsp bovis AF2122/97
gaucagacgcucgacc

SEQ ID NO: 3154541 - RNA, 13 nt, Mycobacterium bovis subsp bovis AF2122/97
gaucagaucccgc

SEQ ID NO: 3154542 - RNA, 16 nt, Mycobacterium bovis subsp bovis AF2122/97
gaucagaucccgccgc

SEQ ID NO: 3154543 - RNA, 16 nt, Mycobacterium bovis subsp bovis AF2122/97
gaucagcaacggcagc

SEQ ID NO: 3154544 - RNA, 22 nt, Mycobacterium bovis subsp bovis AF2122/97
gaucagcaacggcagcgaggcc

SEQ ID NO: 3154545 - RNA, 19 nt, Mycobacterium bovis subsp bovis AF2122/97
gaucagcaacucggccacg

SEQ ID NO: 3154546 - RNA, 21 nt, Mycobacterium bovis subsp bovis AF2122/97
gaucagcacgucgcggccgug

SEQ ID NO: 3154547 - RNA, 17 nt, Mycobacterium bovis subsp bovis AF2122/97
gaucagcagcggcgacc

SEQ ID NO: 3154548 - RNA, 14 nt, Mycobacterium bovis subsp bovis AF2122/97
gaucagcagcgucg

SEQ ID NO: 3154549 - RNA, 16 nt, Mycobacterium bovis subsp bovis AF2122/97
gaucagcagcuguugg

SEQ ID NO: 3154550 - RNA, 14 nt, Mycobacterium bovis subsp bovis AF2122/97
gaucagcaggacga

SEQ ID NO: 3154551 - RNA, 22 nt, Mycobacterium bovis subsp bovis AF2122/97
gaucagcaggaucggcagcaga

SEQ ID NO: 3154552 - RNA, 14 nt, Mycobacterium bovis subsp bovis AF2122/97
gaucagcaugcccu

SEQ ID NO: 3154553 - RNA, 22 nt, Mycobacterium bovis subsp bovis AF2122/97
gaucagcaugcccucgcuguug

SEQ ID NO: 3154554 - RNA, 18 nt, Mycobacterium bovis subsp bovis AF2122/97
gaucagcaugcggccaug

SEQ ID NO: 3154555 - RNA, 21 nt, Mycobacterium bovis subsp bovis AF2122/97
gaucagcaugcggccaugguc

SEQ ID NO: 3154556 - RNA, 13 nt, Mycobacterium bovis subsp bovis AF2122/97
gaucagccagacc

SEQ ID NO: 3154557 - RNA, 14 nt, Mycobacterium bovis subsp bovis AF2122/97
gaucagcccgcgca

SEQ ID NO: 3154558 - RNA, 23 nt, Mycobacterium bovis subsp bovis AF2122/97
gaucagcccggccuugccgccgg

SEQ ID NO: 3154559 - RNA, 15 nt, Mycobacterium bovis subsp bovis AF2122/97
gaucagccgccgccu

SEQ ID NO: 3154560 - RNA, 21 nt, Mycobacterium bovis subsp bovis AF2122/97
gaucagccgccgccugugcgc

SEQ ID NO: 3154561 - RNA, 20 nt, Mycobacterium bovis subsp bovis AF2122/97
gaucagccgggugcgcaccc

SEQ ID NO: 3154562 - RNA, 15 nt, Mycobacterium bovis subsp bovis AF2122/97
gaucagccgugcggg

SEQ ID NO: 3154563 - RNA, 17 nt, Mycobacterium bovis subsp bovis AF2122/97
gaucagccgugcgggcc

SEQ ID NO: 3154564 - RNA, 18 nt, Mycobacterium bovis subsp bovis AF2122/97
gaucagccgugcgggccg

SEQ ID NO: 3154565 - RNA, 22 nt, Mycobacterium bovis subsp bovis AF2122/97
gaucagccguggcagucgcacg

SEQ ID NO: 3154566 - RNA, 18 nt, Mycobacterium bovis subsp bovis AF2122/97
gauccaggcccagccgag

SEQ ID NO: 3154567 - RNA, 23 nt, Mycobacterium bovis subsp bovis AF2122/97
gauccaggcccagccgagcggcg

SEQ ID NO: 3154568 - RNA, 18 nt, Mycobacterium bovis subsp bovis AF2122/97
gauccagggagcggcugc

SEQ ID NO: 3154569 - RNA, 19 nt, Mycobacterium bovis subsp bovis AF2122/97
gauccagggccgacgcgaa

SEQ ID NO: 3154570 - RNA, 23 nt, Mycobacterium bovis subsp bovis AF2122/97
gauccagggccuucgggccagga

SEQ ID NO: 3154571 - RNA, 15 nt, Mycobacterium bovis subsp bovis AF2122/97
gaucccaacgcccgg

SEQ ID NO: 3154572 - RNA, 23 nt, Mycobacterium bovis subsp bovis AF2122/97
gaucccaacgcccgggcgaaucc

SEQ ID NO: 3154573 - RNA, 14 nt, Mycobacterium bovis subsp bovis AF2122/97
gaucccacccucgg

SEQ ID NO: 3154574 - RNA, 22 nt, Mycobacterium bovis subsp bovis AF2122/97
gaucccaccggcuaugcuggcg

SEQ ID NO: 3154575 - RNA, 14 nt, Mycobacterium bovis subsp bovis AF2122/97
gaucccacgaaucc

SEQ ID NO: 3154576 - RNA, 13 nt, Mycobacterium bovis subsp bovis AF2122/97
gaucccagcccga

SEQ ID NO: 3154577 - RNA, 19 nt, Mycobacterium bovis subsp bovis AF2122/97
gaucccagcgcagcggacg

SEQ ID NO: 3154578 - RNA, 12 nt, Mycobacterium bovis subsp bovis AF2122/97
gaucccagcggg

SEQ ID NO: 3154579 - RNA, 18 nt, Mycobacterium bovis subsp bovis AF2122/97
gaucccaguccgauggug

SEQ ID NO: 3154580 - RNA, 13 nt, Mycobacterium bovis subsp bovis AF2122/97
gauccccaaaucg

SEQ ID NO: 3154581 - RNA, 13 nt, Mycobacterium bovis subsp bovis AF2122/97
gauccccacgaua

SEQ ID NO: 3154582 - RNA, 13 nt, Mycobacterium bovis subsp bovis AF2122/97
gauccccagcucc

SEQ ID NO: 3154583 - RNA, 16 nt, Mycobacterium bovis subsp bovis AF2122/97
gauccccgcaauuccc

SEQ ID NO: 3154584 - RNA, 19 nt, Mycobacterium bovis subsp bovis AF2122/97
gauccccgcaauucccauc

SEQ ID NO: 3154585 - RNA, 18 nt, Mycobacterium bovis subsp bovis AF2122/97
gauccccgccaccgaacg

SEQ ID NO: 3154586 - RNA, 21 nt, Mycobacterium bovis subsp bovis AF2122/97
gauccccgccaccgaacgcac

SEQ ID NO: 3154587 - RNA, 13 nt, Mycobacterium bovis subsp bovis AF2122/97
gauccccgcguuc

SEQ ID NO: 3154588 - RNA, 17 nt, Mycobacterium bovis subsp bovis AF2122/97
gauccccgcguucggcg

SEQ ID NO: 3154589 - RNA, 20 nt, Mycobacterium bovis subsp bovis AF2122/97
gauccccgcguucggcggcg

SEQ ID NO: 3154590 - RNA, 20 nt, Mycobacterium bovis subsp bovis AF2122/97
gauccccguugacccagacc

SEQ ID NO: 3154591 - RNA, 16 nt, Mycobacterium bovis subsp bovis AF2122/97
gaucccgaucgaucag

SEQ ID NO: 3154592 - RNA, 16 nt, Mycobacterium bovis subsp bovis AF2122/97
gaucccgaucgcgcug

SEQ ID NO: 3154593 - RNA, 16 nt, Mycobacterium bovis subsp bovis AF2122/97
gaucccgaugcuggca

SEQ ID NO: 3154594 - RNA, 13 nt, Mycobacterium bovis subsp bovis AF2122/97
gaucccgcccaag

SEQ ID NO: 3154595 - RNA, 22 nt, Mycobacterium bovis subsp bovis AF2122/97
gaucccgccgaucgaaccgcug

SEQ ID NO: 3154596 - RNA, 13 nt, Mycobacterium bovis subsp bovis AF2122/97
gaucccgccgcgg

SEQ ID NO: 3154597 - RNA, 16 nt, Mycobacterium bovis subsp bovis AF2122/97
gaucccgccgcugccg

SEQ ID NO: 3154598 - RNA, 21 nt, Mycobacterium bovis subsp bovis AF2122/97
gaucccgcugaccuggggugu

SEQ ID NO: 3154599 - RNA, 13 nt, Mycobacterium bovis subsp bovis AF2122/97
gaucccggccagg

SEQ ID NO: 3154600 - RNA, 19 nt, Mycobacterium bovis subsp bovis AF2122/97
gaucccggccaggccgaca

SEQ ID NO: 3154601 - RNA, 18 nt, Mycobacterium bovis subsp bovis AF2122/97
gaucccggcgagcacccg

SEQ ID NO: 3154602 - RNA, 18 nt, Mycobacterium bovis subsp bovis AF2122/97
gaucccgguggcagcaca

SEQ ID NO: 3154603 - RNA, 16 nt, Mycobacterium bovis subsp bovis AF2122/97
gaucccguccgcgccc

SEQ ID NO: 3154604 - RNA, 13 nt, Mycobacterium bovis subsp bovis AF2122/97
gaucccgucgggc

SEQ ID NO: 3154605 - RNA, 15 nt, Mycobacterium bovis subsp bovis AF2122/97
gaucccgucgggcac

SEQ ID NO: 3154606 - RNA, 17 nt, Mycobacterium bovis subsp bovis AF2122/97
gauccgaagagccagca

SEQ ID NO: 3154607 - RNA, 15 nt, Mycobacterium bovis subsp bovis AF2122/97
gauccgacgaccgca

SEQ ID NO: 3154608 - RNA, 21 nt, Mycobacterium bovis subsp bovis AF2122/97
gauccgauaaauggccgauga

SEQ ID NO: 3154609 - RNA, 16 nt, Mycobacterium bovis subsp bovis AF2122/97
gauccgaugacauaug

SEQ ID NO: 3154610 - RNA, 20 nt, Mycobacterium bovis subsp bovis AF2122/97
gauccgauuggcgaucuugc

SEQ ID NO: 3154611 - RNA, 20 nt, Mycobacterium bovis subsp bovis AF2122/97
gauccgcaacaacgccgcga

SEQ ID NO: 3154612 - RNA, 14 nt, Mycobacterium bovis subsp bovis AF2122/97
gauccgcacagcaa

SEQ ID NO: 3154613 - RNA, 15 nt, Mycobacterium bovis subsp bovis AF2122/97
gauccgcaccacgcc

SEQ ID NO: 3154614 - RNA, 21 nt, Mycobacterium bovis subsp bovis AF2122/97
gauccgcaccacgcccgacga

SEQ ID NO: 3154615 - RNA, 22 nt, Mycobacterium bovis subsp bovis AF2122/97
gauccgcaccccauacucggcg

SEQ ID NO: 3154616 - RNA, 17 nt, Mycobacterium bovis subsp bovis AF2122/97
gauccgcacccggccgc

SEQ ID NO: 3154617 - RNA, 23 nt, Mycobacterium bovis subsp bovis AF2122/97
gauccgcacccggccgcgcaccc

SEQ ID NO: 3154618 - RNA, 17 nt, Mycobacterium bovis subsp bovis AF2122/97
gauccgccacgaaucgc

SEQ ID NO: 3154619 - RNA, 17 nt, Mycobacterium bovis subsp bovis AF2122/97
gauccgccagaccgcgg

SEQ ID NO: 3154620 - RNA, 13 nt, Mycobacterium bovis subsp bovis AF2122/97
gauccgcccgccu

SEQ ID NO: 3154621 - RNA, 15 nt, Mycobacterium bovis subsp bovis AF2122/97
gauccgccgacagcc

SEQ ID NO: 3154622 - RNA, 20 nt, Mycobacterium bovis subsp bovis AF2122/97
gauccgccgacagcccacga

SEQ ID NO: 3154623 - RNA, 14 nt, Mycobacterium bovis subsp bovis AF2122/97
gauccgccugccga

SEQ ID NO: 3154624 - RNA, 16 nt, Mycobacterium bovis subsp bovis AF2122/97
gauccgccugccgacg

SEQ ID NO: 3154625 - RNA, 17 nt, Mycobacterium bovis subsp bovis AF2122/97
gauccgccugccgacgg

SEQ ID NO: 3154626 - RNA, 14 nt, Mycobacterium bovis subsp bovis AF2122/97
gauccgcgcgcugg

SEQ ID NO: 3154627 - RNA, 20 nt, Mycobacterium bovis subsp bovis AF2122/97
gauccgcggcguuccccgag

SEQ ID NO: 3154628 - RNA, 13 nt, Mycobacterium bovis subsp bovis AF2122/97
gauccgcuagccc

SEQ ID NO: 3154629 - RNA, 18 nt, Mycobacterium bovis subsp bovis AF2122/97
gauccgcuagccccgauc

SEQ ID NO: 3154630 - RNA, 19 nt, Mycobacterium bovis subsp bovis AF2122/97
gauccgcucacccgcccgg

SEQ ID NO: 3154631 - RNA, 18 nt, Mycobacterium bovis subsp bovis AF2122/97
gauccgcugcgccgaggc

SEQ ID NO: 3154632 - RNA, 13 nt, Mycobacterium bovis subsp bovis AF2122/97
gauccgcugggcc

SEQ ID NO: 3154633 - RNA, 17 nt, Mycobacterium bovis subsp bovis AF2122/97
gauccggaucccaccac

SEQ ID NO: 3154634 - RNA, 18 nt, Mycobacterium bovis subsp bovis AF2122/97
gauccggcaauugugcug

SEQ ID NO: 3154635 - RNA, 18 nt, Mycobacterium bovis subsp bovis AF2122/97
gauccggcagcagccggc

SEQ ID NO: 3154636 - RNA, 19 nt, Mycobacterium bovis subsp bovis AF2122/97
gauccggcagcagccggcg

SEQ ID NO: 3154637 - RNA, 19 nt, Mycobacterium bovis subsp bovis AF2122/97
gauccggccaacggcaccc

SEQ ID NO: 3154638 - RNA, 14 nt, Mycobacterium bovis subsp bovis AF2122/97
gauccggccagagu

SEQ ID NO: 3154639 - RNA, 12 nt, Mycobacterium bovis subsp bovis AF2122/97
gauccggccagg

SEQ ID NO: 3154640 - RNA, 14 nt, Mycobacterium bovis subsp bovis AF2122/97
gauccggccgccga

SEQ ID NO: 3154641 - RNA, 16 nt, Mycobacterium bovis subsp bovis AF2122/97
gauccggcgccauucg

SEQ ID NO: 3154642 - RNA, 13 nt, Mycobacterium bovis subsp bovis AF2122/97
gauccggcugcgg

SEQ ID NO: 3154643 - RNA, 13 nt, Mycobacterium bovis subsp bovis AF2122/97
gauccgggcgccg

SEQ ID NO: 3154644 - RNA, 15 nt, Mycobacterium bovis subsp bovis AF2122/97
gauccgggcguggug

SEQ ID NO: 3154645 - RNA, 13 nt, Mycobacterium bovis subsp bovis AF2122/97
gauccggguggcg

SEQ ID NO: 3154646 - RNA, 23 nt, Mycobacterium bovis subsp bovis AF2122/97
gauccggguggcgucaccgccgg

SEQ ID NO: 3154647 - RNA, 14 nt, Mycobacterium bovis subsp bovis AF2122/97
gauccggucggcca

SEQ ID NO: 3154648 - RNA, 16 nt, Mycobacterium bovis subsp bovis AF2122/97
gauccggucggccagg

SEQ ID NO: 3154649 - RNA, 16 nt, Mycobacterium bovis subsp bovis AF2122/97
gauccggucgggggcg

SEQ ID NO: 3154650 - RNA, 20 nt, Mycobacterium bovis subsp bovis AF2122/97
gauccggugccgcgaucgcg

SEQ ID NO: 3154651 - RNA, 21 nt, Mycobacterium bovis subsp bovis AF2122/97
gauccgguggcuggccgccac

SEQ ID NO: 3154652 - RNA, 13 nt, Mycobacterium bovis subsp bovis AF2122/97
gauccgguggugg

SEQ ID NO: 3154653 - RNA, 15 nt, Mycobacterium bovis subsp bovis AF2122/97
gaucgccguccagca

SEQ ID NO: 3154654 - RNA, 14 nt, Mycobacterium bovis subsp bovis AF2122/97
gaucgccguugccg

SEQ ID NO: 3154655 - RNA, 13 nt, Mycobacterium bovis subsp bovis AF2122/97
gaucgccucgacg

SEQ ID NO: 3154656 - RNA, 19 nt, Mycobacterium bovis subsp bovis AF2122/97
gaucgccuuggcgcccgcg

SEQ ID NO: 3154657 - RNA, 24 nt, Mycobacterium bovis subsp bovis AF2122/97
gaucgcgaacaucgccagcgccgg

SEQ ID NO: 3154658 - RNA, 15 nt, Mycobacterium bovis subsp bovis AF2122/97
gaucgcgaacuucca

SEQ ID NO: 3154659 - RNA, 21 nt, Mycobacterium bovis subsp bovis AF2122/97
gaucgcgacccgaucgcgcca

SEQ ID NO: 3154660 - RNA, 16 nt, Mycobacterium bovis subsp bovis AF2122/97
gaucgcgacgaugccc

SEQ ID NO: 3154661 - RNA, 16 nt, Mycobacterium bovis subsp bovis AF2122/97
gaucgcgagcgagcca

SEQ ID NO: 3154662 - RNA, 19 nt, Mycobacterium bovis subsp bovis AF2122/97
gaucgcgagcgagccaacu

SEQ ID NO: 3154663 - RNA, 19 nt, Mycobacterium bovis subsp bovis AF2122/97
gaucgcgagcgcggcggag

SEQ ID NO: 3154664 - RNA, 12 nt, Mycobacterium bovis subsp bovis AF2122/97
gaucgcgaucca

SEQ ID NO: 3154665 - RNA, 20 nt, Mycobacterium bovis subsp bovis AF2122/97
gaucgcgauccacccggcau

SEQ ID NO: 3154666 - RNA, 14 nt, Mycobacterium bovis subsp bovis AF2122/97
gaucgcgcagcgcc

SEQ ID NO: 3154667 - RNA, 17 nt, Mycobacterium bovis subsp bovis AF2122/97
gaucgcgcagcgccgcc

SEQ ID NO: 3154668 - RNA, 21 nt, Mycobacterium bovis subsp bovis AF2122/97
gaucgcgcccaccgaugcgau

SEQ ID NO: 3154669 - RNA, 12 nt, Mycobacterium bovis subsp bovis AF2122/97
gaucgcgccguc

SEQ ID NO: 3154670 - RNA, 16 nt, Mycobacterium bovis subsp bovis AF2122/97
gaucgcgccgucggcg

SEQ ID NO: 3154671 - RNA, 13 nt, Mycobacterium bovis subsp bovis AF2122/97
gaucgcgccuauc

SEQ ID NO: 3154672 - RNA, 13 nt, Mycobacterium bovis subsp bovis AF2122/97
gaucgcgcugauc

SEQ ID NO: 3154673 - RNA, 13 nt, Mycobacterium bovis subsp bovis AF2122/97
gaucgcgcugcgg

SEQ ID NO: 3154674 - RNA, 14 nt, Mycobacterium bovis subsp bovis AF2122/97
gaucgcgcugcggg

SEQ ID NO: 3154675 - RNA, 13 nt, Mycobacterium bovis subsp bovis AF2122/97
gaucgcgcuggcg

SEQ ID NO: 3154676 - RNA, 18 nt, Mycobacterium bovis subsp bovis AF2122/97
gaucgcggacacugcgaa

SEQ ID NO: 3154677 - RNA, 16 nt, Mycobacterium bovis subsp bovis AF2122/97
gaucgcggacccgucg

SEQ ID NO: 3154678 - RNA, 19 nt, Mycobacterium bovis subsp bovis AF2122/97
gaucgcggacccgucggcg

SEQ ID NO: 3154679 - RNA, 22 nt, Mycobacterium bovis subsp bovis AF2122/97
gaucgcggcaaugaggccgucu

SEQ ID NO: 3154680 - RNA, 13 nt, Mycobacterium bovis subsp bovis AF2122/97
gaucgcggcgacc

SEQ ID NO: 3154681 - RNA, 17 nt, Mycobacterium bovis subsp bovis AF2122/97
gaucgcggcgacccggu

SEQ ID NO: 3154682 - RNA, 20 nt, Mycobacterium bovis subsp bovis AF2122/97
gaucgcggcgacccggucgc

SEQ ID NO: 3154683 - RNA, 13 nt, Mycobacterium bovis subsp bovis AF2122/97
gaucgcggcgagc

SEQ ID NO: 3154684 - RNA, 18 nt, Mycobacterium bovis subsp bovis AF2122/97
gaucgcggcgagcaccac

SEQ ID NO: 3154685 - RNA, 18 nt, Mycobacterium bovis subsp bovis AF2122/97
gaucgcggcgcccaggaa

SEQ ID NO: 3154686 - RNA, 13 nt, Mycobacterium bovis subsp bovis AF2122/97
gaucgcggcgccg

SEQ ID NO: 3154687 - RNA, 13 nt, Mycobacterium bovis subsp bovis AF2122/97
gaucgcggcggcc

SEQ ID NO: 3154688 - RNA, 19 nt, Mycobacterium bovis subsp bovis AF2122/97
gaucgcggcggccuccacc

SEQ ID NO: 3154689 - RNA, 15 nt, Mycobacterium bovis subsp bovis AF2122/97
gaucgcggcggcgug

SEQ ID NO: 3154690 - RNA, 16 nt, Mycobacterium bovis subsp bovis AF2122/97
gaucgcggcggcgugc

SEQ ID NO: 3154691 - RNA, 22 nt, Mycobacterium bovis subsp bovis AF2122/97
gaucgcggucagcgggucgacc

SEQ ID NO: 3154692 - RNA, 21 nt, Mycobacterium bovis subsp bovis AF2122/97
gaucgcgguccaacagcgcca

SEQ ID NO: 3154693 - RNA, 14 nt, Mycobacterium bovis subsp bovis AF2122/97
gaucgcgguccgag

SEQ ID NO: 3154694 - RNA, 15 nt, Mycobacterium bovis subsp bovis AF2122/97
gaucgcgguccgagc

SEQ ID NO: 3154695 - RNA, 17 nt, Mycobacterium bovis subsp bovis AF2122/97
gaucgcggugaccggcu

SEQ ID NO: 3154696 - RNA, 22 nt, Mycobacterium bovis subsp bovis AF2122/97
gaucgcgguggcggugucggcg

SEQ ID NO: 3154697 - RNA, 19 nt, Mycobacterium bovis subsp bovis AF2122/97
gaucgcggugggccccgau

SEQ ID NO: 3154698 - RNA, 17 nt, Mycobacterium bovis subsp bovis AF2122/97
gaucgcguccgccucgg

SEQ ID NO: 3154699 - RNA, 15 nt, Mycobacterium bovis subsp bovis AF2122/97
gaucgcgucgggcuc

SEQ ID NO: 3154700 - RNA, 17 nt, Mycobacterium bovis subsp bovis AF2122/97
gaucgcgugccacagca

SEQ ID NO: 3154701 - RNA, 22 nt, Mycobacterium bovis subsp bovis AF2122/97
gaucgcgugcggugccguggug

SEQ ID NO: 3154702 - RNA, 15 nt, Mycobacterium bovis subsp bovis AF2122/97
gaucgcguggaucgc

SEQ ID NO: 3154703 - RNA, 17 nt, Mycobacterium bovis subsp bovis AF2122/97
gaucgcguggcgcacca

SEQ ID NO: 3154704 - RNA, 18 nt, Mycobacterium bovis subsp bovis AF2122/97
gaucgcguggcgcaccac

SEQ ID NO: 3154705 - RNA, 22 nt, Mycobacterium bovis subsp bovis AF2122/97
gaucgcguggcgcaccaccgcc

SEQ ID NO: 3154706 - RNA, 23 nt, Mycobacterium bovis subsp bovis AF2122/97
gaucgcguggcgcaccaccgccc

SEQ ID NO: 3154707 - RNA, 20 nt, Mycobacterium bovis subsp bovis AF2122/97
gaucgcguuagccaggucga

SEQ ID NO: 3154708 - RNA, 15 nt, Mycobacterium bovis subsp bovis AF2122/97
gaucgcuacgucgac

SEQ ID NO: 3154709 - RNA, 17 nt, Mycobacterium bovis subsp bovis AF2122/97
gaucgcuaggaccgcgg

SEQ ID NO: 3154710 - RNA, 15 nt, Mycobacterium bovis subsp bovis AF2122/97
gaucgcuccgcggcg

SEQ ID NO: 3154711 - RNA, 21 nt, Mycobacterium bovis subsp bovis AF2122/97
gaucgcuccggcccugccgcc

SEQ ID NO: 3154712 - RNA, 23 nt, Mycobacterium bovis subsp bovis AF2122/97
gaucgcuccggcccugccgccgg

SEQ ID NO: 3154713 - RNA, 16 nt, Mycobacterium bovis subsp bovis AF2122/97
gaucgcugcgaagccg

SEQ ID NO: 3154714 - RNA, 19 nt, Mycobacterium bovis subsp bovis AF2122/97
gaucgcugcgaagccgagc

SEQ ID NO: 3154715 - RNA, 20 nt, Mycobacterium bovis subsp bovis AF2122/97
gaucgcugcgaagccgagca

SEQ ID NO: 3154716 - RNA, 19 nt, Mycobacterium bovis subsp bovis AF2122/97
gaucgcuggccgcgaggua

SEQ ID NO: 3154717 - RNA, 22 nt, Mycobacterium bovis subsp bovis AF2122/97
gaucgcuucccggaagcgccgg

SEQ ID NO: 3154718 - RNA, 14 nt, Mycobacterium bovis subsp bovis AF2122/97
gaucggaagaaacg

SEQ ID NO: 3154719 - RNA, 17 nt, Mycobacterium bovis subsp bovis AF2122/97
gaucggacagguaacgc

SEQ ID NO: 3154720 - RNA, 16 nt, Mycobacterium bovis subsp bovis AF2122/97
gaucggaccaccaggg

SEQ ID NO: 3154721 - RNA, 17 nt, Mycobacterium bovis subsp bovis AF2122/97
gaucggaggcccgccac

SEQ ID NO: 3154722 - RNA, 13 nt, Mycobacterium bovis subsp bovis AF2122/97
gaucggaucgaag

SEQ ID NO: 3154723 - RNA, 13 nt, Mycobacterium bovis subsp bovis AF2122/97
gaucggaucggca

SEQ ID NO: 3154724 - RNA, 17 nt, Mycobacterium bovis subsp bovis AF2122/97
gaucggauggcggccac

SEQ ID NO: 3154725 - RNA, 19 nt, Mycobacterium bovis subsp bovis AF2122/97
gaucggauggugugucggg

SEQ ID NO: 3154726 - RNA, 22 nt, Mycobacterium bovis subsp bovis AF2122/97
gaucggauggugugucggguug

SEQ ID NO: 3154727 - RNA, 14 nt, Mycobacterium bovis subsp bovis AF2122/97
gaucggcaaaccgu

SEQ ID NO: 3154728 - RNA, 18 nt, Mycobacterium bovis subsp bovis AF2122/97
gaucggcaacccgcacca

SEQ ID NO: 3154729 - RNA, 22 nt, Mycobacterium bovis subsp bovis AF2122/97
gaucggcaacccgcaccagggu

SEQ ID NO: 3154730 - RNA, 16 nt, Mycobacterium bovis subsp bovis AF2122/97
gaucggcaaucgacuc

SEQ ID NO: 3154731 - RNA, 13 nt, Mycobacterium bovis subsp bovis AF2122/97
gaucggcacccca

SEQ ID NO: 3154732 - RNA, 17 nt, Mycobacterium bovis subsp bovis AF2122/97
gaucggcaccccacgcc

SEQ ID NO: 3154733 - RNA, 11 nt, Mycobacterium bovis subsp bovis AF2122/97
gaucggcacua

SEQ ID NO: 3154734 - RNA, 22 nt, Mycobacterium bovis subsp bovis AF2122/97
gaucggcacuagcgagccggcg

SEQ ID NO: 3154735 - RNA, 11 nt, Mycobacterium bovis subsp bovis AF2122/97
gaucggcacuu

SEQ ID NO: 3154736 - RNA, 14 nt, Mycobacterium bovis subsp bovis AF2122/97
gaucggcagcccgg

SEQ ID NO: 3154737 - RNA, 21 nt, Mycobacterium bovis subsp bovis AF2122/97
gaucggcagcguggacaucgg

SEQ ID NO: 3154738 - RNA, 15 nt, Mycobacterium bovis subsp bovis AF2122/97
gaucggcaggccgcu

SEQ ID NO: 3154739 - RNA, 19 nt, Mycobacterium bovis subsp bovis AF2122/97
gaucggcaggguggccagc

SEQ ID NO: 3154740 - RNA, 21 nt, Mycobacterium bovis subsp bovis AF2122/97
gaucgugccgggaccggugug

SEQ ID NO: 3154741 - RNA, 13 nt, Mycobacterium bovis subsp bovis AF2122/97
gaucgugcuggcg

SEQ ID NO: 3154742 - RNA, 14 nt, Mycobacterium bovis subsp bovis AF2122/97
gaucguggcgacca

SEQ ID NO: 3154743 - RNA, 15 nt, Mycobacterium bovis subsp bovis AF2122/97
gaucguggcgaccac

SEQ ID NO: 3154744 - RNA, 17 nt, Mycobacterium bovis subsp bovis AF2122/97
gaucguggcgaccacga

SEQ ID NO: 3154745 - RNA, 23 nt, Mycobacterium bovis subsp bovis AF2122/97
gaucgugugaggccuucgccgac

SEQ ID NO: 3154746 - RNA, 19 nt, Mycobacterium bovis subsp bovis AF2122/97
gaucguuaugaccucgacg

SEQ ID NO: 3154747 - RNA, 20 nt, Mycobacterium bovis subsp bovis AF2122/97
gaucguuaugaccucgacgu

SEQ ID NO: 3154748 - RNA, 14 nt, Mycobacterium bovis subsp bovis AF2122/97
gaucguucaaugca

SEQ ID NO: 3154749 - RNA, 20 nt, Mycobacterium bovis subsp bovis AF2122/97
gaucguuccaggccgcgucg

SEQ ID NO: 3154750 - RNA, 19 nt, Mycobacterium bovis subsp bovis AF2122/97
gaucguuccgauccggugg

SEQ ID NO: 3154751 - RNA, 16 nt, Mycobacterium bovis subsp bovis AF2122/97
gaucguugccucgucg

SEQ ID NO: 3154752 - RNA, 19 nt, Mycobacterium bovis subsp bovis AF2122/97
gaucguugccucgucgccg

SEQ ID NO: 3154753 - RNA, 20 nt, Mycobacterium bovis subsp bovis AF2122/97
gaucguugccucgucgccgc

SEQ ID NO: 3154754 - RNA, 23 nt, Mycobacterium bovis subsp bovis AF2122/97
gaucguuuccguagacgggguga

SEQ ID NO: 3154755 - RNA, 22 nt, Mycobacterium bovis subsp bovis AF2122/97
gaucuagaggcggcccccggca

SEQ ID NO: 3154756 - RNA, 22 nt, Mycobacterium bovis subsp bovis AF2122/97
gaucucaccacccgucggcccg

SEQ ID NO: 3154757 - RNA, 23 nt, Mycobacterium bovis subsp bovis AF2122/97
gaucucaccacccgucggcccgc

SEQ ID NO: 3154758 - RNA, 22 nt, Mycobacterium bovis subsp bovis AF2122/97
gaucucacgugcccgcgcggcg

SEQ ID NO: 3154759 - RNA, 19 nt, Mycobacterium bovis subsp bovis AF2122/97
gaucucauccuccugcgcc

SEQ ID NO: 3154760 - RNA, 23 nt, Mycobacterium bovis subsp bovis AF2122/97
gaucuccacccgccggccgucgg

SEQ ID NO: 3154761 - RNA, 19 nt, Mycobacterium bovis subsp bovis AF2122/97
gaucuccaccuucuggucc

SEQ ID NO: 3154762 - RNA, 16 nt, Mycobacterium bovis subsp bovis AF2122/97
gaucuccacggcggug

SEQ ID NO: 3154763 - RNA, 16 nt, Mycobacterium bovis subsp bovis AF2122/97
gaucuccccgaccgcg

SEQ ID NO: 3154764 - RNA, 15 nt, Mycobacterium bovis subsp bovis AF2122/97
gaucuccgugagccg

SEQ ID NO: 3154765 - RNA, 20 nt, Mycobacterium bovis subsp bovis AF2122/97
gaucuccgugagccggaccg

SEQ ID NO: 3154766 - RNA, 22 nt, Mycobacterium bovis subsp bovis AF2122/97
gaucuccucgaguugcgcggca

SEQ ID NO: 3154767 - RNA, 16 nt, Mycobacterium bovis subsp bovis AF2122/97
gaucucgaaggccgcc

SEQ ID NO: 3154768 - RNA, 15 nt, Mycobacterium bovis subsp bovis AF2122/97
gaucucgaccagcgc

SEQ ID NO: 3154769 - RNA, 21 nt, Mycobacterium bovis subsp bovis AF2122/97
gaucucgaccagcgccgauac

SEQ ID NO: 3154770 - RNA, 22 nt, Mycobacterium bovis subsp bovis AF2122/97
gaucucgaccggcuugcccucc

SEQ ID NO: 3154771 - RNA, 21 nt, Mycobacterium bovis subsp bovis AF2122/97
gaucucgaccguauugaccag

SEQ ID NO: 3154772 - RNA, 17 nt, Mycobacterium bovis subsp bovis AF2122/97
gaucucgacggccucgu

SEQ ID NO: 3154773 - RNA, 19 nt, Mycobacterium bovis subsp bovis AF2122/97
gaucucgacggccucgucg

SEQ ID NO: 3154774 - RNA, 22 nt, Mycobacterium bovis subsp bovis AF2122/97
gaucucgagcaggcgcaccagg

SEQ ID NO: 3154775 - RNA, 17 nt, Mycobacterium bovis subsp bovis AF2122/97
gaucucgagccgcggca

SEQ ID NO: 3154776 - RNA, 19 nt, Mycobacterium bovis subsp bovis AF2122/97
gaucucgagccgcggcaac

SEQ ID NO: 3154777 - RNA, 22 nt, Mycobacterium bovis subsp bovis AF2122/97
gaucucgaucaucaugucggcg

SEQ ID NO: 3154778 - RNA, 18 nt, Mycobacterium bovis subsp bovis AF2122/97
gaucucgaucgacccggu

SEQ ID NO: 3154779 - RNA, 13 nt, Mycobacterium bovis subsp bovis AF2122/97
gaucucgcccagc

SEQ ID NO: 3154780 - RNA, 17 nt, Mycobacterium bovis subsp bovis AF2122/97
gaucucgcccagcgagc

SEQ ID NO: 3154781 - RNA, 18 nt, Mycobacterium bovis subsp bovis AF2122/97
gaucucgcccagcgagcg

SEQ ID NO: 3154782 - RNA, 20 nt, Mycobacterium bovis subsp bovis AF2122/97
gaucucgcccagcgagcgcc

SEQ ID NO: 3154783 - RNA, 23 nt, Mycobacterium bovis subsp bovis AF2122/97
gaucucgcccagcgagcgccagg

SEQ ID NO: 3154784 - RNA, 16 nt, Mycobacterium bovis subsp bovis AF2122/97
gaucucgccccagugc

SEQ ID NO: 3154785 - RNA, 15 nt, Mycobacterium bovis subsp bovis AF2122/97
gaucucgccgccagc

SEQ ID NO: 3154786 - RNA, 18 nt, Mycobacterium bovis subsp bovis AF2122/97
gaucucgccgccagcgcu

SEQ ID NO: 3154787 - RNA, 14 nt, Mycobacterium bovis subsp bovis AF2122/97
gaucucgcgcgcgg

SEQ ID NO: 3154788 - RNA, 17 nt, Mycobacterium bovis subsp bovis AF2122/97
gaucucgcgcgcggcga

SEQ ID NO: 3154789 - RNA, 22 nt, Mycobacterium bovis subsp bovis AF2122/97
gaucucgcgggcccgcgcggcg

SEQ ID NO: 3154790 - RNA, 17 nt, Mycobacterium bovis subsp bovis AF2122/97
gaucucggcaaggacgu

SEQ ID NO: 3154791 - RNA, 13 nt, Mycobacterium bovis subsp bovis AF2122/97
gaucucggccagg

SEQ ID NO: 3154792 - RNA, 15 nt, Mycobacterium bovis subsp bovis AF2122/97
gaucucggcggccgc

SEQ ID NO: 3154793 - RNA, 17 nt, Mycobacterium bovis subsp bovis AF2122/97
gaucucggcggccgcgu

SEQ ID NO: 3154794 - RNA, 17 nt, Mycobacterium bovis subsp bovis AF2122/97
gaucucguagccgccgu

SEQ ID NO: 3154795 - RNA, 17 nt, Mycobacterium bovis subsp bovis AF2122/97
gaucucgucgcggucga

SEQ ID NO: 3154796 - RNA, 19 nt, Mycobacterium bovis subsp bovis AF2122/97
gaucucuaccagccgcccc

SEQ ID NO: 3154797 - RNA, 21 nt, Mycobacterium bovis subsp bovis AF2122/97
gaucugaaacagucgaccgag

SEQ ID NO: 3154798 - RNA, 22 nt, Mycobacterium bovis subsp bovis AF2122/97
gaucugaagagcggagccggcg

SEQ ID NO: 3154799 - RNA, 14 nt, Mycobacterium bovis subsp bovis AF2122/97
gaucugagcgcggg

SEQ ID NO: 3154800 - RNA, 18 nt, Mycobacterium bovis subsp bovis AF2122/97
gaucugagcgcggguggc

SEQ ID NO: 3154801 - RNA, 21 nt, Mycobacterium bovis subsp bovis AF2122/97
gaucugagcuagccguucggc

SEQ ID NO: 3154802 - RNA, 22 nt, Mycobacterium bovis subsp bovis AF2122/97
gaucugagcuagccguucggcu

SEQ ID NO: 3154803 - RNA, 16 nt, Mycobacterium bovis subsp bovis AF2122/97
gaucugaucggcgcgg

SEQ ID NO: 3154804 - RNA, 19 nt, Mycobacterium bovis subsp bovis AF2122/97
gaucugcagcacgcguggu

SEQ ID NO: 3154805 - RNA, 23 nt, Mycobacterium bovis subsp bovis AF2122/97
gaucugcagcgcggauucgguua

SEQ ID NO: 3154806 - RNA, 16 nt, Mycobacterium bovis subsp bovis AF2122/97
gaucugcccccgccgg

SEQ ID NO: 3154807 - RNA, 19 nt, Mycobacterium bovis subsp bovis AF2122/97
gaucugccgccgcggccac

SEQ ID NO: 3154808 - RNA, 21 nt, Mycobacterium bovis subsp bovis AF2122/97
gaucugccgccgcggccacaa

SEQ ID NO: 3154809 - RNA, 24 nt, Mycobacterium bovis subsp bovis AF2122/97
gaucugccgccgcggccacaaccu

SEQ ID NO: 3154810 - RNA, 21 nt, Mycobacterium bovis subsp bovis AF2122/97
gaucugcgacaagaccggcgg

SEQ ID NO: 3154811 - RNA, 13 nt, Mycobacterium bovis subsp bovis AF2122/97
gaucugcgccauc

SEQ ID NO: 3154812 - RNA, 14 nt, Mycobacterium bovis subsp bovis AF2122/97
gaucugcgccgcgc

SEQ ID NO: 3154813 - RNA, 22 nt, Mycobacterium bovis subsp bovis AF2122/97
gaucugcgcgucaggccagcgc

SEQ ID NO: 3154814 - RNA, 18 nt, Mycobacterium bovis subsp bovis AF2122/97
gaucugcggaggcgaccc

SEQ ID NO: 3154815 - RNA, 15 nt, Mycobacterium bovis subsp bovis AF2122/97
gaucugcguugcggc

SEQ ID NO: 3154816 - RNA, 19 nt, Mycobacterium bovis subsp bovis AF2122/97
gaucugcguugcggcaaca

SEQ ID NO: 3154817 - RNA, 21 nt, Mycobacterium bovis subsp bovis AF2122/97
gaucugcguuugggucaucga

SEQ ID NO: 3154818 - RNA, 22 nt, Mycobacterium bovis subsp bovis AF2122/97
gaucugcuaccagagccgcgau

SEQ ID NO: 3154819 - RNA, 14 nt, Mycobacterium bovis subsp bovis AF2122/97
gaucugcuccgcag

SEQ ID NO: 3154820 - RNA, 15 nt, Mycobacterium bovis subsp bovis AF2122/97
gaucugcuccucggu

SEQ ID NO: 3154821 - RNA, 12 nt, Mycobacterium bovis subsp bovis AF2122/97
gaucugcucgcc

SEQ ID NO: 3154822 - RNA, 21 nt, Mycobacterium bovis subsp bovis AF2122/97
gaucugcucguagcggcggcg

SEQ ID NO: 3154823 - RNA, 20 nt, Mycobacterium bovis subsp bovis AF2122/97
gaucuggccgaagcccgauc

SEQ ID NO: 3154824 - RNA, 14 nt, Mycobacterium bovis subsp bovis AF2122/97
gaucuggcgcagca

SEQ ID NO: 3154825 - RNA, 18 nt, Mycobacterium bovis subsp bovis AF2122/97
gaucuggcguucagcggc

SEQ ID NO: 3154826 - RNA, 13 nt, Mycobacterium bovis subsp bovis AF2122/97
gaugagcgaggcu

SEQ ID NO: 3154827 - RNA, 16 nt, Mycobacterium bovis subsp bovis AF2122/97
gaugagcgcggcgaca

SEQ ID NO: 3154828 - RNA, 17 nt, Mycobacterium bovis subsp bovis AF2122/97
gaugagcgcuucgaggu

SEQ ID NO: 3154829 - RNA, 16 nt, Mycobacterium bovis subsp bovis AF2122/97
gaugagcggcgcggca

SEQ ID NO: 3154830 - RNA, 13 nt, Mycobacterium bovis subsp bovis AF2122/97
gaugagcgguacc

SEQ ID NO: 3154831 - RNA, 18 nt, Mycobacterium bovis subsp bovis AF2122/97
gaugagcgguacccccca

SEQ ID NO: 3154832 - RNA, 23 nt, Mycobacterium bovis subsp bovis AF2122/97
gaugagcgguaccccccagcgac

SEQ ID NO: 3154833 - RNA, 21 nt, Mycobacterium bovis subsp bovis AF2122/97
gaugagcgugccgcagcggcg

SEQ ID NO: 3154834 - RNA, 13 nt, Mycobacterium bovis subsp bovis AF2122/97
gaugagcucggcc

SEQ ID NO: 3154835 - RNA, 16 nt, Mycobacterium bovis subsp bovis AF2122/97
gaugagcucggccauc

SEQ ID NO: 3154836 - RNA, 15 nt, Mycobacterium bovis subsp bovis AF2122/97
gaugaggaucaucga

SEQ ID NO: 3154837 - RNA, 22 nt, Mycobacterium bovis subsp bovis AF2122/97
gaugaggaucgcguccgccucg

SEQ ID NO: 3154838 - RNA, 23 nt, Mycobacterium bovis subsp bovis AF2122/97
gaugagggcuuguggugagcgga

SEQ ID NO: 3154839 - RNA, 21 nt, Mycobacterium bovis subsp bovis AF2122/97
gaugagggugcucgucaccaa

SEQ ID NO: 3154840 - RNA, 14 nt, Mycobacterium bovis subsp bovis AF2122/97
gaugagguggccgc

SEQ ID NO: 3154841 - RNA, 19 nt, Mycobacterium bovis subsp bovis AF2122/97
gaugagguucaucgccggc

SEQ ID NO: 3154842 - RNA, 17 nt, Mycobacterium bovis subsp bovis AF2122/97
gaugagucaggcgccgc

SEQ ID NO: 3154843 - RNA, 15 nt, Mycobacterium bovis subsp bovis AF2122/97
gaugagugacggucc

SEQ ID NO: 3154844 - RNA, 22 nt, Mycobacterium bovis subsp bovis AF2122/97
gaugaguuccuugaugcggccg

SEQ ID NO: 3154845 - RNA, 19 nt, Mycobacterium bovis subsp bovis AF2122/97
gaugauacccaacgacaug

SEQ ID NO: 3154846 - RNA, 14 nt, Mycobacterium bovis subsp bovis AF2122/97
gaugaucagcgagg

SEQ ID NO: 3154847 - RNA, 18 nt, Mycobacterium bovis subsp bovis AF2122/97
gaugaucccaagcgucgc

SEQ ID NO: 3154848 - RNA, 17 nt, Mycobacterium bovis subsp bovis AF2122/97
gaugaucccgccaccga

SEQ ID NO: 3154849 - RNA, 22 nt, Mycobacterium bovis subsp bovis AF2122/97
gaugaucgcgaacaucgccagc

SEQ ID NO: 3154850 - RNA, 18 nt, Mycobacterium bovis subsp bovis AF2122/97
gaugaucgguaccgacgg

SEQ ID NO: 3154851 - RNA, 21 nt, Mycobacterium bovis subsp bovis AF2122/97
gaugaucugcuugccaccgcc

SEQ ID NO: 3154852 - RNA, 19 nt, Mycobacterium bovis subsp bovis AF2122/97
gaugaucuugccgcggcgc

SEQ ID NO: 3154853 - RNA, 13 nt, Mycobacterium bovis subsp bovis AF2122/97
gaugaugaccgcc

SEQ ID NO: 3154854 - RNA, 14 nt, Mycobacterium bovis subsp bovis AF2122/97
gaugaugaccgcca

SEQ ID NO: 3154855 - RNA, 21 nt, Mycobacterium bovis subsp bovis AF2122/97
gaugaugccggacagcucgcg

SEQ ID NO: 3154856 - RNA, 14 nt, Mycobacterium bovis subsp bovis AF2122/97
gaugaugccggcgu

SEQ ID NO: 3154857 - RNA, 22 nt, Mycobacterium bovis subsp bovis AF2122/97
gaugaugccggcguuguaguug

SEQ ID NO: 3154858 - RNA, 20 nt, Mycobacterium bovis subsp bovis AF2122/97
gaugaugcucgacaaccacg

SEQ ID NO: 3154859 - RNA, 14 nt, Mycobacterium bovis subsp bovis AF2122/97
gaugauguggugug

SEQ ID NO: 3154860 - RNA, 19 nt, Mycobacterium bovis subsp bovis AF2122/97
gaugauguuuuccccgccc

SEQ ID NO: 3154861 - RNA, 15 nt, Mycobacterium bovis subsp bovis AF2122/97
gaugauuucgccgag

SEQ ID NO: 3154862 - RNA, 15 nt, Mycobacterium bovis subsp bovis AF2122/97
gaugcaacccgguga

SEQ ID NO: 3154863 - RNA, 22 nt, Mycobacterium bovis subsp bovis AF2122/97
gaugcaacucggcagauugucg

SEQ ID NO: 3154864 - RNA, 17 nt, Mycobacterium bovis subsp bovis AF2122/97
gaugcaagcgggcauga

SEQ ID NO: 3154865 - RNA, 21 nt, Mycobacterium bovis subsp bovis AF2122/97
gaugcacaaccgcugcugcug

SEQ ID NO: 3154866 - RNA, 12 nt, Mycobacterium bovis subsp bovis AF2122/97
gaugcacgucga

SEQ ID NO: 3154867 - RNA, 18 nt, Mycobacterium bovis subsp bovis AF2122/97
gaugcacgucgagcaggc

SEQ ID NO: 3154868 - RNA, 18 nt, Mycobacterium bovis subsp bovis AF2122/97
gaugcagcgggucgccgg

SEQ ID NO: 3154869 - RNA, 19 nt, Mycobacterium bovis subsp bovis AF2122/97
gaugcagcugcccggcgug

SEQ ID NO: 3154870 - RNA, 17 nt, Mycobacterium bovis subsp bovis AF2122/97
gaugcagggcccgcaac

SEQ ID NO: 3154871 - RNA, 13 nt, Mycobacterium bovis subsp bovis AF2122/97
gaugcagugcgac

SEQ ID NO: 3154872 - RNA, 18 nt, Mycobacterium bovis subsp bovis AF2122/97
gaugcauccagcugcugc

SEQ ID NO: 3154873 - RNA, 13 nt, Mycobacterium bovis subsp bovis AF2122/97
gaugcaucggugc

SEQ ID NO: 3154874 - RNA, 19 nt, Mycobacterium bovis subsp bovis AF2122/97
gaugcaugucuuguggugg

SEQ ID NO: 3154875 - RNA, 22 nt, Mycobacterium bovis subsp bovis AF2122/97
gaugcaugucuugugguggaaa

SEQ ID NO: 3154876 - RNA, 13 nt, Mycobacterium bovis subsp bovis AF2122/97
gaugccacccaac

SEQ ID NO: 3154877 - RNA, 14 nt, Mycobacterium bovis subsp bovis AF2122/97
gaugccacccaaca

SEQ ID NO: 3154878 - RNA, 17 nt, Mycobacterium bovis subsp bovis AF2122/97
gaugccacccaacagcg

SEQ ID NO: 3154879 - RNA, 18 nt, Mycobacterium bovis subsp bovis AF2122/97
gaugccacccucgguguc

SEQ ID NO: 3154880 - RNA, 18 nt, Mycobacterium bovis subsp bovis AF2122/97
gaugccacgucccaggac

SEQ ID NO: 3154881 - RNA, 19 nt, Mycobacterium bovis subsp bovis AF2122/97
gaugccagugcaucgguca

SEQ ID NO: 3154882 - RNA, 21 nt, Mycobacterium bovis subsp bovis AF2122/97
gaugcccacgcacagcaacgc

SEQ ID NO: 3154883 - RNA, 14 nt, Mycobacterium bovis subsp bovis AF2122/97
gaugcccagcagga

SEQ ID NO: 3154884 - RNA, 17 nt, Mycobacterium bovis subsp bovis AF2122/97
gaugcccauccggccgu

SEQ ID NO: 3154885 - RNA, 17 nt, Mycobacterium bovis subsp bovis AF2122/97
gaugccccuucaaagcg

SEQ ID NO: 3154886 - RNA, 14 nt, Mycobacterium bovis subsp bovis AF2122/97
gaugcccgacaccg

SEQ ID NO: 3154887 - RNA, 19 nt, Mycobacterium bovis subsp bovis AF2122/97
gaugcccggcaucgcgauc

SEQ ID NO: 3154888 - RNA, 21 nt, Mycobacterium bovis subsp bovis AF2122/97
gaugcccguagacgccgagca

SEQ ID NO: 3154889 - RNA, 14 nt, Mycobacterium bovis subsp bovis AF2122/97
gaugcccgucgaac

SEQ ID NO: 3154890 - RNA, 23 nt, Mycobacterium bovis subsp bovis AF2122/97
gaugcccgucgaaccagagguca

SEQ ID NO: 3154891 - RNA, 17 nt, Mycobacterium bovis subsp bovis AF2122/97
gaugcccucgauggcca

SEQ ID NO: 3154892 - RNA, 21 nt, Mycobacterium bovis subsp bovis AF2122/97
gaugcccucgauggccaggcu

SEQ ID NO: 3154893 - RNA, 17 nt, Mycobacterium bovis subsp bovis AF2122/97
gaugcccugccccggac

SEQ ID NO: 3154894 - RNA, 18 nt, Mycobacterium bovis subsp bovis AF2122/97
gaugccgaaccgcugcgg

SEQ ID NO: 3154895 - RNA, 23 nt, Mycobacterium bovis subsp bovis AF2122/97
gaugccgaacuccgcggaaccca

SEQ ID NO: 3154896 - RNA, 15 nt, Mycobacterium bovis subsp bovis AF2122/97
gaugccgaagccccc

SEQ ID NO: 3154897 - RNA, 19 nt, Mycobacterium bovis subsp bovis AF2122/97
gaugccgaccuagcucgcg

SEQ ID NO: 3154898 - RNA, 23 nt, Mycobacterium bovis subsp bovis AF2122/97
gaugccgaccuuuugcggcaagc

SEQ ID NO: 3154899 - RNA, 14 nt, Mycobacterium bovis subsp bovis AF2122/97
gaugccgacgaacg

SEQ ID NO: 3154900 - RNA, 13 nt, Mycobacterium bovis subsp bovis AF2122/97
gaugccgacggcg

SEQ ID NO: 3154901 - RNA, 14 nt, Mycobacterium bovis subsp bovis AF2122/97
gaugccgacggcgc

SEQ ID NO: 3154902 - RNA, 15 nt, Mycobacterium bovis subsp bovis AF2122/97
gaugccgacggcggg

SEQ ID NO: 3154903 - RNA, 16 nt, Mycobacterium bovis subsp bovis AF2122/97
gaugccgacggcgggc

SEQ ID NO: 3154904 - RNA, 19 nt, Mycobacterium bovis subsp bovis AF2122/97
gaugccgacggcgggcgau

SEQ ID NO: 3154905 - RNA, 12 nt, Mycobacterium bovis subsp bovis AF2122/97
gaugccgcccgu

SEQ ID NO: 3154906 - RNA, 21 nt, Mycobacterium bovis subsp bovis AF2122/97
gaugccgcccgugagauccuc

SEQ ID NO: 3154907 - RNA, 23 nt, Mycobacterium bovis subsp bovis AF2122/97
gaugccgcccgugagauccucca

SEQ ID NO: 3154908 - RNA, 11 nt, Mycobacterium bovis subsp bovis AF2122/97
gaugccgccgg

SEQ ID NO: 3154909 - RNA, 12 nt, Mycobacterium bovis subsp bovis AF2122/97
gaugccgccgga

SEQ ID NO: 3154910 - RNA, 13 nt, Mycobacterium bovis subsp bovis AF2122/97
gaugccgccggcc

SEQ ID NO: 3154911 - RNA, 14 nt, Mycobacterium bovis subsp bovis AF2122/97
gaugccgccggccc

SEQ ID NO: 3154912 - RNA, 21 nt, Mycobacterium bovis subsp bovis AF2122/97
gaugccgccggugccgccgcc

SEQ ID NO: 3154913 - RNA, 19 nt, Mycobacterium bovis subsp bovis AF2122/97
gaugcgguucucgagcucg

SEQ ID NO: 3154914 - RNA, 18 nt, Mycobacterium bovis subsp bovis AF2122/97
gaugcguagugcggcgug

SEQ ID NO: 3154915 - RNA, 20 nt, Mycobacterium bovis subsp bovis AF2122/97
gaugcguccgcccagccgca

SEQ ID NO: 3154916 - RNA, 21 nt, Mycobacterium bovis subsp bovis AF2122/97
gaugcgugaccagucgcggcg

SEQ ID NO: 3154917 - RNA, 15 nt, Mycobacterium bovis subsp bovis AF2122/97
gaugcgugguuggcc

SEQ ID NO: 3154918 - RNA, 14 nt, Mycobacterium bovis subsp bovis AF2122/97
gaugcucaccggga

SEQ ID NO: 3154919 - RNA, 23 nt, Mycobacterium bovis subsp bovis AF2122/97
gaugcucaggucaccggccgccg

SEQ ID NO: 3154920 - RNA, 22 nt, Mycobacterium bovis subsp bovis AF2122/97
gaugcucagugccaaagcggca

SEQ ID NO: 3154921 - RNA, 19 nt, Mycobacterium bovis subsp bovis AF2122/97
gaugcucccuauugcugcg

SEQ ID NO: 3154922 - RNA, 23 nt, Mycobacterium bovis subsp bovis AF2122/97
gaugcugccagaucggucggcca

SEQ ID NO: 3154923 - RNA, 22 nt, Mycobacterium bovis subsp bovis AF2122/97
gaugcuggcggccucgccggcg

SEQ ID NO: 3154924 - RNA, 10 nt, Mycobacterium bovis subsp bovis AF2122/97
gaugcugggc

SEQ ID NO: 3154925 - RNA, 15 nt, Mycobacterium bovis subsp bovis AF2122/97
gaugcuggucggcga

SEQ ID NO: 3154926 - RNA, 17 nt, Mycobacterium bovis subsp bovis AF2122/97
gaugcuggucggcgaug

SEQ ID NO: 3154927 - RNA, 13 nt, Mycobacterium bovis subsp bovis AF2122/97
gaugcuucccgga

SEQ ID NO: 3154928 - RNA, 17 nt, Mycobacterium bovis subsp bovis AF2122/97
gauggacaccaccucgu

SEQ ID NO: 3154929 - RNA, 14 nt, Mycobacterium bovis subsp bovis AF2122/97
gauggacaccagcc

SEQ ID NO: 3154930 - RNA, 14 nt, Mycobacterium bovis subsp bovis AF2122/97
gauggacagcugcg

SEQ ID NO: 3154931 - RNA, 17 nt, Mycobacterium bovis subsp bovis AF2122/97
gauggaccgcacugaca

SEQ ID NO: 3154932 - RNA, 15 nt, Mycobacterium bovis subsp bovis AF2122/97
gauggacggcagcca

SEQ ID NO: 3154933 - RNA, 18 nt, Mycobacterium bovis subsp bovis AF2122/97
gauggacggugcgcaggg

SEQ ID NO: 3154934 - RNA, 14 nt, Mycobacterium bovis subsp bovis AF2122/97
gauggacugaucgc

SEQ ID NO: 3154935 - RNA, 12 nt, Mycobacterium bovis subsp bovis AF2122/97
gauggauuggcg

SEQ ID NO: 3154936 - RNA, 21 nt, Mycobacterium bovis subsp bovis AF2122/97
gauggauuggcgucagcagca

SEQ ID NO: 3154937 - RNA, 14 nt, Mycobacterium bovis subsp bovis AF2122/97
gauggcaaacgcac

SEQ ID NO: 3154938 - RNA, 16 nt, Mycobacterium bovis subsp bovis AF2122/97
gauggcaccaccccga

SEQ ID NO: 3154939 - RNA, 13 nt, Mycobacterium bovis subsp bovis AF2122/97
gauggcaccgccc

SEQ ID NO: 3154940 - RNA, 21 nt, Mycobacterium bovis subsp bovis AF2122/97
gauggcaccgcccccgucggc

SEQ ID NO: 3154941 - RNA, 13 nt, Mycobacterium bovis subsp bovis AF2122/97
gauggcaccgugg

SEQ ID NO: 3154942 - RNA, 13 nt, Mycobacterium bovis subsp bovis AF2122/97
gauggcaggggcg

SEQ ID NO: 3154943 - RNA, 14 nt, Mycobacterium bovis subsp bovis AF2122/97
gauggcaucggcca

SEQ ID NO: 3154944 - RNA, 15 nt, Mycobacterium bovis subsp bovis AF2122/97
gauggcaucggccau

SEQ ID NO: 3154945 - RNA, 16 nt, Mycobacterium bovis subsp bovis AF2122/97
gauggcaucucgauac

SEQ ID NO: 3154946 - RNA, 16 nt, Mycobacterium bovis subsp bovis AF2122/97
gauggcauugcgccca

SEQ ID NO: 3154947 - RNA, 18 nt, Mycobacterium bovis subsp bovis AF2122/97
gauggcauugcgcccacc

SEQ ID NO: 3154948 - RNA, 19 nt, Mycobacterium bovis subsp bovis AF2122/97
gauggcauugcgcccaccg

SEQ ID NO: 3154949 - RNA, 16 nt, Mycobacterium bovis subsp bovis AF2122/97
gauggccagcgcggcg

SEQ ID NO: 3154950 - RNA, 19 nt, Mycobacterium bovis subsp bovis AF2122/97
gauggccagcgcggcgucg

SEQ ID NO: 3154951 - RNA, 12 nt, Mycobacterium bovis subsp bovis AF2122/97
gauggccaggcc

SEQ ID NO: 3154952 - RNA, 15 nt, Mycobacterium bovis subsp bovis AF2122/97
gauggccaucaucga

SEQ ID NO: 3154953 - RNA, 19 nt, Mycobacterium bovis subsp bovis AF2122/97
gauggccaucuggccgcgg

SEQ ID NO: 3154954 - RNA, 21 nt, Mycobacterium bovis subsp bovis AF2122/97
gauggccaucuggccgcgggc

SEQ ID NO: 3154955 - RNA, 21 nt, Mycobacterium bovis subsp bovis AF2122/97
gauggcccccaagaccaagug

SEQ ID NO: 3154956 - RNA, 21 nt, Mycobacterium bovis subsp bovis AF2122/97
gauggccgaccagccgaucau

SEQ ID NO: 3154957 - RNA, 15 nt, Mycobacterium bovis subsp bovis AF2122/97
gauggccgacgcugc

SEQ ID NO: 3154958 - RNA, 23 nt, Mycobacterium bovis subsp bovis AF2122/97
gauggccgccgcgaggaugcuga

SEQ ID NO: 3154959 - RNA, 19 nt, Mycobacterium bovis subsp bovis AF2122/97
gauggccgcgcccgccucg

SEQ ID NO: 3154960 - RNA, 14 nt, Mycobacterium bovis subsp bovis AF2122/97
gauggccgucagcc

SEQ ID NO: 3154961 - RNA, 15 nt, Mycobacterium bovis subsp bovis AF2122/97
gauggccgucagcca

SEQ ID NO: 3154962 - RNA, 12 nt, Mycobacterium bovis subsp bovis AF2122/97
gauggccgucga

SEQ ID NO: 3154963 - RNA, 14 nt, Mycobacterium bovis subsp bovis AF2122/97
gauggccgucgauc

SEQ ID NO: 3154964 - RNA, 15 nt, Mycobacterium bovis subsp bovis AF2122/97
gauggccugaucuuu

SEQ ID NO: 3154965 - RNA, 18 nt, Mycobacterium bovis subsp bovis AF2122/97
gauggcgaaccucaccug

SEQ ID NO: 3154966 - RNA, 22 nt, Mycobacterium bovis subsp bovis AF2122/97
gauggcgauacgcgcgucgggu

SEQ ID NO: 3154967 - RNA, 21 nt, Mycobacterium bovis subsp bovis AF2122/97
gauggcgaucaugagcagcac

SEQ ID NO: 3154968 - RNA, 18 nt, Mycobacterium bovis subsp bovis AF2122/97
gauggcgaugcgcgcccc

SEQ ID NO: 3154969 - RNA, 15 nt, Mycobacterium bovis subsp bovis AF2122/97
gauggcgauggcagg

SEQ ID NO: 3154970 - RNA, 20 nt, Mycobacterium bovis subsp bovis AF2122/97
gauggcgauggcaggggcga

SEQ ID NO: 3154971 - RNA, 19 nt, Mycobacterium bovis subsp bovis AF2122/97
gauggcgcaccggcgucgg

SEQ ID NO: 3154972 - RNA, 20 nt, Mycobacterium bovis subsp bovis AF2122/97
gauggcgcacugguugggcg

SEQ ID NO: 3154973 - RNA, 14 nt, Mycobacterium bovis subsp bovis AF2122/97
gauggcgcccugcg

SEQ ID NO: 3154974 - RNA, 16 nt, Mycobacterium bovis subsp bovis AF2122/97
gauggcgcccugcgcc

SEQ ID NO: 3154975 - RNA, 12 nt, Mycobacterium bovis subsp bovis AF2122/97
gauggcgcgauc

SEQ ID NO: 3154976 - RNA, 14 nt, Mycobacterium bovis subsp bovis AF2122/97
gauggcgcgcaacg

SEQ ID NO: 3154977 - RNA, 21 nt, Mycobacterium bovis subsp bovis AF2122/97
gauggcggaaguucuccucgu

SEQ ID NO: 3154978 - RNA, 18 nt, Mycobacterium bovis subsp bovis AF2122/97
gauggcggccaccagcgc

SEQ ID NO: 3154979 - RNA, 16 nt, Mycobacterium bovis subsp bovis AF2122/97
gauggcggcgacccgu

SEQ ID NO: 3154980 - RNA, 14 nt, Mycobacterium bovis subsp bovis AF2122/97
gauggcggcgcacc

SEQ ID NO: 3154981 - RNA, 23 nt, Mycobacterium bovis subsp bovis AF2122/97
gauggcggcucguugcgggcggg

SEQ ID NO: 3154982 - RNA, 15 nt, Mycobacterium bovis subsp bovis AF2122/97
gauggcgguggcgag

SEQ ID NO: 3154983 - RNA, 12 nt, Mycobacterium bovis subsp bovis AF2122/97
gauggcgguggg

SEQ ID NO: 3154984 - RNA, 20 nt, Mycobacterium bovis subsp bovis AF2122/97
gauggcgguggugccgcggc

SEQ ID NO: 3154985 - RNA, 24 nt, Mycobacterium bovis subsp bovis AF2122/97
gauggcgguggugccgcggccacc

SEQ ID NO: 3154986 - RNA, 20 nt, Mycobacterium bovis subsp bovis AF2122/97
gauggcguagcccaugccga

SEQ ID NO: 3154987 - RNA, 19 nt, Mycobacterium bovis subsp bovis AF2122/97
gauggcgucaagcacacug

SEQ ID NO: 3154988 - RNA, 15 nt, Mycobacterium bovis subsp bovis AF2122/97
gauggcgucgaccac

SEQ ID NO: 3154989 - RNA, 15 nt, Mycobacterium bovis subsp bovis AF2122/97
gauggcgucgccggc

SEQ ID NO: 3154990 - RNA, 14 nt, Mycobacterium bovis subsp bovis AF2122/97
gauggcgucggcca

SEQ ID NO: 3154991 - RNA, 18 nt, Mycobacterium bovis subsp bovis AF2122/97
gauggcguuugccggccg

SEQ ID NO: 3154992 - RNA, 20 nt, Mycobacterium bovis subsp bovis AF2122/97
gauggcguuugccggccgau

SEQ ID NO: 3154993 - RNA, 22 nt, Mycobacterium bovis subsp bovis AF2122/97
gauggcucacaugcccgcaccg

SEQ ID NO: 3154994 - RNA, 18 nt, Mycobacterium bovis subsp bovis AF2122/97
gauggcucacccaggcgc

SEQ ID NO: 3154995 - RNA, 19 nt, Mycobacterium bovis subsp bovis AF2122/97
gauggcucacccaggcgcc

SEQ ID NO: 3154996 - RNA, 15 nt, Mycobacterium bovis subsp bovis AF2122/97
gauggcuccggccgc

SEQ ID NO: 3154997 - RNA, 14 nt, Mycobacterium bovis subsp bovis AF2122/97
gauggcuggccagc

SEQ ID NO: 3154998 - RNA, 18 nt, Mycobacterium bovis subsp bovis AF2122/97
gauggcuuggaccagcgu

SEQ ID NO: 3154999 - RNA, 18 nt, Mycobacterium bovis subsp bovis AF2122/97
gaugggagcccggcggcc

SEQ ID NO: 3155000 - RNA, 21 nt, Mycobacterium bovis subsp bovis AF2122/97
gaugggagcccggcggcccga

SEQ ID NO: 3155001 - RNA, 14 nt, Mycobacterium bovis subsp bovis AF2122/97
gaugggcagccgcc

SEQ ID NO: 3155002 - RNA, 17 nt, Mycobacterium bovis subsp bovis AF2122/97
gaugggcaugguggugg

SEQ ID NO: 3155003 - RNA, 16 nt, Mycobacterium bovis subsp bovis AF2122/97
gaugggcccagcggcc

SEQ ID NO: 3155004 - RNA, 20 nt, Mycobacterium bovis subsp bovis AF2122/97
gaugggcccagcggccgcga

SEQ ID NO: 3155005 - RNA, 21 nt, Mycobacterium bovis subsp bovis AF2122/97
gaugggcgaauugcaggacgc

SEQ ID NO: 3155006 - RNA, 15 nt, Mycobacterium bovis subsp bovis AF2122/97
gaugggcgucgguca

SEQ ID NO: 3155007 - RNA, 17 nt, Mycobacterium bovis subsp bovis AF2122/97
gaugggcuacuugguca

SEQ ID NO: 3155008 - RNA, 17 nt, Mycobacterium bovis subsp bovis AF2122/97
gaugggggagccgguga

SEQ ID NO: 3155009 - RNA, 23 nt, Mycobacterium bovis subsp bovis AF2122/97
gaugggucugguguccaccgcaa

SEQ ID NO: 3155010 - RNA, 16 nt, Mycobacterium bovis subsp bovis AF2122/97
gaugggugacccgcua

SEQ ID NO: 3155011 - RNA, 17 nt, Mycobacterium bovis subsp bovis AF2122/97
gaugguaugcccgccgu

SEQ ID NO: 3155012 - RNA, 19 nt, Mycobacterium bovis subsp bovis AF2122/97
gauggucaaugccggccgc

SEQ ID NO: 3155013 - RNA, 17 nt, Mycobacterium bovis subsp bovis AF2122/97
gauggucaaugcgcugg

SEQ ID NO: 3155014 - RNA, 17 nt, Mycobacterium bovis subsp bovis AF2122/97
gauggucaccggauagc

SEQ ID NO: 3155015 - RNA, 19 nt, Mycobacterium bovis subsp bovis AF2122/97
gauggucaccgucugcacc

SEQ ID NO: 3155016 - RNA, 17 nt, Mycobacterium bovis subsp bovis AF2122/97
gauggucagcagcucca

SEQ ID NO: 3155017 - RNA, 20 nt, Mycobacterium bovis subsp bovis AF2122/97
gauggucccgagggcggcag

SEQ ID NO: 3155018 - RNA, 16 nt, Mycobacterium bovis subsp bovis AF2122/97
gauggucccgcucugg

SEQ ID NO: 3155019 - RNA, 16 nt, Mycobacterium bovis subsp bovis AF2122/97
gaugguccgccagauc

SEQ ID NO: 3155020 - RNA, 13 nt, Mycobacterium bovis subsp bovis AF2122/97
gauggucggccac

SEQ ID NO: 3155021 - RNA, 15 nt, Mycobacterium bovis subsp bovis AF2122/97
gauggucggccacgc

SEQ ID NO: 3155022 - RNA, 21 nt, Mycobacterium bovis subsp bovis AF2122/97
gauggucgugaucuucugccu

SEQ ID NO: 3155023 - RNA, 17 nt, Mycobacterium bovis subsp bovis AF2122/97
gauggucuccaccaggu

SEQ ID NO: 3155024 - RNA, 22 nt, Mycobacterium bovis subsp bovis AF2122/97
gauggucuccggacgcacgauc

SEQ ID NO: 3155025 - RNA, 17 nt, Mycobacterium bovis subsp bovis AF2122/97
gauggucuccucgguca

SEQ ID NO: 3155026 - RNA, 18 nt, Mycobacterium bovis subsp bovis AF2122/97
gauggugacuucgguggc

SEQ ID NO: 3155027 - RNA, 21 nt, Mycobacterium bovis subsp bovis AF2122/97
gauggugacuucgguggcggg

SEQ ID NO: 3155028 - RNA, 20 nt, Mycobacterium bovis subsp bovis AF2122/97
gauggugaugggggagccgg

SEQ ID NO: 3155029 - RNA, 17 nt, Mycobacterium bovis subsp bovis AF2122/97
gauggugccgacccgcc

SEQ ID NO: 3155030 - RNA, 18 nt, Mycobacterium bovis subsp bovis AF2122/97
gauggugccgacccgccg

SEQ ID NO: 3155031 - RNA, 16 nt, Mycobacterium bovis subsp bovis AF2122/97
gauggugcgcccgccg

SEQ ID NO: 3155032 - RNA, 18 nt, Mycobacterium bovis subsp bovis AF2122/97
gauggugcgcccgccggc

SEQ ID NO: 3155033 - RNA, 22 nt, Mycobacterium bovis subsp bovis AF2122/97
gauggugcucaaggcuucggcg

SEQ ID NO: 3155034 - RNA, 19 nt, Mycobacterium bovis subsp bovis AF2122/97
gaugguggcaacggguccg

SEQ ID NO: 3155035 - RNA, 23 nt, Mycobacterium bovis subsp bovis AF2122/97
gaugguggucaccaccaucacgg

SEQ ID NO: 3155036 - RNA, 17 nt, Mycobacterium bovis subsp bovis AF2122/97
gauggugguggcccggc

SEQ ID NO: 3155037 - RNA, 20 nt, Mycobacterium bovis subsp bovis AF2122/97
gaugguguccucgucgaggu

SEQ ID NO: 3155038 - RNA, 13 nt, Mycobacterium bovis subsp bovis AF2122/97
gauggugucgcgc

SEQ ID NO: 3155039 - RNA, 14 nt, Mycobacterium bovis subsp bovis AF2122/97
gauggugugcagca

SEQ ID NO: 3155040 - RNA, 16 nt, Mycobacterium bovis subsp bovis AF2122/97
gauggugugcagcagc

SEQ ID NO: 3155041 - RNA, 16 nt, Mycobacterium bovis subsp bovis AF2122/97
gauggugugcccgcac

SEQ ID NO: 3155042 - RNA, 16 nt, Mycobacterium bovis subsp bovis AF2122/97
gaugguuggaucgcca

SEQ ID NO: 3155043 - RNA, 18 nt, Mycobacterium bovis subsp bovis AF2122/97
gauguacaccgugcgccg

SEQ ID NO: 3155044 - RNA, 17 nt, Mycobacterium bovis subsp bovis AF2122/97
gauguacagcgggaucc

SEQ ID NO: 3155045 - RNA, 14 nt, Mycobacterium bovis subsp bovis AF2122/97
gauguacccggcga

SEQ ID NO: 3155046 - RNA, 17 nt, Mycobacterium bovis subsp bovis AF2122/97
gauguacccggcgacgu

SEQ ID NO: 3155047 - RNA, 23 nt, Mycobacterium bovis subsp bovis AF2122/97
gauguacugugccgcccccggca

SEQ ID NO: 3155048 - RNA, 19 nt, Mycobacterium bovis subsp bovis AF2122/97
gauguagagcucaccgucg

SEQ ID NO: 3155049 - RNA, 15 nt, Mycobacterium bovis subsp bovis AF2122/97
gauguagcgcugcgg

SEQ ID NO: 3155050 - RNA, 12 nt, Mycobacterium bovis subsp bovis AF2122/97
gauguagcggcg

SEQ ID NO: 3155051 - RNA, 17 nt, Mycobacterium bovis subsp bovis AF2122/97
gauguaguccucggugg

SEQ ID NO: 3155052 - RNA, 16 nt, Mycobacterium bovis subsp bovis AF2122/97
gauguagugcugcucg

SEQ ID NO: 3155053 - RNA, 13 nt, Mycobacterium bovis subsp bovis AF2122/97
gauguaguuggcg

SEQ ID NO: 3155054 - RNA, 16 nt, Mycobacterium bovis subsp bovis AF2122/97
gaugucaacgugguca

SEQ ID NO: 3155055 - RNA, 14 nt, Mycobacterium bovis subsp bovis AF2122/97
gaugucacccgccc

SEQ ID NO: 3155056 - RNA, 13 nt, Mycobacterium bovis subsp bovis AF2122/97
gaugucagcggcc

SEQ ID NO: 3155057 - RNA, 15 nt, Mycobacterium bovis subsp bovis AF2122/97
gaugucagcggccgc

SEQ ID NO: 3155058 - RNA, 16 nt, Mycobacterium bovis subsp bovis AF2122/97
gaugucagcggccgcg

SEQ ID NO: 3155059 - RNA, 16 nt, Mycobacterium bovis subsp bovis AF2122/97
gauguccacgccgugc

SEQ ID NO: 3155060 - RNA, 21 nt, Mycobacterium bovis subsp bovis AF2122/97
gauguccaggagugcgggcau

SEQ ID NO: 3155061 - RNA, 17 nt, Mycobacterium bovis subsp bovis AF2122/97
gaugucccaugcacggc

SEQ ID NO: 3155062 - RNA, 16 nt, Mycobacterium bovis subsp bovis AF2122/97
gauguccccgacggac

SEQ ID NO: 3155063 - RNA, 18 nt, Mycobacterium bovis subsp bovis AF2122/97
gauguccccggcggcagc

SEQ ID NO: 3155064 - RNA, 16 nt, Mycobacterium bovis subsp bovis AF2122/97
gauguccgacgcacca

SEQ ID NO: 3155065 - RNA, 17 nt, Mycobacterium bovis subsp bovis AF2122/97
gauguccgacgccaccg

SEQ ID NO: 3155066 - RNA, 19 nt, Mycobacterium bovis subsp bovis AF2122/97
gauguccgacgccaccgcc

SEQ ID NO: 3155067 - RNA, 13 nt, Mycobacterium bovis subsp bovis AF2122/97
gauguccgcagca

SEQ ID NO: 3155068 - RNA, 15 nt, Mycobacterium bovis subsp bovis AF2122/97
gauguccgcagcacc

SEQ ID NO: 3155069 - RNA, 22 nt, Mycobacterium bovis subsp bovis AF2122/97
gauguccgcagcaccgucgggc

SEQ ID NO: 3155070 - RNA, 16 nt, Mycobacterium bovis subsp bovis AF2122/97
gauguccgcggccacc

SEQ ID NO: 3155071 - RNA, 17 nt, Mycobacterium bovis subsp bovis AF2122/97
gauguccgcggccacca

SEQ ID NO: 3155072 - RNA, 18 nt, Mycobacterium bovis subsp bovis AF2122/97
gauguccgguccgccagc

SEQ ID NO: 3155073 - RNA, 20 nt, Mycobacterium bovis subsp bovis AF2122/97
gauguccgguccgccagcgc

SEQ ID NO: 3155074 - RNA, 17 nt, Mycobacterium bovis subsp bovis AF2122/97
gauguccucgacaccca

SEQ ID NO: 3155075 - RNA, 18 nt, Mycobacterium bovis subsp bovis AF2122/97
gauguccucgaugcgggc

SEQ ID NO: 3155076 - RNA, 19 nt, Mycobacterium bovis subsp bovis AF2122/97
gauguccucgaugcgggcg

SEQ ID NO: 3155077 - RNA, 16 nt, Mycobacterium bovis subsp bovis AF2122/97
gaugucgagcacaccg

SEQ ID NO: 3155078 - RNA, 19 nt, Mycobacterium bovis subsp bovis AF2122/97
gaugucgagcacaccgucg

SEQ ID NO: 3155079 - RNA, 15 nt, Mycobacterium bovis subsp bovis AF2122/97
gaugucgagcguggc

SEQ ID NO: 3155080 - RNA, 18 nt, Mycobacterium bovis subsp bovis AF2122/97
gaugucgagcguggcgac

SEQ ID NO: 3155081 - RNA, 15 nt, Mycobacterium bovis subsp bovis AF2122/97
gaugucgagguagug

SEQ ID NO: 3155082 - RNA, 15 nt, Mycobacterium bovis subsp bovis AF2122/97
gaugucgaucagccg

SEQ ID NO: 3155083 - RNA, 23 nt, Mycobacterium bovis subsp bovis AF2122/97
gaugucgauggggacggcggcga

SEQ ID NO: 3155084 - RNA, 21 nt, Mycobacterium bovis subsp bovis AF2122/97
gaugucgcgcauugccgacgc

SEQ ID NO: 3155085 - RNA, 18 nt, Mycobacterium bovis subsp bovis AF2122/97
gaugucgcgcgcuaggug

SEQ ID NO: 3155086 - RNA, 22 nt, Mycobacterium bovis subsp bovis AF2122/97
gaugucggcgaaccacggcagc

SEQ ID NO: 3155087 - RNA, 18 nt, Mycobacterium bovis subsp bovis AF2122/97
gauucggcgauggucccg

SEQ ID NO: 3155088 - RNA, 14 nt, Mycobacterium bovis subsp bovis AF2122/97
gauucggcggucgc

SEQ ID NO: 3155089 - RNA, 14 nt, Mycobacterium bovis subsp bovis AF2122/97
gauucgggcgucgg

SEQ ID NO: 3155090 - RNA, 15 nt, Mycobacterium bovis subsp bovis AF2122/97
gauucgguaucaggg

SEQ ID NO: 3155091 - RNA, 15 nt, Mycobacterium bovis subsp bovis AF2122/97
gauucggugccagca

SEQ ID NO: 3155092 - RNA, 19 nt, Mycobacterium bovis subsp bovis AF2122/97
gauucgucgcggaucagcc

SEQ ID NO: 3155093 - RNA, 15 nt, Mycobacterium bovis subsp bovis AF2122/97
gauucugcguccugc

SEQ ID NO: 3155094 - RNA, 19 nt, Mycobacterium bovis subsp bovis AF2122/97
gauucugcgucugcucgcc

SEQ ID NO: 3155095 - RNA, 20 nt, Mycobacterium bovis subsp bovis AF2122/97
gauucugcgucugcucgcca

SEQ ID NO: 3155096 - RNA, 20 nt, Mycobacterium bovis subsp bovis AF2122/97
gauucugcgucugcucggcg

SEQ ID NO: 3155097 - RNA, 22 nt, Mycobacterium bovis subsp bovis AF2122/97
gauucugcgucugcucggcgga

SEQ ID NO: 3155098 - RNA, 20 nt, Mycobacterium bovis subsp bovis AF2122/97
gauucuggccggaugccacg

SEQ ID NO: 3155099 - RNA, 19 nt, Mycobacterium bovis subsp bovis AF2122/97
gauucugggcuucaucggc

SEQ ID NO: 3155100 - RNA, 22 nt, Mycobacterium bovis subsp bovis AF2122/97
gauucuggucgaaauugggugc

SEQ ID NO: 3155101 - RNA, 19 nt, Mycobacterium bovis subsp bovis AF2122/97
gauucugugucugcucgcg

SEQ ID NO: 3155102 - RNA, 15 nt, Mycobacterium bovis subsp bovis AF2122/97
gauucuucagcgcgg

SEQ ID NO: 3155103 - RNA, 13 nt, Mycobacterium bovis subsp bovis AF2122/97
gauugaagccccc

SEQ ID NO: 3155104 - RNA, 16 nt, Mycobacterium bovis subsp bovis AF2122/97
gauugaagcuggccac

SEQ ID NO: 3155105 - RNA, 17 nt, Mycobacterium bovis subsp bovis AF2122/97
gauugaagcuggccacc

SEQ ID NO: 3155106 - RNA, 22 nt, Mycobacterium bovis subsp bovis AF2122/97
gauugaccaacccucgccgguc

SEQ ID NO: 3155107 - RNA, 16 nt, Mycobacterium bovis subsp bovis AF2122/97
gauugaccugcuggcg

SEQ ID NO: 3155108 - RNA, 11 nt, Mycobacterium bovis subsp bovis AF2122/97
gauugagcccg

SEQ ID NO: 3155109 - RNA, 21 nt, Mycobacterium bovis subsp bovis AF2122/97
gauugaugcgugguuggccau

SEQ ID NO: 3155110 - RNA, 16 nt, Mycobacterium bovis subsp bovis AF2122/97
gauugcagcuucggcc

SEQ ID NO: 3155111 - RNA, 22 nt, Mycobacterium bovis subsp bovis AF2122/97
gauugccaccgagaucaugccg

SEQ ID NO: 3155112 - RNA, 13 nt, Mycobacterium bovis subsp bovis AF2122/97
gauugccccgcau

SEQ ID NO: 3155113 - RNA, 17 nt, Mycobacterium bovis subsp bovis AF2122/97
gauugcccgcgcucgca

SEQ ID NO: 3155114 - RNA, 22 nt, Mycobacterium bovis subsp bovis AF2122/97
gauugcccgugcgaugcacaac

SEQ ID NO: 3155115 - RNA, 24 nt, Mycobacterium bovis subsp bovis AF2122/97
gauugcccgugcgaugcacaaccg

SEQ ID NO: 3155116 - RNA, 17 nt, Mycobacterium bovis subsp bovis AF2122/97
gauugccgagaacaccg

SEQ ID NO: 3155117 - RNA, 20 nt, Mycobacterium bovis subsp bovis AF2122/97
gauugccgcgguugugcugg

SEQ ID NO: 3155118 - RNA, 19 nt, Mycobacterium bovis subsp bovis AF2122/97
gauugccgcguagguggcc

SEQ ID NO: 3155119 - RNA, 17 nt, Mycobacterium bovis subsp bovis AF2122/97
gauugccgugcucgucg

SEQ ID NO: 3155120 - RNA, 20 nt, Mycobacterium bovis subsp bovis AF2122/97
gauugccugacaacucccga

SEQ ID NO: 3155121 - RNA, 12 nt, Mycobacterium bovis subsp bovis AF2122/97
gauugccugggc

SEQ ID NO: 3155122 - RNA, 23 nt, Mycobacterium bovis subsp bovis AF2122/97
gauugcgaagggcaccggcgauc

SEQ ID NO: 3155123 - RNA, 13 nt, Mycobacterium bovis subsp bovis AF2122/97
gauugcgaccgcg

SEQ ID NO: 3155124 - RNA, 22 nt, Mycobacterium bovis subsp bovis AF2122/97
gauugcgccaggagcgcggccc

SEQ ID NO: 3155125 - RNA, 20 nt, Mycobacterium bovis subsp bovis AF2122/97
gauugcgcgcugagcucgau

SEQ ID NO: 3155126 - RNA, 15 nt, Mycobacterium bovis subsp bovis AF2122/97
gauugcgcgggcauc

SEQ ID NO: 3155127 - RNA, 22 nt, Mycobacterium bovis subsp bovis AF2122/97
gauugcggaaacccggccgccg

SEQ ID NO: 3155128 - RNA, 14 nt, Mycobacterium bovis subsp bovis AF2122/97
gauugcggcacgga

SEQ ID NO: 3155129 - RNA, 13 nt, Mycobacterium bovis subsp bovis AF2122/97
gauugcggccgcc

SEQ ID NO: 3155130 - RNA, 15 nt, Mycobacterium bovis subsp bovis AF2122/97
gauugcggccgccga

SEQ ID NO: 3155131 - RNA, 14 nt, Mycobacterium bovis subsp bovis AF2122/97
gauugcgggccugc

SEQ ID NO: 3155132 - RNA, 15 nt, Mycobacterium bovis subsp bovis AF2122/97
gauugcgggccugca

SEQ ID NO: 3155133 - RNA, 17 nt, Mycobacterium bovis subsp bovis AF2122/97
gauugcguucaucaucc

SEQ ID NO: 3155134 - RNA, 23 nt, Mycobacterium bovis subsp bovis AF2122/97
gauugcugcggcuuucagcgcuu

SEQ ID NO: 3155135 - RNA, 20 nt, Mycobacterium bovis subsp bovis AF2122/97
gauugcuugggugccucgcc

SEQ ID NO: 3155136 - RNA, 16 nt, Mycobacterium bovis subsp bovis AF2122/97
gauuggccaaccccau

SEQ ID NO: 3155137 - RNA, 23 nt, Mycobacterium bovis subsp bovis AF2122/97
gauuggccaaccccauggccagc

SEQ ID NO: 3155138 - RNA, 11 nt, Mycobacterium bovis subsp bovis AF2122/97
gauuggcccga

SEQ ID NO: 3155139 - RNA, 18 nt, Mycobacterium bovis subsp bovis AF2122/97
gauuggcccgaguuggcg

SEQ ID NO: 3155140 - RNA, 13 nt, Mycobacterium bovis subsp bovis AF2122/97
gauuggccgcugc

SEQ ID NO: 3155141 - RNA, 14 nt, Mycobacterium bovis subsp bovis AF2122/97
gauuggccgcugca

SEQ ID NO: 3155142 - RNA, 21 nt, Mycobacterium bovis subsp bovis AF2122/97
gauuggccugccauaggccca

SEQ ID NO: 3155143 - RNA, 12 nt, Mycobacterium bovis subsp bovis AF2122/97
gauuggcgacgu

SEQ ID NO: 3155144 - RNA, 12 nt, Mycobacterium bovis subsp bovis AF2122/97
gauuggcgcugc

SEQ ID NO: 3155145 - RNA, 14 nt, Mycobacterium bovis subsp bovis AF2122/97
gauuggcgcugccc

SEQ ID NO: 3155146 - RNA, 18 nt, Mycobacterium bovis subsp bovis AF2122/97
gauuggcgcugcccgccg

SEQ ID NO: 3155147 - RNA, 21 nt, Mycobacterium bovis subsp bovis AF2122/97
gauuggcgcugcccgccgccc

SEQ ID NO: 3155148 - RNA, 17 nt, Mycobacterium bovis subsp bovis AF2122/97
gauuggcgucagcagca

SEQ ID NO: 3155149 - RNA, 22 nt, Mycobacterium bovis subsp bovis AF2122/97
gauugguggcccgggccaccgg

SEQ ID NO: 3155150 - RNA, 14 nt, Mycobacterium bovis subsp bovis AF2122/97
gauugucggggccg

SEQ ID NO: 3155151 - RNA, 23 nt, Mycobacterium bovis subsp bovis AF2122/97
gauugucggggccgcaggccagu

SEQ ID NO: 3155152 - RNA, 16 nt, Mycobacterium bovis subsp bovis AF2122/97
gauugugcagcgaaau

SEQ ID NO: 3155153 - RNA, 23 nt, Mycobacterium bovis subsp bovis AF2122/97
gauugugucccauggugagcugu

SEQ ID NO: 3155154 - RNA, 23 nt, Mycobacterium bovis subsp bovis AF2122/97
gauuguuuuccuugcgguaggcg

SEQ ID NO: 3155155 - RNA, 14 nt, Mycobacterium bovis subsp bovis AF2122/97
gauuucccagcgca

SEQ ID NO: 3155156 - RNA, 20 nt, Mycobacterium bovis subsp bovis AF2122/97
gauuucccagcgcagugccu

SEQ ID NO: 3155157 - RNA, 23 nt, Mycobacterium bovis subsp bovis AF2122/97
gauuucgcacggaaggcccggcg

SEQ ID NO: 3155158 - RNA, 18 nt, Mycobacterium bovis subsp bovis AF2122/97
gauuucgcgucugcucgc

SEQ ID NO: 3155159 - RNA, 20 nt, Mycobacterium bovis subsp bovis AF2122/97
gauuucgcgucugcucgcca

SEQ ID NO: 3155160 - RNA, 13 nt, Mycobacterium bovis subsp bovis AF2122/97
gauuucggcgccg

SEQ ID NO: 3155161 - RNA, 16 nt, Mycobacterium bovis subsp bovis AF2122/97
gauuucggcgccggcg

SEQ ID NO: 3155162 - RNA, 14 nt, Mycobacterium bovis subsp bovis AF2122/97
gauuucggcggcga

SEQ ID NO: 3155163 - RNA, 22 nt, Mycobacterium bovis subsp bovis AF2122/97
gauuucggugacuccggcugga

SEQ ID NO: 3155164 - RNA, 20 nt, Mycobacterium bovis subsp bovis AF2122/97
gauuucuuuaaaccccuggc

SEQ ID NO: 3155165 - RNA, 23 nt, Mycobacterium bovis subsp bovis AF2122/97
gauuugacgacaaacggcgaccc

SEQ ID NO: 3155166 - RNA, 19 nt, Mycobacterium bovis subsp bovis AF2122/97
gauuuggaucggcugcgcg

SEQ ID NO: 3155167 - RNA, 15 nt, Mycobacterium bovis subsp bovis AF2122/97
gauuugggucagugc

SEQ ID NO: 3155168 - RNA, 21 nt, Mycobacterium bovis subsp bovis AF2122/97
gauuuugcgucgcgccugccc

SEQ ID NO: 3155169 - RNA, 18 nt, Mycobacterium bovis subsp bovis AF2122/97
gauuuugcgucugcucgc

SEQ ID NO: 3155170 - RNA, 20 nt, Mycobacterium bovis subsp bovis AF2122/97
gauuuugcgucugcucgcca

SEQ ID NO: 3155171 - RNA, 20 nt, Mycobacterium bovis subsp bovis AF2122/97
gauuuugcgucugcucgcgc

SEQ ID NO: 3155172 - RNA, 20 nt, Mycobacterium bovis subsp bovis AF2122/97
gauuuugcgucugcucggcg

SEQ ID NO: 3155173 - RNA, 22 nt, Mycobacterium bovis subsp bovis AF2122/97
gcaaccacgccccgaucgguga

SEQ ID NO: 3155174 - RNA, 14 nt, Mycobacterium bovis subsp bovis AF2122/97
gcaaccacguccgc

SEQ ID NO: 3155175 - RNA, 13 nt, Mycobacterium bovis subsp bovis AF2122/97
gcaaccagcagca

SEQ ID NO: 3155176 - RNA, 16 nt, Mycobacterium bovis subsp bovis AF2122/97
gcaaccagcagcaggu

SEQ ID NO: 3155177 - RNA, 22 nt, Mycobacterium bovis subsp bovis AF2122/97
gcaaccaggaugguugcgacgg

SEQ ID NO: 3155178 - RNA, 22 nt, Mycobacterium bovis subsp bovis AF2122/97
gcaacccacacgcccucgacgc

SEQ ID NO: 3155179 - RNA, 15 nt, Mycobacterium bovis subsp bovis AF2122/97
gcaacccagccgcgc

SEQ ID NO: 3155180 - RNA, 16 nt, Mycobacterium bovis subsp bovis AF2122/97
gcaacccagccgcgcc

SEQ ID NO: 3155181 - RNA, 20 nt, Mycobacterium bovis subsp bovis AF2122/97
gcaacccagccgcgccagcu

SEQ ID NO: 3155182 - RNA, 23 nt, Mycobacterium bovis subsp bovis AF2122/97
gcaaccccgagcggagccgccga

SEQ ID NO: 3155183 - RNA, 15 nt, Mycobacterium bovis subsp bovis AF2122/97
gcaacccgccguugc

SEQ ID NO: 3155184 - RNA, 17 nt, Mycobacterium bovis subsp bovis AF2122/97
gcaacccggugauggug

SEQ ID NO: 3155185 - RNA, 15 nt, Mycobacterium bovis subsp bovis AF2122/97
gcaacccugcccggc

SEQ ID NO: 3155186 - RNA, 21 nt, Mycobacterium bovis subsp bovis AF2122/97
gcaacccugcccggcccgccc

SEQ ID NO: 3155187 - RNA, 15 nt, Mycobacterium bovis subsp bovis AF2122/97
gcaacccugccgcga

SEQ ID NO: 3155188 - RNA, 18 nt, Mycobacterium bovis subsp bovis AF2122/97
gcaacccugccgcgauga

SEQ ID NO: 3155189 - RNA, 14 nt, Mycobacterium bovis subsp bovis AF2122/97
gcaacccugcggug

SEQ ID NO: 3155190 - RNA, 17 nt, Mycobacterium bovis subsp bovis AF2122/97
gcaacccugcggugcag

SEQ ID NO: 3155191 - RNA, 17 nt, Mycobacterium bovis subsp bovis AF2122/97
gcaaccgagggcauucc

SEQ ID NO: 3155192 - RNA, 19 nt, Mycobacterium bovis subsp bovis AF2122/97
gcaaccgaugacgcguuca

SEQ ID NO: 3155193 - RNA, 13 nt, Mycobacterium bovis subsp bovis AF2122/97
gcaaccgccaucg

SEQ ID NO: 3155194 - RNA, 17 nt, Mycobacterium bovis subsp bovis AF2122/97
gcaaccgccaucgucga

SEQ ID NO: 3155195 - RNA, 16 nt, Mycobacterium bovis subsp bovis AF2122/97
gcaaccgccccuuccc

SEQ ID NO: 3155196 - RNA, 15 nt, Mycobacterium bovis subsp bovis AF2122/97
gcaaccgccgccacc

SEQ ID NO: 3155197 - RNA, 17 nt, Mycobacterium bovis subsp bovis AF2122/97
gcaaccgccggugccga

SEQ ID NO: 3155198 - RNA, 15 nt, Mycobacterium bovis subsp bovis AF2122/97
gcaaccgccgugugc

SEQ ID NO: 3155199 - RNA, 19 nt, Mycobacterium bovis subsp bovis AF2122/97
gcaaccgccgugugccacg

SEQ ID NO: 3155200 - RNA, 13 nt, Mycobacterium bovis subsp bovis AF2122/97
gcaaccgcggccc

SEQ ID NO: 3155201 - RNA, 14 nt, Mycobacterium bovis subsp bovis AF2122/97
gcaaccgcggcccc

SEQ ID NO: 3155202 - RNA, 17 nt, Mycobacterium bovis subsp bovis AF2122/97
gcaaccgcucaucgauc

SEQ ID NO: 3155203 - RNA, 15 nt, Mycobacterium bovis subsp bovis AF2122/97
gcaaccgcucggcga

SEQ ID NO: 3155204 - RNA, 16 nt, Mycobacterium bovis subsp bovis AF2122/97
gcaaccgcucggcgau

SEQ ID NO: 3155205 - RNA, 19 nt, Mycobacterium bovis subsp bovis AF2122/97
gcaaccggauuucgucggg

SEQ ID NO: 3155206 - RNA, 12 nt, Mycobacterium bovis subsp bovis AF2122/97
gcaaccggcgga

SEQ ID NO: 3155207 - RNA, 19 nt, Mycobacterium bovis subsp bovis AF2122/97
gcaaccgggaggccaccgc

SEQ ID NO: 3155208 - RNA, 21 nt, Mycobacterium bovis subsp bovis AF2122/97
gcaaccgggaggccaccgcga

SEQ ID NO: 3155209 - RNA, 17 nt, Mycobacterium bovis subsp bovis AF2122/97
gcaaccgggaucugcuc

SEQ ID NO: 3155210 - RNA, 23 nt, Mycobacterium bovis subsp bovis AF2122/97
gcaaccgggccucaugcuaggcc

SEQ ID NO: 3155211 - RNA, 18 nt, Mycobacterium bovis subsp bovis AF2122/97
gcaaccgguaucgccgcu

SEQ ID NO: 3155212 - RNA, 14 nt, Mycobacterium bovis subsp bovis AF2122/97
gcaaccggucagcc

SEQ ID NO: 3155213 - RNA, 22 nt, Mycobacterium bovis subsp bovis AF2122/97
gcaaccgguggaugaacaccuc

SEQ ID NO: 3155214 - RNA, 17 nt, Mycobacterium bovis subsp bovis AF2122/97
gcaaccgugccgcauca

SEQ ID NO: 3155215 - RNA, 18 nt, Mycobacterium bovis subsp bovis AF2122/97
gcaaccucgccgucgucg

SEQ ID NO: 3155216 - RNA, 22 nt, Mycobacterium bovis subsp bovis AF2122/97
gcaaccucgguugguccucggc

SEQ ID NO: 3155217 - RNA, 14 nt, Mycobacterium bovis subsp bovis AF2122/97
gcaaccugaaucca

SEQ ID NO: 3155218 - RNA, 16 nt, Mycobacterium bovis subsp bovis AF2122/97
gcaaccugaauccaga

SEQ ID NO: 3155219 - RNA, 22 nt, Mycobacterium bovis subsp bovis AF2122/97
gcaaccugaauccagaccaugc

SEQ ID NO: 3155220 - RNA, 15 nt, Mycobacterium bovis subsp bovis AF2122/97
gcaaccugccgggcc

SEQ ID NO: 3155221 - RNA, 20 nt, Mycobacterium bovis subsp bovis AF2122/97
gcaaccugccgggccacggc

SEQ ID NO: 3155222 - RNA, 21 nt, Mycobacterium bovis subsp bovis AF2122/97
gcaaccugccgggccacggcu

SEQ ID NO: 3155223 - RNA, 22 nt, Mycobacterium bovis subsp bovis AF2122/97
gcaaccugccgggccacggcug

SEQ ID NO: 3155224 - RNA, 18 nt, Mycobacterium bovis subsp bovis AF2122/97
gcaaccuugggcgccguc

SEQ ID NO: 3155225 - RNA, 16 nt, Mycobacterium bovis subsp bovis AF2122/97
gcaacgaagagggcgc

SEQ ID NO: 3155226 - RNA, 20 nt, Mycobacterium bovis subsp bovis AF2122/97
gcaacgaagagggcgccgcg

SEQ ID NO: 3155227 - RNA, 22 nt, Mycobacterium bovis subsp bovis AF2122/97
gcaacgaagagggcgccgcgcg

SEQ ID NO: 3155228 - RNA, 23 nt, Mycobacterium bovis subsp bovis AF2122/97
gcaacgaagagggcgccgcgcgc

SEQ ID NO: 3155229 - RNA, 18 nt, Mycobacterium bovis subsp bovis AF2122/97
gcaacgaauagguucccu

SEQ ID NO: 3155230 - RNA, 20 nt, Mycobacterium bovis subsp bovis AF2122/97
gcaacgacaaaccgggcgug

SEQ ID NO: 3155231 - RNA, 13 nt, Mycobacterium bovis subsp bovis AF2122/97
gcaacgacacgcc

SEQ ID NO: 3155232 - RNA, 16 nt, Mycobacterium bovis subsp bovis AF2122/97
gcaacgacauccagau

SEQ ID NO: 3155233 - RNA, 21 nt, Mycobacterium bovis subsp bovis AF2122/97
gcaacgacccgaagccgaccg

SEQ ID NO: 3155234 - RNA, 17 nt, Mycobacterium bovis subsp bovis AF2122/97
gcaacgacggccgucgc

SEQ ID NO: 3155235 - RNA, 19 nt, Mycobacterium bovis subsp bovis AF2122/97
gcaacgacggccgucgccc

SEQ ID NO: 3155236 - RNA, 15 nt, Mycobacterium bovis subsp bovis AF2122/97
gcaacgacugcauga

SEQ ID NO: 3155237 - RNA, 18 nt, Mycobacterium bovis subsp bovis AF2122/97
gcaacgagagcggcuccg

SEQ ID NO: 3155238 - RNA, 21 nt, Mycobacterium bovis subsp bovis AF2122/97
gcaacgaucagguuggcggcu

SEQ ID NO: 3155239 - RNA, 23 nt, Mycobacterium bovis subsp bovis AF2122/97
gcaacgaucagguuggcggcugc

SEQ ID NO: 3155240 - RNA, 15 nt, Mycobacterium bovis subsp bovis AF2122/97
gcaacgaucgacacc

SEQ ID NO: 3155241 - RNA, 16 nt, Mycobacterium bovis subsp bovis AF2122/97
gcaacgaucgacacca

SEQ ID NO: 3155242 - RNA, 23 nt, Mycobacterium bovis subsp bovis AF2122/97
gcaacgauugaacucuggugacg

SEQ ID NO: 3155243 - RNA, 19 nt, Mycobacterium bovis subsp bovis AF2122/97
gcaacgauuuuagcggcug

SEQ ID NO: 3155244 - RNA, 14 nt, Mycobacterium bovis subsp bovis AF2122/97
gcaacgcccaacgu

SEQ ID NO: 3155245 - RNA, 15 nt, Mycobacterium bovis subsp bovis AF2122/97
gcaacgccgauggcu

SEQ ID NO: 3155246 - RNA, 12 nt, Mycobacterium bovis subsp bovis AF2122/97
gcaacgccgcgc

SEQ ID NO: 3155247 - RNA, 14 nt, Mycobacterium bovis subsp bovis AF2122/97
gcaacgccgcgccg

SEQ ID NO: 3155248 - RNA, 15 nt, Mycobacterium bovis subsp bovis AF2122/97
gcaacgccucgagca

SEQ ID NO: 3155249 - RNA, 20 nt, Mycobacterium bovis subsp bovis AF2122/97
gcaacgcgaaccggccaucg

SEQ ID NO: 3155250 - RNA, 21 nt, Mycobacterium bovis subsp bovis AF2122/97
gcaacgcgaaccggccaucga

SEQ ID NO: 3155251 - RNA, 23 nt, Mycobacterium bovis subsp bovis AF2122/97
gcaacgcggccuugcgcacaggc

SEQ ID NO: 3155252 - RNA, 19 nt, Mycobacterium bovis subsp bovis AF2122/97
gcaacgcggcgaagugcac

SEQ ID NO: 3155253 - RNA, 16 nt, Mycobacterium bovis subsp bovis AF2122/97
gcaacgcggucugcuc

SEQ ID NO: 3155254 - RNA, 17 nt, Mycobacterium bovis subsp bovis AF2122/97
gcaacgcggucugcucc

SEQ ID NO: 3155255 - RNA, 22 nt, Mycobacterium bovis subsp bovis AF2122/97
gcaacgcggucugcuccaggcg

SEQ ID NO: 3155256 - RNA, 20 nt, Mycobacterium bovis subsp bovis AF2122/97
gcaacgcgguggaccgcucg

SEQ ID NO: 3155257 - RNA, 21 nt, Mycobacterium bovis subsp bovis AF2122/97
gcaacgcgguggaccgcucga

SEQ ID NO: 3155258 - RNA, 17 nt, Mycobacterium bovis subsp bovis AF2122/97
gcaacgcgucggucgcg

SEQ ID NO: 3155259 - RNA, 18 nt, Mycobacterium bovis subsp bovis AF2122/97
gcaagccgacaucggcgg

SEQ ID NO: 3155260 - RNA, 19 nt, Mycobacterium bovis subsp bovis AF2122/97
gcaagccggacagaucaac

SEQ ID NO: 3155261 - RNA, 22 nt, Mycobacterium bovis subsp bovis AF2122/97
gcaagccguucugucccggcgc

SEQ ID NO: 3155262 - RNA, 19 nt, Mycobacterium bovis subsp bovis AF2122/97
gcaagccguugcacggccg

SEQ ID NO: 3155263 - RNA, 22 nt, Mycobacterium bovis subsp bovis AF2122/97
gcaagccguugcacggccggga

SEQ ID NO: 3155264 - RNA, 22 nt, Mycobacterium bovis subsp bovis AF2122/97
gcaagccuaaaaccccgagccg

SEQ ID NO: 3155265 - RNA, 16 nt, Mycobacterium bovis subsp bovis AF2122/97
gcaagcgcagacacga

SEQ ID NO: 3155266 - RNA, 13 nt, Mycobacterium bovis subsp bovis AF2122/97
gcaagcgccgcgc

SEQ ID NO: 3155267 - RNA, 18 nt, Mycobacterium bovis subsp bovis AF2122/97
gcaagcgccgcgcuugcg

SEQ ID NO: 3155268 - RNA, 13 nt, Mycobacterium bovis subsp bovis AF2122/97
gcaagcggaugug

SEQ ID NO: 3155269 - RNA, 19 nt, Mycobacterium bovis subsp bovis AF2122/97
gcaagcgugacccgccggc

SEQ ID NO: 3155270 - RNA, 22 nt, Mycobacterium bovis subsp bovis AF2122/97
gcaagcgugacccgccggcgac

SEQ ID NO: 3155271 - RNA, 15 nt, Mycobacterium bovis subsp bovis AF2122/97
gcaagcguugggaca

SEQ ID NO: 3155272 - RNA, 16 nt, Mycobacterium bovis subsp bovis AF2122/97
gcaagcuaccggcccg

SEQ ID NO: 3155273 - RNA, 20 nt, Mycobacterium bovis subsp bovis AF2122/97
gcaagcugaccgccagcggc

SEQ ID NO: 3155274 - RNA, 18 nt, Mycobacterium bovis subsp bovis AF2122/97
gcaaggaauuccggcugc

SEQ ID NO: 3155275 - RNA, 19 nt, Mycobacterium bovis subsp bovis AF2122/97
gcaaggaccugugcggccg

SEQ ID NO: 3155276 - RNA, 21 nt, Mycobacterium bovis subsp bovis AF2122/97
gcaaggacguggcgcuggacc

SEQ ID NO: 3155277 - RNA, 22 nt, Mycobacterium bovis subsp bovis AF2122/97
gcaaggacguggcgcuggaccg

SEQ ID NO: 3155278 - RNA, 15 nt, Mycobacterium bovis subsp bovis AF2122/97
gcaaggcauccaacg

SEQ ID NO: 3155279 - RNA, 13 nt, Mycobacterium bovis subsp bovis AF2122/97
gcaaggccaccgg

SEQ ID NO: 3155280 - RNA, 23 nt, Mycobacterium bovis subsp bovis AF2122/97
gcaaggccaccggcggugccggu

SEQ ID NO: 3155281 - RNA, 17 nt, Mycobacterium bovis subsp bovis AF2122/97
gcaaggccaccgucgcg

SEQ ID NO: 3155282 - RNA, 15 nt, Mycobacterium bovis subsp bovis AF2122/97
gcaaggcccgcaccg

SEQ ID NO: 3155283 - RNA, 20 nt, Mycobacterium bovis subsp bovis AF2122/97
gcaaggcggaucuucucggu

SEQ ID NO: 3155284 - RNA, 16 nt, Mycobacterium bovis subsp bovis AF2122/97
gcaaggcggcggccag

SEQ ID NO: 3155285 - RNA, 20 nt, Mycobacterium bovis subsp bovis AF2122/97
gcaaggcguguagccugcgg

SEQ ID NO: 3155286 - RNA, 23 nt, Mycobacterium bovis subsp bovis AF2122/97
gcaagggcauacagcaugucgcg

SEQ ID NO: 3155287 - RNA, 19 nt, Mycobacterium bovis subsp bovis AF2122/97
gcaaggggcgucgcaacgc

SEQ ID NO: 3155288 - RNA, 18 nt, Mycobacterium bovis subsp bovis AF2122/97
gcaaggguggggccggcg

SEQ ID NO: 3155289 - RNA, 19 nt, Mycobacterium bovis subsp bovis AF2122/97
gcaaggguggggccggcgg

SEQ ID NO: 3155290 - RNA, 20 nt, Mycobacterium bovis subsp bovis AF2122/97
gcaaggguggggccggcggu

SEQ ID NO: 3155291 - RNA, 15 nt, Mycobacterium bovis subsp bovis AF2122/97
gcaaggucaacccgc

SEQ ID NO: 3155292 - RNA, 22 nt, Mycobacterium bovis subsp bovis AF2122/97
gcaaggucgcugcuugcgggcu

SEQ ID NO: 3155293 - RNA, 16 nt, Mycobacterium bovis subsp bovis AF2122/97
gcaagguugccaacgc

SEQ ID NO: 3155294 - RNA, 21 nt, Mycobacterium bovis subsp bovis AF2122/97
gcaagguugccaacgccuuga

SEQ ID NO: 3155295 - RNA, 13 nt, Mycobacterium bovis subsp bovis AF2122/97
gcaagucaaacgc

SEQ ID NO: 3155296 - RNA, 15 nt, Mycobacterium bovis subsp bovis AF2122/97
gcaagucauccaggu

SEQ ID NO: 3155297 - RNA, 16 nt, Mycobacterium bovis subsp bovis AF2122/97
gcaaguccugcagcug

SEQ ID NO: 3155298 - RNA, 18 nt, Mycobacterium bovis subsp bovis AF2122/97
gcaaguccugcagcuggc

SEQ ID NO: 3155299 - RNA, 21 nt, Mycobacterium bovis subsp bovis AF2122/97
gcaagucgagauagaccuugg

SEQ ID NO: 3155300 - RNA, 19 nt, Mycobacterium bovis subsp bovis AF2122/97
gcaagucgcccagccgagc

SEQ ID NO: 3155301 - RNA, 20 nt, Mycobacterium bovis subsp bovis AF2122/97
gcaagucgcccagccgagcg

SEQ ID NO: 3155302 - RNA, 12 nt, Mycobacterium bovis subsp bovis AF2122/97
gcaagucgccga

SEQ ID NO: 3155303 - RNA, 13 nt, Mycobacterium bovis subsp bovis AF2122/97
gcaagucgccgag

SEQ ID NO: 3155304 - RNA, 18 nt, Mycobacterium bovis subsp bovis AF2122/97
gcaagugaauaccccaga

SEQ ID NO: 3155305 - RNA, 20 nt, Mycobacterium bovis subsp bovis AF2122/97
gcaagugggcgcgaacggcg

SEQ ID NO: 3155306 - RNA, 21 nt, Mycobacterium bovis subsp bovis AF2122/97
gcaagugucuccggcaacagc

SEQ ID NO: 3155307 - RNA, 17 nt, Mycobacterium bovis subsp bovis AF2122/97
gcaagugugagcagacc

SEQ ID NO: 3155308 - RNA, 18 nt, Mycobacterium bovis subsp bovis AF2122/97
gcaaguucgucgggaucg

SEQ ID NO: 3155309 - RNA, 15 nt, Mycobacterium bovis subsp bovis AF2122/97
gcaaguucugcgcuc

SEQ ID NO: 3155310 - RNA, 19 nt, Mycobacterium bovis subsp bovis AF2122/97
gcaaguugagcagcuuggu

SEQ ID NO: 3155311 - RNA, 24 nt, Mycobacterium bovis subsp bovis AF2122/97
gcaauaagggagaccgcggccggc

SEQ ID NO: 3155312 - RNA, 18 nt, Mycobacterium bovis subsp bovis AF2122/97
gcaauacccgagcguccg

SEQ ID NO: 3155313 - RNA, 16 nt, Mycobacterium bovis subsp bovis AF2122/97
gcaauacccgccgcga

SEQ ID NO: 3155314 - RNA, 21 nt, Mycobacterium bovis subsp bovis AF2122/97
gcaauacccgccgcgaugcca

SEQ ID NO: 3155315 - RNA, 19 nt, Mycobacterium bovis subsp bovis AF2122/97
gcaauaccgaaccggugua

SEQ ID NO: 3155316 - RNA, 20 nt, Mycobacterium bovis subsp bovis AF2122/97
gcaauaccugagcgcgcgcg

SEQ ID NO: 3155317 - RNA, 15 nt, Mycobacterium bovis subsp bovis AF2122/97
gcaauacggcggcgc

SEQ ID NO: 3155318 - RNA, 21 nt, Mycobacterium bovis subsp bovis AF2122/97
gcaauacggcggcgccgccca

SEQ ID NO: 3155319 - RNA, 23 nt, Mycobacterium bovis subsp bovis AF2122/97
gcaauacguagucgccgaucgag

SEQ ID NO: 3155320 - RNA, 14 nt, Mycobacterium bovis subsp bovis AF2122/97
gcaauagaccgcag

SEQ ID NO: 3155321 - RNA, 17 nt, Mycobacterium bovis subsp bovis AF2122/97
gcaauagaccgcagucg

SEQ ID NO: 3155322 - RNA, 20 nt, Mycobacterium bovis subsp bovis AF2122/97
gcaauagccggguugccugc

SEQ ID NO: 3155323 - RNA, 15 nt, Mycobacterium bovis subsp bovis AF2122/97
gcaauagcgacagca

SEQ ID NO: 3155324 - RNA, 23 nt, Mycobacterium bovis subsp bovis AF2122/97
gcaauauccgggagugcgccggc

SEQ ID NO: 3155325 - RNA, 19 nt, Mycobacterium bovis subsp bovis AF2122/97
gcaauauccuccagcaggu

SEQ ID NO: 3155326 - RNA, 20 nt, Mycobacterium bovis subsp bovis AF2122/97
gcaauaucuuuagcgcgugc

SEQ ID NO: 3155327 - RNA, 12 nt, Mycobacterium bovis subsp bovis AF2122/97
gcaaucacauca

SEQ ID NO: 3155328 - RNA, 13 nt, Mycobacterium bovis subsp bovis AF2122/97
gcaaucacaucaa

SEQ ID NO: 3155329 - RNA, 19 nt, Mycobacterium bovis subsp bovis AF2122/97
gcaaucaccgccggcggcg

SEQ ID NO: 3155330 - RNA, 14 nt, Mycobacterium bovis subsp bovis AF2122/97
gcaaucagacggcg

SEQ ID NO: 3155331 - RNA, 17 nt, Mycobacterium bovis subsp bovis AF2122/97
gcaaucaggaaccgcuc

SEQ ID NO: 3155332 - RNA, 22 nt, Mycobacterium bovis subsp bovis AF2122/97
gcaaucaucucccgaccgccga

SEQ ID NO: 3155333 - RNA, 21 nt, Mycobacterium bovis subsp bovis AF2122/97
gcaauccaaggcucagcagcg

SEQ ID NO: 3155334 - RNA, 14 nt, Mycobacterium bovis subsp bovis AF2122/97
gcaaucccgccauc

SEQ ID NO: 3155335 - RNA, 20 nt, Mycobacterium bovis subsp bovis AF2122/97
gcaauccgcaaaacgagcuu

SEQ ID NO: 3155336 - RNA, 23 nt, Mycobacterium bovis subsp bovis AF2122/97
gcaauccgcaaaacgagcuucca

SEQ ID NO: 3155337 - RNA, 20 nt, Mycobacterium bovis subsp bovis AF2122/97
gcaauccggucagcgcggcg

SEQ ID NO: 3155338 - RNA, 19 nt, Mycobacterium bovis subsp bovis AF2122/97
gcaauccugcgggacuggc

SEQ ID NO: 3155339 - RNA, 17 nt, Mycobacterium bovis subsp bovis AF2122/97
gcaaucgaccacgacgu

SEQ ID NO: 3155340 - RNA, 23 nt, Mycobacterium bovis subsp bovis AF2122/97
gcaaucgaccacgacguggacuc

SEQ ID NO: 3155341 - RNA, 23 nt, Mycobacterium bovis subsp bovis AF2122/97
gcaaucgaggaaggugugcgucu

SEQ ID NO: 3155342 - RNA, 13 nt, Mycobacterium bovis subsp bovis AF2122/97
gcaaucgcgacgg

SEQ ID NO: 3155343 - RNA, 18 nt, Mycobacterium bovis subsp bovis AF2122/97
gcaaucgcgacggggucg

SEQ ID NO: 3155344 - RNA, 17 nt, Mycobacterium bovis subsp bovis AF2122/97
gcaaucgcgggcgaugg

SEQ ID NO: 3155345 - RNA, 14 nt, Mycobacterium bovis subsp bovis AF2122/97
gcacaccgaggucg

SEQ ID NO: 3155346 - RNA, 18 nt, Mycobacterium bovis subsp bovis AF2122/97
gcacaccgaggucgccaa

SEQ ID NO: 3155347 - RNA, 21 nt, Mycobacterium bovis subsp bovis AF2122/97
gcacaccgaucggcaaaccgu

SEQ ID NO: 3155348 - RNA, 13 nt, Mycobacterium bovis subsp bovis AF2122/97
gcacaccgccagc

SEQ ID NO: 3155349 - RNA, 15 nt, Mycobacterium bovis subsp bovis AF2122/97
gcacaccgccagcgg

SEQ ID NO: 3155350 - RNA, 16 nt, Mycobacterium bovis subsp bovis AF2122/97
gcacaccgccagcggc

SEQ ID NO: 3155351 - RNA, 13 nt, Mycobacterium bovis subsp bovis AF2122/97
gcacaccggcacu

SEQ ID NO: 3155352 - RNA, 13 nt, Mycobacterium bovis subsp bovis AF2122/97
gcacaccggcuuu

SEQ ID NO: 3155353 - RNA, 15 nt, Mycobacterium bovis subsp bovis AF2122/97
gcacaccgggcacca

SEQ ID NO: 3155354 - RNA, 19 nt, Mycobacterium bovis subsp bovis AF2122/97
gcacaccgggcaccagucg

SEQ ID NO: 3155355 - RNA, 12 nt, Mycobacterium bovis subsp bovis AF2122/97
gcacaccggugg

SEQ ID NO: 3155356 - RNA, 14 nt, Mycobacterium bovis subsp bovis AF2122/97
gcacaccgguggac

SEQ ID NO: 3155357 - RNA, 19 nt, Mycobacterium bovis subsp bovis AF2122/97
gcacaccgguggacccggc

SEQ ID NO: 3155358 - RNA, 21 nt, Mycobacterium bovis subsp bovis AF2122/97
gcacaccgguggacccggcgg

SEQ ID NO: 3155359 - RNA, 13 nt, Mycobacterium bovis subsp bovis AF2122/97
gcacaccgguggc

SEQ ID NO: 3155360 - RNA, 17 nt, Mycobacterium bovis subsp bovis AF2122/97
gcacaccgguggcgccc

SEQ ID NO: 3155361 - RNA, 17 nt, Mycobacterium bovis subsp bovis AF2122/97
gcacaccguccgucggc

SEQ ID NO: 3155362 - RNA, 19 nt, Mycobacterium bovis subsp bovis AF2122/97
gcacaccguccgucggcgc

SEQ ID NO: 3155363 - RNA, 15 nt, Mycobacterium bovis subsp bovis AF2122/97
gcacaccgucgacga

SEQ ID NO: 3155364 - RNA, 18 nt, Mycobacterium bovis subsp bovis AF2122/97
gcacaccgucgacgacau

SEQ ID NO: 3155365 - RNA, 16 nt, Mycobacterium bovis subsp bovis AF2122/97
gcacaccgucgcaccc

SEQ ID NO: 3155366 - RNA, 15 nt, Mycobacterium bovis subsp bovis AF2122/97
gcacaccugcgcggc

SEQ ID NO: 3155367 - RNA, 16 nt, Mycobacterium bovis subsp bovis AF2122/97
gcacaccugcgcggcg

SEQ ID NO: 3155368 - RNA, 17 nt, Mycobacterium bovis subsp bovis AF2122/97
gcacaccugcgcggcgu

SEQ ID NO: 3155369 - RNA, 23 nt, Mycobacterium bovis subsp bovis AF2122/97
gcacaccugcgcggcgugcgcgg

SEQ ID NO: 3155370 - RNA, 13 nt, Mycobacterium bovis subsp bovis AF2122/97
gcacacgaucgcg

SEQ ID NO: 3155371 - RNA, 19 nt, Mycobacterium bovis subsp bovis AF2122/97
gcacacgccuaccgcgacg

SEQ ID NO: 3155372 - RNA, 20 nt, Mycobacterium bovis subsp bovis AF2122/97
gcacacgccuaccgcgacga

SEQ ID NO: 3155373 - RNA, 21 nt, Mycobacterium bovis subsp bovis AF2122/97
gcacacgccuaccgcgacgau

SEQ ID NO: 3155374 - RNA, 13 nt, Mycobacterium bovis subsp bovis AF2122/97
gcacacggccuug

SEQ ID NO: 3155375 - RNA, 20 nt, Mycobacterium bovis subsp bovis AF2122/97
gcacacggucaccggcacgu

SEQ ID NO: 3155376 - RNA, 20 nt, Mycobacterium bovis subsp bovis AF2122/97
gcacacguccggcgaugacc

SEQ ID NO: 3155377 - RNA, 19 nt, Mycobacterium bovis subsp bovis AF2122/97
gcacacgucgggaguaagg

SEQ ID NO: 3155378 - RNA, 22 nt, Mycobacterium bovis subsp bovis AF2122/97
gcacacuaccgccgcgaccgcg

SEQ ID NO: 3155379 - RNA, 15 nt, Mycobacterium bovis subsp bovis AF2122/97
gcacacuccuagcca

SEQ ID NO: 3155380 - RNA, 20 nt, Mycobacterium bovis subsp bovis AF2122/97
gcacacuccuagccaacgag

SEQ ID NO: 3155381 - RNA, 19 nt, Mycobacterium bovis subsp bovis AF2122/97
gcacacugaccccgccgcc

SEQ ID NO: 3155382 - RNA, 20 nt, Mycobacterium bovis subsp bovis AF2122/97
gcacacugaccccgccgcca

SEQ ID NO: 3155383 - RNA, 20 nt, Mycobacterium bovis subsp bovis AF2122/97
gcacacuggccacaaucgcg

SEQ ID NO: 3155384 - RNA, 22 nt, Mycobacterium bovis subsp bovis AF2122/97
gcacacugucgauuugaucgac

SEQ ID NO: 3155385 - RNA, 22 nt, Mycobacterium bovis subsp bovis AF2122/97
gcacacuguuacuccgacggcc

SEQ ID NO: 3155386 - RNA, 18 nt, Mycobacterium bovis subsp bovis AF2122/97
gcacagaaaacgauggug

SEQ ID NO: 3155387 - RNA, 17 nt, Mycobacterium bovis subsp bovis AF2122/97
gcacagacacggcagcu

SEQ ID NO: 3155388 - RNA, 20 nt, Mycobacterium bovis subsp bovis AF2122/97
gcacagagugaggcgcuggc

SEQ ID NO: 3155389 - RNA, 12 nt, Mycobacterium bovis subsp bovis AF2122/97
gcacagcaacaa

SEQ ID NO: 3155390 - RNA, 12 nt, Mycobacterium bovis subsp bovis AF2122/97
gcacagcaccac

SEQ ID NO: 3155391 - RNA, 13 nt, Mycobacterium bovis subsp bovis AF2122/97
gcacagcaccacg

SEQ ID NO: 3155392 - RNA, 21 nt, Mycobacterium bovis subsp bovis AF2122/97
gcacagcagcaacgcggugcc

SEQ ID NO: 3155393 - RNA, 14 nt, Mycobacterium bovis subsp bovis AF2122/97
gcacagcagcaccg

SEQ ID NO: 3155394 - RNA, 17 nt, Mycobacterium bovis subsp bovis AF2122/97
gcacagcagcaccgcga

SEQ ID NO: 3155395 - RNA, 18 nt, Mycobacterium bovis subsp bovis AF2122/97
gcacagcagcgguugaug

SEQ ID NO: 3155396 - RNA, 14 nt, Mycobacterium bovis subsp bovis AF2122/97
gcacagcagugaac

SEQ ID NO: 3155397 - RNA, 17 nt, Mycobacterium bovis subsp bovis AF2122/97
gcacagcauuguccggc

SEQ ID NO: 3155398 - RNA, 18 nt, Mycobacterium bovis subsp bovis AF2122/97
gcacagcauuguccggcg

SEQ ID NO: 3155399 - RNA, 18 nt, Mycobacterium bovis subsp bovis AF2122/97
gcacagccauggugggcc

SEQ ID NO: 3155400 - RNA, 16 nt, Mycobacterium bovis subsp bovis AF2122/97
gcacagcccgaugccg

SEQ ID NO: 3155401 - RNA, 12 nt, Mycobacterium bovis subsp bovis AF2122/97
gcacagcccggc

SEQ ID NO: 3155402 - RNA, 18 nt, Mycobacterium bovis subsp bovis AF2122/97
gcacagcccggcgacgac

SEQ ID NO: 3155403 - RNA, 21 nt, Mycobacterium bovis subsp bovis AF2122/97
gcacagccgcuuggcgcggcc

SEQ ID NO: 3155404 - RNA, 14 nt, Mycobacterium bovis subsp bovis AF2122/97
gcacagcgcagccu

SEQ ID NO: 3155405 - RNA, 21 nt, Mycobacterium bovis subsp bovis AF2122/97
gcacagcgcaggguucgucgg

SEQ ID NO: 3155406 - RNA, 16 nt, Mycobacterium bovis subsp bovis AF2122/97
gcacagcggcaucgcg

SEQ ID NO: 3155407 - RNA, 21 nt, Mycobacterium bovis subsp bovis AF2122/97
gcacagcggcaucgcgggcgg

SEQ ID NO: 3155408 - RNA, 16 nt, Mycobacterium bovis subsp bovis AF2122/97
gcacaggaucacccac

SEQ ID NO: 3155409 - RNA, 14 nt, Mycobacterium bovis subsp bovis AF2122/97
gcacaggauuuucu

SEQ ID NO: 3155410 - RNA, 20 nt, Mycobacterium bovis subsp bovis AF2122/97
gcacaggcaucguccgccgg

SEQ ID NO: 3155411 - RNA, 23 nt, Mycobacterium bovis subsp bovis AF2122/97
gcacaggcaucguccgccgggcu

SEQ ID NO: 3155412 - RNA, 15 nt, Mycobacterium bovis subsp bovis AF2122/97
gcacaggcgacggcc

SEQ ID NO: 3155413 - RNA, 15 nt, Mycobacterium bovis subsp bovis AF2122/97
gcacaggcgcgaucg

SEQ ID NO: 3155414 - RNA, 19 nt, Mycobacterium bovis subsp bovis AF2122/97
gcacaggcggccagcaucg

SEQ ID NO: 3155415 - RNA, 17 nt, Mycobacterium bovis subsp bovis AF2122/97
gcacaggcuggcgaugg

SEQ ID NO: 3155416 - RNA, 19 nt, Mycobacterium bovis subsp bovis AF2122/97
gcacaggcuggcgauggcc

SEQ ID NO: 3155417 - RNA, 15 nt, Mycobacterium bovis subsp bovis AF2122/97
gcacagguccggguu

SEQ ID NO: 3155418 - RNA, 22 nt, Mycobacterium bovis subsp bovis AF2122/97
gcacagguccggguuggccacc

SEQ ID NO: 3155419 - RNA, 20 nt, Mycobacterium bovis subsp bovis AF2122/97
gcacaggugccaaacgccgc

SEQ ID NO: 3155420 - RNA, 21 nt, Mycobacterium bovis subsp bovis AF2122/97
gcacaggugccaaacgccgcc

SEQ ID NO: 3155421 - RNA, 13 nt, Mycobacterium bovis subsp bovis AF2122/97
gcacaguccgcga

SEQ ID NO: 3155422 - RNA, 13 nt, Mycobacterium bovis subsp bovis AF2122/97
gcacauaggcgau

SEQ ID NO: 3155423 - RNA, 15 nt, Mycobacterium bovis subsp bovis AF2122/97
gcacauaggcgaucg

SEQ ID NO: 3155424 - RNA, 17 nt, Mycobacterium bovis subsp bovis AF2122/97
gcacauaggcgaucgca

SEQ ID NO: 3155425 - RNA, 19 nt, Mycobacterium bovis subsp bovis AF2122/97
gcacauaugugcccggcgc

SEQ ID NO: 3155426 - RNA, 20 nt, Mycobacterium bovis subsp bovis AF2122/97
gcacauaugugcccggcgcg

SEQ ID NO: 3155427 - RNA, 13 nt, Mycobacterium bovis subsp bovis AF2122/97
gcacaucggcgag

SEQ ID NO: 3155428 - RNA, 19 nt, Mycobacterium bovis subsp bovis AF2122/97
gcacaucugcgggacgucg

SEQ ID NO: 3155429 - RNA, 20 nt, Mycobacterium bovis subsp bovis AF2122/97
gcacaugcucgacgcccgcc

SEQ ID NO: 3155430 - RNA, 22 nt, Mycobacterium bovis subsp bovis AF2122/97
gcacaugcucgacgcccgccac

SEQ ID NO: 3155431 - RNA, 16 nt, Mycobacterium bovis subsp bovis AF2122/97
gcacaugcucggccug

SEQ ID NO: 3155432 - RNA, 23 nt, Mycobacterium bovis subsp bovis AF2122/97
gcaccagccccuggaggggcaac

SEQ ID NO: 3155433 - RNA, 12 nt, Mycobacterium bovis subsp bovis AF2122/97
gcaccagccggu

SEQ ID NO: 3155434 - RNA, 14 nt, Mycobacterium bovis subsp bovis AF2122/97
gcaccagccgguga

SEQ ID NO: 3155435 - RNA, 16 nt, Mycobacterium bovis subsp bovis AF2122/97
gcaccagccggugagc

SEQ ID NO: 3155436 - RNA, 23 nt, Mycobacterium bovis subsp bovis AF2122/97
gcaccagccggugagcgagcgcg

SEQ ID NO: 3155437 - RNA, 14 nt, Mycobacterium bovis subsp bovis AF2122/97
gcaccagcgaaucc

SEQ ID NO: 3155438 - RNA, 14 nt, Mycobacterium bovis subsp bovis AF2122/97
gcaccagcgaccag

SEQ ID NO: 3155439 - RNA, 14 nt, Mycobacterium bovis subsp bovis AF2122/97
gcaccagcgcgcgc

SEQ ID NO: 3155440 - RNA, 19 nt, Mycobacterium bovis subsp bovis AF2122/97
gcaccagcgcgcgccgagc

SEQ ID NO: 3155441 - RNA, 12 nt, Mycobacterium bovis subsp bovis AF2122/97
gcaccagcggca

SEQ ID NO: 3155442 - RNA, 20 nt, Mycobacterium bovis subsp bovis AF2122/97
gcaccagcggcaccgcggcc

SEQ ID NO: 3155443 - RNA, 13 nt, Mycobacterium bovis subsp bovis AF2122/97
gcaccagcggcug

SEQ ID NO: 3155444 - RNA, 16 nt, Mycobacterium bovis subsp bovis AF2122/97
gcaccagcggcugacc

SEQ ID NO: 3155445 - RNA, 18 nt, Mycobacterium bovis subsp bovis AF2122/97
gcaccagcggcugaccgg

SEQ ID NO: 3155446 - RNA, 12 nt, Mycobacterium bovis subsp bovis AF2122/97
gcaccagcgggu

SEQ ID NO: 3155447 - RNA, 20 nt, Mycobacterium bovis subsp bovis AF2122/97
gcaccagcgucgcggccacg

SEQ ID NO: 3155448 - RNA, 19 nt, Mycobacterium bovis subsp bovis AF2122/97
gcaccagcucacccggagc

SEQ ID NO: 3155449 - RNA, 23 nt, Mycobacterium bovis subsp bovis AF2122/97
gcaccagcucacccggagcaccc

SEQ ID NO: 3155450 - RNA, 13 nt, Mycobacterium bovis subsp bovis AF2122/97
gcaccagcucggu

SEQ ID NO: 3155451 - RNA, 22 nt, Mycobacterium bovis subsp bovis AF2122/97
gcaccagcucggugaucaccau

SEQ ID NO: 3155452 - RNA, 19 nt, Mycobacterium bovis subsp bovis AF2122/97
gcaccagcugucgggcagc

SEQ ID NO: 3155453 - RNA, 20 nt, Mycobacterium bovis subsp bovis AF2122/97
gcaccagcugucgggcagcu

SEQ ID NO: 3155454 - RNA, 17 nt, Mycobacterium bovis subsp bovis AF2122/97
gcaccaggcggccguaa

SEQ ID NO: 3155455 - RNA, 14 nt, Mycobacterium bovis subsp bovis AF2122/97
gcaccagggccucg

SEQ ID NO: 3155456 - RNA, 15 nt, Mycobacterium bovis subsp bovis AF2122/97
gcaccagggccucga

SEQ ID NO: 3155457 - RNA, 18 nt, Mycobacterium bovis subsp bovis AF2122/97
gcaccagggcgcaacgga

SEQ ID NO: 3155458 - RNA, 20 nt, Mycobacterium bovis subsp bovis AF2122/97
gcaccaggggcgcgucaugg

SEQ ID NO: 3155459 - RNA, 20 nt, Mycobacterium bovis subsp bovis AF2122/97
gcaccaggguggcccgggga

SEQ ID NO: 3155460 - RNA, 22 nt, Mycobacterium bovis subsp bovis AF2122/97
gcaccaggguggcccggggacg

SEQ ID NO: 3155461 - RNA, 17 nt, Mycobacterium bovis subsp bovis AF2122/97
gcaccagguugcaaccu

SEQ ID NO: 3155462 - RNA, 22 nt, Mycobacterium bovis subsp bovis AF2122/97
gcaccaguuugugccgccgcgg

SEQ ID NO: 3155463 - RNA, 23 nt, Mycobacterium bovis subsp bovis AF2122/97
gcaccaguuugugccgccgcggc

SEQ ID NO: 3155464 - RNA, 14 nt, Mycobacterium bovis subsp bovis AF2122/97
gcaccauacucacc

SEQ ID NO: 3155465 - RNA, 17 nt, Mycobacterium bovis subsp bovis AF2122/97
gcaccauacucaccgac

SEQ ID NO: 3155466 - RNA, 19 nt, Mycobacterium bovis subsp bovis AF2122/97
gcaccauacucaccgacgc

SEQ ID NO: 3155467 - RNA, 21 nt, Mycobacterium bovis subsp bovis AF2122/97
gcaccauccggucccgccgug

SEQ ID NO: 3155468 - RNA, 14 nt, Mycobacterium bovis subsp bovis AF2122/97
gcaccaucgcggcc

SEQ ID NO: 3155469 - RNA, 21 nt, Mycobacterium bovis subsp bovis AF2122/97
gcaccaugggucuggcaggcc

SEQ ID NO: 3155470 - RNA, 18 nt, Mycobacterium bovis subsp bovis AF2122/97
gcaccauucgcaccggcc

SEQ ID NO: 3155471 - RNA, 18 nt, Mycobacterium bovis subsp bovis AF2122/97
gcaccauuguuccguccc

SEQ ID NO: 3155472 - RNA, 19 nt, Mycobacterium bovis subsp bovis AF2122/97
gcaccauuguuccgucccc

SEQ ID NO: 3155473 - RNA, 20 nt, Mycobacterium bovis subsp bovis AF2122/97
gcaccauuguuccguccccg

SEQ ID NO: 3155474 - RNA, 21 nt, Mycobacterium bovis subsp bovis AF2122/97
gcaccauuguuccguccccga

SEQ ID NO: 3155475 - RNA, 15 nt, Mycobacterium bovis subsp bovis AF2122/97
gcacccaaccaggcc

SEQ ID NO: 3155476 - RNA, 18 nt, Mycobacterium bovis subsp bovis AF2122/97
gcacccaaccaggccgcg

SEQ ID NO: 3155477 - RNA, 19 nt, Mycobacterium bovis subsp bovis AF2122/97
gcacccaaccaggccgcga

SEQ ID NO: 3155478 - RNA, 13 nt, Mycobacterium bovis subsp bovis AF2122/97
gcacccaacccgg

SEQ ID NO: 3155479 - RNA, 12 nt, Mycobacterium bovis subsp bovis AF2122/97
gcacccaacucc

SEQ ID NO: 3155480 - RNA, 15 nt, Mycobacterium bovis subsp bovis AF2122/97
gcacccaacuccauc

SEQ ID NO: 3155481 - RNA, 16 nt, Mycobacterium bovis subsp bovis AF2122/97
gcacccaacuccauca

SEQ ID NO: 3155482 - RNA, 21 nt, Mycobacterium bovis subsp bovis AF2122/97
gcacccaacuccaucagcgcg

SEQ ID NO: 3155483 - RNA, 14 nt, Mycobacterium bovis subsp bovis AF2122/97
gcacccaaugccac

SEQ ID NO: 3155484 - RNA, 18 nt, Mycobacterium bovis subsp bovis AF2122/97
gcacccaaugccaccgcg

SEQ ID NO: 3155485 - RNA, 21 nt, Mycobacterium bovis subsp bovis AF2122/97
gcacccaaugccaccgcggcc

SEQ ID NO: 3155486 - RNA, 22 nt, Mycobacterium bovis subsp bovis AF2122/97
gcacccaaugccaccgcggccg

SEQ ID NO: 3155487 - RNA, 23 nt, Mycobacterium bovis subsp bovis AF2122/97
gcacccacaucagccgcaccagu

SEQ ID NO: 3155488 - RNA, 14 nt, Mycobacterium bovis subsp bovis AF2122/97
gcacccaccccgaa

SEQ ID NO: 3155489 - RNA, 21 nt, Mycobacterium bovis subsp bovis AF2122/97
gcacccacccguucggcugcg

SEQ ID NO: 3155490 - RNA, 14 nt, Mycobacterium bovis subsp bovis AF2122/97
gcacccacgccggu

SEQ ID NO: 3155491 - RNA, 22 nt, Mycobacterium bovis subsp bovis AF2122/97
gcacccacuuuucgguggcggc

SEQ ID NO: 3155492 - RNA, 14 nt, Mycobacterium bovis subsp bovis AF2122/97
gcacccagaccgcc

SEQ ID NO: 3155493 - RNA, 17 nt, Mycobacterium bovis subsp bovis AF2122/97
gcacccagacgauggcc

SEQ ID NO: 3155494 - RNA, 21 nt, Mycobacterium bovis subsp bovis AF2122/97
gcacccagggcguuggcggcu

SEQ ID NO: 3155495 - RNA, 20 nt, Mycobacterium bovis subsp bovis AF2122/97
gcacccaggugucgcugcug

SEQ ID NO: 3155496 - RNA, 22 nt, Mycobacterium bovis subsp bovis AF2122/97
gcacccaggugucgcugcugaa

SEQ ID NO: 3155497 - RNA, 18 nt, Mycobacterium bovis subsp bovis AF2122/97
gcacccagucggcgccgc

SEQ ID NO: 3155498 - RNA, 23 nt, Mycobacterium bovis subsp bovis AF2122/97
gcacccauacggcaauacccgcc

SEQ ID NO: 3155499 - RNA, 22 nt, Mycobacterium bovis subsp bovis AF2122/97
gcacccaucccguucagcgacc

SEQ ID NO: 3155500 - RNA, 23 nt, Mycobacterium bovis subsp bovis AF2122/97
gcacccaucccguucagcgacca

SEQ ID NO: 3155501 - RNA, 13 nt, Mycobacterium bovis subsp bovis AF2122/97
gcaccccacggcc

SEQ ID NO: 3155502 - RNA, 18 nt, Mycobacterium bovis subsp bovis AF2122/97
gcaccccauacucggcgg

SEQ ID NO: 3155503 - RNA, 17 nt, Mycobacterium bovis subsp bovis AF2122/97
gcaccccauggccaccg

SEQ ID NO: 3155504 - RNA, 18 nt, Mycobacterium bovis subsp bovis AF2122/97
gcaccccauggccaccga

SEQ ID NO: 3155505 - RNA, 19 nt, Mycobacterium bovis subsp bovis AF2122/97
gcaccccauggccaccgaa

SEQ ID NO: 3155506 - RNA, 21 nt, Mycobacterium bovis subsp bovis AF2122/97
gcaccccauggccaccgaacg

SEQ ID NO: 3155507 - RNA, 17 nt, Mycobacterium bovis subsp bovis AF2122/97
gcacccccgucgaucag

SEQ ID NO: 3155508 - RNA, 19 nt, Mycobacterium bovis subsp bovis AF2122/97
gcacccccgucgaucagcg

SEQ ID NO: 3155509 - RNA, 14 nt, Mycobacterium bovis subsp bovis AF2122/97
gcacccccgucgcc

SEQ ID NO: 3155510 - RNA, 16 nt, Mycobacterium bovis subsp bovis AF2122/97
gcacccccgucgccac

SEQ ID NO: 3155511 - RNA, 17 nt, Mycobacterium bovis subsp bovis AF2122/97
gcacccccgucgccacc

SEQ ID NO: 3155512 - RNA, 18 nt, Mycobacterium bovis subsp bovis AF2122/97
gcacccccgucgccaccg

SEQ ID NO: 3155513 - RNA, 19 nt, Mycobacterium bovis subsp bovis AF2122/97
gcacccccgucgccaccga

SEQ ID NO: 3155514 - RNA, 17 nt, Mycobacterium bovis subsp bovis AF2122/97
gcacccccucggcuucg

SEQ ID NO: 3155515 - RNA, 13 nt, Mycobacterium bovis subsp bovis AF2122/97
gcaccccgaccac

SEQ ID NO: 3155516 - RNA, 13 nt, Mycobacterium bovis subsp bovis AF2122/97
gcaccccgccggg

SEQ ID NO: 3155517 - RNA, 17 nt, Mycobacterium bovis subsp bovis AF2122/97
gcaccccgccgggggca

SEQ ID NO: 3155518 - RNA, 22 nt, Mycobacterium bovis subsp bovis AF2122/97
gcaccgacagcaguuucaccuu

SEQ ID NO: 3155519 - RNA, 21 nt, Mycobacterium bovis subsp bovis AF2122/97
gcaccgacagcccgaacgagg

SEQ ID NO: 3155520 - RNA, 18 nt, Mycobacterium bovis subsp bovis AF2122/97
gcaccgacaucgucaucc

SEQ ID NO: 3155521 - RNA, 19 nt, Mycobacterium bovis subsp bovis AF2122/97
gcaccgacaucgucaucca

SEQ ID NO: 3155522 - RNA, 15 nt, Mycobacterium bovis subsp bovis AF2122/97
gcaccgaccagggcc

SEQ ID NO: 3155523 - RNA, 20 nt, Mycobacterium bovis subsp bovis AF2122/97
gcaccgaccagggccgccgc

SEQ ID NO: 3155524 - RNA, 13 nt, Mycobacterium bovis subsp bovis AF2122/97
gcaccgaccgcac

SEQ ID NO: 3155525 - RNA, 19 nt, Mycobacterium bovis subsp bovis AF2122/97
gcaccgaccgcaccgugcc

SEQ ID NO: 3155526 - RNA, 14 nt, Mycobacterium bovis subsp bovis AF2122/97
gcaccgacggcgca

SEQ ID NO: 3155527 - RNA, 20 nt, Mycobacterium bovis subsp bovis AF2122/97
gcaccgacgugauggugacu

SEQ ID NO: 3155528 - RNA, 15 nt, Mycobacterium bovis subsp bovis AF2122/97
gcaccgacugcuguc

SEQ ID NO: 3155529 - RNA, 19 nt, Mycobacterium bovis subsp bovis AF2122/97
gcaccgacugcugucaccg

SEQ ID NO: 3155530 - RNA, 21 nt, Mycobacterium bovis subsp bovis AF2122/97
gcaccgacugcugucaccgca

SEQ ID NO: 3155531 - RNA, 21 nt, Mycobacterium bovis subsp bovis AF2122/97
gcaccgacuucagcaacgcau

SEQ ID NO: 3155532 - RNA, 22 nt, Mycobacterium bovis subsp bovis AF2122/97
gcaccgagcaucucgucgucga

SEQ ID NO: 3155533 - RNA, 11 nt, Mycobacterium bovis subsp bovis AF2122/97
gcaccgagcga

SEQ ID NO: 3155534 - RNA, 16 nt, Mycobacterium bovis subsp bovis AF2122/97
gcaccgagcugagcgg

SEQ ID NO: 3155535 - RNA, 20 nt, Mycobacterium bovis subsp bovis AF2122/97
gcaccgagcugagcggccag

SEQ ID NO: 3155536 - RNA, 20 nt, Mycobacterium bovis subsp bovis AF2122/97
gcaccgaggccaaguugcag

SEQ ID NO: 3155537 - RNA, 14 nt, Mycobacterium bovis subsp bovis AF2122/97
gcaccgaggccgcc

SEQ ID NO: 3155538 - RNA, 16 nt, Mycobacterium bovis subsp bovis AF2122/97
gcaccgaggccgccga

SEQ ID NO: 3155539 - RNA, 18 nt, Mycobacterium bovis subsp bovis AF2122/97
gcaccgaggccgccgaga

SEQ ID NO: 3155540 - RNA, 19 nt, Mycobacterium bovis subsp bovis AF2122/97
gcaccgaggccgccgagau

SEQ ID NO: 3155541 - RNA, 20 nt, Mycobacterium bovis subsp bovis AF2122/97
gcaccgaggccgccgagaug

SEQ ID NO: 3155542 - RNA, 15 nt, Mycobacterium bovis subsp bovis AF2122/97
gcaccgauccuggac

SEQ ID NO: 3155543 - RNA, 16 nt, Mycobacterium bovis subsp bovis AF2122/97
gcaccgaucggugccg

SEQ ID NO: 3155544 - RNA, 18 nt, Mycobacterium bovis subsp bovis AF2122/97
gcaccgaugccgaagccc

SEQ ID NO: 3155545 - RNA, 20 nt, Mycobacterium bovis subsp bovis AF2122/97
gcaccgaugccgaagccccc

SEQ ID NO: 3155546 - RNA, 12 nt, Mycobacterium bovis subsp bovis AF2122/97
gcaccgaugccu

SEQ ID NO: 3155547 - RNA, 20 nt, Mycobacterium bovis subsp bovis AF2122/97
gcaccgaugcugacgaugcg

SEQ ID NO: 3155548 - RNA, 16 nt, Mycobacterium bovis subsp bovis AF2122/97
gcaccgauggcgcacc

SEQ ID NO: 3155549 - RNA, 18 nt, Mycobacterium bovis subsp bovis AF2122/97
gcaccgauggcgcaccgg

SEQ ID NO: 3155550 - RNA, 21 nt, Mycobacterium bovis subsp bovis AF2122/97
gcaccgauggcgcaccggcgu

SEQ ID NO: 3155551 - RNA, 22 nt, Mycobacterium bovis subsp bovis AF2122/97
gcaccgauggcgcaccggcguc

SEQ ID NO: 3155552 - RNA, 23 nt, Mycobacterium bovis subsp bovis AF2122/97
gcaccgauggcgcaccggcgucg

SEQ ID NO: 3155553 - RNA, 19 nt, Mycobacterium bovis subsp bovis AF2122/97
gcaccgauuccuugaugcc

SEQ ID NO: 3155554 - RNA, 18 nt, Mycobacterium bovis subsp bovis AF2122/97
gcaccgauuuuggcaagc

SEQ ID NO: 3155555 - RNA, 21 nt, Mycobacterium bovis subsp bovis AF2122/97
gcaccgcagcgaccaccguca

SEQ ID NO: 3155556 - RNA, 15 nt, Mycobacterium bovis subsp bovis AF2122/97
gcaccgcagcggaac

SEQ ID NO: 3155557 - RNA, 22 nt, Mycobacterium bovis subsp bovis AF2122/97
gcaccgcauuguugaagaaagc

SEQ ID NO: 3155558 - RNA, 16 nt, Mycobacterium bovis subsp bovis AF2122/97
gcaccgccagccacca

SEQ ID NO: 3155559 - RNA, 18 nt, Mycobacterium bovis subsp bovis AF2122/97
gcaccgccagccaccaca

SEQ ID NO: 3155560 - RNA, 12 nt, Mycobacterium bovis subsp bovis AF2122/97
gcaccgccaggu

SEQ ID NO: 3155561 - RNA, 15 nt, Mycobacterium bovis subsp bovis AF2122/97
gcaccgcccccgucg

SEQ ID NO: 3155562 - RNA, 18 nt, Mycobacterium bovis subsp bovis AF2122/97
gcaccgcccccgucggcc

SEQ ID NO: 3155563 - RNA, 18 nt, Mycobacterium bovis subsp bovis AF2122/97
gcaccgccccgccguuga

SEQ ID NO: 3155564 - RNA, 12 nt, Mycobacterium bovis subsp bovis AF2122/97
gcaccgcccgcc

SEQ ID NO: 3155565 - RNA, 17 nt, Mycobacterium bovis subsp bovis AF2122/97
gcaccgcccgccgaacg

SEQ ID NO: 3155566 - RNA, 15 nt, Mycobacterium bovis subsp bovis AF2122/97
gcaccgccgagcaga

SEQ ID NO: 3155567 - RNA, 18 nt, Mycobacterium bovis subsp bovis AF2122/97
gcaccgccgagcagacgc

SEQ ID NO: 3155568 - RNA, 20 nt, Mycobacterium bovis subsp bovis AF2122/97
gcaccgccgauguggucggc

SEQ ID NO: 3155569 - RNA, 13 nt, Mycobacterium bovis subsp bovis AF2122/97
gcaccgccgcccc

SEQ ID NO: 3155570 - RNA, 21 nt, Mycobacterium bovis subsp bovis AF2122/97
gcaccgccgcccccgccggcc

SEQ ID NO: 3155571 - RNA, 14 nt, Mycobacterium bovis subsp bovis AF2122/97
gcaccgccgccgcc

SEQ ID NO: 3155572 - RNA, 15 nt, Mycobacterium bovis subsp bovis AF2122/97
gcaccgccgccgccc

SEQ ID NO: 3155573 - RNA, 16 nt, Mycobacterium bovis subsp bovis AF2122/97
gcaccgccgcgccggc

SEQ ID NO: 3155574 - RNA, 17 nt, Mycobacterium bovis subsp bovis AF2122/97
gcaccgccgcgccggcg

SEQ ID NO: 3155575 - RNA, 18 nt, Mycobacterium bovis subsp bovis AF2122/97
gcaccgccgcgccggcgg

SEQ ID NO: 3155576 - RNA, 13 nt, Mycobacterium bovis subsp bovis AF2122/97
gcaccgccgcgcg

SEQ ID NO: 3155577 - RNA, 11 nt, Mycobacterium bovis subsp bovis AF2122/97
gcaccgccggc

SEQ ID NO: 3155578 - RNA, 19 nt, Mycobacterium bovis subsp bovis AF2122/97
gcaccgccggcaccgccgg

SEQ ID NO: 3155579 - RNA, 14 nt, Mycobacterium bovis subsp bovis AF2122/97
gcaccgccggcgcc

SEQ ID NO: 3155580 - RNA, 17 nt, Mycobacterium bovis subsp bovis AF2122/97
gcaccgccggcgccacc

SEQ ID NO: 3155581 - RNA, 15 nt, Mycobacterium bovis subsp bovis AF2122/97
gcaccgccggcgccc

SEQ ID NO: 3155582 - RNA, 17 nt, Mycobacterium bovis subsp bovis AF2122/97
gcaccgccggcgcccag

SEQ ID NO: 3155583 - RNA, 23 nt, Mycobacterium bovis subsp bovis AF2122/97
gcaccgccggcgcccaggccgau

SEQ ID NO: 3155584 - RNA, 17 nt, Mycobacterium bovis subsp bovis AF2122/97
gcaccgccggcuccgcc

SEQ ID NO: 3155585 - RNA, 12 nt, Mycobacterium bovis subsp bovis AF2122/97
gcaccgccggug

SEQ ID NO: 3155586 - RNA, 13 nt, Mycobacterium bovis subsp bovis AF2122/97
gcaccgccggugc

SEQ ID NO: 3155587 - RNA, 16 nt, Mycobacterium bovis subsp bovis AF2122/97
gcaccgccgguggcgc

SEQ ID NO: 3155588 - RNA, 21 nt, Mycobacterium bovis subsp bovis AF2122/97
gcaccgccgguggcgccgggg

SEQ ID NO: 3155589 - RNA, 13 nt, Mycobacterium bovis subsp bovis AF2122/97
gcaccgccugcgc

SEQ ID NO: 3155590 - RNA, 15 nt, Mycobacterium bovis subsp bovis AF2122/97
gcaccgccugcgccg

SEQ ID NO: 3155591 - RNA, 16 nt, Mycobacterium bovis subsp bovis AF2122/97
gcaccgccugcgccgc

SEQ ID NO: 3155592 - RNA, 18 nt, Mycobacterium bovis subsp bovis AF2122/97
gcaccgccugcgccgccc

SEQ ID NO: 3155593 - RNA, 21 nt, Mycobacterium bovis subsp bovis AF2122/97
gcaccgccugcgccgcccgcg

SEQ ID NO: 3155594 - RNA, 18 nt, Mycobacterium bovis subsp bovis AF2122/97
gcaccgccugcucggcga

SEQ ID NO: 3155595 - RNA, 20 nt, Mycobacterium bovis subsp bovis AF2122/97
gcaccgccugcucggcgacc

SEQ ID NO: 3155596 - RNA, 19 nt, Mycobacterium bovis subsp bovis AF2122/97
gcaccgcgaaagaacaucu

SEQ ID NO: 3155597 - RNA, 18 nt, Mycobacterium bovis subsp bovis AF2122/97
gcaccgcgaacauggugc

SEQ ID NO: 3155598 - RNA, 18 nt, Mycobacterium bovis subsp bovis AF2122/97
gcaccgcgaccaucgcga

SEQ ID NO: 3155599 - RNA, 16 nt, Mycobacterium bovis subsp bovis AF2122/97
gcaccgcgaccgcgca

SEQ ID NO: 3155600 - RNA, 19 nt, Mycobacterium bovis subsp bovis AF2122/97
gcaccgcgaccgcgcacgg

SEQ ID NO: 3155601 - RNA, 15 nt, Mycobacterium bovis subsp bovis AF2122/97
gcaccgcgacgacga

SEQ ID NO: 3155602 - RNA, 18 nt, Mycobacterium bovis subsp bovis AF2122/97
gcaccgcgacgacgaggu

SEQ ID NO: 3155603 - RNA, 21 nt, Mycobacterium bovis subsp bovis AF2122/97
gcaccgcgcccaccagcggcg

SEQ ID NO: 3155604 - RNA, 15 nt, Mycobacterium bovis subsp bovis AF2122/97
gcaccgcgccgaaca

SEQ ID NO: 3155605 - RNA, 19 nt, Mycobacterium bovis subsp bovis AF2122/97
gcaccgugcggggggcagc

SEQ ID NO: 3155606 - RNA, 21 nt, Mycobacterium bovis subsp bovis AF2122/97
gcaccgugcggggggcagcuc

SEQ ID NO: 3155607 - RNA, 17 nt, Mycobacterium bovis subsp bovis AF2122/97
gcaccguggcggaucgc

SEQ ID NO: 3155608 - RNA, 14 nt, Mycobacterium bovis subsp bovis AF2122/97
gcaccgugucgacg

SEQ ID NO: 3155609 - RNA, 16 nt, Mycobacterium bovis subsp bovis AF2122/97
gcaccgugugggcccc

SEQ ID NO: 3155610 - RNA, 22 nt, Mycobacterium bovis subsp bovis AF2122/97
gcaccgugugggccccgccgau

SEQ ID NO: 3155611 - RNA, 19 nt, Mycobacterium bovis subsp bovis AF2122/97
gcaccguuaccgccgucgc

SEQ ID NO: 3155612 - RNA, 20 nt, Mycobacterium bovis subsp bovis AF2122/97
gcaccguuaccgccgucgcc

SEQ ID NO: 3155613 - RNA, 21 nt, Mycobacterium bovis subsp bovis AF2122/97
gcaccguuaccgccgucgcca

SEQ ID NO: 3155614 - RNA, 23 nt, Mycobacterium bovis subsp bovis AF2122/97
gcaccguuguaugcugcgcgccg

SEQ ID NO: 3155615 - RNA, 16 nt, Mycobacterium bovis subsp bovis AF2122/97
gcaccguuuccggcgc

SEQ ID NO: 3155616 - RNA, 13 nt, Mycobacterium bovis subsp bovis AF2122/97
gcaccuacccugc

SEQ ID NO: 3155617 - RNA, 16 nt, Mycobacterium bovis subsp bovis AF2122/97
gcaccuagucgcggcc

SEQ ID NO: 3155618 - RNA, 17 nt, Mycobacterium bovis subsp bovis AF2122/97
gcaccuauggucaaccg

SEQ ID NO: 3155619 - RNA, 18 nt, Mycobacterium bovis subsp bovis AF2122/97
gcaccuccaccgcgccgg

SEQ ID NO: 3155620 - RNA, 19 nt, Mycobacterium bovis subsp bovis AF2122/97
gcaccuccaccgcgccggc

SEQ ID NO: 3155621 - RNA, 21 nt, Mycobacterium bovis subsp bovis AF2122/97
gcaccuccaccgcgccggcgg

SEQ ID NO: 3155622 - RNA, 23 nt, Mycobacterium bovis subsp bovis AF2122/97
gcaccuccacugggucgcugccg

SEQ ID NO: 3155623 - RNA, 15 nt, Mycobacterium bovis subsp bovis AF2122/97
gcaccuccagcacca

SEQ ID NO: 3155624 - RNA, 20 nt, Mycobacterium bovis subsp bovis AF2122/97
gcaccuccagcaccaccgga

SEQ ID NO: 3155625 - RNA, 14 nt, Mycobacterium bovis subsp bovis AF2122/97
gcaccuccgacggc

SEQ ID NO: 3155626 - RNA, 22 nt, Mycobacterium bovis subsp bovis AF2122/97
gcaccuccugcgagugcggcac

SEQ ID NO: 3155627 - RNA, 13 nt, Mycobacterium bovis subsp bovis AF2122/97
gcaccucgaccgc

SEQ ID NO: 3155628 - RNA, 17 nt, Mycobacterium bovis subsp bovis AF2122/97
gcaccucgaccgccaac

SEQ ID NO: 3155629 - RNA, 22 nt, Mycobacterium bovis subsp bovis AF2122/97
gcaccucgaugaugcgcucggc

SEQ ID NO: 3155630 - RNA, 14 nt, Mycobacterium bovis subsp bovis AF2122/97
gcaccucgcccugc

SEQ ID NO: 3155631 - RNA, 14 nt, Mycobacterium bovis subsp bovis AF2122/97
gcaccucggccucg

SEQ ID NO: 3155632 - RNA, 14 nt, Mycobacterium bovis subsp bovis AF2122/97
gcaccucggccuug

SEQ ID NO: 3155633 - RNA, 19 nt, Mycobacterium bovis subsp bovis AF2122/97
gcaccucggucccguugcc

SEQ ID NO: 3155634 - RNA, 18 nt, Mycobacterium bovis subsp bovis AF2122/97
gcaccucgguggcugcca

SEQ ID NO: 3155635 - RNA, 23 nt, Mycobacterium bovis subsp bovis AF2122/97
gcaccucgucccagcgguagccg

SEQ ID NO: 3155636 - RNA, 17 nt, Mycobacterium bovis subsp bovis AF2122/97
gcaccugaaggcggcga

SEQ ID NO: 3155637 - RNA, 14 nt, Mycobacterium bovis subsp bovis AF2122/97
gcaccugagccuca

SEQ ID NO: 3155638 - RNA, 16 nt, Mycobacterium bovis subsp bovis AF2122/97
gcaccugccgaucggg

SEQ ID NO: 3155639 - RNA, 16 nt, Mycobacterium bovis subsp bovis AF2122/97
gcaccugccguuccgg

SEQ ID NO: 3155640 - RNA, 23 nt, Mycobacterium bovis subsp bovis AF2122/97
gcaccugcgaugaugugcgacca

SEQ ID NO: 3155641 - RNA, 17 nt, Mycobacterium bovis subsp bovis AF2122/97
gcaccugcgcgcggccg

SEQ ID NO: 3155642 - RNA, 19 nt, Mycobacterium bovis subsp bovis AF2122/97
gcaccugcgcgcggccgcg

SEQ ID NO: 3155643 - RNA, 20 nt, Mycobacterium bovis subsp bovis AF2122/97
gcaccugcgcgcggccgcgc

SEQ ID NO: 3155644 - RNA, 17 nt, Mycobacterium bovis subsp bovis AF2122/97
gcaccuggauccaccag

SEQ ID NO: 3155645 - RNA, 14 nt, Mycobacterium bovis subsp bovis AF2122/97
gcaccuggccgccc

SEQ ID NO: 3155646 - RNA, 22 nt, Mycobacterium bovis subsp bovis AF2122/97
gcaccuggccgcccgcuccaac

SEQ ID NO: 3155647 - RNA, 20 nt, Mycobacterium bovis subsp bovis AF2122/97
gcaccuggcgcagcaacucg

SEQ ID NO: 3155648 - RNA, 12 nt, Mycobacterium bovis subsp bovis AF2122/97
gcaccugggcgc

SEQ ID NO: 3155649 - RNA, 15 nt, Mycobacterium bovis subsp bovis AF2122/97
gcaccugggcggcgc

SEQ ID NO: 3155650 - RNA, 18 nt, Mycobacterium bovis subsp bovis AF2122/97
gcaccugggcugccggcc

SEQ ID NO: 3155651 - RNA, 20 nt, Mycobacterium bovis subsp bovis AF2122/97
gcaccugggcugccggccag

SEQ ID NO: 3155652 - RNA, 17 nt, Mycobacterium bovis subsp bovis AF2122/97
gcaccugggucgacgag

SEQ ID NO: 3155653 - RNA, 21 nt, Mycobacterium bovis subsp bovis AF2122/97
gcaccuggucggccgcaaggc

SEQ ID NO: 3155654 - RNA, 21 nt, Mycobacterium bovis subsp bovis AF2122/97
gcaccugguuccagaggcccg

SEQ ID NO: 3155655 - RNA, 14 nt, Mycobacterium bovis subsp bovis AF2122/97
gcaccuucuccacc

SEQ ID NO: 3155656 - RNA, 17 nt, Mycobacterium bovis subsp bovis AF2122/97
gcaccuugaccgucgcg

SEQ ID NO: 3155657 - RNA, 19 nt, Mycobacterium bovis subsp bovis AF2122/97
gcaccuugcgauugcgcac

SEQ ID NO: 3155658 - RNA, 12 nt, Mycobacterium bovis subsp bovis AF2122/97
gcaccuuggccg

SEQ ID NO: 3155659 - RNA, 21 nt, Mycobacterium bovis subsp bovis AF2122/97
gcaccuuggccggccccgccc

SEQ ID NO: 3155660 - RNA, 15 nt, Mycobacterium bovis subsp bovis AF2122/97
gcacgaaaaccgguu

SEQ ID NO: 3155661 - RNA, 15 nt, Mycobacterium bovis subsp bovis AF2122/97
gcacgaaaccgcagc

SEQ ID NO: 3155662 - RNA, 20 nt, Mycobacterium bovis subsp bovis AF2122/97
gcacgaaagucaaucgcguc

SEQ ID NO: 3155663 - RNA, 16 nt, Mycobacterium bovis subsp bovis AF2122/97
gcacgaaaucagcccg

SEQ ID NO: 3155664 - RNA, 18 nt, Mycobacterium bovis subsp bovis AF2122/97
gcacgaaaucagcccgcc

SEQ ID NO: 3155665 - RNA, 21 nt, Mycobacterium bovis subsp bovis AF2122/97
gcacgaacaucagaucgccga

SEQ ID NO: 3155666 - RNA, 22 nt, Mycobacterium bovis subsp bovis AF2122/97
gcacgaacaucagaucgccgac

SEQ ID NO: 3155667 - RNA, 17 nt, Mycobacterium bovis subsp bovis AF2122/97
gcacgaacgaguccaac

SEQ ID NO: 3155668 - RNA, 13 nt, Mycobacterium bovis subsp bovis AF2122/97
gcacgaacgccug

SEQ ID NO: 3155669 - RNA, 20 nt, Mycobacterium bovis subsp bovis AF2122/97
gcacgaagcuggcgugcagc

SEQ ID NO: 3155670 - RNA, 15 nt, Mycobacterium bovis subsp bovis AF2122/97
gcacgaaucccccgg

SEQ ID NO: 3155671 - RNA, 14 nt, Mycobacterium bovis subsp bovis AF2122/97
gcacgacaccucga

SEQ ID NO: 3155672 - RNA, 17 nt, Mycobacterium bovis subsp bovis AF2122/97
gcacgacaccucgaagg

SEQ ID NO: 3155673 - RNA, 18 nt, Mycobacterium bovis subsp bovis AF2122/97
gcacgacaccucgaaggc

SEQ ID NO: 3155674 - RNA, 21 nt, Mycobacterium bovis subsp bovis AF2122/97
gcacgacaccucgaaggcacu

SEQ ID NO: 3155675 - RNA, 19 nt, Mycobacterium bovis subsp bovis AF2122/97
gcacgacaucgucgcgacg

SEQ ID NO: 3155676 - RNA, 20 nt, Mycobacterium bovis subsp bovis AF2122/97
gcacgacaucgucgcgacga

SEQ ID NO: 3155677 - RNA, 21 nt, Mycobacterium bovis subsp bovis AF2122/97
gcacgacaucgucgcgacgac

SEQ ID NO: 3155678 - RNA, 23 nt, Mycobacterium bovis subsp bovis AF2122/97
gcacgacaucgucgcgacgacgu

SEQ ID NO: 3155679 - RNA, 14 nt, Mycobacterium bovis subsp bovis AF2122/97
gcacgaccaccgga

SEQ ID NO: 3155680 - RNA, 15 nt, Mycobacterium bovis subsp bovis AF2122/97
gcacgaccaccggau

SEQ ID NO: 3155681 - RNA, 23 nt, Mycobacterium bovis subsp bovis AF2122/97
gcacgaccagcugagcuggcagc

SEQ ID NO: 3155682 - RNA, 16 nt, Mycobacterium bovis subsp bovis AF2122/97
gcacgacccgcugguc

SEQ ID NO: 3155683 - RNA, 17 nt, Mycobacterium bovis subsp bovis AF2122/97
gcacgacccgggaagga

SEQ ID NO: 3155684 - RNA, 20 nt, Mycobacterium bovis subsp bovis AF2122/97
gcacgacccgggaaggaacc

SEQ ID NO: 3155685 - RNA, 20 nt, Mycobacterium bovis subsp bovis AF2122/97
gcacgaccgcucccgguguu

SEQ ID NO: 3155686 - RNA, 13 nt, Mycobacterium bovis subsp bovis AF2122/97
gcacgaccugguu

SEQ ID NO: 3155687 - RNA, 23 nt, Mycobacterium bovis subsp bovis AF2122/97
gcacgaccugguuauucgacucg

SEQ ID NO: 3155688 - RNA, 15 nt, Mycobacterium bovis subsp bovis AF2122/97
gcacgacgacaucga

SEQ ID NO: 3155689 - RNA, 16 nt, Mycobacterium bovis subsp bovis AF2122/97
gcacgacgcgacacgc

SEQ ID NO: 3155690 - RNA, 18 nt, Mycobacterium bovis subsp bovis AF2122/97
gcacgacgcgacacgccg

SEQ ID NO: 3155691 - RNA, 13 nt, Mycobacterium bovis subsp bovis AF2122/97
gcacgcucgcccu

SEQ ID NO: 3155692 - RNA, 19 nt, Mycobacterium bovis subsp bovis AF2122/97
gcacgcucgcgcacccugc

SEQ ID NO: 3155693 - RNA, 11 nt, Mycobacterium bovis subsp bovis AF2122/97
gcacgcucggc

SEQ ID NO: 3155694 - RNA, 14 nt, Mycobacterium bovis subsp bovis AF2122/97
gcacgcucggcgcc

SEQ ID NO: 3155695 - RNA, 13 nt, Mycobacterium bovis subsp bovis AF2122/97
gcacgcucggcgg

SEQ ID NO: 3155696 - RNA, 19 nt, Mycobacterium bovis subsp bovis AF2122/97
gcacgcucggcggggaccg

SEQ ID NO: 3155697 - RNA, 13 nt, Mycobacterium bovis subsp bovis AF2122/97
gcacgcucggcgu

SEQ ID NO: 3155698 - RNA, 21 nt, Mycobacterium bovis subsp bovis AF2122/97
gcacgcucgugacgaucagcg

SEQ ID NO: 3155699 - RNA, 14 nt, Mycobacterium bovis subsp bovis AF2122/97
gcacgcucguuugg

SEQ ID NO: 3155700 - RNA, 16 nt, Mycobacterium bovis subsp bovis AF2122/97
gcacgcucugcgccac

SEQ ID NO: 3155701 - RNA, 21 nt, Mycobacterium bovis subsp bovis AF2122/97
gcacgcugaccacaaccguga

SEQ ID NO: 3155702 - RNA, 22 nt, Mycobacterium bovis subsp bovis AF2122/97
gcacgcugaccggaucugacgg

SEQ ID NO: 3155703 - RNA, 16 nt, Mycobacterium bovis subsp bovis AF2122/97
gcacgcugagucccca

SEQ ID NO: 3155704 - RNA, 15 nt, Mycobacterium bovis subsp bovis AF2122/97
gcacgcugcucgacg

SEQ ID NO: 3155705 - RNA, 16 nt, Mycobacterium bovis subsp bovis AF2122/97
gcacgcugcucgacgg

SEQ ID NO: 3155706 - RNA, 22 nt, Mycobacterium bovis subsp bovis AF2122/97
gcacgcuggaacuuggcgucga

SEQ ID NO: 3155707 - RNA, 21 nt, Mycobacterium bovis subsp bovis AF2122/97
gcacgcuggcguuguugacga

SEQ ID NO: 3155708 - RNA, 23 nt, Mycobacterium bovis subsp bovis AF2122/97
gcacgcuggcguuguugacgauc

SEQ ID NO: 3155709 - RNA, 14 nt, Mycobacterium bovis subsp bovis AF2122/97
gcacgcugucgauc

SEQ ID NO: 3155710 - RNA, 17 nt, Mycobacterium bovis subsp bovis AF2122/97
gcacggaaggcccggcg

SEQ ID NO: 3155711 - RNA, 18 nt, Mycobacterium bovis subsp bovis AF2122/97
gcacggaaggcccggcgc

SEQ ID NO: 3155712 - RNA, 19 nt, Mycobacterium bovis subsp bovis AF2122/97
gcacggaaggcccggcgcg

SEQ ID NO: 3155713 - RNA, 15 nt, Mycobacterium bovis subsp bovis AF2122/97
gcacggaaggucgac

SEQ ID NO: 3155714 - RNA, 18 nt, Mycobacterium bovis subsp bovis AF2122/97
gcacggaaguacuccacc

SEQ ID NO: 3155715 - RNA, 15 nt, Mycobacterium bovis subsp bovis AF2122/97
gcacggaaucgcauc

SEQ ID NO: 3155716 - RNA, 20 nt, Mycobacterium bovis subsp bovis AF2122/97
gcacggacaguuccccgggc

SEQ ID NO: 3155717 - RNA, 16 nt, Mycobacterium bovis subsp bovis AF2122/97
gcacggaccaucgcca

SEQ ID NO: 3155718 - RNA, 20 nt, Mycobacterium bovis subsp bovis AF2122/97
gcacggaccaucgccaggcc

SEQ ID NO: 3155719 - RNA, 16 nt, Mycobacterium bovis subsp bovis AF2122/97
gcacggagccgccggc

SEQ ID NO: 3155720 - RNA, 19 nt, Mycobacterium bovis subsp bovis AF2122/97
gcacggagccgccggcggu

SEQ ID NO: 3155721 - RNA, 17 nt, Mycobacterium bovis subsp bovis AF2122/97
gcacggaugaugccggu

SEQ ID NO: 3155722 - RNA, 18 nt, Mycobacterium bovis subsp bovis AF2122/97
gcacggaugcgauggccg

SEQ ID NO: 3155723 - RNA, 21 nt, Mycobacterium bovis subsp bovis AF2122/97
gcacggaugcgauggccgacg

SEQ ID NO: 3155724 - RNA, 13 nt, Mycobacterium bovis subsp bovis AF2122/97
gcacggaugucgc

SEQ ID NO: 3155725 - RNA, 16 nt, Mycobacterium bovis subsp bovis AF2122/97
gcacggaugucgccca

SEQ ID NO: 3155726 - RNA, 14 nt, Mycobacterium bovis subsp bovis AF2122/97
gcacggauuuucgc

SEQ ID NO: 3155727 - RNA, 16 nt, Mycobacterium bovis subsp bovis AF2122/97
gcacggcaaccagcga

SEQ ID NO: 3155728 - RNA, 22 nt, Mycobacterium bovis subsp bovis AF2122/97
gcacggcaaccagcgagcccag

SEQ ID NO: 3155729 - RNA, 13 nt, Mycobacterium bovis subsp bovis AF2122/97
gcacggcacccac

SEQ ID NO: 3155730 - RNA, 18 nt, Mycobacterium bovis subsp bovis AF2122/97
gcacggccaccgcgcaac

SEQ ID NO: 3155731 - RNA, 21 nt, Mycobacterium bovis subsp bovis AF2122/97
gcacggccaugaucacaccgc

SEQ ID NO: 3155732 - RNA, 22 nt, Mycobacterium bovis subsp bovis AF2122/97
gcacggccaugaucacaccgcu

SEQ ID NO: 3155733 - RNA, 18 nt, Mycobacterium bovis subsp bovis AF2122/97
gcacggccccugccacga

SEQ ID NO: 3155734 - RNA, 21 nt, Mycobacterium bovis subsp bovis AF2122/97
gcacggccccugccacgacga

SEQ ID NO: 3155735 - RNA, 13 nt, Mycobacterium bovis subsp bovis AF2122/97
gcacggccgagca

SEQ ID NO: 3155736 - RNA, 13 nt, Mycobacterium bovis subsp bovis AF2122/97
gcacggccgggac

SEQ ID NO: 3155737 - RNA, 14 nt, Mycobacterium bovis subsp bovis AF2122/97
gcacggccgggacg

SEQ ID NO: 3155738 - RNA, 17 nt, Mycobacterium bovis subsp bovis AF2122/97
gcacggccgggacggcg

SEQ ID NO: 3155739 - RNA, 13 nt, Mycobacterium bovis subsp bovis AF2122/97
gcacggccggguc

SEQ ID NO: 3155740 - RNA, 16 nt, Mycobacterium bovis subsp bovis AF2122/97
gcacggccgucgacga

SEQ ID NO: 3155741 - RNA, 17 nt, Mycobacterium bovis subsp bovis AF2122/97
gcacggccuccggaccg

SEQ ID NO: 3155742 - RNA, 20 nt, Mycobacterium bovis subsp bovis AF2122/97
gcacggcgaaugcauuggcg

SEQ ID NO: 3155743 - RNA, 16 nt, Mycobacterium bovis subsp bovis AF2122/97
gcacggcgaucgguga

SEQ ID NO: 3155744 - RNA, 19 nt, Mycobacterium bovis subsp bovis AF2122/97
gcacggcgauugcccgugc

SEQ ID NO: 3155745 - RNA, 13 nt, Mycobacterium bovis subsp bovis AF2122/97
gcacggcgccgcc

SEQ ID NO: 3155746 - RNA, 15 nt, Mycobacterium bovis subsp bovis AF2122/97
gcacggcgccgccac

SEQ ID NO: 3155747 - RNA, 13 nt, Mycobacterium bovis subsp bovis AF2122/97
gcacggcgcgcca

SEQ ID NO: 3155748 - RNA, 13 nt, Mycobacterium bovis subsp bovis AF2122/97
gcacggcgcggcg

SEQ ID NO: 3155749 - RNA, 14 nt, Mycobacterium bovis subsp bovis AF2122/97
gcacggcgcggcgg

SEQ ID NO: 3155750 - RNA, 15 nt, Mycobacterium bovis subsp bovis AF2122/97
gcacggcggccacgu

SEQ ID NO: 3155751 - RNA, 21 nt, Mycobacterium bovis subsp bovis AF2122/97
gcacggcggccagggugcccu

SEQ ID NO: 3155752 - RNA, 14 nt, Mycobacterium bovis subsp bovis AF2122/97
gcacggcggcccac

SEQ ID NO: 3155753 - RNA, 13 nt, Mycobacterium bovis subsp bovis AF2122/97
gcacggcggugug

SEQ ID NO: 3155754 - RNA, 15 nt, Mycobacterium bovis subsp bovis AF2122/97
gcacggcgucggcca

SEQ ID NO: 3155755 - RNA, 17 nt, Mycobacterium bovis subsp bovis AF2122/97
gcacggcgucggccacc

SEQ ID NO: 3155756 - RNA, 18 nt, Mycobacterium bovis subsp bovis AF2122/97
gcacggcgucggccaccg

SEQ ID NO: 3155757 - RNA, 15 nt, Mycobacterium bovis subsp bovis AF2122/97
gcacggcgugucgag

SEQ ID NO: 3155758 - RNA, 20 nt, Mycobacterium bovis subsp bovis AF2122/97
gcacggcgugucgagggcuu

SEQ ID NO: 3155759 - RNA, 16 nt, Mycobacterium bovis subsp bovis AF2122/97
gcacggcuucgaccau

SEQ ID NO: 3155760 - RNA, 13 nt, Mycobacterium bovis subsp bovis AF2122/97
gcacggcuucggc

SEQ ID NO: 3155761 - RNA, 15 nt, Mycobacterium bovis subsp bovis AF2122/97
gcacggcuucggcga

SEQ ID NO: 3155762 - RNA, 16 nt, Mycobacterium bovis subsp bovis AF2122/97
gcacggcuucggcgag

SEQ ID NO: 3155763 - RNA, 18 nt, Mycobacterium bovis subsp bovis AF2122/97
gcacggcuucggcgagcg

SEQ ID NO: 3155764 - RNA, 20 nt, Mycobacterium bovis subsp bovis AF2122/97
gcacggcuucggcgagcgca

SEQ ID NO: 3155765 - RNA, 17 nt, Mycobacterium bovis subsp bovis AF2122/97
gcacggcuuuucgacgc

SEQ ID NO: 3155766 - RNA, 20 nt, Mycobacterium bovis subsp bovis AF2122/97
gcacggcuuuucgacgcugu

SEQ ID NO: 3155767 - RNA, 23 nt, Mycobacterium bovis subsp bovis AF2122/97
gcacgggaucgaucugcggaggc

SEQ ID NO: 3155768 - RNA, 18 nt, Mycobacterium bovis subsp bovis AF2122/97
gcacgggcacgaucgucg

SEQ ID NO: 3155769 - RNA, 22 nt, Mycobacterium bovis subsp bovis AF2122/97
gcacgggcagauacgccaaccg

SEQ ID NO: 3155770 - RNA, 13 nt, Mycobacterium bovis subsp bovis AF2122/97
gcacgggccacca

SEQ ID NO: 3155771 - RNA, 15 nt, Mycobacterium bovis subsp bovis AF2122/97
gcacgggcggccaug

SEQ ID NO: 3155772 - RNA, 18 nt, Mycobacterium bovis subsp bovis AF2122/97
gcacgggcggccauggca

SEQ ID NO: 3155773 - RNA, 19 nt, Mycobacterium bovis subsp bovis AF2122/97
gcacgggcucgcugcacca

SEQ ID NO: 3155774 - RNA, 19 nt, Mycobacterium bovis subsp bovis AF2122/97
gcacggggaccuuggcgac

SEQ ID NO: 3155775 - RNA, 16 nt, Mycobacterium bovis subsp bovis AF2122/97
gcacggguagcgucca

SEQ ID NO: 3155776 - RNA, 19 nt, Mycobacterium bovis subsp bovis AF2122/97
gcacggguagcguccaggu

SEQ ID NO: 3155777 - RNA, 20 nt, Mycobacterium bovis subsp bovis AF2122/97
gcacgggucgucaugccagu

SEQ ID NO: 3155778 - RNA, 19 nt, Mycobacterium bovis subsp bovis AF2122/97
gcacguugugaucgucagu

SEQ ID NO: 3155779 - RNA, 16 nt, Mycobacterium bovis subsp bovis AF2122/97
gcacguuuacauagac

SEQ ID NO: 3155780 - RNA, 23 nt, Mycobacterium bovis subsp bovis AF2122/97
gcacuaccccacaagcgauggca

SEQ ID NO: 3155781 - RNA, 21 nt, Mycobacterium bovis subsp bovis AF2122/97
gcacuagcccgaccgguccag

SEQ ID NO: 3155782 - RNA, 18 nt, Mycobacterium bovis subsp bovis AF2122/97
gcacuagcgagccggcgc

SEQ ID NO: 3155783 - RNA, 23 nt, Mycobacterium bovis subsp bovis AF2122/97
gcacuagcgagccggcgccgggu

SEQ ID NO: 3155784 - RNA, 18 nt, Mycobacterium bovis subsp bovis AF2122/97
gcacucagcaggggaucg

SEQ ID NO: 3155785 - RNA, 13 nt, Mycobacterium bovis subsp bovis AF2122/97
gcacucaucgccg

SEQ ID NO: 3155786 - RNA, 18 nt, Mycobacterium bovis subsp bovis AF2122/97
gcacucaucgccggaccg

SEQ ID NO: 3155787 - RNA, 17 nt, Mycobacterium bovis subsp bovis AF2122/97
gcacucaugaugccgga

SEQ ID NO: 3155788 - RNA, 19 nt, Mycobacterium bovis subsp bovis AF2122/97
gcacuccaagucacagcuc

SEQ ID NO: 3155789 - RNA, 16 nt, Mycobacterium bovis subsp bovis AF2122/97
gcacuccagcggcggg

SEQ ID NO: 3155790 - RNA, 20 nt, Mycobacterium bovis subsp bovis AF2122/97
gcacucccggcucggccagc

SEQ ID NO: 3155791 - RNA, 18 nt, Mycobacterium bovis subsp bovis AF2122/97
gcacuccggagcccacac

SEQ ID NO: 3155792 - RNA, 22 nt, Mycobacterium bovis subsp bovis AF2122/97
gcacucgaagaugucgucaccg

SEQ ID NO: 3155793 - RNA, 12 nt, Mycobacterium bovis subsp bovis AF2122/97
gcacucgaccag

SEQ ID NO: 3155794 - RNA, 19 nt, Mycobacterium bovis subsp bovis AF2122/97
gcacucgaccaggaccggc

SEQ ID NO: 3155795 - RNA, 15 nt, Mycobacterium bovis subsp bovis AF2122/97
gcacucgacgccaau

SEQ ID NO: 3155796 - RNA, 13 nt, Mycobacterium bovis subsp bovis AF2122/97
gcacucggccacg

SEQ ID NO: 3155797 - RNA, 18 nt, Mycobacterium bovis subsp bovis AF2122/97
gcacucggccacgacgac

SEQ ID NO: 3155798 - RNA, 16 nt, Mycobacterium bovis subsp bovis AF2122/97
gcacucggcccggccc

SEQ ID NO: 3155799 - RNA, 14 nt, Mycobacterium bovis subsp bovis AF2122/97
gcacucggcgcccu

SEQ ID NO: 3155800 - RNA, 17 nt, Mycobacterium bovis subsp bovis AF2122/97
gcacucggcgguuccgg

SEQ ID NO: 3155801 - RNA, 19 nt, Mycobacterium bovis subsp bovis AF2122/97
gcacucgggauucggcagc

SEQ ID NO: 3155802 - RNA, 22 nt, Mycobacterium bovis subsp bovis AF2122/97
gcacucgggauucggcagcggc

SEQ ID NO: 3155803 - RNA, 16 nt, Mycobacterium bovis subsp bovis AF2122/97
gcacugaccgcggcug

SEQ ID NO: 3155804 - RNA, 22 nt, Mycobacterium bovis subsp bovis AF2122/97
gcacugaucugcguugcggcaa

SEQ ID NO: 3155805 - RNA, 20 nt, Mycobacterium bovis subsp bovis AF2122/97
gcacugaugucacccgcccg

SEQ ID NO: 3155806 - RNA, 21 nt, Mycobacterium bovis subsp bovis AF2122/97
gcacugaugucacccgcccga

SEQ ID NO: 3155807 - RNA, 18 nt, Mycobacterium bovis subsp bovis AF2122/97
gcacugcccagcagacca

SEQ ID NO: 3155808 - RNA, 16 nt, Mycobacterium bovis subsp bovis AF2122/97
gcacugccccgcaucg

SEQ ID NO: 3155809 - RNA, 16 nt, Mycobacterium bovis subsp bovis AF2122/97
gcacugcccggggugc

SEQ ID NO: 3155810 - RNA, 15 nt, Mycobacterium bovis subsp bovis AF2122/97
gcacugccgagcacg

SEQ ID NO: 3155811 - RNA, 14 nt, Mycobacterium bovis subsp bovis AF2122/97
gcacugccggcacg

SEQ ID NO: 3155812 - RNA, 14 nt, Mycobacterium bovis subsp bovis AF2122/97
gcacugccgggugg

SEQ ID NO: 3155813 - RNA, 19 nt, Mycobacterium bovis subsp bovis AF2122/97
gcacugcgaacccugcgca

SEQ ID NO: 3155814 - RNA, 20 nt, Mycobacterium bovis subsp bovis AF2122/97
gcacugcgaacccugcgcac

SEQ ID NO: 3155815 - RNA, 14 nt, Mycobacterium bovis subsp bovis AF2122/97
gcacugcgaucgcg

SEQ ID NO: 3155816 - RNA, 18 nt, Mycobacterium bovis subsp bovis AF2122/97
gcacugcgaucgcgaccc

SEQ ID NO: 3155817 - RNA, 16 nt, Mycobacterium bovis subsp bovis AF2122/97
gcacugcgccggccgg

SEQ ID NO: 3155818 - RNA, 17 nt, Mycobacterium bovis subsp bovis AF2122/97
gcacugcgccggccggc

SEQ ID NO: 3155819 - RNA, 18 nt, Mycobacterium bovis subsp bovis AF2122/97
gcacugcgccggccggcg

SEQ ID NO: 3155820 - RNA, 20 nt, Mycobacterium bovis subsp bovis AF2122/97
gcacugcgccggccggcgca

SEQ ID NO: 3155821 - RNA, 20 nt, Mycobacterium bovis subsp bovis AF2122/97
gcacugcgcgugcucgacgc

SEQ ID NO: 3155822 - RNA, 15 nt, Mycobacterium bovis subsp bovis AF2122/97
gcacugcggcagcga

SEQ ID NO: 3155823 - RNA, 16 nt, Mycobacterium bovis subsp bovis AF2122/97
gcacugcggcagcgaa

SEQ ID NO: 3155824 - RNA, 13 nt, Mycobacterium bovis subsp bovis AF2122/97
gcacugcggccag

SEQ ID NO: 3155825 - RNA, 12 nt, Mycobacterium bovis subsp bovis AF2122/97
gcacuggccccg

SEQ ID NO: 3155826 - RNA, 13 nt, Mycobacterium bovis subsp bovis AF2122/97
gcacuggccccgg

SEQ ID NO: 3155827 - RNA, 22 nt, Mycobacterium bovis subsp bovis AF2122/97
gcacugggaugaguucgucgug

SEQ ID NO: 3155828 - RNA, 23 nt, Mycobacterium bovis subsp bovis AF2122/97
gcacugggaugaguucgucgugg

SEQ ID NO: 3155829 - RNA, 22 nt, Mycobacterium bovis subsp bovis AF2122/97
gcacuggguccacgcgcucggu

SEQ ID NO: 3155830 - RNA, 22 nt, Mycobacterium bovis subsp bovis AF2122/97
gcacuggugcccgacccgccga

SEQ ID NO: 3155831 - RNA, 21 nt, Mycobacterium bovis subsp bovis AF2122/97
gcacugguugggcgagaccgc

SEQ ID NO: 3155832 - RNA, 22 nt, Mycobacterium bovis subsp bovis AF2122/97
gcacugucgagguggucgaccc

SEQ ID NO: 3155833 - RNA, 20 nt, Mycobacterium bovis subsp bovis AF2122/97
gcacugugaggucauuggcg

SEQ ID NO: 3155834 - RNA, 18 nt, Mycobacterium bovis subsp bovis AF2122/97
gcacugugcguccgcaac

SEQ ID NO: 3155835 - RNA, 16 nt, Mycobacterium bovis subsp bovis AF2122/97
gcacuguggaagaacc

SEQ ID NO: 3155836 - RNA, 20 nt, Mycobacterium bovis subsp bovis AF2122/97
gcacuguugcccaauucgac

SEQ ID NO: 3155837 - RNA, 15 nt, Mycobacterium bovis subsp bovis AF2122/97
gcacuuaccgagccg

SEQ ID NO: 3155838 - RNA, 18 nt, Mycobacterium bovis subsp bovis AF2122/97
gcacuuagcccgauggug

SEQ ID NO: 3155839 - RNA, 15 nt, Mycobacterium bovis subsp bovis AF2122/97
gcacuucggcgaagu

SEQ ID NO: 3155840 - RNA, 23 nt, Mycobacterium bovis subsp bovis AF2122/97
gcacuucggcgaaguugcgcgac

SEQ ID NO: 3155841 - RNA, 23 nt, Mycobacterium bovis subsp bovis AF2122/97
gcacuucguuuuccagccgacgu

SEQ ID NO: 3155842 - RNA, 19 nt, Mycobacterium bovis subsp bovis AF2122/97
gcacuugaaauugagccgg

SEQ ID NO: 3155843 - RNA, 17 nt, Mycobacterium bovis subsp bovis AF2122/97
gcacuugauguucgacg

SEQ ID NO: 3155844 - RNA, 23 nt, Mycobacterium bovis subsp bovis AF2122/97
gcacuugauguucgacgggccgg

SEQ ID NO: 3155845 - RNA, 19 nt, Mycobacterium bovis subsp bovis AF2122/97
gcacuugcccgucggcgcc

SEQ ID NO: 3155846 - RNA, 18 nt, Mycobacterium bovis subsp bovis AF2122/97
gcacuuggacccggccgg

SEQ ID NO: 3155847 - RNA, 22 nt, Mycobacterium bovis subsp bovis AF2122/97
gcacuuggacccggccggcccg

SEQ ID NO: 3155848 - RNA, 18 nt, Mycobacterium bovis subsp bovis AF2122/97
gcacuuggcccccgacgg

SEQ ID NO: 3155849 - RNA, 22 nt, Mycobacterium bovis subsp bovis AF2122/97
gcacuugggaaggauggucgaa

SEQ ID NO: 3155850 - RNA, 19 nt, Mycobacterium bovis subsp bovis AF2122/97
gcacuuucuuccucggggc

SEQ ID NO: 3155851 - RNA, 20 nt, Mycobacterium bovis subsp bovis AF2122/97
gcacuuuugcgugguggacg

SEQ ID NO: 3155852 - RNA, 18 nt, Mycobacterium bovis subsp bovis AF2122/97
gcagaaaacccucgcugc

SEQ ID NO: 3155853 - RNA, 20 nt, Mycobacterium bovis subsp bovis AF2122/97
gcagaaacaacgucgccgcg

SEQ ID NO: 3155854 - RNA, 22 nt, Mycobacterium bovis subsp bovis AF2122/97
gcagaaacaacgucgccgcggc

SEQ ID NO: 3155855 - RNA, 17 nt, Mycobacterium bovis subsp bovis AF2122/97
gcagaaacagccgcagc

SEQ ID NO: 3155856 - RNA, 16 nt, Mycobacterium bovis subsp bovis AF2122/97
gcagaaaccauucggc

SEQ ID NO: 3155857 - RNA, 19 nt, Mycobacterium bovis subsp bovis AF2122/97
gcagaaaccauucggcgag

SEQ ID NO: 3155858 - RNA, 19 nt, Mycobacterium bovis subsp bovis AF2122/97
gcagaaacgccgagcgcca

SEQ ID NO: 3155859 - RNA, 17 nt, Mycobacterium bovis subsp bovis AF2122/97
gcagaaagucgcgcgcg

SEQ ID NO: 3155860 - RNA, 18 nt, Mycobacterium bovis subsp bovis AF2122/97
gcagaacaguaucgccgg

SEQ ID NO: 3155861 - RNA, 18 nt, Mycobacterium bovis subsp bovis AF2122/97
gcagaacucgcguauccc

SEQ ID NO: 3155862 - RNA, 15 nt, Mycobacterium bovis subsp bovis AF2122/97
gcagaagaguguccc

SEQ ID NO: 3155863 - RNA, 22 nt, Mycobacterium bovis subsp bovis AF2122/97
gcagaagcccccaaaccggcgg

SEQ ID NO: 3155864 - RNA, 20 nt, Mycobacterium bovis subsp bovis AF2122/97
gcagacucgauaugcagcuc

SEQ ID NO: 3155865 - RNA, 12 nt, Mycobacterium bovis subsp bovis AF2122/97
gcagacugccga

SEQ ID NO: 3155866 - RNA, 21 nt, Mycobacterium bovis subsp bovis AF2122/97
gcagagaacuccgccaccauc

SEQ ID NO: 3155867 - RNA, 16 nt, Mycobacterium bovis subsp bovis AF2122/97
gcagagaccaaggucc

SEQ ID NO: 3155868 - RNA, 18 nt, Mycobacterium bovis subsp bovis AF2122/97
gcagagaccaagguccgc

SEQ ID NO: 3155869 - RNA, 17 nt, Mycobacterium bovis subsp bovis AF2122/97
gcagagcaccgcgaaca

SEQ ID NO: 3155870 - RNA, 17 nt, Mycobacterium bovis subsp bovis AF2122/97
gcagagcacgcgcggcg

SEQ ID NO: 3155871 - RNA, 18 nt, Mycobacterium bovis subsp bovis AF2122/97
gcagagcacgcgcggcgu

SEQ ID NO: 3155872 - RNA, 13 nt, Mycobacterium bovis subsp bovis AF2122/97
gcagagccccggc

SEQ ID NO: 3155873 - RNA, 18 nt, Mycobacterium bovis subsp bovis AF2122/97
gcagagccccggcaagcg

SEQ ID NO: 3155874 - RNA, 15 nt, Mycobacterium bovis subsp bovis AF2122/97
gcagagccgccguug

SEQ ID NO: 3155875 - RNA, 21 nt, Mycobacterium bovis subsp bovis AF2122/97
gcagagccgccguugccgccg

SEQ ID NO: 3155876 - RNA, 22 nt, Mycobacterium bovis subsp bovis AF2122/97
gcagagccgccguugccgccgg

SEQ ID NO: 3155877 - RNA, 16 nt, Mycobacterium bovis subsp bovis AF2122/97
gcagagccgucaccga

SEQ ID NO: 3155878 - RNA, 14 nt, Mycobacterium bovis subsp bovis AF2122/97
gcagagcggcacgc

SEQ ID NO: 3155879 - RNA, 16 nt, Mycobacterium bovis subsp bovis AF2122/97
gcagaggcggcuggcg

SEQ ID NO: 3155880 - RNA, 19 nt, Mycobacterium bovis subsp bovis AF2122/97
gcagaguauucagcgguug

SEQ ID NO: 3155881 - RNA, 15 nt, Mycobacterium bovis subsp bovis AF2122/97
gcagaguucccugau

SEQ ID NO: 3155882 - RNA, 22 nt, Mycobacterium bovis subsp bovis AF2122/97
gcagaguucccugaugggcgaa

SEQ ID NO: 3155883 - RNA, 16 nt, Mycobacterium bovis subsp bovis AF2122/97
gcagauacgagcugua

SEQ ID NO: 3155884 - RNA, 18 nt, Mycobacterium bovis subsp bovis AF2122/97
gcagauacgccaaccgcu

SEQ ID NO: 3155885 - RNA, 14 nt, Mycobacterium bovis subsp bovis AF2122/97
gcagauacucggcg

SEQ ID NO: 3155886 - RNA, 18 nt, Mycobacterium bovis subsp bovis AF2122/97
gcagauauuccucgucgg

SEQ ID NO: 3155887 - RNA, 16 nt, Mycobacterium bovis subsp bovis AF2122/97
gcagauauugccugcc

SEQ ID NO: 3155888 - RNA, 21 nt, Mycobacterium bovis subsp bovis AF2122/97
gcagauauugccugccacccg

SEQ ID NO: 3155889 - RNA, 15 nt, Mycobacterium bovis subsp bovis AF2122/97
gcagaucaccgccag

SEQ ID NO: 3155890 - RNA, 14 nt, Mycobacterium bovis subsp bovis AF2122/97
gcagaucagcacgu

SEQ ID NO: 3155891 - RNA, 22 nt, Mycobacterium bovis subsp bovis AF2122/97
gcagaucagcacguugauucgg

SEQ ID NO: 3155892 - RNA, 17 nt, Mycobacterium bovis subsp bovis AF2122/97
gcagaucaggacgcgau

SEQ ID NO: 3155893 - RNA, 20 nt, Mycobacterium bovis subsp bovis AF2122/97
gcagaucaggacgcgaucgg

SEQ ID NO: 3155894 - RNA, 22 nt, Mycobacterium bovis subsp bovis AF2122/97
gcagaucaggguggcgcgguac

SEQ ID NO: 3155895 - RNA, 12 nt, Mycobacterium bovis subsp bovis AF2122/97
gcagauccaggc

SEQ ID NO: 3155896 - RNA, 17 nt, Mycobacterium bovis subsp bovis AF2122/97
gcagauccaggcgucgg

SEQ ID NO: 3155897 - RNA, 21 nt, Mycobacterium bovis subsp bovis AF2122/97
gcagauccaggcgucggugac

SEQ ID NO: 3155898 - RNA, 13 nt, Mycobacterium bovis subsp bovis AF2122/97
gcagaucccacgc

SEQ ID NO: 3155899 - RNA, 18 nt, Mycobacterium bovis subsp bovis AF2122/97
gcagauccccgccaccga

SEQ ID NO: 3155900 - RNA, 19 nt, Mycobacterium bovis subsp bovis AF2122/97
gcagauccccgccaccgaa

SEQ ID NO: 3155901 - RNA, 17 nt, Mycobacterium bovis subsp bovis AF2122/97
gcagauccuggccggug

SEQ ID NO: 3155902 - RNA, 17 nt, Mycobacterium bovis subsp bovis AF2122/97
gcagaucgaaaucagcc

SEQ ID NO: 3155903 - RNA, 14 nt, Mycobacterium bovis subsp bovis AF2122/97
gcagaucgauaccg

SEQ ID NO: 3155904 - RNA, 15 nt, Mycobacterium bovis subsp bovis AF2122/97
gcagaucgauaccgu

SEQ ID NO: 3155905 - RNA, 19 nt, Mycobacterium bovis subsp bovis AF2122/97
gcagaucgccccagccaug

SEQ ID NO: 3155906 - RNA, 14 nt, Mycobacterium bovis subsp bovis AF2122/97
gcagaucgucgccg

SEQ ID NO: 3155907 - RNA, 15 nt, Mycobacterium bovis subsp bovis AF2122/97
gcagaucgucgccga

SEQ ID NO: 3155908 - RNA, 18 nt, Mycobacterium bovis subsp bovis AF2122/97
gcagaucuuccgagcacu

SEQ ID NO: 3155909 - RNA, 20 nt, Mycobacterium bovis subsp bovis AF2122/97
gcagaugaauugccgggcgc

SEQ ID NO: 3155910 - RNA, 21 nt, Mycobacterium bovis subsp bovis AF2122/97
gcagaugaauugccgggcgca

SEQ ID NO: 3155911 - RNA, 14 nt, Mycobacterium bovis subsp bovis AF2122/97
gcagaugagcgcgg

SEQ ID NO: 3155912 - RNA, 16 nt, Mycobacterium bovis subsp bovis AF2122/97
gcagaugagcgcggcg

SEQ ID NO: 3155913 - RNA, 20 nt, Mycobacterium bovis subsp bovis AF2122/97
gcagaugagucaaaauccgc

SEQ ID NO: 3155914 - RNA, 14 nt, Mycobacterium bovis subsp bovis AF2122/97
gcagaugaugccgu

SEQ ID NO: 3155915 - RNA, 15 nt, Mycobacterium bovis subsp bovis AF2122/97
gcagaugaugccguu

SEQ ID NO: 3155916 - RNA, 14 nt, Mycobacterium bovis subsp bovis AF2122/97
gcagaugggcgucg

SEQ ID NO: 3155917 - RNA, 23 nt, Mycobacterium bovis subsp bovis AF2122/97
gcagauggugaacgugccuuccu

SEQ ID NO: 3155918 - RNA, 15 nt, Mycobacterium bovis subsp bovis AF2122/97
gcagauguguccggc

SEQ ID NO: 3155919 - RNA, 17 nt, Mycobacterium bovis subsp bovis AF2122/97
gcagauucuucacccaa

SEQ ID NO: 3155920 - RNA, 17 nt, Mycobacterium bovis subsp bovis AF2122/97
gcagauuggcggcuucg

SEQ ID NO: 3155921 - RNA, 22 nt, Mycobacterium bovis subsp bovis AF2122/97
gcagauugucgacggucaccgg

SEQ ID NO: 3155922 - RNA, 22 nt, Mycobacterium bovis subsp bovis AF2122/97
gcagauuugcuccagcgacgaa

SEQ ID NO: 3155923 - RNA, 20 nt, Mycobacterium bovis subsp bovis AF2122/97
gcagcaaaacccgagccugg

SEQ ID NO: 3155924 - RNA, 12 nt, Mycobacterium bovis subsp bovis AF2122/97
gcagcaacaccu

SEQ ID NO: 3155925 - RNA, 14 nt, Mycobacterium bovis subsp bovis AF2122/97
gcagcaacgacccg

SEQ ID NO: 3155926 - RNA, 18 nt, Mycobacterium bovis subsp bovis AF2122/97
gcagcaacgacgucgucg

SEQ ID NO: 3155927 - RNA, 15 nt, Mycobacterium bovis subsp bovis AF2122/97
gcagcaacgcggugc

SEQ ID NO: 3155928 - RNA, 18 nt, Mycobacterium bovis subsp bovis AF2122/97
gcagcaacgcggugccgg

SEQ ID NO: 3155929 - RNA, 21 nt, Mycobacterium bovis subsp bovis AF2122/97
gcagcaacgcggugccgggau

SEQ ID NO: 3155930 - RNA, 22 nt, Mycobacterium bovis subsp bovis AF2122/97
gcagcaacgcggugccgggauc

SEQ ID NO: 3155931 - RNA, 12 nt, Mycobacterium bovis subsp bovis AF2122/97
gcagcaacggcg

SEQ ID NO: 3155932 - RNA, 20 nt, Mycobacterium bovis subsp bovis AF2122/97
gcagcaacggcggcgucgcg

SEQ ID NO: 3155933 - RNA, 19 nt, Mycobacterium bovis subsp bovis AF2122/97
gcagcaacugggcggccug

SEQ ID NO: 3155934 - RNA, 15 nt, Mycobacterium bovis subsp bovis AF2122/97
gcagcaagaccgcgc

SEQ ID NO: 3155935 - RNA, 13 nt, Mycobacterium bovis subsp bovis AF2122/97
gcagcaagccgcc

SEQ ID NO: 3155936 - RNA, 14 nt, Mycobacterium bovis subsp bovis AF2122/97
gcagcaagccgccg

SEQ ID NO: 3155937 - RNA, 16 nt, Mycobacterium bovis subsp bovis AF2122/97
gcagcaagccgccggu

SEQ ID NO: 3155938 - RNA, 17 nt, Mycobacterium bovis subsp bovis AF2122/97
gcagcaagccgccggug

SEQ ID NO: 3155939 - RNA, 16 nt, Mycobacterium bovis subsp bovis AF2122/97
gcagcaaucagccgcc

SEQ ID NO: 3155940 - RNA, 21 nt, Mycobacterium bovis subsp bovis AF2122/97
gcagcaauccaaggcucagca

SEQ ID NO: 3155941 - RNA, 21 nt, Mycobacterium bovis subsp bovis AF2122/97
gcagcacaggcuggcgauggc

SEQ ID NO: 3155942 - RNA, 22 nt, Mycobacterium bovis subsp bovis AF2122/97
gcagcacauacgauuucgacga

SEQ ID NO: 3155943 - RNA, 17 nt, Mycobacterium bovis subsp bovis AF2122/97
gcagcacauccugcagc

SEQ ID NO: 3155944 - RNA, 21 nt, Mycobacterium bovis subsp bovis AF2122/97
gcagcacauccugcagcucgg

SEQ ID NO: 3155945 - RNA, 23 nt, Mycobacterium bovis subsp bovis AF2122/97
gcagcacauccugcagcucgggc

SEQ ID NO: 3155946 - RNA, 15 nt, Mycobacterium bovis subsp bovis AF2122/97
gcagcaccaaggucu

SEQ ID NO: 3155947 - RNA, 20 nt, Mycobacterium bovis subsp bovis AF2122/97
gcagcaccaggguggcccgg

SEQ ID NO: 3155948 - RNA, 23 nt, Mycobacterium bovis subsp bovis AF2122/97
gcagcacccacaucagccgcacc

SEQ ID NO: 3155949 - RNA, 13 nt, Mycobacterium bovis subsp bovis AF2122/97
gcagcacccccuc

SEQ ID NO: 3155950 - RNA, 16 nt, Mycobacterium bovis subsp bovis AF2122/97
gcagcacccccucggc

SEQ ID NO: 3155951 - RNA, 23 nt, Mycobacterium bovis subsp bovis AF2122/97
gcagcaucuccgucggccaggcc

SEQ ID NO: 3155952 - RNA, 23 nt, Mycobacterium bovis subsp bovis AF2122/97
gcagcaucuggggguagccgccg

SEQ ID NO: 3155953 - RNA, 15 nt, Mycobacterium bovis subsp bovis AF2122/97
gcagcauggccaucg

SEQ ID NO: 3155954 - RNA, 16 nt, Mycobacterium bovis subsp bovis AF2122/97
gcagcauggccaucgg

SEQ ID NO: 3155955 - RNA, 16 nt, Mycobacterium bovis subsp bovis AF2122/97
gcagcauggcccuggc

SEQ ID NO: 3155956 - RNA, 18 nt, Mycobacterium bovis subsp bovis AF2122/97
gcagcauggcccuggcga

SEQ ID NO: 3155957 - RNA, 18 nt, Mycobacterium bovis subsp bovis AF2122/97
gcagcauggugcggcggc

SEQ ID NO: 3155958 - RNA, 22 nt, Mycobacterium bovis subsp bovis AF2122/97
gcagcauguccgcagcggugcg

SEQ ID NO: 3155959 - RNA, 20 nt, Mycobacterium bovis subsp bovis AF2122/97
gcagcaugucguaguagcgg

SEQ ID NO: 3155960 - RNA, 19 nt, Mycobacterium bovis subsp bovis AF2122/97
gcagcauguggccgccguc

SEQ ID NO: 3155961 - RNA, 15 nt, Mycobacterium bovis subsp bovis AF2122/97
gcagccaaugccgga

SEQ ID NO: 3155962 - RNA, 19 nt, Mycobacterium bovis subsp bovis AF2122/97
gcagccacauacaggcccg

SEQ ID NO: 3155963 - RNA, 15 nt, Mycobacterium bovis subsp bovis AF2122/97
gcagccaccagcgac

SEQ ID NO: 3155964 - RNA, 13 nt, Mycobacterium bovis subsp bovis AF2122/97
gcagccacccgac

SEQ ID NO: 3155965 - RNA, 16 nt, Mycobacterium bovis subsp bovis AF2122/97
gcagccaccgucaugc

SEQ ID NO: 3155966 - RNA, 22 nt, Mycobacterium bovis subsp bovis AF2122/97
gcagccaccgucaugccgacga

SEQ ID NO: 3155967 - RNA, 22 nt, Mycobacterium bovis subsp bovis AF2122/97
gcagccacguagacaaggccaa

SEQ ID NO: 3155968 - RNA, 16 nt, Mycobacterium bovis subsp bovis AF2122/97
gcagccacgucucgcg

SEQ ID NO: 3155969 - RNA, 22 nt, Mycobacterium bovis subsp bovis AF2122/97
gcagccagacugcauccagagc

SEQ ID NO: 3155970 - RNA, 23 nt, Mycobacterium bovis subsp bovis AF2122/97
gcagccagauucauuggccuggc

SEQ ID NO: 3155971 - RNA, 12 nt, Mycobacterium bovis subsp bovis AF2122/97
gcagccagcaag

SEQ ID NO: 3155972 - RNA, 15 nt, Mycobacterium bovis subsp bovis AF2122/97
gcagccagccaccga

SEQ ID NO: 3155973 - RNA, 18 nt, Mycobacterium bovis subsp bovis AF2122/97
gcagccagcccagccgcc

SEQ ID NO: 3155974 - RNA, 15 nt, Mycobacterium bovis subsp bovis AF2122/97
gcagccagcgccaug

SEQ ID NO: 3155975 - RNA, 14 nt, Mycobacterium bovis subsp bovis AF2122/97
gcagccagcgucca

SEQ ID NO: 3155976 - RNA, 15 nt, Mycobacterium bovis subsp bovis AF2122/97
gcagccagcugaaca

SEQ ID NO: 3155977 - RNA, 16 nt, Mycobacterium bovis subsp bovis AF2122/97
gcagccaggagccgau

SEQ ID NO: 3155978 - RNA, 16 nt, Mycobacterium bovis subsp bovis AF2122/97
gcagccagggcgccga

SEQ ID NO: 3155979 - RNA, 17 nt, Mycobacterium bovis subsp bovis AF2122/97
gcagccagggcgccgaa

SEQ ID NO: 3155980 - RNA, 22 nt, Mycobacterium bovis subsp bovis AF2122/97
gcagccaggugucgucgaucgc

SEQ ID NO: 3155981 - RNA, 23 nt, Mycobacterium bovis subsp bovis AF2122/97
gcagccaggugucgucgaucgcg

SEQ ID NO: 3155982 - RNA, 16 nt, Mycobacterium bovis subsp bovis AF2122/97
gcagccaugcggcugc

SEQ ID NO: 3155983 - RNA, 19 nt, Mycobacterium bovis subsp bovis AF2122/97
gcagcccaaagcgccagca

SEQ ID NO: 3155984 - RNA, 21 nt, Mycobacterium bovis subsp bovis AF2122/97
gcagcccaaaucccagagcau

SEQ ID NO: 3155985 - RNA, 23 nt, Mycobacterium bovis subsp bovis AF2122/97
gcagccccaaaucguaggggucu

SEQ ID NO: 3155986 - RNA, 15 nt, Mycobacterium bovis subsp bovis AF2122/97
gcagcccccggaucc

SEQ ID NO: 3155987 - RNA, 17 nt, Mycobacterium bovis subsp bovis AF2122/97
gcagccccuccgcgccg

SEQ ID NO: 3155988 - RNA, 18 nt, Mycobacterium bovis subsp bovis AF2122/97
gcagccccuccgcgccga

SEQ ID NO: 3155989 - RNA, 14 nt, Mycobacterium bovis subsp bovis AF2122/97
gcagccccucgucg

SEQ ID NO: 3155990 - RNA, 16 nt, Mycobacterium bovis subsp bovis AF2122/97
gcagcccgccgcugaa

SEQ ID NO: 3155991 - RNA, 15 nt, Mycobacterium bovis subsp bovis AF2122/97
gcagcccgccgggcu

SEQ ID NO: 3155992 - RNA, 13 nt, Mycobacterium bovis subsp bovis AF2122/97
gcagcccggcggc

SEQ ID NO: 3155993 - RNA, 15 nt, Mycobacterium bovis subsp bovis AF2122/97
gcagcccggcggccg

SEQ ID NO: 3155994 - RNA, 14 nt, Mycobacterium bovis subsp bovis AF2122/97
gcagcccgggcagc

SEQ ID NO: 3155995 - RNA, 17 nt, Mycobacterium bovis subsp bovis AF2122/97
gcagcccgggcagcacc

SEQ ID NO: 3155996 - RNA, 13 nt, Mycobacterium bovis subsp bovis AF2122/97
gcagcccggggau

SEQ ID NO: 3155997 - RNA, 23 nt, Mycobacterium bovis subsp bovis AF2122/97
gcagcccgguggugcugucgugg

SEQ ID NO: 3155998 - RNA, 16 nt, Mycobacterium bovis subsp bovis AF2122/97
gcagcccggugugcug

SEQ ID NO: 3155999 - RNA, 13 nt, Mycobacterium bovis subsp bovis AF2122/97
gcagcccgucggc

SEQ ID NO: 3156000 - RNA, 17 nt, Mycobacterium bovis subsp bovis AF2122/97
gcagcccgucggcgccg

SEQ ID NO: 3156001 - RNA, 21 nt, Mycobacterium bovis subsp bovis AF2122/97
gcagcccgucggcgccgaaca

SEQ ID NO: 3156002 - RNA, 15 nt, Mycobacterium bovis subsp bovis AF2122/97
gcagcccgucggugg

SEQ ID NO: 3156003 - RNA, 19 nt, Mycobacterium bovis subsp bovis AF2122/97
gcagcccgugacuggugaa

SEQ ID NO: 3156004 - RNA, 18 nt, Mycobacterium bovis subsp bovis AF2122/97
gcagcccguucgugccgu

SEQ ID NO: 3156005 - RNA, 21 nt, Mycobacterium bovis subsp bovis AF2122/97
gcagcccguucgugccguuga

SEQ ID NO: 3156006 - RNA, 16 nt, Mycobacterium bovis subsp bovis AF2122/97
gcagcccugcgcagcc

SEQ ID NO: 3156007 - RNA, 18 nt, Mycobacterium bovis subsp bovis AF2122/97
gcagcccugcgcagccgc

SEQ ID NO: 3156008 - RNA, 19 nt, Mycobacterium bovis subsp bovis AF2122/97
gcagcccugcgcagccgcc

SEQ ID NO: 3156009 - RNA, 20 nt, Mycobacterium bovis subsp bovis AF2122/97
gcagcccugcgcagccgccu

SEQ ID NO: 3156010 - RNA, 21 nt, Mycobacterium bovis subsp bovis AF2122/97
gcagcccugcgcagccgccuc

SEQ ID NO: 3156011 - RNA, 13 nt, Mycobacterium bovis subsp bovis AF2122/97
gcagccgaaccgg

SEQ ID NO: 3156012 - RNA, 16 nt, Mycobacterium bovis subsp bovis AF2122/97
gcagccgaagcgcccg

SEQ ID NO: 3156013 - RNA, 16 nt, Mycobacterium bovis subsp bovis AF2122/97
gcagccgaaguggcgc

SEQ ID NO: 3156014 - RNA, 21 nt, Mycobacterium bovis subsp bovis AF2122/97
gcagccgaaguggcgccuugg

SEQ ID NO: 3156015 - RNA, 13 nt, Mycobacterium bovis subsp bovis AF2122/97
gcagccgagcuca

SEQ ID NO: 3156016 - RNA, 18 nt, Mycobacterium bovis subsp bovis AF2122/97
gcagccgaucgucucggc

SEQ ID NO: 3156017 - RNA, 22 nt, Mycobacterium bovis subsp bovis AF2122/97
gcagccgaucgucucggccacg

SEQ ID NO: 3156018 - RNA, 21 nt, Mycobacterium bovis subsp bovis AF2122/97
gcagccgaugcucgucccaga

SEQ ID NO: 3156019 - RNA, 19 nt, Mycobacterium bovis subsp bovis AF2122/97
gcagccgaugcugcgggcg

SEQ ID NO: 3156020 - RNA, 15 nt, Mycobacterium bovis subsp bovis AF2122/97
gcagccgaugucgcg

SEQ ID NO: 3156021 - RNA, 16 nt, Mycobacterium bovis subsp bovis AF2122/97
gcagccgaugucgcgc

SEQ ID NO: 3156022 - RNA, 18 nt, Mycobacterium bovis subsp bovis AF2122/97
gcagccgaugucgcgcgc

SEQ ID NO: 3156023 - RNA, 19 nt, Mycobacterium bovis subsp bovis AF2122/97
gcagccgaugucgcgcgcu

SEQ ID NO: 3156024 - RNA, 24 nt, Mycobacterium bovis subsp bovis AF2122/97
gcagccgaugucgcgcgcuaggug

SEQ ID NO: 3156025 - RNA, 16 nt, Mycobacterium bovis subsp bovis AF2122/97
gcagccgcaggccaug

SEQ ID NO: 3156026 - RNA, 19 nt, Mycobacterium bovis subsp bovis AF2122/97
gcagccgcauaggccccgc

SEQ ID NO: 3156027 - RNA, 10 nt, Mycobacterium bovis subsp bovis AF2122/97
gcagccgccc

SEQ ID NO: 3156028 - RNA, 18 nt, Mycobacterium bovis subsp bovis AF2122/97
gcagccgcccgccaggaa

SEQ ID NO: 3156029 - RNA, 19 nt, Mycobacterium bovis subsp bovis AF2122/97
gcagccgcccgcccaccuc

SEQ ID NO: 3156030 - RNA, 20 nt, Mycobacterium bovis subsp bovis AF2122/97
gcagccgcccgcccaccucg

SEQ ID NO: 3156031 - RNA, 21 nt, Mycobacterium bovis subsp bovis AF2122/97
gcagccgcccgcccaccucga

SEQ ID NO: 3156032 - RNA, 15 nt, Mycobacterium bovis subsp bovis AF2122/97
gcagccgccgcgccc

SEQ ID NO: 3156033 - RNA, 11 nt, Mycobacterium bovis subsp bovis AF2122/97
gcagccgccgg

SEQ ID NO: 3156034 - RNA, 14 nt, Mycobacterium bovis subsp bovis AF2122/97
gcagccgccggccg

SEQ ID NO: 3156035 - RNA, 23 nt, Mycobacterium bovis subsp bovis AF2122/97
gcagccgccucaaugaccaccgg

SEQ ID NO: 3156036 - RNA, 20 nt, Mycobacterium bovis subsp bovis AF2122/97
gcagccgcgacacgugcauc

SEQ ID NO: 3156037 - RNA, 22 nt, Mycobacterium bovis subsp bovis AF2122/97
gcagcgcgacccguagcuuggc

SEQ ID NO: 3156038 - RNA, 14 nt, Mycobacterium bovis subsp bovis AF2122/97
gcagcgcgacgguu

SEQ ID NO: 3156039 - RNA, 14 nt, Mycobacterium bovis subsp bovis AF2122/97
gcagcgcgaucacc

SEQ ID NO: 3156040 - RNA, 15 nt, Mycobacterium bovis subsp bovis AF2122/97
gcagcgcgaucaccg

SEQ ID NO: 3156041 - RNA, 13 nt, Mycobacterium bovis subsp bovis AF2122/97
gcagcgcgaucgc

SEQ ID NO: 3156042 - RNA, 18 nt, Mycobacterium bovis subsp bovis AF2122/97
gcagcgcgaucgcgguca

SEQ ID NO: 3156043 - RNA, 14 nt, Mycobacterium bovis subsp bovis AF2122/97
gcagcgcgauggcc

SEQ ID NO: 3156044 - RNA, 21 nt, Mycobacterium bovis subsp bovis AF2122/97
gcagcgcgaugucgccggcga

SEQ ID NO: 3156045 - RNA, 19 nt, Mycobacterium bovis subsp bovis AF2122/97
gcagcgcgcccgacacccg

SEQ ID NO: 3156046 - RNA, 19 nt, Mycobacterium bovis subsp bovis AF2122/97
gcagcgcgccguucgccug

SEQ ID NO: 3156047 - RNA, 15 nt, Mycobacterium bovis subsp bovis AF2122/97
gcagcgcgcggaugg

SEQ ID NO: 3156048 - RNA, 15 nt, Mycobacterium bovis subsp bovis AF2122/97
gcagcgcgcugaggu

SEQ ID NO: 3156049 - RNA, 13 nt, Mycobacterium bovis subsp bovis AF2122/97
gcagcgcggcaaa

SEQ ID NO: 3156050 - RNA, 13 nt, Mycobacterium bovis subsp bovis AF2122/97
gcagcgcggcacc

SEQ ID NO: 3156051 - RNA, 14 nt, Mycobacterium bovis subsp bovis AF2122/97
gcagcgcggccacc

SEQ ID NO: 3156052 - RNA, 16 nt, Mycobacterium bovis subsp bovis AF2122/97
gcagcgcggccacccg

SEQ ID NO: 3156053 - RNA, 22 nt, Mycobacterium bovis subsp bovis AF2122/97
gcagcgcggccacccgcgacga

SEQ ID NO: 3156054 - RNA, 14 nt, Mycobacterium bovis subsp bovis AF2122/97
gcagcgcggccaga

SEQ ID NO: 3156055 - RNA, 22 nt, Mycobacterium bovis subsp bovis AF2122/97
gcagcgcggccagagccgcgcg

SEQ ID NO: 3156056 - RNA, 14 nt, Mycobacterium bovis subsp bovis AF2122/97
gcagcgcggccagu

SEQ ID NO: 3156057 - RNA, 14 nt, Mycobacterium bovis subsp bovis AF2122/97
gcagcgcggccggg

SEQ ID NO: 3156058 - RNA, 14 nt, Mycobacterium bovis subsp bovis AF2122/97
gcagcgcgggaucu

SEQ ID NO: 3156059 - RNA, 21 nt, Mycobacterium bovis subsp bovis AF2122/97
gcagcgcgguggucagcaccg

SEQ ID NO: 3156060 - RNA, 23 nt, Mycobacterium bovis subsp bovis AF2122/97
gcagcgcgguggucagcaccggc

SEQ ID NO: 3156061 - RNA, 13 nt, Mycobacterium bovis subsp bovis AF2122/97
gcagcgcgucgcc

SEQ ID NO: 3156062 - RNA, 14 nt, Mycobacterium bovis subsp bovis AF2122/97
gcagcgcgucgccg

SEQ ID NO: 3156063 - RNA, 16 nt, Mycobacterium bovis subsp bovis AF2122/97
gcagcgcugcgaugga

SEQ ID NO: 3156064 - RNA, 14 nt, Mycobacterium bovis subsp bovis AF2122/97
gcagcgcuggcuac

SEQ ID NO: 3156065 - RNA, 22 nt, Mycobacterium bovis subsp bovis AF2122/97
gcagcgcuggcuacgccuccuu

SEQ ID NO: 3156066 - RNA, 17 nt, Mycobacterium bovis subsp bovis AF2122/97
gcagcgcuucggcgguc

SEQ ID NO: 3156067 - RNA, 18 nt, Mycobacterium bovis subsp bovis AF2122/97
gcagcggaccgcugccug

SEQ ID NO: 3156068 - RNA, 23 nt, Mycobacterium bovis subsp bovis AF2122/97
gcagcggaccgcugccugccgcg

SEQ ID NO: 3156069 - RNA, 15 nt, Mycobacterium bovis subsp bovis AF2122/97
gcagcggcauccagc

SEQ ID NO: 3156070 - RNA, 12 nt, Mycobacterium bovis subsp bovis AF2122/97
gcagcggccagc

SEQ ID NO: 3156071 - RNA, 21 nt, Mycobacterium bovis subsp bovis AF2122/97
gcagcggccagcccagccggg

SEQ ID NO: 3156072 - RNA, 23 nt, Mycobacterium bovis subsp bovis AF2122/97
gcagcggccagcccagccgggag

SEQ ID NO: 3156073 - RNA, 14 nt, Mycobacterium bovis subsp bovis AF2122/97
gcagcggccuccgg

SEQ ID NO: 3156074 - RNA, 20 nt, Mycobacterium bovis subsp bovis AF2122/97
gcagcggccugaccggcucg

SEQ ID NO: 3156075 - RNA, 20 nt, Mycobacterium bovis subsp bovis AF2122/97
gcagcggcgaccgcggucgc

SEQ ID NO: 3156076 - RNA, 22 nt, Mycobacterium bovis subsp bovis AF2122/97
gcagcggcgaccgcggucgcca

SEQ ID NO: 3156077 - RNA, 20 nt, Mycobacterium bovis subsp bovis AF2122/97
gcagcggcgcauaggcggcc

SEQ ID NO: 3156078 - RNA, 14 nt, Mycobacterium bovis subsp bovis AF2122/97
gcagcggcgccgcc

SEQ ID NO: 3156079 - RNA, 13 nt, Mycobacterium bovis subsp bovis AF2122/97
gcagcggcgcgcu

SEQ ID NO: 3156080 - RNA, 16 nt, Mycobacterium bovis subsp bovis AF2122/97
gcagcggcgcgcugca

SEQ ID NO: 3156081 - RNA, 14 nt, Mycobacterium bovis subsp bovis AF2122/97
gcagcggcgcucgg

SEQ ID NO: 3156082 - RNA, 14 nt, Mycobacterium bovis subsp bovis AF2122/97
gcagcggcggaagg

SEQ ID NO: 3156083 - RNA, 21 nt, Mycobacterium bovis subsp bovis AF2122/97
gcagcggcggaaggacggcag

SEQ ID NO: 3156084 - RNA, 23 nt, Mycobacterium bovis subsp bovis AF2122/97
gcagcggcggaaggacggcagcc

SEQ ID NO: 3156085 - RNA, 14 nt, Mycobacterium bovis subsp bovis AF2122/97
gcagcggcggcaac

SEQ ID NO: 3156086 - RNA, 15 nt, Mycobacterium bovis subsp bovis AF2122/97
gcagcggcggcgacg

SEQ ID NO: 3156087 - RNA, 13 nt, Mycobacterium bovis subsp bovis AF2122/97
gcagcggcgguau

SEQ ID NO: 3156088 - RNA, 19 nt, Mycobacterium bovis subsp bovis AF2122/97
gcagcggcgucgucgucga

SEQ ID NO: 3156089 - RNA, 17 nt, Mycobacterium bovis subsp bovis AF2122/97
gcagcggcuaacgaagc

SEQ ID NO: 3156090 - RNA, 17 nt, Mycobacterium bovis subsp bovis AF2122/97
gcagcggcucggcggcg

SEQ ID NO: 3156091 - RNA, 21 nt, Mycobacterium bovis subsp bovis AF2122/97
gcagcggcuugcccaggcgca

SEQ ID NO: 3156092 - RNA, 23 nt, Mycobacterium bovis subsp bovis AF2122/97
gcagcggcuugcccaggcgcaac

SEQ ID NO: 3156093 - RNA, 19 nt, Mycobacterium bovis subsp bovis AF2122/97
gcagcgggacugcggaagc

SEQ ID NO: 3156094 - RNA, 15 nt, Mycobacterium bovis subsp bovis AF2122/97
gcagcgggccgcccu

SEQ ID NO: 3156095 - RNA, 23 nt, Mycobacterium bovis subsp bovis AF2122/97
gcagcgggccgcccuucaucuug

SEQ ID NO: 3156096 - RNA, 23 nt, Mycobacterium bovis subsp bovis AF2122/97
gcagcgggcuccccggauuccuc

SEQ ID NO: 3156097 - RNA, 16 nt, Mycobacterium bovis subsp bovis AF2122/97
gcagcgggcugcgcua

SEQ ID NO: 3156098 - RNA, 18 nt, Mycobacterium bovis subsp bovis AF2122/97
gcagcggguugcggucac

SEQ ID NO: 3156099 - RNA, 19 nt, Mycobacterium bovis subsp bovis AF2122/97
gcagcggguuugccgggcg

SEQ ID NO: 3156100 - RNA, 19 nt, Mycobacterium bovis subsp bovis AF2122/97
gcagcgguccagacaucag

SEQ ID NO: 3156101 - RNA, 16 nt, Mycobacterium bovis subsp bovis AF2122/97
gcagcgguccgccgcc

SEQ ID NO: 3156102 - RNA, 14 nt, Mycobacterium bovis subsp bovis AF2122/97
gcagcggugcagcc

SEQ ID NO: 3156103 - RNA, 19 nt, Mycobacterium bovis subsp bovis AF2122/97
gcagcggugcgcgguugug

SEQ ID NO: 3156104 - RNA, 15 nt, Mycobacterium bovis subsp bovis AF2122/97
gcagcgguggucggc

SEQ ID NO: 3156105 - RNA, 22 nt, Mycobacterium bovis subsp bovis AF2122/97
gcagcgguguagccggcgccgc

SEQ ID NO: 3156106 - RNA, 23 nt, Mycobacterium bovis subsp bovis AF2122/97
gcagcgguugaugcggccgcggc

SEQ ID NO: 3156107 - RNA, 20 nt, Mycobacterium bovis subsp bovis AF2122/97
gcagcgguuuuaggcagccc

SEQ ID NO: 3156108 - RNA, 12 nt, Mycobacterium bovis subsp bovis AF2122/97
gcagcguccagc

SEQ ID NO: 3156109 - RNA, 16 nt, Mycobacterium bovis subsp bovis AF2122/97
gcagcguccgaaccac

SEQ ID NO: 3156110 - RNA, 17 nt, Mycobacterium bovis subsp bovis AF2122/97
gcagcguccgaaccacc

SEQ ID NO: 3156111 - RNA, 13 nt, Mycobacterium bovis subsp bovis AF2122/97
gcagcguccgcgg

SEQ ID NO: 3156112 - RNA, 18 nt, Mycobacterium bovis subsp bovis AF2122/97
gcagcguccgcggaugca

SEQ ID NO: 3156113 - RNA, 22 nt, Mycobacterium bovis subsp bovis AF2122/97
gcagcguccgcggaugcauguc

SEQ ID NO: 3156114 - RNA, 19 nt, Mycobacterium bovis subsp bovis AF2122/97
gcagcgucggugccaccac

SEQ ID NO: 3156115 - RNA, 21 nt, Mycobacterium bovis subsp bovis AF2122/97
gcagcgucggugccaccacgc

SEQ ID NO: 3156116 - RNA, 22 nt, Mycobacterium bovis subsp bovis AF2122/97
gcagcgucguaaccgucgccug

SEQ ID NO: 3156117 - RNA, 16 nt, Mycobacterium bovis subsp bovis AF2122/97
gcagcgucgucgacga

SEQ ID NO: 3156118 - RNA, 13 nt, Mycobacterium bovis subsp bovis AF2122/97
gcagcgucuccuu

SEQ ID NO: 3156119 - RNA, 22 nt, Mycobacterium bovis subsp bovis AF2122/97
gcagcgucuccuugagcuucuc

SEQ ID NO: 3156120 - RNA, 23 nt, Mycobacterium bovis subsp bovis AF2122/97
gcagcgugaaaugcacgaucgcc

SEQ ID NO: 3156121 - RNA, 15 nt, Mycobacterium bovis subsp bovis AF2122/97
gcagcgugaccaccg

SEQ ID NO: 3156122 - RNA, 17 nt, Mycobacterium bovis subsp bovis AF2122/97
gcagcgugaccaccgcc

SEQ ID NO: 3156123 - RNA, 23 nt, Mycobacterium bovis subsp bovis AF2122/97
gcaggaaucgggucagcaccacc

SEQ ID NO: 3156124 - RNA, 22 nt, Mycobacterium bovis subsp bovis AF2122/97
gcaggaauucgccauagcgggc

SEQ ID NO: 3156125 - RNA, 13 nt, Mycobacterium bovis subsp bovis AF2122/97
gcaggaccagcac

SEQ ID NO: 3156126 - RNA, 18 nt, Mycobacterium bovis subsp bovis AF2122/97
gcaggaccagcaccgccg

SEQ ID NO: 3156127 - RNA, 21 nt, Mycobacterium bovis subsp bovis AF2122/97
gcaggaccagcaccgccgcgc

SEQ ID NO: 3156128 - RNA, 18 nt, Mycobacterium bovis subsp bovis AF2122/97
gcaggacgcccacaugcu

SEQ ID NO: 3156129 - RNA, 21 nt, Mycobacterium bovis subsp bovis AF2122/97
gcaggacggugaagcacacug

SEQ ID NO: 3156130 - RNA, 20 nt, Mycobacterium bovis subsp bovis AF2122/97
gcaggacguuugagacccca

SEQ ID NO: 3156131 - RNA, 12 nt, Mycobacterium bovis subsp bovis AF2122/97
gcaggacucgcg

SEQ ID NO: 3156132 - RNA, 23 nt, Mycobacterium bovis subsp bovis AF2122/97
gcaggagaacacauccgcuugcg

SEQ ID NO: 3156133 - RNA, 18 nt, Mycobacterium bovis subsp bovis AF2122/97
gcaggagcagcacgucga

SEQ ID NO: 3156134 - RNA, 11 nt, Mycobacterium bovis subsp bovis AF2122/97
gcaggagccgg

SEQ ID NO: 3156135 - RNA, 17 nt, Mycobacterium bovis subsp bovis AF2122/97
gcaggagccggcaaccg

SEQ ID NO: 3156136 - RNA, 16 nt, Mycobacterium bovis subsp bovis AF2122/97
gcaggaggcguccggc

SEQ ID NO: 3156137 - RNA, 21 nt, Mycobacterium bovis subsp bovis AF2122/97
gcaggaggcguccggcucaug

SEQ ID NO: 3156138 - RNA, 17 nt, Mycobacterium bovis subsp bovis AF2122/97
gcaggauaccgaaauca

SEQ ID NO: 3156139 - RNA, 21 nt, Mycobacterium bovis subsp bovis AF2122/97
gcaggaucacgccgccggcga

SEQ ID NO: 3156140 - RNA, 22 nt, Mycobacterium bovis subsp bovis AF2122/97
gcaggaucacgccgccggcgaa

SEQ ID NO: 3156141 - RNA, 19 nt, Mycobacterium bovis subsp bovis AF2122/97
gcaggaucgaggcgucggc

SEQ ID NO: 3156142 - RNA, 20 nt, Mycobacterium bovis subsp bovis AF2122/97
gcaggaucgaggcgucggca

SEQ ID NO: 3156143 - RNA, 15 nt, Mycobacterium bovis subsp bovis AF2122/97
gcaggaucggcagca

SEQ ID NO: 3156144 - RNA, 23 nt, Mycobacterium bovis subsp bovis AF2122/97
gcaggaucggcggauagucgcgg

SEQ ID NO: 3156145 - RNA, 14 nt, Mycobacterium bovis subsp bovis AF2122/97
gcaggaucggcuug

SEQ ID NO: 3156146 - RNA, 17 nt, Mycobacterium bovis subsp bovis AF2122/97
gcaggaucuccgggucg

SEQ ID NO: 3156147 - RNA, 20 nt, Mycobacterium bovis subsp bovis AF2122/97
gcaggaucuccgggucgaug

SEQ ID NO: 3156148 - RNA, 16 nt, Mycobacterium bovis subsp bovis AF2122/97
gcaggaugaugaccgc

SEQ ID NO: 3156149 - RNA, 22 nt, Mycobacterium bovis subsp bovis AF2122/97
gcaggauguucaaucccuccgc

SEQ ID NO: 3156150 - RNA, 21 nt, Mycobacterium bovis subsp bovis AF2122/97
gcaggauucccagucgcggcg

SEQ ID NO: 3156151 - RNA, 24 nt, Mycobacterium bovis subsp bovis AF2122/97
gcaggauucccagucgcggcgcga

SEQ ID NO: 3156152 - RNA, 15 nt, Mycobacterium bovis subsp bovis AF2122/97
gcaggauucccucga

SEQ ID NO: 3156153 - RNA, 15 nt, Mycobacterium bovis subsp bovis AF2122/97
gcaggauucggcggu

SEQ ID NO: 3156154 - RNA, 13 nt, Mycobacterium bovis subsp bovis AF2122/97
gcaggcaccccga

SEQ ID NO: 3156155 - RNA, 16 nt, Mycobacterium bovis subsp bovis AF2122/97
gcaggcagggcagccc

SEQ ID NO: 3156156 - RNA, 19 nt, Mycobacterium bovis subsp bovis AF2122/97
gcaggcagguuggccaccg

SEQ ID NO: 3156157 - RNA, 22 nt, Mycobacterium bovis subsp bovis AF2122/97
gcaggcagguuggccaccgccc

SEQ ID NO: 3156158 - RNA, 18 nt, Mycobacterium bovis subsp bovis AF2122/97
gcaggcauggcgccguug

SEQ ID NO: 3156159 - RNA, 13 nt, Mycobacterium bovis subsp bovis AF2122/97
gcaggcauucccg

SEQ ID NO: 3156160 - RNA, 17 nt, Mycobacterium bovis subsp bovis AF2122/97
gcaggcauucccgcggc

SEQ ID NO: 3156161 - RNA, 23 nt, Mycobacterium bovis subsp bovis AF2122/97
gcaggccagggucagcucgguga

SEQ ID NO: 3156162 - RNA, 13 nt, Mycobacterium bovis subsp bovis AF2122/97
gcaggccauggga

SEQ ID NO: 3156163 - RNA, 14 nt, Mycobacterium bovis subsp bovis AF2122/97
gcaggccaugggaa

SEQ ID NO: 3156164 - RNA, 12 nt, Mycobacterium bovis subsp bovis AF2122/97
gcaggcccaccc

SEQ ID NO: 3156165 - RNA, 16 nt, Mycobacterium bovis subsp bovis AF2122/97
gcaggcccacccgggc

SEQ ID NO: 3156166 - RNA, 12 nt, Mycobacterium bovis subsp bovis AF2122/97
gcaggcccagcg

SEQ ID NO: 3156167 - RNA, 14 nt, Mycobacterium bovis subsp bovis AF2122/97
gcaggcccagcgga

SEQ ID NO: 3156168 - RNA, 17 nt, Mycobacterium bovis subsp bovis AF2122/97
gcaggccccacuggugc

SEQ ID NO: 3156169 - RNA, 18 nt, Mycobacterium bovis subsp bovis AF2122/97
gcaggccccacuggugca

SEQ ID NO: 3156170 - RNA, 15 nt, Mycobacterium bovis subsp bovis AF2122/97
gcaggcccgacggcg

SEQ ID NO: 3156171 - RNA, 16 nt, Mycobacterium bovis subsp bovis AF2122/97
gcaggcccgacggcgc

SEQ ID NO: 3156172 - RNA, 20 nt, Mycobacterium bovis subsp bovis AF2122/97
gcaggcccgacggcgcccag

SEQ ID NO: 3156173 - RNA, 21 nt, Mycobacterium bovis subsp bovis AF2122/97
gcaggcccgacggcgcccagc

SEQ ID NO: 3156174 - RNA, 16 nt, Mycobacterium bovis subsp bovis AF2122/97
gcaggcccuggccacc

SEQ ID NO: 3156175 - RNA, 19 nt, Mycobacterium bovis subsp bovis AF2122/97
gcaggcccuggccacccag

SEQ ID NO: 3156176 - RNA, 12 nt, Mycobacterium bovis subsp bovis AF2122/97
gcaggcccuuca

SEQ ID NO: 3156177 - RNA, 18 nt, Mycobacterium bovis subsp bovis AF2122/97
gcaggccgaagacgugcc

SEQ ID NO: 3156178 - RNA, 13 nt, Mycobacterium bovis subsp bovis AF2122/97
gcaggccgccgcc

SEQ ID NO: 3156179 - RNA, 17 nt, Mycobacterium bovis subsp bovis AF2122/97
gcaggccgcguucgugg

SEQ ID NO: 3156180 - RNA, 13 nt, Mycobacterium bovis subsp bovis AF2122/97
gcaggccgcuggg

SEQ ID NO: 3156181 - RNA, 16 nt, Mycobacterium bovis subsp bovis AF2122/97
gcaggccgcugggccg

SEQ ID NO: 3156182 - RNA, 14 nt, Mycobacterium bovis subsp bovis AF2122/97
gcaggccggccacc

SEQ ID NO: 3156183 - RNA, 15 nt, Mycobacterium bovis subsp bovis AF2122/97
gcaggccggccaccg

SEQ ID NO: 3156184 - RNA, 12 nt, Mycobacterium bovis subsp bovis AF2122/97
gcaggccggcgg

SEQ ID NO: 3156185 - RNA, 14 nt, Mycobacterium bovis subsp bovis AF2122/97
gcaggccggcgucg

SEQ ID NO: 3156186 - RNA, 15 nt, Mycobacterium bovis subsp bovis AF2122/97
gcaggccggcgucga

SEQ ID NO: 3156187 - RNA, 14 nt, Mycobacterium bovis subsp bovis AF2122/97
gcaggccggcucgc

SEQ ID NO: 3156188 - RNA, 12 nt, Mycobacterium bovis subsp bovis AF2122/97
gcaggccgggcg

SEQ ID NO: 3156189 - RNA, 13 nt, Mycobacterium bovis subsp bovis AF2122/97
gcaggccgggcgc

SEQ ID NO: 3156190 - RNA, 24 nt, Mycobacterium bovis subsp bovis AF2122/97
gcaggccgggcgcaagcagcccgg

SEQ ID NO: 3156191 - RNA, 15 nt, Mycobacterium bovis subsp bovis AF2122/97
gcaggccuccaagcc

SEQ ID NO: 3156192 - RNA, 18 nt, Mycobacterium bovis subsp bovis AF2122/97
gcaggccuccaagcccgc

SEQ ID NO: 3156193 - RNA, 19 nt, Mycobacterium bovis subsp bovis AF2122/97
gcaggccuccaagcccgcc

SEQ ID NO: 3156194 - RNA, 21 nt, Mycobacterium bovis subsp bovis AF2122/97
gcaggccuccaagcccgccgg

SEQ ID NO: 3156195 - RNA, 22 nt, Mycobacterium bovis subsp bovis AF2122/97
gcaggccuccaagcccgccgga

SEQ ID NO: 3156196 - RNA, 19 nt, Mycobacterium bovis subsp bovis AF2122/97
gcaggccucggcgccgccc

SEQ ID NO: 3156197 - RNA, 20 nt, Mycobacterium bovis subsp bovis AF2122/97
gcaggccucggcgccgccca

SEQ ID NO: 3156198 - RNA, 14 nt, Mycobacterium bovis subsp bovis AF2122/97
gcaggcgaacacca

SEQ ID NO: 3156199 - RNA, 16 nt, Mycobacterium bovis subsp bovis AF2122/97
gcaggcgaaggcggcu

SEQ ID NO: 3156200 - RNA, 20 nt, Mycobacterium bovis subsp bovis AF2122/97
gcaggcgaaggcggcuucgc

SEQ ID NO: 3156201 - RNA, 15 nt, Mycobacterium bovis subsp bovis AF2122/97
gcaggcgacggcucu

SEQ ID NO: 3156202 - RNA, 21 nt, Mycobacterium bovis subsp bovis AF2122/97
gcaggcgaguuaggccgccag

SEQ ID NO: 3156203 - RNA, 17 nt, Mycobacterium bovis subsp bovis AF2122/97
gcaggcgcaagguggca

SEQ ID NO: 3156204 - RNA, 15 nt, Mycobacterium bovis subsp bovis AF2122/97
gcaggcgcaccaggc

SEQ ID NO: 3156205 - RNA, 13 nt, Mycobacterium bovis subsp bovis AF2122/97
gcaggcggccagc

SEQ ID NO: 3156206 - RNA, 15 nt, Mycobacterium bovis subsp bovis AF2122/97
gcaggcggccgccag

SEQ ID NO: 3156207 - RNA, 14 nt, Mycobacterium bovis subsp bovis AF2122/97
gcaggcggccgccg

SEQ ID NO: 3156208 - RNA, 15 nt, Mycobacterium bovis subsp bovis AF2122/97
gcaggcggcucaacc

SEQ ID NO: 3156209 - RNA, 19 nt, Mycobacterium bovis subsp bovis AF2122/97
gcaggcgggggaucggugg

SEQ ID NO: 3156210 - RNA, 17 nt, Mycobacterium bovis subsp bovis AF2122/97
gcaguacaccgcccggc

SEQ ID NO: 3156211 - RNA, 19 nt, Mycobacterium bovis subsp bovis AF2122/97
gcaguacuaacaacaccac

SEQ ID NO: 3156212 - RNA, 21 nt, Mycobacterium bovis subsp bovis AF2122/97
gcaguacuaacaacaccacca

SEQ ID NO: 3156213 - RNA, 23 nt, Mycobacterium bovis subsp bovis AF2122/97
gcaguacuaacaacaccaccagc

SEQ ID NO: 3156214 - RNA, 13 nt, Mycobacterium bovis subsp bovis AF2122/97
gcaguacugggcu

SEQ ID NO: 3156215 - RNA, 22 nt, Mycobacterium bovis subsp bovis AF2122/97
gcaguacuugaccguccaccga

SEQ ID NO: 3156216 - RNA, 16 nt, Mycobacterium bovis subsp bovis AF2122/97
gcaguacuugguugcg

SEQ ID NO: 3156217 - RNA, 17 nt, Mycobacterium bovis subsp bovis AF2122/97
gcaguagccgaccagga

SEQ ID NO: 3156218 - RNA, 14 nt, Mycobacterium bovis subsp bovis AF2122/97
gcaguagcuguggc

SEQ ID NO: 3156219 - RNA, 19 nt, Mycobacterium bovis subsp bovis AF2122/97
gcaguagugaucgaucgcg

SEQ ID NO: 3156220 - RNA, 20 nt, Mycobacterium bovis subsp bovis AF2122/97
gcaguagugaucgaucgcgg

SEQ ID NO: 3156221 - RNA, 20 nt, Mycobacterium bovis subsp bovis AF2122/97
gcaguaucaucggcgcuggc

SEQ ID NO: 3156222 - RNA, 21 nt, Mycobacterium bovis subsp bovis AF2122/97
gcaguauucacagucgcucgc

SEQ ID NO: 3156223 - RNA, 15 nt, Mycobacterium bovis subsp bovis AF2122/97
gcagucaggccuagc

SEQ ID NO: 3156224 - RNA, 21 nt, Mycobacterium bovis subsp bovis AF2122/97
gcagucaggccuagcgcggcg

SEQ ID NO: 3156225 - RNA, 23 nt, Mycobacterium bovis subsp bovis AF2122/97
gcagucaggccuagcgcggcgac

SEQ ID NO: 3156226 - RNA, 19 nt, Mycobacterium bovis subsp bovis AF2122/97
gcaguccaccgcgcggcgc

SEQ ID NO: 3156227 - RNA, 22 nt, Mycobacterium bovis subsp bovis AF2122/97
gcaguccaccgcgcggcgcagc

SEQ ID NO: 3156228 - RNA, 12 nt, Mycobacterium bovis subsp bovis AF2122/97
gcaguccacgag

SEQ ID NO: 3156229 - RNA, 15 nt, Mycobacterium bovis subsp bovis AF2122/97
gcaguccacgagcac

SEQ ID NO: 3156230 - RNA, 23 nt, Mycobacterium bovis subsp bovis AF2122/97
gcaguccagccgggugccggcau

SEQ ID NO: 3156231 - RNA, 12 nt, Mycobacterium bovis subsp bovis AF2122/97
gcaguccaggca

SEQ ID NO: 3156232 - RNA, 20 nt, Mycobacterium bovis subsp bovis AF2122/97
gcagucccaguucguuggug

SEQ ID NO: 3156233 - RNA, 15 nt, Mycobacterium bovis subsp bovis AF2122/97
gcagucccggugggc

SEQ ID NO: 3156234 - RNA, 15 nt, Mycobacterium bovis subsp bovis AF2122/97
gcaguccgagcuugg

SEQ ID NO: 3156235 - RNA, 23 nt, Mycobacterium bovis subsp bovis AF2122/97
gcaguccgagcuuggccgccgcc

SEQ ID NO: 3156236 - RNA, 14 nt, Mycobacterium bovis subsp bovis AF2122/97
gcaguccgggugua

SEQ ID NO: 3156237 - RNA, 19 nt, Mycobacterium bovis subsp bovis AF2122/97
gcaguccgguuacgcucgc

SEQ ID NO: 3156238 - RNA, 20 nt, Mycobacterium bovis subsp bovis AF2122/97
gcaguccgguuacgcucgcg

SEQ ID NO: 3156239 - RNA, 16 nt, Mycobacterium bovis subsp bovis AF2122/97
gcagucgaugagugac

SEQ ID NO: 3156240 - RNA, 20 nt, Mycobacterium bovis subsp bovis AF2122/97
gcagucgauuucggcggcga

SEQ ID NO: 3156241 - RNA, 12 nt, Mycobacterium bovis subsp bovis AF2122/97
gcagucgcacgg

SEQ ID NO: 3156242 - RNA, 22 nt, Mycobacterium bovis subsp bovis AF2122/97
gcagucgcacggugccgccguc

SEQ ID NO: 3156243 - RNA, 15 nt, Mycobacterium bovis subsp bovis AF2122/97
gcagucgcgagguga

SEQ ID NO: 3156244 - RNA, 13 nt, Mycobacterium bovis subsp bovis AF2122/97
gcagucgcggcag

SEQ ID NO: 3156245 - RNA, 17 nt, Mycobacterium bovis subsp bovis AF2122/97
gcagucgcggcagacgc

SEQ ID NO: 3156246 - RNA, 21 nt, Mycobacterium bovis subsp bovis AF2122/97
gcagucgcgguaccaucaccg

SEQ ID NO: 3156247 - RNA, 14 nt, Mycobacterium bovis subsp bovis AF2122/97
gcagucgggcagcg

SEQ ID NO: 3156248 - RNA, 17 nt, Mycobacterium bovis subsp bovis AF2122/97
gcagucggugcggugca

SEQ ID NO: 3156249 - RNA, 23 nt, Mycobacterium bovis subsp bovis AF2122/97
gcagucguugaugcuucgaaccg

SEQ ID NO: 3156250 - RNA, 19 nt, Mycobacterium bovis subsp bovis AF2122/97
gcagugaaauugccgccgc

SEQ ID NO: 3156251 - RNA, 20 nt, Mycobacterium bovis subsp bovis AF2122/97
gcagugaaauugccgccgcc

SEQ ID NO: 3156252 - RNA, 22 nt, Mycobacterium bovis subsp bovis AF2122/97
gcagugaacguaucgccucgag

SEQ ID NO: 3156253 - RNA, 16 nt, Mycobacterium bovis subsp bovis AF2122/97
gcagugaccgcuggug

SEQ ID NO: 3156254 - RNA, 19 nt, Mycobacterium bovis subsp bovis AF2122/97
gcagugaccucgucggcga

SEQ ID NO: 3156255 - RNA, 17 nt, Mycobacterium bovis subsp bovis AF2122/97
gcagugacgccucgaca

SEQ ID NO: 3156256 - RNA, 22 nt, Mycobacterium bovis subsp bovis AF2122/97
gcagugacgccucgacacccag

SEQ ID NO: 3156257 - RNA, 21 nt, Mycobacterium bovis subsp bovis AF2122/97
gcagugacguuccgcucgccg

SEQ ID NO: 3156258 - RNA, 15 nt, Mycobacterium bovis subsp bovis AF2122/97
gcagugagucgguga

SEQ ID NO: 3156259 - RNA, 22 nt, Mycobacterium bovis subsp bovis AF2122/97
gcagugcacccgggccgccucg

SEQ ID NO: 3156260 - RNA, 23 nt, Mycobacterium bovis subsp bovis AF2122/97
gcagugcacccgggccgccucga

SEQ ID NO: 3156261 - RNA, 16 nt, Mycobacterium bovis subsp bovis AF2122/97
gcagugcagcgauccc

SEQ ID NO: 3156262 - RNA, 15 nt, Mycobacterium bovis subsp bovis AF2122/97
gcagugcaggcggcc

SEQ ID NO: 3156263 - RNA, 18 nt, Mycobacterium bovis subsp bovis AF2122/97
gcagugccgcacccagac

SEQ ID NO: 3156264 - RNA, 14 nt, Mycobacterium bovis subsp bovis AF2122/97
gcagugccgugcgg

SEQ ID NO: 3156265 - RNA, 17 nt, Mycobacterium bovis subsp bovis AF2122/97
gcagugccguguccagc

SEQ ID NO: 3156266 - RNA, 13 nt, Mycobacterium bovis subsp bovis AF2122/97
gcagugccucggc

SEQ ID NO: 3156267 - RNA, 16 nt, Mycobacterium bovis subsp bovis AF2122/97
gcagugccucggcgau

SEQ ID NO: 3156268 - RNA, 21 nt, Mycobacterium bovis subsp bovis AF2122/97
gcagugcgaaaaucgcgcgcg

SEQ ID NO: 3156269 - RNA, 13 nt, Mycobacterium bovis subsp bovis AF2122/97
gcagugcgacccg

SEQ ID NO: 3156270 - RNA, 14 nt, Mycobacterium bovis subsp bovis AF2122/97
gcagugcgacccgg

SEQ ID NO: 3156271 - RNA, 16 nt, Mycobacterium bovis subsp bovis AF2122/97
gcagugcgacccgggc

SEQ ID NO: 3156272 - RNA, 22 nt, Mycobacterium bovis subsp bovis AF2122/97
gcagugcgcgaguaagcgaaca

SEQ ID NO: 3156273 - RNA, 14 nt, Mycobacterium bovis subsp bovis AF2122/97
gcagugcgggggcg

SEQ ID NO: 3156274 - RNA, 13 nt, Mycobacterium bovis subsp bovis AF2122/97
gcaguggcagccc

SEQ ID NO: 3156275 - RNA, 19 nt, Mycobacterium bovis subsp bovis AF2122/97
gcaguggcguuacgcucgg

SEQ ID NO: 3156276 - RNA, 20 nt, Mycobacterium bovis subsp bovis AF2122/97
gcaguggcguuacgcucggc

SEQ ID NO: 3156277 - RNA, 21 nt, Mycobacterium bovis subsp bovis AF2122/97
gcaguucaacgaggccgacga

SEQ ID NO: 3156278 - RNA, 16 nt, Mycobacterium bovis subsp bovis AF2122/97
gcaguuccagcucgcg

SEQ ID NO: 3156279 - RNA, 17 nt, Mycobacterium bovis subsp bovis AF2122/97
gcaguuccgcggggccg

SEQ ID NO: 3156280 - RNA, 14 nt, Mycobacterium bovis subsp bovis AF2122/97
gcaguucgccgcgc

SEQ ID NO: 3156281 - RNA, 18 nt, Mycobacterium bovis subsp bovis AF2122/97
gcaguucgccgcgcagcg

SEQ ID NO: 3156282 - RNA, 13 nt, Mycobacterium bovis subsp bovis AF2122/97
gcaguucggcgau

SEQ ID NO: 3156283 - RNA, 17 nt, Mycobacterium bovis subsp bovis AF2122/97
gcaguucucggucccgc

SEQ ID NO: 3156284 - RNA, 22 nt, Mycobacterium bovis subsp bovis AF2122/97
gcaguugaacucgaccaccgcc

SEQ ID NO: 3156285 - RNA, 14 nt, Mycobacterium bovis subsp bovis AF2122/97
gcaguugacccaug

SEQ ID NO: 3156286 - RNA, 15 nt, Mycobacterium bovis subsp bovis AF2122/97
gcaguuggcaccagc

SEQ ID NO: 3156287 - RNA, 16 nt, Mycobacterium bovis subsp bovis AF2122/97
gcaguuggcaccagcc

SEQ ID NO: 3156288 - RNA, 18 nt, Mycobacterium bovis subsp bovis AF2122/97
gcaguuggcaccagccgg

SEQ ID NO: 3156289 - RNA, 17 nt, Mycobacterium bovis subsp bovis AF2122/97
gcaguuggucgcggucc

SEQ ID NO: 3156290 - RNA, 16 nt, Mycobacterium bovis subsp bovis AF2122/97
gcaguuguggcgcugc

SEQ ID NO: 3156291 - RNA, 15 nt, Mycobacterium bovis subsp bovis AF2122/97
gcaguuucaccuugc

SEQ ID NO: 3156292 - RNA, 15 nt, Mycobacterium bovis subsp bovis AF2122/97
gcaguuuggcggcgc

SEQ ID NO: 3156293 - RNA, 15 nt, Mycobacterium bovis subsp bovis AF2122/97
gcauaacccgcaccg

SEQ ID NO: 3156294 - RNA, 19 nt, Mycobacterium bovis subsp bovis AF2122/97
gcauaaccggcgcgccccg

SEQ ID NO: 3156295 - RNA, 12 nt, Mycobacterium bovis subsp bovis AF2122/97
gcauaacgaucc

SEQ ID NO: 3156296 - RNA, 22 nt, Mycobacterium bovis subsp bovis AF2122/97
gcaucgaacuucgauucuggcc

SEQ ID NO: 3156297 - RNA, 18 nt, Mycobacterium bovis subsp bovis AF2122/97
gcaucgaagugcggcccg

SEQ ID NO: 3156298 - RNA, 14 nt, Mycobacterium bovis subsp bovis AF2122/97
gcaucgacgcggcc

SEQ ID NO: 3156299 - RNA, 17 nt, Mycobacterium bovis subsp bovis AF2122/97
gcaucgacguagcgaag

SEQ ID NO: 3156300 - RNA, 17 nt, Mycobacterium bovis subsp bovis AF2122/97
gcaucgacgugcgcggc

SEQ ID NO: 3156301 - RNA, 23 nt, Mycobacterium bovis subsp bovis AF2122/97
gcaucgacugccagcgccgcggc

SEQ ID NO: 3156302 - RNA, 13 nt, Mycobacterium bovis subsp bovis AF2122/97
gcaucgagcagcc

SEQ ID NO: 3156303 - RNA, 16 nt, Mycobacterium bovis subsp bovis AF2122/97
gcaucgagcagcccgg

SEQ ID NO: 3156304 - RNA, 21 nt, Mycobacterium bovis subsp bovis AF2122/97
gcaucgagcaguggccgccgg

SEQ ID NO: 3156305 - RNA, 13 nt, Mycobacterium bovis subsp bovis AF2122/97
gcaucgagcccgg

SEQ ID NO: 3156306 - RNA, 23 nt, Mycobacterium bovis subsp bovis AF2122/97
gcaucgauaauggccgaguccgg

SEQ ID NO: 3156307 - RNA, 15 nt, Mycobacterium bovis subsp bovis AF2122/97
gcaucgaucaccgcu

SEQ ID NO: 3156308 - RNA, 14 nt, Mycobacterium bovis subsp bovis AF2122/97
gcaucgauucgaug

SEQ ID NO: 3156309 - RNA, 22 nt, Mycobacterium bovis subsp bovis AF2122/97
gcaucgauucgauguccucgac

SEQ ID NO: 3156310 - RNA, 14 nt, Mycobacterium bovis subsp bovis AF2122/97
gcaucgcaccaggu

SEQ ID NO: 3156311 - RNA, 18 nt, Mycobacterium bovis subsp bovis AF2122/97
gcaucgcacgggccacca

SEQ ID NO: 3156312 - RNA, 21 nt, Mycobacterium bovis subsp bovis AF2122/97
gcaucgcacgggccaccagcg

SEQ ID NO: 3156313 - RNA, 13 nt, Mycobacterium bovis subsp bovis AF2122/97
gcaucgccaccac

SEQ ID NO: 3156314 - RNA, 17 nt, Mycobacterium bovis subsp bovis AF2122/97
gcaucgccaccaccgga

SEQ ID NO: 3156315 - RNA, 21 nt, Mycobacterium bovis subsp bovis AF2122/97
gcaucgccaccaucaccgccu

SEQ ID NO: 3156316 - RNA, 22 nt, Mycobacterium bovis subsp bovis AF2122/97
gcaucgccaccaucaccgccuu

SEQ ID NO: 3156317 - RNA, 17 nt, Mycobacterium bovis subsp bovis AF2122/97
gcaucgccgacagcgcc

SEQ ID NO: 3156318 - RNA, 18 nt, Mycobacterium bovis subsp bovis AF2122/97
gcaucgccgacagcgccu

SEQ ID NO: 3156319 - RNA, 16 nt, Mycobacterium bovis subsp bovis AF2122/97
gcaucgccgcgaucag

SEQ ID NO: 3156320 - RNA, 20 nt, Mycobacterium bovis subsp bovis AF2122/97
gcaucgccgcgggugaucug

SEQ ID NO: 3156321 - RNA, 14 nt, Mycobacterium bovis subsp bovis AF2122/97
gcaucgccgcuggc

SEQ ID NO: 3156322 - RNA, 15 nt, Mycobacterium bovis subsp bovis AF2122/97
gcaucgccgcuggcc

SEQ ID NO: 3156323 - RNA, 13 nt, Mycobacterium bovis subsp bovis AF2122/97
gcaucgccgucaa

SEQ ID NO: 3156324 - RNA, 16 nt, Mycobacterium bovis subsp bovis AF2122/97
gcaucgccgucaacgc

SEQ ID NO: 3156325 - RNA, 16 nt, Mycobacterium bovis subsp bovis AF2122/97
gcaucgccuccaggcg

SEQ ID NO: 3156326 - RNA, 18 nt, Mycobacterium bovis subsp bovis AF2122/97
gcaucgccuccaggcgcc

SEQ ID NO: 3156327 - RNA, 14 nt, Mycobacterium bovis subsp bovis AF2122/97
gcaucgccuccucg

SEQ ID NO: 3156328 - RNA, 15 nt, Mycobacterium bovis subsp bovis AF2122/97
gcaucgccuccucga

SEQ ID NO: 3156329 - RNA, 16 nt, Mycobacterium bovis subsp bovis AF2122/97
gcaucgcgaacucggg

SEQ ID NO: 3156330 - RNA, 20 nt, Mycobacterium bovis subsp bovis AF2122/97
gcaucgcgaauauagcggcg

SEQ ID NO: 3156331 - RNA, 20 nt, Mycobacterium bovis subsp bovis AF2122/97
gcaucgcgagccagcugcuc

SEQ ID NO: 3156332 - RNA, 20 nt, Mycobacterium bovis subsp bovis AF2122/97
gcaucgcgauuccggcggcc

SEQ ID NO: 3156333 - RNA, 21 nt, Mycobacterium bovis subsp bovis AF2122/97
gcaucgcgauuccggcggcca

SEQ ID NO: 3156334 - RNA, 23 nt, Mycobacterium bovis subsp bovis AF2122/97
gcaucgcgccuuugagcccgcga

SEQ ID NO: 3156335 - RNA, 13 nt, Mycobacterium bovis subsp bovis AF2122/97
gcaucgcgcgcgg

SEQ ID NO: 3156336 - RNA, 15 nt, Mycobacterium bovis subsp bovis AF2122/97
gcaucgcgcgcggcu

SEQ ID NO: 3156337 - RNA, 21 nt, Mycobacterium bovis subsp bovis AF2122/97
gcaucgcggaagcgggcgaug

SEQ ID NO: 3156338 - RNA, 14 nt, Mycobacterium bovis subsp bovis AF2122/97
gcaucgcggcaucg

SEQ ID NO: 3156339 - RNA, 15 nt, Mycobacterium bovis subsp bovis AF2122/97
gcaucgcggcaucga

SEQ ID NO: 3156340 - RNA, 13 nt, Mycobacterium bovis subsp bovis AF2122/97
gcaucgcggccga

SEQ ID NO: 3156341 - RNA, 14 nt, Mycobacterium bovis subsp bovis AF2122/97
gcaucgcggcggcg

SEQ ID NO: 3156342 - RNA, 15 nt, Mycobacterium bovis subsp bovis AF2122/97
gcaucgcgggcggcg

SEQ ID NO: 3156343 - RNA, 16 nt, Mycobacterium bovis subsp bovis AF2122/97
gcaucgcgggcggcgc

SEQ ID NO: 3156344 - RNA, 18 nt, Mycobacterium bovis subsp bovis AF2122/97
gcaucgcgggcggcgcug

SEQ ID NO: 3156345 - RNA, 21 nt, Mycobacterium bovis subsp bovis AF2122/97
gcaucgcgggcggcgcuggcg

SEQ ID NO: 3156346 - RNA, 15 nt, Mycobacterium bovis subsp bovis AF2122/97
gcaucggaaucgcga

SEQ ID NO: 3156347 - RNA, 22 nt, Mycobacterium bovis subsp bovis AF2122/97
gcaucggagauacgggccaccg

SEQ ID NO: 3156348 - RNA, 18 nt, Mycobacterium bovis subsp bovis AF2122/97
gcaucggcaaggcggauc

SEQ ID NO: 3156349 - RNA, 14 nt, Mycobacterium bovis subsp bovis AF2122/97
gcaucggcagcagc

SEQ ID NO: 3156350 - RNA, 15 nt, Mycobacterium bovis subsp bovis AF2122/97
gcaucggcagcagcg

SEQ ID NO: 3156351 - RNA, 16 nt, Mycobacterium bovis subsp bovis AF2122/97
gcaucggcagcagcgc

SEQ ID NO: 3156352 - RNA, 20 nt, Mycobacterium bovis subsp bovis AF2122/97
gcaucggcagccccugccga

SEQ ID NO: 3156353 - RNA, 13 nt, Mycobacterium bovis subsp bovis AF2122/97
gcaucggccaaca

SEQ ID NO: 3156354 - RNA, 17 nt, Mycobacterium bovis subsp bovis AF2122/97
gcaucggccaacaccac

SEQ ID NO: 3156355 - RNA, 14 nt, Mycobacterium bovis subsp bovis AF2122/97
gcaucggcccccaa

SEQ ID NO: 3156356 - RNA, 12 nt, Mycobacterium bovis subsp bovis AF2122/97
gcaucggcgaac

SEQ ID NO: 3156357 - RNA, 13 nt, Mycobacterium bovis subsp bovis AF2122/97
gcaucggcggcaa

SEQ ID NO: 3156358 - RNA, 22 nt, Mycobacterium bovis subsp bovis AF2122/97
gcaucggcggcaacggcggauc

SEQ ID NO: 3156359 - RNA, 15 nt, Mycobacterium bovis subsp bovis AF2122/97
gcaucggcggcgucu

SEQ ID NO: 3156360 - RNA, 21 nt, Mycobacterium bovis subsp bovis AF2122/97
gcaucggcggcgucuucgucg

SEQ ID NO: 3156361 - RNA, 22 nt, Mycobacterium bovis subsp bovis AF2122/97
gcaucggcggcgucuucgucgg

SEQ ID NO: 3156362 - RNA, 19 nt, Mycobacterium bovis subsp bovis AF2122/97
gcaucggcggggcccacac

SEQ ID NO: 3156363 - RNA, 14 nt, Mycobacterium bovis subsp bovis AF2122/97
gcaucggcggugaa

SEQ ID NO: 3156364 - RNA, 15 nt, Mycobacterium bovis subsp bovis AF2122/97
gcaucggcggugaac

SEQ ID NO: 3156365 - RNA, 13 nt, Mycobacterium bovis subsp bovis AF2122/97
gcaucggcgguuc

SEQ ID NO: 3156366 - RNA, 14 nt, Mycobacterium bovis subsp bovis AF2122/97
gcaucggcgguucc

SEQ ID NO: 3156367 - RNA, 21 nt, Mycobacterium bovis subsp bovis AF2122/97
gcaucggcgguuccauacagc

SEQ ID NO: 3156368 - RNA, 20 nt, Mycobacterium bovis subsp bovis AF2122/97
gcaucgggcgagcucgucga

SEQ ID NO: 3156369 - RNA, 22 nt, Mycobacterium bovis subsp bovis AF2122/97
gcaucgggcuugcgcagcagcg

SEQ ID NO: 3156370 - RNA, 15 nt, Mycobacterium bovis subsp bovis AF2122/97
gcaucggucaccgcg

SEQ ID NO: 3156371 - RNA, 17 nt, Mycobacterium bovis subsp bovis AF2122/97
gcaucggucaccgcggc

SEQ ID NO: 3156372 - RNA, 18 nt, Mycobacterium bovis subsp bovis AF2122/97
gcaucggucaccgcggca

SEQ ID NO: 3156373 - RNA, 15 nt, Mycobacterium bovis subsp bovis AF2122/97
gcaucggucagcgcg

SEQ ID NO: 3156374 - RNA, 16 nt, Mycobacterium bovis subsp bovis AF2122/97
gcaucgguccaaagca

SEQ ID NO: 3156375 - RNA, 17 nt, Mycobacterium bovis subsp bovis AF2122/97
gcaucggucccacugcc

SEQ ID NO: 3156376 - RNA, 16 nt, Mycobacterium bovis subsp bovis AF2122/97
gcaucggugcagcccg

SEQ ID NO: 3156377 - RNA, 17 nt, Mycobacterium bovis subsp bovis AF2122/97
gcaucggugccacggca

SEQ ID NO: 3156378 - RNA, 20 nt, Mycobacterium bovis subsp bovis AF2122/97
gcaucggugccacggcaccg

SEQ ID NO: 3156379 - RNA, 18 nt, Mycobacterium bovis subsp bovis AF2122/97
gcaucgguggggcgccgg

SEQ ID NO: 3156380 - RNA, 15 nt, Mycobacterium bovis subsp bovis AF2122/97
gcaucggugguaaca

SEQ ID NO: 3156381 - RNA, 14 nt, Mycobacterium bovis subsp bovis AF2122/97
gcaucguccacgca

SEQ ID NO: 3156382 - RNA, 22 nt, Mycobacterium bovis subsp bovis AF2122/97
gcaucgucgaaagccuggaaaa

SEQ ID NO: 3156383 - RNA, 22 nt, Mycobacterium bovis subsp bovis AF2122/97
gcauggcaggcgaaggcggcuu

SEQ ID NO: 3156384 - RNA, 15 nt, Mycobacterium bovis subsp bovis AF2122/97
gcauggcccuggcga

SEQ ID NO: 3156385 - RNA, 12 nt, Mycobacterium bovis subsp bovis AF2122/97
gcauggccuggg

SEQ ID NO: 3156386 - RNA, 21 nt, Mycobacterium bovis subsp bovis AF2122/97
gcauggcgaacacgucggcca

SEQ ID NO: 3156387 - RNA, 16 nt, Mycobacterium bovis subsp bovis AF2122/97
gcauggcggcuggugc

SEQ ID NO: 3156388 - RNA, 18 nt, Mycobacterium bovis subsp bovis AF2122/97
gcauggcggcuggugcgg

SEQ ID NO: 3156389 - RNA, 21 nt, Mycobacterium bovis subsp bovis AF2122/97
gcauggcuugcucugcgcauc

SEQ ID NO: 3156390 - RNA, 15 nt, Mycobacterium bovis subsp bovis AF2122/97
gcaugggccggcgcc

SEQ ID NO: 3156391 - RNA, 23 nt, Mycobacterium bovis subsp bovis AF2122/97
gcaugggcuaccgagauugggcu

SEQ ID NO: 3156392 - RNA, 16 nt, Mycobacterium bovis subsp bovis AF2122/97
gcaugggucgugcagg

SEQ ID NO: 3156393 - RNA, 16 nt, Mycobacterium bovis subsp bovis AF2122/97
gcauggucaggcggcc

SEQ ID NO: 3156394 - RNA, 19 nt, Mycobacterium bovis subsp bovis AF2122/97
gcaugguccacagccggcg

SEQ ID NO: 3156395 - RNA, 20 nt, Mycobacterium bovis subsp bovis AF2122/97
gcaugguccacagccggcgg

SEQ ID NO: 3156396 - RNA, 22 nt, Mycobacterium bovis subsp bovis AF2122/97
gcaugguccacagccggcggcu

SEQ ID NO: 3156397 - RNA, 13 nt, Mycobacterium bovis subsp bovis AF2122/97
gcaugguccagca

SEQ ID NO: 3156398 - RNA, 13 nt, Mycobacterium bovis subsp bovis AF2122/97
gcauggucgacga

SEQ ID NO: 3156399 - RNA, 23 nt, Mycobacterium bovis subsp bovis AF2122/97
gcauggucgacgaacaccccggg

SEQ ID NO: 3156400 - RNA, 13 nt, Mycobacterium bovis subsp bovis AF2122/97
gcauggucgccgg

SEQ ID NO: 3156401 - RNA, 16 nt, Mycobacterium bovis subsp bovis AF2122/97
gcauggugcggcggcg

SEQ ID NO: 3156402 - RNA, 19 nt, Mycobacterium bovis subsp bovis AF2122/97
gcaugguggacgaggcggu

SEQ ID NO: 3156403 - RNA, 17 nt, Mycobacterium bovis subsp bovis AF2122/97
gcaugguggcgccgacc

SEQ ID NO: 3156404 - RNA, 15 nt, Mycobacterium bovis subsp bovis AF2122/97
gcauggugggugccg

SEQ ID NO: 3156405 - RNA, 20 nt, Mycobacterium bovis subsp bovis AF2122/97
gcaugguuagcggugauggg

SEQ ID NO: 3156406 - RNA, 22 nt, Mycobacterium bovis subsp bovis AF2122/97
gcauguagaguaucgaauccgu

SEQ ID NO: 3156407 - RNA, 17 nt, Mycobacterium bovis subsp bovis AF2122/97
gcaugucgauccggcgc

SEQ ID NO: 3156408 - RNA, 13 nt, Mycobacterium bovis subsp bovis AF2122/97
gcaugucgccgaa

SEQ ID NO: 3156409 - RNA, 20 nt, Mycobacterium bovis subsp bovis AF2122/97
gcaugucgccgaacgccacc

SEQ ID NO: 3156410 - RNA, 18 nt, Mycobacterium bovis subsp bovis AF2122/97
gcaugucgcggacccgcg

SEQ ID NO: 3156411 - RNA, 17 nt, Mycobacterium bovis subsp bovis AF2122/97
gcaugucgggccaggcg

SEQ ID NO: 3156412 - RNA, 17 nt, Mycobacterium bovis subsp bovis AF2122/97
gcaugucgggccgcucg

SEQ ID NO: 3156413 - RNA, 18 nt, Mycobacterium bovis subsp bovis AF2122/97
gcaugucgggccgcucga

SEQ ID NO: 3156414 - RNA, 21 nt, Mycobacterium bovis subsp bovis AF2122/97
gcaugugaaagacaacccgcu

SEQ ID NO: 3156415 - RNA, 23 nt, Mycobacterium bovis subsp bovis AF2122/97
gcaugugaaagacaacccgcucg

SEQ ID NO: 3156416 - RNA, 24 nt, Mycobacterium bovis subsp bovis AF2122/97
gcaugugaaagacaacccgcucgg

SEQ ID NO: 3156417 - RNA, 14 nt, Mycobacterium bovis subsp bovis AF2122/97
gcauguggccgccg

SEQ ID NO: 3156418 - RNA, 17 nt, Mycobacterium bovis subsp bovis AF2122/97
gcauguggccgccgucg

SEQ ID NO: 3156419 - RNA, 19 nt, Mycobacterium bovis subsp bovis AF2122/97
gcaugugggaacuggacca

SEQ ID NO: 3156420 - RNA, 17 nt, Mycobacterium bovis subsp bovis AF2122/97
gcauguucaucgcaguc

SEQ ID NO: 3156421 - RNA, 22 nt, Mycobacterium bovis subsp bovis AF2122/97
gcauguuccccgucgccagggc

SEQ ID NO: 3156422 - RNA, 18 nt, Mycobacterium bovis subsp bovis AF2122/97
gcauguucuccacgccga

SEQ ID NO: 3156423 - RNA, 19 nt, Mycobacterium bovis subsp bovis AF2122/97
gcauguucuccacgccgau

SEQ ID NO: 3156424 - RNA, 18 nt, Mycobacterium bovis subsp bovis AF2122/97
gcauguugcaggcgcagc

SEQ ID NO: 3156425 - RNA, 20 nt, Mycobacterium bovis subsp bovis AF2122/97
gcauguugcaggcgcagcug

SEQ ID NO: 3156426 - RNA, 23 nt, Mycobacterium bovis subsp bovis AF2122/97
gcauuaggccggggucgaacgcg

SEQ ID NO: 3156427 - RNA, 15 nt, Mycobacterium bovis subsp bovis AF2122/97
gcauucaccaaaccg

SEQ ID NO: 3156428 - RNA, 14 nt, Mycobacterium bovis subsp bovis AF2122/97
gcauucccgcggca

SEQ ID NO: 3156429 - RNA, 23 nt, Mycobacterium bovis subsp bovis AF2122/97
gcauucccgcggcaacgcggucu

SEQ ID NO: 3156430 - RNA, 15 nt, Mycobacterium bovis subsp bovis AF2122/97
gcauucgccgggcgg

SEQ ID NO: 3156431 - RNA, 18 nt, Mycobacterium bovis subsp bovis AF2122/97
gcauucggcgagccgcgc

SEQ ID NO: 3156432 - RNA, 14 nt, Mycobacterium bovis subsp bovis AF2122/97
gcauucucccggua

SEQ ID NO: 3156433 - RNA, 17 nt, Mycobacterium bovis subsp bovis AF2122/97
gcauugaagaagcccga

SEQ ID NO: 3156434 - RNA, 21 nt, Mycobacterium bovis subsp bovis AF2122/97
gcauugagccgggcuauccgc

SEQ ID NO: 3156435 - RNA, 18 nt, Mycobacterium bovis subsp bovis AF2122/97
gcauugaguucggccacc

SEQ ID NO: 3156436 - RNA, 14 nt, Mycobacterium bovis subsp bovis AF2122/97
gcauugaucggugc

SEQ ID NO: 3156437 - RNA, 14 nt, Mycobacterium bovis subsp bovis AF2122/97
gcauugccgacgcg

SEQ ID NO: 3156438 - RNA, 18 nt, Mycobacterium bovis subsp bovis AF2122/97
gcauugccgacgcgcggc

SEQ ID NO: 3156439 - RNA, 22 nt, Mycobacterium bovis subsp bovis AF2122/97
gcauugccgacgcgcggccagc

SEQ ID NO: 3156440 - RNA, 11 nt, Mycobacterium bovis subsp bovis AF2122/97
gcauugccgcc

SEQ ID NO: 3156441 - RNA, 20 nt, Mycobacterium bovis subsp bovis AF2122/97
gcauugccgccagcccagcc

SEQ ID NO: 3156442 - RNA, 13 nt, Mycobacterium bovis subsp bovis AF2122/97
gcauugccgccgu

SEQ ID NO: 3156443 - RNA, 15 nt, Mycobacterium bovis subsp bovis AF2122/97
gcauugcggcccgcg

SEQ ID NO: 3156444 - RNA, 16 nt, Mycobacterium bovis subsp bovis AF2122/97
gcauugcggcccgcga

SEQ ID NO: 3156445 - RNA, 18 nt, Mycobacterium bovis subsp bovis AF2122/97
gcauugcuccgguuggcg

SEQ ID NO: 3156446 - RNA, 21 nt, Mycobacterium bovis subsp bovis AF2122/97
gcauugcugguugcgcucacc

SEQ ID NO: 3156447 - RNA, 18 nt, Mycobacterium bovis subsp bovis AF2122/97
gcauugcuguguugcacc

SEQ ID NO: 3156448 - RNA, 21 nt, Mycobacterium bovis subsp bovis AF2122/97
gcauuggccugaugcagggcc

SEQ ID NO: 3156449 - RNA, 13 nt, Mycobacterium bovis subsp bovis AF2122/97
gcauuggcggugc

SEQ ID NO: 3156450 - RNA, 23 nt, Mycobacterium bovis subsp bovis AF2122/97
gcauuggcggugccgguagcggc

SEQ ID NO: 3156451 - RNA, 13 nt, Mycobacterium bovis subsp bovis AF2122/97
gcauuggcgucga

SEQ ID NO: 3156452 - RNA, 23 nt, Mycobacterium bovis subsp bovis AF2122/97
gcauuguccugaaaacaccgcac

SEQ ID NO: 3156453 - RNA, 23 nt, Mycobacterium bovis subsp bovis AF2122/97
gcauuuccugauccgccugccga

SEQ ID NO: 3156454 - RNA, 17 nt, Mycobacterium bovis subsp bovis AF2122/97
gcauuuguugcugcugc

SEQ ID NO: 3156455 - RNA, 21 nt, Mycobacterium bovis subsp bovis AF2122/97
gcauuuguugcugcugccgug

SEQ ID NO: 3156456 - RNA, 17 nt, Mycobacterium bovis subsp bovis AF2122/97
gccaaaaacgccccggc

SEQ ID NO: 3156457 - RNA, 23 nt, Mycobacterium bovis subsp bovis AF2122/97
gccaaaaacgccccggcgcggcc

SEQ ID NO: 3156458 - RNA, 20 nt, Mycobacterium bovis subsp bovis AF2122/97
gccaaaaacgcugccgccgu

SEQ ID NO: 3156459 - RNA, 22 nt, Mycobacterium bovis subsp bovis AF2122/97
gccaaaaacgcugccgccguuc

SEQ ID NO: 3156460 - RNA, 19 nt, Mycobacterium bovis subsp bovis AF2122/97
gccaaaaaggaucccgccg

SEQ ID NO: 3156461 - RNA, 20 nt, Mycobacterium bovis subsp bovis AF2122/97
gccaaaaaggaucccgccgc

SEQ ID NO: 3156462 - RNA, 15 nt, Mycobacterium bovis subsp bovis AF2122/97
gccaaaacgagcaga

SEQ ID NO: 3156463 - RNA, 11 nt, Mycobacterium bovis subsp bovis AF2122/97
gccaaaagggc

SEQ ID NO: 3156464 - RNA, 16 nt, Mycobacterium bovis subsp bovis AF2122/97
gccaaaagggcggcag

SEQ ID NO: 3156465 - RNA, 21 nt, Mycobacterium bovis subsp bovis AF2122/97
gccaaaagggcggcagcgagg

SEQ ID NO: 3156466 - RNA, 23 nt, Mycobacterium bovis subsp bovis AF2122/97
gccaaaaguacuggcguugccac

SEQ ID NO: 3156467 - RNA, 16 nt, Mycobacterium bovis subsp bovis AF2122/97
gccaaaauccgcccac

SEQ ID NO: 3156468 - RNA, 23 nt, Mycobacterium bovis subsp bovis AF2122/97
gccaaaauccgcccaccggucgc

SEQ ID NO: 3156469 - RNA, 17 nt, Mycobacterium bovis subsp bovis AF2122/97
gccaacggcuccgggcg

SEQ ID NO: 3156470 - RNA, 22 nt, Mycobacterium bovis subsp bovis AF2122/97
gccaacgguaguugcgcggcau

SEQ ID NO: 3156471 - RNA, 23 nt, Mycobacterium bovis subsp bovis AF2122/97
gccaacgguaguugcgcggcauc

SEQ ID NO: 3156472 - RNA, 18 nt, Mycobacterium bovis subsp bovis AF2122/97
gccaacgugacgccggcc

SEQ ID NO: 3156473 - RNA, 18 nt, Mycobacterium bovis subsp bovis AF2122/97
gccaacguugcgccagcg

SEQ ID NO: 3156474 - RNA, 19 nt, Mycobacterium bovis subsp bovis AF2122/97
gccaacguugcgccagcgg

SEQ ID NO: 3156475 - RNA, 20 nt, Mycobacterium bovis subsp bovis AF2122/97
gccaacguugcgccagcggu

SEQ ID NO: 3156476 - RNA, 15 nt, Mycobacterium bovis subsp bovis AF2122/97
gccaacucaggccgg

SEQ ID NO: 3156477 - RNA, 18 nt, Mycobacterium bovis subsp bovis AF2122/97
gccaacucaggccgguac

SEQ ID NO: 3156478 - RNA, 15 nt, Mycobacterium bovis subsp bovis AF2122/97
gccaacucccgcggu

SEQ ID NO: 3156479 - RNA, 17 nt, Mycobacterium bovis subsp bovis AF2122/97
gccaacucccgcgguac

SEQ ID NO: 3156480 - RNA, 17 nt, Mycobacterium bovis subsp bovis AF2122/97
gccaacuccucagccgc

SEQ ID NO: 3156481 - RNA, 14 nt, Mycobacterium bovis subsp bovis AF2122/97
gccaacucggcgau

SEQ ID NO: 3156482 - RNA, 22 nt, Mycobacterium bovis subsp bovis AF2122/97
gccaacucggcgaugacaucac

SEQ ID NO: 3156483 - RNA, 19 nt, Mycobacterium bovis subsp bovis AF2122/97
gccaacucguccaacugaa

SEQ ID NO: 3156484 - RNA, 16 nt, Mycobacterium bovis subsp bovis AF2122/97
gccaacugcgccguuc

SEQ ID NO: 3156485 - RNA, 18 nt, Mycobacterium bovis subsp bovis AF2122/97
gccaacugggccgagcgc

SEQ ID NO: 3156486 - RNA, 20 nt, Mycobacterium bovis subsp bovis AF2122/97
gccaacugggccgagcgcgc

SEQ ID NO: 3156487 - RNA, 21 nt, Mycobacterium bovis subsp bovis AF2122/97
gccaacugggccgagcgcgcc

SEQ ID NO: 3156488 - RNA, 17 nt, Mycobacterium bovis subsp bovis AF2122/97
gccaacuucugcacgaa

SEQ ID NO: 3156489 - RNA, 16 nt, Mycobacterium bovis subsp bovis AF2122/97
gccaacuuggcggcca

SEQ ID NO: 3156490 - RNA, 18 nt, Mycobacterium bovis subsp bovis AF2122/97
gccaagaaugugggcgac

SEQ ID NO: 3156491 - RNA, 19 nt, Mycobacterium bovis subsp bovis AF2122/97
gccaagauggcgcgcuggg

SEQ ID NO: 3156492 - RNA, 20 nt, Mycobacterium bovis subsp bovis AF2122/97
gccaagauggcgcgcugggc

SEQ ID NO: 3156493 - RNA, 16 nt, Mycobacterium bovis subsp bovis AF2122/97
gccaagcagcugggca

SEQ ID NO: 3156494 - RNA, 16 nt, Mycobacterium bovis subsp bovis AF2122/97
gccaagcccaggcgau

SEQ ID NO: 3156495 - RNA, 14 nt, Mycobacterium bovis subsp bovis AF2122/97
gccaagccgcggcu

SEQ ID NO: 3156496 - RNA, 14 nt, Mycobacterium bovis subsp bovis AF2122/97
gccaagccggagcc

SEQ ID NO: 3156497 - RNA, 13 nt, Mycobacterium bovis subsp bovis AF2122/97
gccaagccggcga

SEQ ID NO: 3156498 - RNA, 15 nt, Mycobacterium bovis subsp bovis AF2122/97
gccaagccggcgagu

SEQ ID NO: 3156499 - RNA, 15 nt, Mycobacterium bovis subsp bovis AF2122/97
gccaagcgacucgcc

SEQ ID NO: 3156500 - RNA, 17 nt, Mycobacterium bovis subsp bovis AF2122/97
gccaagcgacucgccgg

SEQ ID NO: 3156501 - RNA, 18 nt, Mycobacterium bovis subsp bovis AF2122/97
gccaagcgacucgccggc

SEQ ID NO: 3156502 - RNA, 12 nt, Mycobacterium bovis subsp bovis AF2122/97
gccaagcgcgcg

SEQ ID NO: 3156503 - RNA, 24 nt, Mycobacterium bovis subsp bovis AF2122/97
gccaagcggguuguggcacccggc

SEQ ID NO: 3156504 - RNA, 16 nt, Mycobacterium bovis subsp bovis AF2122/97
gccaagcucggccacc

SEQ ID NO: 3156505 - RNA, 23 nt, Mycobacterium bovis subsp bovis AF2122/97
gccaagcucggccaccagcgccc

SEQ ID NO: 3156506 - RNA, 17 nt, Mycobacterium bovis subsp bovis AF2122/97
gccaagcucggcccagc

SEQ ID NO: 3156507 - RNA, 19 nt, Mycobacterium bovis subsp bovis AF2122/97
gccaagcucggcccagcgc

SEQ ID NO: 3156508 - RNA, 22 nt, Mycobacterium bovis subsp bovis AF2122/97
gccaaggcuuccuccgacgcga

SEQ ID NO: 3156509 - RNA, 17 nt, Mycobacterium bovis subsp bovis AF2122/97
gccaagggccccuccgg

SEQ ID NO: 3156510 - RNA, 15 nt, Mycobacterium bovis subsp bovis AF2122/97
gccaagguggccacc

SEQ ID NO: 3156511 - RNA, 17 nt, Mycobacterium bovis subsp bovis AF2122/97
gccaagguggccaccaa

SEQ ID NO: 3156512 - RNA, 15 nt, Mycobacterium bovis subsp bovis AF2122/97
gccaagguugucgcu

SEQ ID NO: 3156513 - RNA, 14 nt, Mycobacterium bovis subsp bovis AF2122/97
gccaaguacgcgac

SEQ ID NO: 3156514 - RNA, 15 nt, Mycobacterium bovis subsp bovis AF2122/97
gccaaguacgcgacc

SEQ ID NO: 3156515 - RNA, 16 nt, Mycobacterium bovis subsp bovis AF2122/97
gccaaguacgcgaccg

SEQ ID NO: 3156516 - RNA, 19 nt, Mycobacterium bovis subsp bovis AF2122/97
gccaaguacgcgaccgcga

SEQ ID NO: 3156517 - RNA, 20 nt, Mycobacterium bovis subsp bovis AF2122/97
gccaaguacgcgaccgcgau

SEQ ID NO: 3156518 - RNA, 16 nt, Mycobacterium bovis subsp bovis AF2122/97
gccaaguacugggcca

SEQ ID NO: 3156519 - RNA, 18 nt, Mycobacterium bovis subsp bovis AF2122/97
gccaagugcagggcugcu

SEQ ID NO: 3156520 - RNA, 15 nt, Mycobacterium bovis subsp bovis AF2122/97
gccaaguugcagcgg

SEQ ID NO: 3156521 - RNA, 19 nt, Mycobacterium bovis subsp bovis AF2122/97
gccaauacgugauguagcu

SEQ ID NO: 3156522 - RNA, 22 nt, Mycobacterium bovis subsp bovis AF2122/97
gccaaucaccguaauuucuuca

SEQ ID NO: 3156523 - RNA, 14 nt, Mycobacterium bovis subsp bovis AF2122/97
gccaaucagcccgc

SEQ ID NO: 3156524 - RNA, 17 nt, Mycobacterium bovis subsp bovis AF2122/97
gccaaucagcccgccgg

SEQ ID NO: 3156525 - RNA, 22 nt, Mycobacterium bovis subsp bovis AF2122/97
gccaauccaccggugccgcaga

SEQ ID NO: 3156526 - RNA, 15 nt, Mycobacterium bovis subsp bovis AF2122/97
gccaauccggcggcg

SEQ ID NO: 3156527 - RNA, 16 nt, Mycobacterium bovis subsp bovis AF2122/97
gccaauccggcggcga

SEQ ID NO: 3156528 - RNA, 13 nt, Mycobacterium bovis subsp bovis AF2122/97
gccaauccggggc

SEQ ID NO: 3156529 - RNA, 20 nt, Mycobacterium bovis subsp bovis AF2122/97
gccaaucgaguagcugaccg

SEQ ID NO: 3156530 - RNA, 21 nt, Mycobacterium bovis subsp bovis AF2122/97
gccaaucgaguagcugaccga

SEQ ID NO: 3156531 - RNA, 13 nt, Mycobacterium bovis subsp bovis AF2122/97
gccaaucgcacug

SEQ ID NO: 3156532 - RNA, 16 nt, Mycobacterium bovis subsp bovis AF2122/97
gccaaucgccgucagc

SEQ ID NO: 3156533 - RNA, 21 nt, Mycobacterium bovis subsp bovis AF2122/97
gccaaucgccgucagcaccgc

SEQ ID NO: 3156534 - RNA, 17 nt, Mycobacterium bovis subsp bovis AF2122/97
gccaaugacgucgcgga

SEQ ID NO: 3156535 - RNA, 20 nt, Mycobacterium bovis subsp bovis AF2122/97
gccaaugauucggcacgccg

SEQ ID NO: 3156536 - RNA, 21 nt, Mycobacterium bovis subsp bovis AF2122/97
gccaaugauucggcacgccgg

SEQ ID NO: 3156537 - RNA, 23 nt, Mycobacterium bovis subsp bovis AF2122/97
gccaaugauucggcacgccgggc

SEQ ID NO: 3156538 - RNA, 23 nt, Mycobacterium bovis subsp bovis AF2122/97
gccaaugcccuuggccagcaggg

SEQ ID NO: 3156539 - RNA, 14 nt, Mycobacterium bovis subsp bovis AF2122/97
gccaaugccgcgga

SEQ ID NO: 3156540 - RNA, 17 nt, Mycobacterium bovis subsp bovis AF2122/97
gccaaugccgcggaggc

SEQ ID NO: 3156541 - RNA, 14 nt, Mycobacterium bovis subsp bovis AF2122/97
gccaaugccguuga

SEQ ID NO: 3156542 - RNA, 18 nt, Mycobacterium bovis subsp bovis AF2122/97
gccaaugcgggaaaccca

SEQ ID NO: 3156543 - RNA, 15 nt, Mycobacterium bovis subsp bovis AF2122/97
gccaaugcugcaggu

SEQ ID NO: 3156544 - RNA, 17 nt, Mycobacterium bovis subsp bovis AF2122/97
gccaauggccugcagcg

SEQ ID NO: 3156545 - RNA, 17 nt, Mycobacterium bovis subsp bovis AF2122/97
gccaauuccagcccccc

SEQ ID NO: 3156546 - RNA, 16 nt, Mycobacterium bovis subsp bovis AF2122/97
gccaauugcgccgcca

SEQ ID NO: 3156547 - RNA, 16 nt, Mycobacterium bovis subsp bovis AF2122/97
gccacaaaggcgccgg

SEQ ID NO: 3156548 - RNA, 19 nt, Mycobacterium bovis subsp bovis AF2122/97
gccacaaaggcgccggguc

SEQ ID NO: 3156549 - RNA, 16 nt, Mycobacterium bovis subsp bovis AF2122/97
gccacaaccucgucgu

SEQ ID NO: 3156550 - RNA, 21 nt, Mycobacterium bovis subsp bovis AF2122/97
gccacaacgccucgauggcgg

SEQ ID NO: 3156551 - RNA, 14 nt, Mycobacterium bovis subsp bovis AF2122/97
gccacaacggcggc

SEQ ID NO: 3156552 - RNA, 15 nt, Mycobacterium bovis subsp bovis AF2122/97
gccacaacggcggcg

SEQ ID NO: 3156553 - RNA, 17 nt, Mycobacterium bovis subsp bovis AF2122/97
gccacaacggcggcgca

SEQ ID NO: 3156554 - RNA, 19 nt, Mycobacterium bovis subsp bovis AF2122/97
gccacaacggcggcgcagu

SEQ ID NO: 3156555 - RNA, 20 nt, Mycobacterium bovis subsp bovis AF2122/97
gccaccacugcgcccgccac

SEQ ID NO: 3156556 - RNA, 19 nt, Mycobacterium bovis subsp bovis AF2122/97
gccaccagaaacaccgacg

SEQ ID NO: 3156557 - RNA, 20 nt, Mycobacterium bovis subsp bovis AF2122/97
gccaccagaaacaccgacga

SEQ ID NO: 3156558 - RNA, 15 nt, Mycobacterium bovis subsp bovis AF2122/97
gccaccagaaccacu

SEQ ID NO: 3156559 - RNA, 18 nt, Mycobacterium bovis subsp bovis AF2122/97
gccaccagaaccagcgac

SEQ ID NO: 3156560 - RNA, 18 nt, Mycobacterium bovis subsp bovis AF2122/97
gccaccagacaacgccgu

SEQ ID NO: 3156561 - RNA, 22 nt, Mycobacterium bovis subsp bovis AF2122/97
gccaccagaucgcacaccaaca

SEQ ID NO: 3156562 - RNA, 17 nt, Mycobacterium bovis subsp bovis AF2122/97
gccaccagcaccgccgc

SEQ ID NO: 3156563 - RNA, 16 nt, Mycobacterium bovis subsp bovis AF2122/97
gccaccagcccgauga

SEQ ID NO: 3156564 - RNA, 15 nt, Mycobacterium bovis subsp bovis AF2122/97
gccaccagccgggca

SEQ ID NO: 3156565 - RNA, 22 nt, Mycobacterium bovis subsp bovis AF2122/97
gccaccagcgcacgcucggcac

SEQ ID NO: 3156566 - RNA, 17 nt, Mycobacterium bovis subsp bovis AF2122/97
gccaccagcgcccggcc

SEQ ID NO: 3156567 - RNA, 14 nt, Mycobacterium bovis subsp bovis AF2122/97
gccaccagcggcau

SEQ ID NO: 3156568 - RNA, 16 nt, Mycobacterium bovis subsp bovis AF2122/97
gccaccagcgucgcac

SEQ ID NO: 3156569 - RNA, 13 nt, Mycobacterium bovis subsp bovis AF2122/97
gccaccaggcggu

SEQ ID NO: 3156570 - RNA, 13 nt, Mycobacterium bovis subsp bovis AF2122/97
gccaccagggcca

SEQ ID NO: 3156571 - RNA, 15 nt, Mycobacterium bovis subsp bovis AF2122/97
gccaccagggccacc

SEQ ID NO: 3156572 - RNA, 17 nt, Mycobacterium bovis subsp bovis AF2122/97
gccaccagggccaccgc

SEQ ID NO: 3156573 - RNA, 18 nt, Mycobacterium bovis subsp bovis AF2122/97
gccaccagggccaccgcg

SEQ ID NO: 3156574 - RNA, 20 nt, Mycobacterium bovis subsp bovis AF2122/97
gccaccaggggaccgcggcg

SEQ ID NO: 3156575 - RNA, 20 nt, Mycobacterium bovis subsp bovis AF2122/97
gccaccagucacgcccacca

SEQ ID NO: 3156576 - RNA, 17 nt, Mycobacterium bovis subsp bovis AF2122/97
gccaccaguccgauggg

SEQ ID NO: 3156577 - RNA, 17 nt, Mycobacterium bovis subsp bovis AF2122/97
gccaccaucaccucgca

SEQ ID NO: 3156578 - RNA, 16 nt, Mycobacterium bovis subsp bovis AF2122/97
gccaccaucgccgccg

SEQ ID NO: 3156579 - RNA, 21 nt, Mycobacterium bovis subsp bovis AF2122/97
gccaccaucgccucggcgcug

SEQ ID NO: 3156580 - RNA, 14 nt, Mycobacterium bovis subsp bovis AF2122/97
gccaccaucuggau

SEQ ID NO: 3156581 - RNA, 19 nt, Mycobacterium bovis subsp bovis AF2122/97
gccaccaucuggauggcgc

SEQ ID NO: 3156582 - RNA, 14 nt, Mycobacterium bovis subsp bovis AF2122/97
gccacccaacagcg

SEQ ID NO: 3156583 - RNA, 13 nt, Mycobacterium bovis subsp bovis AF2122/97
gccacccaccgac

SEQ ID NO: 3156584 - RNA, 13 nt, Mycobacterium bovis subsp bovis AF2122/97
gccacccagaaug

SEQ ID NO: 3156585 - RNA, 18 nt, Mycobacterium bovis subsp bovis AF2122/97
gccacccagaaugacauc

SEQ ID NO: 3156586 - RNA, 22 nt, Mycobacterium bovis subsp bovis AF2122/97
gccacccagaugcagcggucca

SEQ ID NO: 3156587 - RNA, 19 nt, Mycobacterium bovis subsp bovis AF2122/97
gccacccccaaccgccggc

SEQ ID NO: 3156588 - RNA, 20 nt, Mycobacterium bovis subsp bovis AF2122/97
gccacccccaaccgccggcc

SEQ ID NO: 3156589 - RNA, 22 nt, Mycobacterium bovis subsp bovis AF2122/97
gccacccccaaccgccggccag

SEQ ID NO: 3156590 - RNA, 23 nt, Mycobacterium bovis subsp bovis AF2122/97
gccacccccaaccgccggccagc

SEQ ID NO: 3156591 - RNA, 19 nt, Mycobacterium bovis subsp bovis AF2122/97
gccacccccaccgucgcgg

SEQ ID NO: 3156592 - RNA, 12 nt, Mycobacterium bovis subsp bovis AF2122/97
gccaccccgcgc

SEQ ID NO: 3156593 - RNA, 15 nt, Mycobacterium bovis subsp bovis AF2122/97
gccaccccgcgcgcc

SEQ ID NO: 3156594 - RNA, 23 nt, Mycobacterium bovis subsp bovis AF2122/97
gccaccccgcgcgccagcucggc

SEQ ID NO: 3156595 - RNA, 23 nt, Mycobacterium bovis subsp bovis AF2122/97
gccaccccgcuuggaccguugcc

SEQ ID NO: 3156596 - RNA, 18 nt, Mycobacterium bovis subsp bovis AF2122/97
gccaccccggguacgccg

SEQ ID NO: 3156597 - RNA, 22 nt, Mycobacterium bovis subsp bovis AF2122/97
gccaccccggucggagcggugc

SEQ ID NO: 3156598 - RNA, 21 nt, Mycobacterium bovis subsp bovis AF2122/97
gccaccccugcgguccgcugc

SEQ ID NO: 3156599 - RNA, 23 nt, Mycobacterium bovis subsp bovis AF2122/97
gccaccccugcgguccgcugcca

SEQ ID NO: 3156600 - RNA, 16 nt, Mycobacterium bovis subsp bovis AF2122/97
gccacccgacaacgcu

SEQ ID NO: 3156601 - RNA, 19 nt, Mycobacterium bovis subsp bovis AF2122/97
gccacccgacaugcgccga

SEQ ID NO: 3156602 - RNA, 12 nt, Mycobacterium bovis subsp bovis AF2122/97
gccacccgcaac

SEQ ID NO: 3156603 - RNA, 15 nt, Mycobacterium bovis subsp bovis AF2122/97
gccacccgcagaccg

SEQ ID NO: 3156604 - RNA, 18 nt, Mycobacterium bovis subsp bovis AF2122/97
gccacccgcaggucgcac

SEQ ID NO: 3156605 - RNA, 20 nt, Mycobacterium bovis subsp bovis AF2122/97
gccacccgcaggucgcacca

SEQ ID NO: 3156606 - RNA, 19 nt, Mycobacterium bovis subsp bovis AF2122/97
gccacccgcgaagccgcca

SEQ ID NO: 3156607 - RNA, 13 nt, Mycobacterium bovis subsp bovis AF2122/97
gccacccgcgacg

SEQ ID NO: 3156608 - RNA, 16 nt, Mycobacterium bovis subsp bovis AF2122/97
gccacccgcgccgccc

SEQ ID NO: 3156609 - RNA, 22 nt, Mycobacterium bovis subsp bovis AF2122/97
gccacccggacauagccgcgcu

SEQ ID NO: 3156610 - RNA, 14 nt, Mycobacterium bovis subsp bovis AF2122/97
gccacccggccagg

SEQ ID NO: 3156611 - RNA, 15 nt, Mycobacterium bovis subsp bovis AF2122/97
gccacccggccaggu

SEQ ID NO: 3156612 - RNA, 13 nt, Mycobacterium bovis subsp bovis AF2122/97
gccacccggccgc

SEQ ID NO: 3156613 - RNA, 15 nt, Mycobacterium bovis subsp bovis AF2122/97
gccacccgguccacc

SEQ ID NO: 3156614 - RNA, 20 nt, Mycobacterium bovis subsp bovis AF2122/97
gccacccuugccgccggugg

SEQ ID NO: 3156615 - RNA, 20 nt, Mycobacterium bovis subsp bovis AF2122/97
gccacccuuggcccggugca

SEQ ID NO: 3156616 - RNA, 17 nt, Mycobacterium bovis subsp bovis AF2122/97
gccaccgaaauugcccu

SEQ ID NO: 3156617 - RNA, 21 nt, Mycobacterium bovis subsp bovis AF2122/97
gccaccgaaauugcccuagca

SEQ ID NO: 3156618 - RNA, 16 nt, Mycobacterium bovis subsp bovis AF2122/97
gccaccgaacgcggcc

SEQ ID NO: 3156619 - RNA, 17 nt, Mycobacterium bovis subsp bovis AF2122/97
gccaccgaacgcggcca

SEQ ID NO: 3156620 - RNA, 20 nt, Mycobacterium bovis subsp bovis AF2122/97
gccaccgaacgcggccaccg

SEQ ID NO: 3156621 - RNA, 15 nt, Mycobacterium bovis subsp bovis AF2122/97
gccaccgaagccgcc

SEQ ID NO: 3156622 - RNA, 20 nt, Mycobacterium bovis subsp bovis AF2122/97
gccaccgaagccgccgggug

SEQ ID NO: 3156623 - RNA, 15 nt, Mycobacterium bovis subsp bovis AF2122/97
gccaccgaccccgga

SEQ ID NO: 3156624 - RNA, 13 nt, Mycobacterium bovis subsp bovis AF2122/97
gccaccgaccgca

SEQ ID NO: 3156625 - RNA, 16 nt, Mycobacterium bovis subsp bovis AF2122/97
gccaccgaccgcauga

SEQ ID NO: 3156626 - RNA, 17 nt, Mycobacterium bovis subsp bovis AF2122/97
gccaccgacgacaucgg

SEQ ID NO: 3156627 - RNA, 22 nt, Mycobacterium bovis subsp bovis AF2122/97
gccaccgagaucaugccggcga

SEQ ID NO: 3156628 - RNA, 14 nt, Mycobacterium bovis subsp bovis AF2122/97
gccaccgagcccuc

SEQ ID NO: 3156629 - RNA, 16 nt, Mycobacterium bovis subsp bovis AF2122/97
gccaccgagcccucca

SEQ ID NO: 3156630 - RNA, 16 nt, Mycobacterium bovis subsp bovis AF2122/97
gccaccgaggcguuca

SEQ ID NO: 3156631 - RNA, 12 nt, Mycobacterium bovis subsp bovis AF2122/97
gccaccgagucg

SEQ ID NO: 3156632 - RNA, 18 nt, Mycobacterium bovis subsp bovis AF2122/97
gccaccgagucgaucacg

SEQ ID NO: 3156633 - RNA, 21 nt, Mycobacterium bovis subsp bovis AF2122/97
gccaccgauaccgucagcgcc

SEQ ID NO: 3156634 - RNA, 20 nt, Mycobacterium bovis subsp bovis AF2122/97
gccaccgaucgacugcagcc

SEQ ID NO: 3156635 - RNA, 18 nt, Mycobacterium bovis subsp bovis AF2122/97
gccaccgcaacucgccga

SEQ ID NO: 3156636 - RNA, 13 nt, Mycobacterium bovis subsp bovis AF2122/97
gccaccgcaagaa

SEQ ID NO: 3156637 - RNA, 18 nt, Mycobacterium bovis subsp bovis AF2122/97
gccaccgcaagaaucagc

SEQ ID NO: 3156638 - RNA, 13 nt, Mycobacterium bovis subsp bovis AF2122/97
gccaccgcacgca

SEQ ID NO: 3156639 - RNA, 14 nt, Mycobacterium bovis subsp bovis AF2122/97
gccaccgcacgcug

SEQ ID NO: 3156640 - RNA, 17 nt, Mycobacterium bovis subsp bovis AF2122/97
gccaccgcacgcuggcg

SEQ ID NO: 3156641 - RNA, 18 nt, Mycobacterium bovis subsp bovis AF2122/97
gccaccgcacgcuggcgg

SEQ ID NO: 3156642 - RNA, 24 nt, Mycobacterium bovis subsp bovis AF2122/97
gccaccgguuuggagcucaucgac

SEQ ID NO: 3156643 - RNA, 22 nt, Mycobacterium bovis subsp bovis AF2122/97
gccaccguaaacagcgcgccgg

SEQ ID NO: 3156644 - RNA, 16 nt, Mycobacterium bovis subsp bovis AF2122/97
gccaccguagccagca

SEQ ID NO: 3156645 - RNA, 18 nt, Mycobacterium bovis subsp bovis AF2122/97
gccaccgucacccaucga

SEQ ID NO: 3156646 - RNA, 19 nt, Mycobacterium bovis subsp bovis AF2122/97
gccaccgucaccgccguca

SEQ ID NO: 3156647 - RNA, 22 nt, Mycobacterium bovis subsp bovis AF2122/97
gccaccgucaccgccgucaccg

SEQ ID NO: 3156648 - RNA, 17 nt, Mycobacterium bovis subsp bovis AF2122/97
gccaccgucagcgcgac

SEQ ID NO: 3156649 - RNA, 18 nt, Mycobacterium bovis subsp bovis AF2122/97
gccaccgucagcgcgacc

SEQ ID NO: 3156650 - RNA, 21 nt, Mycobacterium bovis subsp bovis AF2122/97
gccaccgucagcgcgaccguc

SEQ ID NO: 3156651 - RNA, 17 nt, Mycobacterium bovis subsp bovis AF2122/97
gccaccgucaugccgac

SEQ ID NO: 3156652 - RNA, 17 nt, Mycobacterium bovis subsp bovis AF2122/97
gccaccgucauggcggg

SEQ ID NO: 3156653 - RNA, 13 nt, Mycobacterium bovis subsp bovis AF2122/97
gccaccgucgccg

SEQ ID NO: 3156654 - RNA, 14 nt, Mycobacterium bovis subsp bovis AF2122/97
gccaccgucgccgu

SEQ ID NO: 3156655 - RNA, 16 nt, Mycobacterium bovis subsp bovis AF2122/97
gccaccgucgcugccc

SEQ ID NO: 3156656 - RNA, 23 nt, Mycobacterium bovis subsp bovis AF2122/97
gccaccgucgcugcccgcgcggc

SEQ ID NO: 3156657 - RNA, 17 nt, Mycobacterium bovis subsp bovis AF2122/97
gccaccguugccgaacc

SEQ ID NO: 3156658 - RNA, 19 nt, Mycobacterium bovis subsp bovis AF2122/97
gccaccguugccgaaccac

SEQ ID NO: 3156659 - RNA, 20 nt, Mycobacterium bovis subsp bovis AF2122/97
gccaccguugccgaaccacg

SEQ ID NO: 3156660 - RNA, 15 nt, Mycobacterium bovis subsp bovis AF2122/97
gccaccguugccgcc

SEQ ID NO: 3156661 - RNA, 17 nt, Mycobacterium bovis subsp bovis AF2122/97
gccaccguugccgccgu

SEQ ID NO: 3156662 - RNA, 22 nt, Mycobacterium bovis subsp bovis AF2122/97
gccaccguugccgccguugccg

SEQ ID NO: 3156663 - RNA, 18 nt, Mycobacterium bovis subsp bovis AF2122/97
gccaccguuugcgcaccg

SEQ ID NO: 3156664 - RNA, 15 nt, Mycobacterium bovis subsp bovis AF2122/97
gccaccucaucgcca

SEQ ID NO: 3156665 - RNA, 16 nt, Mycobacterium bovis subsp bovis AF2122/97
gccaccucaucgccau

SEQ ID NO: 3156666 - RNA, 17 nt, Mycobacterium bovis subsp bovis AF2122/97
gccaccucccacgccgc

SEQ ID NO: 3156667 - RNA, 23 nt, Mycobacterium bovis subsp bovis AF2122/97
gccaccucccacgccgccguugc

SEQ ID NO: 3156668 - RNA, 16 nt, Mycobacterium bovis subsp bovis AF2122/97
gccaccucccagggcu

SEQ ID NO: 3156669 - RNA, 20 nt, Mycobacterium bovis subsp bovis AF2122/97
gccaccucccagggcucggc

SEQ ID NO: 3156670 - RNA, 23 nt, Mycobacterium bovis subsp bovis AF2122/97
gccaccucccagggcucggcggc

SEQ ID NO: 3156671 - RNA, 15 nt, Mycobacterium bovis subsp bovis AF2122/97
gccaccuccgacggg

SEQ ID NO: 3156672 - RNA, 19 nt, Mycobacterium bovis subsp bovis AF2122/97
gccaccuccgaggccgcca

SEQ ID NO: 3156673 - RNA, 22 nt, Mycobacterium bovis subsp bovis AF2122/97
gccaccucgacggugacgacca

SEQ ID NO: 3156674 - RNA, 14 nt, Mycobacterium bovis subsp bovis AF2122/97
gccaccucgccggc

SEQ ID NO: 3156675 - RNA, 15 nt, Mycobacterium bovis subsp bovis AF2122/97
gccaccucgccggcc

SEQ ID NO: 3156676 - RNA, 14 nt, Mycobacterium bovis subsp bovis AF2122/97
gccaccucggcgcg

SEQ ID NO: 3156677 - RNA, 22 nt, Mycobacterium bovis subsp bovis AF2122/97
gccaccucggguguggucacca

SEQ ID NO: 3156678 - RNA, 17 nt, Mycobacterium bovis subsp bovis AF2122/97
gccaccucggugcggaa

SEQ ID NO: 3156679 - RNA, 22 nt, Mycobacterium bovis subsp bovis AF2122/97
gccaccucggugcggaacaccg

SEQ ID NO: 3156680 - RNA, 23 nt, Mycobacterium bovis subsp bovis AF2122/97
gccaccucggugcggaacaccgc

SEQ ID NO: 3156681 - RNA, 17 nt, Mycobacterium bovis subsp bovis AF2122/97
gccaccucuaccggugg

SEQ ID NO: 3156682 - RNA, 21 nt, Mycobacterium bovis subsp bovis AF2122/97
gccaccucuaccggugguagc

SEQ ID NO: 3156683 - RNA, 18 nt, Mycobacterium bovis subsp bovis AF2122/97
gccaccucuucucggaca

SEQ ID NO: 3156684 - RNA, 16 nt, Mycobacterium bovis subsp bovis AF2122/97
gccaccugacaaacgg

SEQ ID NO: 3156685 - RNA, 22 nt, Mycobacterium bovis subsp bovis AF2122/97
gccaccugacaaacggcuuggc

SEQ ID NO: 3156686 - RNA, 22 nt, Mycobacterium bovis subsp bovis AF2122/97
gccaccugacgugcggcgcggc

SEQ ID NO: 3156687 - RNA, 14 nt, Mycobacterium bovis subsp bovis AF2122/97
gccaccugcuggcc

SEQ ID NO: 3156688 - RNA, 16 nt, Mycobacterium bovis subsp bovis AF2122/97
gccaccuggucggcau

SEQ ID NO: 3156689 - RNA, 14 nt, Mycobacterium bovis subsp bovis AF2122/97
gccaccugugcgaa

SEQ ID NO: 3156690 - RNA, 21 nt, Mycobacterium bovis subsp bovis AF2122/97
gccaccuuagcgcuugccgcu

SEQ ID NO: 3156691 - RNA, 19 nt, Mycobacterium bovis subsp bovis AF2122/97
gccaccuuggucuucgccg

SEQ ID NO: 3156692 - RNA, 23 nt, Mycobacterium bovis subsp bovis AF2122/97
gccaccuuggucuucgccgucgg

SEQ ID NO: 3156693 - RNA, 17 nt, Mycobacterium bovis subsp bovis AF2122/97
gccaccuugugcaggcc

SEQ ID NO: 3156694 - RNA, 19 nt, Mycobacterium bovis subsp bovis AF2122/97
gccacgaacccucagccgc

SEQ ID NO: 3156695 - RNA, 13 nt, Mycobacterium bovis subsp bovis AF2122/97
gccacgaacugau

SEQ ID NO: 3156696 - RNA, 13 nt, Mycobacterium bovis subsp bovis AF2122/97
gccacgaaucgcc

SEQ ID NO: 3156697 - RNA, 13 nt, Mycobacterium bovis subsp bovis AF2122/97
gccacgacccagc

SEQ ID NO: 3156698 - RNA, 14 nt, Mycobacterium bovis subsp bovis AF2122/97
gccacgacccagca

SEQ ID NO: 3156699 - RNA, 14 nt, Mycobacterium bovis subsp bovis AF2122/97
gccacgaccgccga

SEQ ID NO: 3156700 - RNA, 18 nt, Mycobacterium bovis subsp bovis AF2122/97
gccacgaccgccgauacu

SEQ ID NO: 3156701 - RNA, 18 nt, Mycobacterium bovis subsp bovis AF2122/97
gccacgaccucgggaucg

SEQ ID NO: 3156702 - RNA, 14 nt, Mycobacterium bovis subsp bovis AF2122/97
gccacgacgaacac

SEQ ID NO: 3156703 - RNA, 19 nt, Mycobacterium bovis subsp bovis AF2122/97
gccacgacgaacaccagcg

SEQ ID NO: 3156704 - RNA, 24 nt, Mycobacterium bovis subsp bovis AF2122/97
gccacgacgacuggacaggucgcc

SEQ ID NO: 3156705 - RNA, 18 nt, Mycobacterium bovis subsp bovis AF2122/97
gccacgagcaacgggcga

SEQ ID NO: 3156706 - RNA, 20 nt, Mycobacterium bovis subsp bovis AF2122/97
gccacgagcaacgggcgaac

SEQ ID NO: 3156707 - RNA, 18 nt, Mycobacterium bovis subsp bovis AF2122/97
gccacgaggacccgucga

SEQ ID NO: 3156708 - RNA, 14 nt, Mycobacterium bovis subsp bovis AF2122/97
gccacgauccgcgg

SEQ ID NO: 3156709 - RNA, 16 nt, Mycobacterium bovis subsp bovis AF2122/97
gccacgaugucgucga

SEQ ID NO: 3156710 - RNA, 21 nt, Mycobacterium bovis subsp bovis AF2122/97
gccacgcaaaguucgucacca

SEQ ID NO: 3156711 - RNA, 17 nt, Mycobacterium bovis subsp bovis AF2122/97
gccacgcagaacacgcu

SEQ ID NO: 3156712 - RNA, 15 nt, Mycobacterium bovis subsp bovis AF2122/97
gccacgcagcacggc

SEQ ID NO: 3156713 - RNA, 17 nt, Mycobacterium bovis subsp bovis AF2122/97
gccacgcaugggccagg

SEQ ID NO: 3156714 - RNA, 18 nt, Mycobacterium bovis subsp bovis AF2122/97
gccacgcaugggccaggu

SEQ ID NO: 3156715 - RNA, 20 nt, Mycobacterium bovis subsp bovis AF2122/97
gccacgcaugggccagguca

SEQ ID NO: 3156716 - RNA, 14 nt, Mycobacterium bovis subsp bovis AF2122/97
gccacgccaccgcg

SEQ ID NO: 3156717 - RNA, 17 nt, Mycobacterium bovis subsp bovis AF2122/97
gccacgccaccgcgguc

SEQ ID NO: 3156718 - RNA, 15 nt, Mycobacterium bovis subsp bovis AF2122/97
gccacgccagccagg

SEQ ID NO: 3156719 - RNA, 17 nt, Mycobacterium bovis subsp bovis AF2122/97
gccacgccagccaggcg

SEQ ID NO: 3156720 - RNA, 12 nt, Mycobacterium bovis subsp bovis AF2122/97
gccacgccagcg

SEQ ID NO: 3156721 - RNA, 13 nt, Mycobacterium bovis subsp bovis AF2122/97
gccacgccagcgu

SEQ ID NO: 3156722 - RNA, 16 nt, Mycobacterium bovis subsp bovis AF2122/97
gccacgccagcgucga

SEQ ID NO: 3156723 - RNA, 17 nt, Mycobacterium bovis subsp bovis AF2122/97
gccacgccagcucgccg

SEQ ID NO: 3156724 - RNA, 19 nt, Mycobacterium bovis subsp bovis AF2122/97
gccacgccagcucgccggc

SEQ ID NO: 3156725 - RNA, 20 nt, Mycobacterium bovis subsp bovis AF2122/97
gccacgccagcucgccggcc

SEQ ID NO: 3156726 - RNA, 20 nt, Mycobacterium bovis subsp bovis AF2122/97
gccacgcccacaggggcagc

SEQ ID NO: 3156727 - RNA, 16 nt, Mycobacterium bovis subsp bovis AF2122/97
gccacgcccaggcaag

SEQ ID NO: 3156728 - RNA, 12 nt, Mycobacterium bovis subsp bovis AF2122/97
gccacucgauca

SEQ ID NO: 3156729 - RNA, 17 nt, Mycobacterium bovis subsp bovis AF2122/97
gccacucgaucaccggc

SEQ ID NO: 3156730 - RNA, 14 nt, Mycobacterium bovis subsp bovis AF2122/97
gccacucgccacuc

SEQ ID NO: 3156731 - RNA, 22 nt, Mycobacterium bovis subsp bovis AF2122/97
gccacucgccacucagcccgac

SEQ ID NO: 3156732 - RNA, 13 nt, Mycobacterium bovis subsp bovis AF2122/97
gccacucgcccga

SEQ ID NO: 3156733 - RNA, 18 nt, Mycobacterium bovis subsp bovis AF2122/97
gccacucgcccgauccgg

SEQ ID NO: 3156734 - RNA, 14 nt, Mycobacterium bovis subsp bovis AF2122/97
gccacucgcccgcu

SEQ ID NO: 3156735 - RNA, 15 nt, Mycobacterium bovis subsp bovis AF2122/97
gccacucgcccgcug

SEQ ID NO: 3156736 - RNA, 13 nt, Mycobacterium bovis subsp bovis AF2122/97
gccacucggcccg

SEQ ID NO: 3156737 - RNA, 21 nt, Mycobacterium bovis subsp bovis AF2122/97
gccacucgggacuucccgcga

SEQ ID NO: 3156738 - RNA, 14 nt, Mycobacterium bovis subsp bovis AF2122/97
gccacucuggucac

SEQ ID NO: 3156739 - RNA, 22 nt, Mycobacterium bovis subsp bovis AF2122/97
gccacugaaccguagcgcccac

SEQ ID NO: 3156740 - RNA, 13 nt, Mycobacterium bovis subsp bovis AF2122/97
gccacugaccgcg

SEQ ID NO: 3156741 - RNA, 21 nt, Mycobacterium bovis subsp bovis AF2122/97
gccacugaccgcgaucgccga

SEQ ID NO: 3156742 - RNA, 12 nt, Mycobacterium bovis subsp bovis AF2122/97
gccacugagcca

SEQ ID NO: 3156743 - RNA, 16 nt, Mycobacterium bovis subsp bovis AF2122/97
gccacugccggugggc

SEQ ID NO: 3156744 - RNA, 18 nt, Mycobacterium bovis subsp bovis AF2122/97
gccacugccggugggcgu

SEQ ID NO: 3156745 - RNA, 14 nt, Mycobacterium bovis subsp bovis AF2122/97
gccacugccguugc

SEQ ID NO: 3156746 - RNA, 15 nt, Mycobacterium bovis subsp bovis AF2122/97
gccacugccguugcc

SEQ ID NO: 3156747 - RNA, 18 nt, Mycobacterium bovis subsp bovis AF2122/97
gccacugccguugccgcc

SEQ ID NO: 3156748 - RNA, 20 nt, Mycobacterium bovis subsp bovis AF2122/97
gccacugccguugccgccgg

SEQ ID NO: 3156749 - RNA, 12 nt, Mycobacterium bovis subsp bovis AF2122/97
gccacugcggca

SEQ ID NO: 3156750 - RNA, 21 nt, Mycobacterium bovis subsp bovis AF2122/97
gccacugcguuccaucgccga

SEQ ID NO: 3156751 - RNA, 16 nt, Mycobacterium bovis subsp bovis AF2122/97
gccacugcuuccggaa

SEQ ID NO: 3156752 - RNA, 14 nt, Mycobacterium bovis subsp bovis AF2122/97
gccacuggccgguu

SEQ ID NO: 3156753 - RNA, 23 nt, Mycobacterium bovis subsp bovis AF2122/97
gccacuguugaagaagcccgaag

SEQ ID NO: 3156754 - RNA, 23 nt, Mycobacterium bovis subsp bovis AF2122/97
gccacuucccccggguccgccgu

SEQ ID NO: 3156755 - RNA, 17 nt, Mycobacterium bovis subsp bovis AF2122/97
gccacuugaugccgcac

SEQ ID NO: 3156756 - RNA, 18 nt, Mycobacterium bovis subsp bovis AF2122/97
gccacuuggacgaacaca

SEQ ID NO: 3156757 - RNA, 22 nt, Mycobacterium bovis subsp bovis AF2122/97
gccagaaaccccaaacaacccc

SEQ ID NO: 3156758 - RNA, 14 nt, Mycobacterium bovis subsp bovis AF2122/97
gccagaaacccggc

SEQ ID NO: 3156759 - RNA, 17 nt, Mycobacterium bovis subsp bovis AF2122/97
gccagaaacccggcgac

SEQ ID NO: 3156760 - RNA, 19 nt, Mycobacterium bovis subsp bovis AF2122/97
gccagaaacccggcgacca

SEQ ID NO: 3156761 - RNA, 17 nt, Mycobacterium bovis subsp bovis AF2122/97
gccagaacgacaccgcu

SEQ ID NO: 3156762 - RNA, 15 nt, Mycobacterium bovis subsp bovis AF2122/97
gccagaacggcgucg

SEQ ID NO: 3156763 - RNA, 17 nt, Mycobacterium bovis subsp bovis AF2122/97
gccagaacggcgucgaa

SEQ ID NO: 3156764 - RNA, 15 nt, Mycobacterium bovis subsp bovis AF2122/97
gccagaacguggcca

SEQ ID NO: 3156765 - RNA, 16 nt, Mycobacterium bovis subsp bovis AF2122/97
gccagaagaccuggcg

SEQ ID NO: 3156766 - RNA, 17 nt, Mycobacterium bovis subsp bovis AF2122/97
gccagaaugggcggcau

SEQ ID NO: 3156767 - RNA, 17 nt, Mycobacterium bovis subsp bovis AF2122/97
gccagaauugccggcga

SEQ ID NO: 3156768 - RNA, 13 nt, Mycobacterium bovis subsp bovis AF2122/97
gccagaccagggc

SEQ ID NO: 3156769 - RNA, 16 nt, Mycobacterium bovis subsp bovis AF2122/97
gccagaccagggcagc

SEQ ID NO: 3156770 - RNA, 18 nt, Mycobacterium bovis subsp bovis AF2122/97
gccagaccagggcagcgg

SEQ ID NO: 3156771 - RNA, 19 nt, Mycobacterium bovis subsp bovis AF2122/97
gccagaccagggcagcggc

SEQ ID NO: 3156772 - RNA, 21 nt, Mycobacterium bovis subsp bovis AF2122/97
gccagaccagggcagcggcca

SEQ ID NO: 3156773 - RNA, 18 nt, Mycobacterium bovis subsp bovis AF2122/97
gccagacccaccaccgca

SEQ ID NO: 3156774 - RNA, 11 nt, Mycobacterium bovis subsp bovis AF2122/97
gccagacccga

SEQ ID NO: 3156775 - RNA, 22 nt, Mycobacterium bovis subsp bovis AF2122/97
gccagacccgaauccaccagcu

SEQ ID NO: 3156776 - RNA, 16 nt, Mycobacterium bovis subsp bovis AF2122/97
gccagacccuggccgu

SEQ ID NO: 3156777 - RNA, 14 nt, Mycobacterium bovis subsp bovis AF2122/97
gccagaccgcacca

SEQ ID NO: 3156778 - RNA, 15 nt, Mycobacterium bovis subsp bovis AF2122/97
gccagaccgcgcgca

SEQ ID NO: 3156779 - RNA, 14 nt, Mycobacterium bovis subsp bovis AF2122/97
gccagaccgcggcg

SEQ ID NO: 3156780 - RNA, 13 nt, Mycobacterium bovis subsp bovis AF2122/97
gccagagaucagc

SEQ ID NO: 3156781 - RNA, 13 nt, Mycobacterium bovis subsp bovis AF2122/97
gccagagccgcgc

SEQ ID NO: 3156782 - RNA, 18 nt, Mycobacterium bovis subsp bovis AF2122/97
gccagagcggaaaaucac

SEQ ID NO: 3156783 - RNA, 23 nt, Mycobacterium bovis subsp bovis AF2122/97
gccagagucggagacccguccgg

SEQ ID NO: 3156784 - RNA, 14 nt, Mycobacterium bovis subsp bovis AF2122/97
gccagauaggcacc

SEQ ID NO: 3156785 - RNA, 19 nt, Mycobacterium bovis subsp bovis AF2122/97
gccagauagguuccaccgg

SEQ ID NO: 3156786 - RNA, 19 nt, Mycobacterium bovis subsp bovis AF2122/97
gccagauaguuguucgacu

SEQ ID NO: 3156787 - RNA, 17 nt, Mycobacterium bovis subsp bovis AF2122/97
gccagaucaccgucgac

SEQ ID NO: 3156788 - RNA, 16 nt, Mycobacterium bovis subsp bovis AF2122/97
gccagaucagcaccga

SEQ ID NO: 3156789 - RNA, 23 nt, Mycobacterium bovis subsp bovis AF2122/97
gccagaucagcaccgacagcccg

SEQ ID NO: 3156790 - RNA, 18 nt, Mycobacterium bovis subsp bovis AF2122/97
gccagaucagccgccgcc

SEQ ID NO: 3156791 - RNA, 16 nt, Mycobacterium bovis subsp bovis AF2122/97
gccagauccgucagcu

SEQ ID NO: 3156792 - RNA, 20 nt, Mycobacterium bovis subsp bovis AF2122/97
gccagaucgaacgcagccag

SEQ ID NO: 3156793 - RNA, 21 nt, Mycobacterium bovis subsp bovis AF2122/97
gccagaucgaacgcagccagc

SEQ ID NO: 3156794 - RNA, 18 nt, Mycobacterium bovis subsp bovis AF2122/97
gccagaucgaagcgcagc

SEQ ID NO: 3156795 - RNA, 20 nt, Mycobacterium bovis subsp bovis AF2122/97
gccagaucgaagcgcagcac

SEQ ID NO: 3156796 - RNA, 15 nt, Mycobacterium bovis subsp bovis AF2122/97
gccagaucgccgggc

SEQ ID NO: 3156797 - RNA, 18 nt, Mycobacterium bovis subsp bovis AF2122/97
gccagaucgccgggcuug

SEQ ID NO: 3156798 - RNA, 15 nt, Mycobacterium bovis subsp bovis AF2122/97
gccagaucgcuagga

SEQ ID NO: 3156799 - RNA, 22 nt, Mycobacterium bovis subsp bovis AF2122/97
gccagaucgcuaggaccgcggu

SEQ ID NO: 3156800 - RNA, 15 nt, Mycobacterium bovis subsp bovis AF2122/97
gccagaucggucggc

SEQ ID NO: 3156801 - RNA, 16 nt, Mycobacterium bovis subsp bovis AF2122/97
gccagaucggucggcc

SEQ ID NO: 3156802 - RNA, 18 nt, Mycobacterium bovis subsp bovis AF2122/97
gccagaucggucggccaa

SEQ ID NO: 3156803 - RNA, 19 nt, Mycobacterium bovis subsp bovis AF2122/97
gccagaucucgcgcgcggc

SEQ ID NO: 3156804 - RNA, 20 nt, Mycobacterium bovis subsp bovis AF2122/97
gccagaucucgcgcgcggcg

SEQ ID NO: 3156805 - RNA, 22 nt, Mycobacterium bovis subsp bovis AF2122/97
gccagaucucgcgcgcggcgac

SEQ ID NO: 3156806 - RNA, 14 nt, Mycobacterium bovis subsp bovis AF2122/97
gccagaugaugcca

SEQ ID NO: 3156807 - RNA, 15 nt, Mycobacterium bovis subsp bovis AF2122/97
gccagaugguggcau

SEQ ID NO: 3156808 - RNA, 14 nt, Mycobacterium bovis subsp bovis AF2122/97
gccagauuggcgcu

SEQ ID NO: 3156809 - RNA, 19 nt, Mycobacterium bovis subsp bovis AF2122/97
gccagauuggcgcugcccg

SEQ ID NO: 3156810 - RNA, 20 nt, Mycobacterium bovis subsp bovis AF2122/97
gccagauuugacgacaaacg

SEQ ID NO: 3156811 - RNA, 14 nt, Mycobacterium bovis subsp bovis AF2122/97
gccagcaaaccuuc

SEQ ID NO: 3156812 - RNA, 21 nt, Mycobacterium bovis subsp bovis AF2122/97
gccagcaacgguuggucgaac

SEQ ID NO: 3156813 - RNA, 15 nt, Mycobacterium bovis subsp bovis AF2122/97
gccagcaacgucggu

SEQ ID NO: 3156814 - RNA, 17 nt, Mycobacterium bovis subsp bovis AF2122/97
gccagcaacugccgcac

SEQ ID NO: 3156815 - RNA, 20 nt, Mycobacterium bovis subsp bovis AF2122/97
gccagccacuccucggugug

SEQ ID NO: 3156816 - RNA, 15 nt, Mycobacterium bovis subsp bovis AF2122/97
gccagccagcgggcg

SEQ ID NO: 3156817 - RNA, 15 nt, Mycobacterium bovis subsp bovis AF2122/97
gccagccagcgggug

SEQ ID NO: 3156818 - RNA, 14 nt, Mycobacterium bovis subsp bovis AF2122/97
gccagccaggcgaa

SEQ ID NO: 3156819 - RNA, 21 nt, Mycobacterium bovis subsp bovis AF2122/97
gccagccaggcgaaguacccg

SEQ ID NO: 3156820 - RNA, 23 nt, Mycobacterium bovis subsp bovis AF2122/97
gccagccauggcagcgccgcagc

SEQ ID NO: 3156821 - RNA, 12 nt, Mycobacterium bovis subsp bovis AF2122/97
gccagcccagca

SEQ ID NO: 3156822 - RNA, 14 nt, Mycobacterium bovis subsp bovis AF2122/97
gccagcccagcacg

SEQ ID NO: 3156823 - RNA, 13 nt, Mycobacterium bovis subsp bovis AF2122/97
gccagcccagccg

SEQ ID NO: 3156824 - RNA, 15 nt, Mycobacterium bovis subsp bovis AF2122/97
gccagcccagccgcc

SEQ ID NO: 3156825 - RNA, 15 nt, Mycobacterium bovis subsp bovis AF2122/97
gccagcccagccggg

SEQ ID NO: 3156826 - RNA, 17 nt, Mycobacterium bovis subsp bovis AF2122/97
gccagcccagggugucc

SEQ ID NO: 3156827 - RNA, 24 nt, Mycobacterium bovis subsp bovis AF2122/97
gccagccccagcguucccgccggc

SEQ ID NO: 3156828 - RNA, 22 nt, Mycobacterium bovis subsp bovis AF2122/97
gccagccccauugccgucgcgg

SEQ ID NO: 3156829 - RNA, 13 nt, Mycobacterium bovis subsp bovis AF2122/97
gccagccccgcgc

SEQ ID NO: 3156830 - RNA, 15 nt, Mycobacterium bovis subsp bovis AF2122/97
gccagccccgcgccc

SEQ ID NO: 3156831 - RNA, 18 nt, Mycobacterium bovis subsp bovis AF2122/97
gccagccccgcgcccacc

SEQ ID NO: 3156832 - RNA, 15 nt, Mycobacterium bovis subsp bovis AF2122/97
gccagcccgagcucg

SEQ ID NO: 3156833 - RNA, 16 nt, Mycobacterium bovis subsp bovis AF2122/97
gccagcccggcgugca

SEQ ID NO: 3156834 - RNA, 18 nt, Mycobacterium bovis subsp bovis AF2122/97
gccagcccguugcaggac

SEQ ID NO: 3156835 - RNA, 13 nt, Mycobacterium bovis subsp bovis AF2122/97
gccagccgaccga

SEQ ID NO: 3156836 - RNA, 16 nt, Mycobacterium bovis subsp bovis AF2122/97
gccagccgacgcggcg

SEQ ID NO: 3156837 - RNA, 17 nt, Mycobacterium bovis subsp bovis AF2122/97
gccagccgacgcggcgg

SEQ ID NO: 3156838 - RNA, 15 nt, Mycobacterium bovis subsp bovis AF2122/97
gccagccgcacgguu

SEQ ID NO: 3156839 - RNA, 14 nt, Mycobacterium bovis subsp bovis AF2122/97
gccagccgcgagcc

SEQ ID NO: 3156840 - RNA, 20 nt, Mycobacterium bovis subsp bovis AF2122/97
gccagccgcgagccggugau

SEQ ID NO: 3156841 - RNA, 11 nt, Mycobacterium bovis subsp bovis AF2122/97
gccagccgcgc

SEQ ID NO: 3156842 - RNA, 21 nt, Mycobacterium bovis subsp bovis AF2122/97
gccagccgcgcuagcucggcc

SEQ ID NO: 3156843 - RNA, 13 nt, Mycobacterium bovis subsp bovis AF2122/97
gccagccgcggcc

SEQ ID NO: 3156844 - RNA, 21 nt, Mycobacterium bovis subsp bovis AF2122/97
gccagccgcucacccggucgc

SEQ ID NO: 3156845 - RNA, 21 nt, Mycobacterium bovis subsp bovis AF2122/97
gccagccggauguuggucggc

SEQ ID NO: 3156846 - RNA, 24 nt, Mycobacterium bovis subsp bovis AF2122/97
gccagccggauguuggucggcuga

SEQ ID NO: 3156847 - RNA, 14 nt, Mycobacterium bovis subsp bovis AF2122/97
gccagccggccgcg

SEQ ID NO: 3156848 - RNA, 18 nt, Mycobacterium bovis subsp bovis AF2122/97
gccagccggccgcgaccg

SEQ ID NO: 3156849 - RNA, 20 nt, Mycobacterium bovis subsp bovis AF2122/97
gccagccggccgcgaccgcg

SEQ ID NO: 3156850 - RNA, 13 nt, Mycobacterium bovis subsp bovis AF2122/97
gccagccggcgca

SEQ ID NO: 3156851 - RNA, 14 nt, Mycobacterium bovis subsp bovis AF2122/97
gccagccggcgcac

SEQ ID NO: 3156852 - RNA, 22 nt, Mycobacterium bovis subsp bovis AF2122/97
gccagccggucgaugccgaugc

SEQ ID NO: 3156853 - RNA, 16 nt, Mycobacterium bovis subsp bovis AF2122/97
gccagccgucaccgcg

SEQ ID NO: 3156854 - RNA, 21 nt, Mycobacterium bovis subsp bovis AF2122/97
gccagccgucgucagguggcc

SEQ ID NO: 3156855 - RNA, 23 nt, Mycobacterium bovis subsp bovis AF2122/97
gccagccgucgucagguggccaa

SEQ ID NO: 3156856 - RNA, 14 nt, Mycobacterium bovis subsp bovis AF2122/97
gccagccgugcagg

SEQ ID NO: 3156857 - RNA, 20 nt, Mycobacterium bovis subsp bovis AF2122/97
gccagccguucucgcccacc

SEQ ID NO: 3156858 - RNA, 20 nt, Mycobacterium bovis subsp bovis AF2122/97
gccagccucaucugaggcuu

SEQ ID NO: 3156859 - RNA, 14 nt, Mycobacterium bovis subsp bovis AF2122/97
gccagccuccacca

SEQ ID NO: 3156860 - RNA, 15 nt, Mycobacterium bovis subsp bovis AF2122/97
gccagccuccaccag

SEQ ID NO: 3156861 - RNA, 15 nt, Mycobacterium bovis subsp bovis AF2122/97
gccagccugcuggcc

SEQ ID NO: 3156862 - RNA, 20 nt, Mycobacterium bovis subsp bovis AF2122/97
gccagccugcuggccgcggc

SEQ ID NO: 3156863 - RNA, 21 nt, Mycobacterium bovis subsp bovis AF2122/97
gccagccugugcugccaacgg

SEQ ID NO: 3156864 - RNA, 23 nt, Mycobacterium bovis subsp bovis AF2122/97
gccagcgaaauacagggugucac

SEQ ID NO: 3156865 - RNA, 19 nt, Mycobacterium bovis subsp bovis AF2122/97
gccagcgagaucagcaugc

SEQ ID NO: 3156866 - RNA, 20 nt, Mycobacterium bovis subsp bovis AF2122/97
gccagcgagcauaccgccgc

SEQ ID NO: 3156867 - RNA, 23 nt, Mycobacterium bovis subsp bovis AF2122/97
gccagcgagcauaccgccgcugc

SEQ ID NO: 3156868 - RNA, 12 nt, Mycobacterium bovis subsp bovis AF2122/97
gccagcgagcgc

SEQ ID NO: 3156869 - RNA, 19 nt, Mycobacterium bovis subsp bovis AF2122/97
gccagcgauaucggcggcu

SEQ ID NO: 3156870 - RNA, 22 nt, Mycobacterium bovis subsp bovis AF2122/97
gccagcgaugugaaccgggcac

SEQ ID NO: 3156871 - RNA, 16 nt, Mycobacterium bovis subsp bovis AF2122/97
gccagcgcaccgccga

SEQ ID NO: 3156872 - RNA, 20 nt, Mycobacterium bovis subsp bovis AF2122/97
gccagcgcaccgccgaugug

SEQ ID NO: 3156873 - RNA, 15 nt, Mycobacterium bovis subsp bovis AF2122/97
gccagcgcagcaccg

SEQ ID NO: 3156874 - RNA, 16 nt, Mycobacterium bovis subsp bovis AF2122/97
gccagcgcagccaggc

SEQ ID NO: 3156875 - RNA, 19 nt, Mycobacterium bovis subsp bovis AF2122/97
gccagcgcagccaggcugc

SEQ ID NO: 3156876 - RNA, 13 nt, Mycobacterium bovis subsp bovis AF2122/97
gccagcgccaccg

SEQ ID NO: 3156877 - RNA, 16 nt, Mycobacterium bovis subsp bovis AF2122/97
gccagcgccaccguua

SEQ ID NO: 3156878 - RNA, 14 nt, Mycobacterium bovis subsp bovis AF2122/97
gccagcgccacugg

SEQ ID NO: 3156879 - RNA, 11 nt, Mycobacterium bovis subsp bovis AF2122/97
gccagcgcccc

SEQ ID NO: 3156880 - RNA, 15 nt, Mycobacterium bovis subsp bovis AF2122/97
gccagcgccccgcgg

SEQ ID NO: 3156881 - RNA, 12 nt, Mycobacterium bovis subsp bovis AF2122/97
gccagcgcccgc

SEQ ID NO: 3156882 - RNA, 13 nt, Mycobacterium bovis subsp bovis AF2122/97
gccagcgcccgca

SEQ ID NO: 3156883 - RNA, 15 nt, Mycobacterium bovis subsp bovis AF2122/97
gccagcgcccgcagg

SEQ ID NO: 3156884 - RNA, 13 nt, Mycobacterium bovis subsp bovis AF2122/97
gccagcgccgccg

SEQ ID NO: 3156885 - RNA, 14 nt, Mycobacterium bovis subsp bovis AF2122/97
gccagcgccgccga

SEQ ID NO: 3156886 - RNA, 15 nt, Mycobacterium bovis subsp bovis AF2122/97
gccagcgccgccgag

SEQ ID NO: 3156887 - RNA, 19 nt, Mycobacterium bovis subsp bovis AF2122/97
gccagcgccgccgaggucg

SEQ ID NO: 3156888 - RNA, 17 nt, Mycobacterium bovis subsp bovis AF2122/97
gccagcgccgccgccga

SEQ ID NO: 3156889 - RNA, 15 nt, Mycobacterium bovis subsp bovis AF2122/97
gccagcgccgccgcg

SEQ ID NO: 3156890 - RNA, 18 nt, Mycobacterium bovis subsp bovis AF2122/97
gccagcgccgccgcgagc

SEQ ID NO: 3156891 - RNA, 14 nt, Mycobacterium bovis subsp bovis AF2122/97
gccagcgccgccgg

SEQ ID NO: 3156892 - RNA, 17 nt, Mycobacterium bovis subsp bovis AF2122/97
gccagcgccgccggagc

SEQ ID NO: 3156893 - RNA, 15 nt, Mycobacterium bovis subsp bovis AF2122/97
gccagcgccgccggc

SEQ ID NO: 3156894 - RNA, 16 nt, Mycobacterium bovis subsp bovis AF2122/97
gccagcgccgccggcg

SEQ ID NO: 3156895 - RNA, 18 nt, Mycobacterium bovis subsp bovis AF2122/97
gccagcgccgccggcgcc

SEQ ID NO: 3156896 - RNA, 14 nt, Mycobacterium bovis subsp bovis AF2122/97
gccagcgccgcggc

SEQ ID NO: 3156897 - RNA, 17 nt, Mycobacterium bovis subsp bovis AF2122/97
gccagcgccgcggcuac

SEQ ID NO: 3156898 - RNA, 12 nt, Mycobacterium bovis subsp bovis AF2122/97
gccagcgccggc

SEQ ID NO: 3156899 - RNA, 17 nt, Mycobacterium bovis subsp bovis AF2122/97
gccagcgccucggcauc

SEQ ID NO: 3156900 - RNA, 18 nt, Mycobacterium bovis subsp bovis AF2122/97
gccagcgccucggcaucg

SEQ ID NO: 3156901 - RNA, 12 nt, Mycobacterium bovis subsp bovis AF2122/97
gccagcgcgaac

SEQ ID NO: 3156902 - RNA, 15 nt, Mycobacterium bovis subsp bovis AF2122/97
gccaggaagcggugg

SEQ ID NO: 3156903 - RNA, 17 nt, Mycobacterium bovis subsp bovis AF2122/97
gccaggaagcgguggcc

SEQ ID NO: 3156904 - RNA, 18 nt, Mycobacterium bovis subsp bovis AF2122/97
gccaggaagcgguggccu

SEQ ID NO: 3156905 - RNA, 17 nt, Mycobacterium bovis subsp bovis AF2122/97
gccaggaaucccucggc

SEQ ID NO: 3156906 - RNA, 23 nt, Mycobacterium bovis subsp bovis AF2122/97
gccaggaaucccucggccgcagg

SEQ ID NO: 3156907 - RNA, 13 nt, Mycobacterium bovis subsp bovis AF2122/97
gccaggaauugcc

SEQ ID NO: 3156908 - RNA, 17 nt, Mycobacterium bovis subsp bovis AF2122/97
gccaggacaacgcaccg

SEQ ID NO: 3156909 - RNA, 17 nt, Mycobacterium bovis subsp bovis AF2122/97
gccaggacauucccgag

SEQ ID NO: 3156910 - RNA, 13 nt, Mycobacterium bovis subsp bovis AF2122/97
gccaggaccgcgc

SEQ ID NO: 3156911 - RNA, 14 nt, Mycobacterium bovis subsp bovis AF2122/97
gccaggaccgcgcc

SEQ ID NO: 3156912 - RNA, 17 nt, Mycobacterium bovis subsp bovis AF2122/97
gccaggacuggcaccgc

SEQ ID NO: 3156913 - RNA, 21 nt, Mycobacterium bovis subsp bovis AF2122/97
gccaggacuggcaccgccagc

SEQ ID NO: 3156914 - RNA, 16 nt, Mycobacterium bovis subsp bovis AF2122/97
gccaggagcgcggccc

SEQ ID NO: 3156915 - RNA, 18 nt, Mycobacterium bovis subsp bovis AF2122/97
gccaggagcgcggcccgc

SEQ ID NO: 3156916 - RNA, 20 nt, Mycobacterium bovis subsp bovis AF2122/97
gccaggagcgcggcccgccu

SEQ ID NO: 3156917 - RNA, 21 nt, Mycobacterium bovis subsp bovis AF2122/97
gccaggauaaguccggacauc

SEQ ID NO: 3156918 - RNA, 17 nt, Mycobacterium bovis subsp bovis AF2122/97
gccaggauccgaccccg

SEQ ID NO: 3156919 - RNA, 20 nt, Mycobacterium bovis subsp bovis AF2122/97
gccaggauccgaccccgcgc

SEQ ID NO: 3156920 - RNA, 13 nt, Mycobacterium bovis subsp bovis AF2122/97
gccaggaucgcgg

SEQ ID NO: 3156921 - RNA, 15 nt, Mycobacterium bovis subsp bovis AF2122/97
gccaggaucgcggcg

SEQ ID NO: 3156922 - RNA, 16 nt, Mycobacterium bovis subsp bovis AF2122/97
gccaggaucgcggcgc

SEQ ID NO: 3156923 - RNA, 20 nt, Mycobacterium bovis subsp bovis AF2122/97
gccaggaucgcggcgccguc

SEQ ID NO: 3156924 - RNA, 22 nt, Mycobacterium bovis subsp bovis AF2122/97
gccaggaucgcuacgucgaccg

SEQ ID NO: 3156925 - RNA, 22 nt, Mycobacterium bovis subsp bovis AF2122/97
gccaggaucuccccguccugcc

SEQ ID NO: 3156926 - RNA, 18 nt, Mycobacterium bovis subsp bovis AF2122/97
gccaggaucuguuugggc

SEQ ID NO: 3156927 - RNA, 22 nt, Mycobacterium bovis subsp bovis AF2122/97
gccaggaugaagacgcgggucu

SEQ ID NO: 3156928 - RNA, 23 nt, Mycobacterium bovis subsp bovis AF2122/97
gccaggaugaauuuggugaagug

SEQ ID NO: 3156929 - RNA, 22 nt, Mycobacterium bovis subsp bovis AF2122/97
gccaggcaaccggucagccugc

SEQ ID NO: 3156930 - RNA, 21 nt, Mycobacterium bovis subsp bovis AF2122/97
gccaggcacguccgaucggcg

SEQ ID NO: 3156931 - RNA, 17 nt, Mycobacterium bovis subsp bovis AF2122/97
gccaggccagugccacc

SEQ ID NO: 3156932 - RNA, 12 nt, Mycobacterium bovis subsp bovis AF2122/97
gccaggcccagc

SEQ ID NO: 3156933 - RNA, 14 nt, Mycobacterium bovis subsp bovis AF2122/97
gccaggcccagcua

SEQ ID NO: 3156934 - RNA, 12 nt, Mycobacterium bovis subsp bovis AF2122/97
gccaggcccccu

SEQ ID NO: 3156935 - RNA, 16 nt, Mycobacterium bovis subsp bovis AF2122/97
gccaggcccccucggc

SEQ ID NO: 3156936 - RNA, 13 nt, Mycobacterium bovis subsp bovis AF2122/97
gccaggcccgugc

SEQ ID NO: 3156937 - RNA, 18 nt, Mycobacterium bovis subsp bovis AF2122/97
gccaggcccucgacggcg

SEQ ID NO: 3156938 - RNA, 22 nt, Mycobacterium bovis subsp bovis AF2122/97
gccaggccgacaaugucggcga

SEQ ID NO: 3156939 - RNA, 15 nt, Mycobacterium bovis subsp bovis AF2122/97
gccaggccgaccgcg

SEQ ID NO: 3156940 - RNA, 17 nt, Mycobacterium bovis subsp bovis AF2122/97
gccaggccgaccgcgca

SEQ ID NO: 3156941 - RNA, 20 nt, Mycobacterium bovis subsp bovis AF2122/97
gccaggccgaccgcgcacau

SEQ ID NO: 3156942 - RNA, 13 nt, Mycobacterium bovis subsp bovis AF2122/97
gccaggccgagcc

SEQ ID NO: 3156943 - RNA, 12 nt, Mycobacterium bovis subsp bovis AF2122/97
gccaggccgaug

SEQ ID NO: 3156944 - RNA, 16 nt, Mycobacterium bovis subsp bovis AF2122/97
gccaggccgaugccga

SEQ ID NO: 3156945 - RNA, 16 nt, Mycobacterium bovis subsp bovis AF2122/97
gccaggccgcacagca

SEQ ID NO: 3156946 - RNA, 13 nt, Mycobacterium bovis subsp bovis AF2122/97
gccaggccggcgg

SEQ ID NO: 3156947 - RNA, 14 nt, Mycobacterium bovis subsp bovis AF2122/97
gccaggccggcggc

SEQ ID NO: 3156948 - RNA, 21 nt, Mycobacterium bovis subsp bovis AF2122/97
gccaggccguaguggccggcu

SEQ ID NO: 3156949 - RNA, 14 nt, Mycobacterium bovis subsp bovis AF2122/97
gccaggccgucggc

SEQ ID NO: 3156950 - RNA, 15 nt, Mycobacterium bovis subsp bovis AF2122/97
gccaggccgucggcg

SEQ ID NO: 3156951 - RNA, 16 nt, Mycobacterium bovis subsp bovis AF2122/97
gccaggccgucggcgu

SEQ ID NO: 3156952 - RNA, 20 nt, Mycobacterium bovis subsp bovis AF2122/97
gccaggccuuggugcggccg

SEQ ID NO: 3156953 - RNA, 19 nt, Mycobacterium bovis subsp bovis AF2122/97
gccaggcgaagucgacucg

SEQ ID NO: 3156954 - RNA, 19 nt, Mycobacterium bovis subsp bovis AF2122/97
gccaggcgauugcccgcgc

SEQ ID NO: 3156955 - RNA, 12 nt, Mycobacterium bovis subsp bovis AF2122/97
gccaggcgcagc

SEQ ID NO: 3156956 - RNA, 14 nt, Mycobacterium bovis subsp bovis AF2122/97
gccaggcgcagcug

SEQ ID NO: 3156957 - RNA, 13 nt, Mycobacterium bovis subsp bovis AF2122/97
gccaggcgcgacg

SEQ ID NO: 3156958 - RNA, 13 nt, Mycobacterium bovis subsp bovis AF2122/97
gccaggcgcgcua

SEQ ID NO: 3156959 - RNA, 16 nt, Mycobacterium bovis subsp bovis AF2122/97
gccaggcgcuuggccg

SEQ ID NO: 3156960 - RNA, 12 nt, Mycobacterium bovis subsp bovis AF2122/97
gccaggcggcaa

SEQ ID NO: 3156961 - RNA, 13 nt, Mycobacterium bovis subsp bovis AF2122/97
gccaggcggcaag

SEQ ID NO: 3156962 - RNA, 12 nt, Mycobacterium bovis subsp bovis AF2122/97
gccaggcggccg

SEQ ID NO: 3156963 - RNA, 22 nt, Mycobacterium bovis subsp bovis AF2122/97
gccaggcgguacgggucgccgg

SEQ ID NO: 3156964 - RNA, 19 nt, Mycobacterium bovis subsp bovis AF2122/97
gccaggcgguagucgucga

SEQ ID NO: 3156965 - RNA, 22 nt, Mycobacterium bovis subsp bovis AF2122/97
gccaggcgugcacaggucagcg

SEQ ID NO: 3156966 - RNA, 15 nt, Mycobacterium bovis subsp bovis AF2122/97
gccaggcuggccaac

SEQ ID NO: 3156967 - RNA, 18 nt, Mycobacterium bovis subsp bovis AF2122/97
gccaggcuugcggcaccc

SEQ ID NO: 3156968 - RNA, 18 nt, Mycobacterium bovis subsp bovis AF2122/97
gccagggaggggccguca

SEQ ID NO: 3156969 - RNA, 13 nt, Mycobacterium bovis subsp bovis AF2122/97
gccagggaucagc

SEQ ID NO: 3156970 - RNA, 20 nt, Mycobacterium bovis subsp bovis AF2122/97
gccagggaucagccgugcgg

SEQ ID NO: 3156971 - RNA, 16 nt, Mycobacterium bovis subsp bovis AF2122/97
gccagggcacguggcg

SEQ ID NO: 3156972 - RNA, 13 nt, Mycobacterium bovis subsp bovis AF2122/97
gccagggcgccga

SEQ ID NO: 3156973 - RNA, 14 nt, Mycobacterium bovis subsp bovis AF2122/97
gccagggcgccgaa

SEQ ID NO: 3156974 - RNA, 14 nt, Mycobacterium bovis subsp bovis AF2122/97
gccagggcggcauc

SEQ ID NO: 3156975 - RNA, 13 nt, Mycobacterium bovis subsp bovis AF2122/97
gccagggcgggcg

SEQ ID NO: 3156976 - RNA, 22 nt, Mycobacterium bovis subsp bovis AF2122/97
gccagggcgguggccacccggc

SEQ ID NO: 3156977 - RNA, 14 nt, Mycobacterium bovis subsp bovis AF2122/97
gccaggggcgcagc

SEQ ID NO: 3156978 - RNA, 16 nt, Mycobacterium bovis subsp bovis AF2122/97
gccaggggcgcagcgc

SEQ ID NO: 3156979 - RNA, 21 nt, Mycobacterium bovis subsp bovis AF2122/97
gccaggggugugccguggucg

SEQ ID NO: 3156980 - RNA, 23 nt, Mycobacterium bovis subsp bovis AF2122/97
gccaggggugugccguggucgaa

SEQ ID NO: 3156981 - RNA, 21 nt, Mycobacterium bovis subsp bovis AF2122/97
gccagggucacaaacccagca

SEQ ID NO: 3156982 - RNA, 15 nt, Mycobacterium bovis subsp bovis AF2122/97
gccagggucagcucg

SEQ ID NO: 3156983 - RNA, 16 nt, Mycobacterium bovis subsp bovis AF2122/97
gccagggucagcucgg

SEQ ID NO: 3156984 - RNA, 18 nt, Mycobacterium bovis subsp bovis AF2122/97
gccagggucccgccgccu

SEQ ID NO: 3156985 - RNA, 19 nt, Mycobacterium bovis subsp bovis AF2122/97
gccagggucccgccgccug

SEQ ID NO: 3156986 - RNA, 15 nt, Mycobacterium bovis subsp bovis AF2122/97
gccagggugaccagg

SEQ ID NO: 3156987 - RNA, 21 nt, Mycobacterium bovis subsp bovis AF2122/97
gccagggugaccaggccgagc

SEQ ID NO: 3156988 - RNA, 18 nt, Mycobacterium bovis subsp bovis AF2122/97
gccagggugcccucggcc

SEQ ID NO: 3156989 - RNA, 22 nt, Mycobacterium bovis subsp bovis AF2122/97
gccagugcugcaccgauucggg

SEQ ID NO: 3156990 - RNA, 17 nt, Mycobacterium bovis subsp bovis AF2122/97
gccaguggccaccauca

SEQ ID NO: 3156991 - RNA, 19 nt, Mycobacterium bovis subsp bovis AF2122/97
gccaguggccaccaucacc

SEQ ID NO: 3156992 - RNA, 12 nt, Mycobacterium bovis subsp bovis AF2122/97
gccagugggccg

SEQ ID NO: 3156993 - RNA, 23 nt, Mycobacterium bovis subsp bovis AF2122/97
gccaguggucgauuucggcgcgu

SEQ ID NO: 3156994 - RNA, 18 nt, Mycobacterium bovis subsp bovis AF2122/97
gccaguggugcaccgauu

SEQ ID NO: 3156995 - RNA, 19 nt, Mycobacterium bovis subsp bovis AF2122/97
gccagugucccgcgcggau

SEQ ID NO: 3156996 - RNA, 17 nt, Mycobacterium bovis subsp bovis AF2122/97
gccaguguggugcggcg

SEQ ID NO: 3156997 - RNA, 17 nt, Mycobacterium bovis subsp bovis AF2122/97
gccaguguugcgcugcg

SEQ ID NO: 3156998 - RNA, 19 nt, Mycobacterium bovis subsp bovis AF2122/97
gccaguguugcgcugcggc

SEQ ID NO: 3156999 - RNA, 21 nt, Mycobacterium bovis subsp bovis AF2122/97
gccaguguugcgcugcggcca

SEQ ID NO: 3157000 - RNA, 21 nt, Mycobacterium bovis subsp bovis AF2122/97
gccaguucggccuugaucgug

SEQ ID NO: 3157001 - RNA, 14 nt, Mycobacterium bovis subsp bovis AF2122/97
gccaguucggcggc

SEQ ID NO: 3157002 - RNA, 20 nt, Mycobacterium bovis subsp bovis AF2122/97
gccaguucggcggccgccgc

SEQ ID NO: 3157003 - RNA, 21 nt, Mycobacterium bovis subsp bovis AF2122/97
gccaguucggcggccgccgcg

SEQ ID NO: 3157004 - RNA, 22 nt, Mycobacterium bovis subsp bovis AF2122/97
gccaguucggcggccgccgcgu

SEQ ID NO: 3157005 - RNA, 20 nt, Mycobacterium bovis subsp bovis AF2122/97
gccaguucggcgucguccgc

SEQ ID NO: 3157006 - RNA, 15 nt, Mycobacterium bovis subsp bovis AF2122/97
gccaguucuuggcga

SEQ ID NO: 3157007 - RNA, 19 nt, Mycobacterium bovis subsp bovis AF2122/97
gccaguugcacaucggugg

SEQ ID NO: 3157008 - RNA, 22 nt, Mycobacterium bovis subsp bovis AF2122/97
gccaguuuggcgcuuuggcguu

SEQ ID NO: 3157009 - RNA, 23 nt, Mycobacterium bovis subsp bovis AF2122/97
gccaguuugggauccuggccgau

SEQ ID NO: 3157010 - RNA, 20 nt, Mycobacterium bovis subsp bovis AF2122/97
gccauaaaugcgcguucgac

SEQ ID NO: 3157011 - RNA, 23 nt, Mycobacterium bovis subsp bovis AF2122/97
gccauaaaugcgcguucgaccuc

SEQ ID NO: 3157012 - RNA, 16 nt, Mycobacterium bovis subsp bovis AF2122/97
gccauaacaccgggua

SEQ ID NO: 3157013 - RNA, 18 nt, Mycobacterium bovis subsp bovis AF2122/97
gccauaaccgguggggac

SEQ ID NO: 3157014 - RNA, 21 nt, Mycobacterium bovis subsp bovis AF2122/97
gccauaauauugccgccuccg

SEQ ID NO: 3157015 - RNA, 18 nt, Mycobacterium bovis subsp bovis AF2122/97
gccauaauucgcccgcuc

SEQ ID NO: 3157016 - RNA, 21 nt, Mycobacterium bovis subsp bovis AF2122/97
gccauaauucgcccgcucgcg

SEQ ID NO: 3157017 - RNA, 19 nt, Mycobacterium bovis subsp bovis AF2122/97
gccauacagcaccccgccg

SEQ ID NO: 3157018 - RNA, 14 nt, Mycobacterium bovis subsp bovis AF2122/97
gccauaccggccgc

SEQ ID NO: 3157019 - RNA, 22 nt, Mycobacterium bovis subsp bovis AF2122/97
gccauaccggccgccaucaucg

SEQ ID NO: 3157020 - RNA, 13 nt, Mycobacterium bovis subsp bovis AF2122/97
gccauaccucggc

SEQ ID NO: 3157021 - RNA, 15 nt, Mycobacterium bovis subsp bovis AF2122/97
gccauaccucggcga

SEQ ID NO: 3157022 - RNA, 14 nt, Mycobacterium bovis subsp bovis AF2122/97
gccauacgcgcgcg

SEQ ID NO: 3157023 - RNA, 14 nt, Mycobacterium bovis subsp bovis AF2122/97
gccauacgucgccu

SEQ ID NO: 3157024 - RNA, 14 nt, Mycobacterium bovis subsp bovis AF2122/97
gccauagcccgagc

SEQ ID NO: 3157025 - RNA, 14 nt, Mycobacterium bovis subsp bovis AF2122/97
gccauagcgccgcg

SEQ ID NO: 3157026 - RNA, 13 nt, Mycobacterium bovis subsp bovis AF2122/97
gccauagcgggcg

SEQ ID NO: 3157027 - RNA, 15 nt, Mycobacterium bovis subsp bovis AF2122/97
gccauagcgggcggu

SEQ ID NO: 3157028 - RNA, 16 nt, Mycobacterium bovis subsp bovis AF2122/97
gccauagcgggcggua

SEQ ID NO: 3157029 - RNA, 16 nt, Mycobacterium bovis subsp bovis AF2122/97
gccauaggcccacggc

SEQ ID NO: 3157030 - RNA, 18 nt, Mycobacterium bovis subsp bovis AF2122/97
gccauagugaggccgacc

SEQ ID NO: 3157031 - RNA, 19 nt, Mycobacterium bovis subsp bovis AF2122/97
gccaucaacaaggggcagc

SEQ ID NO: 3157032 - RNA, 20 nt, Mycobacterium bovis subsp bovis AF2122/97
gccaucaacaaggggcagca

SEQ ID NO: 3157033 - RNA, 21 nt, Mycobacterium bovis subsp bovis AF2122/97
gccaucaacaaggggcagcac

SEQ ID NO: 3157034 - RNA, 15 nt, Mycobacterium bovis subsp bovis AF2122/97
gccaucaaggccacc

SEQ ID NO: 3157035 - RNA, 18 nt, Mycobacterium bovis subsp bovis AF2122/97
gccaucacaucggccucu

SEQ ID NO: 3157036 - RNA, 14 nt, Mycobacterium bovis subsp bovis AF2122/97
gccaucaccccggc

SEQ ID NO: 3157037 - RNA, 12 nt, Mycobacterium bovis subsp bovis AF2122/97
gccaucacgcac

SEQ ID NO: 3157038 - RNA, 16 nt, Mycobacterium bovis subsp bovis AF2122/97
gccaucagcccggcgc

SEQ ID NO: 3157039 - RNA, 19 nt, Mycobacterium bovis subsp bovis AF2122/97
gccaucagcccggcgcgcc

SEQ ID NO: 3157040 - RNA, 17 nt, Mycobacterium bovis subsp bovis AF2122/97
gccaucagcccuucagc

SEQ ID NO: 3157041 - RNA, 15 nt, Mycobacterium bovis subsp bovis AF2122/97
gccaucagccgcugc

SEQ ID NO: 3157042 - RNA, 19 nt, Mycobacterium bovis subsp bovis AF2122/97
gccaucaucgcccugggcg

SEQ ID NO: 3157043 - RNA, 18 nt, Mycobacterium bovis subsp bovis AF2122/97
gccaucaucgcuuggccu

SEQ ID NO: 3157044 - RNA, 17 nt, Mycobacterium bovis subsp bovis AF2122/97
gccaucaugagcgaccg

SEQ ID NO: 3157045 - RNA, 15 nt, Mycobacterium bovis subsp bovis AF2122/97
gccaucauggccgug

SEQ ID NO: 3157046 - RNA, 16 nt, Mycobacterium bovis subsp bovis AF2122/97
gccaucauggcggccc

SEQ ID NO: 3157047 - RNA, 17 nt, Mycobacterium bovis subsp bovis AF2122/97
gccaucauggcggcccg

SEQ ID NO: 3157048 - RNA, 22 nt, Mycobacterium bovis subsp bovis AF2122/97
gccauccaugauggccgucagc

SEQ ID NO: 3157049 - RNA, 15 nt, Mycobacterium bovis subsp bovis AF2122/97
gccauccccgccggc

SEQ ID NO: 3157050 - RNA, 17 nt, Mycobacterium bovis subsp bovis AF2122/97
gccauccccgccggcgc

SEQ ID NO: 3157051 - RNA, 14 nt, Mycobacterium bovis subsp bovis AF2122/97
gccauccccuggcc

SEQ ID NO: 3157052 - RNA, 13 nt, Mycobacterium bovis subsp bovis AF2122/97
gccaucccgaucc

SEQ ID NO: 3157053 - RNA, 21 nt, Mycobacterium bovis subsp bovis AF2122/97
gccaucccgaucccggccagc

SEQ ID NO: 3157054 - RNA, 22 nt, Mycobacterium bovis subsp bovis AF2122/97
gccaucccgaucccggccagcu

SEQ ID NO: 3157055 - RNA, 14 nt, Mycobacterium bovis subsp bovis AF2122/97
gccaucccgccgcc

SEQ ID NO: 3157056 - RNA, 18 nt, Mycobacterium bovis subsp bovis AF2122/97
gccaucccgcguucgaga

SEQ ID NO: 3157057 - RNA, 18 nt, Mycobacterium bovis subsp bovis AF2122/97
gccauccgauggcccggc

SEQ ID NO: 3157058 - RNA, 13 nt, Mycobacterium bovis subsp bovis AF2122/97
gccauccggcggc

SEQ ID NO: 3157059 - RNA, 18 nt, Mycobacterium bovis subsp bovis AF2122/97
gccauccggcggcggcca

SEQ ID NO: 3157060 - RNA, 22 nt, Mycobacterium bovis subsp bovis AF2122/97
gccauccgugaaucgagcaccg

SEQ ID NO: 3157061 - RNA, 14 nt, Mycobacterium bovis subsp bovis AF2122/97
gccauccucgagcu

SEQ ID NO: 3157062 - RNA, 22 nt, Mycobacterium bovis subsp bovis AF2122/97
gccauccucgagcugcuggcgc

SEQ ID NO: 3157063 - RNA, 22 nt, Mycobacterium bovis subsp bovis AF2122/97
gccauccucgaguuuggccagu

SEQ ID NO: 3157064 - RNA, 20 nt, Mycobacterium bovis subsp bovis AF2122/97
gccauccuuaugcgcgguga

SEQ ID NO: 3157065 - RNA, 22 nt, Mycobacterium bovis subsp bovis AF2122/97
gccauccuuaugcgcggugacc

SEQ ID NO: 3157066 - RNA, 18 nt, Mycobacterium bovis subsp bovis AF2122/97
gccauccuucggggugaa

SEQ ID NO: 3157067 - RNA, 23 nt, Mycobacterium bovis subsp bovis AF2122/97
gccaucgaccguccgggucacca

SEQ ID NO: 3157068 - RNA, 22 nt, Mycobacterium bovis subsp bovis AF2122/97
gccaucgacgacacguugacga

SEQ ID NO: 3157069 - RNA, 15 nt, Mycobacterium bovis subsp bovis AF2122/97
gccaucgagggcauc

SEQ ID NO: 3157070 - RNA, 13 nt, Mycobacterium bovis subsp bovis AF2122/97
gccaucgaggucg

SEQ ID NO: 3157071 - RNA, 20 nt, Mycobacterium bovis subsp bovis AF2122/97
gccaucgaguccaccaccug

SEQ ID NO: 3157072 - RNA, 13 nt, Mycobacterium bovis subsp bovis AF2122/97
gccaucgccgccg

SEQ ID NO: 3157073 - RNA, 14 nt, Mycobacterium bovis subsp bovis AF2122/97
gccaucgccgccgg

SEQ ID NO: 3157074 - RNA, 16 nt, Mycobacterium bovis subsp bovis AF2122/97
gccaucgccuccagcc

SEQ ID NO: 3157075 - RNA, 16 nt, Mycobacterium bovis subsp bovis AF2122/97
gcccaccaucccgcuc

SEQ ID NO: 3157076 - RNA, 13 nt, Mycobacterium bovis subsp bovis AF2122/97
gcccaccaugauc

SEQ ID NO: 3157077 - RNA, 17 nt, Mycobacterium bovis subsp bovis AF2122/97
gcccacccauggccucc

SEQ ID NO: 3157078 - RNA, 13 nt, Mycobacterium bovis subsp bovis AF2122/97
gcccaccccggcc

SEQ ID NO: 3157079 - RNA, 18 nt, Mycobacterium bovis subsp bovis AF2122/97
gcccaccccggccgcauc

SEQ ID NO: 3157080 - RNA, 13 nt, Mycobacterium bovis subsp bovis AF2122/97
gcccacccgcgcc

SEQ ID NO: 3157081 - RNA, 18 nt, Mycobacterium bovis subsp bovis AF2122/97
gcccacccgcgccuaccc

SEQ ID NO: 3157082 - RNA, 16 nt, Mycobacterium bovis subsp bovis AF2122/97
gcccacccgggugggc

SEQ ID NO: 3157083 - RNA, 13 nt, Mycobacterium bovis subsp bovis AF2122/97
gcccaccgaaacc

SEQ ID NO: 3157084 - RNA, 12 nt, Mycobacterium bovis subsp bovis AF2122/97
gcccaccgcaac

SEQ ID NO: 3157085 - RNA, 20 nt, Mycobacterium bovis subsp bovis AF2122/97
gcccaccgcaacgcuucggc

SEQ ID NO: 3157086 - RNA, 22 nt, Mycobacterium bovis subsp bovis AF2122/97
gcccaccgcaacgcuucggcag

SEQ ID NO: 3157087 - RNA, 22 nt, Mycobacterium bovis subsp bovis AF2122/97
gcccaccgccguugggccgcgc

SEQ ID NO: 3157088 - RNA, 21 nt, Mycobacterium bovis subsp bovis AF2122/97
gcccaccgccugggcggccag

SEQ ID NO: 3157089 - RNA, 18 nt, Mycobacterium bovis subsp bovis AF2122/97
gcccaccgcugcggcacc

SEQ ID NO: 3157090 - RNA, 13 nt, Mycobacterium bovis subsp bovis AF2122/97
gcccaccggccac

SEQ ID NO: 3157091 - RNA, 14 nt, Mycobacterium bovis subsp bovis AF2122/97
gcccaccggccacu

SEQ ID NO: 3157092 - RNA, 15 nt, Mycobacterium bovis subsp bovis AF2122/97
gcccaccggcgccgc

SEQ ID NO: 3157093 - RNA, 15 nt, Mycobacterium bovis subsp bovis AF2122/97
gcccaccggcuagcu

SEQ ID NO: 3157094 - RNA, 18 nt, Mycobacterium bovis subsp bovis AF2122/97
gcccaccggucgccgcga

SEQ ID NO: 3157095 - RNA, 23 nt, Mycobacterium bovis subsp bovis AF2122/97
gcccaccggucgccgcgaagggg

SEQ ID NO: 3157096 - RNA, 12 nt, Mycobacterium bovis subsp bovis AF2122/97
gcccaccggugc

SEQ ID NO: 3157097 - RNA, 16 nt, Mycobacterium bovis subsp bovis AF2122/97
gcccaccggugccgcc

SEQ ID NO: 3157098 - RNA, 20 nt, Mycobacterium bovis subsp bovis AF2122/97
gcccaccggugccgcccgcg

SEQ ID NO: 3157099 - RNA, 21 nt, Mycobacterium bovis subsp bovis AF2122/97
gcccaccggugccgcccgcgc

SEQ ID NO: 3157100 - RNA, 22 nt, Mycobacterium bovis subsp bovis AF2122/97
gcccaccggugccgcccgcgcc

SEQ ID NO: 3157101 - RNA, 20 nt, Mycobacterium bovis subsp bovis AF2122/97
gcccaccgucugcuggccgg

SEQ ID NO: 3157102 - RNA, 23 nt, Mycobacterium bovis subsp bovis AF2122/97
gcccaccucaccgaucucgacca

SEQ ID NO: 3157103 - RNA, 13 nt, Mycobacterium bovis subsp bovis AF2122/97
gcccaccuccugg

SEQ ID NO: 3157104 - RNA, 19 nt, Mycobacterium bovis subsp bovis AF2122/97
gcccaccucgaucgcgccg

SEQ ID NO: 3157105 - RNA, 21 nt, Mycobacterium bovis subsp bovis AF2122/97
gcccaccucgaucgcgccguc

SEQ ID NO: 3157106 - RNA, 17 nt, Mycobacterium bovis subsp bovis AF2122/97
gcccacgaaugcaagac

SEQ ID NO: 3157107 - RNA, 15 nt, Mycobacterium bovis subsp bovis AF2122/97
gcccacgaucgcguc

SEQ ID NO: 3157108 - RNA, 20 nt, Mycobacterium bovis subsp bovis AF2122/97
gcccacgcacagcaacgccc

SEQ ID NO: 3157109 - RNA, 17 nt, Mycobacterium bovis subsp bovis AF2122/97
gcccacgccggggcaac

SEQ ID NO: 3157110 - RNA, 22 nt, Mycobacterium bovis subsp bovis AF2122/97
gcccacgcgcacucgaccagga

SEQ ID NO: 3157111 - RNA, 16 nt, Mycobacterium bovis subsp bovis AF2122/97
gcccacggcaccacca

SEQ ID NO: 3157112 - RNA, 15 nt, Mycobacterium bovis subsp bovis AF2122/97
gcccacggcgaccac

SEQ ID NO: 3157113 - RNA, 16 nt, Mycobacterium bovis subsp bovis AF2122/97
gcccacggcgaccacg

SEQ ID NO: 3157114 - RNA, 16 nt, Mycobacterium bovis subsp bovis AF2122/97
gcccacgggccggccg

SEQ ID NO: 3157115 - RNA, 12 nt, Mycobacterium bovis subsp bovis AF2122/97
gcccacggugcc

SEQ ID NO: 3157116 - RNA, 18 nt, Mycobacterium bovis subsp bovis AF2122/97
gcccacggugucccgcga

SEQ ID NO: 3157117 - RNA, 15 nt, Mycobacterium bovis subsp bovis AF2122/97
gcccacguggggccg

SEQ ID NO: 3157118 - RNA, 16 nt, Mycobacterium bovis subsp bovis AF2122/97
gcccacguggggccgg

SEQ ID NO: 3157119 - RNA, 18 nt, Mycobacterium bovis subsp bovis AF2122/97
gcccacguggggccgggg

SEQ ID NO: 3157120 - RNA, 16 nt, Mycobacterium bovis subsp bovis AF2122/97
gcccacguugacggcg

SEQ ID NO: 3157121 - RNA, 19 nt, Mycobacterium bovis subsp bovis AF2122/97
gcccacguugacggcgaac

SEQ ID NO: 3157122 - RNA, 23 nt, Mycobacterium bovis subsp bovis AF2122/97
gcccacguugacggcgaacccgc

SEQ ID NO: 3157123 - RNA, 19 nt, Mycobacterium bovis subsp bovis AF2122/97
gcccacguuggccccgcgg

SEQ ID NO: 3157124 - RNA, 19 nt, Mycobacterium bovis subsp bovis AF2122/97
gcccacuagcagggggacc

SEQ ID NO: 3157125 - RNA, 24 nt, Mycobacterium bovis subsp bovis AF2122/97
gcccacucacacaaccgacggguc

SEQ ID NO: 3157126 - RNA, 15 nt, Mycobacterium bovis subsp bovis AF2122/97
gcccacuccagcagc

SEQ ID NO: 3157127 - RNA, 21 nt, Mycobacterium bovis subsp bovis AF2122/97
gcccacuccagcagcucgccg

SEQ ID NO: 3157128 - RNA, 20 nt, Mycobacterium bovis subsp bovis AF2122/97
gcccacucucgccacgccgu

SEQ ID NO: 3157129 - RNA, 22 nt, Mycobacterium bovis subsp bovis AF2122/97
gcccacucucgccacgccgugg

SEQ ID NO: 3157130 - RNA, 15 nt, Mycobacterium bovis subsp bovis AF2122/97
gcccagaccgccgac

SEQ ID NO: 3157131 - RNA, 17 nt, Mycobacterium bovis subsp bovis AF2122/97
gcccagaccgccgacgc

SEQ ID NO: 3157132 - RNA, 16 nt, Mycobacterium bovis subsp bovis AF2122/97
gcccagagccgcugcg

SEQ ID NO: 3157133 - RNA, 18 nt, Mycobacterium bovis subsp bovis AF2122/97
gcccagagccgcugcggc

SEQ ID NO: 3157134 - RNA, 17 nt, Mycobacterium bovis subsp bovis AF2122/97
gcccagagugaauccgg

SEQ ID NO: 3157135 - RNA, 14 nt, Mycobacterium bovis subsp bovis AF2122/97
gcccagauagagcu

SEQ ID NO: 3157136 - RNA, 17 nt, Mycobacterium bovis subsp bovis AF2122/97
gcccagauagagcuggu

SEQ ID NO: 3157137 - RNA, 16 nt, Mycobacterium bovis subsp bovis AF2122/97
gcccagauccagcaac

SEQ ID NO: 3157138 - RNA, 22 nt, Mycobacterium bovis subsp bovis AF2122/97
gcccagauccagcaacgcggug

SEQ ID NO: 3157139 - RNA, 15 nt, Mycobacterium bovis subsp bovis AF2122/97
gcccagaucgccgag

SEQ ID NO: 3157140 - RNA, 21 nt, Mycobacterium bovis subsp bovis AF2122/97
gcccagaucgguugaucggcc

SEQ ID NO: 3157141 - RNA, 13 nt, Mycobacterium bovis subsp bovis AF2122/97
gcccagaugucuu

SEQ ID NO: 3157142 - RNA, 20 nt, Mycobacterium bovis subsp bovis AF2122/97
gcccagauguuuagcguccg

SEQ ID NO: 3157143 - RNA, 18 nt, Mycobacterium bovis subsp bovis AF2122/97
gcccagcaaccgcucggc

SEQ ID NO: 3157144 - RNA, 21 nt, Mycobacterium bovis subsp bovis AF2122/97
gcccagcaaccgcucggcgau

SEQ ID NO: 3157145 - RNA, 15 nt, Mycobacterium bovis subsp bovis AF2122/97
gcccagcaccaccgc

SEQ ID NO: 3157146 - RNA, 22 nt, Mycobacterium bovis subsp bovis AF2122/97
gcccagcaccaccgcggugugc

SEQ ID NO: 3157147 - RNA, 12 nt, Mycobacterium bovis subsp bovis AF2122/97
gcccagcacccc

SEQ ID NO: 3157148 - RNA, 14 nt, Mycobacterium bovis subsp bovis AF2122/97
gcccagcagcaccu

SEQ ID NO: 3157149 - RNA, 16 nt, Mycobacterium bovis subsp bovis AF2122/97
gcccagcagcgcaacc

SEQ ID NO: 3157150 - RNA, 20 nt, Mycobacterium bovis subsp bovis AF2122/97
gcccagcaggcccuuggcga

SEQ ID NO: 3157151 - RNA, 20 nt, Mycobacterium bovis subsp bovis AF2122/97
gcccagcaggucgucggcgu

SEQ ID NO: 3157152 - RNA, 14 nt, Mycobacterium bovis subsp bovis AF2122/97
gcccagcagguucc

SEQ ID NO: 3157153 - RNA, 22 nt, Mycobacterium bovis subsp bovis AF2122/97
gcccagcaucucggcggccaac

SEQ ID NO: 3157154 - RNA, 17 nt, Mycobacterium bovis subsp bovis AF2122/97
gcccagccacugacggc

SEQ ID NO: 3157155 - RNA, 21 nt, Mycobacterium bovis subsp bovis AF2122/97
gcccagccacugacggcuucc

SEQ ID NO: 3157156 - RNA, 14 nt, Mycobacterium bovis subsp bovis AF2122/97
gcccagcccggcgu

SEQ ID NO: 3157157 - RNA, 14 nt, Mycobacterium bovis subsp bovis AF2122/97
gcccagccgagcgg

SEQ ID NO: 3157158 - RNA, 19 nt, Mycobacterium bovis subsp bovis AF2122/97
gcccagccgagcggcggca

SEQ ID NO: 3157159 - RNA, 21 nt, Mycobacterium bovis subsp bovis AF2122/97
gcccagccgagcggcggcacu

SEQ ID NO: 3157160 - RNA, 22 nt, Mycobacterium bovis subsp bovis AF2122/97
gcccagccgagcggcggcacug

SEQ ID NO: 3157161 - RNA, 24 nt, Mycobacterium bovis subsp bovis AF2122/97
gcccaucccggccgaguaccagcc

SEQ ID NO: 3157162 - RNA, 21 nt, Mycobacterium bovis subsp bovis AF2122/97
gcccaucccgguuccggcgau

SEQ ID NO: 3157163 - RNA, 17 nt, Mycobacterium bovis subsp bovis AF2122/97
gcccauccggccgucgg

SEQ ID NO: 3157164 - RNA, 15 nt, Mycobacterium bovis subsp bovis AF2122/97
gcccaucgcaagcug

SEQ ID NO: 3157165 - RNA, 17 nt, Mycobacterium bovis subsp bovis AF2122/97
gcccaucgcgacggccc

SEQ ID NO: 3157166 - RNA, 20 nt, Mycobacterium bovis subsp bovis AF2122/97
gcccaucgcgacuagacgcc

SEQ ID NO: 3157167 - RNA, 22 nt, Mycobacterium bovis subsp bovis AF2122/97
gcccaucgcgacuagacgccgc

SEQ ID NO: 3157168 - RNA, 17 nt, Mycobacterium bovis subsp bovis AF2122/97
gcccaucucaugcaucu

SEQ ID NO: 3157169 - RNA, 15 nt, Mycobacterium bovis subsp bovis AF2122/97
gcccaucucgggcag

SEQ ID NO: 3157170 - RNA, 19 nt, Mycobacterium bovis subsp bovis AF2122/97
gcccaucucgggcaggccg

SEQ ID NO: 3157171 - RNA, 23 nt, Mycobacterium bovis subsp bovis AF2122/97
gcccaucucgggcaggccgucga

SEQ ID NO: 3157172 - RNA, 21 nt, Mycobacterium bovis subsp bovis AF2122/97
gcccaugaccggccgccaacu

SEQ ID NO: 3157173 - RNA, 18 nt, Mycobacterium bovis subsp bovis AF2122/97
gcccaugaucucggcgaa

SEQ ID NO: 3157174 - RNA, 18 nt, Mycobacterium bovis subsp bovis AF2122/97
gcccaugauggccgcggc

SEQ ID NO: 3157175 - RNA, 19 nt, Mycobacterium bovis subsp bovis AF2122/97
gcccaugauggccgcggcu

SEQ ID NO: 3157176 - RNA, 16 nt, Mycobacterium bovis subsp bovis AF2122/97
gcccaugcagcggcga

SEQ ID NO: 3157177 - RNA, 18 nt, Mycobacterium bovis subsp bovis AF2122/97
gcccaugcgccacgccac

SEQ ID NO: 3157178 - RNA, 14 nt, Mycobacterium bovis subsp bovis AF2122/97
gcccauggacccau

SEQ ID NO: 3157179 - RNA, 16 nt, Mycobacterium bovis subsp bovis AF2122/97
gcccauggcagcccgu

SEQ ID NO: 3157180 - RNA, 17 nt, Mycobacterium bovis subsp bovis AF2122/97
gcccauggccaccaggg

SEQ ID NO: 3157181 - RNA, 11 nt, Mycobacterium bovis subsp bovis AF2122/97
gcccauggcgu

SEQ ID NO: 3157182 - RNA, 14 nt, Mycobacterium bovis subsp bovis AF2122/97
gcccauggcgucga

SEQ ID NO: 3157183 - RNA, 15 nt, Mycobacterium bovis subsp bovis AF2122/97
gcccauggcgucgaa

SEQ ID NO: 3157184 - RNA, 19 nt, Mycobacterium bovis subsp bovis AF2122/97
gcccauggcgucgaaccag

SEQ ID NO: 3157185 - RNA, 19 nt, Mycobacterium bovis subsp bovis AF2122/97
gcccaugguggcgaucugg

SEQ ID NO: 3157186 - RNA, 12 nt, Mycobacterium bovis subsp bovis AF2122/97
gcccaugucgag

SEQ ID NO: 3157187 - RNA, 21 nt, Mycobacterium bovis subsp bovis AF2122/97
gcccauucaucuugcggcagc

SEQ ID NO: 3157188 - RNA, 22 nt, Mycobacterium bovis subsp bovis AF2122/97
gcccauucaucuugcggcagcg

SEQ ID NO: 3157189 - RNA, 22 nt, Mycobacterium bovis subsp bovis AF2122/97
gcccauucccagaggcccgcgg

SEQ ID NO: 3157190 - RNA, 15 nt, Mycobacterium bovis subsp bovis AF2122/97
gcccauugacguaga

SEQ ID NO: 3157191 - RNA, 20 nt, Mycobacterium bovis subsp bovis AF2122/97
gcccauuggccagguggcga

SEQ ID NO: 3157192 - RNA, 21 nt, Mycobacterium bovis subsp bovis AF2122/97
gcccauuggguaaccagcgcc

SEQ ID NO: 3157193 - RNA, 15 nt, Mycobacterium bovis subsp bovis AF2122/97
gcccauuucgagcuc

SEQ ID NO: 3157194 - RNA, 16 nt, Mycobacterium bovis subsp bovis AF2122/97
gcccauuucgagcucg

SEQ ID NO: 3157195 - RNA, 23 nt, Mycobacterium bovis subsp bovis AF2122/97
gccccaaaucguaggggucugcg

SEQ ID NO: 3157196 - RNA, 14 nt, Mycobacterium bovis subsp bovis AF2122/97
gccccaagcgccug

SEQ ID NO: 3157197 - RNA, 22 nt, Mycobacterium bovis subsp bovis AF2122/97
gccccaagcgccugagcggccu

SEQ ID NO: 3157198 - RNA, 22 nt, Mycobacterium bovis subsp bovis AF2122/97
gccccacaccuuggcggucggc

SEQ ID NO: 3157199 - RNA, 23 nt, Mycobacterium bovis subsp bovis AF2122/97
gccccacaccuuggcggucggca

SEQ ID NO: 3157200 - RNA, 20 nt, Mycobacterium bovis subsp bovis AF2122/97
gccccaccauucgcgggccg

SEQ ID NO: 3157201 - RNA, 23 nt, Mycobacterium bovis subsp bovis AF2122/97
gccccaccauucgcgggccgagg

SEQ ID NO: 3157202 - RNA, 16 nt, Mycobacterium bovis subsp bovis AF2122/97
gccccacccgagcacu

SEQ ID NO: 3157203 - RNA, 14 nt, Mycobacterium bovis subsp bovis AF2122/97
gccccacccgcggc

SEQ ID NO: 3157204 - RNA, 14 nt, Mycobacterium bovis subsp bovis AF2122/97
gccccaccgacagc

SEQ ID NO: 3157205 - RNA, 15 nt, Mycobacterium bovis subsp bovis AF2122/97
gccccaccgacagcc

SEQ ID NO: 3157206 - RNA, 18 nt, Mycobacterium bovis subsp bovis AF2122/97
gccccaccgacagcccca

SEQ ID NO: 3157207 - RNA, 13 nt, Mycobacterium bovis subsp bovis AF2122/97
gccccaccgcgcc

SEQ ID NO: 3157208 - RNA, 16 nt, Mycobacterium bovis subsp bovis AF2122/97
gccccaccgcgccgag

SEQ ID NO: 3157209 - RNA, 15 nt, Mycobacterium bovis subsp bovis AF2122/97
gccccaccggcaccc

SEQ ID NO: 3157210 - RNA, 12 nt, Mycobacterium bovis subsp bovis AF2122/97
gccccaccggua

SEQ ID NO: 3157211 - RNA, 18 nt, Mycobacterium bovis subsp bovis AF2122/97
gccccaccgguaccgcca

SEQ ID NO: 3157212 - RNA, 21 nt, Mycobacterium bovis subsp bovis AF2122/97
gccccaccgguaccgccacuu

SEQ ID NO: 3157213 - RNA, 14 nt, Mycobacterium bovis subsp bovis AF2122/97
gccccaccggugcc

SEQ ID NO: 3157214 - RNA, 16 nt, Mycobacterium bovis subsp bovis AF2122/97
gccccacuggugcagc

SEQ ID NO: 3157215 - RNA, 22 nt, Mycobacterium bovis subsp bovis AF2122/97
gccccacuggugcagcgccgac

SEQ ID NO: 3157216 - RNA, 22 nt, Mycobacterium bovis subsp bovis AF2122/97
gccccagauauugaaccgggcc

SEQ ID NO: 3157217 - RNA, 19 nt, Mycobacterium bovis subsp bovis AF2122/97
gccccagcguucccgccgg

SEQ ID NO: 3157218 - RNA, 20 nt, Mycobacterium bovis subsp bovis AF2122/97
gccccagcguucccgccggc

SEQ ID NO: 3157219 - RNA, 19 nt, Mycobacterium bovis subsp bovis AF2122/97
gccccaggggcaccagcga

SEQ ID NO: 3157220 - RNA, 22 nt, Mycobacterium bovis subsp bovis AF2122/97
gccccaggugguucaaccggac

SEQ ID NO: 3157221 - RNA, 17 nt, Mycobacterium bovis subsp bovis AF2122/97
gccccaguccgaagcug

SEQ ID NO: 3157222 - RNA, 15 nt, Mycobacterium bovis subsp bovis AF2122/97
gccccagugcucauc

SEQ ID NO: 3157223 - RNA, 14 nt, Mycobacterium bovis subsp bovis AF2122/97
gccccagugugcgu

SEQ ID NO: 3157224 - RNA, 14 nt, Mycobacterium bovis subsp bovis AF2122/97
gccccaguucgacg

SEQ ID NO: 3157225 - RNA, 16 nt, Mycobacterium bovis subsp bovis AF2122/97
gccccaguucgacggc

SEQ ID NO: 3157226 - RNA, 23 nt, Mycobacterium bovis subsp bovis AF2122/97
gccccauaaacucuguggugucg

SEQ ID NO: 3157227 - RNA, 18 nt, Mycobacterium bovis subsp bovis AF2122/97
gccccauacuugcgccga

SEQ ID NO: 3157228 - RNA, 15 nt, Mycobacterium bovis subsp bovis AF2122/97
gccccaucaccaccg

SEQ ID NO: 3157229 - RNA, 17 nt, Mycobacterium bovis subsp bovis AF2122/97
gccccaucaccaccggc

SEQ ID NO: 3157230 - RNA, 18 nt, Mycobacterium bovis subsp bovis AF2122/97
gccccaucaccaccggca

SEQ ID NO: 3157231 - RNA, 22 nt, Mycobacterium bovis subsp bovis AF2122/97
gccccaucgccuggaugccgau

SEQ ID NO: 3157232 - RNA, 14 nt, Mycobacterium bovis subsp bovis AF2122/97
gccccaugcaacac

SEQ ID NO: 3157233 - RNA, 18 nt, Mycobacterium bovis subsp bovis AF2122/97
gccccaugcaacacaccg

SEQ ID NO: 3157234 - RNA, 22 nt, Mycobacterium bovis subsp bovis AF2122/97
gccccaugcaacacaccgcgga

SEQ ID NO: 3157235 - RNA, 16 nt, Mycobacterium bovis subsp bovis AF2122/97
gccccaugccgaccgg

SEQ ID NO: 3157236 - RNA, 17 nt, Mycobacterium bovis subsp bovis AF2122/97
gccccaugccgaccggc

SEQ ID NO: 3157237 - RNA, 23 nt, Mycobacterium bovis subsp bovis AF2122/97
gccccaugccgaccggcacccgc

SEQ ID NO: 3157238 - RNA, 22 nt, Mycobacterium bovis subsp bovis AF2122/97
gccccauucguaucccgcaaac

SEQ ID NO: 3157239 - RNA, 23 nt, Mycobacterium bovis subsp bovis AF2122/97
gccccauucguaucccgcaaacc

SEQ ID NO: 3157240 - RNA, 16 nt, Mycobacterium bovis subsp bovis AF2122/97
gccccauugccgucgc

SEQ ID NO: 3157241 - RNA, 16 nt, Mycobacterium bovis subsp bovis AF2122/97
gccccauugcgggagc

SEQ ID NO: 3157242 - RNA, 16 nt, Mycobacterium bovis subsp bovis AF2122/97
gcccccaaaccggcgg

SEQ ID NO: 3157243 - RNA, 22 nt, Mycobacterium bovis subsp bovis AF2122/97
gcccccaacgcgguaaagcccc

SEQ ID NO: 3157244 - RNA, 18 nt, Mycobacterium bovis subsp bovis AF2122/97
gcccccagcagcugcgau

SEQ ID NO: 3157245 - RNA, 19 nt, Mycobacterium bovis subsp bovis AF2122/97
gcccccagguaaccccgca

SEQ ID NO: 3157246 - RNA, 16 nt, Mycobacterium bovis subsp bovis AF2122/97
gcccccauugccgccg

SEQ ID NO: 3157247 - RNA, 17 nt, Mycobacterium bovis subsp bovis AF2122/97
gccccgccguugccgcc

SEQ ID NO: 3157248 - RNA, 18 nt, Mycobacterium bovis subsp bovis AF2122/97
gccccgccguuuccgccg

SEQ ID NO: 3157249 - RNA, 14 nt, Mycobacterium bovis subsp bovis AF2122/97
gccccgcgcccacc

SEQ ID NO: 3157250 - RNA, 23 nt, Mycobacterium bovis subsp bovis AF2122/97
gccccgcgcccaccccggccgca

SEQ ID NO: 3157251 - RNA, 14 nt, Mycobacterium bovis subsp bovis AF2122/97
gccccgcgccggcc

SEQ ID NO: 3157252 - RNA, 15 nt, Mycobacterium bovis subsp bovis AF2122/97
gccccgcgccggccg

SEQ ID NO: 3157253 - RNA, 17 nt, Mycobacterium bovis subsp bovis AF2122/97
gccccgcgccggccgca

SEQ ID NO: 3157254 - RNA, 18 nt, Mycobacterium bovis subsp bovis AF2122/97
gccccgcgcguucggcga

SEQ ID NO: 3157255 - RNA, 20 nt, Mycobacterium bovis subsp bovis AF2122/97
gccccgcgcguucggcgagc

SEQ ID NO: 3157256 - RNA, 14 nt, Mycobacterium bovis subsp bovis AF2122/97
gccccgcggcagac

SEQ ID NO: 3157257 - RNA, 12 nt, Mycobacterium bovis subsp bovis AF2122/97
gccccgcggcca

SEQ ID NO: 3157258 - RNA, 20 nt, Mycobacterium bovis subsp bovis AF2122/97
gccccgcggccagcaccggg

SEQ ID NO: 3157259 - RNA, 13 nt, Mycobacterium bovis subsp bovis AF2122/97
gccccgcggcgcc

SEQ ID NO: 3157260 - RNA, 18 nt, Mycobacterium bovis subsp bovis AF2122/97
gccccgcggcgccgccac

SEQ ID NO: 3157261 - RNA, 23 nt, Mycobacterium bovis subsp bovis AF2122/97
gccccgcucgguuugcguccugg

SEQ ID NO: 3157262 - RNA, 20 nt, Mycobacterium bovis subsp bovis AF2122/97
gccccgcuggucgaccggcg

SEQ ID NO: 3157263 - RNA, 22 nt, Mycobacterium bovis subsp bovis AF2122/97
gccccggauagcgucuggcgac

SEQ ID NO: 3157264 - RNA, 18 nt, Mycobacterium bovis subsp bovis AF2122/97
gccccggcaagcgcagac

SEQ ID NO: 3157265 - RNA, 20 nt, Mycobacterium bovis subsp bovis AF2122/97
gccccggcauugcccgagcc

SEQ ID NO: 3157266 - RNA, 21 nt, Mycobacterium bovis subsp bovis AF2122/97
gccccggcauugcccgagccc

SEQ ID NO: 3157267 - RNA, 14 nt, Mycobacterium bovis subsp bovis AF2122/97
gccccggccaggac

SEQ ID NO: 3157268 - RNA, 16 nt, Mycobacterium bovis subsp bovis AF2122/97
gccccggcccgaucgg

SEQ ID NO: 3157269 - RNA, 17 nt, Mycobacterium bovis subsp bovis AF2122/97
gccccggcccgaucggc

SEQ ID NO: 3157270 - RNA, 15 nt, Mycobacterium bovis subsp bovis AF2122/97
gccccggccgcuggc

SEQ ID NO: 3157271 - RNA, 15 nt, Mycobacterium bovis subsp bovis AF2122/97
gccccggcgcggcca

SEQ ID NO: 3157272 - RNA, 17 nt, Mycobacterium bovis subsp bovis AF2122/97
gccccggcgcggccagc

SEQ ID NO: 3157273 - RNA, 23 nt, Mycobacterium bovis subsp bovis AF2122/97
gccccggcgcuggugcgccacgc

SEQ ID NO: 3157274 - RNA, 18 nt, Mycobacterium bovis subsp bovis AF2122/97
gccccggcgguaccggag

SEQ ID NO: 3157275 - RNA, 10 nt, Mycobacterium bovis subsp bovis AF2122/97
gccccggcuc

SEQ ID NO: 3157276 - RNA, 15 nt, Mycobacterium bovis subsp bovis AF2122/97
gccccggcucucuuc

SEQ ID NO: 3157277 - RNA, 21 nt, Mycobacterium bovis subsp bovis AF2122/97
gccccggcucucuucgcgcgc

SEQ ID NO: 3157278 - RNA, 14 nt, Mycobacterium bovis subsp bovis AF2122/97
gccccgggccacca

SEQ ID NO: 3157279 - RNA, 20 nt, Mycobacterium bovis subsp bovis AF2122/97
gccccgggcggugaggcagc

SEQ ID NO: 3157280 - RNA, 12 nt, Mycobacterium bovis subsp bovis AF2122/97
gccccggggugc

SEQ ID NO: 3157281 - RNA, 16 nt, Mycobacterium bovis subsp bovis AF2122/97
gccccggucggcgacg

SEQ ID NO: 3157282 - RNA, 18 nt, Mycobacterium bovis subsp bovis AF2122/97
gccccggucggcgacgua

SEQ ID NO: 3157283 - RNA, 15 nt, Mycobacterium bovis subsp bovis AF2122/97
gccccggugccgacc

SEQ ID NO: 3157284 - RNA, 17 nt, Mycobacterium bovis subsp bovis AF2122/97
gccccggugccgaccgg

SEQ ID NO: 3157285 - RNA, 18 nt, Mycobacterium bovis subsp bovis AF2122/97
gccccggugccgaccggu

SEQ ID NO: 3157286 - RNA, 20 nt, Mycobacterium bovis subsp bovis AF2122/97
gccccguccgauuucccagc

SEQ ID NO: 3157287 - RNA, 22 nt, Mycobacterium bovis subsp bovis AF2122/97
gccccgugggccucgaucagcg

SEQ ID NO: 3157288 - RNA, 16 nt, Mycobacterium bovis subsp bovis AF2122/97
gccccguugagcagca

SEQ ID NO: 3157289 - RNA, 21 nt, Mycobacterium bovis subsp bovis AF2122/97
gccccguugagcagcacccau

SEQ ID NO: 3157290 - RNA, 22 nt, Mycobacterium bovis subsp bovis AF2122/97
gccccguuggucagcguggacg

SEQ ID NO: 3157291 - RNA, 20 nt, Mycobacterium bovis subsp bovis AF2122/97
gccccguugugucaccggcg

SEQ ID NO: 3157292 - RNA, 22 nt, Mycobacterium bovis subsp bovis AF2122/97
gccccguugugucaccggcguc

SEQ ID NO: 3157293 - RNA, 13 nt, Mycobacterium bovis subsp bovis AF2122/97
gccccucaccucg

SEQ ID NO: 3157294 - RNA, 23 nt, Mycobacterium bovis subsp bovis AF2122/97
gccccucaccucggcuuugccgc

SEQ ID NO: 3157295 - RNA, 20 nt, Mycobacterium bovis subsp bovis AF2122/97
gccccuccaggggcuggugc

SEQ ID NO: 3157296 - RNA, 15 nt, Mycobacterium bovis subsp bovis AF2122/97
gccccuccgcgccga

SEQ ID NO: 3157297 - RNA, 16 nt, Mycobacterium bovis subsp bovis AF2122/97
gccccuccgggcgcac

SEQ ID NO: 3157298 - RNA, 22 nt, Mycobacterium bovis subsp bovis AF2122/97
gccccucgucgucaucgagcgg

SEQ ID NO: 3157299 - RNA, 16 nt, Mycobacterium bovis subsp bovis AF2122/97
gccccugaaggccagc

SEQ ID NO: 3157300 - RNA, 17 nt, Mycobacterium bovis subsp bovis AF2122/97
gccccugaaggccagcc

SEQ ID NO: 3157301 - RNA, 22 nt, Mycobacterium bovis subsp bovis AF2122/97
gccccugaaggccagccaacgc

SEQ ID NO: 3157302 - RNA, 14 nt, Mycobacterium bovis subsp bovis AF2122/97
gccccugcacagca

SEQ ID NO: 3157303 - RNA, 16 nt, Mycobacterium bovis subsp bovis AF2122/97
gccccugcacagcagg

SEQ ID NO: 3157304 - RNA, 21 nt, Mycobacterium bovis subsp bovis AF2122/97
gccccugcacagcaggcucga

SEQ ID NO: 3157305 - RNA, 13 nt, Mycobacterium bovis subsp bovis AF2122/97
gccccugcgcggc

SEQ ID NO: 3157306 - RNA, 14 nt, Mycobacterium bovis subsp bovis AF2122/97
gccccugcgcggcc

SEQ ID NO: 3157307 - RNA, 18 nt, Mycobacterium bovis subsp bovis AF2122/97
gccccugcgcggccaccu

SEQ ID NO: 3157308 - RNA, 17 nt, Mycobacterium bovis subsp bovis AF2122/97
gccccuggcaccucgcc

SEQ ID NO: 3157309 - RNA, 20 nt, Mycobacterium bovis subsp bovis AF2122/97
gccccuggcaccucgcccuc

SEQ ID NO: 3157310 - RNA, 16 nt, Mycobacterium bovis subsp bovis AF2122/97
gccccuggccgccgca

SEQ ID NO: 3157311 - RNA, 19 nt, Mycobacterium bovis subsp bovis AF2122/97
gccccugucaacgccgcgg

SEQ ID NO: 3157312 - RNA, 21 nt, Mycobacterium bovis subsp bovis AF2122/97
gccccugucaacgccgcgguc

SEQ ID NO: 3157313 - RNA, 17 nt, Mycobacterium bovis subsp bovis AF2122/97
gccccuugaccgcugcc

SEQ ID NO: 3157314 - RNA, 18 nt, Mycobacterium bovis subsp bovis AF2122/97
gccccuugaccgcugccc

SEQ ID NO: 3157315 - RNA, 19 nt, Mycobacterium bovis subsp bovis AF2122/97
gccccuugaccgcugccca

SEQ ID NO: 3157316 - RNA, 16 nt, Mycobacterium bovis subsp bovis AF2122/97
gccccuuggcgccacc

SEQ ID NO: 3157317 - RNA, 19 nt, Mycobacterium bovis subsp bovis AF2122/97
gccccuuggcgccaccggc

SEQ ID NO: 3157318 - RNA, 17 nt, Mycobacterium bovis subsp bovis AF2122/97
gccccuuuugccgcagc

SEQ ID NO: 3157319 - RNA, 22 nt, Mycobacterium bovis subsp bovis AF2122/97
gcccgaaccaccgcguuggcca

SEQ ID NO: 3157320 - RNA, 16 nt, Mycobacterium bovis subsp bovis AF2122/97
gcccgaacgaggcgcc

SEQ ID NO: 3157321 - RNA, 19 nt, Mycobacterium bovis subsp bovis AF2122/97
gcccgaacgaggcgcccag

SEQ ID NO: 3157322 - RNA, 16 nt, Mycobacterium bovis subsp bovis AF2122/97
gcccgaacucguuggc

SEQ ID NO: 3157323 - RNA, 17 nt, Mycobacterium bovis subsp bovis AF2122/97
gcccgaacucguuggcg

SEQ ID NO: 3157324 - RNA, 17 nt, Mycobacterium bovis subsp bovis AF2122/97
gcccgaagacggggugg

SEQ ID NO: 3157325 - RNA, 20 nt, Mycobacterium bovis subsp bovis AF2122/97
gcccgaagacgggguggugg

SEQ ID NO: 3157326 - RNA, 15 nt, Mycobacterium bovis subsp bovis AF2122/97
gcccgaagccgggcc

SEQ ID NO: 3157327 - RNA, 16 nt, Mycobacterium bovis subsp bovis AF2122/97
gcccgaagccgggccc

SEQ ID NO: 3157328 - RNA, 15 nt, Mycobacterium bovis subsp bovis AF2122/97
gcccgaaggcggcuc

SEQ ID NO: 3157329 - RNA, 17 nt, Mycobacterium bovis subsp bovis AF2122/97
gcccgaaggcggcucca

SEQ ID NO: 3157330 - RNA, 21 nt, Mycobacterium bovis subsp bovis AF2122/97
gcccgaaggcggcuccaccgg

SEQ ID NO: 3157331 - RNA, 17 nt, Mycobacterium bovis subsp bovis AF2122/97
gcccgaaugcgacgucg

SEQ ID NO: 3157332 - RNA, 14 nt, Mycobacterium bovis subsp bovis AF2122/97
gcccgaaugcggug

SEQ ID NO: 3157333 - RNA, 12 nt, Mycobacterium bovis subsp bovis AF2122/97
gcccgaucccga

SEQ ID NO: 3157334 - RNA, 15 nt, Mycobacterium bovis subsp bovis AF2122/97
gcccgaucgauaucg

SEQ ID NO: 3157335 - RNA, 23 nt, Mycobacterium bovis subsp bovis AF2122/97
gcccgaucgauaucggcaaucag

SEQ ID NO: 3157336 - RNA, 21 nt, Mycobacterium bovis subsp bovis AF2122/97
gcccgaucggcaacccgcacc

SEQ ID NO: 3157337 - RNA, 23 nt, Mycobacterium bovis subsp bovis AF2122/97
gcccgaucggcggaucgugcccu

SEQ ID NO: 3157338 - RNA, 13 nt, Mycobacterium bovis subsp bovis AF2122/97
gcccgaucguagg

SEQ ID NO: 3157339 - RNA, 22 nt, Mycobacterium bovis subsp bovis AF2122/97
gcccgaugaggacauccggcgc

SEQ ID NO: 3157340 - RNA, 23 nt, Mycobacterium bovis subsp bovis AF2122/97
gcccgaugaggacauccggcgcc

SEQ ID NO: 3157341 - RNA, 24 nt, Mycobacterium bovis subsp bovis AF2122/97
gcccgaugaggacauccggcgccg

SEQ ID NO: 3157342 - RNA, 20 nt, Mycobacterium bovis subsp bovis AF2122/97
gcccgaugcccucgauggcc

SEQ ID NO: 3157343 - RNA, 16 nt, Mycobacterium bovis subsp bovis AF2122/97
gcccgaugccgugccc

SEQ ID NO: 3157344 - RNA, 15 nt, Mycobacterium bovis subsp bovis AF2122/97
gcccgaugcgccagc

SEQ ID NO: 3157345 - RNA, 18 nt, Mycobacterium bovis subsp bovis AF2122/97
gcccgaugguacccgcgc

SEQ ID NO: 3157346 - RNA, 19 nt, Mycobacterium bovis subsp bovis AF2122/97
gcccgaugguacccgcgcc

SEQ ID NO: 3157347 - RNA, 21 nt, Mycobacterium bovis subsp bovis AF2122/97
gcccgaugguacccgcgccgc

SEQ ID NO: 3157348 - RNA, 15 nt, Mycobacterium bovis subsp bovis AF2122/97
gcccgauggugccga

SEQ ID NO: 3157349 - RNA, 23 nt, Mycobacterium bovis subsp bovis AF2122/97
gcccgauggugccgacccgccgc

SEQ ID NO: 3157350 - RNA, 18 nt, Mycobacterium bovis subsp bovis AF2122/97
gcccgaugguggugccga

SEQ ID NO: 3157351 - RNA, 20 nt, Mycobacterium bovis subsp bovis AF2122/97
gcccgaugguggugccgacc

SEQ ID NO: 3157352 - RNA, 15 nt, Mycobacterium bovis subsp bovis AF2122/97
gcccgauucagcgcc

SEQ ID NO: 3157353 - RNA, 17 nt, Mycobacterium bovis subsp bovis AF2122/97
gcccgauucagcgcccc

SEQ ID NO: 3157354 - RNA, 21 nt, Mycobacterium bovis subsp bovis AF2122/97
gcccgauucugauaucgucgg

SEQ ID NO: 3157355 - RNA, 20 nt, Mycobacterium bovis subsp bovis AF2122/97
gcccgauugaguucggcggc

SEQ ID NO: 3157356 - RNA, 13 nt, Mycobacterium bovis subsp bovis AF2122/97
gcccgcaaacagu

SEQ ID NO: 3157357 - RNA, 17 nt, Mycobacterium bovis subsp bovis AF2122/97
gcccgcaauuguucgcg

SEQ ID NO: 3157358 - RNA, 21 nt, Mycobacterium bovis subsp bovis AF2122/97
gcccgcaauuguucgcggccg

SEQ ID NO: 3157359 - RNA, 14 nt, Mycobacterium bovis subsp bovis AF2122/97
gcccgcaccacacc

SEQ ID NO: 3157360 - RNA, 20 nt, Mycobacterium bovis subsp bovis AF2122/97
gcccgcaccacaccgugggc

SEQ ID NO: 3157361 - RNA, 22 nt, Mycobacterium bovis subsp bovis AF2122/97
gcccgcaccacaccgugggcga

SEQ ID NO: 3157362 - RNA, 13 nt, Mycobacterium bovis subsp bovis AF2122/97
gcccgcaccaccg

SEQ ID NO: 3157363 - RNA, 15 nt, Mycobacterium bovis subsp bovis AF2122/97
gcccgcaccaccggc

SEQ ID NO: 3157364 - RNA, 13 nt, Mycobacterium bovis subsp bovis AF2122/97
gcccgcaccagcu

SEQ ID NO: 3157365 - RNA, 22 nt, Mycobacterium bovis subsp bovis AF2122/97
gcccgcacccacuuucgacccg

SEQ ID NO: 3157366 - RNA, 14 nt, Mycobacterium bovis subsp bovis AF2122/97
gcccgcacccauga

SEQ ID NO: 3157367 - RNA, 20 nt, Mycobacterium bovis subsp bovis AF2122/97
gcccgcacccaugaucccgc

SEQ ID NO: 3157368 - RNA, 19 nt, Mycobacterium bovis subsp bovis AF2122/97
gcccgcacccguccggccg

SEQ ID NO: 3157369 - RNA, 12 nt, Mycobacterium bovis subsp bovis AF2122/97
gcccgcaccgcg

SEQ ID NO: 3157370 - RNA, 18 nt, Mycobacterium bovis subsp bovis AF2122/97
gcccgcaccgcguucugg

SEQ ID NO: 3157371 - RNA, 15 nt, Mycobacterium bovis subsp bovis AF2122/97
gcccgcaccgucgcu

SEQ ID NO: 3157372 - RNA, 19 nt, Mycobacterium bovis subsp bovis AF2122/97
gcccgcacgaaccggucga

SEQ ID NO: 3157373 - RNA, 20 nt, Mycobacterium bovis subsp bovis AF2122/97
gcccgcacgacgaauccccg

SEQ ID NO: 3157374 - RNA, 15 nt, Mycobacterium bovis subsp bovis AF2122/97
gcccgcacgcucggc

SEQ ID NO: 3157375 - RNA, 16 nt, Mycobacterium bovis subsp bovis AF2122/97
gcccgcacgcucggcg

SEQ ID NO: 3157376 - RNA, 15 nt, Mycobacterium bovis subsp bovis AF2122/97
gcccgcacguuggcg

SEQ ID NO: 3157377 - RNA, 21 nt, Mycobacterium bovis subsp bovis AF2122/97
gcccgcacguuggcggccagc

SEQ ID NO: 3157378 - RNA, 23 nt, Mycobacterium bovis subsp bovis AF2122/97
gcccgcacucggcgguuccggcg

SEQ ID NO: 3157379 - RNA, 16 nt, Mycobacterium bovis subsp bovis AF2122/97
gcccgcacugccgccg

SEQ ID NO: 3157380 - RNA, 16 nt, Mycobacterium bovis subsp bovis AF2122/97
gcccgcagcccgccgg

SEQ ID NO: 3157381 - RNA, 13 nt, Mycobacterium bovis subsp bovis AF2122/97
gcccgcaggacgc

SEQ ID NO: 3157382 - RNA, 18 nt, Mycobacterium bovis subsp bovis AF2122/97
gcccgcaggacgcugccg

SEQ ID NO: 3157383 - RNA, 20 nt, Mycobacterium bovis subsp bovis AF2122/97
gcccgcagggccgccgcgaa

SEQ ID NO: 3157384 - RNA, 14 nt, Mycobacterium bovis subsp bovis AF2122/97
gcccgcauccgcac

SEQ ID NO: 3157385 - RNA, 15 nt, Mycobacterium bovis subsp bovis AF2122/97
gcccgcauccgcacc

SEQ ID NO: 3157386 - RNA, 15 nt, Mycobacterium bovis subsp bovis AF2122/97
gcccgcaucgcggca

SEQ ID NO: 3157387 - RNA, 22 nt, Mycobacterium bovis subsp bovis AF2122/97
gcccgcaucgcggcaucgacgc

SEQ ID NO: 3157388 - RNA, 15 nt, Mycobacterium bovis subsp bovis AF2122/97
gcccgcaugccggcg

SEQ ID NO: 3157389 - RNA, 16 nt, Mycobacterium bovis subsp bovis AF2122/97
gcccgcaugccggcgc

SEQ ID NO: 3157390 - RNA, 15 nt, Mycobacterium bovis subsp bovis AF2122/97
gcccgcauugaucuc

SEQ ID NO: 3157391 - RNA, 19 nt, Mycobacterium bovis subsp bovis AF2122/97
gcccgcauugccaacgccc

SEQ ID NO: 3157392 - RNA, 20 nt, Mycobacterium bovis subsp bovis AF2122/97
gcccgccacaacggcggcgc

SEQ ID NO: 3157393 - RNA, 21 nt, Mycobacterium bovis subsp bovis AF2122/97
gcccgccacaacggcggcgca

SEQ ID NO: 3157394 - RNA, 23 nt, Mycobacterium bovis subsp bovis AF2122/97
gcccgccacaacggcggcgcagu

SEQ ID NO: 3157395 - RNA, 15 nt, Mycobacterium bovis subsp bovis AF2122/97
gcccgccaccggagg

SEQ ID NO: 3157396 - RNA, 13 nt, Mycobacterium bovis subsp bovis AF2122/97
gcccgccaccggc

SEQ ID NO: 3157397 - RNA, 14 nt, Mycobacterium bovis subsp bovis AF2122/97
gcccgccaccggcg

SEQ ID NO: 3157398 - RNA, 15 nt, Mycobacterium bovis subsp bovis AF2122/97
gcccgccaccggcgc

SEQ ID NO: 3157399 - RNA, 16 nt, Mycobacterium bovis subsp bovis AF2122/97
gcccgccaccggcgcg

SEQ ID NO: 3157400 - RNA, 23 nt, Mycobacterium bovis subsp bovis AF2122/97
gcccgccaccggguucaccgagg

SEQ ID NO: 3157401 - RNA, 20 nt, Mycobacterium bovis subsp bovis AF2122/97
gcccgccacgaugucgucga

SEQ ID NO: 3157402 - RNA, 16 nt, Mycobacterium bovis subsp bovis AF2122/97
gcccgccagaacggcg

SEQ ID NO: 3157403 - RNA, 16 nt, Mycobacterium bovis subsp bovis AF2122/97
gcccgccagcagggcc

SEQ ID NO: 3157404 - RNA, 17 nt, Mycobacterium bovis subsp bovis AF2122/97
gcccgccagcagggcca

SEQ ID NO: 3157405 - RNA, 14 nt, Mycobacterium bovis subsp bovis AF2122/97
gcccgccagcccag

SEQ ID NO: 3157406 - RNA, 15 nt, Mycobacterium bovis subsp bovis AF2122/97
gcccgccagcccagc

SEQ ID NO: 3157407 - RNA, 18 nt, Mycobacterium bovis subsp bovis AF2122/97
gcccgccagcccagcacg

SEQ ID NO: 3157408 - RNA, 13 nt, Mycobacterium bovis subsp bovis AF2122/97
gcccgccagcgau

SEQ ID NO: 3157409 - RNA, 19 nt, Mycobacterium bovis subsp bovis AF2122/97
gcccgccagcgauccacca

SEQ ID NO: 3157410 - RNA, 16 nt, Mycobacterium bovis subsp bovis AF2122/97
gcccgccagcgccgcc

SEQ ID NO: 3157411 - RNA, 23 nt, Mycobacterium bovis subsp bovis AF2122/97
gcccgccagcgccgccgcgagcg

SEQ ID NO: 3157412 - RNA, 17 nt, Mycobacterium bovis subsp bovis AF2122/97
gcccgccaucagcccgg

SEQ ID NO: 3157413 - RNA, 18 nt, Mycobacterium bovis subsp bovis AF2122/97
gcccgccaucagcccggc

SEQ ID NO: 3157414 - RNA, 20 nt, Mycobacterium bovis subsp bovis AF2122/97
gcccgccaucagcccggcgc

SEQ ID NO: 3157415 - RNA, 21 nt, Mycobacterium bovis subsp bovis AF2122/97
gcccgccaucauggcggcccg

SEQ ID NO: 3157416 - RNA, 22 nt, Mycobacterium bovis subsp bovis AF2122/97
gcccgccauccgauggcccggc

SEQ ID NO: 3157417 - RNA, 14 nt, Mycobacterium bovis subsp bovis AF2122/97
gcccgcccaccucg

SEQ ID NO: 3157418 - RNA, 19 nt, Mycobacterium bovis subsp bovis AF2122/97
gcccgcccaccucgaucgc

SEQ ID NO: 3157419 - RNA, 18 nt, Mycobacterium bovis subsp bovis AF2122/97
gcccgcguugccaaagcc

SEQ ID NO: 3157420 - RNA, 21 nt, Mycobacterium bovis subsp bovis AF2122/97
gcccgcguugccaaagcccac

SEQ ID NO: 3157421 - RNA, 19 nt, Mycobacterium bovis subsp bovis AF2122/97
gcccgcguuugcgaagccc

SEQ ID NO: 3157422 - RNA, 12 nt, Mycobacterium bovis subsp bovis AF2122/97
gcccgcuaccaa

SEQ ID NO: 3157423 - RNA, 16 nt, Mycobacterium bovis subsp bovis AF2122/97
gcccgcuacggcagcc

SEQ ID NO: 3157424 - RNA, 17 nt, Mycobacterium bovis subsp bovis AF2122/97
gcccgcucaacgggccg

SEQ ID NO: 3157425 - RNA, 15 nt, Mycobacterium bovis subsp bovis AF2122/97
gcccgcucaccuugg

SEQ ID NO: 3157426 - RNA, 13 nt, Mycobacterium bovis subsp bovis AF2122/97
gcccgcucagccg

SEQ ID NO: 3157427 - RNA, 18 nt, Mycobacterium bovis subsp bovis AF2122/97
gcccgcucagccguccgg

SEQ ID NO: 3157428 - RNA, 21 nt, Mycobacterium bovis subsp bovis AF2122/97
gcccgcucagccguccgggcg

SEQ ID NO: 3157429 - RNA, 14 nt, Mycobacterium bovis subsp bovis AF2122/97
gcccgcucauaccg

SEQ ID NO: 3157430 - RNA, 21 nt, Mycobacterium bovis subsp bovis AF2122/97
gcccgcuccaacacccgccgg

SEQ ID NO: 3157431 - RNA, 14 nt, Mycobacterium bovis subsp bovis AF2122/97
gcccgcucccugca

SEQ ID NO: 3157432 - RNA, 13 nt, Mycobacterium bovis subsp bovis AF2122/97
gcccgcuccgccg

SEQ ID NO: 3157433 - RNA, 17 nt, Mycobacterium bovis subsp bovis AF2122/97
gcccgcuccgccgucgc

SEQ ID NO: 3157434 - RNA, 22 nt, Mycobacterium bovis subsp bovis AF2122/97
gcccgcuccgccgucgccgccg

SEQ ID NO: 3157435 - RNA, 23 nt, Mycobacterium bovis subsp bovis AF2122/97
gcccgcuccgccgucgccgccgg

SEQ ID NO: 3157436 - RNA, 13 nt, Mycobacterium bovis subsp bovis AF2122/97
gcccgcuccgcgg

SEQ ID NO: 3157437 - RNA, 14 nt, Mycobacterium bovis subsp bovis AF2122/97
gcccgcuccgcggc

SEQ ID NO: 3157438 - RNA, 15 nt, Mycobacterium bovis subsp bovis AF2122/97
gcccgcuccgcggcu

SEQ ID NO: 3157439 - RNA, 14 nt, Mycobacterium bovis subsp bovis AF2122/97
gcccgcuccgggac

SEQ ID NO: 3157440 - RNA, 17 nt, Mycobacterium bovis subsp bovis AF2122/97
gcccgcuccgggaccca

SEQ ID NO: 3157441 - RNA, 19 nt, Mycobacterium bovis subsp bovis AF2122/97
gcccgcuccuccggcacca

SEQ ID NO: 3157442 - RNA, 16 nt, Mycobacterium bovis subsp bovis AF2122/97
gcccgcuccugcucgu

SEQ ID NO: 3157443 - RNA, 19 nt, Mycobacterium bovis subsp bovis AF2122/97
gcccgcucgaucggcagcc

SEQ ID NO: 3157444 - RNA, 22 nt, Mycobacterium bovis subsp bovis AF2122/97
gcccgcucgaucggcagccagg

SEQ ID NO: 3157445 - RNA, 19 nt, Mycobacterium bovis subsp bovis AF2122/97
gcccgcucggagaucgcca

SEQ ID NO: 3157446 - RNA, 16 nt, Mycobacterium bovis subsp bovis AF2122/97
gcccgcucggaugagu

SEQ ID NO: 3157447 - RNA, 20 nt, Mycobacterium bovis subsp bovis AF2122/97
gcccgcucggaugaguagca

SEQ ID NO: 3157448 - RNA, 13 nt, Mycobacterium bovis subsp bovis AF2122/97
gcccgcucggccg

SEQ ID NO: 3157449 - RNA, 15 nt, Mycobacterium bovis subsp bovis AF2122/97
gcccgcucggccgca

SEQ ID NO: 3157450 - RNA, 11 nt, Mycobacterium bovis subsp bovis AF2122/97
gcccgcucggg

SEQ ID NO: 3157451 - RNA, 20 nt, Mycobacterium bovis subsp bovis AF2122/97
gcccgcugaccaucacaccc

SEQ ID NO: 3157452 - RNA, 22 nt, Mycobacterium bovis subsp bovis AF2122/97
gcccgcugaccaucacacccau

SEQ ID NO: 3157453 - RNA, 13 nt, Mycobacterium bovis subsp bovis AF2122/97
gcccgcugagcac

SEQ ID NO: 3157454 - RNA, 19 nt, Mycobacterium bovis subsp bovis AF2122/97
gcccgcugagcacucauga

SEQ ID NO: 3157455 - RNA, 13 nt, Mycobacterium bovis subsp bovis AF2122/97
gcccgcugagcca

SEQ ID NO: 3157456 - RNA, 15 nt, Mycobacterium bovis subsp bovis AF2122/97
gcccgcugagccagc

SEQ ID NO: 3157457 - RNA, 20 nt, Mycobacterium bovis subsp bovis AF2122/97
gcccgcugagccagcuccac

SEQ ID NO: 3157458 - RNA, 19 nt, Mycobacterium bovis subsp bovis AF2122/97
gcccgcugaucagauccuc

SEQ ID NO: 3157459 - RNA, 20 nt, Mycobacterium bovis subsp bovis AF2122/97
gcccgcugaucagauccucg

SEQ ID NO: 3157460 - RNA, 14 nt, Mycobacterium bovis subsp bovis AF2122/97
gcccgcugcagacg

SEQ ID NO: 3157461 - RNA, 17 nt, Mycobacterium bovis subsp bovis AF2122/97
gcccgcugcagacgccc

SEQ ID NO: 3157462 - RNA, 15 nt, Mycobacterium bovis subsp bovis AF2122/97
gcccgcugccaucgc

SEQ ID NO: 3157463 - RNA, 19 nt, Mycobacterium bovis subsp bovis AF2122/97
gcccgcugcgccgggucug

SEQ ID NO: 3157464 - RNA, 15 nt, Mycobacterium bovis subsp bovis AF2122/97
gcccgcugcggcggc

SEQ ID NO: 3157465 - RNA, 16 nt, Mycobacterium bovis subsp bovis AF2122/97
gcccgcugcggcggcu

SEQ ID NO: 3157466 - RNA, 20 nt, Mycobacterium bovis subsp bovis AF2122/97
gcccgcugcgggaguucggg

SEQ ID NO: 3157467 - RNA, 11 nt, Mycobacterium bovis subsp bovis AF2122/97
gcccgcuggcc

SEQ ID NO: 3157468 - RNA, 16 nt, Mycobacterium bovis subsp bovis AF2122/97
gcccgcugggcucgcu

SEQ ID NO: 3157469 - RNA, 19 nt, Mycobacterium bovis subsp bovis AF2122/97
gcccgcugggcuuggggcc

SEQ ID NO: 3157470 - RNA, 15 nt, Mycobacterium bovis subsp bovis AF2122/97
gcccgcuucagcacg

SEQ ID NO: 3157471 - RNA, 21 nt, Mycobacterium bovis subsp bovis AF2122/97
gcccgcuucagcacgguguac

SEQ ID NO: 3157472 - RNA, 17 nt, Mycobacterium bovis subsp bovis AF2122/97
gcccggaacccgagccg

SEQ ID NO: 3157473 - RNA, 18 nt, Mycobacterium bovis subsp bovis AF2122/97
gcccggaaccggcgugca

SEQ ID NO: 3157474 - RNA, 17 nt, Mycobacterium bovis subsp bovis AF2122/97
gcccggaauguagucca

SEQ ID NO: 3157475 - RNA, 14 nt, Mycobacterium bovis subsp bovis AF2122/97
gcccggacaugcgg

SEQ ID NO: 3157476 - RNA, 18 nt, Mycobacterium bovis subsp bovis AF2122/97
gcccggacgauggcgucg

SEQ ID NO: 3157477 - RNA, 20 nt, Mycobacterium bovis subsp bovis AF2122/97
gcccggacgauggcgucggc

SEQ ID NO: 3157478 - RNA, 18 nt, Mycobacterium bovis subsp bovis AF2122/97
gcccggacgcaacacccg

SEQ ID NO: 3157479 - RNA, 12 nt, Mycobacterium bovis subsp bovis AF2122/97
gcccggacgcgc

SEQ ID NO: 3157480 - RNA, 21 nt, Mycobacterium bovis subsp bovis AF2122/97
gcccggacguaggcaccccgg

SEQ ID NO: 3157481 - RNA, 14 nt, Mycobacterium bovis subsp bovis AF2122/97
gcccggacgucggc

SEQ ID NO: 3157482 - RNA, 20 nt, Mycobacterium bovis subsp bovis AF2122/97
gcccggaggguucggacggc

SEQ ID NO: 3157483 - RNA, 20 nt, Mycobacterium bovis subsp bovis AF2122/97
gcccggaucucggcguaggc

SEQ ID NO: 3157484 - RNA, 14 nt, Mycobacterium bovis subsp bovis AF2122/97
gcccggaugcgaug

SEQ ID NO: 3157485 - RNA, 18 nt, Mycobacterium bovis subsp bovis AF2122/97
gcccggauguccgccgac

SEQ ID NO: 3157486 - RNA, 21 nt, Mycobacterium bovis subsp bovis AF2122/97
gcccggcaaaggauuucaccg

SEQ ID NO: 3157487 - RNA, 22 nt, Mycobacterium bovis subsp bovis AF2122/97
gcccggcaaugaucaucccggc

SEQ ID NO: 3157488 - RNA, 13 nt, Mycobacterium bovis subsp bovis AF2122/97
gcccggcaccccu

SEQ ID NO: 3157489 - RNA, 13 nt, Mycobacterium bovis subsp bovis AF2122/97
gcccggcacggug

SEQ ID NO: 3157490 - RNA, 18 nt, Mycobacterium bovis subsp bovis AF2122/97
gcccggcacggugucgcg

SEQ ID NO: 3157491 - RNA, 18 nt, Mycobacterium bovis subsp bovis AF2122/97
gcccggcagauguguccg

SEQ ID NO: 3157492 - RNA, 14 nt, Mycobacterium bovis subsp bovis AF2122/97
gcccggcaggacuu

SEQ ID NO: 3157493 - RNA, 23 nt, Mycobacterium bovis subsp bovis AF2122/97
gcccggcaguucgcggccaucgc

SEQ ID NO: 3157494 - RNA, 12 nt, Mycobacterium bovis subsp bovis AF2122/97
gcccggcaucgc

SEQ ID NO: 3157495 - RNA, 17 nt, Mycobacterium bovis subsp bovis AF2122/97
gcccggcaucgcgaucg

SEQ ID NO: 3157496 - RNA, 22 nt, Mycobacterium bovis subsp bovis AF2122/97
gcccggcaucgcgaucggggcg

SEQ ID NO: 3157497 - RNA, 18 nt, Mycobacterium bovis subsp bovis AF2122/97
gcccggccaaccaccaac

SEQ ID NO: 3157498 - RNA, 17 nt, Mycobacterium bovis subsp bovis AF2122/97
gcccggccaagccggcg

SEQ ID NO: 3157499 - RNA, 22 nt, Mycobacterium bovis subsp bovis AF2122/97
gcccggccagccgcacgguugc

SEQ ID NO: 3157500 - RNA, 16 nt, Mycobacterium bovis subsp bovis AF2122/97
gcccggccaggucgac

SEQ ID NO: 3157501 - RNA, 20 nt, Mycobacterium bovis subsp bovis AF2122/97
gcccggccaggucgacaccg

SEQ ID NO: 3157502 - RNA, 15 nt, Mycobacterium bovis subsp bovis AF2122/97
gcccggccaugauga

SEQ ID NO: 3157503 - RNA, 12 nt, Mycobacterium bovis subsp bovis AF2122/97
gcccggccccgc

SEQ ID NO: 3157504 - RNA, 18 nt, Mycobacterium bovis subsp bovis AF2122/97
gcccggccccgcggccag

SEQ ID NO: 3157505 - RNA, 19 nt, Mycobacterium bovis subsp bovis AF2122/97
gcccggccccgcggccagc

SEQ ID NO: 3157506 - RNA, 18 nt, Mycobacterium bovis subsp bovis AF2122/97
gcccgggcggaacgccgg

SEQ ID NO: 3157507 - RNA, 19 nt, Mycobacterium bovis subsp bovis AF2122/97
gcccgggcggaacgccggc

SEQ ID NO: 3157508 - RNA, 14 nt, Mycobacterium bovis subsp bovis AF2122/97
gcccgggcggccag

SEQ ID NO: 3157509 - RNA, 16 nt, Mycobacterium bovis subsp bovis AF2122/97
gcccgggcggccagcu

SEQ ID NO: 3157510 - RNA, 13 nt, Mycobacterium bovis subsp bovis AF2122/97
gcccgggcggcgu

SEQ ID NO: 3157511 - RNA, 21 nt, Mycobacterium bovis subsp bovis AF2122/97
gcccgggcggcgucggugagc

SEQ ID NO: 3157512 - RNA, 22 nt, Mycobacterium bovis subsp bovis AF2122/97
gcccgggcgggagucgucgagc

SEQ ID NO: 3157513 - RNA, 21 nt, Mycobacterium bovis subsp bovis AF2122/97
gcccgggcgggauccacccag

SEQ ID NO: 3157514 - RNA, 23 nt, Mycobacterium bovis subsp bovis AF2122/97
gcccgggcgugggcaccccgcgg

SEQ ID NO: 3157515 - RNA, 21 nt, Mycobacterium bovis subsp bovis AF2122/97
gcccgggcgugguaucgccgg

SEQ ID NO: 3157516 - RNA, 20 nt, Mycobacterium bovis subsp bovis AF2122/97
gcccgggcguugggaucgcg

SEQ ID NO: 3157517 - RNA, 13 nt, Mycobacterium bovis subsp bovis AF2122/97
gcccgggcucggc

SEQ ID NO: 3157518 - RNA, 14 nt, Mycobacterium bovis subsp bovis AF2122/97
gcccgggcucggcg

SEQ ID NO: 3157519 - RNA, 16 nt, Mycobacterium bovis subsp bovis AF2122/97
gcccgggcugccgccc

SEQ ID NO: 3157520 - RNA, 16 nt, Mycobacterium bovis subsp bovis AF2122/97
gcccggggcgcacagc

SEQ ID NO: 3157521 - RNA, 17 nt, Mycobacterium bovis subsp bovis AF2122/97
gcccggggcgcacagcu

SEQ ID NO: 3157522 - RNA, 18 nt, Mycobacterium bovis subsp bovis AF2122/97
gcccggggcgcucgugau

SEQ ID NO: 3157523 - RNA, 22 nt, Mycobacterium bovis subsp bovis AF2122/97
gcccggggcgcucgugauguug

SEQ ID NO: 3157524 - RNA, 15 nt, Mycobacterium bovis subsp bovis AF2122/97
gcccggggcgguggg

SEQ ID NO: 3157525 - RNA, 14 nt, Mycobacterium bovis subsp bovis AF2122/97
gcccgggguccauc

SEQ ID NO: 3157526 - RNA, 19 nt, Mycobacterium bovis subsp bovis AF2122/97
gcccgggguguucgucgac

SEQ ID NO: 3157527 - RNA, 22 nt, Mycobacterium bovis subsp bovis AF2122/97
gcccgggguguucgucgaccau

SEQ ID NO: 3157528 - RNA, 16 nt, Mycobacterium bovis subsp bovis AF2122/97
gcccgggucggccggg

SEQ ID NO: 3157529 - RNA, 22 nt, Mycobacterium bovis subsp bovis AF2122/97
gcccgggucggccggguugccc

SEQ ID NO: 3157530 - RNA, 19 nt, Mycobacterium bovis subsp bovis AF2122/97
gcccgggucuccggcgcac

SEQ ID NO: 3157531 - RNA, 20 nt, Mycobacterium bovis subsp bovis AF2122/97
gcccgggucuccggcgcacc

SEQ ID NO: 3157532 - RNA, 20 nt, Mycobacterium bovis subsp bovis AF2122/97
gcccgggugaaacgauggcg

SEQ ID NO: 3157533 - RNA, 18 nt, Mycobacterium bovis subsp bovis AF2122/97
gcccgggugagacaaagg

SEQ ID NO: 3157534 - RNA, 19 nt, Mycobacterium bovis subsp bovis AF2122/97
gcccggguggcccggaaca

SEQ ID NO: 3157535 - RNA, 18 nt, Mycobacterium bovis subsp bovis AF2122/97
gcccggguggcgucgauc

SEQ ID NO: 3157536 - RNA, 15 nt, Mycobacterium bovis subsp bovis AF2122/97
gcccggguuggccga

SEQ ID NO: 3157537 - RNA, 18 nt, Mycobacterium bovis subsp bovis AF2122/97
gcccggguuggccgaaca

SEQ ID NO: 3157538 - RNA, 21 nt, Mycobacterium bovis subsp bovis AF2122/97
gcccggguuggccgaacagcu

SEQ ID NO: 3157539 - RNA, 13 nt, Mycobacterium bovis subsp bovis AF2122/97
gcccgguacgccg

SEQ ID NO: 3157540 - RNA, 17 nt, Mycobacterium bovis subsp bovis AF2122/97
gcccgguacgccgcgcc

SEQ ID NO: 3157541 - RNA, 22 nt, Mycobacterium bovis subsp bovis AF2122/97
gcccgguaucgucccggcgacc

SEQ ID NO: 3157542 - RNA, 16 nt, Mycobacterium bovis subsp bovis AF2122/97
gcccggucacgcugug

SEQ ID NO: 3157543 - RNA, 22 nt, Mycobacterium bovis subsp bovis AF2122/97
gcccggucauggucagcagaau

SEQ ID NO: 3157544 - RNA, 23 nt, Mycobacterium bovis subsp bovis AF2122/97
gcccgguccgccauuggcgccgu

SEQ ID NO: 3157545 - RNA, 13 nt, Mycobacterium bovis subsp bovis AF2122/97
gcccgguccgccg

SEQ ID NO: 3157546 - RNA, 14 nt, Mycobacterium bovis subsp bovis AF2122/97
gcccgguccgccgc

SEQ ID NO: 3157547 - RNA, 19 nt, Mycobacterium bovis subsp bovis AF2122/97
gcccgguccgccgcagacc

SEQ ID NO: 3157548 - RNA, 16 nt, Mycobacterium bovis subsp bovis AF2122/97
gcccggucgcugaucc

SEQ ID NO: 3157549 - RNA, 20 nt, Mycobacterium bovis subsp bovis AF2122/97
gcccggucgggcgcggggcg

SEQ ID NO: 3157550 - RNA, 17 nt, Mycobacterium bovis subsp bovis AF2122/97
gcccggucuacgccacc

SEQ ID NO: 3157551 - RNA, 18 nt, Mycobacterium bovis subsp bovis AF2122/97
gcccggucuacgccaccg

SEQ ID NO: 3157552 - RNA, 22 nt, Mycobacterium bovis subsp bovis AF2122/97
gcccggucucgacggcggccgc

SEQ ID NO: 3157553 - RNA, 19 nt, Mycobacterium bovis subsp bovis AF2122/97
gcccggucuuacggucggc

SEQ ID NO: 3157554 - RNA, 23 nt, Mycobacterium bovis subsp bovis AF2122/97
gcccggugagcuuagcgcauggg

SEQ ID NO: 3157555 - RNA, 19 nt, Mycobacterium bovis subsp bovis AF2122/97
gcccggugauccacgcucg

SEQ ID NO: 3157556 - RNA, 15 nt, Mycobacterium bovis subsp bovis AF2122/97
gcccggugauggugc

SEQ ID NO: 3157557 - RNA, 15 nt, Mycobacterium bovis subsp bovis AF2122/97
gcccggugcggugca

SEQ ID NO: 3157558 - RNA, 18 nt, Mycobacterium bovis subsp bovis AF2122/97
gcccggugcuaaccgacg

SEQ ID NO: 3157559 - RNA, 13 nt, Mycobacterium bovis subsp bovis AF2122/97
gcccgguggugcu

SEQ ID NO: 3157560 - RNA, 16 nt, Mycobacterium bovis subsp bovis AF2122/97
gcccgguggugcuguc

SEQ ID NO: 3157561 - RNA, 23 nt, Mycobacterium bovis subsp bovis AF2122/97
gcccgguguguauucgccgacgu

SEQ ID NO: 3157562 - RNA, 23 nt, Mycobacterium bovis subsp bovis AF2122/97
gcccgguguucaucacgccgccg

SEQ ID NO: 3157563 - RNA, 15 nt, Mycobacterium bovis subsp bovis AF2122/97
gcccgguucagcgcu

SEQ ID NO: 3157564 - RNA, 22 nt, Mycobacterium bovis subsp bovis AF2122/97
gcccgguucgaggaucccgcug

SEQ ID NO: 3157565 - RNA, 19 nt, Mycobacterium bovis subsp bovis AF2122/97
gcccgguuggaccacguga

SEQ ID NO: 3157566 - RNA, 16 nt, Mycobacterium bovis subsp bovis AF2122/97
gcccguagacccacag

SEQ ID NO: 3157567 - RNA, 15 nt, Mycobacterium bovis subsp bovis AF2122/97
gcccguagccgagcu

SEQ ID NO: 3157568 - RNA, 19 nt, Mycobacterium bovis subsp bovis AF2122/97
gcccguagcgucgaucacg

SEQ ID NO: 3157569 - RNA, 21 nt, Mycobacterium bovis subsp bovis AF2122/97
gcccguagcgucgaucacguc

SEQ ID NO: 3157570 - RNA, 15 nt, Mycobacterium bovis subsp bovis AF2122/97
gcccguagcugcgca

SEQ ID NO: 3157571 - RNA, 17 nt, Mycobacterium bovis subsp bovis AF2122/97
gcccguaucggcuucgu

SEQ ID NO: 3157572 - RNA, 13 nt, Mycobacterium bovis subsp bovis AF2122/97
gcccgucaccgcg

SEQ ID NO: 3157573 - RNA, 18 nt, Mycobacterium bovis subsp bovis AF2122/97
gcccgucacgcccgcgaa

SEQ ID NO: 3157574 - RNA, 19 nt, Mycobacterium bovis subsp bovis AF2122/97
gcccgucacgcccgcgaac

SEQ ID NO: 3157575 - RNA, 23 nt, Mycobacterium bovis subsp bovis AF2122/97
gcccgucagcuccccgucgggga

SEQ ID NO: 3157576 - RNA, 20 nt, Mycobacterium bovis subsp bovis AF2122/97
gcccgucauacucgacaccg

SEQ ID NO: 3157577 - RNA, 18 nt, Mycobacterium bovis subsp bovis AF2122/97
gcccguccaggcgcugca

SEQ ID NO: 3157578 - RNA, 21 nt, Mycobacterium bovis subsp bovis AF2122/97
gcccguccaggcgcugcagca

SEQ ID NO: 3157579 - RNA, 20 nt, Mycobacterium bovis subsp bovis AF2122/97
gcccgucccgcucgagcagc

SEQ ID NO: 3157580 - RNA, 15 nt, Mycobacterium bovis subsp bovis AF2122/97
gcccguccgcgcgcc

SEQ ID NO: 3157581 - RNA, 13 nt, Mycobacterium bovis subsp bovis AF2122/97
gcccguccucguc

SEQ ID NO: 3157582 - RNA, 17 nt, Mycobacterium bovis subsp bovis AF2122/97
gcccguccucgucggug

SEQ ID NO: 3157583 - RNA, 22 nt, Mycobacterium bovis subsp bovis AF2122/97
gcccguccucgucggugugcca

SEQ ID NO: 3157584 - RNA, 11 nt, Mycobacterium bovis subsp bovis AF2122/97
gcccgucgcca

SEQ ID NO: 3157585 - RNA, 15 nt, Mycobacterium bovis subsp bovis AF2122/97
gcccgucgcggccgg

SEQ ID NO: 3157586 - RNA, 22 nt, Mycobacterium bovis subsp bovis AF2122/97
gcccgucgcugggaggcgcggu

SEQ ID NO: 3157587 - RNA, 12 nt, Mycobacterium bovis subsp bovis AF2122/97
gcccgucggcgc

SEQ ID NO: 3157588 - RNA, 15 nt, Mycobacterium bovis subsp bovis AF2122/97
gcccgucggcgccga

SEQ ID NO: 3157589 - RNA, 17 nt, Mycobacterium bovis subsp bovis AF2122/97
gcccgucggcgccgaac

SEQ ID NO: 3157590 - RNA, 13 nt, Mycobacterium bovis subsp bovis AF2122/97
gcccgucgggccg

SEQ ID NO: 3157591 - RNA, 14 nt, Mycobacterium bovis subsp bovis AF2122/97
gcccgucgguggug

SEQ ID NO: 3157592 - RNA, 13 nt, Mycobacterium bovis subsp bovis AF2122/97
gcccucggccgcc

SEQ ID NO: 3157593 - RNA, 15 nt, Mycobacterium bovis subsp bovis AF2122/97
gcccucggcgccgaa

SEQ ID NO: 3157594 - RNA, 14 nt, Mycobacterium bovis subsp bovis AF2122/97
gcccucgggacugc

SEQ ID NO: 3157595 - RNA, 20 nt, Mycobacterium bovis subsp bovis AF2122/97
gcccucgggguagccaaccu

SEQ ID NO: 3157596 - RNA, 17 nt, Mycobacterium bovis subsp bovis AF2122/97
gcccucgucgaucgccg

SEQ ID NO: 3157597 - RNA, 19 nt, Mycobacterium bovis subsp bovis AF2122/97
gcccucgucgcgggccacc

SEQ ID NO: 3157598 - RNA, 19 nt, Mycobacterium bovis subsp bovis AF2122/97
gcccucgucgggaucggcg

SEQ ID NO: 3157599 - RNA, 20 nt, Mycobacterium bovis subsp bovis AF2122/97
gcccucgucgggaucggcgu

SEQ ID NO: 3157600 - RNA, 19 nt, Mycobacterium bovis subsp bovis AF2122/97
gcccucguuaucgaccgcc

SEQ ID NO: 3157601 - RNA, 23 nt, Mycobacterium bovis subsp bovis AF2122/97
gcccucguuaucgaccgccgcga

SEQ ID NO: 3157602 - RNA, 17 nt, Mycobacterium bovis subsp bovis AF2122/97
gcccucuaugcgggcag

SEQ ID NO: 3157603 - RNA, 13 nt, Mycobacterium bovis subsp bovis AF2122/97
gcccucuggcucg

SEQ ID NO: 3157604 - RNA, 15 nt, Mycobacterium bovis subsp bovis AF2122/97
gcccugaauccucuc

SEQ ID NO: 3157605 - RNA, 20 nt, Mycobacterium bovis subsp bovis AF2122/97
gcccugacacaacaccggcg

SEQ ID NO: 3157606 - RNA, 21 nt, Mycobacterium bovis subsp bovis AF2122/97
gcccugacacccaucgaccgc

SEQ ID NO: 3157607 - RNA, 20 nt, Mycobacterium bovis subsp bovis AF2122/97
gcccugacgccccgccacaa

SEQ ID NO: 3157608 - RNA, 20 nt, Mycobacterium bovis subsp bovis AF2122/97
gcccugacgucacguucggc

SEQ ID NO: 3157609 - RNA, 19 nt, Mycobacterium bovis subsp bovis AF2122/97
gcccugagaacacguucgg

SEQ ID NO: 3157610 - RNA, 20 nt, Mycobacterium bovis subsp bovis AF2122/97
gcccugagaacacguucggc

SEQ ID NO: 3157611 - RNA, 23 nt, Mycobacterium bovis subsp bovis AF2122/97
gcccugagaacacguucggcguc

SEQ ID NO: 3157612 - RNA, 20 nt, Mycobacterium bovis subsp bovis AF2122/97
gcccugagcgaagugucgcu

SEQ ID NO: 3157613 - RNA, 20 nt, Mycobacterium bovis subsp bovis AF2122/97
gcccugagcugccgagcggu

SEQ ID NO: 3157614 - RNA, 24 nt, Mycobacterium bovis subsp bovis AF2122/97
gcccugagcugccgagcggucaac

SEQ ID NO: 3157615 - RNA, 14 nt, Mycobacterium bovis subsp bovis AF2122/97
gcccugauugaagc

SEQ ID NO: 3157616 - RNA, 16 nt, Mycobacterium bovis subsp bovis AF2122/97
gcccugauugaagccc

SEQ ID NO: 3157617 - RNA, 14 nt, Mycobacterium bovis subsp bovis AF2122/97
gcccugcacagcag

SEQ ID NO: 3157618 - RNA, 15 nt, Mycobacterium bovis subsp bovis AF2122/97
gcccugcacagcagc

SEQ ID NO: 3157619 - RNA, 13 nt, Mycobacterium bovis subsp bovis AF2122/97
gcccugcagacgg

SEQ ID NO: 3157620 - RNA, 20 nt, Mycobacterium bovis subsp bovis AF2122/97
gcccugccccggacuccaaa

SEQ ID NO: 3157621 - RNA, 16 nt, Mycobacterium bovis subsp bovis AF2122/97
gcccugcccgaaggug

SEQ ID NO: 3157622 - RNA, 17 nt, Mycobacterium bovis subsp bovis AF2122/97
gcccugcccgaaggugg

SEQ ID NO: 3157623 - RNA, 18 nt, Mycobacterium bovis subsp bovis AF2122/97
gcccugccgacgcuccag

SEQ ID NO: 3157624 - RNA, 13 nt, Mycobacterium bovis subsp bovis AF2122/97
gcccugccgccgg

SEQ ID NO: 3157625 - RNA, 14 nt, Mycobacterium bovis subsp bovis AF2122/97
gcccugccgccggc

SEQ ID NO: 3157626 - RNA, 17 nt, Mycobacterium bovis subsp bovis AF2122/97
gcccugccggcagcggc

SEQ ID NO: 3157627 - RNA, 19 nt, Mycobacterium bovis subsp bovis AF2122/97
gcccugccggcagcggcga

SEQ ID NO: 3157628 - RNA, 14 nt, Mycobacterium bovis subsp bovis AF2122/97
gcccugcgcagccg

SEQ ID NO: 3157629 - RNA, 19 nt, Mycobacterium bovis subsp bovis AF2122/97
gcccugcgccacacccggc

SEQ ID NO: 3157630 - RNA, 13 nt, Mycobacterium bovis subsp bovis AF2122/97
gcccugcgccucg

SEQ ID NO: 3157631 - RNA, 19 nt, Mycobacterium bovis subsp bovis AF2122/97
gcccugcgccucggcggcc

SEQ ID NO: 3157632 - RNA, 14 nt, Mycobacterium bovis subsp bovis AF2122/97
gcccugcgcucggg

SEQ ID NO: 3157633 - RNA, 14 nt, Mycobacterium bovis subsp bovis AF2122/97
gcccugcggccacg

SEQ ID NO: 3157634 - RNA, 15 nt, Mycobacterium bovis subsp bovis AF2122/97
gcccugcuccucgcg

SEQ ID NO: 3157635 - RNA, 22 nt, Mycobacterium bovis subsp bovis AF2122/97
gcccugcuccucgcgggcggcg

SEQ ID NO: 3157636 - RNA, 14 nt, Mycobacterium bovis subsp bovis AF2122/97
gcccugcuggccca

SEQ ID NO: 3157637 - RNA, 16 nt, Mycobacterium bovis subsp bovis AF2122/97
gcccugcuggugucgg

SEQ ID NO: 3157638 - RNA, 20 nt, Mycobacterium bovis subsp bovis AF2122/97
gcccugcuggugucggcucg

SEQ ID NO: 3157639 - RNA, 22 nt, Mycobacterium bovis subsp bovis AF2122/97
gcccugcuugcaggcgaucugg

SEQ ID NO: 3157640 - RNA, 18 nt, Mycobacterium bovis subsp bovis AF2122/97
gcccuggaaugccgccac

SEQ ID NO: 3157641 - RNA, 22 nt, Mycobacterium bovis subsp bovis AF2122/97
gcccuggacauaccggcccggg

SEQ ID NO: 3157642 - RNA, 14 nt, Mycobacterium bovis subsp bovis AF2122/97
gcccuggaccagcg

SEQ ID NO: 3157643 - RNA, 15 nt, Mycobacterium bovis subsp bovis AF2122/97
gcccuggacgucggc

SEQ ID NO: 3157644 - RNA, 16 nt, Mycobacterium bovis subsp bovis AF2122/97
gcccuggacgucggcg

SEQ ID NO: 3157645 - RNA, 16 nt, Mycobacterium bovis subsp bovis AF2122/97
gcccuggcaacgacac

SEQ ID NO: 3157646 - RNA, 18 nt, Mycobacterium bovis subsp bovis AF2122/97
gcccuggcaacgacacgc

SEQ ID NO: 3157647 - RNA, 20 nt, Mycobacterium bovis subsp bovis AF2122/97
gcccuggcaacgacacgccg

SEQ ID NO: 3157648 - RNA, 16 nt, Mycobacterium bovis subsp bovis AF2122/97
gcccuggccagcccga

SEQ ID NO: 3157649 - RNA, 23 nt, Mycobacterium bovis subsp bovis AF2122/97
gcccuggccgcccagaccgccga

SEQ ID NO: 3157650 - RNA, 20 nt, Mycobacterium bovis subsp bovis AF2122/97
gcccuggccgcccuggccgc

SEQ ID NO: 3157651 - RNA, 13 nt, Mycobacterium bovis subsp bovis AF2122/97
gcccuggccgccg

SEQ ID NO: 3157652 - RNA, 15 nt, Mycobacterium bovis subsp bovis AF2122/97
gcccuggccgccggc

SEQ ID NO: 3157653 - RNA, 16 nt, Mycobacterium bovis subsp bovis AF2122/97
gcccuggccgccggcc

SEQ ID NO: 3157654 - RNA, 23 nt, Mycobacterium bovis subsp bovis AF2122/97
gcccuggccgccggccccgccgu

SEQ ID NO: 3157655 - RNA, 14 nt, Mycobacterium bovis subsp bovis AF2122/97
gcccuggccgcgcc

SEQ ID NO: 3157656 - RNA, 16 nt, Mycobacterium bovis subsp bovis AF2122/97
gcccuggccgcgccgg

SEQ ID NO: 3157657 - RNA, 20 nt, Mycobacterium bovis subsp bovis AF2122/97
gcccuggcgaccagccgagc

SEQ ID NO: 3157658 - RNA, 14 nt, Mycobacterium bovis subsp bovis AF2122/97
gcccuggcggcccg

SEQ ID NO: 3157659 - RNA, 14 nt, Mycobacterium bovis subsp bovis AF2122/97
gcccugggcgccgg

SEQ ID NO: 3157660 - RNA, 15 nt, Mycobacterium bovis subsp bovis AF2122/97
gcccugggcgccggc

SEQ ID NO: 3157661 - RNA, 19 nt, Mycobacterium bovis subsp bovis AF2122/97
gcccugggugauggccgcg

SEQ ID NO: 3157662 - RNA, 21 nt, Mycobacterium bovis subsp bovis AF2122/97
gcccugggugauggccgcgcc

SEQ ID NO: 3157663 - RNA, 22 nt, Mycobacterium bovis subsp bovis AF2122/97
gcccugggugauggccgcgccc

SEQ ID NO: 3157664 - RNA, 17 nt, Mycobacterium bovis subsp bovis AF2122/97
gcccugguccaggcccu

SEQ ID NO: 3157665 - RNA, 18 nt, Mycobacterium bovis subsp bovis AF2122/97
gcccugguccaggcccug

SEQ ID NO: 3157666 - RNA, 11 nt, Mycobacterium bovis subsp bovis AF2122/97
gcccugguugg

SEQ ID NO: 3157667 - RNA, 20 nt, Mycobacterium bovis subsp bovis AF2122/97
gcccugguuggugacguaga

SEQ ID NO: 3157668 - RNA, 17 nt, Mycobacterium bovis subsp bovis AF2122/97
gcccuguccggcgccga

SEQ ID NO: 3157669 - RNA, 22 nt, Mycobacterium bovis subsp bovis AF2122/97
gcccuguccggguagcggcgcc

SEQ ID NO: 3157670 - RNA, 15 nt, Mycobacterium bovis subsp bovis AF2122/97
gcccuguucggcccg

SEQ ID NO: 3157671 - RNA, 13 nt, Mycobacterium bovis subsp bovis AF2122/97
gcccuguucuccg

SEQ ID NO: 3157672 - RNA, 21 nt, Mycobacterium bovis subsp bovis AF2122/97
gcccuuaagccggcgcggcgg

SEQ ID NO: 3157673 - RNA, 17 nt, Mycobacterium bovis subsp bovis AF2122/97
gcccuuagggucgccgc

SEQ ID NO: 3157674 - RNA, 13 nt, Mycobacterium bovis subsp bovis AF2122/97
gcccuucaccagc

SEQ ID NO: 3157675 - RNA, 14 nt, Mycobacterium bovis subsp bovis AF2122/97
gcccuucaccagcc

SEQ ID NO: 3157676 - RNA, 13 nt, Mycobacterium bovis subsp bovis AF2122/97
gcccuucagcacg

SEQ ID NO: 3157677 - RNA, 14 nt, Mycobacterium bovis subsp bovis AF2122/97
gcccuucagcacgg

SEQ ID NO: 3157678 - RNA, 19 nt, Mycobacterium bovis subsp bovis AF2122/97
gcccuucagcguccuggug

SEQ ID NO: 3157679 - RNA, 19 nt, Mycobacterium bovis subsp bovis AF2122/97
gccgaacguggcucggcgg

SEQ ID NO: 3157680 - RNA, 20 nt, Mycobacterium bovis subsp bovis AF2122/97
gccgaacguguugaccaggc

SEQ ID NO: 3157681 - RNA, 16 nt, Mycobacterium bovis subsp bovis AF2122/97
gccgaacuaccgacgc

SEQ ID NO: 3157682 - RNA, 19 nt, Mycobacterium bovis subsp bovis AF2122/97
gccgaacuaccgacgcacc

SEQ ID NO: 3157683 - RNA, 17 nt, Mycobacterium bovis subsp bovis AF2122/97
gccgaacuaucguugug

SEQ ID NO: 3157684 - RNA, 12 nt, Mycobacterium bovis subsp bovis AF2122/97
gccgaacuccgc

SEQ ID NO: 3157685 - RNA, 19 nt, Mycobacterium bovis subsp bovis AF2122/97
gccgaacuccgcggaaccc

SEQ ID NO: 3157686 - RNA, 20 nt, Mycobacterium bovis subsp bovis AF2122/97
gccgaagaaccggucgcagu

SEQ ID NO: 3157687 - RNA, 18 nt, Mycobacterium bovis subsp bovis AF2122/97
gccgaagacgugccggcu

SEQ ID NO: 3157688 - RNA, 15 nt, Mycobacterium bovis subsp bovis AF2122/97
gccgaagaugaccgc

SEQ ID NO: 3157689 - RNA, 16 nt, Mycobacterium bovis subsp bovis AF2122/97
gccgaagaugaccgcu

SEQ ID NO: 3157690 - RNA, 17 nt, Mycobacterium bovis subsp bovis AF2122/97
gccgaagcagaacagua

SEQ ID NO: 3157691 - RNA, 12 nt, Mycobacterium bovis subsp bovis AF2122/97
gccgaagcccga

SEQ ID NO: 3157692 - RNA, 19 nt, Mycobacterium bovis subsp bovis AF2122/97
gccgaagcccgaucggcgg

SEQ ID NO: 3157693 - RNA, 13 nt, Mycobacterium bovis subsp bovis AF2122/97
gccgaagcccggc

SEQ ID NO: 3157694 - RNA, 13 nt, Mycobacterium bovis subsp bovis AF2122/97
gccgaagccgaag

SEQ ID NO: 3157695 - RNA, 16 nt, Mycobacterium bovis subsp bovis AF2122/97
gccgaagccgaagggg

SEQ ID NO: 3157696 - RNA, 14 nt, Mycobacterium bovis subsp bovis AF2122/97
gccgaagccgacga

SEQ ID NO: 3157697 - RNA, 16 nt, Mycobacterium bovis subsp bovis AF2122/97
gccgaagccgacgaac

SEQ ID NO: 3157698 - RNA, 13 nt, Mycobacterium bovis subsp bovis AF2122/97
gccgaagccgcgc

SEQ ID NO: 3157699 - RNA, 16 nt, Mycobacterium bovis subsp bovis AF2122/97
gccgaagccggagaua

SEQ ID NO: 3157700 - RNA, 21 nt, Mycobacterium bovis subsp bovis AF2122/97
gccgaagccuugcagcgcccc

SEQ ID NO: 3157701 - RNA, 19 nt, Mycobacterium bovis subsp bovis AF2122/97
gccgaagcgaugccgugcu

SEQ ID NO: 3157702 - RNA, 19 nt, Mycobacterium bovis subsp bovis AF2122/97
gccgaagcgccgcuuggcg

SEQ ID NO: 3157703 - RNA, 14 nt, Mycobacterium bovis subsp bovis AF2122/97
gccgaagcggccac

SEQ ID NO: 3157704 - RNA, 16 nt, Mycobacterium bovis subsp bovis AF2122/97
gccgaagcggccaccg

SEQ ID NO: 3157705 - RNA, 18 nt, Mycobacterium bovis subsp bovis AF2122/97
gccgaagcggccaccgcc

SEQ ID NO: 3157706 - RNA, 21 nt, Mycobacterium bovis subsp bovis AF2122/97
gccgaagcggccaccgccgcc

SEQ ID NO: 3157707 - RNA, 22 nt, Mycobacterium bovis subsp bovis AF2122/97
gccgaagcggccaccgccgccg

SEQ ID NO: 3157708 - RNA, 23 nt, Mycobacterium bovis subsp bovis AF2122/97
gccgaagcggccaccgccgccgc

SEQ ID NO: 3157709 - RNA, 13 nt, Mycobacterium bovis subsp bovis AF2122/97
gccgaagcgggcc

SEQ ID NO: 3157710 - RNA, 17 nt, Mycobacterium bovis subsp bovis AF2122/97
gccgaagcgggcccgca

SEQ ID NO: 3157711 - RNA, 15 nt, Mycobacterium bovis subsp bovis AF2122/97
gccgaagcugcccaa

SEQ ID NO: 3157712 - RNA, 14 nt, Mycobacterium bovis subsp bovis AF2122/97
gccgaaggccuuau

SEQ ID NO: 3157713 - RNA, 15 nt, Mycobacterium bovis subsp bovis AF2122/97
gccgaaggcggggga

SEQ ID NO: 3157714 - RNA, 18 nt, Mycobacterium bovis subsp bovis AF2122/97
gccgaaggggaacgcgcc

SEQ ID NO: 3157715 - RNA, 21 nt, Mycobacterium bovis subsp bovis AF2122/97
gccgaaggggaacgcgcccac

SEQ ID NO: 3157716 - RNA, 20 nt, Mycobacterium bovis subsp bovis AF2122/97
gccgaaguagacggugguga

SEQ ID NO: 3157717 - RNA, 18 nt, Mycobacterium bovis subsp bovis AF2122/97
gccgaaguagccgaccgg

SEQ ID NO: 3157718 - RNA, 16 nt, Mycobacterium bovis subsp bovis AF2122/97
gccgaaguggagcccc

SEQ ID NO: 3157719 - RNA, 15 nt, Mycobacterium bovis subsp bovis AF2122/97
gccgaaguggcgccu

SEQ ID NO: 3157720 - RNA, 21 nt, Mycobacterium bovis subsp bovis AF2122/97
gccgaaguggucuccggcacc

SEQ ID NO: 3157721 - RNA, 20 nt, Mycobacterium bovis subsp bovis AF2122/97
gccgaaguuccagccgacgg

SEQ ID NO: 3157722 - RNA, 21 nt, Mycobacterium bovis subsp bovis AF2122/97
gccgaaguuccagccgacggc

SEQ ID NO: 3157723 - RNA, 18 nt, Mycobacterium bovis subsp bovis AF2122/97
gccgaaguugaugucgcg

SEQ ID NO: 3157724 - RNA, 23 nt, Mycobacterium bovis subsp bovis AF2122/97
gccgaaguuuuggaagcccgaau

SEQ ID NO: 3157725 - RNA, 18 nt, Mycobacterium bovis subsp bovis AF2122/97
gccgaauaccacaccgug

SEQ ID NO: 3157726 - RNA, 20 nt, Mycobacterium bovis subsp bovis AF2122/97
gccgaauaccgguggcagcc

SEQ ID NO: 3157727 - RNA, 22 nt, Mycobacterium bovis subsp bovis AF2122/97
gccgaauaccgguggcagccug

SEQ ID NO: 3157728 - RNA, 12 nt, Mycobacterium bovis subsp bovis AF2122/97
gccgaaucccgc

SEQ ID NO: 3157729 - RNA, 18 nt, Mycobacterium bovis subsp bovis AF2122/97
gccgaauccguccgacga

SEQ ID NO: 3157730 - RNA, 13 nt, Mycobacterium bovis subsp bovis AF2122/97
gccgaaucgcggg

SEQ ID NO: 3157731 - RNA, 21 nt, Mycobacterium bovis subsp bovis AF2122/97
gccgaaucgcgggcugaccaa

SEQ ID NO: 3157732 - RNA, 13 nt, Mycobacterium bovis subsp bovis AF2122/97
gccgaaucggcag

SEQ ID NO: 3157733 - RNA, 20 nt, Mycobacterium bovis subsp bovis AF2122/97
gccgaaucggcaguugaacu

SEQ ID NO: 3157734 - RNA, 22 nt, Mycobacterium bovis subsp bovis AF2122/97
gccgaaugccaccucgacgcac

SEQ ID NO: 3157735 - RNA, 14 nt, Mycobacterium bovis subsp bovis AF2122/97
gccgaauggcuggg

SEQ ID NO: 3157736 - RNA, 21 nt, Mycobacterium bovis subsp bovis AF2122/97
gccgaauucauccgggcucgc

SEQ ID NO: 3157737 - RNA, 17 nt, Mycobacterium bovis subsp bovis AF2122/97
gccgaauuggcggaacu

SEQ ID NO: 3157738 - RNA, 13 nt, Mycobacterium bovis subsp bovis AF2122/97
gccgacaaaagcc

SEQ ID NO: 3157739 - RNA, 12 nt, Mycobacterium bovis subsp bovis AF2122/97
gccgacaacccc

SEQ ID NO: 3157740 - RNA, 13 nt, Mycobacterium bovis subsp bovis AF2122/97
gccgacaacccgg

SEQ ID NO: 3157741 - RNA, 15 nt, Mycobacterium bovis subsp bovis AF2122/97
gccgacaacccggcc

SEQ ID NO: 3157742 - RNA, 20 nt, Mycobacterium bovis subsp bovis AF2122/97
gccgacaacccggccgggcc

SEQ ID NO: 3157743 - RNA, 17 nt, Mycobacterium bovis subsp bovis AF2122/97
gccgacaaccuuggcga

SEQ ID NO: 3157744 - RNA, 18 nt, Mycobacterium bovis subsp bovis AF2122/97
gccgacaaucaccaacgc

SEQ ID NO: 3157745 - RNA, 18 nt, Mycobacterium bovis subsp bovis AF2122/97
gccgacaaugucggcgau

SEQ ID NO: 3157746 - RNA, 16 nt, Mycobacterium bovis subsp bovis AF2122/97
gccgacaccaccggcg

SEQ ID NO: 3157747 - RNA, 18 nt, Mycobacterium bovis subsp bovis AF2122/97
gccgacaccaccggcgcc

SEQ ID NO: 3157748 - RNA, 20 nt, Mycobacterium bovis subsp bovis AF2122/97
gccgacaccaccggcgccgc

SEQ ID NO: 3157749 - RNA, 21 nt, Mycobacterium bovis subsp bovis AF2122/97
gccgacaccaccggcgccgcc

SEQ ID NO: 3157750 - RNA, 22 nt, Mycobacterium bovis subsp bovis AF2122/97
gccgacaccaccggcgccgccg

SEQ ID NO: 3157751 - RNA, 15 nt, Mycobacterium bovis subsp bovis AF2122/97
gccgacaccgccacc

SEQ ID NO: 3157752 - RNA, 15 nt, Mycobacterium bovis subsp bovis AF2122/97
gccgacagccaccgc

SEQ ID NO: 3157753 - RNA, 16 nt, Mycobacterium bovis subsp bovis AF2122/97
gccgacagccaccgcg

SEQ ID NO: 3157754 - RNA, 13 nt, Mycobacterium bovis subsp bovis AF2122/97
gccgacagccgau

SEQ ID NO: 3157755 - RNA, 18 nt, Mycobacterium bovis subsp bovis AF2122/97
gccgacagccgauccgau

SEQ ID NO: 3157756 - RNA, 13 nt, Mycobacterium bovis subsp bovis AF2122/97
gccgacagcgccu

SEQ ID NO: 3157757 - RNA, 15 nt, Mycobacterium bovis subsp bovis AF2122/97
gccgacagcucaucg

SEQ ID NO: 3157758 - RNA, 16 nt, Mycobacterium bovis subsp bovis AF2122/97
gccgacagcucaucga

SEQ ID NO: 3157759 - RNA, 15 nt, Mycobacterium bovis subsp bovis AF2122/97
gccgacaggccggcc

SEQ ID NO: 3157760 - RNA, 18 nt, Mycobacterium bovis subsp bovis AF2122/97
gccgacaggccggccacc

SEQ ID NO: 3157761 - RNA, 21 nt, Mycobacterium bovis subsp bovis AF2122/97
gccgacaucgauguggaugga

SEQ ID NO: 3157762 - RNA, 13 nt, Mycobacterium bovis subsp bovis AF2122/97
gccgacaucggcg

SEQ ID NO: 3157763 - RNA, 14 nt, Mycobacterium bovis subsp bovis AF2122/97
gccgacaucggcgg

SEQ ID NO: 3157764 - RNA, 13 nt, Mycobacterium bovis subsp bovis AF2122/97
gccgacauggcgg

SEQ ID NO: 3157765 - RNA, 16 nt, Mycobacterium bovis subsp bovis AF2122/97
gccgacauggcggugc

SEQ ID NO: 3157766 - RNA, 21 nt, Mycobacterium bovis subsp bovis AF2122/97
gccgacgaggggcgcgggugg

SEQ ID NO: 3157767 - RNA, 17 nt, Mycobacterium bovis subsp bovis AF2122/97
gccgacgauccacggcg

SEQ ID NO: 3157768 - RNA, 15 nt, Mycobacterium bovis subsp bovis AF2122/97
gccgacgaucgacgc

SEQ ID NO: 3157769 - RNA, 19 nt, Mycobacterium bovis subsp bovis AF2122/97
gccgacgaucgacgccgcc

SEQ ID NO: 3157770 - RNA, 23 nt, Mycobacterium bovis subsp bovis AF2122/97
gccgacgaucgacgccgccaccc

SEQ ID NO: 3157771 - RNA, 16 nt, Mycobacterium bovis subsp bovis AF2122/97
gccgacgaugacgcgc

SEQ ID NO: 3157772 - RNA, 19 nt, Mycobacterium bovis subsp bovis AF2122/97
gccgacgauguuccaggcu

SEQ ID NO: 3157773 - RNA, 22 nt, Mycobacterium bovis subsp bovis AF2122/97
gccgacgauguuccaggcuacc

SEQ ID NO: 3157774 - RNA, 17 nt, Mycobacterium bovis subsp bovis AF2122/97
gccgacgauuaccagcg

SEQ ID NO: 3157775 - RNA, 19 nt, Mycobacterium bovis subsp bovis AF2122/97
gccgacgauuaccagcggc

SEQ ID NO: 3157776 - RNA, 20 nt, Mycobacterium bovis subsp bovis AF2122/97
gccgacgauuaccagcggca

SEQ ID NO: 3157777 - RNA, 22 nt, Mycobacterium bovis subsp bovis AF2122/97
gccgacgauuaccagcggcacc

SEQ ID NO: 3157778 - RNA, 23 nt, Mycobacterium bovis subsp bovis AF2122/97
gccgacgauuaccagcggcaccg

SEQ ID NO: 3157779 - RNA, 14 nt, Mycobacterium bovis subsp bovis AF2122/97
gccgacgccaacgc

SEQ ID NO: 3157780 - RNA, 21 nt, Mycobacterium bovis subsp bovis AF2122/97
gccgacgccagaacguggcca

SEQ ID NO: 3157781 - RNA, 15 nt, Mycobacterium bovis subsp bovis AF2122/97
gccgacgcccgacga

SEQ ID NO: 3157782 - RNA, 14 nt, Mycobacterium bovis subsp bovis AF2122/97
gccgacgccgccgg

SEQ ID NO: 3157783 - RNA, 15 nt, Mycobacterium bovis subsp bovis AF2122/97
gccgacgccgccggc

SEQ ID NO: 3157784 - RNA, 16 nt, Mycobacterium bovis subsp bovis AF2122/97
gccgacgccgccggca

SEQ ID NO: 3157785 - RNA, 23 nt, Mycobacterium bovis subsp bovis AF2122/97
gccgacgccgccggcaccguaga

SEQ ID NO: 3157786 - RNA, 17 nt, Mycobacterium bovis subsp bovis AF2122/97
gccgacgccgccggccc

SEQ ID NO: 3157787 - RNA, 19 nt, Mycobacterium bovis subsp bovis AF2122/97
gccgacgccgccggccccg

SEQ ID NO: 3157788 - RNA, 16 nt, Mycobacterium bovis subsp bovis AF2122/97
gccgacgccgccggcg

SEQ ID NO: 3157789 - RNA, 19 nt, Mycobacterium bovis subsp bovis AF2122/97
gccgacgccgccggcgcca

SEQ ID NO: 3157790 - RNA, 22 nt, Mycobacterium bovis subsp bovis AF2122/97
gccgacgccgccggcgccaccg

SEQ ID NO: 3157791 - RNA, 13 nt, Mycobacterium bovis subsp bovis AF2122/97
gccgacgccguug

SEQ ID NO: 3157792 - RNA, 16 nt, Mycobacterium bovis subsp bovis AF2122/97
gccgacgccuuccagc

SEQ ID NO: 3157793 - RNA, 14 nt, Mycobacterium bovis subsp bovis AF2122/97
gccgacgcgcggcc

SEQ ID NO: 3157794 - RNA, 16 nt, Mycobacterium bovis subsp bovis AF2122/97
gccgacgcgcggccag

SEQ ID NO: 3157795 - RNA, 12 nt, Mycobacterium bovis subsp bovis AF2122/97
gccgacgcggcg

SEQ ID NO: 3157796 - RNA, 20 nt, Mycobacterium bovis subsp bovis AF2122/97
gccgacgcguucgagugcgg

SEQ ID NO: 3157797 - RNA, 19 nt, Mycobacterium bovis subsp bovis AF2122/97
gccgacgcuaaguccccgc

SEQ ID NO: 3157798 - RNA, 15 nt, Mycobacterium bovis subsp bovis AF2122/97
gccgacggaucgccc

SEQ ID NO: 3157799 - RNA, 17 nt, Mycobacterium bovis subsp bovis AF2122/97
gccgacggcaucaacgc

SEQ ID NO: 3157800 - RNA, 18 nt, Mycobacterium bovis subsp bovis AF2122/97
gccgacggcaucaacgcg

SEQ ID NO: 3157801 - RNA, 14 nt, Mycobacterium bovis subsp bovis AF2122/97
gccgacggccagca

SEQ ID NO: 3157802 - RNA, 16 nt, Mycobacterium bovis subsp bovis AF2122/97
gccgacggccagcagg

SEQ ID NO: 3157803 - RNA, 14 nt, Mycobacterium bovis subsp bovis AF2122/97
gccgacggcgcccc

SEQ ID NO: 3157804 - RNA, 12 nt, Mycobacterium bovis subsp bovis AF2122/97
gccgacgggaac

SEQ ID NO: 3157805 - RNA, 17 nt, Mycobacterium bovis subsp bovis AF2122/97
gccgacgggaaccucga

SEQ ID NO: 3157806 - RNA, 13 nt, Mycobacterium bovis subsp bovis AF2122/97
gccgacgggacaa

SEQ ID NO: 3157807 - RNA, 17 nt, Mycobacterium bovis subsp bovis AF2122/97
gccgacgggacaacccg

SEQ ID NO: 3157808 - RNA, 18 nt, Mycobacterium bovis subsp bovis AF2122/97
gccgacgggugcgcggag

SEQ ID NO: 3157809 - RNA, 20 nt, Mycobacterium bovis subsp bovis AF2122/97
gccgacggguuggcuaccca

SEQ ID NO: 3157810 - RNA, 15 nt, Mycobacterium bovis subsp bovis AF2122/97
gccgacggugauggg

SEQ ID NO: 3157811 - RNA, 23 nt, Mycobacterium bovis subsp bovis AF2122/97
gccgacggugaugggggagccgg

SEQ ID NO: 3157812 - RNA, 15 nt, Mycobacterium bovis subsp bovis AF2122/97
gccgacggugggcga

SEQ ID NO: 3157813 - RNA, 18 nt, Mycobacterium bovis subsp bovis AF2122/97
gccgacguacaggacggu

SEQ ID NO: 3157814 - RNA, 19 nt, Mycobacterium bovis subsp bovis AF2122/97
gccgacguauagaccaggu

SEQ ID NO: 3157815 - RNA, 20 nt, Mycobacterium bovis subsp bovis AF2122/97
gccgacgucgaccacugccc

SEQ ID NO: 3157816 - RNA, 22 nt, Mycobacterium bovis subsp bovis AF2122/97
gccgacgucgacgccggccagc

SEQ ID NO: 3157817 - RNA, 23 nt, Mycobacterium bovis subsp bovis AF2122/97
gccgacgucgacgccggccagcg

SEQ ID NO: 3157818 - RNA, 17 nt, Mycobacterium bovis subsp bovis AF2122/97
gccgacgucgccgacgg

SEQ ID NO: 3157819 - RNA, 13 nt, Mycobacterium bovis subsp bovis AF2122/97
gccgacgucggca

SEQ ID NO: 3157820 - RNA, 21 nt, Mycobacterium bovis subsp bovis AF2122/97
gccgacgucuaggccaaaccc

SEQ ID NO: 3157821 - RNA, 22 nt, Mycobacterium bovis subsp bovis AF2122/97
gccgacgucuaggccaaacccc

SEQ ID NO: 3157822 - RNA, 13 nt, Mycobacterium bovis subsp bovis AF2122/97
gccgacgugacaa

SEQ ID NO: 3157823 - RNA, 15 nt, Mycobacterium bovis subsp bovis AF2122/97
gccgacgugaccagc

SEQ ID NO: 3157824 - RNA, 14 nt, Mycobacterium bovis subsp bovis AF2122/97
gccgacgugcggcg

SEQ ID NO: 3157825 - RNA, 16 nt, Mycobacterium bovis subsp bovis AF2122/97
gccgacgugcggcggc

SEQ ID NO: 3157826 - RNA, 22 nt, Mycobacterium bovis subsp bovis AF2122/97
gccgacguugaagccgccggag

SEQ ID NO: 3157827 - RNA, 14 nt, Mycobacterium bovis subsp bovis AF2122/97
gccgacguugggga

SEQ ID NO: 3157828 - RNA, 22 nt, Mycobacterium bovis subsp bovis AF2122/97
gccgacuacgaagacguucgga

SEQ ID NO: 3157829 - RNA, 18 nt, Mycobacterium bovis subsp bovis AF2122/97
gccgacuagcugggguca

SEQ ID NO: 3157830 - RNA, 23 nt, Mycobacterium bovis subsp bovis AF2122/97
gccgacuagcuggggucaaagca

SEQ ID NO: 3157831 - RNA, 18 nt, Mycobacterium bovis subsp bovis AF2122/97
gccgacuaucggccgccg

SEQ ID NO: 3157832 - RNA, 20 nt, Mycobacterium bovis subsp bovis AF2122/97
gccgacuaucggccgccgga

SEQ ID NO: 3157833 - RNA, 21 nt, Mycobacterium bovis subsp bovis AF2122/97
gccgacuaucggccgccggau

SEQ ID NO: 3157834 - RNA, 16 nt, Mycobacterium bovis subsp bovis AF2122/97
gccgacucaggucggu

SEQ ID NO: 3157835 - RNA, 18 nt, Mycobacterium bovis subsp bovis AF2122/97
gccgacucaggucggugc

SEQ ID NO: 3157836 - RNA, 19 nt, Mycobacterium bovis subsp bovis AF2122/97
gccgacucaggucggugcg

SEQ ID NO: 3157837 - RNA, 18 nt, Mycobacterium bovis subsp bovis AF2122/97
gccgacucaucggccgcg

SEQ ID NO: 3157838 - RNA, 21 nt, Mycobacterium bovis subsp bovis AF2122/97
gccgacucaucggccgcgguc

SEQ ID NO: 3157839 - RNA, 22 nt, Mycobacterium bovis subsp bovis AF2122/97
gccgacucaucggccgcggucg

SEQ ID NO: 3157840 - RNA, 16 nt, Mycobacterium bovis subsp bovis AF2122/97
gccgacuccccgccgg

SEQ ID NO: 3157841 - RNA, 15 nt, Mycobacterium bovis subsp bovis AF2122/97
gccgacucggcaccg

SEQ ID NO: 3157842 - RNA, 18 nt, Mycobacterium bovis subsp bovis AF2122/97
gccgacugggcgcgaccc

SEQ ID NO: 3157843 - RNA, 21 nt, Mycobacterium bovis subsp bovis AF2122/97
gccgacugggcgcgaccccag

SEQ ID NO: 3157844 - RNA, 23 nt, Mycobacterium bovis subsp bovis AF2122/97
gccgacugugaaucugacgacgc

SEQ ID NO: 3157845 - RNA, 19 nt, Mycobacterium bovis subsp bovis AF2122/97
gccgacuuccgcgucgccg

SEQ ID NO: 3157846 - RNA, 21 nt, Mycobacterium bovis subsp bovis AF2122/97
gccgacuuccgcgucgccggc

SEQ ID NO: 3157847 - RNA, 22 nt, Mycobacterium bovis subsp bovis AF2122/97
gccgacuuccgcgucgccggcc

SEQ ID NO: 3157848 - RNA, 23 nt, Mycobacterium bovis subsp bovis AF2122/97
gccgacuucgucaaccaccagga

SEQ ID NO: 3157849 - RNA, 17 nt, Mycobacterium bovis subsp bovis AF2122/97
gccgacuuggugacccc

SEQ ID NO: 3157850 - RNA, 23 nt, Mycobacterium bovis subsp bovis AF2122/97
gccgacuuugagucguuggacgg

SEQ ID NO: 3157851 - RNA, 13 nt, Mycobacterium bovis subsp bovis AF2122/97
gccgagaacaccg

SEQ ID NO: 3157852 - RNA, 17 nt, Mycobacterium bovis subsp bovis AF2122/97
gccgagcuucagcgcgc

SEQ ID NO: 3157853 - RNA, 18 nt, Mycobacterium bovis subsp bovis AF2122/97
gccgagcuucagcgcgcu

SEQ ID NO: 3157854 - RNA, 13 nt, Mycobacterium bovis subsp bovis AF2122/97
gccgagcuugagc

SEQ ID NO: 3157855 - RNA, 17 nt, Mycobacterium bovis subsp bovis AF2122/97
gccgagcuugucgagca

SEQ ID NO: 3157856 - RNA, 19 nt, Mycobacterium bovis subsp bovis AF2122/97
gccgagcuugucgagcagg

SEQ ID NO: 3157857 - RNA, 21 nt, Mycobacterium bovis subsp bovis AF2122/97
gccgagcuugucgagcaggcc

SEQ ID NO: 3157858 - RNA, 23 nt, Mycobacterium bovis subsp bovis AF2122/97
gccgaggaaaucgcccucgucgc

SEQ ID NO: 3157859 - RNA, 21 nt, Mycobacterium bovis subsp bovis AF2122/97
gccgaggaauacucucgcgac

SEQ ID NO: 3157860 - RNA, 18 nt, Mycobacterium bovis subsp bovis AF2122/97
gccgaggaccagaggcgc

SEQ ID NO: 3157861 - RNA, 19 nt, Mycobacterium bovis subsp bovis AF2122/97
gccgaggaccagaggcgcu

SEQ ID NO: 3157862 - RNA, 16 nt, Mycobacterium bovis subsp bovis AF2122/97
gccgaggacgccggcg

SEQ ID NO: 3157863 - RNA, 17 nt, Mycobacterium bovis subsp bovis AF2122/97
gccgaggacgccggcgc

SEQ ID NO: 3157864 - RNA, 19 nt, Mycobacterium bovis subsp bovis AF2122/97
gccgaggacgccggcgccg

SEQ ID NO: 3157865 - RNA, 20 nt, Mycobacterium bovis subsp bovis AF2122/97
gccgaggacgccggcgccgc

SEQ ID NO: 3157866 - RNA, 22 nt, Mycobacterium bovis subsp bovis AF2122/97
gccgaggacgccggcgccgcca

SEQ ID NO: 3157867 - RNA, 21 nt, Mycobacterium bovis subsp bovis AF2122/97
gccgaggacuggaaagcagca

SEQ ID NO: 3157868 - RNA, 23 nt, Mycobacterium bovis subsp bovis AF2122/97
gccgaggacuggaaagcagcagc

SEQ ID NO: 3157869 - RNA, 13 nt, Mycobacterium bovis subsp bovis AF2122/97
gccgaggcaaccg

SEQ ID NO: 3157870 - RNA, 20 nt, Mycobacterium bovis subsp bovis AF2122/97
gccgaggcagcgucgucgac

SEQ ID NO: 3157871 - RNA, 13 nt, Mycobacterium bovis subsp bovis AF2122/97
gccgaggccgccg

SEQ ID NO: 3157872 - RNA, 14 nt, Mycobacterium bovis subsp bovis AF2122/97
gccgaggccgccgu

SEQ ID NO: 3157873 - RNA, 16 nt, Mycobacterium bovis subsp bovis AF2122/97
gccgaggccgccguug

SEQ ID NO: 3157874 - RNA, 18 nt, Mycobacterium bovis subsp bovis AF2122/97
gccgaggccgcugccagg

SEQ ID NO: 3157875 - RNA, 17 nt, Mycobacterium bovis subsp bovis AF2122/97
gccgaggccuaccaggc

SEQ ID NO: 3157876 - RNA, 22 nt, Mycobacterium bovis subsp bovis AF2122/97
gccgaggccuaccaggcgcggc

SEQ ID NO: 3157877 - RNA, 16 nt, Mycobacterium bovis subsp bovis AF2122/97
gccgaggccucggcca

SEQ ID NO: 3157878 - RNA, 21 nt, Mycobacterium bovis subsp bovis AF2122/97
gccgaggcggucuuguccagg

SEQ ID NO: 3157879 - RNA, 22 nt, Mycobacterium bovis subsp bovis AF2122/97
gccgaggcggucuuguccagga

SEQ ID NO: 3157880 - RNA, 21 nt, Mycobacterium bovis subsp bovis AF2122/97
gccgagggauugccgugcucg

SEQ ID NO: 3157881 - RNA, 14 nt, Mycobacterium bovis subsp bovis AF2122/97
gccgagggcgccgg

SEQ ID NO: 3157882 - RNA, 15 nt, Mycobacterium bovis subsp bovis AF2122/97
gccgagggcuugcac

SEQ ID NO: 3157883 - RNA, 22 nt, Mycobacterium bovis subsp bovis AF2122/97
gccgaggguagacggggcgagc

SEQ ID NO: 3157884 - RNA, 15 nt, Mycobacterium bovis subsp bovis AF2122/97
gccgaggucgaaccg

SEQ ID NO: 3157885 - RNA, 19 nt, Mycobacterium bovis subsp bovis AF2122/97
gccgaggucgaaccgccgg

SEQ ID NO: 3157886 - RNA, 21 nt, Mycobacterium bovis subsp bovis AF2122/97
gccgaggucgaaccgccggcu

SEQ ID NO: 3157887 - RNA, 19 nt, Mycobacterium bovis subsp bovis AF2122/97
gccgaggucgaacgcccgc

SEQ ID NO: 3157888 - RNA, 14 nt, Mycobacterium bovis subsp bovis AF2122/97
gccgaggucgcccg

SEQ ID NO: 3157889 - RNA, 13 nt, Mycobacterium bovis subsp bovis AF2122/97
gccgaggucgcgg

SEQ ID NO: 3157890 - RNA, 14 nt, Mycobacterium bovis subsp bovis AF2122/97
gccgaggucgguuc

SEQ ID NO: 3157891 - RNA, 23 nt, Mycobacterium bovis subsp bovis AF2122/97
gccgaggucgguucggccggagc

SEQ ID NO: 3157892 - RNA, 13 nt, Mycobacterium bovis subsp bovis AF2122/97
gccgaggucguau

SEQ ID NO: 3157893 - RNA, 15 nt, Mycobacterium bovis subsp bovis AF2122/97
gccgaggucguaugc

SEQ ID NO: 3157894 - RNA, 22 nt, Mycobacterium bovis subsp bovis AF2122/97
gccgaggucuccggugcgcagc

SEQ ID NO: 3157895 - RNA, 20 nt, Mycobacterium bovis subsp bovis AF2122/97
gccgagguguuuccggugug

SEQ ID NO: 3157896 - RNA, 14 nt, Mycobacterium bovis subsp bovis AF2122/97
gccgagguugcgga

SEQ ID NO: 3157897 - RNA, 16 nt, Mycobacterium bovis subsp bovis AF2122/97
gccgagguugcggacg

SEQ ID NO: 3157898 - RNA, 16 nt, Mycobacterium bovis subsp bovis AF2122/97
gccgaguaccagccca

SEQ ID NO: 3157899 - RNA, 20 nt, Mycobacterium bovis subsp bovis AF2122/97
gccgaguaccggccagccgc

SEQ ID NO: 3157900 - RNA, 22 nt, Mycobacterium bovis subsp bovis AF2122/97
gccgaguaccggccagccgcgg

SEQ ID NO: 3157901 - RNA, 23 nt, Mycobacterium bovis subsp bovis AF2122/97
gccgaguaccggccagccgcggc

SEQ ID NO: 3157902 - RNA, 18 nt, Mycobacterium bovis subsp bovis AF2122/97
gccgaguagauggucgac

SEQ ID NO: 3157903 - RNA, 20 nt, Mycobacterium bovis subsp bovis AF2122/97
gccgaguagauggucgacgg

SEQ ID NO: 3157904 - RNA, 20 nt, Mycobacterium bovis subsp bovis AF2122/97
gccgagucgauugccaccga

SEQ ID NO: 3157905 - RNA, 22 nt, Mycobacterium bovis subsp bovis AF2122/97
gccgagugcccagcgaugcgcu

SEQ ID NO: 3157906 - RNA, 21 nt, Mycobacterium bovis subsp bovis AF2122/97
gccgagugugacuaccgagac

SEQ ID NO: 3157907 - RNA, 22 nt, Mycobacterium bovis subsp bovis AF2122/97
gccgagugugacuaccgagacg

SEQ ID NO: 3157908 - RNA, 15 nt, Mycobacterium bovis subsp bovis AF2122/97
gccgaguugaccgcc

SEQ ID NO: 3157909 - RNA, 22 nt, Mycobacterium bovis subsp bovis AF2122/97
gccgaguugcccgggucggccg

SEQ ID NO: 3157910 - RNA, 20 nt, Mycobacterium bovis subsp bovis AF2122/97
gccgauacagcacauccagc

SEQ ID NO: 3157911 - RNA, 13 nt, Mycobacterium bovis subsp bovis AF2122/97
gccgauacaggcc

SEQ ID NO: 3157912 - RNA, 17 nt, Mycobacterium bovis subsp bovis AF2122/97
gccgauacaggccacgc

SEQ ID NO: 3157913 - RNA, 22 nt, Mycobacterium bovis subsp bovis AF2122/97
gccgauacccagcgggucgcgg

SEQ ID NO: 3157914 - RNA, 14 nt, Mycobacterium bovis subsp bovis AF2122/97
gccgauaccgccgg

SEQ ID NO: 3157915 - RNA, 15 nt, Mycobacterium bovis subsp bovis AF2122/97
gccgauaccgccggc

SEQ ID NO: 3157916 - RNA, 17 nt, Mycobacterium bovis subsp bovis AF2122/97
gccgauaccgccggccc

SEQ ID NO: 3157917 - RNA, 15 nt, Mycobacterium bovis subsp bovis AF2122/97
gccgauaccggcggc

SEQ ID NO: 3157918 - RNA, 16 nt, Mycobacterium bovis subsp bovis AF2122/97
gccgauaccggcggcg

SEQ ID NO: 3157919 - RNA, 19 nt, Mycobacterium bovis subsp bovis AF2122/97
gccgauaccggcggcgagc

SEQ ID NO: 3157920 - RNA, 20 nt, Mycobacterium bovis subsp bovis AF2122/97
gccgauaccggcggcgagcg

SEQ ID NO: 3157921 - RNA, 19 nt, Mycobacterium bovis subsp bovis AF2122/97
gccgauacgaagccgccgc

SEQ ID NO: 3157922 - RNA, 23 nt, Mycobacterium bovis subsp bovis AF2122/97
gccgauacgugaggucccggcug

SEQ ID NO: 3157923 - RNA, 19 nt, Mycobacterium bovis subsp bovis AF2122/97
gccgauacuucaucggcac

SEQ ID NO: 3157924 - RNA, 23 nt, Mycobacterium bovis subsp bovis AF2122/97
gccgauacuucaucggcacaggc

SEQ ID NO: 3157925 - RNA, 15 nt, Mycobacterium bovis subsp bovis AF2122/97
gccgauagcaccgga

SEQ ID NO: 3157926 - RNA, 20 nt, Mycobacterium bovis subsp bovis AF2122/97
gccgauagcgcggcaccagc

SEQ ID NO: 3157927 - RNA, 22 nt, Mycobacterium bovis subsp bovis AF2122/97
gccgauagcgcggcaccagcac

SEQ ID NO: 3157928 - RNA, 17 nt, Mycobacterium bovis subsp bovis AF2122/97
gccgauagggauggcga

SEQ ID NO: 3157929 - RNA, 15 nt, Mycobacterium bovis subsp bovis AF2122/97
gccgauauaccaggg

SEQ ID NO: 3157930 - RNA, 16 nt, Mycobacterium bovis subsp bovis AF2122/97
gccgauauaccagggc

SEQ ID NO: 3157931 - RNA, 21 nt, Mycobacterium bovis subsp bovis AF2122/97
gccgauaucggugaccguggc

SEQ ID NO: 3157932 - RNA, 15 nt, Mycobacterium bovis subsp bovis AF2122/97
gccgauaucugccac

SEQ ID NO: 3157933 - RNA, 16 nt, Mycobacterium bovis subsp bovis AF2122/97
gccgauaucugccacg

SEQ ID NO: 3157934 - RNA, 21 nt, Mycobacterium bovis subsp bovis AF2122/97
gccgauaugcgugagcugcuc

SEQ ID NO: 3157935 - RNA, 22 nt, Mycobacterium bovis subsp bovis AF2122/97
gccgauaugcgugagcugcucg

SEQ ID NO: 3157936 - RNA, 16 nt, Mycobacterium bovis subsp bovis AF2122/97
gccgaucaauggcaac

SEQ ID NO: 3157937 - RNA, 15 nt, Mycobacterium bovis subsp bovis AF2122/97
gccgaucaccaccgg

SEQ ID NO: 3157938 - RNA, 16 nt, Mycobacterium bovis subsp bovis AF2122/97
gccgaugcugccgccg

SEQ ID NO: 3157939 - RNA, 17 nt, Mycobacterium bovis subsp bovis AF2122/97
gccgaugcugccgccgc

SEQ ID NO: 3157940 - RNA, 23 nt, Mycobacterium bovis subsp bovis AF2122/97
gccgaugcugccgccgccgccgg

SEQ ID NO: 3157941 - RNA, 14 nt, Mycobacterium bovis subsp bovis AF2122/97
gccgaugcugcggg

SEQ ID NO: 3157942 - RNA, 18 nt, Mycobacterium bovis subsp bovis AF2122/97
gccgaugcugcgggcggu

SEQ ID NO: 3157943 - RNA, 21 nt, Mycobacterium bovis subsp bovis AF2122/97
gccgauggcuaccccagggag

SEQ ID NO: 3157944 - RNA, 19 nt, Mycobacterium bovis subsp bovis AF2122/97
gccgauggcuuggugccca

SEQ ID NO: 3157945 - RNA, 17 nt, Mycobacterium bovis subsp bovis AF2122/97
gccgaugggaaccgaau

SEQ ID NO: 3157946 - RNA, 20 nt, Mycobacterium bovis subsp bovis AF2122/97
gccgaugggcaucaagaaac

SEQ ID NO: 3157947 - RNA, 20 nt, Mycobacterium bovis subsp bovis AF2122/97
gccgauggucaaugcgcugg

SEQ ID NO: 3157948 - RNA, 21 nt, Mycobacterium bovis subsp bovis AF2122/97
gccgauggucaaugcgcuggc

SEQ ID NO: 3157949 - RNA, 23 nt, Mycobacterium bovis subsp bovis AF2122/97
gccgauggugaugggggagccgg

SEQ ID NO: 3157950 - RNA, 12 nt, Mycobacterium bovis subsp bovis AF2122/97
gccgaugucgau

SEQ ID NO: 3157951 - RNA, 19 nt, Mycobacterium bovis subsp bovis AF2122/97
gccgaugucgaugccgcgc

SEQ ID NO: 3157952 - RNA, 17 nt, Mycobacterium bovis subsp bovis AF2122/97
gccgaugucgcgcgcua

SEQ ID NO: 3157953 - RNA, 18 nt, Mycobacterium bovis subsp bovis AF2122/97
gccgaugucgcgcgcuag

SEQ ID NO: 3157954 - RNA, 16 nt, Mycobacterium bovis subsp bovis AF2122/97
gccgaugucgggcacg

SEQ ID NO: 3157955 - RNA, 16 nt, Mycobacterium bovis subsp bovis AF2122/97
gccgauguggccggcg

SEQ ID NO: 3157956 - RNA, 17 nt, Mycobacterium bovis subsp bovis AF2122/97
gccgauguggccggcga

SEQ ID NO: 3157957 - RNA, 15 nt, Mycobacterium bovis subsp bovis AF2122/97
gccgaugugggcgga

SEQ ID NO: 3157958 - RNA, 23 nt, Mycobacterium bovis subsp bovis AF2122/97
gccgauguguggaacauccgcac

SEQ ID NO: 3157959 - RNA, 22 nt, Mycobacterium bovis subsp bovis AF2122/97
gccgauguuguugacgcccgag

SEQ ID NO: 3157960 - RNA, 16 nt, Mycobacterium bovis subsp bovis AF2122/97
gccgauuacggugauc

SEQ ID NO: 3157961 - RNA, 17 nt, Mycobacterium bovis subsp bovis AF2122/97
gccgauuacggugaucg

SEQ ID NO: 3157962 - RNA, 14 nt, Mycobacterium bovis subsp bovis AF2122/97
gccgauucgccguc

SEQ ID NO: 3157963 - RNA, 21 nt, Mycobacterium bovis subsp bovis AF2122/97
gccgauugcucggggaggaaa

SEQ ID NO: 3157964 - RNA, 14 nt, Mycobacterium bovis subsp bovis AF2122/97
gccgauuggccugc

SEQ ID NO: 3157965 - RNA, 16 nt, Mycobacterium bovis subsp bovis AF2122/97
gccgauuggccugcca

SEQ ID NO: 3157966 - RNA, 17 nt, Mycobacterium bovis subsp bovis AF2122/97
gccgcaaacgcggcguc

SEQ ID NO: 3157967 - RNA, 22 nt, Mycobacterium bovis subsp bovis AF2122/97
gccgcaacaccccccguccacc

SEQ ID NO: 3157968 - RNA, 13 nt, Mycobacterium bovis subsp bovis AF2122/97
gccgcaaccaugu

SEQ ID NO: 3157969 - RNA, 16 nt, Mycobacterium bovis subsp bovis AF2122/97
gccgcaaccggcgauc

SEQ ID NO: 3157970 - RNA, 17 nt, Mycobacterium bovis subsp bovis AF2122/97
gccgcaaccggcgaucg

SEQ ID NO: 3157971 - RNA, 15 nt, Mycobacterium bovis subsp bovis AF2122/97
gccgcaagccgcgag

SEQ ID NO: 3157972 - RNA, 14 nt, Mycobacterium bovis subsp bovis AF2122/97
gccgcaaggcgccg

SEQ ID NO: 3157973 - RNA, 17 nt, Mycobacterium bovis subsp bovis AF2122/97
gccgcaaggcgccgaua

SEQ ID NO: 3157974 - RNA, 16 nt, Mycobacterium bovis subsp bovis AF2122/97
gccgcaaggcguguag

SEQ ID NO: 3157975 - RNA, 21 nt, Mycobacterium bovis subsp bovis AF2122/97
gccgcaagugucuccggcaac

SEQ ID NO: 3157976 - RNA, 14 nt, Mycobacterium bovis subsp bovis AF2122/97
gccgcaauacccga

SEQ ID NO: 3157977 - RNA, 22 nt, Mycobacterium bovis subsp bovis AF2122/97
gccgcaaugacgucgucggcca

SEQ ID NO: 3157978 - RNA, 20 nt, Mycobacterium bovis subsp bovis AF2122/97
gccgcaaugcguugaccgau

SEQ ID NO: 3157979 - RNA, 22 nt, Mycobacterium bovis subsp bovis AF2122/97
gccgcacaaacgggcgugggcc

SEQ ID NO: 3157980 - RNA, 18 nt, Mycobacterium bovis subsp bovis AF2122/97
gccgcacaaguggucgau

SEQ ID NO: 3157981 - RNA, 14 nt, Mycobacterium bovis subsp bovis AF2122/97
gccgcacacgcgug

SEQ ID NO: 3157982 - RNA, 21 nt, Mycobacterium bovis subsp bovis AF2122/97
gccgcacacgcgugcaccaua

SEQ ID NO: 3157983 - RNA, 12 nt, Mycobacterium bovis subsp bovis AF2122/97
gccgcacacucu

SEQ ID NO: 3157984 - RNA, 20 nt, Mycobacterium bovis subsp bovis AF2122/97
gccgcacacucucggugaac

SEQ ID NO: 3157985 - RNA, 24 nt, Mycobacterium bovis subsp bovis AF2122/97
gccgcacacucucggugaacgccg

SEQ ID NO: 3157986 - RNA, 23 nt, Mycobacterium bovis subsp bovis AF2122/97
gccgcacagcaugauccgcucgu

SEQ ID NO: 3157987 - RNA, 23 nt, Mycobacterium bovis subsp bovis AF2122/97
gccgcacauugguguccaccacc

SEQ ID NO: 3157988 - RNA, 16 nt, Mycobacterium bovis subsp bovis AF2122/97
gccgcaccaagcagcg

SEQ ID NO: 3157989 - RNA, 16 nt, Mycobacterium bovis subsp bovis AF2122/97
gccgcaccaaggccgc

SEQ ID NO: 3157990 - RNA, 19 nt, Mycobacterium bovis subsp bovis AF2122/97
gccgcaccagaucgucggg

SEQ ID NO: 3157991 - RNA, 14 nt, Mycobacterium bovis subsp bovis AF2122/97
gccgcaccagcauu

SEQ ID NO: 3157992 - RNA, 13 nt, Mycobacterium bovis subsp bovis AF2122/97
gccgcaccagucg

SEQ ID NO: 3157993 - RNA, 16 nt, Mycobacterium bovis subsp bovis AF2122/97
gccgcaccaguggcgc

SEQ ID NO: 3157994 - RNA, 19 nt, Mycobacterium bovis subsp bovis AF2122/97
gccgcaccaguggcgccca

SEQ ID NO: 3157995 - RNA, 18 nt, Mycobacterium bovis subsp bovis AF2122/97
gccgcaccaucggcgagg

SEQ ID NO: 3157996 - RNA, 19 nt, Mycobacterium bovis subsp bovis AF2122/97
gccgcacccagaccgccga

SEQ ID NO: 3157997 - RNA, 14 nt, Mycobacterium bovis subsp bovis AF2122/97
gccgcacccccucc

SEQ ID NO: 3157998 - RNA, 20 nt, Mycobacterium bovis subsp bovis AF2122/97
gccgcacccccuccgcgaug

SEQ ID NO: 3157999 - RNA, 13 nt, Mycobacterium bovis subsp bovis AF2122/97
gccgcacccgaaa

SEQ ID NO: 3158000 - RNA, 22 nt, Mycobacterium bovis subsp bovis AF2122/97
gccgcacccgaucgacggucgu

SEQ ID NO: 3158001 - RNA, 16 nt, Mycobacterium bovis subsp bovis AF2122/97
gccgcacccgcucccg

SEQ ID NO: 3158002 - RNA, 15 nt, Mycobacterium bovis subsp bovis AF2122/97
gccgcacccggucga

SEQ ID NO: 3158003 - RNA, 23 nt, Mycobacterium bovis subsp bovis AF2122/97
gccgcacccguugcucccacggc

SEQ ID NO: 3158004 - RNA, 14 nt, Mycobacterium bovis subsp bovis AF2122/97
gccgcaccgccacc

SEQ ID NO: 3158005 - RNA, 21 nt, Mycobacterium bovis subsp bovis AF2122/97
gccgcaccgccugcucggcga

SEQ ID NO: 3158006 - RNA, 23 nt, Mycobacterium bovis subsp bovis AF2122/97
gccgcaccgcuguugcaucgccg

SEQ ID NO: 3158007 - RNA, 13 nt, Mycobacterium bovis subsp bovis AF2122/97
gccgcaccggguc

SEQ ID NO: 3158008 - RNA, 19 nt, Mycobacterium bovis subsp bovis AF2122/97
gccgcaccggugcucgucg

SEQ ID NO: 3158009 - RNA, 19 nt, Mycobacterium bovis subsp bovis AF2122/97
gccgcacgaugccgggaac

SEQ ID NO: 3158010 - RNA, 21 nt, Mycobacterium bovis subsp bovis AF2122/97
gccgcacgauggccgucgauc

SEQ ID NO: 3158011 - RNA, 17 nt, Mycobacterium bovis subsp bovis AF2122/97
gccgcacgccgaccagc

SEQ ID NO: 3158012 - RNA, 20 nt, Mycobacterium bovis subsp bovis AF2122/97
gccgcacgccgaccagcacc

SEQ ID NO: 3158013 - RNA, 22 nt, Mycobacterium bovis subsp bovis AF2122/97
gccgcacgccgaccggcccgca

SEQ ID NO: 3158014 - RNA, 13 nt, Mycobacterium bovis subsp bovis AF2122/97
gccgcacgccggc

SEQ ID NO: 3158015 - RNA, 14 nt, Mycobacterium bovis subsp bovis AF2122/97
gccgcacgccggca

SEQ ID NO: 3158016 - RNA, 13 nt, Mycobacterium bovis subsp bovis AF2122/97
gccgcacggcgac

SEQ ID NO: 3158017 - RNA, 21 nt, Mycobacterium bovis subsp bovis AF2122/97
gccgcacggcgacgccagugu

SEQ ID NO: 3158018 - RNA, 12 nt, Mycobacterium bovis subsp bovis AF2122/97
gccgcacgucga

SEQ ID NO: 3158019 - RNA, 13 nt, Mycobacterium bovis subsp bovis AF2122/97
gccgcacgucgac

SEQ ID NO: 3158020 - RNA, 17 nt, Mycobacterium bovis subsp bovis AF2122/97
gccgcacgucgaccucg

SEQ ID NO: 3158021 - RNA, 20 nt, Mycobacterium bovis subsp bovis AF2122/97
gccgcacgucgaccucggca

SEQ ID NO: 3158022 - RNA, 17 nt, Mycobacterium bovis subsp bovis AF2122/97
gccgcacguucggcgau

SEQ ID NO: 3158023 - RNA, 21 nt, Mycobacterium bovis subsp bovis AF2122/97
gccgcacucggucgggggugc

SEQ ID NO: 3158024 - RNA, 22 nt, Mycobacterium bovis subsp bovis AF2122/97
gccgcacucgguuugacgagac

SEQ ID NO: 3158025 - RNA, 13 nt, Mycobacterium bovis subsp bovis AF2122/97
gccgcacugggcg

SEQ ID NO: 3158026 - RNA, 22 nt, Mycobacterium bovis subsp bovis AF2122/97
gccgcacugggcgaugacgcca

SEQ ID NO: 3158027 - RNA, 20 nt, Mycobacterium bovis subsp bovis AF2122/97
gccgcacugggugcgucgac

SEQ ID NO: 3158028 - RNA, 15 nt, Mycobacterium bovis subsp bovis AF2122/97
gccgcacuuucuucc

SEQ ID NO: 3158029 - RNA, 18 nt, Mycobacterium bovis subsp bovis AF2122/97
gccgcagaaucccaacuc

SEQ ID NO: 3158030 - RNA, 19 nt, Mycobacterium bovis subsp bovis AF2122/97
gccgcagaaucccaacucc

SEQ ID NO: 3158031 - RNA, 21 nt, Mycobacterium bovis subsp bovis AF2122/97
gccgcagaaucccaacuccuc

SEQ ID NO: 3158032 - RNA, 14 nt, Mycobacterium bovis subsp bovis AF2122/97
gccgcagacgccga

SEQ ID NO: 3158033 - RNA, 15 nt, Mycobacterium bovis subsp bovis AF2122/97
gccgcagacgccgac

SEQ ID NO: 3158034 - RNA, 14 nt, Mycobacterium bovis subsp bovis AF2122/97
gccgcagacgcggc

SEQ ID NO: 3158035 - RNA, 16 nt, Mycobacterium bovis subsp bovis AF2122/97
gccgcagagcaccgcg

SEQ ID NO: 3158036 - RNA, 15 nt, Mycobacterium bovis subsp bovis AF2122/97
gccgcagaucaccgc

SEQ ID NO: 3158037 - RNA, 22 nt, Mycobacterium bovis subsp bovis AF2122/97
gccgcagaugaaagugccagug

SEQ ID NO: 3158038 - RNA, 16 nt, Mycobacterium bovis subsp bovis AF2122/97
gccgcagcaccucggu

SEQ ID NO: 3158039 - RNA, 19 nt, Mycobacterium bovis subsp bovis AF2122/97
gccgcagcaggggacgacc

SEQ ID NO: 3158040 - RNA, 19 nt, Mycobacterium bovis subsp bovis AF2122/97
gccgcagcaggugcaucgc

SEQ ID NO: 3158041 - RNA, 18 nt, Mycobacterium bovis subsp bovis AF2122/97
gccgcagcauccccgcag

SEQ ID NO: 3158042 - RNA, 13 nt, Mycobacterium bovis subsp bovis AF2122/97
gccgcagccagca

SEQ ID NO: 3158043 - RNA, 16 nt, Mycobacterium bovis subsp bovis AF2122/97
gccgcagccagcggua

SEQ ID NO: 3158044 - RNA, 19 nt, Mycobacterium bovis subsp bovis AF2122/97
gccgcagcccgugacuggu

SEQ ID NO: 3158045 - RNA, 14 nt, Mycobacterium bovis subsp bovis AF2122/97
gccgcagcgcucgc

SEQ ID NO: 3158046 - RNA, 14 nt, Mycobacterium bovis subsp bovis AF2122/97
gccgcagcggccag

SEQ ID NO: 3158047 - RNA, 20 nt, Mycobacterium bovis subsp bovis AF2122/97
gccgcagcggccagcccagc

SEQ ID NO: 3158048 - RNA, 12 nt, Mycobacterium bovis subsp bovis AF2122/97
gccgcagcggcg

SEQ ID NO: 3158049 - RNA, 14 nt, Mycobacterium bovis subsp bovis AF2122/97
gccgcagcggcggc

SEQ ID NO: 3158050 - RNA, 15 nt, Mycobacterium bovis subsp bovis AF2122/97
gccgcagcggcggca

SEQ ID NO: 3158051 - RNA, 18 nt, Mycobacterium bovis subsp bovis AF2122/97
gccgcagcggcggcaacc

SEQ ID NO: 3158052 - RNA, 16 nt, Mycobacterium bovis subsp bovis AF2122/97
gccgcagcguccgcgg

SEQ ID NO: 3158053 - RNA, 17 nt, Mycobacterium bovis subsp bovis AF2122/97
gccgcagcuccccgacc

SEQ ID NO: 3158054 - RNA, 22 nt, Mycobacterium bovis subsp bovis AF2122/97
gccgcagcuccccgaccgaacc

SEQ ID NO: 3158055 - RNA, 14 nt, Mycobacterium bovis subsp bovis AF2122/97
gccgcagcucgccg

SEQ ID NO: 3158056 - RNA, 17 nt, Mycobacterium bovis subsp bovis AF2122/97
gccgcagcucgccgagu

SEQ ID NO: 3158057 - RNA, 18 nt, Mycobacterium bovis subsp bovis AF2122/97
gccgcagcucgccgagug

SEQ ID NO: 3158058 - RNA, 14 nt, Mycobacterium bovis subsp bovis AF2122/97
gccgcaggcgaaca

SEQ ID NO: 3158059 - RNA, 15 nt, Mycobacterium bovis subsp bovis AF2122/97
gccgcaggcuugccg

SEQ ID NO: 3158060 - RNA, 20 nt, Mycobacterium bovis subsp bovis AF2122/97
gccgcaggcuugccgauggc

SEQ ID NO: 3158061 - RNA, 21 nt, Mycobacterium bovis subsp bovis AF2122/97
gccgcaggcuugccgauggcg

SEQ ID NO: 3158062 - RNA, 22 nt, Mycobacterium bovis subsp bovis AF2122/97
gccgcaggcuugccgauggcgg

SEQ ID NO: 3158063 - RNA, 13 nt, Mycobacterium bovis subsp bovis AF2122/97
gccgcagggccgc

SEQ ID NO: 3158064 - RNA, 17 nt, Mycobacterium bovis subsp bovis AF2122/97
gccgcagggccgcgcgc

SEQ ID NO: 3158065 - RNA, 13 nt, Mycobacterium bovis subsp bovis AF2122/97
gccgcaggugggc

SEQ ID NO: 3158066 - RNA, 14 nt, Mycobacterium bovis subsp bovis AF2122/97
gccgcaggugggcg

SEQ ID NO: 3158067 - RNA, 20 nt, Mycobacterium bovis subsp bovis AF2122/97
gccgcaggugggcguuggcg

SEQ ID NO: 3158068 - RNA, 21 nt, Mycobacterium bovis subsp bovis AF2122/97
gccgcaggugggcguuggcga

SEQ ID NO: 3158069 - RNA, 16 nt, Mycobacterium bovis subsp bovis AF2122/97
gccgcagugcgcgagu

SEQ ID NO: 3158070 - RNA, 16 nt, Mycobacterium bovis subsp bovis AF2122/97
gccgcauaaaacucgc

SEQ ID NO: 3158071 - RNA, 13 nt, Mycobacterium bovis subsp bovis AF2122/97
gccgcauaccagu

SEQ ID NO: 3158072 - RNA, 17 nt, Mycobacterium bovis subsp bovis AF2122/97
gccgcauaggccccgcc

SEQ ID NO: 3158073 - RNA, 19 nt, Mycobacterium bovis subsp bovis AF2122/97
gccgcauaggccccgccag

SEQ ID NO: 3158074 - RNA, 21 nt, Mycobacterium bovis subsp bovis AF2122/97
gccgcauaggccccgccagcg

SEQ ID NO: 3158075 - RNA, 22 nt, Mycobacterium bovis subsp bovis AF2122/97
gccgcauaggccccgccagcgc

SEQ ID NO: 3158076 - RNA, 23 nt, Mycobacterium bovis subsp bovis AF2122/97
gccgcauaucacccggagaccga

SEQ ID NO: 3158077 - RNA, 20 nt, Mycobacterium bovis subsp bovis AF2122/97
gccgcauauugcggcgccgu

SEQ ID NO: 3158078 - RNA, 23 nt, Mycobacterium bovis subsp bovis AF2122/97
gccgcauccagccgugcggcggc

SEQ ID NO: 3158079 - RNA, 15 nt, Mycobacterium bovis subsp bovis AF2122/97
gccgcaucgcccaac

SEQ ID NO: 3158080 - RNA, 19 nt, Mycobacterium bovis subsp bovis AF2122/97
gccgcaucgccucaccacg

SEQ ID NO: 3158081 - RNA, 16 nt, Mycobacterium bovis subsp bovis AF2122/97
gccgcaucggauggcc

SEQ ID NO: 3158082 - RNA, 21 nt, Mycobacterium bovis subsp bovis AF2122/97
gccgcaucggcgggucugggu

SEQ ID NO: 3158083 - RNA, 15 nt, Mycobacterium bovis subsp bovis AF2122/97
gccgcaucggcggug

SEQ ID NO: 3158084 - RNA, 18 nt, Mycobacterium bovis subsp bovis AF2122/97
gccgcaucggcggugaac

SEQ ID NO: 3158085 - RNA, 13 nt, Mycobacterium bovis subsp bovis AF2122/97
gccgcaucgguca

SEQ ID NO: 3158086 - RNA, 14 nt, Mycobacterium bovis subsp bovis AF2122/97
gccgcaucgucgcc

SEQ ID NO: 3158087 - RNA, 19 nt, Mycobacterium bovis subsp bovis AF2122/97
gccgcaucuggccggcggu

SEQ ID NO: 3158088 - RNA, 20 nt, Mycobacterium bovis subsp bovis AF2122/97
gccgcaucuggccggcggug

SEQ ID NO: 3158089 - RNA, 22 nt, Mycobacterium bovis subsp bovis AF2122/97
gccgcaucuggccggcgguguu

SEQ ID NO: 3158090 - RNA, 23 nt, Mycobacterium bovis subsp bovis AF2122/97
gccgcaugccaccgagcaaacac

SEQ ID NO: 3158091 - RNA, 15 nt, Mycobacterium bovis subsp bovis AF2122/97
gccgcaugccacggc

SEQ ID NO: 3158092 - RNA, 15 nt, Mycobacterium bovis subsp bovis AF2122/97
gccgcaugcgcuccg

SEQ ID NO: 3158093 - RNA, 17 nt, Mycobacterium bovis subsp bovis AF2122/97
gccgcaugcgcuccggc

SEQ ID NO: 3158094 - RNA, 20 nt, Mycobacterium bovis subsp bovis AF2122/97
gccgcaugcgcuccggcgcg

SEQ ID NO: 3158095 - RNA, 22 nt, Mycobacterium bovis subsp bovis AF2122/97
gccgcaugcgcuccggcgcgac

SEQ ID NO: 3158096 - RNA, 19 nt, Mycobacterium bovis subsp bovis AF2122/97
gccgcauggugggugccgg

SEQ ID NO: 3158097 - RNA, 14 nt, Mycobacterium bovis subsp bovis AF2122/97
gccgcauucgcgac

SEQ ID NO: 3158098 - RNA, 17 nt, Mycobacterium bovis subsp bovis AF2122/97
gccgcauucgcgacaac

SEQ ID NO: 3158099 - RNA, 14 nt, Mycobacterium bovis subsp bovis AF2122/97
gccgcauuggcgac

SEQ ID NO: 3158100 - RNA, 15 nt, Mycobacterium bovis subsp bovis AF2122/97
gccgccaaagccggg

SEQ ID NO: 3158101 - RNA, 19 nt, Mycobacterium bovis subsp bovis AF2122/97
gccgccaaccgcaggccga

SEQ ID NO: 3158102 - RNA, 22 nt, Mycobacterium bovis subsp bovis AF2122/97
gccgccaaccguucccggcaga

SEQ ID NO: 3158103 - RNA, 17 nt, Mycobacterium bovis subsp bovis AF2122/97
gccgccaacuccagcac

SEQ ID NO: 3158104 - RNA, 19 nt, Mycobacterium bovis subsp bovis AF2122/97
gccgccaacuccagcaccc

SEQ ID NO: 3158105 - RNA, 20 nt, Mycobacterium bovis subsp bovis AF2122/97
gccgccaacuccagcacccg

SEQ ID NO: 3158106 - RNA, 21 nt, Mycobacterium bovis subsp bovis AF2122/97
gccgccaacuccagcacccgc

SEQ ID NO: 3158107 - RNA, 23 nt, Mycobacterium bovis subsp bovis AF2122/97
gccgccaacuccucagccgccug

SEQ ID NO: 3158108 - RNA, 20 nt, Mycobacterium bovis subsp bovis AF2122/97
gccgccaacuucaccacccu

SEQ ID NO: 3158109 - RNA, 13 nt, Mycobacterium bovis subsp bovis AF2122/97
gccgccaagcucg

SEQ ID NO: 3158110 - RNA, 22 nt, Mycobacterium bovis subsp bovis AF2122/97
gccgccauuccagccggugccg

SEQ ID NO: 3158111 - RNA, 15 nt, Mycobacterium bovis subsp bovis AF2122/97
gccgccauugacgaa

SEQ ID NO: 3158112 - RNA, 22 nt, Mycobacterium bovis subsp bovis AF2122/97
gccgccauugacgccguugccg

SEQ ID NO: 3158113 - RNA, 22 nt, Mycobacterium bovis subsp bovis AF2122/97
gccgccauugagcucccgcaac

SEQ ID NO: 3158114 - RNA, 16 nt, Mycobacterium bovis subsp bovis AF2122/97
gccgccauugccgccg

SEQ ID NO: 3158115 - RNA, 18 nt, Mycobacterium bovis subsp bovis AF2122/97
gccgccauugccgccggu

SEQ ID NO: 3158116 - RNA, 22 nt, Mycobacterium bovis subsp bovis AF2122/97
gccgccauugccgccggugccg

SEQ ID NO: 3158117 - RNA, 14 nt, Mycobacterium bovis subsp bovis AF2122/97
gccgccauuggaca

SEQ ID NO: 3158118 - RNA, 20 nt, Mycobacterium bovis subsp bovis AF2122/97
gccgccauuggacagcgcga

SEQ ID NO: 3158119 - RNA, 23 nt, Mycobacterium bovis subsp bovis AF2122/97
gccgccauuggacagcgcgagau

SEQ ID NO: 3158120 - RNA, 23 nt, Mycobacterium bovis subsp bovis AF2122/97
gccgccauuggcaggcauggcgc

SEQ ID NO: 3158121 - RNA, 20 nt, Mycobacterium bovis subsp bovis AF2122/97
gccgcccaacgcgagcuuga

SEQ ID NO: 3158122 - RNA, 18 nt, Mycobacterium bovis subsp bovis AF2122/97
gccgcccaagccgccggc

SEQ ID NO: 3158123 - RNA, 13 nt, Mycobacterium bovis subsp bovis AF2122/97
gccgcccaccaca

SEQ ID NO: 3158124 - RNA, 17 nt, Mycobacterium bovis subsp bovis AF2122/97
gccgcccagaccgccga

SEQ ID NO: 3158125 - RNA, 19 nt, Mycobacterium bovis subsp bovis AF2122/97
gccgcccagaccgccgacg

SEQ ID NO: 3158126 - RNA, 16 nt, Mycobacterium bovis subsp bovis AF2122/97
gccgcccagcaucucg

SEQ ID NO: 3158127 - RNA, 13 nt, Mycobacterium bovis subsp bovis AF2122/97
gccgcccagcgac

SEQ ID NO: 3158128 - RNA, 22 nt, Mycobacterium bovis subsp bovis AF2122/97
gccgcccagcguugucgggugg

SEQ ID NO: 3158129 - RNA, 21 nt, Mycobacterium bovis subsp bovis AF2122/97
gccgcccagcugucauccccg

SEQ ID NO: 3158130 - RNA, 22 nt, Mycobacterium bovis subsp bovis AF2122/97
gccgcccagcugucauccccgg

SEQ ID NO: 3158131 - RNA, 20 nt, Mycobacterium bovis subsp bovis AF2122/97
gccgcccaggagcaccucga

SEQ ID NO: 3158132 - RNA, 13 nt, Mycobacterium bovis subsp bovis AF2122/97
gccgcccaucacc

SEQ ID NO: 3158133 - RNA, 14 nt, Mycobacterium bovis subsp bovis AF2122/97
gccgcccaucaccc

SEQ ID NO: 3158134 - RNA, 20 nt, Mycobacterium bovis subsp bovis AF2122/97
gccgccccauacuugcgccg

SEQ ID NO: 3158135 - RNA, 12 nt, Mycobacterium bovis subsp bovis AF2122/97
gccgcccccgcc

SEQ ID NO: 3158136 - RNA, 14 nt, Mycobacterium bovis subsp bovis AF2122/97
gccgcccccgccgg

SEQ ID NO: 3158137 - RNA, 15 nt, Mycobacterium bovis subsp bovis AF2122/97
gccgcccccgccggc

SEQ ID NO: 3158138 - RNA, 16 nt, Mycobacterium bovis subsp bovis AF2122/97
gccgcccccgccggcc

SEQ ID NO: 3158139 - RNA, 17 nt, Mycobacterium bovis subsp bovis AF2122/97
gccgcccccgccggccg

SEQ ID NO: 3158140 - RNA, 22 nt, Mycobacterium bovis subsp bovis AF2122/97
gccgcccccgccggccgcgccg

SEQ ID NO: 3158141 - RNA, 17 nt, Mycobacterium bovis subsp bovis AF2122/97
gccgcccccggcacagc

SEQ ID NO: 3158142 - RNA, 15 nt, Mycobacterium bovis subsp bovis AF2122/97
gccgcccccgugggg

SEQ ID NO: 3158143 - RNA, 22 nt, Mycobacterium bovis subsp bovis AF2122/97
gccgcccccguuuacggcccgg

SEQ ID NO: 3158144 - RNA, 15 nt, Mycobacterium bovis subsp bovis AF2122/97
gccgccccggccgcu

SEQ ID NO: 3158145 - RNA, 18 nt, Mycobacterium bovis subsp bovis AF2122/97
gccgccccggcgcuggug

SEQ ID NO: 3158146 - RNA, 20 nt, Mycobacterium bovis subsp bovis AF2122/97
gccgccccugcgcggccacc

SEQ ID NO: 3158147 - RNA, 16 nt, Mycobacterium bovis subsp bovis AF2122/97
gccgcccgagccggug

SEQ ID NO: 3158148 - RNA, 15 nt, Mycobacterium bovis subsp bovis AF2122/97
gccgcccgcagggcc

SEQ ID NO: 3158149 - RNA, 17 nt, Mycobacterium bovis subsp bovis AF2122/97
gccgcccgcagggccgc

SEQ ID NO: 3158150 - RNA, 15 nt, Mycobacterium bovis subsp bovis AF2122/97
gccgcccgcaucgcg

SEQ ID NO: 3158151 - RNA, 21 nt, Mycobacterium bovis subsp bovis AF2122/97
gccgcccgcaucgcggcaucg

SEQ ID NO: 3158152 - RNA, 14 nt, Mycobacterium bovis subsp bovis AF2122/97
gccgcccgcccacc

SEQ ID NO: 3158153 - RNA, 14 nt, Mycobacterium bovis subsp bovis AF2122/97
gccgcccgcccgga

SEQ ID NO: 3158154 - RNA, 15 nt, Mycobacterium bovis subsp bovis AF2122/97
gccgcccgcgccacc

SEQ ID NO: 3158155 - RNA, 19 nt, Mycobacterium bovis subsp bovis AF2122/97
gccgcccgcgccaccagca

SEQ ID NO: 3158156 - RNA, 16 nt, Mycobacterium bovis subsp bovis AF2122/97
gccgcccgcgccaccg

SEQ ID NO: 3158157 - RNA, 17 nt, Mycobacterium bovis subsp bovis AF2122/97
gccgcccgcgcccccgg

SEQ ID NO: 3158158 - RNA, 15 nt, Mycobacterium bovis subsp bovis AF2122/97
gccgcccgcgccgcc

SEQ ID NO: 3158159 - RNA, 19 nt, Mycobacterium bovis subsp bovis AF2122/97
gccgcccgcgccgccgcca

SEQ ID NO: 3158160 - RNA, 17 nt, Mycobacterium bovis subsp bovis AF2122/97
gccgcccgcgccgccgg

SEQ ID NO: 3158161 - RNA, 13 nt, Mycobacterium bovis subsp bovis AF2122/97
gccgcccgcgccu

SEQ ID NO: 3158162 - RNA, 15 nt, Mycobacterium bovis subsp bovis AF2122/97
gccgcccgcgccucc

SEQ ID NO: 3158163 - RNA, 16 nt, Mycobacterium bovis subsp bovis AF2122/97
gccgcccgcuccgccg

SEQ ID NO: 3158164 - RNA, 20 nt, Mycobacterium bovis subsp bovis AF2122/97
gccgcccgcuccgccgucgc

SEQ ID NO: 3158165 - RNA, 18 nt, Mycobacterium bovis subsp bovis AF2122/97
gccgcccgcuccuccggc

SEQ ID NO: 3158166 - RNA, 22 nt, Mycobacterium bovis subsp bovis AF2122/97
gccgcccgcuccuccggcacca

SEQ ID NO: 3158167 - RNA, 21 nt, Mycobacterium bovis subsp bovis AF2122/97
gccgcccgcucgaugucgguc

SEQ ID NO: 3158168 - RNA, 13 nt, Mycobacterium bovis subsp bovis AF2122/97
gccgcccgcugcg

SEQ ID NO: 3158169 - RNA, 19 nt, Mycobacterium bovis subsp bovis AF2122/97
gccgcccggacccaaagca

SEQ ID NO: 3158170 - RNA, 13 nt, Mycobacterium bovis subsp bovis AF2122/97
gccgcccggcgag

SEQ ID NO: 3158171 - RNA, 14 nt, Mycobacterium bovis subsp bovis AF2122/97
gccgcccggcgagc

SEQ ID NO: 3158172 - RNA, 21 nt, Mycobacterium bovis subsp bovis AF2122/97
gccgcccggcgagcagggcgu

SEQ ID NO: 3158173 - RNA, 16 nt, Mycobacterium bovis subsp bovis AF2122/97
gccgcccgggcgagaa

SEQ ID NO: 3158174 - RNA, 18 nt, Mycobacterium bovis subsp bovis AF2122/97
gccgcccguaaaccgaua

SEQ ID NO: 3158175 - RNA, 17 nt, Mycobacterium bovis subsp bovis AF2122/97
gccgcccgugccgcccu

SEQ ID NO: 3158176 - RNA, 14 nt, Mycobacterium bovis subsp bovis AF2122/97
gccgcccucaccgc

SEQ ID NO: 3158177 - RNA, 16 nt, Mycobacterium bovis subsp bovis AF2122/97
gccgcccucaccgccu

SEQ ID NO: 3158178 - RNA, 19 nt, Mycobacterium bovis subsp bovis AF2122/97
gccgcccucccuggggccg

SEQ ID NO: 3158179 - RNA, 16 nt, Mycobacterium bovis subsp bovis AF2122/97
gccgcccucgggauug

SEQ ID NO: 3158180 - RNA, 19 nt, Mycobacterium bovis subsp bovis AF2122/97
gccgcccuggacgucggcg

SEQ ID NO: 3158181 - RNA, 14 nt, Mycobacterium bovis subsp bovis AF2122/97
gccgcccuggccgc

SEQ ID NO: 3158182 - RNA, 16 nt, Mycobacterium bovis subsp bovis AF2122/97
gccgcccuggccgccg

SEQ ID NO: 3158183 - RNA, 17 nt, Mycobacterium bovis subsp bovis AF2122/97
gccgcccuggccgccgg

SEQ ID NO: 3158184 - RNA, 19 nt, Mycobacterium bovis subsp bovis AF2122/97
gccgcccuggccgccggcc

SEQ ID NO: 3158185 - RNA, 20 nt, Mycobacterium bovis subsp bovis AF2122/97
gccgcccuggccgccggccc

SEQ ID NO: 3158186 - RNA, 18 nt, Mycobacterium bovis subsp bovis AF2122/97
gccgcccugguccaggcc

SEQ ID NO: 3158187 - RNA, 20 nt, Mycobacterium bovis subsp bovis AF2122/97
gccgcccuugauguccgcga

SEQ ID NO: 3158188 - RNA, 18 nt, Mycobacterium bovis subsp bovis AF2122/97
gccgcccuugccgcccgc

SEQ ID NO: 3158189 - RNA, 17 nt, Mycobacterium bovis subsp bovis AF2122/97
gccgcccuugccgccgg

SEQ ID NO: 3158190 - RNA, 19 nt, Mycobacterium bovis subsp bovis AF2122/97
gccgcccuugccgccggcc

SEQ ID NO: 3158191 - RNA, 20 nt, Mycobacterium bovis subsp bovis AF2122/97
gccgcccuugccgccggccc

SEQ ID NO: 3158192 - RNA, 19 nt, Mycobacterium bovis subsp bovis AF2122/97
gccgccgaaacucaccagc

SEQ ID NO: 3158193 - RNA, 21 nt, Mycobacterium bovis subsp bovis AF2122/97
gccgccgaaacucaccagcac

SEQ ID NO: 3158194 - RNA, 22 nt, Mycobacterium bovis subsp bovis AF2122/97
gccgccgaaacucaccagcacc

SEQ ID NO: 3158195 - RNA, 23 nt, Mycobacterium bovis subsp bovis AF2122/97
gccgccgaaacucaccagcaccc

SEQ ID NO: 3158196 - RNA, 21 nt, Mycobacterium bovis subsp bovis AF2122/97
gccgccgcggccaccaccgcc

SEQ ID NO: 3158197 - RNA, 23 nt, Mycobacterium bovis subsp bovis AF2122/97
gccgccgcggccaccaccgccgc

SEQ ID NO: 3158198 - RNA, 13 nt, Mycobacterium bovis subsp bovis AF2122/97
gccgccgcggccg

SEQ ID NO: 3158199 - RNA, 15 nt, Mycobacterium bovis subsp bovis AF2122/97
gccgccgcggccggc

SEQ ID NO: 3158200 - RNA, 22 nt, Mycobacterium bovis subsp bovis AF2122/97
gccgccgcggccggcgcucgcg

SEQ ID NO: 3158201 - RNA, 15 nt, Mycobacterium bovis subsp bovis AF2122/97
gccgccgcggcgaag

SEQ ID NO: 3158202 - RNA, 12 nt, Mycobacterium bovis subsp bovis AF2122/97
gccgccgcggcu

SEQ ID NO: 3158203 - RNA, 15 nt, Mycobacterium bovis subsp bovis AF2122/97
gccgccgcggcuugu

SEQ ID NO: 3158204 - RNA, 16 nt, Mycobacterium bovis subsp bovis AF2122/97
gccgccgcgggcgccg

SEQ ID NO: 3158205 - RNA, 17 nt, Mycobacterium bovis subsp bovis AF2122/97
gccgccgcgggcgccgg

SEQ ID NO: 3158206 - RNA, 12 nt, Mycobacterium bovis subsp bovis AF2122/97
gccgccgcgguc

SEQ ID NO: 3158207 - RNA, 14 nt, Mycobacterium bovis subsp bovis AF2122/97
gccgccgcuaccgc

SEQ ID NO: 3158208 - RNA, 19 nt, Mycobacterium bovis subsp bovis AF2122/97
gccgccgcuaccgccgggg

SEQ ID NO: 3158209 - RNA, 13 nt, Mycobacterium bovis subsp bovis AF2122/97
gccgccgcugccg

SEQ ID NO: 3158210 - RNA, 17 nt, Mycobacterium bovis subsp bovis AF2122/97
gccgccgcugccgcccu

SEQ ID NO: 3158211 - RNA, 16 nt, Mycobacterium bovis subsp bovis AF2122/97
gccgccgcugccgccu

SEQ ID NO: 3158212 - RNA, 13 nt, Mycobacterium bovis subsp bovis AF2122/97
gccgccgcugguc

SEQ ID NO: 3158213 - RNA, 22 nt, Mycobacterium bovis subsp bovis AF2122/97
gccgccgcuguugaucgacacc

SEQ ID NO: 3158214 - RNA, 18 nt, Mycobacterium bovis subsp bovis AF2122/97
gccgccgcuucaccccac

SEQ ID NO: 3158215 - RNA, 17 nt, Mycobacterium bovis subsp bovis AF2122/97
gccgccggaagcgccgg

SEQ ID NO: 3158216 - RNA, 13 nt, Mycobacterium bovis subsp bovis AF2122/97
gccgccggaaucg

SEQ ID NO: 3158217 - RNA, 18 nt, Mycobacterium bovis subsp bovis AF2122/97
gccgccggacccaccguc

SEQ ID NO: 3158218 - RNA, 17 nt, Mycobacterium bovis subsp bovis AF2122/97
gccgccggacccgucga

SEQ ID NO: 3158219 - RNA, 12 nt, Mycobacterium bovis subsp bovis AF2122/97
gccgccggaggu

SEQ ID NO: 3158220 - RNA, 17 nt, Mycobacterium bovis subsp bovis AF2122/97
gccgccggaggugacaa

SEQ ID NO: 3158221 - RNA, 18 nt, Mycobacterium bovis subsp bovis AF2122/97
gccgccggaucgccacgg

SEQ ID NO: 3158222 - RNA, 20 nt, Mycobacterium bovis subsp bovis AF2122/97
gccgccggaucgccacggug

SEQ ID NO: 3158223 - RNA, 15 nt, Mycobacterium bovis subsp bovis AF2122/97
gccgccggaucgccg

SEQ ID NO: 3158224 - RNA, 15 nt, Mycobacterium bovis subsp bovis AF2122/97
gccgccggcacccgc

SEQ ID NO: 3158225 - RNA, 13 nt, Mycobacterium bovis subsp bovis AF2122/97
gccgccggcaccg

SEQ ID NO: 3158226 - RNA, 15 nt, Mycobacterium bovis subsp bovis AF2122/97
gccgccggcaccgcc

SEQ ID NO: 3158227 - RNA, 17 nt, Mycobacterium bovis subsp bovis AF2122/97
gccgccggcaccgccgg

SEQ ID NO: 3158228 - RNA, 18 nt, Mycobacterium bovis subsp bovis AF2122/97
gccgccggcaccgccggc

SEQ ID NO: 3158229 - RNA, 15 nt, Mycobacterium bovis subsp bovis AF2122/97
gccgccggcaccggg

SEQ ID NO: 3158230 - RNA, 15 nt, Mycobacterium bovis subsp bovis AF2122/97
gccgccggcaccgua

SEQ ID NO: 3158231 - RNA, 11 nt, Mycobacterium bovis subsp bovis AF2122/97
gccgccggcca

SEQ ID NO: 3158232 - RNA, 12 nt, Mycobacterium bovis subsp bovis AF2122/97
gccgccggccag

SEQ ID NO: 3158233 - RNA, 13 nt, Mycobacterium bovis subsp bovis AF2122/97
gccgccggccagu

SEQ ID NO: 3158234 - RNA, 17 nt, Mycobacterium bovis subsp bovis AF2122/97
gccgccggccccgccag

SEQ ID NO: 3158235 - RNA, 18 nt, Mycobacterium bovis subsp bovis AF2122/97
gccgccggccccgccagc

SEQ ID NO: 3158236 - RNA, 20 nt, Mycobacterium bovis subsp bovis AF2122/97
gccgccggccccgccagcgc

SEQ ID NO: 3158237 - RNA, 21 nt, Mycobacterium bovis subsp bovis AF2122/97
gccgccggccccgccagcgcc

SEQ ID NO: 3158238 - RNA, 17 nt, Mycobacterium bovis subsp bovis AF2122/97
gccgccggccccgccgc

SEQ ID NO: 3158239 - RNA, 23 nt, Mycobacterium bovis subsp bovis AF2122/97
gccgccggccccgccgucgccgc

SEQ ID NO: 3158240 - RNA, 13 nt, Mycobacterium bovis subsp bovis AF2122/97
gccgccggccgcg

SEQ ID NO: 3158241 - RNA, 14 nt, Mycobacterium bovis subsp bovis AF2122/97
gccgccggccgcgc

SEQ ID NO: 3158242 - RNA, 15 nt, Mycobacterium bovis subsp bovis AF2122/97
gccgccggccgcgca

SEQ ID NO: 3158243 - RNA, 16 nt, Mycobacterium bovis subsp bovis AF2122/97
gccgccggccgcgcag

SEQ ID NO: 3158244 - RNA, 12 nt, Mycobacterium bovis subsp bovis AF2122/97
gccgccggccgg

SEQ ID NO: 3158245 - RNA, 14 nt, Mycobacterium bovis subsp bovis AF2122/97
gccgccggccggca

SEQ ID NO: 3158246 - RNA, 18 nt, Mycobacterium bovis subsp bovis AF2122/97
gccgccggccggcauccg

SEQ ID NO: 3158247 - RNA, 24 nt, Mycobacterium bovis subsp bovis AF2122/97
gccgccggccggcauccgguucgc

SEQ ID NO: 3158248 - RNA, 22 nt, Mycobacterium bovis subsp bovis AF2122/97
gccgccggcgaagcgugcgccg

SEQ ID NO: 3158249 - RNA, 12 nt, Mycobacterium bovis subsp bovis AF2122/97
gccgccggcgcc

SEQ ID NO: 3158250 - RNA, 13 nt, Mycobacterium bovis subsp bovis AF2122/97
gccgccggcgcca

SEQ ID NO: 3158251 - RNA, 14 nt, Mycobacterium bovis subsp bovis AF2122/97
gccgccggcgccac

SEQ ID NO: 3158252 - RNA, 16 nt, Mycobacterium bovis subsp bovis AF2122/97
gccgccggcgccaccc

SEQ ID NO: 3158253 - RNA, 17 nt, Mycobacterium bovis subsp bovis AF2122/97
gccgccggcgccacccg

SEQ ID NO: 3158254 - RNA, 17 nt, Mycobacterium bovis subsp bovis AF2122/97
gccgccggcgccaccgu

SEQ ID NO: 3158255 - RNA, 14 nt, Mycobacterium bovis subsp bovis AF2122/97
gccgccggcgccag

SEQ ID NO: 3158256 - RNA, 15 nt, Mycobacterium bovis subsp bovis AF2122/97
gccgccggcgccagc

SEQ ID NO: 3158257 - RNA, 22 nt, Mycobacterium bovis subsp bovis AF2122/97
gccgccggcgccagcgccgcca

SEQ ID NO: 3158258 - RNA, 15 nt, Mycobacterium bovis subsp bovis AF2122/97
gccgccggcgccauc

SEQ ID NO: 3158259 - RNA, 15 nt, Mycobacterium bovis subsp bovis AF2122/97
gccgccggcgcccag

SEQ ID NO: 3158260 - RNA, 17 nt, Mycobacterium bovis subsp bovis AF2122/97
gccgccggcgcccaggc

SEQ ID NO: 3158261 - RNA, 13 nt, Mycobacterium bovis subsp bovis AF2122/97
gccgccggcgccg

SEQ ID NO: 3158262 - RNA, 14 nt, Mycobacterium bovis subsp bovis AF2122/97
gccgccggcgccga

SEQ ID NO: 3158263 - RNA, 17 nt, Mycobacterium bovis subsp bovis AF2122/97
gccgccggcgccgccau

SEQ ID NO: 3158264 - RNA, 19 nt, Mycobacterium bovis subsp bovis AF2122/97
gccgccggcgccgcccgcg

SEQ ID NO: 3158265 - RNA, 16 nt, Mycobacterium bovis subsp bovis AF2122/97
gccgccggcgccgccg

SEQ ID NO: 3158266 - RNA, 17 nt, Mycobacterium bovis subsp bovis AF2122/97
gccgccggcgccgccga

SEQ ID NO: 3158267 - RNA, 18 nt, Mycobacterium bovis subsp bovis AF2122/97
gccgccggcgccgccgau

SEQ ID NO: 3158268 - RNA, 17 nt, Mycobacterium bovis subsp bovis AF2122/97
gccgccggcgccgccgu

SEQ ID NO: 3158269 - RNA, 14 nt, Mycobacterium bovis subsp bovis AF2122/97
gccgccggcgccgg

SEQ ID NO: 3158270 - RNA, 22 nt, Mycobacterium bovis subsp bovis AF2122/97
gccgccggcgccggagccgccc

SEQ ID NO: 3158271 - RNA, 15 nt, Mycobacterium bovis subsp bovis AF2122/97
gccgccggcgccggc

SEQ ID NO: 3158272 - RNA, 13 nt, Mycobacterium bovis subsp bovis AF2122/97
gccgccggcgcgu

SEQ ID NO: 3158273 - RNA, 13 nt, Mycobacterium bovis subsp bovis AF2122/97
gccgccggcgcug

SEQ ID NO: 3158274 - RNA, 19 nt, Mycobacterium bovis subsp bovis AF2122/97
gccgccggcgcugaucgcg

SEQ ID NO: 3158275 - RNA, 12 nt, Mycobacterium bovis subsp bovis AF2122/97
gccgccggcggc

SEQ ID NO: 3158276 - RNA, 15 nt, Mycobacterium bovis subsp bovis AF2122/97
gccgccggcggcggu

SEQ ID NO: 3158277 - RNA, 19 nt, Mycobacterium bovis subsp bovis AF2122/97
gccgccggcggcgguaccg

SEQ ID NO: 3158278 - RNA, 16 nt, Mycobacterium bovis subsp bovis AF2122/97
gccgccggcggucgcg

SEQ ID NO: 3158279 - RNA, 15 nt, Mycobacterium bovis subsp bovis AF2122/97
gccgccggcuccacc

SEQ ID NO: 3158280 - RNA, 12 nt, Mycobacterium bovis subsp bovis AF2122/97
gccgccggcucg

SEQ ID NO: 3158281 - RNA, 13 nt, Mycobacterium bovis subsp bovis AF2122/97
gccgccggcucgc

SEQ ID NO: 3158282 - RNA, 15 nt, Mycobacterium bovis subsp bovis AF2122/97
gccgccggcucgccg

SEQ ID NO: 3158283 - RNA, 22 nt, Mycobacterium bovis subsp bovis AF2122/97
gccgccggcucgccggcgaccg

SEQ ID NO: 3158284 - RNA, 15 nt, Mycobacterium bovis subsp bovis AF2122/97
gccgccugcgccgcc

SEQ ID NO: 3158285 - RNA, 16 nt, Mycobacterium bovis subsp bovis AF2122/97
gccgccugcgccgcca

SEQ ID NO: 3158286 - RNA, 17 nt, Mycobacterium bovis subsp bovis AF2122/97
gccgccugcgccgccag

SEQ ID NO: 3158287 - RNA, 18 nt, Mycobacterium bovis subsp bovis AF2122/97
gccgccugcuccucggcc

SEQ ID NO: 3158288 - RNA, 20 nt, Mycobacterium bovis subsp bovis AF2122/97
gccgccugcuccucggccag

SEQ ID NO: 3158289 - RNA, 19 nt, Mycobacterium bovis subsp bovis AF2122/97
gccgccuggguugaccgcc

SEQ ID NO: 3158290 - RNA, 20 nt, Mycobacterium bovis subsp bovis AF2122/97
gccgccuggguugaccgcca

SEQ ID NO: 3158291 - RNA, 22 nt, Mycobacterium bovis subsp bovis AF2122/97
gccgccuggguugaccgccacc

SEQ ID NO: 3158292 - RNA, 15 nt, Mycobacterium bovis subsp bovis AF2122/97
gccgccugucccgcc

SEQ ID NO: 3158293 - RNA, 15 nt, Mycobacterium bovis subsp bovis AF2122/97
gccgccugugcgcgg

SEQ ID NO: 3158294 - RNA, 16 nt, Mycobacterium bovis subsp bovis AF2122/97
gccgccugugcgcggu

SEQ ID NO: 3158295 - RNA, 15 nt, Mycobacterium bovis subsp bovis AF2122/97
gccgccuucuccggc

SEQ ID NO: 3158296 - RNA, 16 nt, Mycobacterium bovis subsp bovis AF2122/97
gccgccuucuccggcg

SEQ ID NO: 3158297 - RNA, 18 nt, Mycobacterium bovis subsp bovis AF2122/97
gccgccuucuccggcguc

SEQ ID NO: 3158298 - RNA, 13 nt, Mycobacterium bovis subsp bovis AF2122/97
gccgccuucucgc

SEQ ID NO: 3158299 - RNA, 20 nt, Mycobacterium bovis subsp bovis AF2122/97
gccgccuucuucucggcgag

SEQ ID NO: 3158300 - RNA, 22 nt, Mycobacterium bovis subsp bovis AF2122/97
gccgccuucuucucggcgagcu

SEQ ID NO: 3158301 - RNA, 12 nt, Mycobacterium bovis subsp bovis AF2122/97
gccgccuucuug

SEQ ID NO: 3158302 - RNA, 21 nt, Mycobacterium bovis subsp bovis AF2122/97
gccgccuugaggcccugcggc

SEQ ID NO: 3158303 - RNA, 14 nt, Mycobacterium bovis subsp bovis AF2122/97
gccgccuuggucgc

SEQ ID NO: 3158304 - RNA, 17 nt, Mycobacterium bovis subsp bovis AF2122/97
gccgccuuugcccccgg

SEQ ID NO: 3158305 - RNA, 21 nt, Mycobacterium bovis subsp bovis AF2122/97
gccgccuuugcccccgguguc

SEQ ID NO: 3158306 - RNA, 18 nt, Mycobacterium bovis subsp bovis AF2122/97
gccgccuuuuuucgccgc

SEQ ID NO: 3158307 - RNA, 22 nt, Mycobacterium bovis subsp bovis AF2122/97
gccgcgaaacccugaaaagggc

SEQ ID NO: 3158308 - RNA, 15 nt, Mycobacterium bovis subsp bovis AF2122/97
gccgcgaacgggucg

SEQ ID NO: 3158309 - RNA, 16 nt, Mycobacterium bovis subsp bovis AF2122/97
gccgcgaacuccagca

SEQ ID NO: 3158310 - RNA, 14 nt, Mycobacterium bovis subsp bovis AF2122/97
gccgcgaagcgcuc

SEQ ID NO: 3158311 - RNA, 18 nt, Mycobacterium bovis subsp bovis AF2122/97
gccgcgaaggggugcccg

SEQ ID NO: 3158312 - RNA, 22 nt, Mycobacterium bovis subsp bovis AF2122/97
gccgcgaaggggugcccggcgg

SEQ ID NO: 3158313 - RNA, 22 nt, Mycobacterium bovis subsp bovis AF2122/97
gccgcgaaugaagcccucgucg

SEQ ID NO: 3158314 - RNA, 17 nt, Mycobacterium bovis subsp bovis AF2122/97
gccgcgaaugcugugcc

SEQ ID NO: 3158315 - RNA, 16 nt, Mycobacterium bovis subsp bovis AF2122/97
gccgcgaaugucgccg

SEQ ID NO: 3158316 - RNA, 20 nt, Mycobacterium bovis subsp bovis AF2122/97
gccgcgaaugucgccgccug

SEQ ID NO: 3158317 - RNA, 14 nt, Mycobacterium bovis subsp bovis AF2122/97
gccgcgacauccgc

SEQ ID NO: 3158318 - RNA, 21 nt, Mycobacterium bovis subsp bovis AF2122/97
gccgcgacauccgcggcaugc

SEQ ID NO: 3158319 - RNA, 17 nt, Mycobacterium bovis subsp bovis AF2122/97
gccgcgaccagcgccgc

SEQ ID NO: 3158320 - RNA, 15 nt, Mycobacterium bovis subsp bovis AF2122/97
gccgcgacccgcgca

SEQ ID NO: 3158321 - RNA, 23 nt, Mycobacterium bovis subsp bovis AF2122/97
gccgcgaccgcagcuggggcgga

SEQ ID NO: 3158322 - RNA, 12 nt, Mycobacterium bovis subsp bovis AF2122/97
gccgcgaccgcc

SEQ ID NO: 3158323 - RNA, 18 nt, Mycobacterium bovis subsp bovis AF2122/97
gccgcgaccgccucgccg

SEQ ID NO: 3158324 - RNA, 22 nt, Mycobacterium bovis subsp bovis AF2122/97
gccgcgaccgccucgccguaga

SEQ ID NO: 3158325 - RNA, 13 nt, Mycobacterium bovis subsp bovis AF2122/97
gccgcgaccgcga

SEQ ID NO: 3158326 - RNA, 14 nt, Mycobacterium bovis subsp bovis AF2122/97
gccgcgaccgcgac

SEQ ID NO: 3158327 - RNA, 23 nt, Mycobacterium bovis subsp bovis AF2122/97
gccgcgaccgcgaccgcauugag

SEQ ID NO: 3158328 - RNA, 16 nt, Mycobacterium bovis subsp bovis AF2122/97
gccgcgaccgcgagca

SEQ ID NO: 3158329 - RNA, 13 nt, Mycobacterium bovis subsp bovis AF2122/97
gccgcgaccggcg

SEQ ID NO: 3158330 - RNA, 17 nt, Mycobacterium bovis subsp bovis AF2122/97
gccgcgaccggcguaac

SEQ ID NO: 3158331 - RNA, 13 nt, Mycobacterium bovis subsp bovis AF2122/97
gccgcgacgacac

SEQ ID NO: 3158332 - RNA, 14 nt, Mycobacterium bovis subsp bovis AF2122/97
gccgcgacgacacg

SEQ ID NO: 3158333 - RNA, 15 nt, Mycobacterium bovis subsp bovis AF2122/97
gccgcgacgacacgc

SEQ ID NO: 3158334 - RNA, 16 nt, Mycobacterium bovis subsp bovis AF2122/97
gccgcgacgacacgcc

SEQ ID NO: 3158335 - RNA, 22 nt, Mycobacterium bovis subsp bovis AF2122/97
gccgcgacgacacgccugggcg

SEQ ID NO: 3158336 - RNA, 19 nt, Mycobacterium bovis subsp bovis AF2122/97
gccgcgacgaugccucggc

SEQ ID NO: 3158337 - RNA, 22 nt, Mycobacterium bovis subsp bovis AF2122/97
gccgcgacgaugccucggcggc

SEQ ID NO: 3158338 - RNA, 14 nt, Mycobacterium bovis subsp bovis AF2122/97
gccgcgacggcacg

SEQ ID NO: 3158339 - RNA, 14 nt, Mycobacterium bovis subsp bovis AF2122/97
gccgcgacgggcac

SEQ ID NO: 3158340 - RNA, 15 nt, Mycobacterium bovis subsp bovis AF2122/97
gccgcgacguugaac

SEQ ID NO: 3158341 - RNA, 16 nt, Mycobacterium bovis subsp bovis AF2122/97
gccgcgacugcaccug

SEQ ID NO: 3158342 - RNA, 23 nt, Mycobacterium bovis subsp bovis AF2122/97
gccgcgagacgcaugucgggcca

SEQ ID NO: 3158343 - RNA, 23 nt, Mycobacterium bovis subsp bovis AF2122/97
gccgcgagagccggcggcgacca

SEQ ID NO: 3158344 - RNA, 15 nt, Mycobacterium bovis subsp bovis AF2122/97
gccgcgagcacgucg

SEQ ID NO: 3158345 - RNA, 16 nt, Mycobacterium bovis subsp bovis AF2122/97
gccgcgagcacgucgg

SEQ ID NO: 3158346 - RNA, 17 nt, Mycobacterium bovis subsp bovis AF2122/97
gccgcgagccggugauc

SEQ ID NO: 3158347 - RNA, 12 nt, Mycobacterium bovis subsp bovis AF2122/97
gccgcgagcgcc

SEQ ID NO: 3158348 - RNA, 15 nt, Mycobacterium bovis subsp bovis AF2122/97
gccgcgagcgccggc

SEQ ID NO: 3158349 - RNA, 16 nt, Mycobacterium bovis subsp bovis AF2122/97
gccgcgagcgccggcc

SEQ ID NO: 3158350 - RNA, 19 nt, Mycobacterium bovis subsp bovis AF2122/97
gccgcgagcgccggccgcg

SEQ ID NO: 3158351 - RNA, 22 nt, Mycobacterium bovis subsp bovis AF2122/97
gccgcgagcgccggccgcggcg

SEQ ID NO: 3158352 - RNA, 21 nt, Mycobacterium bovis subsp bovis AF2122/97
gccgcgaggaugcugagcgcc

SEQ ID NO: 3158353 - RNA, 17 nt, Mycobacterium bovis subsp bovis AF2122/97
gccgcgaggcaccgaca

SEQ ID NO: 3158354 - RNA, 23 nt, Mycobacterium bovis subsp bovis AF2122/97
gccgcgaucaguugcucguugug

SEQ ID NO: 3158355 - RNA, 15 nt, Mycobacterium bovis subsp bovis AF2122/97
gccgcgauccagcgc

SEQ ID NO: 3158356 - RNA, 14 nt, Mycobacterium bovis subsp bovis AF2122/97
gccgcgaucccggc

SEQ ID NO: 3158357 - RNA, 17 nt, Mycobacterium bovis subsp bovis AF2122/97
gccgcgaucccggccgu

SEQ ID NO: 3158358 - RNA, 17 nt, Mycobacterium bovis subsp bovis AF2122/97
gccgcgaucgcggcauc

SEQ ID NO: 3158359 - RNA, 19 nt, Mycobacterium bovis subsp bovis AF2122/97
gccgcgaucgggcccagca

SEQ ID NO: 3158360 - RNA, 22 nt, Mycobacterium bovis subsp bovis AF2122/97
gccgcgaucggugcgggcgccg

SEQ ID NO: 3158361 - RNA, 23 nt, Mycobacterium bovis subsp bovis AF2122/97
gccgcgaucggugcgggcgccgc

SEQ ID NO: 3158362 - RNA, 20 nt, Mycobacterium bovis subsp bovis AF2122/97
gccgcgaucuccuuggccgu

SEQ ID NO: 3158363 - RNA, 23 nt, Mycobacterium bovis subsp bovis AF2122/97
gccgcgaucuccuuggccguucg

SEQ ID NO: 3158364 - RNA, 19 nt, Mycobacterium bovis subsp bovis AF2122/97
gccgcgaugacggugccga

SEQ ID NO: 3158365 - RNA, 21 nt, Mycobacterium bovis subsp bovis AF2122/97
gccgcgaugagcggcgcggca

SEQ ID NO: 3158366 - RNA, 15 nt, Mycobacterium bovis subsp bovis AF2122/97
gccgcgaugccaccc

SEQ ID NO: 3158367 - RNA, 17 nt, Mycobacterium bovis subsp bovis AF2122/97
gccgcgaugccacccaa

SEQ ID NO: 3158368 - RNA, 23 nt, Mycobacterium bovis subsp bovis AF2122/97
gccgcgaugccacccaacagcgc

SEQ ID NO: 3158369 - RNA, 20 nt, Mycobacterium bovis subsp bovis AF2122/97
gccgcgaugcgccuugacga

SEQ ID NO: 3158370 - RNA, 18 nt, Mycobacterium bovis subsp bovis AF2122/97
gccgcgcucaucgcggcg

SEQ ID NO: 3158371 - RNA, 21 nt, Mycobacterium bovis subsp bovis AF2122/97
gccgcgcucaucgcggcgaac

SEQ ID NO: 3158372 - RNA, 21 nt, Mycobacterium bovis subsp bovis AF2122/97
gccgcgcucgaacuccccggu

SEQ ID NO: 3158373 - RNA, 16 nt, Mycobacterium bovis subsp bovis AF2122/97
gccgcgcucgacgagc

SEQ ID NO: 3158374 - RNA, 23 nt, Mycobacterium bovis subsp bovis AF2122/97
gccgcgcucgacgagcacgccga

SEQ ID NO: 3158375 - RNA, 13 nt, Mycobacterium bovis subsp bovis AF2122/97
gccgcgcucgccg

SEQ ID NO: 3158376 - RNA, 14 nt, Mycobacterium bovis subsp bovis AF2122/97
gccgcgcucgccga

SEQ ID NO: 3158377 - RNA, 12 nt, Mycobacterium bovis subsp bovis AF2122/97
gccgcgcugguc

SEQ ID NO: 3158378 - RNA, 15 nt, Mycobacterium bovis subsp bovis AF2122/97
gccgcgcuggucaac

SEQ ID NO: 3158379 - RNA, 15 nt, Mycobacterium bovis subsp bovis AF2122/97
gccgcgcuugcgauc

SEQ ID NO: 3158380 - RNA, 18 nt, Mycobacterium bovis subsp bovis AF2122/97
gccgcgcuugcgaucggc

SEQ ID NO: 3158381 - RNA, 19 nt, Mycobacterium bovis subsp bovis AF2122/97
gccgcgcuugcgaucggca

SEQ ID NO: 3158382 - RNA, 21 nt, Mycobacterium bovis subsp bovis AF2122/97
gccgcgcuugcgaucggcacu

SEQ ID NO: 3158383 - RNA, 15 nt, Mycobacterium bovis subsp bovis AF2122/97
gccgcggacaccagg

SEQ ID NO: 3158384 - RNA, 14 nt, Mycobacterium bovis subsp bovis AF2122/97
gccgcggaccgcga

SEQ ID NO: 3158385 - RNA, 21 nt, Mycobacterium bovis subsp bovis AF2122/97
gccgcggacugguauucguuc

SEQ ID NO: 3158386 - RNA, 19 nt, Mycobacterium bovis subsp bovis AF2122/97
gccgcggacuugcgagccg

SEQ ID NO: 3158387 - RNA, 20 nt, Mycobacterium bovis subsp bovis AF2122/97
gccgcggagaaggcgcgggc

SEQ ID NO: 3158388 - RNA, 22 nt, Mycobacterium bovis subsp bovis AF2122/97
gccgcggagaaggcgcgggcga

SEQ ID NO: 3158389 - RNA, 19 nt, Mycobacterium bovis subsp bovis AF2122/97
gccgcggaggcggccagcc

SEQ ID NO: 3158390 - RNA, 21 nt, Mycobacterium bovis subsp bovis AF2122/97
gccgcggaucauccuucgccg

SEQ ID NO: 3158391 - RNA, 21 nt, Mycobacterium bovis subsp bovis AF2122/97
gccgcggcacccaggugucgc

SEQ ID NO: 3158392 - RNA, 17 nt, Mycobacterium bovis subsp bovis AF2122/97
gccgcggcaccgccccg

SEQ ID NO: 3158393 - RNA, 18 nt, Mycobacterium bovis subsp bovis AF2122/97
gccgcggcaccgccccgc

SEQ ID NO: 3158394 - RNA, 17 nt, Mycobacterium bovis subsp bovis AF2122/97
gccgcggcaccgccgag

SEQ ID NO: 3158395 - RNA, 20 nt, Mycobacterium bovis subsp bovis AF2122/97
gccgcggcaccgccgagcag

SEQ ID NO: 3158396 - RNA, 12 nt, Mycobacterium bovis subsp bovis AF2122/97
gccgcggcaccu

SEQ ID NO: 3158397 - RNA, 20 nt, Mycobacterium bovis subsp bovis AF2122/97
gccgcggcagcauccucgac

SEQ ID NO: 3158398 - RNA, 14 nt, Mycobacterium bovis subsp bovis AF2122/97
gccgcggcagcgga

SEQ ID NO: 3158399 - RNA, 14 nt, Mycobacterium bovis subsp bovis AF2122/97
gccgcggcagggcg

SEQ ID NO: 3158400 - RNA, 21 nt, Mycobacterium bovis subsp bovis AF2122/97
gccgcggcagggcggugccau

SEQ ID NO: 3158401 - RNA, 14 nt, Mycobacterium bovis subsp bovis AF2122/97
gccgcggccacaac

SEQ ID NO: 3158402 - RNA, 20 nt, Mycobacterium bovis subsp bovis AF2122/97
gccgcggccacaucgccagc

SEQ ID NO: 3158403 - RNA, 21 nt, Mycobacterium bovis subsp bovis AF2122/97
gccgcggccacaucgccagca

SEQ ID NO: 3158404 - RNA, 16 nt, Mycobacterium bovis subsp bovis AF2122/97
gccgcggccaccaccg

SEQ ID NO: 3158405 - RNA, 13 nt, Mycobacterium bovis subsp bovis AF2122/97
gccgcggccaccg

SEQ ID NO: 3158406 - RNA, 15 nt, Mycobacterium bovis subsp bovis AF2122/97
gccgcggccaccgcc

SEQ ID NO: 3158407 - RNA, 18 nt, Mycobacterium bovis subsp bovis AF2122/97
gccgcggccaccgccgcc

SEQ ID NO: 3158408 - RNA, 19 nt, Mycobacterium bovis subsp bovis AF2122/97
gccgcggccaguacgucga

SEQ ID NO: 3158409 - RNA, 22 nt, Mycobacterium bovis subsp bovis AF2122/97
gccgcggcccacucucgccacg

SEQ ID NO: 3158410 - RNA, 23 nt, Mycobacterium bovis subsp bovis AF2122/97
gccgcggcccacucucgccacgc

SEQ ID NO: 3158411 - RNA, 13 nt, Mycobacterium bovis subsp bovis AF2122/97
gccgcggcccgcg

SEQ ID NO: 3158412 - RNA, 16 nt, Mycobacterium bovis subsp bovis AF2122/97
gccgcggcccgcgugc

SEQ ID NO: 3158413 - RNA, 13 nt, Mycobacterium bovis subsp bovis AF2122/97
gccgcggccggcg

SEQ ID NO: 3158414 - RNA, 14 nt, Mycobacterium bovis subsp bovis AF2122/97
gccgcggccggcgc

SEQ ID NO: 3158415 - RNA, 14 nt, Mycobacterium bovis subsp bovis AF2122/97
gccgcggccggcgu

SEQ ID NO: 3158416 - RNA, 16 nt, Mycobacterium bovis subsp bovis AF2122/97
gccgcggcgacgguga

SEQ ID NO: 3158417 - RNA, 14 nt, Mycobacterium bovis subsp bovis AF2122/97
gccgcggcgcccgg

SEQ ID NO: 3158418 - RNA, 17 nt, Mycobacterium bovis subsp bovis AF2122/97
gccgcggcgcccggcgg

SEQ ID NO: 3158419 - RNA, 18 nt, Mycobacterium bovis subsp bovis AF2122/97
gccgcggcgcccggcgga

SEQ ID NO: 3158420 - RNA, 11 nt, Mycobacterium bovis subsp bovis AF2122/97
gccgcggcgga

SEQ ID NO: 3158421 - RNA, 19 nt, Mycobacterium bovis subsp bovis AF2122/97
gccgcggcggaaggcgucg

SEQ ID NO: 3158422 - RNA, 19 nt, Mycobacterium bovis subsp bovis AF2122/97
gccgcggcggauggcgucg

SEQ ID NO: 3158423 - RNA, 12 nt, Mycobacterium bovis subsp bovis AF2122/97
gccgcggcggca

SEQ ID NO: 3158424 - RNA, 14 nt, Mycobacterium bovis subsp bovis AF2122/97
gccgcggcggcagc

SEQ ID NO: 3158425 - RNA, 15 nt, Mycobacterium bovis subsp bovis AF2122/97
gccgcggcggcagca

SEQ ID NO: 3158426 - RNA, 18 nt, Mycobacterium bovis subsp bovis AF2122/97
gccgcggcggcagcggcg

SEQ ID NO: 3158427 - RNA, 15 nt, Mycobacterium bovis subsp bovis AF2122/97
gccgcggcggccagc

SEQ ID NO: 3158428 - RNA, 13 nt, Mycobacterium bovis subsp bovis AF2122/97
gccgcggcggccc

SEQ ID NO: 3158429 - RNA, 14 nt, Mycobacterium bovis subsp bovis AF2122/97
gccgcggcggucug

SEQ ID NO: 3158430 - RNA, 21 nt, Mycobacterium bovis subsp bovis AF2122/97
gccgcggcuacaucggcggcg

SEQ ID NO: 3158431 - RNA, 20 nt, Mycobacterium bovis subsp bovis AF2122/97
gccgcggcuaggccagcacg

SEQ ID NO: 3158432 - RNA, 22 nt, Mycobacterium bovis subsp bovis AF2122/97
gccgcggcuccgagggcugcgu

SEQ ID NO: 3158433 - RNA, 22 nt, Mycobacterium bovis subsp bovis AF2122/97
gccgcggcugccaucccgaucc

SEQ ID NO: 3158434 - RNA, 21 nt, Mycobacterium bovis subsp bovis AF2122/97
gccgcggcugggggauaccgc

SEQ ID NO: 3158435 - RNA, 22 nt, Mycobacterium bovis subsp bovis AF2122/97
gccgcggcuggugucgggcguc

SEQ ID NO: 3158436 - RNA, 23 nt, Mycobacterium bovis subsp bovis AF2122/97
gccgcggcuggugucgggcguca

SEQ ID NO: 3158437 - RNA, 20 nt, Mycobacterium bovis subsp bovis AF2122/97
gccgcggcuugucgccccau

SEQ ID NO: 3158438 - RNA, 15 nt, Mycobacterium bovis subsp bovis AF2122/97
gccgcgggacaccac

SEQ ID NO: 3158439 - RNA, 17 nt, Mycobacterium bovis subsp bovis AF2122/97
gccgcgggacaccaccg

SEQ ID NO: 3158440 - RNA, 23 nt, Mycobacterium bovis subsp bovis AF2122/97
gccgcgggacagauggcggccga

SEQ ID NO: 3158441 - RNA, 19 nt, Mycobacterium bovis subsp bovis AF2122/97
gccgcgggcgccgguuacc

SEQ ID NO: 3158442 - RNA, 17 nt, Mycobacterium bovis subsp bovis AF2122/97
gccgcgggcgcggccca

SEQ ID NO: 3158443 - RNA, 16 nt, Mycobacterium bovis subsp bovis AF2122/97
gccgcgggucgcgcga

SEQ ID NO: 3158444 - RNA, 16 nt, Mycobacterium bovis subsp bovis AF2122/97
gccgcgggucgcugcg

SEQ ID NO: 3158445 - RNA, 20 nt, Mycobacterium bovis subsp bovis AF2122/97
gccgcgggugaucugggcgg

SEQ ID NO: 3158446 - RNA, 15 nt, Mycobacterium bovis subsp bovis AF2122/97
gccgcgggugcggca

SEQ ID NO: 3158447 - RNA, 14 nt, Mycobacterium bovis subsp bovis AF2122/97
gccgcggguugggu

SEQ ID NO: 3158448 - RNA, 17 nt, Mycobacterium bovis subsp bovis AF2122/97
gccgcgguagacgccgc

SEQ ID NO: 3158449 - RNA, 19 nt, Mycobacterium bovis subsp bovis AF2122/97
gccgcgguagacgccgccg

SEQ ID NO: 3158450 - RNA, 17 nt, Mycobacterium bovis subsp bovis AF2122/97
gccgcggucaccccggc

SEQ ID NO: 3158451 - RNA, 20 nt, Mycobacterium bovis subsp bovis AF2122/97
gccgcggucagauccagaga

SEQ ID NO: 3158452 - RNA, 17 nt, Mycobacterium bovis subsp bovis AF2122/97
gccgcggucggaccacc

SEQ ID NO: 3158453 - RNA, 14 nt, Mycobacterium bovis subsp bovis AF2122/97
gccgcggucggcca

SEQ ID NO: 3158454 - RNA, 16 nt, Mycobacterium bovis subsp bovis AF2122/97
gccgcggucggccacc

SEQ ID NO: 3158455 - RNA, 18 nt, Mycobacterium bovis subsp bovis AF2122/97
gccgcggucggccaccaa

SEQ ID NO: 3158456 - RNA, 22 nt, Mycobacterium bovis subsp bovis AF2122/97
gccgcggucggccaccaacucg

SEQ ID NO: 3158457 - RNA, 18 nt, Mycobacterium bovis subsp bovis AF2122/97
gccgcucauuagcccccg

SEQ ID NO: 3158458 - RNA, 21 nt, Mycobacterium bovis subsp bovis AF2122/97
gccgcuccaaaagccucagcc

SEQ ID NO: 3158459 - RNA, 22 nt, Mycobacterium bovis subsp bovis AF2122/97
gccgcuccaaaagccucagccg

SEQ ID NO: 3158460 - RNA, 13 nt, Mycobacterium bovis subsp bovis AF2122/97
gccgcuccaccac

SEQ ID NO: 3158461 - RNA, 23 nt, Mycobacterium bovis subsp bovis AF2122/97
gccgcuccacguacgcggcugcg

SEQ ID NO: 3158462 - RNA, 13 nt, Mycobacterium bovis subsp bovis AF2122/97
gccgcuccaugac

SEQ ID NO: 3158463 - RNA, 14 nt, Mycobacterium bovis subsp bovis AF2122/97
gccgcucgacggcc

SEQ ID NO: 3158464 - RNA, 14 nt, Mycobacterium bovis subsp bovis AF2122/97
gccgcucgauggcc

SEQ ID NO: 3158465 - RNA, 16 nt, Mycobacterium bovis subsp bovis AF2122/97
gccgcucggggugguc

SEQ ID NO: 3158466 - RNA, 22 nt, Mycobacterium bovis subsp bovis AF2122/97
gccgcucguuacgccgagcaca

SEQ ID NO: 3158467 - RNA, 22 nt, Mycobacterium bovis subsp bovis AF2122/97
gccgcucuagcgucgugugggu

SEQ ID NO: 3158468 - RNA, 21 nt, Mycobacterium bovis subsp bovis AF2122/97
gccgcugaacucaacgggacc

SEQ ID NO: 3158469 - RNA, 17 nt, Mycobacterium bovis subsp bovis AF2122/97
gccgcugaagccaaaug

SEQ ID NO: 3158470 - RNA, 16 nt, Mycobacterium bovis subsp bovis AF2122/97
gccgcugaauuggcgc

SEQ ID NO: 3158471 - RNA, 18 nt, Mycobacterium bovis subsp bovis AF2122/97
gccgcugaauuggcgccg

SEQ ID NO: 3158472 - RNA, 22 nt, Mycobacterium bovis subsp bovis AF2122/97
gccgcugacgguucggucgggg

SEQ ID NO: 3158473 - RNA, 18 nt, Mycobacterium bovis subsp bovis AF2122/97
gccgcugacuccugcggc

SEQ ID NO: 3158474 - RNA, 19 nt, Mycobacterium bovis subsp bovis AF2122/97
gccgcugacuccugcggca

SEQ ID NO: 3158475 - RNA, 15 nt, Mycobacterium bovis subsp bovis AF2122/97
gccgcugagcccugc

SEQ ID NO: 3158476 - RNA, 11 nt, Mycobacterium bovis subsp bovis AF2122/97
gccgcugauca

SEQ ID NO: 3158477 - RNA, 18 nt, Mycobacterium bovis subsp bovis AF2122/97
gccgcugaucugccgccg

SEQ ID NO: 3158478 - RNA, 18 nt, Mycobacterium bovis subsp bovis AF2122/97
gccgcugcacguggccac

SEQ ID NO: 3158479 - RNA, 22 nt, Mycobacterium bovis subsp bovis AF2122/97
gccgcugcauacaaccccgcgc

SEQ ID NO: 3158480 - RNA, 14 nt, Mycobacterium bovis subsp bovis AF2122/97
gccgcugcauccgc

SEQ ID NO: 3158481 - RNA, 15 nt, Mycobacterium bovis subsp bovis AF2122/97
gccgcugcauccgca

SEQ ID NO: 3158482 - RNA, 18 nt, Mycobacterium bovis subsp bovis AF2122/97
gccgcugcauccgcagca

SEQ ID NO: 3158483 - RNA, 23 nt, Mycobacterium bovis subsp bovis AF2122/97
gccgcugcauccgcagcaccaag

SEQ ID NO: 3158484 - RNA, 13 nt, Mycobacterium bovis subsp bovis AF2122/97
gccgcugccacag

SEQ ID NO: 3158485 - RNA, 12 nt, Mycobacterium bovis subsp bovis AF2122/97
gccgcugccacu

SEQ ID NO: 3158486 - RNA, 20 nt, Mycobacterium bovis subsp bovis AF2122/97
gccgcugccaugcggguguc

SEQ ID NO: 3158487 - RNA, 12 nt, Mycobacterium bovis subsp bovis AF2122/97
gccgcugccgaa

SEQ ID NO: 3158488 - RNA, 21 nt, Mycobacterium bovis subsp bovis AF2122/97
gccgcugccgaagcggccacc

SEQ ID NO: 3158489 - RNA, 20 nt, Mycobacterium bovis subsp bovis AF2122/97
gccgcugccgaucaguccgg

SEQ ID NO: 3158490 - RNA, 21 nt, Mycobacterium bovis subsp bovis AF2122/97
gccgcugccgaucaguccggc

SEQ ID NO: 3158491 - RNA, 20 nt, Mycobacterium bovis subsp bovis AF2122/97
gccgcugccgcccuugccgc

SEQ ID NO: 3158492 - RNA, 13 nt, Mycobacterium bovis subsp bovis AF2122/97
gccgcugccgccg

SEQ ID NO: 3158493 - RNA, 17 nt, Mycobacterium bovis subsp bovis AF2122/97
gccgcugccgccgagcu

SEQ ID NO: 3158494 - RNA, 14 nt, Mycobacterium bovis subsp bovis AF2122/97
gccgcugccgccug

SEQ ID NO: 3158495 - RNA, 17 nt, Mycobacterium bovis subsp bovis AF2122/97
gccgcugccgcgcggcg

SEQ ID NO: 3158496 - RNA, 15 nt, Mycobacterium bovis subsp bovis AF2122/97
gccgcugccgguggc

SEQ ID NO: 3158497 - RNA, 16 nt, Mycobacterium bovis subsp bovis AF2122/97
gccgcugccgguggcg

SEQ ID NO: 3158498 - RNA, 15 nt, Mycobacterium bovis subsp bovis AF2122/97
gccgcugccuggccg

SEQ ID NO: 3158499 - RNA, 13 nt, Mycobacterium bovis subsp bovis AF2122/97
gccgcugccuugg

SEQ ID NO: 3158500 - RNA, 16 nt, Mycobacterium bovis subsp bovis AF2122/97
gccgcugccuuggcgc

SEQ ID NO: 3158501 - RNA, 21 nt, Mycobacterium bovis subsp bovis AF2122/97
gccgcugccuuggcgcggcac

SEQ ID NO: 3158502 - RNA, 18 nt, Mycobacterium bovis subsp bovis AF2122/97
gccgcugcgccgucgcag

SEQ ID NO: 3158503 - RNA, 13 nt, Mycobacterium bovis subsp bovis AF2122/97
gccgcugcggcac

SEQ ID NO: 3158504 - RNA, 14 nt, Mycobacterium bovis subsp bovis AF2122/97
gccgcugcggcacc

SEQ ID NO: 3158505 - RNA, 15 nt, Mycobacterium bovis subsp bovis AF2122/97
gccgcugcggcaccg

SEQ ID NO: 3158506 - RNA, 20 nt, Mycobacterium bovis subsp bovis AF2122/97
gccgcuggagaucacgccga

SEQ ID NO: 3158507 - RNA, 23 nt, Mycobacterium bovis subsp bovis AF2122/97
gccgcuggagaucacgccgacga

SEQ ID NO: 3158508 - RNA, 15 nt, Mycobacterium bovis subsp bovis AF2122/97
gccgcuggaggcggc

SEQ ID NO: 3158509 - RNA, 18 nt, Mycobacterium bovis subsp bovis AF2122/97
gccgcuggaggcggcgcc

SEQ ID NO: 3158510 - RNA, 17 nt, Mycobacterium bovis subsp bovis AF2122/97
gccgcuggcaaucccgc

SEQ ID NO: 3158511 - RNA, 20 nt, Mycobacterium bovis subsp bovis AF2122/97
gccgcuggcaaucccgcggu

SEQ ID NO: 3158512 - RNA, 13 nt, Mycobacterium bovis subsp bovis AF2122/97
gccgcuggccagc

SEQ ID NO: 3158513 - RNA, 15 nt, Mycobacterium bovis subsp bovis AF2122/97
gccgcuggggcgccc

SEQ ID NO: 3158514 - RNA, 17 nt, Mycobacterium bovis subsp bovis AF2122/97
gccgcuggggcgcccga

SEQ ID NO: 3158515 - RNA, 21 nt, Mycobacterium bovis subsp bovis AF2122/97
gccgcuggggcgcccgagacc

SEQ ID NO: 3158516 - RNA, 14 nt, Mycobacterium bovis subsp bovis AF2122/97
gccgcugggugacc

SEQ ID NO: 3158517 - RNA, 18 nt, Mycobacterium bovis subsp bovis AF2122/97
gccgcugggugaccagga

SEQ ID NO: 3158518 - RNA, 17 nt, Mycobacterium bovis subsp bovis AF2122/97
gccgcuggucgucgagu

SEQ ID NO: 3158519 - RNA, 21 nt, Mycobacterium bovis subsp bovis AF2122/97
gccgcugguggcgccaucccc

SEQ ID NO: 3158520 - RNA, 20 nt, Mycobacterium bovis subsp bovis AF2122/97
gccgcugugagcuuggucgc

SEQ ID NO: 3158521 - RNA, 16 nt, Mycobacterium bovis subsp bovis AF2122/97
gccgcugugauagcgc

SEQ ID NO: 3158522 - RNA, 22 nt, Mycobacterium bovis subsp bovis AF2122/97
gccgcugugauagcgccguaca

SEQ ID NO: 3158523 - RNA, 20 nt, Mycobacterium bovis subsp bovis AF2122/97
gccgcugugggcgagucggg

SEQ ID NO: 3158524 - RNA, 16 nt, Mycobacterium bovis subsp bovis AF2122/97
gccgcuguugaucgac

SEQ ID NO: 3158525 - RNA, 18 nt, Mycobacterium bovis subsp bovis AF2122/97
gccgcuguugaucgacac

SEQ ID NO: 3158526 - RNA, 20 nt, Mycobacterium bovis subsp bovis AF2122/97
gccgcuguugaucgacaccg

SEQ ID NO: 3158527 - RNA, 17 nt, Mycobacterium bovis subsp bovis AF2122/97
gccgcuuagcaaucggc

SEQ ID NO: 3158528 - RNA, 15 nt, Mycobacterium bovis subsp bovis AF2122/97
gccgcuucaccccac

SEQ ID NO: 3158529 - RNA, 23 nt, Mycobacterium bovis subsp bovis AF2122/97
gccgcuucaccccacuggcacac

SEQ ID NO: 3158530 - RNA, 17 nt, Mycobacterium bovis subsp bovis AF2122/97
gccgcuucggcggucag

SEQ ID NO: 3158531 - RNA, 15 nt, Mycobacterium bovis subsp bovis AF2122/97
gccgcuugacgcagc

SEQ ID NO: 3158532 - RNA, 16 nt, Mycobacterium bovis subsp bovis AF2122/97
gccgcuugacgcagcu

SEQ ID NO: 3158533 - RNA, 18 nt, Mycobacterium bovis subsp bovis AF2122/97
gccgcuugacgcagcucg

SEQ ID NO: 3158534 - RNA, 15 nt, Mycobacterium bovis subsp bovis AF2122/97
gccgcuugccccgcc

SEQ ID NO: 3158535 - RNA, 17 nt, Mycobacterium bovis subsp bovis AF2122/97
gccgcuugccccgccuu

SEQ ID NO: 3158536 - RNA, 15 nt, Mycobacterium bovis subsp bovis AF2122/97
gccgcuuggcccggc

SEQ ID NO: 3158537 - RNA, 16 nt, Mycobacterium bovis subsp bovis AF2122/97
gccgcuuggcccggca

SEQ ID NO: 3158538 - RNA, 13 nt, Mycobacterium bovis subsp bovis AF2122/97
gccgcuuggccgc

SEQ ID NO: 3158539 - RNA, 21 nt, Mycobacterium bovis subsp bovis AF2122/97
gccgcuuggccgcugccuucu

SEQ ID NO: 3158540 - RNA, 14 nt, Mycobacterium bovis subsp bovis AF2122/97
gccgcuugggccug

SEQ ID NO: 3158541 - RNA, 22 nt, Mycobacterium bovis subsp bovis AF2122/97
gccgcuugggccugggccgcac

SEQ ID NO: 3158542 - RNA, 19 nt, Mycobacterium bovis subsp bovis AF2122/97
gccgcuuucccggcugggg

SEQ ID NO: 3158543 - RNA, 14 nt, Mycobacterium bovis subsp bovis AF2122/97
gccgcuuucgccgg

SEQ ID NO: 3158544 - RNA, 17 nt, Mycobacterium bovis subsp bovis AF2122/97
gccggaugacaccgacc

SEQ ID NO: 3158545 - RNA, 19 nt, Mycobacterium bovis subsp bovis AF2122/97
gccggaugacaccgaccgg

SEQ ID NO: 3158546 - RNA, 14 nt, Mycobacterium bovis subsp bovis AF2122/97
gccggaugacgccc

SEQ ID NO: 3158547 - RNA, 14 nt, Mycobacterium bovis subsp bovis AF2122/97
gccggaugagcgaa

SEQ ID NO: 3158548 - RNA, 20 nt, Mycobacterium bovis subsp bovis AF2122/97
gccggaugagcgaacgccag

SEQ ID NO: 3158549 - RNA, 17 nt, Mycobacterium bovis subsp bovis AF2122/97
gccggaugaugucgguc

SEQ ID NO: 3158550 - RNA, 15 nt, Mycobacterium bovis subsp bovis AF2122/97
gccggaugcgcuucc

SEQ ID NO: 3158551 - RNA, 19 nt, Mycobacterium bovis subsp bovis AF2122/97
gccggauggguggccagca

SEQ ID NO: 3158552 - RNA, 15 nt, Mycobacterium bovis subsp bovis AF2122/97
gccggaugucgacga

SEQ ID NO: 3158553 - RNA, 18 nt, Mycobacterium bovis subsp bovis AF2122/97
gccggaugucgacgagca

SEQ ID NO: 3158554 - RNA, 20 nt, Mycobacterium bovis subsp bovis AF2122/97
gccggaugucgacgagcacc

SEQ ID NO: 3158555 - RNA, 21 nt, Mycobacterium bovis subsp bovis AF2122/97
gccggauuauucgcgguagcc

SEQ ID NO: 3158556 - RNA, 13 nt, Mycobacterium bovis subsp bovis AF2122/97
gccggauucgaug

SEQ ID NO: 3158557 - RNA, 15 nt, Mycobacterium bovis subsp bovis AF2122/97
gccggauucgcccgg

SEQ ID NO: 3158558 - RNA, 23 nt, Mycobacterium bovis subsp bovis AF2122/97
gccggauucgcccgggcguuggg

SEQ ID NO: 3158559 - RNA, 16 nt, Mycobacterium bovis subsp bovis AF2122/97
gccggauucggcugcc

SEQ ID NO: 3158560 - RNA, 19 nt, Mycobacterium bovis subsp bovis AF2122/97
gccggauucggcugccacc

SEQ ID NO: 3158561 - RNA, 20 nt, Mycobacterium bovis subsp bovis AF2122/97
gccggauucggcugccaccg

SEQ ID NO: 3158562 - RNA, 12 nt, Mycobacterium bovis subsp bovis AF2122/97
gccggcaacagc

SEQ ID NO: 3158563 - RNA, 17 nt, Mycobacterium bovis subsp bovis AF2122/97
gccggcaacagcucgcc

SEQ ID NO: 3158564 - RNA, 19 nt, Mycobacterium bovis subsp bovis AF2122/97
gccggcaacauuggccugu

SEQ ID NO: 3158565 - RNA, 16 nt, Mycobacterium bovis subsp bovis AF2122/97
gccggcaaccgacucg

SEQ ID NO: 3158566 - RNA, 16 nt, Mycobacterium bovis subsp bovis AF2122/97
gccggcaaccgggagg

SEQ ID NO: 3158567 - RNA, 19 nt, Mycobacterium bovis subsp bovis AF2122/97
gccggcaaccgggaggcca

SEQ ID NO: 3158568 - RNA, 22 nt, Mycobacterium bovis subsp bovis AF2122/97
gccggcaaccgggaggccaccg

SEQ ID NO: 3158569 - RNA, 13 nt, Mycobacterium bovis subsp bovis AF2122/97
gccggcaaccuga

SEQ ID NO: 3158570 - RNA, 18 nt, Mycobacterium bovis subsp bovis AF2122/97
gccggcaacgcggcucgu

SEQ ID NO: 3158571 - RNA, 15 nt, Mycobacterium bovis subsp bovis AF2122/97
gccggcaacggcgcg

SEQ ID NO: 3158572 - RNA, 23 nt, Mycobacterium bovis subsp bovis AF2122/97
gccggcaacggcgcgccgaccac

SEQ ID NO: 3158573 - RNA, 16 nt, Mycobacterium bovis subsp bovis AF2122/97
gccggcaagaccgaac

SEQ ID NO: 3158574 - RNA, 20 nt, Mycobacterium bovis subsp bovis AF2122/97
gccggcaagaccgaacagcg

SEQ ID NO: 3158575 - RNA, 22 nt, Mycobacterium bovis subsp bovis AF2122/97
gccggcaagaccgaacagcggc

SEQ ID NO: 3158576 - RNA, 13 nt, Mycobacterium bovis subsp bovis AF2122/97
gccggcaagcagu

SEQ ID NO: 3158577 - RNA, 16 nt, Mycobacterium bovis subsp bovis AF2122/97
gccggcaagcagucgg

SEQ ID NO: 3158578 - RNA, 17 nt, Mycobacterium bovis subsp bovis AF2122/97
gccggcaauaccgccag

SEQ ID NO: 3158579 - RNA, 21 nt, Mycobacterium bovis subsp bovis AF2122/97
gccggcaauaccgccagcgcc

SEQ ID NO: 3158580 - RNA, 23 nt, Mycobacterium bovis subsp bovis AF2122/97
gccggcaauaccgccagcgccac

SEQ ID NO: 3158581 - RNA, 15 nt, Mycobacterium bovis subsp bovis AF2122/97
gccggcaaugccgcg

SEQ ID NO: 3158582 - RNA, 18 nt, Mycobacterium bovis subsp bovis AF2122/97
gccggcaaugccgcggcc

SEQ ID NO: 3158583 - RNA, 20 nt, Mycobacterium bovis subsp bovis AF2122/97
gccggcaaugccgcggccag

SEQ ID NO: 3158584 - RNA, 18 nt, Mycobacterium bovis subsp bovis AF2122/97
gccggcacauugaucgac

SEQ ID NO: 3158585 - RNA, 13 nt, Mycobacterium bovis subsp bovis AF2122/97
gccggcaccaacc

SEQ ID NO: 3158586 - RNA, 18 nt, Mycobacterium bovis subsp bovis AF2122/97
gccggcaccaaccaccga

SEQ ID NO: 3158587 - RNA, 19 nt, Mycobacterium bovis subsp bovis AF2122/97
gccggcacccaccagugca

SEQ ID NO: 3158588 - RNA, 17 nt, Mycobacterium bovis subsp bovis AF2122/97
gccggcaccccacggcc

SEQ ID NO: 3158589 - RNA, 17 nt, Mycobacterium bovis subsp bovis AF2122/97
gccggcacccgccgugc

SEQ ID NO: 3158590 - RNA, 16 nt, Mycobacterium bovis subsp bovis AF2122/97
gccggcacccgucggg

SEQ ID NO: 3158591 - RNA, 20 nt, Mycobacterium bovis subsp bovis AF2122/97
gccggcacccgucgggugcu

SEQ ID NO: 3158592 - RNA, 13 nt, Mycobacterium bovis subsp bovis AF2122/97
gccggcaccgaca

SEQ ID NO: 3158593 - RNA, 17 nt, Mycobacterium bovis subsp bovis AF2122/97
gccggcaccgacgguag

SEQ ID NO: 3158594 - RNA, 14 nt, Mycobacterium bovis subsp bovis AF2122/97
gccggcaccgcagc

SEQ ID NO: 3158595 - RNA, 16 nt, Mycobacterium bovis subsp bovis AF2122/97
gccggcaccgcagcgg

SEQ ID NO: 3158596 - RNA, 14 nt, Mycobacterium bovis subsp bovis AF2122/97
gccggcaccgccag

SEQ ID NO: 3158597 - RNA, 21 nt, Mycobacterium bovis subsp bovis AF2122/97
gccggcaccgccagugcccgc

SEQ ID NO: 3158598 - RNA, 15 nt, Mycobacterium bovis subsp bovis AF2122/97
gccggcaccgccgcc

SEQ ID NO: 3158599 - RNA, 16 nt, Mycobacterium bovis subsp bovis AF2122/97
gccggcaccgccgccc

SEQ ID NO: 3158600 - RNA, 17 nt, Mycobacterium bovis subsp bovis AF2122/97
gccggcaccgccgcccc

SEQ ID NO: 3158601 - RNA, 20 nt, Mycobacterium bovis subsp bovis AF2122/97
gccggcaccgccgcccccgc

SEQ ID NO: 3158602 - RNA, 14 nt, Mycobacterium bovis subsp bovis AF2122/97
gccggcaccgccgg

SEQ ID NO: 3158603 - RNA, 15 nt, Mycobacterium bovis subsp bovis AF2122/97
gccggcaccgccggc

SEQ ID NO: 3158604 - RNA, 16 nt, Mycobacterium bovis subsp bovis AF2122/97
gccggcaccgccggcg

SEQ ID NO: 3158605 - RNA, 20 nt, Mycobacterium bovis subsp bovis AF2122/97
gccggcaccgccggcgccac

SEQ ID NO: 3158606 - RNA, 20 nt, Mycobacterium bovis subsp bovis AF2122/97
gccggcaccgccggcgccca

SEQ ID NO: 3158607 - RNA, 18 nt, Mycobacterium bovis subsp bovis AF2122/97
gccggcaccgccgguggc

SEQ ID NO: 3158608 - RNA, 20 nt, Mycobacterium bovis subsp bovis AF2122/97
gccggcaccgccgguggcgc

SEQ ID NO: 3158609 - RNA, 14 nt, Mycobacterium bovis subsp bovis AF2122/97
gccggcaccggaug

SEQ ID NO: 3158610 - RNA, 12 nt, Mycobacterium bovis subsp bovis AF2122/97
gccggcaccggg

SEQ ID NO: 3158611 - RNA, 14 nt, Mycobacterium bovis subsp bovis AF2122/97
gccggcaccggggc

SEQ ID NO: 3158612 - RNA, 12 nt, Mycobacterium bovis subsp bovis AF2122/97
gccggcaccgua

SEQ ID NO: 3158613 - RNA, 14 nt, Mycobacterium bovis subsp bovis AF2122/97
gccggcaccguaga

SEQ ID NO: 3158614 - RNA, 17 nt, Mycobacterium bovis subsp bovis AF2122/97
gccggcacgcaugccgg

SEQ ID NO: 3158615 - RNA, 17 nt, Mycobacterium bovis subsp bovis AF2122/97
gccggcacgccgaccgg

SEQ ID NO: 3158616 - RNA, 20 nt, Mycobacterium bovis subsp bovis AF2122/97
gccggcacgccgaccggugg

SEQ ID NO: 3158617 - RNA, 21 nt, Mycobacterium bovis subsp bovis AF2122/97
gccggcacgccgaccgguggc

SEQ ID NO: 3158618 - RNA, 15 nt, Mycobacterium bovis subsp bovis AF2122/97
gccggcacgcgcgcu

SEQ ID NO: 3158619 - RNA, 20 nt, Mycobacterium bovis subsp bovis AF2122/97
gccggcacgggcggggacgg

SEQ ID NO: 3158620 - RNA, 15 nt, Mycobacterium bovis subsp bovis AF2122/97
gccggcacggugaac

SEQ ID NO: 3158621 - RNA, 12 nt, Mycobacterium bovis subsp bovis AF2122/97
gccggcagcagc

SEQ ID NO: 3158622 - RNA, 13 nt, Mycobacterium bovis subsp bovis AF2122/97
gccggcagcagcg

SEQ ID NO: 3158623 - RNA, 16 nt, Mycobacterium bovis subsp bovis AF2122/97
gccggcagcagcgggc

SEQ ID NO: 3158624 - RNA, 18 nt, Mycobacterium bovis subsp bovis AF2122/97
gccggcagcaucggcacc

SEQ ID NO: 3158625 - RNA, 19 nt, Mycobacterium bovis subsp bovis AF2122/97
gccggcagcaucggcaccc

SEQ ID NO: 3158626 - RNA, 21 nt, Mycobacterium bovis subsp bovis AF2122/97
gccggcagcaucggcaccccg

SEQ ID NO: 3158627 - RNA, 15 nt, Mycobacterium bovis subsp bovis AF2122/97
gccggcagcgccccc

SEQ ID NO: 3158628 - RNA, 13 nt, Mycobacterium bovis subsp bovis AF2122/97
gccggcagcggcg

SEQ ID NO: 3158629 - RNA, 15 nt, Mycobacterium bovis subsp bovis AF2122/97
gccggcagcggcgag

SEQ ID NO: 3158630 - RNA, 18 nt, Mycobacterium bovis subsp bovis AF2122/97
gccggcagcggcgcgcug

SEQ ID NO: 3158631 - RNA, 13 nt, Mycobacterium bovis subsp bovis AF2122/97
gccggccgccgcg

SEQ ID NO: 3158632 - RNA, 14 nt, Mycobacterium bovis subsp bovis AF2122/97
gccggccgccgcgg

SEQ ID NO: 3158633 - RNA, 14 nt, Mycobacterium bovis subsp bovis AF2122/97
gccggccgcgaccg

SEQ ID NO: 3158634 - RNA, 14 nt, Mycobacterium bovis subsp bovis AF2122/97
gccggccgcgccgg

SEQ ID NO: 3158635 - RNA, 15 nt, Mycobacterium bovis subsp bovis AF2122/97
gccggccgcgccggc

SEQ ID NO: 3158636 - RNA, 15 nt, Mycobacterium bovis subsp bovis AF2122/97
gccggccgcgcuggu

SEQ ID NO: 3158637 - RNA, 14 nt, Mycobacterium bovis subsp bovis AF2122/97
gccggccgcggcgg

SEQ ID NO: 3158638 - RNA, 15 nt, Mycobacterium bovis subsp bovis AF2122/97
gccggccgcggcggc

SEQ ID NO: 3158639 - RNA, 16 nt, Mycobacterium bovis subsp bovis AF2122/97
gccggccgcggcggcc

SEQ ID NO: 3158640 - RNA, 12 nt, Mycobacterium bovis subsp bovis AF2122/97
gccggccgcggg

SEQ ID NO: 3158641 - RNA, 13 nt, Mycobacterium bovis subsp bovis AF2122/97
gccggccgcgggc

SEQ ID NO: 3158642 - RNA, 14 nt, Mycobacterium bovis subsp bovis AF2122/97
gccggccgcggggc

SEQ ID NO: 3158643 - RNA, 13 nt, Mycobacterium bovis subsp bovis AF2122/97
gccggccgcugcc

SEQ ID NO: 3158644 - RNA, 16 nt, Mycobacterium bovis subsp bovis AF2122/97
gccggccgcugccacu

SEQ ID NO: 3158645 - RNA, 14 nt, Mycobacterium bovis subsp bovis AF2122/97
gccggccgcuuggc

SEQ ID NO: 3158646 - RNA, 21 nt, Mycobacterium bovis subsp bovis AF2122/97
gccggccggcaaugccgcggc

SEQ ID NO: 3158647 - RNA, 14 nt, Mycobacterium bovis subsp bovis AF2122/97
gccggccggcccgg

SEQ ID NO: 3158648 - RNA, 15 nt, Mycobacterium bovis subsp bovis AF2122/97
gccggccggcccggg

SEQ ID NO: 3158649 - RNA, 12 nt, Mycobacterium bovis subsp bovis AF2122/97
gccggccggcgc

SEQ ID NO: 3158650 - RNA, 14 nt, Mycobacterium bovis subsp bovis AF2122/97
gccggccggcgcgg

SEQ ID NO: 3158651 - RNA, 15 nt, Mycobacterium bovis subsp bovis AF2122/97
gccggccggcgcggu

SEQ ID NO: 3158652 - RNA, 12 nt, Mycobacterium bovis subsp bovis AF2122/97
gccggccggugg

SEQ ID NO: 3158653 - RNA, 14 nt, Mycobacterium bovis subsp bovis AF2122/97
gccggccgguggcc

SEQ ID NO: 3158654 - RNA, 19 nt, Mycobacterium bovis subsp bovis AF2122/97
gccggccgucagcacaaac

SEQ ID NO: 3158655 - RNA, 12 nt, Mycobacterium bovis subsp bovis AF2122/97
gccggccgucga

SEQ ID NO: 3158656 - RNA, 14 nt, Mycobacterium bovis subsp bovis AF2122/97
gccggccgucgauc

SEQ ID NO: 3158657 - RNA, 13 nt, Mycobacterium bovis subsp bovis AF2122/97
gccggccgucggc

SEQ ID NO: 3158658 - RNA, 16 nt, Mycobacterium bovis subsp bovis AF2122/97
gccggccgucggccgg

SEQ ID NO: 3158659 - RNA, 17 nt, Mycobacterium bovis subsp bovis AF2122/97
gccggccguucgugggc

SEQ ID NO: 3158660 - RNA, 18 nt, Mycobacterium bovis subsp bovis AF2122/97
gccggccuagccgauggc

SEQ ID NO: 3158661 - RNA, 17 nt, Mycobacterium bovis subsp bovis AF2122/97
gccggccuccucgacga

SEQ ID NO: 3158662 - RNA, 17 nt, Mycobacterium bovis subsp bovis AF2122/97
gccggccucgccgaagc

SEQ ID NO: 3158663 - RNA, 21 nt, Mycobacterium bovis subsp bovis AF2122/97
gccggccucgccgaagcgggc

SEQ ID NO: 3158664 - RNA, 22 nt, Mycobacterium bovis subsp bovis AF2122/97
gccggccucgccgaagcgggcc

SEQ ID NO: 3158665 - RNA, 18 nt, Mycobacterium bovis subsp bovis AF2122/97
gccggccucuggaucacg

SEQ ID NO: 3158666 - RNA, 22 nt, Mycobacterium bovis subsp bovis AF2122/97
gccggccucuggaucacgucga

SEQ ID NO: 3158667 - RNA, 17 nt, Mycobacterium bovis subsp bovis AF2122/97
gccggccugcucggcga

SEQ ID NO: 3158668 - RNA, 21 nt, Mycobacterium bovis subsp bovis AF2122/97
gccggccugucccgcacccgg

SEQ ID NO: 3158669 - RNA, 18 nt, Mycobacterium bovis subsp bovis AF2122/97
gccggccuugagcacccg

SEQ ID NO: 3158670 - RNA, 20 nt, Mycobacterium bovis subsp bovis AF2122/97
gccggccuugugcucgaugc

SEQ ID NO: 3158671 - RNA, 18 nt, Mycobacterium bovis subsp bovis AF2122/97
gccggcgaaccccagcgc

SEQ ID NO: 3158672 - RNA, 19 nt, Mycobacterium bovis subsp bovis AF2122/97
gccggcgaacucgcgccga

SEQ ID NO: 3158673 - RNA, 16 nt, Mycobacterium bovis subsp bovis AF2122/97
gccggcgaacugaucg

SEQ ID NO: 3158674 - RNA, 20 nt, Mycobacterium bovis subsp bovis AF2122/97
gccggcgaagaccgccggga

SEQ ID NO: 3158675 - RNA, 20 nt, Mycobacterium bovis subsp bovis AF2122/97
gccggcgaagcgugcgccga

SEQ ID NO: 3158676 - RNA, 16 nt, Mycobacterium bovis subsp bovis AF2122/97
gccggcgaaggccagc

SEQ ID NO: 3158677 - RNA, 21 nt, Mycobacterium bovis subsp bovis AF2122/97
gccggcgaauccgcacagguc

SEQ ID NO: 3158678 - RNA, 13 nt, Mycobacterium bovis subsp bovis AF2122/97
gccggcgacaaca

SEQ ID NO: 3158679 - RNA, 19 nt, Mycobacterium bovis subsp bovis AF2122/97
gccggcgacaccgcaggug

SEQ ID NO: 3158680 - RNA, 22 nt, Mycobacterium bovis subsp bovis AF2122/97
gccggcgacaccgcaggugccg

SEQ ID NO: 3158681 - RNA, 15 nt, Mycobacterium bovis subsp bovis AF2122/97
gccggcgaccaaggc

SEQ ID NO: 3158682 - RNA, 16 nt, Mycobacterium bovis subsp bovis AF2122/97
gccggcgaccaggauu

SEQ ID NO: 3158683 - RNA, 17 nt, Mycobacterium bovis subsp bovis AF2122/97
gccggcgaccgggaucg

SEQ ID NO: 3158684 - RNA, 17 nt, Mycobacterium bovis subsp bovis AF2122/97
gccggcgacgcuaccgc

SEQ ID NO: 3158685 - RNA, 17 nt, Mycobacterium bovis subsp bovis AF2122/97
gccggcgacggcgucac

SEQ ID NO: 3158686 - RNA, 15 nt, Mycobacterium bovis subsp bovis AF2122/97
gccggcgacgggucg

SEQ ID NO: 3158687 - RNA, 20 nt, Mycobacterium bovis subsp bovis AF2122/97
gccggcgacgggucgggcaa

SEQ ID NO: 3158688 - RNA, 21 nt, Mycobacterium bovis subsp bovis AF2122/97
gccggcgacgggucgggcaac

SEQ ID NO: 3158689 - RNA, 17 nt, Mycobacterium bovis subsp bovis AF2122/97
gccggcgagaaacacga

SEQ ID NO: 3158690 - RNA, 17 nt, Mycobacterium bovis subsp bovis AF2122/97
gccggcgagcagacgca

SEQ ID NO: 3158691 - RNA, 19 nt, Mycobacterium bovis subsp bovis AF2122/97
gccggcgagcagacgcaaa

SEQ ID NO: 3158692 - RNA, 14 nt, Mycobacterium bovis subsp bovis AF2122/97
gccggcgagggcca

SEQ ID NO: 3158693 - RNA, 15 nt, Mycobacterium bovis subsp bovis AF2122/97
gccggcgagggccac

SEQ ID NO: 3158694 - RNA, 17 nt, Mycobacterium bovis subsp bovis AF2122/97
gccggcgagggcgcgga

SEQ ID NO: 3158695 - RNA, 16 nt, Mycobacterium bovis subsp bovis AF2122/97
gccggcgagggugagc

SEQ ID NO: 3158696 - RNA, 22 nt, Mycobacterium bovis subsp bovis AF2122/97
gccggcgagggugagcauggcu

SEQ ID NO: 3158697 - RNA, 18 nt, Mycobacterium bovis subsp bovis AF2122/97
gccggcgagugguccagc

SEQ ID NO: 3158698 - RNA, 13 nt, Mycobacterium bovis subsp bovis AF2122/97
gccggcgauggcc

SEQ ID NO: 3158699 - RNA, 20 nt, Mycobacterium bovis subsp bovis AF2122/97
gccggcgauggcccuuccgg

SEQ ID NO: 3158700 - RNA, 19 nt, Mycobacterium bovis subsp bovis AF2122/97
gccggcgauuaccggcacg

SEQ ID NO: 3158701 - RNA, 20 nt, Mycobacterium bovis subsp bovis AF2122/97
gccggcgauuaccggcacgc

SEQ ID NO: 3158702 - RNA, 23 nt, Mycobacterium bovis subsp bovis AF2122/97
gccggcgauuaccggcacgccgg

SEQ ID NO: 3158703 - RNA, 13 nt, Mycobacterium bovis subsp bovis AF2122/97
gccggcgccaagu

SEQ ID NO: 3158704 - RNA, 16 nt, Mycobacterium bovis subsp bovis AF2122/97
gccggcgccaccccca

SEQ ID NO: 3158705 - RNA, 15 nt, Mycobacterium bovis subsp bovis AF2122/97
gccggcgccacccgc

SEQ ID NO: 3158706 - RNA, 13 nt, Mycobacterium bovis subsp bovis AF2122/97
gccggcgccaccg

SEQ ID NO: 3158707 - RNA, 15 nt, Mycobacterium bovis subsp bovis AF2122/97
gccggcgccaccguc

SEQ ID NO: 3158708 - RNA, 18 nt, Mycobacterium bovis subsp bovis AF2122/97
gccggcgccaccgucacc

SEQ ID NO: 3158709 - RNA, 20 nt, Mycobacterium bovis subsp bovis AF2122/97
gccggcgccaccgucgccgu

SEQ ID NO: 3158710 - RNA, 19 nt, Mycobacterium bovis subsp bovis AF2122/97
gccggcgccagcagaucuc

SEQ ID NO: 3158711 - RNA, 18 nt, Mycobacterium bovis subsp bovis AF2122/97
gccggcgcccaggccgau

SEQ ID NO: 3158712 - RNA, 22 nt, Mycobacterium bovis subsp bovis AF2122/97
gccggcgcccaggccgaucagc

SEQ ID NO: 3158713 - RNA, 12 nt, Mycobacterium bovis subsp bovis AF2122/97
gccggcgcccgc

SEQ ID NO: 3158714 - RNA, 17 nt, Mycobacterium bovis subsp bovis AF2122/97
gccggcgcccgccgcga

SEQ ID NO: 3158715 - RNA, 22 nt, Mycobacterium bovis subsp bovis AF2122/97
gccggcgcccgccgcgaacucc

SEQ ID NO: 3158716 - RNA, 15 nt, Mycobacterium bovis subsp bovis AF2122/97
gccggcgcccggggc

SEQ ID NO: 3158717 - RNA, 16 nt, Mycobacterium bovis subsp bovis AF2122/97
gccggcgcccggggcg

SEQ ID NO: 3158718 - RNA, 12 nt, Mycobacterium bovis subsp bovis AF2122/97
gccggcgguggc

SEQ ID NO: 3158719 - RNA, 19 nt, Mycobacterium bovis subsp bovis AF2122/97
gccggcgguggggccggcg

SEQ ID NO: 3158720 - RNA, 20 nt, Mycobacterium bovis subsp bovis AF2122/97
gccggcgguguuagcgcgaa

SEQ ID NO: 3158721 - RNA, 15 nt, Mycobacterium bovis subsp bovis AF2122/97
gccggcguagaucau

SEQ ID NO: 3158722 - RNA, 19 nt, Mycobacterium bovis subsp bovis AF2122/97
gccggcguagaucaucagc

SEQ ID NO: 3158723 - RNA, 22 nt, Mycobacterium bovis subsp bovis AF2122/97
gccggcguagaucaucagcgac

SEQ ID NO: 3158724 - RNA, 19 nt, Mycobacterium bovis subsp bovis AF2122/97
gccggcguagcggcgauac

SEQ ID NO: 3158725 - RNA, 24 nt, Mycobacterium bovis subsp bovis AF2122/97
gccggcgucagccccgacugcgcc

SEQ ID NO: 3158726 - RNA, 15 nt, Mycobacterium bovis subsp bovis AF2122/97
gccggcgucgagccg

SEQ ID NO: 3158727 - RNA, 14 nt, Mycobacterium bovis subsp bovis AF2122/97
gccggcgucgauga

SEQ ID NO: 3158728 - RNA, 15 nt, Mycobacterium bovis subsp bovis AF2122/97
gccggcgucgcuggc

SEQ ID NO: 3158729 - RNA, 13 nt, Mycobacterium bovis subsp bovis AF2122/97
gccggcgucggcg

SEQ ID NO: 3158730 - RNA, 16 nt, Mycobacterium bovis subsp bovis AF2122/97
gccggcgucggcgccc

SEQ ID NO: 3158731 - RNA, 17 nt, Mycobacterium bovis subsp bovis AF2122/97
gccggcgucggucgucg

SEQ ID NO: 3158732 - RNA, 19 nt, Mycobacterium bovis subsp bovis AF2122/97
gccggcgugcacucccuua

SEQ ID NO: 3158733 - RNA, 15 nt, Mycobacterium bovis subsp bovis AF2122/97
gccggcgugccagca

SEQ ID NO: 3158734 - RNA, 14 nt, Mycobacterium bovis subsp bovis AF2122/97
gccggcgugcgcga

SEQ ID NO: 3158735 - RNA, 16 nt, Mycobacterium bovis subsp bovis AF2122/97
gccggcgugcgcgaga

SEQ ID NO: 3158736 - RNA, 13 nt, Mycobacterium bovis subsp bovis AF2122/97
gccggcgugcggc

SEQ ID NO: 3158737 - RNA, 14 nt, Mycobacterium bovis subsp bovis AF2122/97
gccggcgugcggcg

SEQ ID NO: 3158738 - RNA, 15 nt, Mycobacterium bovis subsp bovis AF2122/97
gccggcgugcggcga

SEQ ID NO: 3158739 - RNA, 16 nt, Mycobacterium bovis subsp bovis AF2122/97
gccggcgugcggcgag

SEQ ID NO: 3158740 - RNA, 20 nt, Mycobacterium bovis subsp bovis AF2122/97
gccggcgugucgcgucgugc

SEQ ID NO: 3158741 - RNA, 23 nt, Mycobacterium bovis subsp bovis AF2122/97
gccggcguuagcguagcccgagu

SEQ ID NO: 3158742 - RNA, 15 nt, Mycobacterium bovis subsp bovis AF2122/97
gccggcguugccgaa

SEQ ID NO: 3158743 - RNA, 21 nt, Mycobacterium bovis subsp bovis AF2122/97
gccggcguugccgaaacccga

SEQ ID NO: 3158744 - RNA, 16 nt, Mycobacterium bovis subsp bovis AF2122/97
gccggcguugccgccg

SEQ ID NO: 3158745 - RNA, 18 nt, Mycobacterium bovis subsp bovis AF2122/97
gccggcguugccgccguc

SEQ ID NO: 3158746 - RNA, 12 nt, Mycobacterium bovis subsp bovis AF2122/97
gccggcguuggc

SEQ ID NO: 3158747 - RNA, 20 nt, Mycobacterium bovis subsp bovis AF2122/97
gccggcguuggccauggcca

SEQ ID NO: 3158748 - RNA, 22 nt, Mycobacterium bovis subsp bovis AF2122/97
gccggcuaccgccuugucggcg

SEQ ID NO: 3158749 - RNA, 15 nt, Mycobacterium bovis subsp bovis AF2122/97
gccggcuaccgcgcu

SEQ ID NO: 3158750 - RNA, 21 nt, Mycobacterium bovis subsp bovis AF2122/97
gccggcuaccgcgcucccggc

SEQ ID NO: 3158751 - RNA, 16 nt, Mycobacterium bovis subsp bovis AF2122/97
gccggcuagggcagca

SEQ ID NO: 3158752 - RNA, 15 nt, Mycobacterium bovis subsp bovis AF2122/97
gccggcuagggcccu

SEQ ID NO: 3158753 - RNA, 22 nt, Mycobacterium bovis subsp bovis AF2122/97
gccggcuagggcccuggcggcc

SEQ ID NO: 3158754 - RNA, 23 nt, Mycobacterium bovis subsp bovis AF2122/97
gccggcuagggcccuggcggccc

SEQ ID NO: 3158755 - RNA, 16 nt, Mycobacterium bovis subsp bovis AF2122/97
gccggcucaacaccga

SEQ ID NO: 3158756 - RNA, 14 nt, Mycobacterium bovis subsp bovis AF2122/97
gccggcuccacccu

SEQ ID NO: 3158757 - RNA, 15 nt, Mycobacterium bovis subsp bovis AF2122/97
gccggcuccacccuu

SEQ ID NO: 3158758 - RNA, 16 nt, Mycobacterium bovis subsp bovis AF2122/97
gccggcuccgccacug

SEQ ID NO: 3158759 - RNA, 19 nt, Mycobacterium bovis subsp bovis AF2122/97
gccggcuccgccacuggcg

SEQ ID NO: 3158760 - RNA, 13 nt, Mycobacterium bovis subsp bovis AF2122/97
gccggcuccgccg

SEQ ID NO: 3158761 - RNA, 14 nt, Mycobacterium bovis subsp bovis AF2122/97
gccggcuccgccgu

SEQ ID NO: 3158762 - RNA, 22 nt, Mycobacterium bovis subsp bovis AF2122/97
gccggcuccggauugcuguacu

SEQ ID NO: 3158763 - RNA, 16 nt, Mycobacterium bovis subsp bovis AF2122/97
gccggcuccggcggug

SEQ ID NO: 3158764 - RNA, 16 nt, Mycobacterium bovis subsp bovis AF2122/97
gccggcucggcgguac

SEQ ID NO: 3158765 - RNA, 15 nt, Mycobacterium bovis subsp bovis AF2122/97
gccggcucgucgauc

SEQ ID NO: 3158766 - RNA, 14 nt, Mycobacterium bovis subsp bovis AF2122/97
gccggcugacaacg

SEQ ID NO: 3158767 - RNA, 17 nt, Mycobacterium bovis subsp bovis AF2122/97
gccggcugacgaccaac

SEQ ID NO: 3158768 - RNA, 14 nt, Mycobacterium bovis subsp bovis AF2122/97
gccggcugccgcac

SEQ ID NO: 3158769 - RNA, 15 nt, Mycobacterium bovis subsp bovis AF2122/97
gccggcugcggaggc

SEQ ID NO: 3158770 - RNA, 15 nt, Mycobacterium bovis subsp bovis AF2122/97
gccggcuggcggccu

SEQ ID NO: 3158771 - RNA, 15 nt, Mycobacterium bovis subsp bovis AF2122/97
gccggcuucgcccag

SEQ ID NO: 3158772 - RNA, 14 nt, Mycobacterium bovis subsp bovis AF2122/97
gccggcuucggcga

SEQ ID NO: 3158773 - RNA, 16 nt, Mycobacterium bovis subsp bovis AF2122/97
gccggcuucggcgagc

SEQ ID NO: 3158774 - RNA, 17 nt, Mycobacterium bovis subsp bovis AF2122/97
gccggcuucggcgagcg

SEQ ID NO: 3158775 - RNA, 16 nt, Mycobacterium bovis subsp bovis AF2122/97
gccggcuucggugagc

SEQ ID NO: 3158776 - RNA, 23 nt, Mycobacterium bovis subsp bovis AF2122/97
gccggcuugcagugaggucaucg

SEQ ID NO: 3158777 - RNA, 22 nt, Mycobacterium bovis subsp bovis AF2122/97
gccggcuuggccuuugccgucg

SEQ ID NO: 3158778 - RNA, 17 nt, Mycobacterium bovis subsp bovis AF2122/97
gccggcuugggcgguag

SEQ ID NO: 3158779 - RNA, 15 nt, Mycobacterium bovis subsp bovis AF2122/97
gccggcuugucgacc

SEQ ID NO: 3158780 - RNA, 18 nt, Mycobacterium bovis subsp bovis AF2122/97
gccggcuugucgaccacg

SEQ ID NO: 3158781 - RNA, 19 nt, Mycobacterium bovis subsp bovis AF2122/97
gccggcuugucgaccacga

SEQ ID NO: 3158782 - RNA, 16 nt, Mycobacterium bovis subsp bovis AF2122/97
gccggcuuugagccgc

SEQ ID NO: 3158783 - RNA, 19 nt, Mycobacterium bovis subsp bovis AF2122/97
gccggcuuugagccgcucg

SEQ ID NO: 3158784 - RNA, 16 nt, Mycobacterium bovis subsp bovis AF2122/97
gccgggaaacaccggc

SEQ ID NO: 3158785 - RNA, 17 nt, Mycobacterium bovis subsp bovis AF2122/97
gccgggaacaucccagc

SEQ ID NO: 3158786 - RNA, 16 nt, Mycobacterium bovis subsp bovis AF2122/97
gccgggaacgcugacg

SEQ ID NO: 3158787 - RNA, 19 nt, Mycobacterium bovis subsp bovis AF2122/97
gccgggaacgcugacgccc

SEQ ID NO: 3158788 - RNA, 12 nt, Mycobacterium bovis subsp bovis AF2122/97
gccgggaagccg

SEQ ID NO: 3158789 - RNA, 19 nt, Mycobacterium bovis subsp bovis AF2122/97
gccgggaauuucgacacga

SEQ ID NO: 3158790 - RNA, 20 nt, Mycobacterium bovis subsp bovis AF2122/97
gccgggaccgccccggccag

SEQ ID NO: 3158791 - RNA, 15 nt, Mycobacterium bovis subsp bovis AF2122/97
gccgggaccggugug

SEQ ID NO: 3158792 - RNA, 17 nt, Mycobacterium bovis subsp bovis AF2122/97
gccgggagacgcugcgc

SEQ ID NO: 3158793 - RNA, 16 nt, Mycobacterium bovis subsp bovis AF2122/97
gccgggagucgucggc

SEQ ID NO: 3158794 - RNA, 16 nt, Mycobacterium bovis subsp bovis AF2122/97
gccgggauaacccagc

SEQ ID NO: 3158795 - RNA, 18 nt, Mycobacterium bovis subsp bovis AF2122/97
gccgggauaacccagcac

SEQ ID NO: 3158796 - RNA, 22 nt, Mycobacterium bovis subsp bovis AF2122/97
gccgggauaacccagcaccaca

SEQ ID NO: 3158797 - RNA, 16 nt, Mycobacterium bovis subsp bovis AF2122/97
gccgggauaucgucga

SEQ ID NO: 3158798 - RNA, 14 nt, Mycobacterium bovis subsp bovis AF2122/97
gccgggaucgccgu

SEQ ID NO: 3158799 - RNA, 18 nt, Mycobacterium bovis subsp bovis AF2122/97
gccgggaucgccguccag

SEQ ID NO: 3158800 - RNA, 19 nt, Mycobacterium bovis subsp bovis AF2122/97
gccgggaucgccguccagc

SEQ ID NO: 3158801 - RNA, 20 nt, Mycobacterium bovis subsp bovis AF2122/97
gccgggaucgccguccagca

SEQ ID NO: 3158802 - RNA, 18 nt, Mycobacterium bovis subsp bovis AF2122/97
gccgggaugaagccaccc

SEQ ID NO: 3158803 - RNA, 14 nt, Mycobacterium bovis subsp bovis AF2122/97
gccgggaugccgcc

SEQ ID NO: 3158804 - RNA, 15 nt, Mycobacterium bovis subsp bovis AF2122/97
gccgggaugccgccg

SEQ ID NO: 3158805 - RNA, 22 nt, Mycobacterium bovis subsp bovis AF2122/97
gccgggguaggggucgaggucu

SEQ ID NO: 3158806 - RNA, 15 nt, Mycobacterium bovis subsp bovis AF2122/97
gccggggugccggcg

SEQ ID NO: 3158807 - RNA, 16 nt, Mycobacterium bovis subsp bovis AF2122/97
gccggggugccggcga

SEQ ID NO: 3158808 - RNA, 15 nt, Mycobacterium bovis subsp bovis AF2122/97
gccgggguggcgcgc

SEQ ID NO: 3158809 - RNA, 16 nt, Mycobacterium bovis subsp bovis AF2122/97
gccgggguggcgcgcc

SEQ ID NO: 3158810 - RNA, 19 nt, Mycobacterium bovis subsp bovis AF2122/97
gccgggguggcgcgccaac

SEQ ID NO: 3158811 - RNA, 15 nt, Mycobacterium bovis subsp bovis AF2122/97
gccggggugugcggg

SEQ ID NO: 3158812 - RNA, 23 nt, Mycobacterium bovis subsp bovis AF2122/97
gccgggucaccgauucggccagc

SEQ ID NO: 3158813 - RNA, 16 nt, Mycobacterium bovis subsp bovis AF2122/97
gccgggucacgugggc

SEQ ID NO: 3158814 - RNA, 17 nt, Mycobacterium bovis subsp bovis AF2122/97
gccgggucacgugggcc

SEQ ID NO: 3158815 - RNA, 19 nt, Mycobacterium bovis subsp bovis AF2122/97
gccgggucacgugggccau

SEQ ID NO: 3158816 - RNA, 22 nt, Mycobacterium bovis subsp bovis AF2122/97
gccgggucagcccggcgcgauc

SEQ ID NO: 3158817 - RNA, 14 nt, Mycobacterium bovis subsp bovis AF2122/97
gccggguccgccgg

SEQ ID NO: 3158818 - RNA, 16 nt, Mycobacterium bovis subsp bovis AF2122/97
gccggguccgccgggc

SEQ ID NO: 3158819 - RNA, 22 nt, Mycobacterium bovis subsp bovis AF2122/97
gccggguccggaaccgguaucg

SEQ ID NO: 3158820 - RNA, 18 nt, Mycobacterium bovis subsp bovis AF2122/97
gccgggucgaucaccgac

SEQ ID NO: 3158821 - RNA, 22 nt, Mycobacterium bovis subsp bovis AF2122/97
gccgggucgaucaccgacaccg

SEQ ID NO: 3158822 - RNA, 14 nt, Mycobacterium bovis subsp bovis AF2122/97
gccgggucgcgcug

SEQ ID NO: 3158823 - RNA, 22 nt, Mycobacterium bovis subsp bovis AF2122/97
gccgggucgcgcuggcgccggc

SEQ ID NO: 3158824 - RNA, 19 nt, Mycobacterium bovis subsp bovis AF2122/97
gccgggucguacaacacgg

SEQ ID NO: 3158825 - RNA, 22 nt, Mycobacterium bovis subsp bovis AF2122/97
gccgggucguacaacacgggca

SEQ ID NO: 3158826 - RNA, 16 nt, Mycobacterium bovis subsp bovis AF2122/97
gccgggucuguuggug

SEQ ID NO: 3158827 - RNA, 20 nt, Mycobacterium bovis subsp bovis AF2122/97
gccgggugaguucggcguag

SEQ ID NO: 3158828 - RNA, 22 nt, Mycobacterium bovis subsp bovis AF2122/97
gccgggugcaacggcguuggcg

SEQ ID NO: 3158829 - RNA, 14 nt, Mycobacterium bovis subsp bovis AF2122/97
gccgggugcaggcg

SEQ ID NO: 3158830 - RNA, 21 nt, Mycobacterium bovis subsp bovis AF2122/97
gccgggugccacaacccgcuu

SEQ ID NO: 3158831 - RNA, 15 nt, Mycobacterium bovis subsp bovis AF2122/97
gccgggugccgccac

SEQ ID NO: 3158832 - RNA, 14 nt, Mycobacterium bovis subsp bovis AF2122/97
gccgggugcgagcg

SEQ ID NO: 3158833 - RNA, 19 nt, Mycobacterium bovis subsp bovis AF2122/97
gccgggugcgagcgacacc

SEQ ID NO: 3158834 - RNA, 14 nt, Mycobacterium bovis subsp bovis AF2122/97
gccgggugcgcacc

SEQ ID NO: 3158835 - RNA, 16 nt, Mycobacterium bovis subsp bovis AF2122/97
gccgggugcgugcgcg

SEQ ID NO: 3158836 - RNA, 22 nt, Mycobacterium bovis subsp bovis AF2122/97
gccgggugcgugcgcgucggug

SEQ ID NO: 3158837 - RNA, 13 nt, Mycobacterium bovis subsp bovis AF2122/97
gccggguggccac

SEQ ID NO: 3158838 - RNA, 19 nt, Mycobacterium bovis subsp bovis AF2122/97
gccggguggccacgcccag

SEQ ID NO: 3158839 - RNA, 21 nt, Mycobacterium bovis subsp bovis AF2122/97
gccggguggccacgcccaggc

SEQ ID NO: 3158840 - RNA, 19 nt, Mycobacterium bovis subsp bovis AF2122/97
gccggguggcccggcgaaa

SEQ ID NO: 3158841 - RNA, 16 nt, Mycobacterium bovis subsp bovis AF2122/97
gccgggugggagcagc

SEQ ID NO: 3158842 - RNA, 19 nt, Mycobacterium bovis subsp bovis AF2122/97
gccgggugggagcagccga

SEQ ID NO: 3158843 - RNA, 22 nt, Mycobacterium bovis subsp bovis AF2122/97
gccggguguggcuugacgcccg

SEQ ID NO: 3158844 - RNA, 13 nt, Mycobacterium bovis subsp bovis AF2122/97
gccggguguuggg

SEQ ID NO: 3158845 - RNA, 16 nt, Mycobacterium bovis subsp bovis AF2122/97
gccggguuaucggcag

SEQ ID NO: 3158846 - RNA, 20 nt, Mycobacterium bovis subsp bovis AF2122/97
gccggguuccagcggcaccg

SEQ ID NO: 3158847 - RNA, 22 nt, Mycobacterium bovis subsp bovis AF2122/97
gccggguuccagcggcaccgcg

SEQ ID NO: 3158848 - RNA, 12 nt, Mycobacterium bovis subsp bovis AF2122/97
gccggguucgcg

SEQ ID NO: 3158849 - RNA, 14 nt, Mycobacterium bovis subsp bovis AF2122/97
gccggguuggccgg

SEQ ID NO: 3158850 - RNA, 17 nt, Mycobacterium bovis subsp bovis AF2122/97
gccggguuggccggcgc

SEQ ID NO: 3158851 - RNA, 17 nt, Mycobacterium bovis subsp bovis AF2122/97
gccggguuggcgccggc

SEQ ID NO: 3158852 - RNA, 16 nt, Mycobacterium bovis subsp bovis AF2122/97
gccggguuggucuucg

SEQ ID NO: 3158853 - RNA, 19 nt, Mycobacterium bovis subsp bovis AF2122/97
gccggguuggucuucgauc

SEQ ID NO: 3158854 - RNA, 17 nt, Mycobacterium bovis subsp bovis AF2122/97
gccggguuuauccaguc

SEQ ID NO: 3158855 - RNA, 18 nt, Mycobacterium bovis subsp bovis AF2122/97
gccgguaaccgcgucgac

SEQ ID NO: 3158856 - RNA, 22 nt, Mycobacterium bovis subsp bovis AF2122/97
gccgguaaccgcgucgaccgga

SEQ ID NO: 3158857 - RNA, 23 nt, Mycobacterium bovis subsp bovis AF2122/97
gccgguacacguccaguggcagc

SEQ ID NO: 3158858 - RNA, 14 nt, Mycobacterium bovis subsp bovis AF2122/97
gccgguaccggcga

SEQ ID NO: 3158859 - RNA, 17 nt, Mycobacterium bovis subsp bovis AF2122/97
gccgguaccgggacgaa

SEQ ID NO: 3158860 - RNA, 22 nt, Mycobacterium bovis subsp bovis AF2122/97
gccgguaccgggacgaaucccg

SEQ ID NO: 3158861 - RNA, 23 nt, Mycobacterium bovis subsp bovis AF2122/97
gccgguaccgggacgaaucccgc

SEQ ID NO: 3158862 - RNA, 20 nt, Mycobacterium bovis subsp bovis AF2122/97
gccgguagaucuucggccgc

SEQ ID NO: 3158863 - RNA, 22 nt, Mycobacterium bovis subsp bovis AF2122/97
gccgguagaucuucggccgcac

SEQ ID NO: 3158864 - RNA, 15 nt, Mycobacterium bovis subsp bovis AF2122/97
gccgguagcacagca

SEQ ID NO: 3158865 - RNA, 18 nt, Mycobacterium bovis subsp bovis AF2122/97
gccgguagcacagcagca

SEQ ID NO: 3158866 - RNA, 16 nt, Mycobacterium bovis subsp bovis AF2122/97
gccgguagcgcgggug

SEQ ID NO: 3158867 - RNA, 20 nt, Mycobacterium bovis subsp bovis AF2122/97
gccgguagcugucgccuuug

SEQ ID NO: 3158868 - RNA, 14 nt, Mycobacterium bovis subsp bovis AF2122/97
gccgguaggcggcc

SEQ ID NO: 3158869 - RNA, 16 nt, Mycobacterium bovis subsp bovis AF2122/97
gccgguaggcggccag

SEQ ID NO: 3158870 - RNA, 18 nt, Mycobacterium bovis subsp bovis AF2122/97
gccgguaggcggccagcg

SEQ ID NO: 3158871 - RNA, 22 nt, Mycobacterium bovis subsp bovis AF2122/97
gccgguaguagcugaccaucgu

SEQ ID NO: 3158872 - RNA, 18 nt, Mycobacterium bovis subsp bovis AF2122/97
gccgguauacccggcccc

SEQ ID NO: 3158873 - RNA, 15 nt, Mycobacterium bovis subsp bovis AF2122/97
gccgguaugccgaac

SEQ ID NO: 3158874 - RNA, 19 nt, Mycobacterium bovis subsp bovis AF2122/97
gccgguaugcgccaucucg

SEQ ID NO: 3158875 - RNA, 21 nt, Mycobacterium bovis subsp bovis AF2122/97
gccgguaugcgccaucucgac

SEQ ID NO: 3158876 - RNA, 23 nt, Mycobacterium bovis subsp bovis AF2122/97
gccgguaugcgccaucucgacgg

SEQ ID NO: 3158877 - RNA, 17 nt, Mycobacterium bovis subsp bovis AF2122/97
gccgguauuucggcgac

SEQ ID NO: 3158878 - RNA, 21 nt, Mycobacterium bovis subsp bovis AF2122/97
gccggucaacccucgccacgc

SEQ ID NO: 3158879 - RNA, 15 nt, Mycobacterium bovis subsp bovis AF2122/97
gccggucaccucgcc

SEQ ID NO: 3158880 - RNA, 18 nt, Mycobacterium bovis subsp bovis AF2122/97
gccggucaccucgccggc

SEQ ID NO: 3158881 - RNA, 19 nt, Mycobacterium bovis subsp bovis AF2122/97
gccggucaccucgccggcg

SEQ ID NO: 3158882 - RNA, 21 nt, Mycobacterium bovis subsp bovis AF2122/97
gccggucaccucgccggcggg

SEQ ID NO: 3158883 - RNA, 15 nt, Mycobacterium bovis subsp bovis AF2122/97
gccggucacgacguc

SEQ ID NO: 3158884 - RNA, 15 nt, Mycobacterium bovis subsp bovis AF2122/97
gccggucacguccgc

SEQ ID NO: 3158885 - RNA, 17 nt, Mycobacterium bovis subsp bovis AF2122/97
gccggucacguccgcgg

SEQ ID NO: 3158886 - RNA, 19 nt, Mycobacterium bovis subsp bovis AF2122/97
gccggucagcaauacggcg

SEQ ID NO: 3158887 - RNA, 19 nt, Mycobacterium bovis subsp bovis AF2122/97
gccggucaggcaguccacc

SEQ ID NO: 3158888 - RNA, 22 nt, Mycobacterium bovis subsp bovis AF2122/97
gccggucaggcaguccaccgcg

SEQ ID NO: 3158889 - RNA, 14 nt, Mycobacterium bovis subsp bovis AF2122/97
gccggucaggccgc

SEQ ID NO: 3158890 - RNA, 16 nt, Mycobacterium bovis subsp bovis AF2122/97
gccggucaggccgccg

SEQ ID NO: 3158891 - RNA, 13 nt, Mycobacterium bovis subsp bovis AF2122/97
gccggugcuccuc

SEQ ID NO: 3158892 - RNA, 21 nt, Mycobacterium bovis subsp bovis AF2122/97
gccggugcugacgacgagggc

SEQ ID NO: 3158893 - RNA, 23 nt, Mycobacterium bovis subsp bovis AF2122/97
gccggugcugacgacgagggcca

SEQ ID NO: 3158894 - RNA, 13 nt, Mycobacterium bovis subsp bovis AF2122/97
gccggugcugcgg

SEQ ID NO: 3158895 - RNA, 20 nt, Mycobacterium bovis subsp bovis AF2122/97
gccgguggaaaagccacggc

SEQ ID NO: 3158896 - RNA, 13 nt, Mycobacterium bovis subsp bovis AF2122/97
gccgguggcaccc

SEQ ID NO: 3158897 - RNA, 15 nt, Mycobacterium bovis subsp bovis AF2122/97
gccgguggcacggcc

SEQ ID NO: 3158898 - RNA, 13 nt, Mycobacterium bovis subsp bovis AF2122/97
gccgguggcccgc

SEQ ID NO: 3158899 - RNA, 22 nt, Mycobacterium bovis subsp bovis AF2122/97
gccgguggcccgccggcaguga

SEQ ID NO: 3158900 - RNA, 13 nt, Mycobacterium bovis subsp bovis AF2122/97
gccgguggcggcg

SEQ ID NO: 3158901 - RNA, 16 nt, Mycobacterium bovis subsp bovis AF2122/97
gccgguggcggcggcg

SEQ ID NO: 3158902 - RNA, 23 nt, Mycobacterium bovis subsp bovis AF2122/97
gccggugggcgguccgcgucugg

SEQ ID NO: 3158903 - RNA, 17 nt, Mycobacterium bovis subsp bovis AF2122/97
gccgguggguagccagc

SEQ ID NO: 3158904 - RNA, 14 nt, Mycobacterium bovis subsp bovis AF2122/97
gccggugguaacgg

SEQ ID NO: 3158905 - RNA, 18 nt, Mycobacterium bovis subsp bovis AF2122/97
gccggugguaacggcggc

SEQ ID NO: 3158906 - RNA, 16 nt, Mycobacterium bovis subsp bovis AF2122/97
gccggugguaccggcg

SEQ ID NO: 3158907 - RNA, 17 nt, Mycobacterium bovis subsp bovis AF2122/97
gccggugguaccggcgg

SEQ ID NO: 3158908 - RNA, 19 nt, Mycobacterium bovis subsp bovis AF2122/97
gccggugguaccggcggcg

SEQ ID NO: 3158909 - RNA, 18 nt, Mycobacterium bovis subsp bovis AF2122/97
gccgguggucgcgcccau

SEQ ID NO: 3158910 - RNA, 16 nt, Mycobacterium bovis subsp bovis AF2122/97
gccgguggugacggcg

SEQ ID NO: 3158911 - RNA, 20 nt, Mycobacterium bovis subsp bovis AF2122/97
gccgguggugacggcgguac

SEQ ID NO: 3158912 - RNA, 21 nt, Mycobacterium bovis subsp bovis AF2122/97
gccgguggugacggcgguacc

SEQ ID NO: 3158913 - RNA, 17 nt, Mycobacterium bovis subsp bovis AF2122/97
gccgguggugccggcgc

SEQ ID NO: 3158914 - RNA, 19 nt, Mycobacterium bovis subsp bovis AF2122/97
gccgguggugccggcgccg

SEQ ID NO: 3158915 - RNA, 22 nt, Mycobacterium bovis subsp bovis AF2122/97
gccgguggugccggcgccgcca

SEQ ID NO: 3158916 - RNA, 17 nt, Mycobacterium bovis subsp bovis AF2122/97
gccgguguaacccucga

SEQ ID NO: 3158917 - RNA, 17 nt, Mycobacterium bovis subsp bovis AF2122/97
gccgguguccuuggccg

SEQ ID NO: 3158918 - RNA, 20 nt, Mycobacterium bovis subsp bovis AF2122/97
gccgguguccuuggccgcca

SEQ ID NO: 3158919 - RNA, 19 nt, Mycobacterium bovis subsp bovis AF2122/97
gccggugucgacggggaac

SEQ ID NO: 3158920 - RNA, 21 nt, Mycobacterium bovis subsp bovis AF2122/97
gccggugucucccuugccgcc

SEQ ID NO: 3158921 - RNA, 19 nt, Mycobacterium bovis subsp bovis AF2122/97
gccggugugcaggaucacg

SEQ ID NO: 3158922 - RNA, 19 nt, Mycobacterium bovis subsp bovis AF2122/97
gccggugugcccgccugga

SEQ ID NO: 3158923 - RNA, 16 nt, Mycobacterium bovis subsp bovis AF2122/97
gccggugugcgcaccc

SEQ ID NO: 3158924 - RNA, 21 nt, Mycobacterium bovis subsp bovis AF2122/97
gccgguguguccagcggaucg

SEQ ID NO: 3158925 - RNA, 22 nt, Mycobacterium bovis subsp bovis AF2122/97
gccgguguugccgaagcccgag

SEQ ID NO: 3158926 - RNA, 16 nt, Mycobacterium bovis subsp bovis AF2122/97
gccgguguugccgccg

SEQ ID NO: 3158927 - RNA, 23 nt, Mycobacterium bovis subsp bovis AF2122/97
gccgguguugccguuaccgccaa

SEQ ID NO: 3158928 - RNA, 21 nt, Mycobacterium bovis subsp bovis AF2122/97
gccgguguuuccgaaacccgc

SEQ ID NO: 3158929 - RNA, 22 nt, Mycobacterium bovis subsp bovis AF2122/97
gccgguguuuccgaaacccgcc

SEQ ID NO: 3158930 - RNA, 21 nt, Mycobacterium bovis subsp bovis AF2122/97
gccgguuacccggaccgucgu

SEQ ID NO: 3158931 - RNA, 17 nt, Mycobacterium bovis subsp bovis AF2122/97
gccgguucccuuguucc

SEQ ID NO: 3158932 - RNA, 23 nt, Mycobacterium bovis subsp bovis AF2122/97
gccgguucccuuguucccgaaac

SEQ ID NO: 3158933 - RNA, 16 nt, Mycobacterium bovis subsp bovis AF2122/97
gccgguuccgccggcc

SEQ ID NO: 3158934 - RNA, 18 nt, Mycobacterium bovis subsp bovis AF2122/97
gccgguuccgccggcccc

SEQ ID NO: 3158935 - RNA, 20 nt, Mycobacterium bovis subsp bovis AF2122/97
gccgguuccgccggccccac

SEQ ID NO: 3158936 - RNA, 16 nt, Mycobacterium bovis subsp bovis AF2122/97
gccgguucgcccgagg

SEQ ID NO: 3158937 - RNA, 12 nt, Mycobacterium bovis subsp bovis AF2122/97
gccgguucggcg

SEQ ID NO: 3158938 - RNA, 22 nt, Mycobacterium bovis subsp bovis AF2122/97
gccgguucggcgaucuccggcg

SEQ ID NO: 3158939 - RNA, 14 nt, Mycobacterium bovis subsp bovis AF2122/97
gccgguugcggcug

SEQ ID NO: 3158940 - RNA, 19 nt, Mycobacterium bovis subsp bovis AF2122/97
gccgguugcggcugcguug

SEQ ID NO: 3158941 - RNA, 21 nt, Mycobacterium bovis subsp bovis AF2122/97
gccgguugcggcugcguuggc

SEQ ID NO: 3158942 - RNA, 17 nt, Mycobacterium bovis subsp bovis AF2122/97
gccgguuggccagccac

SEQ ID NO: 3158943 - RNA, 14 nt, Mycobacterium bovis subsp bovis AF2122/97
gccgguuggccagu

SEQ ID NO: 3158944 - RNA, 19 nt, Mycobacterium bovis subsp bovis AF2122/97
gccgguuggccagugacuc

SEQ ID NO: 3158945 - RNA, 16 nt, Mycobacterium bovis subsp bovis AF2122/97
gccgguuggcugccgg

SEQ ID NO: 3158946 - RNA, 18 nt, Mycobacterium bovis subsp bovis AF2122/97
gccgguuugggggcuucu

SEQ ID NO: 3158947 - RNA, 23 nt, Mycobacterium bovis subsp bovis AF2122/97
gccgguuugucgugucaugcuca

SEQ ID NO: 3158948 - RNA, 14 nt, Mycobacterium bovis subsp bovis AF2122/97
gccguaaagccaac

SEQ ID NO: 3158949 - RNA, 21 nt, Mycobacterium bovis subsp bovis AF2122/97
gccguaaagccaacuggucgc

SEQ ID NO: 3158950 - RNA, 19 nt, Mycobacterium bovis subsp bovis AF2122/97
gccguaacggucgcugucg

SEQ ID NO: 3158951 - RNA, 15 nt, Mycobacterium bovis subsp bovis AF2122/97
gccguaagcaccagc

SEQ ID NO: 3158952 - RNA, 21 nt, Mycobacterium bovis subsp bovis AF2122/97
gccguacagcgcaaagcccuc

SEQ ID NO: 3158953 - RNA, 13 nt, Mycobacterium bovis subsp bovis AF2122/97
gccguacagcggc

SEQ ID NO: 3158954 - RNA, 18 nt, Mycobacterium bovis subsp bovis AF2122/97
gccguacagcggcggcgu

SEQ ID NO: 3158955 - RNA, 18 nt, Mycobacterium bovis subsp bovis AF2122/97
gccguacaucagcgcgaa

SEQ ID NO: 3158956 - RNA, 13 nt, Mycobacterium bovis subsp bovis AF2122/97
gccguacgcccag

SEQ ID NO: 3158957 - RNA, 15 nt, Mycobacterium bovis subsp bovis AF2122/97
gccguacgcccaggc

SEQ ID NO: 3158958 - RNA, 22 nt, Mycobacterium bovis subsp bovis AF2122/97
gccguacgguccgaacacggug

SEQ ID NO: 3158959 - RNA, 16 nt, Mycobacterium bovis subsp bovis AF2122/97
gccguacguucaccac

SEQ ID NO: 3158960 - RNA, 22 nt, Mycobacterium bovis subsp bovis AF2122/97
gccguacguucaccaccgcaca

SEQ ID NO: 3158961 - RNA, 14 nt, Mycobacterium bovis subsp bovis AF2122/97
gccguacucgucgu

SEQ ID NO: 3158962 - RNA, 23 nt, Mycobacterium bovis subsp bovis AF2122/97
gccguagaccagccgucguccgc

SEQ ID NO: 3158963 - RNA, 15 nt, Mycobacterium bovis subsp bovis AF2122/97
gccguagaccaggcc

SEQ ID NO: 3158964 - RNA, 22 nt, Mycobacterium bovis subsp bovis AF2122/97
gccguagagcuggugcgggacg

SEQ ID NO: 3158965 - RNA, 14 nt, Mycobacterium bovis subsp bovis AF2122/97
gccguagaucccga

SEQ ID NO: 3158966 - RNA, 17 nt, Mycobacterium bovis subsp bovis AF2122/97
gccguagcccacgacga

SEQ ID NO: 3158967 - RNA, 22 nt, Mycobacterium bovis subsp bovis AF2122/97
gccguagccgaucaacagggcc

SEQ ID NO: 3158968 - RNA, 13 nt, Mycobacterium bovis subsp bovis AF2122/97
gccguagccgccg

SEQ ID NO: 3158969 - RNA, 22 nt, Mycobacterium bovis subsp bovis AF2122/97
gccguagccgccguggauacgc

SEQ ID NO: 3158970 - RNA, 15 nt, Mycobacterium bovis subsp bovis AF2122/97
gccguagcgcagcgc

SEQ ID NO: 3158971 - RNA, 16 nt, Mycobacterium bovis subsp bovis AF2122/97
gccguagcgcagcgcc

SEQ ID NO: 3158972 - RNA, 14 nt, Mycobacterium bovis subsp bovis AF2122/97
gccguagcggucga

SEQ ID NO: 3158973 - RNA, 14 nt, Mycobacterium bovis subsp bovis AF2122/97
gccguaggcggcga

SEQ ID NO: 3158974 - RNA, 19 nt, Mycobacterium bovis subsp bovis AF2122/97
gccguagguugcgccccga

SEQ ID NO: 3158975 - RNA, 17 nt, Mycobacterium bovis subsp bovis AF2122/97
gccguaguaaggagccg

SEQ ID NO: 3158976 - RNA, 19 nt, Mycobacterium bovis subsp bovis AF2122/97
gccguaguaguggccgcca

SEQ ID NO: 3158977 - RNA, 18 nt, Mycobacterium bovis subsp bovis AF2122/97
gccguccggcuuggcggc

SEQ ID NO: 3158978 - RNA, 20 nt, Mycobacterium bovis subsp bovis AF2122/97
gccguccggcuuggcggcga

SEQ ID NO: 3158979 - RNA, 15 nt, Mycobacterium bovis subsp bovis AF2122/97
gccguccgggcggcc

SEQ ID NO: 3158980 - RNA, 23 nt, Mycobacterium bovis subsp bovis AF2122/97
gccguccggguagacauggguga

SEQ ID NO: 3158981 - RNA, 13 nt, Mycobacterium bovis subsp bovis AF2122/97
gccguccggugug

SEQ ID NO: 3158982 - RNA, 17 nt, Mycobacterium bovis subsp bovis AF2122/97
gccguccucccacaggu

SEQ ID NO: 3158983 - RNA, 16 nt, Mycobacterium bovis subsp bovis AF2122/97
gccguccucggucagc

SEQ ID NO: 3158984 - RNA, 22 nt, Mycobacterium bovis subsp bovis AF2122/97
gccgucgaaagagaaggcggcg

SEQ ID NO: 3158985 - RNA, 20 nt, Mycobacterium bovis subsp bovis AF2122/97
gccgucgaagcggaccagcg

SEQ ID NO: 3158986 - RNA, 20 nt, Mycobacterium bovis subsp bovis AF2122/97
gccgucgacaacaaacccgg

SEQ ID NO: 3158987 - RNA, 13 nt, Mycobacterium bovis subsp bovis AF2122/97
gccgucgaccacg

SEQ ID NO: 3158988 - RNA, 13 nt, Mycobacterium bovis subsp bovis AF2122/97
gccgucgaccggc

SEQ ID NO: 3158989 - RNA, 15 nt, Mycobacterium bovis subsp bovis AF2122/97
gccgucgaccggcgg

SEQ ID NO: 3158990 - RNA, 16 nt, Mycobacterium bovis subsp bovis AF2122/97
gccgucgacgaucagc

SEQ ID NO: 3158991 - RNA, 17 nt, Mycobacterium bovis subsp bovis AF2122/97
gccgucgacgcggccgg

SEQ ID NO: 3158992 - RNA, 18 nt, Mycobacterium bovis subsp bovis AF2122/97
gccgucgacgcggccggc

SEQ ID NO: 3158993 - RNA, 17 nt, Mycobacterium bovis subsp bovis AF2122/97
gccgucgacgcgguccu

SEQ ID NO: 3158994 - RNA, 15 nt, Mycobacterium bovis subsp bovis AF2122/97
gccgucgacgucgau

SEQ ID NO: 3158995 - RNA, 23 nt, Mycobacterium bovis subsp bovis AF2122/97
gccgucgacgucgauggugcggc

SEQ ID NO: 3158996 - RNA, 22 nt, Mycobacterium bovis subsp bovis AF2122/97
gccgucgacguugaugaccugu

SEQ ID NO: 3158997 - RNA, 14 nt, Mycobacterium bovis subsp bovis AF2122/97
gccgucgagcacgg

SEQ ID NO: 3158998 - RNA, 15 nt, Mycobacterium bovis subsp bovis AF2122/97
gccgucgagcacggu

SEQ ID NO: 3158999 - RNA, 18 nt, Mycobacterium bovis subsp bovis AF2122/97
gccgucgagcacggugag

SEQ ID NO: 3159000 - RNA, 15 nt, Mycobacterium bovis subsp bovis AF2122/97
gccgucgagcagccg

SEQ ID NO: 3159001 - RNA, 16 nt, Mycobacterium bovis subsp bovis AF2122/97
gccgucgagcagccga

SEQ ID NO: 3159002 - RNA, 19 nt, Mycobacterium bovis subsp bovis AF2122/97
gccgucgagcagccgagcu

SEQ ID NO: 3159003 - RNA, 21 nt, Mycobacterium bovis subsp bovis AF2122/97
gccgucgagcagccgagcuca

SEQ ID NO: 3159004 - RNA, 16 nt, Mycobacterium bovis subsp bovis AF2122/97
gccgucgagcauccac

SEQ ID NO: 3159005 - RNA, 22 nt, Mycobacterium bovis subsp bovis AF2122/97
gccgucgagcucccacaggacc

SEQ ID NO: 3159006 - RNA, 18 nt, Mycobacterium bovis subsp bovis AF2122/97
gccgucgaguccaggccg

SEQ ID NO: 3159007 - RNA, 17 nt, Mycobacterium bovis subsp bovis AF2122/97
gccgucgaugaccagca

SEQ ID NO: 3159008 - RNA, 22 nt, Mycobacterium bovis subsp bovis AF2122/97
gccgucgaugaucugcuugcca

SEQ ID NO: 3159009 - RNA, 21 nt, Mycobacterium bovis subsp bovis AF2122/97
gccgucgauguggcgcuccgg

SEQ ID NO: 3159010 - RNA, 14 nt, Mycobacterium bovis subsp bovis AF2122/97
gccgucgcaccaga

SEQ ID NO: 3159011 - RNA, 12 nt, Mycobacterium bovis subsp bovis AF2122/97
gccgucgcagcc

SEQ ID NO: 3159012 - RNA, 14 nt, Mycobacterium bovis subsp bovis AF2122/97
gccgucgcaucagg

SEQ ID NO: 3159013 - RNA, 11 nt, Mycobacterium bovis subsp bovis AF2122/97
gccgucgccac

SEQ ID NO: 3159014 - RNA, 12 nt, Mycobacterium bovis subsp bovis AF2122/97
gccgucgccacc

SEQ ID NO: 3159015 - RNA, 16 nt, Mycobacterium bovis subsp bovis AF2122/97
gccgucgccaccaucg

SEQ ID NO: 3159016 - RNA, 16 nt, Mycobacterium bovis subsp bovis AF2122/97
gccgucgccaccggua

SEQ ID NO: 3159017 - RNA, 21 nt, Mycobacterium bovis subsp bovis AF2122/97
gccgucgccaccgguaccgau

SEQ ID NO: 3159018 - RNA, 19 nt, Mycobacterium bovis subsp bovis AF2122/97
gccgucgccacgcccagcg

SEQ ID NO: 3159019 - RNA, 14 nt, Mycobacterium bovis subsp bovis AF2122/97
gccgucgcccagcg

SEQ ID NO: 3159020 - RNA, 19 nt, Mycobacterium bovis subsp bovis AF2122/97
gccgucgcccagcgugaac

SEQ ID NO: 3159021 - RNA, 20 nt, Mycobacterium bovis subsp bovis AF2122/97
gccgucgcccagcgugaacu

SEQ ID NO: 3159022 - RNA, 12 nt, Mycobacterium bovis subsp bovis AF2122/97
gccgucgccgau

SEQ ID NO: 3159023 - RNA, 21 nt, Mycobacterium bovis subsp bovis AF2122/97
gccgucgccgaucagcugcgc

SEQ ID NO: 3159024 - RNA, 23 nt, Mycobacterium bovis subsp bovis AF2122/97
gccgucgccgcccuggccgccgg

SEQ ID NO: 3159025 - RNA, 13 nt, Mycobacterium bovis subsp bovis AF2122/97
gccgucgccgccg

SEQ ID NO: 3159026 - RNA, 14 nt, Mycobacterium bovis subsp bovis AF2122/97
gccgucgccgccgc

SEQ ID NO: 3159027 - RNA, 15 nt, Mycobacterium bovis subsp bovis AF2122/97
gccgucgccgccggc

SEQ ID NO: 3159028 - RNA, 16 nt, Mycobacterium bovis subsp bovis AF2122/97
gccgucgccgccggcg

SEQ ID NO: 3159029 - RNA, 17 nt, Mycobacterium bovis subsp bovis AF2122/97
gccgucgccgccggcgc

SEQ ID NO: 3159030 - RNA, 18 nt, Mycobacterium bovis subsp bovis AF2122/97
gccgucgccgccggcgcc

SEQ ID NO: 3159031 - RNA, 14 nt, Mycobacterium bovis subsp bovis AF2122/97
gccgucgccgccgu

SEQ ID NO: 3159032 - RNA, 16 nt, Mycobacterium bovis subsp bovis AF2122/97
gccgucgccgccguua

SEQ ID NO: 3159033 - RNA, 17 nt, Mycobacterium bovis subsp bovis AF2122/97
gccgucgccggagucga

SEQ ID NO: 3159034 - RNA, 14 nt, Mycobacterium bovis subsp bovis AF2122/97
gccgucgccggugc

SEQ ID NO: 3159035 - RNA, 14 nt, Mycobacterium bovis subsp bovis AF2122/97
gccgucgccgucca

SEQ ID NO: 3159036 - RNA, 17 nt, Mycobacterium bovis subsp bovis AF2122/97
gccgucgccguuggguu

SEQ ID NO: 3159037 - RNA, 13 nt, Mycobacterium bovis subsp bovis AF2122/97
gccgucgccucca

SEQ ID NO: 3159038 - RNA, 16 nt, Mycobacterium bovis subsp bovis AF2122/97
gccgucgccugcaagc

SEQ ID NO: 3159039 - RNA, 14 nt, Mycobacterium bovis subsp bovis AF2122/97
gccgucgcggcacg

SEQ ID NO: 3159040 - RNA, 23 nt, Mycobacterium bovis subsp bovis AF2122/97
gccgucgcggcacgcccacagcu

SEQ ID NO: 3159041 - RNA, 15 nt, Mycobacterium bovis subsp bovis AF2122/97
gccgucgcggucaac

SEQ ID NO: 3159042 - RNA, 22 nt, Mycobacterium bovis subsp bovis AF2122/97
gccgucgcuagggugagcccgg

SEQ ID NO: 3159043 - RNA, 15 nt, Mycobacterium bovis subsp bovis AF2122/97
gccgucgcugguggc

SEQ ID NO: 3159044 - RNA, 19 nt, Mycobacterium bovis subsp bovis AF2122/97
gccgucggagaccagcucg

SEQ ID NO: 3159045 - RNA, 23 nt, Mycobacterium bovis subsp bovis AF2122/97
gccgucggagaccagcucguugc

SEQ ID NO: 3159046 - RNA, 14 nt, Mycobacterium bovis subsp bovis AF2122/97
gccgucggagccgg

SEQ ID NO: 3159047 - RNA, 18 nt, Mycobacterium bovis subsp bovis AF2122/97
gccgucggagccggccac

SEQ ID NO: 3159048 - RNA, 21 nt, Mycobacterium bovis subsp bovis AF2122/97
gccgucggcaauacuccgcug

SEQ ID NO: 3159049 - RNA, 16 nt, Mycobacterium bovis subsp bovis AF2122/97
gccgucggccgagucg

SEQ ID NO: 3159050 - RNA, 12 nt, Mycobacterium bovis subsp bovis AF2122/97
gccgucggccgg

SEQ ID NO: 3159051 - RNA, 22 nt, Mycobacterium bovis subsp bovis AF2122/97
gccgucggccggaugagcgaac

SEQ ID NO: 3159052 - RNA, 13 nt, Mycobacterium bovis subsp bovis AF2122/97
gccgucggccggc

SEQ ID NO: 3159053 - RNA, 14 nt, Mycobacterium bovis subsp bovis AF2122/97
gccgucggccggca

SEQ ID NO: 3159054 - RNA, 15 nt, Mycobacterium bovis subsp bovis AF2122/97
gccgucggccucggc

SEQ ID NO: 3159055 - RNA, 17 nt, Mycobacterium bovis subsp bovis AF2122/97
gccgucggccucggcgg

SEQ ID NO: 3159056 - RNA, 19 nt, Mycobacterium bovis subsp bovis AF2122/97
gccgucggccucggcgguc

SEQ ID NO: 3159057 - RNA, 20 nt, Mycobacterium bovis subsp bovis AF2122/97
gccgucggccucggcggucg

SEQ ID NO: 3159058 - RNA, 12 nt, Mycobacterium bovis subsp bovis AF2122/97
gccgucggcgac

SEQ ID NO: 3159059 - RNA, 14 nt, Mycobacterium bovis subsp bovis AF2122/97
gccgucggcgagca

SEQ ID NO: 3159060 - RNA, 18 nt, Mycobacterium bovis subsp bovis AF2122/97
gccgucggcgagcagacg

SEQ ID NO: 3159061 - RNA, 13 nt, Mycobacterium bovis subsp bovis AF2122/97
gccgucggcgaug

SEQ ID NO: 3159062 - RNA, 16 nt, Mycobacterium bovis subsp bovis AF2122/97
gccgucggcgaugaag

SEQ ID NO: 3159063 - RNA, 14 nt, Mycobacterium bovis subsp bovis AF2122/97
gccgucggcgccgg

SEQ ID NO: 3159064 - RNA, 20 nt, Mycobacterium bovis subsp bovis AF2122/97
gccgugcccggugcggugca

SEQ ID NO: 3159065 - RNA, 17 nt, Mycobacterium bovis subsp bovis AF2122/97
gccgugccgaaguggag

SEQ ID NO: 3159066 - RNA, 15 nt, Mycobacterium bovis subsp bovis AF2122/97
gccgugccgccagca

SEQ ID NO: 3159067 - RNA, 13 nt, Mycobacterium bovis subsp bovis AF2122/97
gccgugccgccga

SEQ ID NO: 3159068 - RNA, 23 nt, Mycobacterium bovis subsp bovis AF2122/97
gccgugccgccgacaccaccggc

SEQ ID NO: 3159069 - RNA, 16 nt, Mycobacterium bovis subsp bovis AF2122/97
gccgugccgcggcgac

SEQ ID NO: 3159070 - RNA, 13 nt, Mycobacterium bovis subsp bovis AF2122/97
gccgugccgggcc

SEQ ID NO: 3159071 - RNA, 14 nt, Mycobacterium bovis subsp bovis AF2122/97
gccgugccggugug

SEQ ID NO: 3159072 - RNA, 15 nt, Mycobacterium bovis subsp bovis AF2122/97
gccgugccgugguga

SEQ ID NO: 3159073 - RNA, 20 nt, Mycobacterium bovis subsp bovis AF2122/97
gccgugcgaucaccuccgcg

SEQ ID NO: 3159074 - RNA, 17 nt, Mycobacterium bovis subsp bovis AF2122/97
gccgugcgaucgucaac

SEQ ID NO: 3159075 - RNA, 22 nt, Mycobacterium bovis subsp bovis AF2122/97
gccgugcgaucgucaacgacga

SEQ ID NO: 3159076 - RNA, 22 nt, Mycobacterium bovis subsp bovis AF2122/97
gccgugcgccacggcuguggcc

SEQ ID NO: 3159077 - RNA, 16 nt, Mycobacterium bovis subsp bovis AF2122/97
gccgugcgccgugcga

SEQ ID NO: 3159078 - RNA, 13 nt, Mycobacterium bovis subsp bovis AF2122/97
gccgugcggcggc

SEQ ID NO: 3159079 - RNA, 23 nt, Mycobacterium bovis subsp bovis AF2122/97
gccgugcggcggcugccgguuuc

SEQ ID NO: 3159080 - RNA, 17 nt, Mycobacterium bovis subsp bovis AF2122/97
gccgugcgggccggucg

SEQ ID NO: 3159081 - RNA, 14 nt, Mycobacterium bovis subsp bovis AF2122/97
gccgugcggucgcg

SEQ ID NO: 3159082 - RNA, 18 nt, Mycobacterium bovis subsp bovis AF2122/97
gccgugcggucgcgcccu

SEQ ID NO: 3159083 - RNA, 14 nt, Mycobacterium bovis subsp bovis AF2122/97
gccgugcgugcggg

SEQ ID NO: 3159084 - RNA, 19 nt, Mycobacterium bovis subsp bovis AF2122/97
gccgugcuacccauucggc

SEQ ID NO: 3159085 - RNA, 21 nt, Mycobacterium bovis subsp bovis AF2122/97
gccgugcuacccauucggcgg

SEQ ID NO: 3159086 - RNA, 23 nt, Mycobacterium bovis subsp bovis AF2122/97
gccgugcuacccauucggcggcg

SEQ ID NO: 3159087 - RNA, 15 nt, Mycobacterium bovis subsp bovis AF2122/97
gccgugcucaccggc

SEQ ID NO: 3159088 - RNA, 14 nt, Mycobacterium bovis subsp bovis AF2122/97
gccgugcucacggc

SEQ ID NO: 3159089 - RNA, 19 nt, Mycobacterium bovis subsp bovis AF2122/97
gccgugcucacggcaggcg

SEQ ID NO: 3159090 - RNA, 18 nt, Mycobacterium bovis subsp bovis AF2122/97
gccgugcugaacuccgcc

SEQ ID NO: 3159091 - RNA, 22 nt, Mycobacterium bovis subsp bovis AF2122/97
gccgugcugaauugccaagcgc

SEQ ID NO: 3159092 - RNA, 18 nt, Mycobacterium bovis subsp bovis AF2122/97
gccgugcugcccaucccg

SEQ ID NO: 3159093 - RNA, 14 nt, Mycobacterium bovis subsp bovis AF2122/97
gccgugcugggccg

SEQ ID NO: 3159094 - RNA, 20 nt, Mycobacterium bovis subsp bovis AF2122/97
gccgugcuuguugcgcgacg

SEQ ID NO: 3159095 - RNA, 17 nt, Mycobacterium bovis subsp bovis AF2122/97
gccguggaagacgucga

SEQ ID NO: 3159096 - RNA, 16 nt, Mycobacterium bovis subsp bovis AF2122/97
gccguggauacgcacg

SEQ ID NO: 3159097 - RNA, 16 nt, Mycobacterium bovis subsp bovis AF2122/97
gccguggaucaucccg

SEQ ID NO: 3159098 - RNA, 21 nt, Mycobacterium bovis subsp bovis AF2122/97
gccguggauggcccguucgac

SEQ ID NO: 3159099 - RNA, 14 nt, Mycobacterium bovis subsp bovis AF2122/97
gccguggcacccgc

SEQ ID NO: 3159100 - RNA, 17 nt, Mycobacterium bovis subsp bovis AF2122/97
gccguggcagucgcacg

SEQ ID NO: 3159101 - RNA, 19 nt, Mycobacterium bovis subsp bovis AF2122/97
gccguggcagucgcacggu

SEQ ID NO: 3159102 - RNA, 22 nt, Mycobacterium bovis subsp bovis AF2122/97
gccguggcagucgcacggugcc

SEQ ID NO: 3159103 - RNA, 13 nt, Mycobacterium bovis subsp bovis AF2122/97
gccguggcaucgc

SEQ ID NO: 3159104 - RNA, 14 nt, Mycobacterium bovis subsp bovis AF2122/97
gccguggcccgcuc

SEQ ID NO: 3159105 - RNA, 15 nt, Mycobacterium bovis subsp bovis AF2122/97
gccguggcgcggucg

SEQ ID NO: 3159106 - RNA, 15 nt, Mycobacterium bovis subsp bovis AF2122/97
gccguggcggacggc

SEQ ID NO: 3159107 - RNA, 16 nt, Mycobacterium bovis subsp bovis AF2122/97
gccguggcggacggcg

SEQ ID NO: 3159108 - RNA, 20 nt, Mycobacterium bovis subsp bovis AF2122/97
gccguggcggcagcggugcu

SEQ ID NO: 3159109 - RNA, 13 nt, Mycobacterium bovis subsp bovis AF2122/97
gccguggcggcgg

SEQ ID NO: 3159110 - RNA, 16 nt, Mycobacterium bovis subsp bovis AF2122/97
gccguggcggcgggcc

SEQ ID NO: 3159111 - RNA, 14 nt, Mycobacterium bovis subsp bovis AF2122/97
gccguggcgucggc

SEQ ID NO: 3159112 - RNA, 17 nt, Mycobacterium bovis subsp bovis AF2122/97
gccguggcgucggcguc

SEQ ID NO: 3159113 - RNA, 17 nt, Mycobacterium bovis subsp bovis AF2122/97
gccguggcgucgguggc

SEQ ID NO: 3159114 - RNA, 16 nt, Mycobacterium bovis subsp bovis AF2122/97
gccgugggccuguugc

SEQ ID NO: 3159115 - RNA, 19 nt, Mycobacterium bovis subsp bovis AF2122/97
gccgugggugucgguggcc

SEQ ID NO: 3159116 - RNA, 21 nt, Mycobacterium bovis subsp bovis AF2122/97
gccgugggugucgguggccgc

SEQ ID NO: 3159117 - RNA, 12 nt, Mycobacterium bovis subsp bovis AF2122/97
gccguggucgaa

SEQ ID NO: 3159118 - RNA, 19 nt, Mycobacterium bovis subsp bovis AF2122/97
gccguggugaaaugccgag

SEQ ID NO: 3159119 - RNA, 20 nt, Mycobacterium bovis subsp bovis AF2122/97
gccguggugaaaugccgaga

SEQ ID NO: 3159120 - RNA, 17 nt, Mycobacterium bovis subsp bovis AF2122/97
gccguggugcgcauggc

SEQ ID NO: 3159121 - RNA, 20 nt, Mycobacterium bovis subsp bovis AF2122/97
gccgugguugcacguucggc

SEQ ID NO: 3159122 - RNA, 16 nt, Mycobacterium bovis subsp bovis AF2122/97
gccguguacgugcucg

SEQ ID NO: 3159123 - RNA, 17 nt, Mycobacterium bovis subsp bovis AF2122/97
gccguguacgugcucgu

SEQ ID NO: 3159124 - RNA, 18 nt, Mycobacterium bovis subsp bovis AF2122/97
gccgugucaccgggugca

SEQ ID NO: 3159125 - RNA, 17 nt, Mycobacterium bovis subsp bovis AF2122/97
gccgugucgggcgcgaa

SEQ ID NO: 3159126 - RNA, 18 nt, Mycobacterium bovis subsp bovis AF2122/97
gccgugucgggcgcgaaa

SEQ ID NO: 3159127 - RNA, 20 nt, Mycobacterium bovis subsp bovis AF2122/97
gccgugugcaucggcgaccg

SEQ ID NO: 3159128 - RNA, 18 nt, Mycobacterium bovis subsp bovis AF2122/97
gccgugugugcgauccag

SEQ ID NO: 3159129 - RNA, 20 nt, Mycobacterium bovis subsp bovis AF2122/97
gccgugugugcgauccaggg

SEQ ID NO: 3159130 - RNA, 20 nt, Mycobacterium bovis subsp bovis AF2122/97
gccguguucagcacccaccg

SEQ ID NO: 3159131 - RNA, 20 nt, Mycobacterium bovis subsp bovis AF2122/97
gccguguucgggggcggucg

SEQ ID NO: 3159132 - RNA, 21 nt, Mycobacterium bovis subsp bovis AF2122/97
gccguguucgggggcggucgc

SEQ ID NO: 3159133 - RNA, 17 nt, Mycobacterium bovis subsp bovis AF2122/97
gccguuaaucaagguga

SEQ ID NO: 3159134 - RNA, 15 nt, Mycobacterium bovis subsp bovis AF2122/97
gccguuaccgacgcc

SEQ ID NO: 3159135 - RNA, 13 nt, Mycobacterium bovis subsp bovis AF2122/97
gccguuaccgcca

SEQ ID NO: 3159136 - RNA, 22 nt, Mycobacterium bovis subsp bovis AF2122/97
gccguuaccgccaaacgcugcg

SEQ ID NO: 3159137 - RNA, 14 nt, Mycobacterium bovis subsp bovis AF2122/97
gccguuaccgccgc

SEQ ID NO: 3159138 - RNA, 17 nt, Mycobacterium bovis subsp bovis AF2122/97
gccguuaccgccggcgc

SEQ ID NO: 3159139 - RNA, 14 nt, Mycobacterium bovis subsp bovis AF2122/97
gccguuaccgccgu

SEQ ID NO: 3159140 - RNA, 16 nt, Mycobacterium bovis subsp bovis AF2122/97
gccguuaccgccguug

SEQ ID NO: 3159141 - RNA, 21 nt, Mycobacterium bovis subsp bovis AF2122/97
gccguuaccgccguugccgau

SEQ ID NO: 3159142 - RNA, 18 nt, Mycobacterium bovis subsp bovis AF2122/97
gccguucaaccggacgcc

SEQ ID NO: 3159143 - RNA, 16 nt, Mycobacterium bovis subsp bovis AF2122/97
gccguucacccuggug

SEQ ID NO: 3159144 - RNA, 14 nt, Mycobacterium bovis subsp bovis AF2122/97
gccguuccagcauc

SEQ ID NO: 3159145 - RNA, 16 nt, Mycobacterium bovis subsp bovis AF2122/97
gccguucccaccacca

SEQ ID NO: 3159146 - RNA, 14 nt, Mycobacterium bovis subsp bovis AF2122/97
gccguucccaccca

SEQ ID NO: 3159147 - RNA, 17 nt, Mycobacterium bovis subsp bovis AF2122/97
gccguucgcucccccgc

SEQ ID NO: 3159148 - RNA, 12 nt, Mycobacterium bovis subsp bovis AF2122/97
gccguucggcgc

SEQ ID NO: 3159149 - RNA, 15 nt, Mycobacterium bovis subsp bovis AF2122/97
gccguucggcgcccg

SEQ ID NO: 3159150 - RNA, 20 nt, Mycobacterium bovis subsp bovis AF2122/97
gccguucggcgcccgcucgg

SEQ ID NO: 3159151 - RNA, 16 nt, Mycobacterium bovis subsp bovis AF2122/97
gccuaugcugcccggc

SEQ ID NO: 3159152 - RNA, 19 nt, Mycobacterium bovis subsp bovis AF2122/97
gccuaugcugcccggcaac

SEQ ID NO: 3159153 - RNA, 15 nt, Mycobacterium bovis subsp bovis AF2122/97
gccucaacacccggc

SEQ ID NO: 3159154 - RNA, 15 nt, Mycobacterium bovis subsp bovis AF2122/97
gccucaccacgucga

SEQ ID NO: 3159155 - RNA, 17 nt, Mycobacterium bovis subsp bovis AF2122/97
gccucaccgacgucgcc

SEQ ID NO: 3159156 - RNA, 18 nt, Mycobacterium bovis subsp bovis AF2122/97
gccucaccgacgucgcca

SEQ ID NO: 3159157 - RNA, 13 nt, Mycobacterium bovis subsp bovis AF2122/97
gccucaccgccgc

SEQ ID NO: 3159158 - RNA, 22 nt, Mycobacterium bovis subsp bovis AF2122/97
gccucaccggcgcgagcagacg

SEQ ID NO: 3159159 - RNA, 16 nt, Mycobacterium bovis subsp bovis AF2122/97
gccucagaaccggguc

SEQ ID NO: 3159160 - RNA, 23 nt, Mycobacterium bovis subsp bovis AF2122/97
gccucagccaccgggcgugcggc

SEQ ID NO: 3159161 - RNA, 14 nt, Mycobacterium bovis subsp bovis AF2122/97
gccucagcccggcc

SEQ ID NO: 3159162 - RNA, 17 nt, Mycobacterium bovis subsp bovis AF2122/97
gccucagcccggccagc

SEQ ID NO: 3159163 - RNA, 12 nt, Mycobacterium bovis subsp bovis AF2122/97
gccucagccgcu

SEQ ID NO: 3159164 - RNA, 19 nt, Mycobacterium bovis subsp bovis AF2122/97
gccucagcuaccccggcgg

SEQ ID NO: 3159165 - RNA, 14 nt, Mycobacterium bovis subsp bovis AF2122/97
gccucauccaccga

SEQ ID NO: 3159166 - RNA, 15 nt, Mycobacterium bovis subsp bovis AF2122/97
gccucauccaccgau

SEQ ID NO: 3159167 - RNA, 19 nt, Mycobacterium bovis subsp bovis AF2122/97
gccucauccaccgauggcg

SEQ ID NO: 3159168 - RNA, 19 nt, Mycobacterium bovis subsp bovis AF2122/97
gccucaucggacagcgccu

SEQ ID NO: 3159169 - RNA, 23 nt, Mycobacterium bovis subsp bovis AF2122/97
gccucaucggacagcgccuggcc

SEQ ID NO: 3159170 - RNA, 21 nt, Mycobacterium bovis subsp bovis AF2122/97
gccucaucggcaaacuccugc

SEQ ID NO: 3159171 - RNA, 13 nt, Mycobacterium bovis subsp bovis AF2122/97
gccucaucuccug

SEQ ID NO: 3159172 - RNA, 21 nt, Mycobacterium bovis subsp bovis AF2122/97
gccucaucugaggcuuccagc

SEQ ID NO: 3159173 - RNA, 15 nt, Mycobacterium bovis subsp bovis AF2122/97
gccucaugcuaggcc

SEQ ID NO: 3159174 - RNA, 17 nt, Mycobacterium bovis subsp bovis AF2122/97
gccucaugcuaggccac

SEQ ID NO: 3159175 - RNA, 21 nt, Mycobacterium bovis subsp bovis AF2122/97
gccucaugcuaggccaccggc

SEQ ID NO: 3159176 - RNA, 23 nt, Mycobacterium bovis subsp bovis AF2122/97
gccucaugcuaggccaccggcga

SEQ ID NO: 3159177 - RNA, 20 nt, Mycobacterium bovis subsp bovis AF2122/97
gccucauuuauggacaccuu

SEQ ID NO: 3159178 - RNA, 18 nt, Mycobacterium bovis subsp bovis AF2122/97
gccuccaaaaucgcggcc

SEQ ID NO: 3159179 - RNA, 19 nt, Mycobacterium bovis subsp bovis AF2122/97
gccuccaaaaucgcggcca

SEQ ID NO: 3159180 - RNA, 20 nt, Mycobacterium bovis subsp bovis AF2122/97
gccuccaaaaucgcggccac

SEQ ID NO: 3159181 - RNA, 18 nt, Mycobacterium bovis subsp bovis AF2122/97
gccuccaagcccgccgga

SEQ ID NO: 3159182 - RNA, 12 nt, Mycobacterium bovis subsp bovis AF2122/97
gccuccaccagg

SEQ ID NO: 3159183 - RNA, 16 nt, Mycobacterium bovis subsp bovis AF2122/97
gccuccaccaggucgu

SEQ ID NO: 3159184 - RNA, 16 nt, Mycobacterium bovis subsp bovis AF2122/97
gccuccacccgccacg

SEQ ID NO: 3159185 - RNA, 12 nt, Mycobacterium bovis subsp bovis AF2122/97
gccuccaccgcc

SEQ ID NO: 3159186 - RNA, 19 nt, Mycobacterium bovis subsp bovis AF2122/97
gccuccaccgccgcgcgga

SEQ ID NO: 3159187 - RNA, 18 nt, Mycobacterium bovis subsp bovis AF2122/97
gccuccaccgcguccagg

SEQ ID NO: 3159188 - RNA, 21 nt, Mycobacterium bovis subsp bovis AF2122/97
gccuccacucuucgggcggcg

SEQ ID NO: 3159189 - RNA, 18 nt, Mycobacterium bovis subsp bovis AF2122/97
gccuccagaaccgaagcc

SEQ ID NO: 3159190 - RNA, 17 nt, Mycobacterium bovis subsp bovis AF2122/97
gccuccagauucgccgc

SEQ ID NO: 3159191 - RNA, 19 nt, Mycobacterium bovis subsp bovis AF2122/97
gccuccagauucgccgccc

SEQ ID NO: 3159192 - RNA, 13 nt, Mycobacterium bovis subsp bovis AF2122/97
gccuccagcaccc

SEQ ID NO: 3159193 - RNA, 15 nt, Mycobacterium bovis subsp bovis AF2122/97
gccuccagcacccgg

SEQ ID NO: 3159194 - RNA, 17 nt, Mycobacterium bovis subsp bovis AF2122/97
gccuccagcacccgguc

SEQ ID NO: 3159195 - RNA, 19 nt, Mycobacterium bovis subsp bovis AF2122/97
gccuccagcacccggucga

SEQ ID NO: 3159196 - RNA, 15 nt, Mycobacterium bovis subsp bovis AF2122/97
gccuccagcaggucc

SEQ ID NO: 3159197 - RNA, 21 nt, Mycobacterium bovis subsp bovis AF2122/97
gccuccagcagguccgcggcc

SEQ ID NO: 3159198 - RNA, 15 nt, Mycobacterium bovis subsp bovis AF2122/97
gccuccagccggcga

SEQ ID NO: 3159199 - RNA, 18 nt, Mycobacterium bovis subsp bovis AF2122/97
gccuccagcuuggcgagc

SEQ ID NO: 3159200 - RNA, 13 nt, Mycobacterium bovis subsp bovis AF2122/97
gccuccaggcgcc

SEQ ID NO: 3159201 - RNA, 14 nt, Mycobacterium bovis subsp bovis AF2122/97
gccuccaggcgcca

SEQ ID NO: 3159202 - RNA, 17 nt, Mycobacterium bovis subsp bovis AF2122/97
gccuccaggcgccaccc

SEQ ID NO: 3159203 - RNA, 22 nt, Mycobacterium bovis subsp bovis AF2122/97
gccuccauaucgcagcguuggc

SEQ ID NO: 3159204 - RNA, 13 nt, Mycobacterium bovis subsp bovis AF2122/97
gccuccaucgcga

SEQ ID NO: 3159205 - RNA, 13 nt, Mycobacterium bovis subsp bovis AF2122/97
gccuccauggccu

SEQ ID NO: 3159206 - RNA, 19 nt, Mycobacterium bovis subsp bovis AF2122/97
gccuccauuucgucggaga

SEQ ID NO: 3159207 - RNA, 20 nt, Mycobacterium bovis subsp bovis AF2122/97
gccuccauuucgucggagaa

SEQ ID NO: 3159208 - RNA, 18 nt, Mycobacterium bovis subsp bovis AF2122/97
gccucccacucacccagc

SEQ ID NO: 3159209 - RNA, 16 nt, Mycobacterium bovis subsp bovis AF2122/97
gccuccccgaccugca

SEQ ID NO: 3159210 - RNA, 12 nt, Mycobacterium bovis subsp bovis AF2122/97
gccucccgcgcc

SEQ ID NO: 3159211 - RNA, 14 nt, Mycobacterium bovis subsp bovis AF2122/97
gccucccgcgccgg

SEQ ID NO: 3159212 - RNA, 15 nt, Mycobacterium bovis subsp bovis AF2122/97
gccucccgcgccggc

SEQ ID NO: 3159213 - RNA, 16 nt, Mycobacterium bovis subsp bovis AF2122/97
gccucccgcgccggcg

SEQ ID NO: 3159214 - RNA, 19 nt, Mycobacterium bovis subsp bovis AF2122/97
gccucccgggccgccgcga

SEQ ID NO: 3159215 - RNA, 16 nt, Mycobacterium bovis subsp bovis AF2122/97
gccuccgccugcccca

SEQ ID NO: 3159216 - RNA, 15 nt, Mycobacterium bovis subsp bovis AF2122/97
gccuccgcugccgcc

SEQ ID NO: 3159217 - RNA, 18 nt, Mycobacterium bovis subsp bovis AF2122/97
gccuccgcugccgcccgc

SEQ ID NO: 3159218 - RNA, 21 nt, Mycobacterium bovis subsp bovis AF2122/97
gccuccgcugccgcccgcgcc

SEQ ID NO: 3159219 - RNA, 13 nt, Mycobacterium bovis subsp bovis AF2122/97
gccuccggcaccu

SEQ ID NO: 3159220 - RNA, 16 nt, Mycobacterium bovis subsp bovis AF2122/97
gccuccguugccccca

SEQ ID NO: 3159221 - RNA, 14 nt, Mycobacterium bovis subsp bovis AF2122/97
gccuccuccccgac

SEQ ID NO: 3159222 - RNA, 19 nt, Mycobacterium bovis subsp bovis AF2122/97
gccuccuccccgaccgcca

SEQ ID NO: 3159223 - RNA, 21 nt, Mycobacterium bovis subsp bovis AF2122/97
gccuccucgacgucggcgagc

SEQ ID NO: 3159224 - RNA, 15 nt, Mycobacterium bovis subsp bovis AF2122/97
gccuccucgauagcg

SEQ ID NO: 3159225 - RNA, 18 nt, Mycobacterium bovis subsp bovis AF2122/97
gccuccucgucgcucccg

SEQ ID NO: 3159226 - RNA, 19 nt, Mycobacterium bovis subsp bovis AF2122/97
gccuccucgucgcucccgg

SEQ ID NO: 3159227 - RNA, 13 nt, Mycobacterium bovis subsp bovis AF2122/97
gccuccucgugca

SEQ ID NO: 3159228 - RNA, 18 nt, Mycobacterium bovis subsp bovis AF2122/97
gccuccucgugcaggacc

SEQ ID NO: 3159229 - RNA, 22 nt, Mycobacterium bovis subsp bovis AF2122/97
gccuccucgugcaggaccagca

SEQ ID NO: 3159230 - RNA, 17 nt, Mycobacterium bovis subsp bovis AF2122/97
gccuccugcuggcccug

SEQ ID NO: 3159231 - RNA, 18 nt, Mycobacterium bovis subsp bovis AF2122/97
gccuccuggaaggaggcc

SEQ ID NO: 3159232 - RNA, 16 nt, Mycobacterium bovis subsp bovis AF2122/97
gccucgaacgccgccc

SEQ ID NO: 3159233 - RNA, 22 nt, Mycobacterium bovis subsp bovis AF2122/97
gccucgaacgccgcccgcuggg

SEQ ID NO: 3159234 - RNA, 22 nt, Mycobacterium bovis subsp bovis AF2122/97
gccucgaagggcuugucgccgg

SEQ ID NO: 3159235 - RNA, 14 nt, Mycobacterium bovis subsp bovis AF2122/97
gccucgacacccag

SEQ ID NO: 3159236 - RNA, 21 nt, Mycobacterium bovis subsp bovis AF2122/97
gccucgacacccagccgcagc

SEQ ID NO: 3159237 - RNA, 14 nt, Mycobacterium bovis subsp bovis AF2122/97
gccucgacagcggc

SEQ ID NO: 3159238 - RNA, 21 nt, Mycobacterium bovis subsp bovis AF2122/97
gccugaaacggcugcagaggc

SEQ ID NO: 3159239 - RNA, 19 nt, Mycobacterium bovis subsp bovis AF2122/97
gccugaagcuuguccagau

SEQ ID NO: 3159240 - RNA, 14 nt, Mycobacterium bovis subsp bovis AF2122/97
gccugacacgaugc

SEQ ID NO: 3159241 - RNA, 18 nt, Mycobacterium bovis subsp bovis AF2122/97
gccugaccgaagucugca

SEQ ID NO: 3159242 - RNA, 23 nt, Mycobacterium bovis subsp bovis AF2122/97
gccugaccgaagucugcagacgg

SEQ ID NO: 3159243 - RNA, 16 nt, Mycobacterium bovis subsp bovis AF2122/97
gccugaccggcucgcc

SEQ ID NO: 3159244 - RNA, 19 nt, Mycobacterium bovis subsp bovis AF2122/97
gccugaccggcucgccggc

SEQ ID NO: 3159245 - RNA, 15 nt, Mycobacterium bovis subsp bovis AF2122/97
gccugaccggucacc

SEQ ID NO: 3159246 - RNA, 18 nt, Mycobacterium bovis subsp bovis AF2122/97
gccugacgcgucagcggc

SEQ ID NO: 3159247 - RNA, 19 nt, Mycobacterium bovis subsp bovis AF2122/97
gccugacgcgucagcggcg

SEQ ID NO: 3159248 - RNA, 20 nt, Mycobacterium bovis subsp bovis AF2122/97
gccugacgcgucagcggcga

SEQ ID NO: 3159249 - RNA, 14 nt, Mycobacterium bovis subsp bovis AF2122/97
gccugagcgccgcg

SEQ ID NO: 3159250 - RNA, 16 nt, Mycobacterium bovis subsp bovis AF2122/97
gccugagcggccucgg

SEQ ID NO: 3159251 - RNA, 14 nt, Mycobacterium bovis subsp bovis AF2122/97
gccugauaaagccc

SEQ ID NO: 3159252 - RNA, 17 nt, Mycobacterium bovis subsp bovis AF2122/97
gccugauaaagcccggc

SEQ ID NO: 3159253 - RNA, 19 nt, Mycobacterium bovis subsp bovis AF2122/97
gccugauaaagcccggcgg

SEQ ID NO: 3159254 - RNA, 21 nt, Mycobacterium bovis subsp bovis AF2122/97
gccugauaaagcccggcggca

SEQ ID NO: 3159255 - RNA, 23 nt, Mycobacterium bovis subsp bovis AF2122/97
gccugauaaagcccggcggcaug

SEQ ID NO: 3159256 - RNA, 18 nt, Mycobacterium bovis subsp bovis AF2122/97
gccugauaugacuugcgc

SEQ ID NO: 3159257 - RNA, 21 nt, Mycobacterium bovis subsp bovis AF2122/97
gccugaucuuuguuggccucg

SEQ ID NO: 3159258 - RNA, 15 nt, Mycobacterium bovis subsp bovis AF2122/97
gccugaugcagggcc

SEQ ID NO: 3159259 - RNA, 18 nt, Mycobacterium bovis subsp bovis AF2122/97
gccugaugcagggcccgc

SEQ ID NO: 3159260 - RNA, 14 nt, Mycobacterium bovis subsp bovis AF2122/97
gccugaugcggccg

SEQ ID NO: 3159261 - RNA, 24 nt, Mycobacterium bovis subsp bovis AF2122/97
gccugaugcugccagaucggucgg

SEQ ID NO: 3159262 - RNA, 15 nt, Mycobacterium bovis subsp bovis AF2122/97
gccugauuguugagc

SEQ ID NO: 3159263 - RNA, 15 nt, Mycobacterium bovis subsp bovis AF2122/97
gccugcaacgccgcg

SEQ ID NO: 3159264 - RNA, 15 nt, Mycobacterium bovis subsp bovis AF2122/97
gccugcaagacaaag

SEQ ID NO: 3159265 - RNA, 22 nt, Mycobacterium bovis subsp bovis AF2122/97
gccugcaagacaaagccgucga

SEQ ID NO: 3159266 - RNA, 19 nt, Mycobacterium bovis subsp bovis AF2122/97
gccugcaagcuaagcgccu

SEQ ID NO: 3159267 - RNA, 20 nt, Mycobacterium bovis subsp bovis AF2122/97
gccugcaagcuaagcgccug

SEQ ID NO: 3159268 - RNA, 15 nt, Mycobacterium bovis subsp bovis AF2122/97
gccugcaccacggcg

SEQ ID NO: 3159269 - RNA, 17 nt, Mycobacterium bovis subsp bovis AF2122/97
gccugcaccacggcggc

SEQ ID NO: 3159270 - RNA, 16 nt, Mycobacterium bovis subsp bovis AF2122/97
gccugcaccagcgagu

SEQ ID NO: 3159271 - RNA, 17 nt, Mycobacterium bovis subsp bovis AF2122/97
gccugcaccgccgccgc

SEQ ID NO: 3159272 - RNA, 13 nt, Mycobacterium bovis subsp bovis AF2122/97
gccugcacgccgg

SEQ ID NO: 3159273 - RNA, 14 nt, Mycobacterium bovis subsp bovis AF2122/97
gccugcacgccggc

SEQ ID NO: 3159274 - RNA, 15 nt, Mycobacterium bovis subsp bovis AF2122/97
gccugcacgccggcg

SEQ ID NO: 3159275 - RNA, 15 nt, Mycobacterium bovis subsp bovis AF2122/97
gccugcacggcgcug

SEQ ID NO: 3159276 - RNA, 12 nt, Mycobacterium bovis subsp bovis AF2122/97
gccugcagccga

SEQ ID NO: 3159277 - RNA, 19 nt, Mycobacterium bovis subsp bovis AF2122/97
gccugcagcgaaacaccgg

SEQ ID NO: 3159278 - RNA, 21 nt, Mycobacterium bovis subsp bovis AF2122/97
gccugcagcgaaacaccggcc

SEQ ID NO: 3159279 - RNA, 23 nt, Mycobacterium bovis subsp bovis AF2122/97
gccugcagcgaaacaccggccag

SEQ ID NO: 3159280 - RNA, 17 nt, Mycobacterium bovis subsp bovis AF2122/97
gccugcagcgcgacccg

SEQ ID NO: 3159281 - RNA, 15 nt, Mycobacterium bovis subsp bovis AF2122/97
gccugcaggccgccg

SEQ ID NO: 3159282 - RNA, 17 nt, Mycobacterium bovis subsp bovis AF2122/97
gccugcaggccgccggc

SEQ ID NO: 3159283 - RNA, 22 nt, Mycobacterium bovis subsp bovis AF2122/97
gccugcagguuuccggccugca

SEQ ID NO: 3159284 - RNA, 16 nt, Mycobacterium bovis subsp bovis AF2122/97
gccugcaguucggcgu

SEQ ID NO: 3159285 - RNA, 20 nt, Mycobacterium bovis subsp bovis AF2122/97
gccugcaguucggcguacgg

SEQ ID NO: 3159286 - RNA, 14 nt, Mycobacterium bovis subsp bovis AF2122/97
gccugccaccggcg

SEQ ID NO: 3159287 - RNA, 15 nt, Mycobacterium bovis subsp bovis AF2122/97
gccugccaccggcgc

SEQ ID NO: 3159288 - RNA, 17 nt, Mycobacterium bovis subsp bovis AF2122/97
gccugccaguccugaug

SEQ ID NO: 3159289 - RNA, 19 nt, Mycobacterium bovis subsp bovis AF2122/97
gccugccauaggcccacgg

SEQ ID NO: 3159290 - RNA, 22 nt, Mycobacterium bovis subsp bovis AF2122/97
gccugccaucacgcgcucaccg

SEQ ID NO: 3159291 - RNA, 18 nt, Mycobacterium bovis subsp bovis AF2122/97
gccugcccaccuucgagu

SEQ ID NO: 3159292 - RNA, 22 nt, Mycobacterium bovis subsp bovis AF2122/97
gccugcccaccuucgaguuugg

SEQ ID NO: 3159293 - RNA, 17 nt, Mycobacterium bovis subsp bovis AF2122/97
gccugcccagcaccacc

SEQ ID NO: 3159294 - RNA, 16 nt, Mycobacterium bovis subsp bovis AF2122/97
gccugccccacccgcg

SEQ ID NO: 3159295 - RNA, 17 nt, Mycobacterium bovis subsp bovis AF2122/97
gccugccccacccgcgg

SEQ ID NO: 3159296 - RNA, 19 nt, Mycobacterium bovis subsp bovis AF2122/97
gccugccccacccgcggcg

SEQ ID NO: 3159297 - RNA, 22 nt, Mycobacterium bovis subsp bovis AF2122/97
gccugccccacccgcggcgccg

SEQ ID NO: 3159298 - RNA, 20 nt, Mycobacterium bovis subsp bovis AF2122/97
gccugcccccgcgcgcacgg

SEQ ID NO: 3159299 - RNA, 14 nt, Mycobacterium bovis subsp bovis AF2122/97
gccugcccccggcg

SEQ ID NO: 3159300 - RNA, 19 nt, Mycobacterium bovis subsp bovis AF2122/97
gccugcccccggcgcggcg

SEQ ID NO: 3159301 - RNA, 20 nt, Mycobacterium bovis subsp bovis AF2122/97
gccugcccccggcgcggcgg

SEQ ID NO: 3159302 - RNA, 13 nt, Mycobacterium bovis subsp bovis AF2122/97
gccugcccgccgu

SEQ ID NO: 3159303 - RNA, 20 nt, Mycobacterium bovis subsp bovis AF2122/97
gccugcccggcccgcucagc

SEQ ID NO: 3159304 - RNA, 21 nt, Mycobacterium bovis subsp bovis AF2122/97
gccugcccggcccgcucagcc

SEQ ID NO: 3159305 - RNA, 16 nt, Mycobacterium bovis subsp bovis AF2122/97
gccugcccggcgccgu

SEQ ID NO: 3159306 - RNA, 17 nt, Mycobacterium bovis subsp bovis AF2122/97
gccugccgaaacgccga

SEQ ID NO: 3159307 - RNA, 14 nt, Mycobacterium bovis subsp bovis AF2122/97
gccugccgacggca

SEQ ID NO: 3159308 - RNA, 17 nt, Mycobacterium bovis subsp bovis AF2122/97
gccugccgacggcauca

SEQ ID NO: 3159309 - RNA, 16 nt, Mycobacterium bovis subsp bovis AF2122/97
gccugccgaugacgau

SEQ ID NO: 3159310 - RNA, 20 nt, Mycobacterium bovis subsp bovis AF2122/97
gccugccgaugacgauggcc

SEQ ID NO: 3159311 - RNA, 18 nt, Mycobacterium bovis subsp bovis AF2122/97
gccugccgcucgccggua

SEQ ID NO: 3159312 - RNA, 19 nt, Mycobacterium bovis subsp bovis AF2122/97
gccugccgcuggucgucga

SEQ ID NO: 3159313 - RNA, 23 nt, Mycobacterium bovis subsp bovis AF2122/97
gccugccggcugacaacgacaac

SEQ ID NO: 3159314 - RNA, 16 nt, Mycobacterium bovis subsp bovis AF2122/97
gccugccguuccagca

SEQ ID NO: 3159315 - RNA, 17 nt, Mycobacterium bovis subsp bovis AF2122/97
gccugccucaccgccgc

SEQ ID NO: 3159316 - RNA, 21 nt, Mycobacterium bovis subsp bovis AF2122/97
gccugccucgccugcacgccc

SEQ ID NO: 3159317 - RNA, 17 nt, Mycobacterium bovis subsp bovis AF2122/97
gccugcgaaacgcuggc

SEQ ID NO: 3159318 - RNA, 16 nt, Mycobacterium bovis subsp bovis AF2122/97
gccugcgaacacgcga

SEQ ID NO: 3159319 - RNA, 18 nt, Mycobacterium bovis subsp bovis AF2122/97
gccugcgaacacgcgaug

SEQ ID NO: 3159320 - RNA, 13 nt, Mycobacterium bovis subsp bovis AF2122/97
gccugcgacagca

SEQ ID NO: 3159321 - RNA, 15 nt, Mycobacterium bovis subsp bovis AF2122/97
gccugcgacagcacg

SEQ ID NO: 3159322 - RNA, 16 nt, Mycobacterium bovis subsp bovis AF2122/97
gccugcgacagcacgu

SEQ ID NO: 3159323 - RNA, 15 nt, Mycobacterium bovis subsp bovis AF2122/97
gccugcgagucgcgc

SEQ ID NO: 3159324 - RNA, 13 nt, Mycobacterium bovis subsp bovis AF2122/97
gccugggcuuggc

SEQ ID NO: 3159325 - RNA, 18 nt, Mycobacterium bovis subsp bovis AF2122/97
gccugggcuuggcgacga

SEQ ID NO: 3159326 - RNA, 15 nt, Mycobacterium bovis subsp bovis AF2122/97
gccuggggcagccgg

SEQ ID NO: 3159327 - RNA, 21 nt, Mycobacterium bovis subsp bovis AF2122/97
gccuggggguucuggccguag

SEQ ID NO: 3159328 - RNA, 18 nt, Mycobacterium bovis subsp bovis AF2122/97
gccugggugggagcguug

SEQ ID NO: 3159329 - RNA, 15 nt, Mycobacterium bovis subsp bovis AF2122/97
gccuggguugaccgc

SEQ ID NO: 3159330 - RNA, 16 nt, Mycobacterium bovis subsp bovis AF2122/97
gccuggguugaccgcc

SEQ ID NO: 3159331 - RNA, 21 nt, Mycobacterium bovis subsp bovis AF2122/97
gccuggguuggugauugcggc

SEQ ID NO: 3159332 - RNA, 22 nt, Mycobacterium bovis subsp bovis AF2122/97
gccuggguuggugauugcggcc

SEQ ID NO: 3159333 - RNA, 16 nt, Mycobacterium bovis subsp bovis AF2122/97
gccugguaccgcggug

SEQ ID NO: 3159334 - RNA, 21 nt, Mycobacterium bovis subsp bovis AF2122/97
gccuggugcucaacggcgaca

SEQ ID NO: 3159335 - RNA, 23 nt, Mycobacterium bovis subsp bovis AF2122/97
gccuggugcucaacggcgacauc

SEQ ID NO: 3159336 - RNA, 15 nt, Mycobacterium bovis subsp bovis AF2122/97
gccuguacggcggcu

SEQ ID NO: 3159337 - RNA, 16 nt, Mycobacterium bovis subsp bovis AF2122/97
gccuguacggcggcua

SEQ ID NO: 3159338 - RNA, 16 nt, Mycobacterium bovis subsp bovis AF2122/97
gccuguagucccucau

SEQ ID NO: 3159339 - RNA, 23 nt, Mycobacterium bovis subsp bovis AF2122/97
gccuguagucccucaucaccucu

SEQ ID NO: 3159340 - RNA, 17 nt, Mycobacterium bovis subsp bovis AF2122/97
gccugucaggcggcgga

SEQ ID NO: 3159341 - RNA, 13 nt, Mycobacterium bovis subsp bovis AF2122/97
gccuguccacguc

SEQ ID NO: 3159342 - RNA, 19 nt, Mycobacterium bovis subsp bovis AF2122/97
gccuguccacguccagccc

SEQ ID NO: 3159343 - RNA, 18 nt, Mycobacterium bovis subsp bovis AF2122/97
gccugucccgccggcccc

SEQ ID NO: 3159344 - RNA, 20 nt, Mycobacterium bovis subsp bovis AF2122/97
gccugucccgccggccccgc

SEQ ID NO: 3159345 - RNA, 21 nt, Mycobacterium bovis subsp bovis AF2122/97
gccugucccgccggccccgcc

SEQ ID NO: 3159346 - RNA, 13 nt, Mycobacterium bovis subsp bovis AF2122/97
gccugugccgccg

SEQ ID NO: 3159347 - RNA, 15 nt, Mycobacterium bovis subsp bovis AF2122/97
gccugugccgccggc

SEQ ID NO: 3159348 - RNA, 23 nt, Mycobacterium bovis subsp bovis AF2122/97
gccugugcgcggugacgagccac

SEQ ID NO: 3159349 - RNA, 13 nt, Mycobacterium bovis subsp bovis AF2122/97
gccuguucaacuc

SEQ ID NO: 3159350 - RNA, 22 nt, Mycobacterium bovis subsp bovis AF2122/97
gccuguucgagaucgccgagca

SEQ ID NO: 3159351 - RNA, 22 nt, Mycobacterium bovis subsp bovis AF2122/97
gccuguucgccgcgaaugucgc

SEQ ID NO: 3159352 - RNA, 17 nt, Mycobacterium bovis subsp bovis AF2122/97
gccuguugcugcccgac

SEQ ID NO: 3159353 - RNA, 18 nt, Mycobacterium bovis subsp bovis AF2122/97
gccuuacacgccuggcua

SEQ ID NO: 3159354 - RNA, 18 nt, Mycobacterium bovis subsp bovis AF2122/97
gccuuagcccggccgcgc

SEQ ID NO: 3159355 - RNA, 13 nt, Mycobacterium bovis subsp bovis AF2122/97
gccuuagcugcca

SEQ ID NO: 3159356 - RNA, 21 nt, Mycobacterium bovis subsp bovis AF2122/97
gccuucaaggaagccgcggcc

SEQ ID NO: 3159357 - RNA, 16 nt, Mycobacterium bovis subsp bovis AF2122/97
gccuucacgcuggccu

SEQ ID NO: 3159358 - RNA, 23 nt, Mycobacterium bovis subsp bovis AF2122/97
gccuucacgcuggccuccagcuu

SEQ ID NO: 3159359 - RNA, 15 nt, Mycobacterium bovis subsp bovis AF2122/97
gccuucagcggucgc

SEQ ID NO: 3159360 - RNA, 17 nt, Mycobacterium bovis subsp bovis AF2122/97
gccuucagcggucgcag

SEQ ID NO: 3159361 - RNA, 14 nt, Mycobacterium bovis subsp bovis AF2122/97
gccuucagcucacc

SEQ ID NO: 3159362 - RNA, 20 nt, Mycobacterium bovis subsp bovis AF2122/97
gccuuccaggcgggcggcac

SEQ ID NO: 3159363 - RNA, 15 nt, Mycobacterium bovis subsp bovis AF2122/97
gccuucccagccgac

SEQ ID NO: 3159364 - RNA, 14 nt, Mycobacterium bovis subsp bovis AF2122/97
gccuuccgacccaa

SEQ ID NO: 3159365 - RNA, 23 nt, Mycobacterium bovis subsp bovis AF2122/97
gccuuccgacccaacgaccacca

SEQ ID NO: 3159366 - RNA, 13 nt, Mycobacterium bovis subsp bovis AF2122/97
gccuucgccagcg

SEQ ID NO: 3159367 - RNA, 14 nt, Mycobacterium bovis subsp bovis AF2122/97
gccuucggcgagcg

SEQ ID NO: 3159368 - RNA, 21 nt, Mycobacterium bovis subsp bovis AF2122/97
gccuucgggccaggauccgac

SEQ ID NO: 3159369 - RNA, 16 nt, Mycobacterium bovis subsp bovis AF2122/97
gccuucggugccggaa

SEQ ID NO: 3159370 - RNA, 14 nt, Mycobacterium bovis subsp bovis AF2122/97
gccuucggugucgc

SEQ ID NO: 3159371 - RNA, 20 nt, Mycobacterium bovis subsp bovis AF2122/97
gccuucggugucgccgaaca

SEQ ID NO: 3159372 - RNA, 23 nt, Mycobacterium bovis subsp bovis AF2122/97
gccuucggugucgccgaacaccg

SEQ ID NO: 3159373 - RNA, 20 nt, Mycobacterium bovis subsp bovis AF2122/97
gccuucguaaccacgacgac

SEQ ID NO: 3159374 - RNA, 18 nt, Mycobacterium bovis subsp bovis AF2122/97
gccuucguagaaggaccg

SEQ ID NO: 3159375 - RNA, 23 nt, Mycobacterium bovis subsp bovis AF2122/97
gccuucguagaaggaccgcucgu

SEQ ID NO: 3159376 - RNA, 15 nt, Mycobacterium bovis subsp bovis AF2122/97
gccuucgucgaugcg

SEQ ID NO: 3159377 - RNA, 21 nt, Mycobacterium bovis subsp bovis AF2122/97
gccuucgucgaugcgguaucg

SEQ ID NO: 3159378 - RNA, 23 nt, Mycobacterium bovis subsp bovis AF2122/97
gccuucuccccgaucagcaccga

SEQ ID NO: 3159379 - RNA, 22 nt, Mycobacterium bovis subsp bovis AF2122/97
gccuucuccggcgucacggcgu

SEQ ID NO: 3159380 - RNA, 14 nt, Mycobacterium bovis subsp bovis AF2122/97
gccuucucgccgug

SEQ ID NO: 3159381 - RNA, 21 nt, Mycobacterium bovis subsp bovis AF2122/97
gccuucucgcgaagaucagcg

SEQ ID NO: 3159382 - RNA, 14 nt, Mycobacterium bovis subsp bovis AF2122/97
gccuucucgcugac

SEQ ID NO: 3159383 - RNA, 18 nt, Mycobacterium bovis subsp bovis AF2122/97
gccuucuucgcggcgguc

SEQ ID NO: 3159384 - RNA, 20 nt, Mycobacterium bovis subsp bovis AF2122/97
gccuucuucgcggcggucgu

SEQ ID NO: 3159385 - RNA, 21 nt, Mycobacterium bovis subsp bovis AF2122/97
gccuucuuggcaggugccuuc

SEQ ID NO: 3159386 - RNA, 18 nt, Mycobacterium bovis subsp bovis AF2122/97
gccuucuuugccggcgcc

SEQ ID NO: 3159387 - RNA, 14 nt, Mycobacterium bovis subsp bovis AF2122/97
gccuugaaacggug

SEQ ID NO: 3159388 - RNA, 16 nt, Mycobacterium bovis subsp bovis AF2122/97
gccuugaagcggugga

SEQ ID NO: 3159389 - RNA, 21 nt, Mycobacterium bovis subsp bovis AF2122/97
gccuugaagcgguggacgagc

SEQ ID NO: 3159390 - RNA, 17 nt, Mycobacterium bovis subsp bovis AF2122/97
gccuugacagcuuucuu

SEQ ID NO: 3159391 - RNA, 18 nt, Mycobacterium bovis subsp bovis AF2122/97
gccuugacagcuuucuug

SEQ ID NO: 3159392 - RNA, 20 nt, Mycobacterium bovis subsp bovis AF2122/97
gccuugaccgcggucuucuu

SEQ ID NO: 3159393 - RNA, 14 nt, Mycobacterium bovis subsp bovis AF2122/97
gccuugacgaucga

SEQ ID NO: 3159394 - RNA, 19 nt, Mycobacterium bovis subsp bovis AF2122/97
gccuugacugaacucaaca

SEQ ID NO: 3159395 - RNA, 15 nt, Mycobacterium bovis subsp bovis AF2122/97
gccuugagccgcccc

SEQ ID NO: 3159396 - RNA, 18 nt, Mycobacterium bovis subsp bovis AF2122/97
gccuugaggcccugcggc

SEQ ID NO: 3159397 - RNA, 14 nt, Mycobacterium bovis subsp bovis AF2122/97
gccuugaucggcga

SEQ ID NO: 3159398 - RNA, 15 nt, Mycobacterium bovis subsp bovis AF2122/97
gccuugaucggcgag

SEQ ID NO: 3159399 - RNA, 16 nt, Mycobacterium bovis subsp bovis AF2122/97
gccuugaucgugcugg

SEQ ID NO: 3159400 - RNA, 18 nt, Mycobacterium bovis subsp bovis AF2122/97
gccuugaucugagcgcgg

SEQ ID NO: 3159401 - RNA, 19 nt, Mycobacterium bovis subsp bovis AF2122/97
gccuugauggucuccacca

SEQ ID NO: 3159402 - RNA, 14 nt, Mycobacterium bovis subsp bovis AF2122/97
gccuugauugccgc

SEQ ID NO: 3159403 - RNA, 13 nt, Mycobacterium bovis subsp bovis AF2122/97
gccuugcccagcg

SEQ ID NO: 3159404 - RNA, 21 nt, Mycobacterium bovis subsp bovis AF2122/97
gccuugcccucaacggcggca

SEQ ID NO: 3159405 - RNA, 19 nt, Mycobacterium bovis subsp bovis AF2122/97
gccuugccgaucagcuggc

SEQ ID NO: 3159406 - RNA, 19 nt, Mycobacterium bovis subsp bovis AF2122/97
gccuugccgccggccccgc

SEQ ID NO: 3159407 - RNA, 22 nt, Mycobacterium bovis subsp bovis AF2122/97
gccuugccgccggccccgccag

SEQ ID NO: 3159408 - RNA, 21 nt, Mycobacterium bovis subsp bovis AF2122/97
gccuugccgccggcgccgccg

SEQ ID NO: 3159409 - RNA, 20 nt, Mycobacterium bovis subsp bovis AF2122/97
gccuugccgucgagcuccca

SEQ ID NO: 3159410 - RNA, 17 nt, Mycobacterium bovis subsp bovis AF2122/97
gcgaacacgucggccag

SEQ ID NO: 3159411 - RNA, 19 nt, Mycobacterium bovis subsp bovis AF2122/97
gcgaacagacaugcgcacc

SEQ ID NO: 3159412 - RNA, 19 nt, Mycobacterium bovis subsp bovis AF2122/97
gcgaacagacgcaaaaagc

SEQ ID NO: 3159413 - RNA, 22 nt, Mycobacterium bovis subsp bovis AF2122/97
gcgaacagcacauaugugcccg

SEQ ID NO: 3159414 - RNA, 12 nt, Mycobacterium bovis subsp bovis AF2122/97
gcgaacagcggc

SEQ ID NO: 3159415 - RNA, 15 nt, Mycobacterium bovis subsp bovis AF2122/97
gcgaacaggcgaccg

SEQ ID NO: 3159416 - RNA, 17 nt, Mycobacterium bovis subsp bovis AF2122/97
gcgaacagugacgccac

SEQ ID NO: 3159417 - RNA, 14 nt, Mycobacterium bovis subsp bovis AF2122/97
gcgaacaucgccag

SEQ ID NO: 3159418 - RNA, 15 nt, Mycobacterium bovis subsp bovis AF2122/97
gcgaacaucgccagc

SEQ ID NO: 3159419 - RNA, 16 nt, Mycobacterium bovis subsp bovis AF2122/97
gcgaacaucgccagcg

SEQ ID NO: 3159420 - RNA, 18 nt, Mycobacterium bovis subsp bovis AF2122/97
gcgaacaucgccagcgcc

SEQ ID NO: 3159421 - RNA, 19 nt, Mycobacterium bovis subsp bovis AF2122/97
gcgaacaucgccagcgccg

SEQ ID NO: 3159422 - RNA, 15 nt, Mycobacterium bovis subsp bovis AF2122/97
gcgaaccaccggcgc

SEQ ID NO: 3159423 - RNA, 16 nt, Mycobacterium bovis subsp bovis AF2122/97
gcgaaccaccggcgcc

SEQ ID NO: 3159424 - RNA, 21 nt, Mycobacterium bovis subsp bovis AF2122/97
gcgaaccaccggcgccgccgg

SEQ ID NO: 3159425 - RNA, 14 nt, Mycobacterium bovis subsp bovis AF2122/97
gcgaaccaugacca

SEQ ID NO: 3159426 - RNA, 14 nt, Mycobacterium bovis subsp bovis AF2122/97
gcgaacccccgccg

SEQ ID NO: 3159427 - RNA, 16 nt, Mycobacterium bovis subsp bovis AF2122/97
gcgaacccccgccgcg

SEQ ID NO: 3159428 - RNA, 17 nt, Mycobacterium bovis subsp bovis AF2122/97
gcgaacccccgccgcgc

SEQ ID NO: 3159429 - RNA, 17 nt, Mycobacterium bovis subsp bovis AF2122/97
gcgaacccgagccgccg

SEQ ID NO: 3159430 - RNA, 20 nt, Mycobacterium bovis subsp bovis AF2122/97
gcgaacccgagccgccgugg

SEQ ID NO: 3159431 - RNA, 22 nt, Mycobacterium bovis subsp bovis AF2122/97
gcgaacccgcagucggucacgc

SEQ ID NO: 3159432 - RNA, 12 nt, Mycobacterium bovis subsp bovis AF2122/97
gcgaacccgccg

SEQ ID NO: 3159433 - RNA, 14 nt, Mycobacterium bovis subsp bovis AF2122/97
gcgaacccgccgau

SEQ ID NO: 3159434 - RNA, 22 nt, Mycobacterium bovis subsp bovis AF2122/97
gcgaacccgcgagguugaccac

SEQ ID NO: 3159435 - RNA, 12 nt, Mycobacterium bovis subsp bovis AF2122/97
gcgaacccgguc

SEQ ID NO: 3159436 - RNA, 14 nt, Mycobacterium bovis subsp bovis AF2122/97
gcgaacccuccgca

SEQ ID NO: 3159437 - RNA, 21 nt, Mycobacterium bovis subsp bovis AF2122/97
gcgaaccgccggcaccgccgc

SEQ ID NO: 3159438 - RNA, 22 nt, Mycobacterium bovis subsp bovis AF2122/97
gcgaaccgccggcaccgccgcc

SEQ ID NO: 3159439 - RNA, 23 nt, Mycobacterium bovis subsp bovis AF2122/97
gcgaaccgccggcaccgccgccc

SEQ ID NO: 3159440 - RNA, 16 nt, Mycobacterium bovis subsp bovis AF2122/97
gcgaaccggccgucga

SEQ ID NO: 3159441 - RNA, 23 nt, Mycobacterium bovis subsp bovis AF2122/97
gcgaaccggcugggcgccaccau

SEQ ID NO: 3159442 - RNA, 18 nt, Mycobacterium bovis subsp bovis AF2122/97
gcgaaccgucagcgcgcc

SEQ ID NO: 3159443 - RNA, 21 nt, Mycobacterium bovis subsp bovis AF2122/97
gcgaaccugcucggcgcgccg

SEQ ID NO: 3159444 - RNA, 17 nt, Mycobacterium bovis subsp bovis AF2122/97
gcgaaccuugguugcca

SEQ ID NO: 3159445 - RNA, 18 nt, Mycobacterium bovis subsp bovis AF2122/97
gcgaacgaauccgcucga

SEQ ID NO: 3159446 - RNA, 16 nt, Mycobacterium bovis subsp bovis AF2122/97
gcgaacgaucccgccg

SEQ ID NO: 3159447 - RNA, 15 nt, Mycobacterium bovis subsp bovis AF2122/97
gcgaacgccacggca

SEQ ID NO: 3159448 - RNA, 15 nt, Mycobacterium bovis subsp bovis AF2122/97
gcgaacgccugcugg

SEQ ID NO: 3159449 - RNA, 16 nt, Mycobacterium bovis subsp bovis AF2122/97
gcgaacgcgacagcca

SEQ ID NO: 3159450 - RNA, 23 nt, Mycobacterium bovis subsp bovis AF2122/97
gcgaacgcgacagccaccucgac

SEQ ID NO: 3159451 - RNA, 12 nt, Mycobacterium bovis subsp bovis AF2122/97
gcgaacgcggcc

SEQ ID NO: 3159452 - RNA, 15 nt, Mycobacterium bovis subsp bovis AF2122/97
gcgaacgcggccacc

SEQ ID NO: 3159453 - RNA, 16 nt, Mycobacterium bovis subsp bovis AF2122/97
gcgaacgcggcgucga

SEQ ID NO: 3159454 - RNA, 17 nt, Mycobacterium bovis subsp bovis AF2122/97
gcgaacgcguccagcgc

SEQ ID NO: 3159455 - RNA, 22 nt, Mycobacterium bovis subsp bovis AF2122/97
gcgaacgcguccagcgcggccu

SEQ ID NO: 3159456 - RNA, 19 nt, Mycobacterium bovis subsp bovis AF2122/97
gcgaacgcuucaccucguc

SEQ ID NO: 3159457 - RNA, 22 nt, Mycobacterium bovis subsp bovis AF2122/97
gcgaacggauucccgcccagca

SEQ ID NO: 3159458 - RNA, 21 nt, Mycobacterium bovis subsp bovis AF2122/97
gcgaacggcaccagaucuucg

SEQ ID NO: 3159459 - RNA, 13 nt, Mycobacterium bovis subsp bovis AF2122/97
gcgaacggcaccg

SEQ ID NO: 3159460 - RNA, 17 nt, Mycobacterium bovis subsp bovis AF2122/97
gcgaacggcaccgcgcc

SEQ ID NO: 3159461 - RNA, 20 nt, Mycobacterium bovis subsp bovis AF2122/97
gcgaacggcaccgcgcccac

SEQ ID NO: 3159462 - RNA, 14 nt, Mycobacterium bovis subsp bovis AF2122/97
gcgaacggccagga

SEQ ID NO: 3159463 - RNA, 13 nt, Mycobacterium bovis subsp bovis AF2122/97
gcgaacggcgcag

SEQ ID NO: 3159464 - RNA, 15 nt, Mycobacterium bovis subsp bovis AF2122/97
gcgaacgggcuuccg

SEQ ID NO: 3159465 - RNA, 16 nt, Mycobacterium bovis subsp bovis AF2122/97
gcgaacgggucgggac

SEQ ID NO: 3159466 - RNA, 23 nt, Mycobacterium bovis subsp bovis AF2122/97
gcgaacgggucgggacgcugccg

SEQ ID NO: 3159467 - RNA, 23 nt, Mycobacterium bovis subsp bovis AF2122/97
gcgaacgucaaccgggcggcguu

SEQ ID NO: 3159468 - RNA, 22 nt, Mycobacterium bovis subsp bovis AF2122/97
gcgaacgucagugccccgcagc

SEQ ID NO: 3159469 - RNA, 18 nt, Mycobacterium bovis subsp bovis AF2122/97
gcgaacuccagcagcccg

SEQ ID NO: 3159470 - RNA, 20 nt, Mycobacterium bovis subsp bovis AF2122/97
gcgaacuccagcagcccggu

SEQ ID NO: 3159471 - RNA, 14 nt, Mycobacterium bovis subsp bovis AF2122/97
gcgaacucggcgau

SEQ ID NO: 3159472 - RNA, 21 nt, Mycobacterium bovis subsp bovis AF2122/97
gcgaacugcgaucggccgccg

SEQ ID NO: 3159473 - RNA, 22 nt, Mycobacterium bovis subsp bovis AF2122/97
gcgaacugcgaucggccgccga

SEQ ID NO: 3159474 - RNA, 23 nt, Mycobacterium bovis subsp bovis AF2122/97
gcgaacuuaacuacggugcccug

SEQ ID NO: 3159475 - RNA, 19 nt, Mycobacterium bovis subsp bovis AF2122/97
gcgaagaacaacaucgcca

SEQ ID NO: 3159476 - RNA, 17 nt, Mycobacterium bovis subsp bovis AF2122/97
gcgaagaacgacgccac

SEQ ID NO: 3159477 - RNA, 18 nt, Mycobacterium bovis subsp bovis AF2122/97
gcgaagaacgacgccacc

SEQ ID NO: 3159478 - RNA, 21 nt, Mycobacterium bovis subsp bovis AF2122/97
gcgaagaacgacgccaccgcg

SEQ ID NO: 3159479 - RNA, 17 nt, Mycobacterium bovis subsp bovis AF2122/97
gcgaagaacugggcaau

SEQ ID NO: 3159480 - RNA, 19 nt, Mycobacterium bovis subsp bovis AF2122/97
gcgaagaccagcggcggcg

SEQ ID NO: 3159481 - RNA, 20 nt, Mycobacterium bovis subsp bovis AF2122/97
gcgaagaccagcggcggcgg

SEQ ID NO: 3159482 - RNA, 14 nt, Mycobacterium bovis subsp bovis AF2122/97
gcgaagagcccguu

SEQ ID NO: 3159483 - RNA, 21 nt, Mycobacterium bovis subsp bovis AF2122/97
gcgaagcaagugaauacccca

SEQ ID NO: 3159484 - RNA, 13 nt, Mycobacterium bovis subsp bovis AF2122/97
gcgaagcacaccg

SEQ ID NO: 3159485 - RNA, 14 nt, Mycobacterium bovis subsp bovis AF2122/97
gcgaagcaucgcgu

SEQ ID NO: 3159486 - RNA, 13 nt, Mycobacterium bovis subsp bovis AF2122/97
gcgaagccaccag

SEQ ID NO: 3159487 - RNA, 20 nt, Mycobacterium bovis subsp bovis AF2122/97
gcgaagcccgacaugaggcu

SEQ ID NO: 3159488 - RNA, 13 nt, Mycobacterium bovis subsp bovis AF2122/97
gcgaagcccgaga

SEQ ID NO: 3159489 - RNA, 14 nt, Mycobacterium bovis subsp bovis AF2122/97
gcgaagcccgagau

SEQ ID NO: 3159490 - RNA, 13 nt, Mycobacterium bovis subsp bovis AF2122/97
gcgaagccgagca

SEQ ID NO: 3159491 - RNA, 15 nt, Mycobacterium bovis subsp bovis AF2122/97
gcgaagccggccggg

SEQ ID NO: 3159492 - RNA, 11 nt, Mycobacterium bovis subsp bovis AF2122/97
gcgaagccggg

SEQ ID NO: 3159493 - RNA, 12 nt, Mycobacterium bovis subsp bovis AF2122/97
gcgaagccgggu

SEQ ID NO: 3159494 - RNA, 22 nt, Mycobacterium bovis subsp bovis AF2122/97
gcgaagccgguucgcccagcag

SEQ ID NO: 3159495 - RNA, 23 nt, Mycobacterium bovis subsp bovis AF2122/97
gcgaagccgguucgcccagcagg

SEQ ID NO: 3159496 - RNA, 12 nt, Mycobacterium bovis subsp bovis AF2122/97
gcgaagcgggcg

SEQ ID NO: 3159497 - RNA, 17 nt, Mycobacterium bovis subsp bovis AF2122/97
gcgacauugcgagcgcc

SEQ ID NO: 3159498 - RNA, 20 nt, Mycobacterium bovis subsp bovis AF2122/97
gcgaccaacacgguacugug

SEQ ID NO: 3159499 - RNA, 15 nt, Mycobacterium bovis subsp bovis AF2122/97
gcgaccaaggccgac

SEQ ID NO: 3159500 - RNA, 18 nt, Mycobacterium bovis subsp bovis AF2122/97
gcgaccaauaggucccca

SEQ ID NO: 3159501 - RNA, 22 nt, Mycobacterium bovis subsp bovis AF2122/97
gcgaccaaugcagugcgaucgg

SEQ ID NO: 3159502 - RNA, 22 nt, Mycobacterium bovis subsp bovis AF2122/97
gcgaccaaugcguugacgucga

SEQ ID NO: 3159503 - RNA, 13 nt, Mycobacterium bovis subsp bovis AF2122/97
gcgaccaccaccg

SEQ ID NO: 3159504 - RNA, 16 nt, Mycobacterium bovis subsp bovis AF2122/97
gcgaccaccaccgccg

SEQ ID NO: 3159505 - RNA, 20 nt, Mycobacterium bovis subsp bovis AF2122/97
gcgaccaccaccgccgccga

SEQ ID NO: 3159506 - RNA, 14 nt, Mycobacterium bovis subsp bovis AF2122/97
gcgaccaccagcgc

SEQ ID NO: 3159507 - RNA, 17 nt, Mycobacterium bovis subsp bovis AF2122/97
gcgaccaccagcgccga

SEQ ID NO: 3159508 - RNA, 15 nt, Mycobacterium bovis subsp bovis AF2122/97
gcgaccacccgccgc

SEQ ID NO: 3159509 - RNA, 14 nt, Mycobacterium bovis subsp bovis AF2122/97
gcgaccaccgcggc

SEQ ID NO: 3159510 - RNA, 17 nt, Mycobacterium bovis subsp bovis AF2122/97
gcgaccaccgcggcugc

SEQ ID NO: 3159511 - RNA, 16 nt, Mycobacterium bovis subsp bovis AF2122/97
gcgaccaccgcgucgg

SEQ ID NO: 3159512 - RNA, 18 nt, Mycobacterium bovis subsp bovis AF2122/97
gcgaccaccgcgucgggc

SEQ ID NO: 3159513 - RNA, 13 nt, Mycobacterium bovis subsp bovis AF2122/97
gcgaccaccguca

SEQ ID NO: 3159514 - RNA, 13 nt, Mycobacterium bovis subsp bovis AF2122/97
gcgaccacgauga

SEQ ID NO: 3159515 - RNA, 14 nt, Mycobacterium bovis subsp bovis AF2122/97
gcgaccacgcaccg

SEQ ID NO: 3159516 - RNA, 17 nt, Mycobacterium bovis subsp bovis AF2122/97
gcgaccacgcaccgccc

SEQ ID NO: 3159517 - RNA, 13 nt, Mycobacterium bovis subsp bovis AF2122/97
gcgaccacgccgc

SEQ ID NO: 3159518 - RNA, 15 nt, Mycobacterium bovis subsp bovis AF2122/97
gcgaccacgccgccg

SEQ ID NO: 3159519 - RNA, 17 nt, Mycobacterium bovis subsp bovis AF2122/97
gcgaccacgccgccggc

SEQ ID NO: 3159520 - RNA, 15 nt, Mycobacterium bovis subsp bovis AF2122/97
gcgaccacggcaccg

SEQ ID NO: 3159521 - RNA, 18 nt, Mycobacterium bovis subsp bovis AF2122/97
gcgaccacggcaccgauc

SEQ ID NO: 3159522 - RNA, 23 nt, Mycobacterium bovis subsp bovis AF2122/97
gcgaccacggcaccgaucaacgg

SEQ ID NO: 3159523 - RNA, 14 nt, Mycobacterium bovis subsp bovis AF2122/97
gcgaccacgucggc

SEQ ID NO: 3159524 - RNA, 15 nt, Mycobacterium bovis subsp bovis AF2122/97
gcgaccacgucggcg

SEQ ID NO: 3159525 - RNA, 17 nt, Mycobacterium bovis subsp bovis AF2122/97
gcgaccacgucggcgaa

SEQ ID NO: 3159526 - RNA, 14 nt, Mycobacterium bovis subsp bovis AF2122/97
gcgaccagaaucuc

SEQ ID NO: 3159527 - RNA, 18 nt, Mycobacterium bovis subsp bovis AF2122/97
gcgaccagaaucucgccg

SEQ ID NO: 3159528 - RNA, 18 nt, Mycobacterium bovis subsp bovis AF2122/97
gcgaccagaggaugucga

SEQ ID NO: 3159529 - RNA, 19 nt, Mycobacterium bovis subsp bovis AF2122/97
gcgaccagaggaugucgau

SEQ ID NO: 3159530 - RNA, 14 nt, Mycobacterium bovis subsp bovis AF2122/97
gcgaccagccgagc

SEQ ID NO: 3159531 - RNA, 14 nt, Mycobacterium bovis subsp bovis AF2122/97
gcgaccagcgccgc

SEQ ID NO: 3159532 - RNA, 17 nt, Mycobacterium bovis subsp bovis AF2122/97
gcgaccagcgccgcacc

SEQ ID NO: 3159533 - RNA, 19 nt, Mycobacterium bovis subsp bovis AF2122/97
gcgaccagcucagcugcgg

SEQ ID NO: 3159534 - RNA, 13 nt, Mycobacterium bovis subsp bovis AF2122/97
gcgaccagcuggc

SEQ ID NO: 3159535 - RNA, 16 nt, Mycobacterium bovis subsp bovis AF2122/97
gcgaccagcuggccgu

SEQ ID NO: 3159536 - RNA, 18 nt, Mycobacterium bovis subsp bovis AF2122/97
gcgaccaggucgccagcu

SEQ ID NO: 3159537 - RNA, 18 nt, Mycobacterium bovis subsp bovis AF2122/97
gcgaccaggucggcuucg

SEQ ID NO: 3159538 - RNA, 18 nt, Mycobacterium bovis subsp bovis AF2122/97
gcgaccagugguggccga

SEQ ID NO: 3159539 - RNA, 19 nt, Mycobacterium bovis subsp bovis AF2122/97
gcgaccauaaaccgcugcu

SEQ ID NO: 3159540 - RNA, 18 nt, Mycobacterium bovis subsp bovis AF2122/97
gcgaccauacccgcgcgc

SEQ ID NO: 3159541 - RNA, 23 nt, Mycobacterium bovis subsp bovis AF2122/97
gcgaccauccgaguugucgccgg

SEQ ID NO: 3159542 - RNA, 16 nt, Mycobacterium bovis subsp bovis AF2122/97
gcgaccaucgcgacgg

SEQ ID NO: 3159543 - RNA, 14 nt, Mycobacterium bovis subsp bovis AF2122/97
gcgaccaucucgac

SEQ ID NO: 3159544 - RNA, 16 nt, Mycobacterium bovis subsp bovis AF2122/97
gcgaccaucucgacgu

SEQ ID NO: 3159545 - RNA, 18 nt, Mycobacterium bovis subsp bovis AF2122/97
gcgaccaucugaucgggc

SEQ ID NO: 3159546 - RNA, 22 nt, Mycobacterium bovis subsp bovis AF2122/97
gcgaccaugcuccuaucacugg

SEQ ID NO: 3159547 - RNA, 15 nt, Mycobacterium bovis subsp bovis AF2122/97
gcgacccaaaaugcc

SEQ ID NO: 3159548 - RNA, 23 nt, Mycobacterium bovis subsp bovis AF2122/97
gcgacccagcgguaucccccagc

SEQ ID NO: 3159549 - RNA, 21 nt, Mycobacterium bovis subsp bovis AF2122/97
gcgaccccaggcgcucaucac

SEQ ID NO: 3159550 - RNA, 13 nt, Mycobacterium bovis subsp bovis AF2122/97
gcgacccccagcg

SEQ ID NO: 3159551 - RNA, 15 nt, Mycobacterium bovis subsp bovis AF2122/97
gcgacccccagcgcc

SEQ ID NO: 3159552 - RNA, 17 nt, Mycobacterium bovis subsp bovis AF2122/97
gcgacccccagcgcccg

SEQ ID NO: 3159553 - RNA, 22 nt, Mycobacterium bovis subsp bovis AF2122/97
gcgacccccagcgcccgccggc

SEQ ID NO: 3159554 - RNA, 22 nt, Mycobacterium bovis subsp bovis AF2122/97
gcgaccccgaacauccgccgcc

SEQ ID NO: 3159555 - RNA, 16 nt, Mycobacterium bovis subsp bovis AF2122/97
gcgaccccgccgagcg

SEQ ID NO: 3159556 - RNA, 22 nt, Mycobacterium bovis subsp bovis AF2122/97
gcgaccccgcuuuuucccggcg

SEQ ID NO: 3159557 - RNA, 23 nt, Mycobacterium bovis subsp bovis AF2122/97
gcgaccccgcuuuuucccggcgg

SEQ ID NO: 3159558 - RNA, 15 nt, Mycobacterium bovis subsp bovis AF2122/97
gcgaccccggccccg

SEQ ID NO: 3159559 - RNA, 22 nt, Mycobacterium bovis subsp bovis AF2122/97
gcgacccgaucgcgccaggcca

SEQ ID NO: 3159560 - RNA, 13 nt, Mycobacterium bovis subsp bovis AF2122/97
gcgacccggccag

SEQ ID NO: 3159561 - RNA, 16 nt, Mycobacterium bovis subsp bovis AF2122/97
gcgacccggcccagcg

SEQ ID NO: 3159562 - RNA, 18 nt, Mycobacterium bovis subsp bovis AF2122/97
gcgacccggcccagcgcc

SEQ ID NO: 3159563 - RNA, 19 nt, Mycobacterium bovis subsp bovis AF2122/97
gcgacccggcccagcgccc

SEQ ID NO: 3159564 - RNA, 19 nt, Mycobacterium bovis subsp bovis AF2122/97
gcgacccggguagacaccg

SEQ ID NO: 3159565 - RNA, 17 nt, Mycobacterium bovis subsp bovis AF2122/97
gcgacccgguccacgcc

SEQ ID NO: 3159566 - RNA, 23 nt, Mycobacterium bovis subsp bovis AF2122/97
gcgacccguccaacuacgccagc

SEQ ID NO: 3159567 - RNA, 16 nt, Mycobacterium bovis subsp bovis AF2122/97
gcgacccgucccccgc

SEQ ID NO: 3159568 - RNA, 20 nt, Mycobacterium bovis subsp bovis AF2122/97
gcgacccgucccccgcacgc

SEQ ID NO: 3159569 - RNA, 12 nt, Mycobacterium bovis subsp bovis AF2122/97
gcgacccgucga

SEQ ID NO: 3159570 - RNA, 20 nt, Mycobacterium bovis subsp bovis AF2122/97
gcgacccgucgaacgcgcgc

SEQ ID NO: 3159571 - RNA, 21 nt, Mycobacterium bovis subsp bovis AF2122/97
gcgacccgucgaacgcgcgcg

SEQ ID NO: 3159572 - RNA, 23 nt, Mycobacterium bovis subsp bovis AF2122/97
gcgaccgaaaauucaggcgccgu

SEQ ID NO: 3159573 - RNA, 14 nt, Mycobacterium bovis subsp bovis AF2122/97
gcgaccgaccagcc

SEQ ID NO: 3159574 - RNA, 15 nt, Mycobacterium bovis subsp bovis AF2122/97
gcgaccgaccagccg

SEQ ID NO: 3159575 - RNA, 14 nt, Mycobacterium bovis subsp bovis AF2122/97
gcgaccgacgccgg

SEQ ID NO: 3159576 - RNA, 15 nt, Mycobacterium bovis subsp bovis AF2122/97
gcgaccgagacggcg

SEQ ID NO: 3159577 - RNA, 18 nt, Mycobacterium bovis subsp bovis AF2122/97
gcgaccgagacggcgucg

SEQ ID NO: 3159578 - RNA, 21 nt, Mycobacterium bovis subsp bovis AF2122/97
gcgaccgaugaucucacccag

SEQ ID NO: 3159579 - RNA, 12 nt, Mycobacterium bovis subsp bovis AF2122/97
gcgaccgccauu

SEQ ID NO: 3159580 - RNA, 20 nt, Mycobacterium bovis subsp bovis AF2122/97
gcgaccgccggaccgccgca

SEQ ID NO: 3159581 - RNA, 14 nt, Mycobacterium bovis subsp bovis AF2122/97
gcgaccgccugcgc

SEQ ID NO: 3159582 - RNA, 15 nt, Mycobacterium bovis subsp bovis AF2122/97
gcgaccgccugcgcg

SEQ ID NO: 3159583 - RNA, 13 nt, Mycobacterium bovis subsp bovis AF2122/97
gcgaccgcgaugg

SEQ ID NO: 3159584 - RNA, 11 nt, Mycobacterium bovis subsp bovis AF2122/97
gcgacgaucgu

SEQ ID NO: 3159585 - RNA, 17 nt, Mycobacterium bovis subsp bovis AF2122/97
gcgacgaucucgccgcc

SEQ ID NO: 3159586 - RNA, 21 nt, Mycobacterium bovis subsp bovis AF2122/97
gcgacgaucucgccgccagcg

SEQ ID NO: 3159587 - RNA, 17 nt, Mycobacterium bovis subsp bovis AF2122/97
gcgacgaucucggcggc

SEQ ID NO: 3159588 - RNA, 22 nt, Mycobacterium bovis subsp bovis AF2122/97
gcgacgaugaucucgcccaccu

SEQ ID NO: 3159589 - RNA, 16 nt, Mycobacterium bovis subsp bovis AF2122/97
gcgacgaugcagguga

SEQ ID NO: 3159590 - RNA, 16 nt, Mycobacterium bovis subsp bovis AF2122/97
gcgacgaugccccggu

SEQ ID NO: 3159591 - RNA, 16 nt, Mycobacterium bovis subsp bovis AF2122/97
gcgacgaugccgccug

SEQ ID NO: 3159592 - RNA, 23 nt, Mycobacterium bovis subsp bovis AF2122/97
gcgacgaugucgacucguggcgc

SEQ ID NO: 3159593 - RNA, 23 nt, Mycobacterium bovis subsp bovis AF2122/97
gcgacgaugucgagcgcgaucgg

SEQ ID NO: 3159594 - RNA, 21 nt, Mycobacterium bovis subsp bovis AF2122/97
gcgacgcaaagcagcgcaaug

SEQ ID NO: 3159595 - RNA, 17 nt, Mycobacterium bovis subsp bovis AF2122/97
gcgacgcagaccgucca

SEQ ID NO: 3159596 - RNA, 18 nt, Mycobacterium bovis subsp bovis AF2122/97
gcgacgcauaaccggcgc

SEQ ID NO: 3159597 - RNA, 22 nt, Mycobacterium bovis subsp bovis AF2122/97
gcgacgcauaaccggcgcgccc

SEQ ID NO: 3159598 - RNA, 15 nt, Mycobacterium bovis subsp bovis AF2122/97
gcgacgccaugguca

SEQ ID NO: 3159599 - RNA, 19 nt, Mycobacterium bovis subsp bovis AF2122/97
gcgacgccauggucagaua

SEQ ID NO: 3159600 - RNA, 16 nt, Mycobacterium bovis subsp bovis AF2122/97
gcgacgccaugucgau

SEQ ID NO: 3159601 - RNA, 17 nt, Mycobacterium bovis subsp bovis AF2122/97
gcgacgcccgccuucga

SEQ ID NO: 3159602 - RNA, 21 nt, Mycobacterium bovis subsp bovis AF2122/97
gcgacgccgaaaaugccgccc

SEQ ID NO: 3159603 - RNA, 22 nt, Mycobacterium bovis subsp bovis AF2122/97
gcgacgccgaaaaugccgccca

SEQ ID NO: 3159604 - RNA, 13 nt, Mycobacterium bovis subsp bovis AF2122/97
gcgacgccggccc

SEQ ID NO: 3159605 - RNA, 14 nt, Mycobacterium bovis subsp bovis AF2122/97
gcgacgccggcccg

SEQ ID NO: 3159606 - RNA, 18 nt, Mycobacterium bovis subsp bovis AF2122/97
gcgacgccggcccgacgg

SEQ ID NO: 3159607 - RNA, 14 nt, Mycobacterium bovis subsp bovis AF2122/97
gcgacgcgaccgcg

SEQ ID NO: 3159608 - RNA, 15 nt, Mycobacterium bovis subsp bovis AF2122/97
gcgacgcgaccgcga

SEQ ID NO: 3159609 - RNA, 19 nt, Mycobacterium bovis subsp bovis AF2122/97
gcgacgcggaguccgucga

SEQ ID NO: 3159610 - RNA, 17 nt, Mycobacterium bovis subsp bovis AF2122/97
gcgacgcggccagcggc

SEQ ID NO: 3159611 - RNA, 12 nt, Mycobacterium bovis subsp bovis AF2122/97
gcgacgcggcgc

SEQ ID NO: 3159612 - RNA, 15 nt, Mycobacterium bovis subsp bovis AF2122/97
gcgacgcggcgucgg

SEQ ID NO: 3159613 - RNA, 23 nt, Mycobacterium bovis subsp bovis AF2122/97
gcgacgcggggcucaaccccguc

SEQ ID NO: 3159614 - RNA, 15 nt, Mycobacterium bovis subsp bovis AF2122/97
gcgacgcggucaucg

SEQ ID NO: 3159615 - RNA, 16 nt, Mycobacterium bovis subsp bovis AF2122/97
gcgacgcuaccgccgg

SEQ ID NO: 3159616 - RNA, 14 nt, Mycobacterium bovis subsp bovis AF2122/97
gcgacgcucgcugc

SEQ ID NO: 3159617 - RNA, 17 nt, Mycobacterium bovis subsp bovis AF2122/97
gcgacgcucgcugcagc

SEQ ID NO: 3159618 - RNA, 18 nt, Mycobacterium bovis subsp bovis AF2122/97
gcgacggaccaucuccgg

SEQ ID NO: 3159619 - RNA, 15 nt, Mycobacterium bovis subsp bovis AF2122/97
gcgacggacucccuc

SEQ ID NO: 3159620 - RNA, 17 nt, Mycobacterium bovis subsp bovis AF2122/97
gcgacggacucccucga

SEQ ID NO: 3159621 - RNA, 14 nt, Mycobacterium bovis subsp bovis AF2122/97
gcgacggcaacguc

SEQ ID NO: 3159622 - RNA, 13 nt, Mycobacterium bovis subsp bovis AF2122/97
gcgacggcaagca

SEQ ID NO: 3159623 - RNA, 20 nt, Mycobacterium bovis subsp bovis AF2122/97
gcgacggcaagcacgguggc

SEQ ID NO: 3159624 - RNA, 22 nt, Mycobacterium bovis subsp bovis AF2122/97
gcgacggcagcucggggcacaa

SEQ ID NO: 3159625 - RNA, 21 nt, Mycobacterium bovis subsp bovis AF2122/97
gcgacggccaagaucggcgcc

SEQ ID NO: 3159626 - RNA, 13 nt, Mycobacterium bovis subsp bovis AF2122/97
gcgacggccagcg

SEQ ID NO: 3159627 - RNA, 18 nt, Mycobacterium bovis subsp bovis AF2122/97
gcgacggccagcgcgucg

SEQ ID NO: 3159628 - RNA, 19 nt, Mycobacterium bovis subsp bovis AF2122/97
gcgacggccagcgcgucgg

SEQ ID NO: 3159629 - RNA, 13 nt, Mycobacterium bovis subsp bovis AF2122/97
gcgacggccgcca

SEQ ID NO: 3159630 - RNA, 15 nt, Mycobacterium bovis subsp bovis AF2122/97
gcgacggccgccagc

SEQ ID NO: 3159631 - RNA, 22 nt, Mycobacterium bovis subsp bovis AF2122/97
gcgacggccgcucgggccagcg

SEQ ID NO: 3159632 - RNA, 13 nt, Mycobacterium bovis subsp bovis AF2122/97
gcgacggccggga

SEQ ID NO: 3159633 - RNA, 15 nt, Mycobacterium bovis subsp bovis AF2122/97
gcgacggcgcucggc

SEQ ID NO: 3159634 - RNA, 16 nt, Mycobacterium bovis subsp bovis AF2122/97
gcgacggcgcucggcg

SEQ ID NO: 3159635 - RNA, 18 nt, Mycobacterium bovis subsp bovis AF2122/97
gcgacggcgcucggcgag

SEQ ID NO: 3159636 - RNA, 11 nt, Mycobacterium bovis subsp bovis AF2122/97
gcgacggcggc

SEQ ID NO: 3159637 - RNA, 18 nt, Mycobacterium bovis subsp bovis AF2122/97
gcgacggcggcacgggcg

SEQ ID NO: 3159638 - RNA, 16 nt, Mycobacterium bovis subsp bovis AF2122/97
gcgacggcgucacccg

SEQ ID NO: 3159639 - RNA, 17 nt, Mycobacterium bovis subsp bovis AF2122/97
gcgacggcucuaccggu

SEQ ID NO: 3159640 - RNA, 19 nt, Mycobacterium bovis subsp bovis AF2122/97
gcgacgggcacccgagccg

SEQ ID NO: 3159641 - RNA, 15 nt, Mycobacterium bovis subsp bovis AF2122/97
gcgacgggccgcgaa

SEQ ID NO: 3159642 - RNA, 16 nt, Mycobacterium bovis subsp bovis AF2122/97
gcgacggggucgcgau

SEQ ID NO: 3159643 - RNA, 21 nt, Mycobacterium bovis subsp bovis AF2122/97
gcgacggucccuucgucaccg

SEQ ID NO: 3159644 - RNA, 19 nt, Mycobacterium bovis subsp bovis AF2122/97
gcgacggucgugaucggcg

SEQ ID NO: 3159645 - RNA, 15 nt, Mycobacterium bovis subsp bovis AF2122/97
gcgacggugccaccg

SEQ ID NO: 3159646 - RNA, 19 nt, Mycobacterium bovis subsp bovis AF2122/97
gcgacgguucccagcuucc

SEQ ID NO: 3159647 - RNA, 19 nt, Mycobacterium bovis subsp bovis AF2122/97
gcgacgguuucgaccacca

SEQ ID NO: 3159648 - RNA, 16 nt, Mycobacterium bovis subsp bovis AF2122/97
gcgacguagacgacgu

SEQ ID NO: 3159649 - RNA, 22 nt, Mycobacterium bovis subsp bovis AF2122/97
gcgacguaguggaagccgacca

SEQ ID NO: 3159650 - RNA, 21 nt, Mycobacterium bovis subsp bovis AF2122/97
gcgacguaguugccggcuucg

SEQ ID NO: 3159651 - RNA, 22 nt, Mycobacterium bovis subsp bovis AF2122/97
gcgacguauuucgcccccugga

SEQ ID NO: 3159652 - RNA, 17 nt, Mycobacterium bovis subsp bovis AF2122/97
gcgacgucaggguaucc

SEQ ID NO: 3159653 - RNA, 16 nt, Mycobacterium bovis subsp bovis AF2122/97
gcgacgucaucgccga

SEQ ID NO: 3159654 - RNA, 18 nt, Mycobacterium bovis subsp bovis AF2122/97
gcgacgucaucgccgacc

SEQ ID NO: 3159655 - RNA, 16 nt, Mycobacterium bovis subsp bovis AF2122/97
gcgacguccaccagcc

SEQ ID NO: 3159656 - RNA, 23 nt, Mycobacterium bovis subsp bovis AF2122/97
gcgacguccaccagccgguuggc

SEQ ID NO: 3159657 - RNA, 14 nt, Mycobacterium bovis subsp bovis AF2122/97
gcgacguccgcgac

SEQ ID NO: 3159658 - RNA, 16 nt, Mycobacterium bovis subsp bovis AF2122/97
gcgacgucgacaauca

SEQ ID NO: 3159659 - RNA, 22 nt, Mycobacterium bovis subsp bovis AF2122/97
gcgacgucgcaauaugccacag

SEQ ID NO: 3159660 - RNA, 13 nt, Mycobacterium bovis subsp bovis AF2122/97
gcgacgucggcgg

SEQ ID NO: 3159661 - RNA, 18 nt, Mycobacterium bovis subsp bovis AF2122/97
gcgacgucugccaggcgc

SEQ ID NO: 3159662 - RNA, 19 nt, Mycobacterium bovis subsp bovis AF2122/97
gcgacgucugccaggcgca

SEQ ID NO: 3159663 - RNA, 20 nt, Mycobacterium bovis subsp bovis AF2122/97
gcgacgucugccaggcgcag

SEQ ID NO: 3159664 - RNA, 21 nt, Mycobacterium bovis subsp bovis AF2122/97
gcgacgucugccaggcgcagc

SEQ ID NO: 3159665 - RNA, 22 nt, Mycobacterium bovis subsp bovis AF2122/97
gcgacgucugccaggcgcagcu

SEQ ID NO: 3159666 - RNA, 16 nt, Mycobacterium bovis subsp bovis AF2122/97
gcgacguggcgccgac

SEQ ID NO: 3159667 - RNA, 15 nt, Mycobacterium bovis subsp bovis AF2122/97
gcgacguuccgcucg

SEQ ID NO: 3159668 - RNA, 18 nt, Mycobacterium bovis subsp bovis AF2122/97
gcgacguuccgcucgagg

SEQ ID NO: 3159669 - RNA, 18 nt, Mycobacterium bovis subsp bovis AF2122/97
gcgacguugaacucgagu

SEQ ID NO: 3159670 - RNA, 17 nt, Mycobacterium bovis subsp bovis AF2122/97
gcgagcagggcgucgac

SEQ ID NO: 3159671 - RNA, 14 nt, Mycobacterium bovis subsp bovis AF2122/97
gcgagcaggggagu

SEQ ID NO: 3159672 - RNA, 14 nt, Mycobacterium bovis subsp bovis AF2122/97
gcgagcaggucgga

SEQ ID NO: 3159673 - RNA, 19 nt, Mycobacterium bovis subsp bovis AF2122/97
gcgagcagucgcaaaagcc

SEQ ID NO: 3159674 - RNA, 17 nt, Mycobacterium bovis subsp bovis AF2122/97
gcgagcauaccgccgcu

SEQ ID NO: 3159675 - RNA, 15 nt, Mycobacterium bovis subsp bovis AF2122/97
gcgagcaucgacgaa

SEQ ID NO: 3159676 - RNA, 20 nt, Mycobacterium bovis subsp bovis AF2122/97
gcgagcaucugggguccggu

SEQ ID NO: 3159677 - RNA, 17 nt, Mycobacterium bovis subsp bovis AF2122/97
gcgagcaugauguccuc

SEQ ID NO: 3159678 - RNA, 16 nt, Mycobacterium bovis subsp bovis AF2122/97
gcgagcaugccguuga

SEQ ID NO: 3159679 - RNA, 12 nt, Mycobacterium bovis subsp bovis AF2122/97
gcgagccaacuc

SEQ ID NO: 3159680 - RNA, 13 nt, Mycobacterium bovis subsp bovis AF2122/97
gcgagccagcugc

SEQ ID NO: 3159681 - RNA, 22 nt, Mycobacterium bovis subsp bovis AF2122/97
gcgagcccaccuggggccgcac

SEQ ID NO: 3159682 - RNA, 19 nt, Mycobacterium bovis subsp bovis AF2122/97
gcgagcccacguggggccg

SEQ ID NO: 3159683 - RNA, 21 nt, Mycobacterium bovis subsp bovis AF2122/97
gcgagcccacguggggccggg

SEQ ID NO: 3159684 - RNA, 13 nt, Mycobacterium bovis subsp bovis AF2122/97
gcgagcccagcug

SEQ ID NO: 3159685 - RNA, 14 nt, Mycobacterium bovis subsp bovis AF2122/97
gcgagcccagcugc

SEQ ID NO: 3159686 - RNA, 16 nt, Mycobacterium bovis subsp bovis AF2122/97
gcgagcccagcugcgc

SEQ ID NO: 3159687 - RNA, 18 nt, Mycobacterium bovis subsp bovis AF2122/97
gcgagcccagcugcgccg

SEQ ID NO: 3159688 - RNA, 20 nt, Mycobacterium bovis subsp bovis AF2122/97
gcgagcccggccucggcgag

SEQ ID NO: 3159689 - RNA, 14 nt, Mycobacterium bovis subsp bovis AF2122/97
gcgagccgcacgau

SEQ ID NO: 3159690 - RNA, 13 nt, Mycobacterium bovis subsp bovis AF2122/97
gcgagccgcgccc

SEQ ID NO: 3159691 - RNA, 12 nt, Mycobacterium bovis subsp bovis AF2122/97
gcgagccggcgc

SEQ ID NO: 3159692 - RNA, 13 nt, Mycobacterium bovis subsp bovis AF2122/97
gcgagccggcgcc

SEQ ID NO: 3159693 - RNA, 16 nt, Mycobacterium bovis subsp bovis AF2122/97
gcgagccguaucggac

SEQ ID NO: 3159694 - RNA, 15 nt, Mycobacterium bovis subsp bovis AF2122/97
gcgagccgugccagc

SEQ ID NO: 3159695 - RNA, 22 nt, Mycobacterium bovis subsp bovis AF2122/97
gcgagccugauaaagcccggcg

SEQ ID NO: 3159696 - RNA, 13 nt, Mycobacterium bovis subsp bovis AF2122/97
gcgagcgcacacc

SEQ ID NO: 3159697 - RNA, 13 nt, Mycobacterium bovis subsp bovis AF2122/97
gcgagcgcagcgc

SEQ ID NO: 3159698 - RNA, 22 nt, Mycobacterium bovis subsp bovis AF2122/97
gcgagcgcaucgauggccgcga

SEQ ID NO: 3159699 - RNA, 24 nt, Mycobacterium bovis subsp bovis AF2122/97
gcgagcgccaggucagcucgagcg

SEQ ID NO: 3159700 - RNA, 14 nt, Mycobacterium bovis subsp bovis AF2122/97
gcgagcgccuuucg

SEQ ID NO: 3159701 - RNA, 20 nt, Mycobacterium bovis subsp bovis AF2122/97
gcgagcgccuuucggucacg

SEQ ID NO: 3159702 - RNA, 12 nt, Mycobacterium bovis subsp bovis AF2122/97
gcgagcgcgcca

SEQ ID NO: 3159703 - RNA, 12 nt, Mycobacterium bovis subsp bovis AF2122/97
gcgagcgcgccg

SEQ ID NO: 3159704 - RNA, 15 nt, Mycobacterium bovis subsp bovis AF2122/97
gcgagcgcgccggcc

SEQ ID NO: 3159705 - RNA, 12 nt, Mycobacterium bovis subsp bovis AF2122/97
gcgagcgcgcgu

SEQ ID NO: 3159706 - RNA, 13 nt, Mycobacterium bovis subsp bovis AF2122/97
gcgagcgcgcgua

SEQ ID NO: 3159707 - RNA, 22 nt, Mycobacterium bovis subsp bovis AF2122/97
gcgagcgcggcggagccgggug

SEQ ID NO: 3159708 - RNA, 22 nt, Mycobacterium bovis subsp bovis AF2122/97
gcgagcggaauggaggccgccg

SEQ ID NO: 3159709 - RNA, 23 nt, Mycobacterium bovis subsp bovis AF2122/97
gcgagcggaauggaggccgccga

SEQ ID NO: 3159710 - RNA, 13 nt, Mycobacterium bovis subsp bovis AF2122/97
gcgagcggcacca

SEQ ID NO: 3159711 - RNA, 15 nt, Mycobacterium bovis subsp bovis AF2122/97
gcgagcggucgacgu

SEQ ID NO: 3159712 - RNA, 20 nt, Mycobacterium bovis subsp bovis AF2122/97
gcgagcguuuggacgggcgu

SEQ ID NO: 3159713 - RNA, 19 nt, Mycobacterium bovis subsp bovis AF2122/97
gcgagcucggccccgccgc

SEQ ID NO: 3159714 - RNA, 22 nt, Mycobacterium bovis subsp bovis AF2122/97
gcgagcucggccccgccgccgg

SEQ ID NO: 3159715 - RNA, 21 nt, Mycobacterium bovis subsp bovis AF2122/97
gcgagcugcgggucgcguuuc

SEQ ID NO: 3159716 - RNA, 23 nt, Mycobacterium bovis subsp bovis AF2122/97
gcgagcugcuuggcggucugcgc

SEQ ID NO: 3159717 - RNA, 16 nt, Mycobacterium bovis subsp bovis AF2122/97
gcgagcuggcguuccc

SEQ ID NO: 3159718 - RNA, 22 nt, Mycobacterium bovis subsp bovis AF2122/97
gcgagcuggcguucccgcucgg

SEQ ID NO: 3159719 - RNA, 19 nt, Mycobacterium bovis subsp bovis AF2122/97
gcgagcuguaggucagcgc

SEQ ID NO: 3159720 - RNA, 21 nt, Mycobacterium bovis subsp bovis AF2122/97
gcgagcuuggccagcagcagc

SEQ ID NO: 3159721 - RNA, 16 nt, Mycobacterium bovis subsp bovis AF2122/97
gcgaggaacgccgggg

SEQ ID NO: 3159722 - RNA, 17 nt, Mycobacterium bovis subsp bovis AF2122/97
gcgaggaacgccggggc

SEQ ID NO: 3159723 - RNA, 18 nt, Mycobacterium bovis subsp bovis AF2122/97
gcgaggaacgccggggcg

SEQ ID NO: 3159724 - RNA, 21 nt, Mycobacterium bovis subsp bovis AF2122/97
gcgaggaacuggaccggugcc

SEQ ID NO: 3159725 - RNA, 19 nt, Mycobacterium bovis subsp bovis AF2122/97
gcgaggaauuccgcuaccg

SEQ ID NO: 3159726 - RNA, 20 nt, Mycobacterium bovis subsp bovis AF2122/97
gcgaggaauuccgcuaccgc

SEQ ID NO: 3159727 - RNA, 21 nt, Mycobacterium bovis subsp bovis AF2122/97
gcgaggacagcugguugugcu

SEQ ID NO: 3159728 - RNA, 15 nt, Mycobacterium bovis subsp bovis AF2122/97
gcgaggagcagggcu

SEQ ID NO: 3159729 - RNA, 21 nt, Mycobacterium bovis subsp bovis AF2122/97
gcgaggaggcuuacaugcccu

SEQ ID NO: 3159730 - RNA, 21 nt, Mycobacterium bovis subsp bovis AF2122/97
gcgaggauccauuggaaccug

SEQ ID NO: 3159731 - RNA, 16 nt, Mycobacterium bovis subsp bovis AF2122/97
gcgaggaugcgcaaca

SEQ ID NO: 3159732 - RNA, 16 nt, Mycobacterium bovis subsp bovis AF2122/97
gcgaggaugcugagcg

SEQ ID NO: 3159733 - RNA, 18 nt, Mycobacterium bovis subsp bovis AF2122/97
gcgaggaugcugagcgcc

SEQ ID NO: 3159734 - RNA, 16 nt, Mycobacterium bovis subsp bovis AF2122/97
gcgaggcagcacccgc

SEQ ID NO: 3159735 - RNA, 13 nt, Mycobacterium bovis subsp bovis AF2122/97
gcgaggccucggc

SEQ ID NO: 3159736 - RNA, 14 nt, Mycobacterium bovis subsp bovis AF2122/97
gcgaggcgcucacc

SEQ ID NO: 3159737 - RNA, 15 nt, Mycobacterium bovis subsp bovis AF2122/97
gcgaggcgcucaccc

SEQ ID NO: 3159738 - RNA, 21 nt, Mycobacterium bovis subsp bovis AF2122/97
gcgaggcgcucacccgccgcg

SEQ ID NO: 3159739 - RNA, 22 nt, Mycobacterium bovis subsp bovis AF2122/97
gcgaggcgcucacccgccgcgg

SEQ ID NO: 3159740 - RNA, 16 nt, Mycobacterium bovis subsp bovis AF2122/97
gcgaggcggucgccga

SEQ ID NO: 3159741 - RNA, 20 nt, Mycobacterium bovis subsp bovis AF2122/97
gcgaggcguaaucaagcagc

SEQ ID NO: 3159742 - RNA, 17 nt, Mycobacterium bovis subsp bovis AF2122/97
gcgaggcucgcguggcc

SEQ ID NO: 3159743 - RNA, 19 nt, Mycobacterium bovis subsp bovis AF2122/97
gcgaggcucgcguggccgc

SEQ ID NO: 3159744 - RNA, 21 nt, Mycobacterium bovis subsp bovis AF2122/97
gcgaggcucgcguggccgccg

SEQ ID NO: 3159745 - RNA, 17 nt, Mycobacterium bovis subsp bovis AF2122/97
gcgaggcucguggcgac

SEQ ID NO: 3159746 - RNA, 19 nt, Mycobacterium bovis subsp bovis AF2122/97
gcgaggcucguggcgacgg

SEQ ID NO: 3159747 - RNA, 14 nt, Mycobacterium bovis subsp bovis AF2122/97
gcgagggcaacgag

SEQ ID NO: 3159748 - RNA, 17 nt, Mycobacterium bovis subsp bovis AF2122/97
gcgagggcacggcggug

SEQ ID NO: 3159749 - RNA, 14 nt, Mycobacterium bovis subsp bovis AF2122/97
gcgagggcgcgccg

SEQ ID NO: 3159750 - RNA, 22 nt, Mycobacterium bovis subsp bovis AF2122/97
gcgagggcggucagcggccaac

SEQ ID NO: 3159751 - RNA, 15 nt, Mycobacterium bovis subsp bovis AF2122/97
gcgagggcuaccggc

SEQ ID NO: 3159752 - RNA, 18 nt, Mycobacterium bovis subsp bovis AF2122/97
gcgagggcuaccggcgcc

SEQ ID NO: 3159753 - RNA, 20 nt, Mycobacterium bovis subsp bovis AF2122/97
gcgagggcuaccggcgccgc

SEQ ID NO: 3159754 - RNA, 22 nt, Mycobacterium bovis subsp bovis AF2122/97
gcgagggcuaccggcgccgcgc

SEQ ID NO: 3159755 - RNA, 23 nt, Mycobacterium bovis subsp bovis AF2122/97
gcgagggcuaccggcgccgcgcg

SEQ ID NO: 3159756 - RNA, 22 nt, Mycobacterium bovis subsp bovis AF2122/97
gcgaucaucaggugcgccuggc

SEQ ID NO: 3159757 - RNA, 16 nt, Mycobacterium bovis subsp bovis AF2122/97
gcgaucaugagcagca

SEQ ID NO: 3159758 - RNA, 21 nt, Mycobacterium bovis subsp bovis AF2122/97
gcgaucaugguggggaccgcg

SEQ ID NO: 3159759 - RNA, 19 nt, Mycobacterium bovis subsp bovis AF2122/97
gcgauccaccaagcucgca

SEQ ID NO: 3159760 - RNA, 15 nt, Mycobacterium bovis subsp bovis AF2122/97
gcgauccacuccggc

SEQ ID NO: 3159761 - RNA, 14 nt, Mycobacterium bovis subsp bovis AF2122/97
gcgauccagggccg

SEQ ID NO: 3159762 - RNA, 21 nt, Mycobacterium bovis subsp bovis AF2122/97
gcgauccagggccgacgcgaa

SEQ ID NO: 3159763 - RNA, 20 nt, Mycobacterium bovis subsp bovis AF2122/97
gcgaucccaacgcccgggcg

SEQ ID NO: 3159764 - RNA, 15 nt, Mycobacterium bovis subsp bovis AF2122/97
gcgauccccgcgcug

SEQ ID NO: 3159765 - RNA, 17 nt, Mycobacterium bovis subsp bovis AF2122/97
gcgauccccgcgcugag

SEQ ID NO: 3159766 - RNA, 13 nt, Mycobacterium bovis subsp bovis AF2122/97
gcgaucccgaucg

SEQ ID NO: 3159767 - RNA, 18 nt, Mycobacterium bovis subsp bovis AF2122/97
gcgaucccgaucgcgcug

SEQ ID NO: 3159768 - RNA, 13 nt, Mycobacterium bovis subsp bovis AF2122/97
gcgaucccgccgg

SEQ ID NO: 3159769 - RNA, 15 nt, Mycobacterium bovis subsp bovis AF2122/97
gcgaucccgccgggg

SEQ ID NO: 3159770 - RNA, 15 nt, Mycobacterium bovis subsp bovis AF2122/97
gcgaucccggcaaca

SEQ ID NO: 3159771 - RNA, 17 nt, Mycobacterium bovis subsp bovis AF2122/97
gcgaucccggccgucgc

SEQ ID NO: 3159772 - RNA, 16 nt, Mycobacterium bovis subsp bovis AF2122/97
gcgauccgagaccgcg

SEQ ID NO: 3159773 - RNA, 20 nt, Mycobacterium bovis subsp bovis AF2122/97
gcgauccgagaccgcgugcu

SEQ ID NO: 3159774 - RNA, 22 nt, Mycobacterium bovis subsp bovis AF2122/97
gcgauccgagaccgcgugcucg

SEQ ID NO: 3159775 - RNA, 15 nt, Mycobacterium bovis subsp bovis AF2122/97
gcgauccgcggcguu

SEQ ID NO: 3159776 - RNA, 19 nt, Mycobacterium bovis subsp bovis AF2122/97
gcgauccgcugcgccgagg

SEQ ID NO: 3159777 - RNA, 12 nt, Mycobacterium bovis subsp bovis AF2122/97
gcgauccggcgc

SEQ ID NO: 3159778 - RNA, 19 nt, Mycobacterium bovis subsp bovis AF2122/97
gcgauccggucggccaggc

SEQ ID NO: 3159779 - RNA, 20 nt, Mycobacterium bovis subsp bovis AF2122/97
gcgauccggucggccaggcc

SEQ ID NO: 3159780 - RNA, 21 nt, Mycobacterium bovis subsp bovis AF2122/97
gcgauccggucggccaggccg

SEQ ID NO: 3159781 - RNA, 15 nt, Mycobacterium bovis subsp bovis AF2122/97
gcgauccggucgggg

SEQ ID NO: 3159782 - RNA, 15 nt, Mycobacterium bovis subsp bovis AF2122/97
gcgauccugaccagc

SEQ ID NO: 3159783 - RNA, 16 nt, Mycobacterium bovis subsp bovis AF2122/97
gcgaucgacgcucggc

SEQ ID NO: 3159784 - RNA, 20 nt, Mycobacterium bovis subsp bovis AF2122/97
gcgaucgaggagaugccgac

SEQ ID NO: 3159785 - RNA, 24 nt, Mycobacterium bovis subsp bovis AF2122/97
gcgaucgauuccgcucguucgugc

SEQ ID NO: 3159786 - RNA, 14 nt, Mycobacterium bovis subsp bovis AF2122/97
gcgaucgcaacacc

SEQ ID NO: 3159787 - RNA, 15 nt, Mycobacterium bovis subsp bovis AF2122/97
gcgaucgcaacaccg

SEQ ID NO: 3159788 - RNA, 16 nt, Mycobacterium bovis subsp bovis AF2122/97
gcgaucgcaacaccgg

SEQ ID NO: 3159789 - RNA, 16 nt, Mycobacterium bovis subsp bovis AF2122/97
gcgaucgcauccgcgg

SEQ ID NO: 3159790 - RNA, 22 nt, Mycobacterium bovis subsp bovis AF2122/97
gcgaucgccggccgcgugacgu

SEQ ID NO: 3159791 - RNA, 23 nt, Mycobacterium bovis subsp bovis AF2122/97
gcgaucgccugggcuuggcgacg

SEQ ID NO: 3159792 - RNA, 21 nt, Mycobacterium bovis subsp bovis AF2122/97
gcgaucgcgacgaugccccgg

SEQ ID NO: 3159793 - RNA, 14 nt, Mycobacterium bovis subsp bovis AF2122/97
gcgaucgcgagcga

SEQ ID NO: 3159794 - RNA, 16 nt, Mycobacterium bovis subsp bovis AF2122/97
gcgaucgcgagcgagc

SEQ ID NO: 3159795 - RNA, 13 nt, Mycobacterium bovis subsp bovis AF2122/97
gcgaucgcgcccg

SEQ ID NO: 3159796 - RNA, 20 nt, Mycobacterium bovis subsp bovis AF2122/97
gcgaucgcgcccgcugagcc

SEQ ID NO: 3159797 - RNA, 21 nt, Mycobacterium bovis subsp bovis AF2122/97
gcgaucgcggcgagcaccacc

SEQ ID NO: 3159798 - RNA, 14 nt, Mycobacterium bovis subsp bovis AF2122/97
gcgaucgcgugcgg

SEQ ID NO: 3159799 - RNA, 16 nt, Mycobacterium bovis subsp bovis AF2122/97
gcgaucgcuccgcggc

SEQ ID NO: 3159800 - RNA, 17 nt, Mycobacterium bovis subsp bovis AF2122/97
gcgaucgcuccgcggcg

SEQ ID NO: 3159801 - RNA, 17 nt, Mycobacterium bovis subsp bovis AF2122/97
gcgaucgcuucgcaagu

SEQ ID NO: 3159802 - RNA, 23 nt, Mycobacterium bovis subsp bovis AF2122/97
gcgaucggcacuuagcccgaugg

SEQ ID NO: 3159803 - RNA, 12 nt, Mycobacterium bovis subsp bovis AF2122/97
gcgaucggcaug

SEQ ID NO: 3159804 - RNA, 19 nt, Mycobacterium bovis subsp bovis AF2122/97
gcgaucggcgucacgagcc

SEQ ID NO: 3159805 - RNA, 16 nt, Mycobacterium bovis subsp bovis AF2122/97
gcgaucgggccggcgc

SEQ ID NO: 3159806 - RNA, 17 nt, Mycobacterium bovis subsp bovis AF2122/97
gcgaucgggccggcgcg

SEQ ID NO: 3159807 - RNA, 22 nt, Mycobacterium bovis subsp bovis AF2122/97
gcgaucggggcgacgauccgca

SEQ ID NO: 3159808 - RNA, 15 nt, Mycobacterium bovis subsp bovis AF2122/97
gcgaucggugaaucg

SEQ ID NO: 3159809 - RNA, 17 nt, Mycobacterium bovis subsp bovis AF2122/97
gcgaucggugccgaagc

SEQ ID NO: 3159810 - RNA, 18 nt, Mycobacterium bovis subsp bovis AF2122/97
gcgaucggugcgggcgcc

SEQ ID NO: 3159811 - RNA, 21 nt, Mycobacterium bovis subsp bovis AF2122/97
gcgaucggugcgggcgccgcu

SEQ ID NO: 3159812 - RNA, 14 nt, Mycobacterium bovis subsp bovis AF2122/97
gcgaucgucaagcc

SEQ ID NO: 3159813 - RNA, 17 nt, Mycobacterium bovis subsp bovis AF2122/97
gcgaucgucagccagcg

SEQ ID NO: 3159814 - RNA, 23 nt, Mycobacterium bovis subsp bovis AF2122/97
gcgaucgucgacucggcggcgcg

SEQ ID NO: 3159815 - RNA, 18 nt, Mycobacterium bovis subsp bovis AF2122/97
gcgaucgugcugcccgca

SEQ ID NO: 3159816 - RNA, 19 nt, Mycobacterium bovis subsp bovis AF2122/97
gcgaucgugcugcccgcaa

SEQ ID NO: 3159817 - RNA, 14 nt, Mycobacterium bovis subsp bovis AF2122/97
gcgaucuccuuggc

SEQ ID NO: 3159818 - RNA, 22 nt, Mycobacterium bovis subsp bovis AF2122/97
gcgaucuccuuggccguucggc

SEQ ID NO: 3159819 - RNA, 13 nt, Mycobacterium bovis subsp bovis AF2122/97
gcgaucucgaccg

SEQ ID NO: 3159820 - RNA, 13 nt, Mycobacterium bovis subsp bovis AF2122/97
gcgaucucgacgg

SEQ ID NO: 3159821 - RNA, 19 nt, Mycobacterium bovis subsp bovis AF2122/97
gcgaucucuaccagccgcc

SEQ ID NO: 3159822 - RNA, 22 nt, Mycobacterium bovis subsp bovis AF2122/97
gcgaucucuugguagugacugc

SEQ ID NO: 3159823 - RNA, 16 nt, Mycobacterium bovis subsp bovis AF2122/97
gcgaucugcgacaaga

SEQ ID NO: 3159824 - RNA, 18 nt, Mycobacterium bovis subsp bovis AF2122/97
gcgaucugcgacaagacc

SEQ ID NO: 3159825 - RNA, 23 nt, Mycobacterium bovis subsp bovis AF2122/97
gcgaucugcgacaagaccggcgg

SEQ ID NO: 3159826 - RNA, 20 nt, Mycobacterium bovis subsp bovis AF2122/97
gcgaucugcgcgaugcccac

SEQ ID NO: 3159827 - RNA, 17 nt, Mycobacterium bovis subsp bovis AF2122/97
gcgaucugcggcgcccg

SEQ ID NO: 3159828 - RNA, 18 nt, Mycobacterium bovis subsp bovis AF2122/97
gcgaucugcggcgcccgg

SEQ ID NO: 3159829 - RNA, 13 nt, Mycobacterium bovis subsp bovis AF2122/97
gcgaucugcucgu

SEQ ID NO: 3159830 - RNA, 15 nt, Mycobacterium bovis subsp bovis AF2122/97
gcgaucugcuguguc

SEQ ID NO: 3159831 - RNA, 21 nt, Mycobacterium bovis subsp bovis AF2122/97
gcgaucuggucggcggccucg

SEQ ID NO: 3159832 - RNA, 17 nt, Mycobacterium bovis subsp bovis AF2122/97
gcgaucuugcgacgccc

SEQ ID NO: 3159833 - RNA, 22 nt, Mycobacterium bovis subsp bovis AF2122/97
gcgaucuugcgacgcccgccuu

SEQ ID NO: 3159834 - RNA, 23 nt, Mycobacterium bovis subsp bovis AF2122/97
gcgaucuugcgacgcccgccuuc

SEQ ID NO: 3159835 - RNA, 14 nt, Mycobacterium bovis subsp bovis AF2122/97
gcgaucuuggaucg

SEQ ID NO: 3159836 - RNA, 22 nt, Mycobacterium bovis subsp bovis AF2122/97
gcgaucuuggcgacaugcagcg

SEQ ID NO: 3159837 - RNA, 18 nt, Mycobacterium bovis subsp bovis AF2122/97
gcgaucuugguggccuca

SEQ ID NO: 3159838 - RNA, 23 nt, Mycobacterium bovis subsp bovis AF2122/97
gcgaucuuguccaggguggucag

SEQ ID NO: 3159839 - RNA, 16 nt, Mycobacterium bovis subsp bovis AF2122/97
gcgaugaacgggaucg

SEQ ID NO: 3159840 - RNA, 21 nt, Mycobacterium bovis subsp bovis AF2122/97
gcgaugaauucuuuggggcgc

SEQ ID NO: 3159841 - RNA, 16 nt, Mycobacterium bovis subsp bovis AF2122/97
gcgaugacaucaccga

SEQ ID NO: 3159842 - RNA, 21 nt, Mycobacterium bovis subsp bovis AF2122/97
gcgcacaaacgacucgcggug

SEQ ID NO: 3159843 - RNA, 17 nt, Mycobacterium bovis subsp bovis AF2122/97
gcgcacaacccgucgag

SEQ ID NO: 3159844 - RNA, 13 nt, Mycobacterium bovis subsp bovis AF2122/97
gcgcacacccugc

SEQ ID NO: 3159845 - RNA, 16 nt, Mycobacterium bovis subsp bovis AF2122/97
gcgcacacccugcagc

SEQ ID NO: 3159846 - RNA, 17 nt, Mycobacterium bovis subsp bovis AF2122/97
gcgcacacuaccgccgc

SEQ ID NO: 3159847 - RNA, 18 nt, Mycobacterium bovis subsp bovis AF2122/97
gcgcacacuaccgccgcg

SEQ ID NO: 3159848 - RNA, 20 nt, Mycobacterium bovis subsp bovis AF2122/97
gcgcacacuaccgccgcgac

SEQ ID NO: 3159849 - RNA, 13 nt, Mycobacterium bovis subsp bovis AF2122/97
gcgcacagcgagc

SEQ ID NO: 3159850 - RNA, 15 nt, Mycobacterium bovis subsp bovis AF2122/97
gcgcacagcgagcac

SEQ ID NO: 3159851 - RNA, 18 nt, Mycobacterium bovis subsp bovis AF2122/97
gcgcacauaggcgaucgc

SEQ ID NO: 3159852 - RNA, 14 nt, Mycobacterium bovis subsp bovis AF2122/97
gcgcacaucgcgaa

SEQ ID NO: 3159853 - RNA, 16 nt, Mycobacterium bovis subsp bovis AF2122/97
gcgcacaucgcgaaac

SEQ ID NO: 3159854 - RNA, 21 nt, Mycobacterium bovis subsp bovis AF2122/97
gcgcacaugguuuucaguagg

SEQ ID NO: 3159855 - RNA, 17 nt, Mycobacterium bovis subsp bovis AF2122/97
gcgcaccaacaccagcg

SEQ ID NO: 3159856 - RNA, 18 nt, Mycobacterium bovis subsp bovis AF2122/97
gcgcaccaacaccagcgc

SEQ ID NO: 3159857 - RNA, 17 nt, Mycobacterium bovis subsp bovis AF2122/97
gcgcaccaagacgccac

SEQ ID NO: 3159858 - RNA, 19 nt, Mycobacterium bovis subsp bovis AF2122/97
gcgcaccaagacgccaccc

SEQ ID NO: 3159859 - RNA, 14 nt, Mycobacterium bovis subsp bovis AF2122/97
gcgcaccaccgagc

SEQ ID NO: 3159860 - RNA, 13 nt, Mycobacterium bovis subsp bovis AF2122/97
gcgcaccaccgcc

SEQ ID NO: 3159861 - RNA, 20 nt, Mycobacterium bovis subsp bovis AF2122/97
gcgcaccaccgucucgccgc

SEQ ID NO: 3159862 - RNA, 11 nt, Mycobacterium bovis subsp bovis AF2122/97
gcgcaccaccu

SEQ ID NO: 3159863 - RNA, 12 nt, Mycobacterium bovis subsp bovis AF2122/97
gcgcaccagcac

SEQ ID NO: 3159864 - RNA, 17 nt, Mycobacterium bovis subsp bovis AF2122/97
gcgcaccaggcggccgu

SEQ ID NO: 3159865 - RNA, 18 nt, Mycobacterium bovis subsp bovis AF2122/97
gcgcaccaucgcggccgc

SEQ ID NO: 3159866 - RNA, 13 nt, Mycobacterium bovis subsp bovis AF2122/97
gcgcacccagccc

SEQ ID NO: 3159867 - RNA, 17 nt, Mycobacterium bovis subsp bovis AF2122/97
gcgcacccagcccagcc

SEQ ID NO: 3159868 - RNA, 19 nt, Mycobacterium bovis subsp bovis AF2122/97
gcgcacccagcccagccgu

SEQ ID NO: 3159869 - RNA, 21 nt, Mycobacterium bovis subsp bovis AF2122/97
gcgcaccccgcuugcgcggcu

SEQ ID NO: 3159870 - RNA, 15 nt, Mycobacterium bovis subsp bovis AF2122/97
gcgcacccgcggguc

SEQ ID NO: 3159871 - RNA, 22 nt, Mycobacterium bovis subsp bovis AF2122/97
gcgcacccgcgggucguccggc

SEQ ID NO: 3159872 - RNA, 16 nt, Mycobacterium bovis subsp bovis AF2122/97
gcgcacccggucggcg

SEQ ID NO: 3159873 - RNA, 17 nt, Mycobacterium bovis subsp bovis AF2122/97
gcgcacccguccgccgc

SEQ ID NO: 3159874 - RNA, 18 nt, Mycobacterium bovis subsp bovis AF2122/97
gcgcacccguccgccgca

SEQ ID NO: 3159875 - RNA, 18 nt, Mycobacterium bovis subsp bovis AF2122/97
gcgcacccugcgugcggc

SEQ ID NO: 3159876 - RNA, 17 nt, Mycobacterium bovis subsp bovis AF2122/97
gcgcaccgaccgcaccg

SEQ ID NO: 3159877 - RNA, 19 nt, Mycobacterium bovis subsp bovis AF2122/97
gcgcaccgcauaacgcgaa

SEQ ID NO: 3159878 - RNA, 22 nt, Mycobacterium bovis subsp bovis AF2122/97
gcgcaccgccgauguggucggc

SEQ ID NO: 3159879 - RNA, 12 nt, Mycobacterium bovis subsp bovis AF2122/97
gcgcaccgccgc

SEQ ID NO: 3159880 - RNA, 14 nt, Mycobacterium bovis subsp bovis AF2122/97
gcgcaccgccgcgc

SEQ ID NO: 3159881 - RNA, 15 nt, Mycobacterium bovis subsp bovis AF2122/97
gcgcaccgcugaccg

SEQ ID NO: 3159882 - RNA, 13 nt, Mycobacterium bovis subsp bovis AF2122/97
gcgcaccggcguc

SEQ ID NO: 3159883 - RNA, 15 nt, Mycobacterium bovis subsp bovis AF2122/97
gcgcaccggcgucgg

SEQ ID NO: 3159884 - RNA, 18 nt, Mycobacterium bovis subsp bovis AF2122/97
gcgcaccggcgucggcgc

SEQ ID NO: 3159885 - RNA, 19 nt, Mycobacterium bovis subsp bovis AF2122/97
gcgcaccggcgucggcgcg

SEQ ID NO: 3159886 - RNA, 20 nt, Mycobacterium bovis subsp bovis AF2122/97
gcgcaccggcgucggcgcgg

SEQ ID NO: 3159887 - RNA, 20 nt, Mycobacterium bovis subsp bovis AF2122/97
gcgcaccggcuggcccagcg

SEQ ID NO: 3159888 - RNA, 21 nt, Mycobacterium bovis subsp bovis AF2122/97
gcgcaccggguugagccgccg

SEQ ID NO: 3159889 - RNA, 15 nt, Mycobacterium bovis subsp bovis AF2122/97
gcgcaccggucaacg

SEQ ID NO: 3159890 - RNA, 15 nt, Mycobacterium bovis subsp bovis AF2122/97
gcgcaccguggcgga

SEQ ID NO: 3159891 - RNA, 14 nt, Mycobacterium bovis subsp bovis AF2122/97
gcgcaccugaaggc

SEQ ID NO: 3159892 - RNA, 19 nt, Mycobacterium bovis subsp bovis AF2122/97
gcgcaccuggcgcgcgcaa

SEQ ID NO: 3159893 - RNA, 17 nt, Mycobacterium bovis subsp bovis AF2122/97
gcgcaccugggcugccg

SEQ ID NO: 3159894 - RNA, 18 nt, Mycobacterium bovis subsp bovis AF2122/97
gcgcaccugggucgacga

SEQ ID NO: 3159895 - RNA, 15 nt, Mycobacterium bovis subsp bovis AF2122/97
gcgcaccuugaccgu

SEQ ID NO: 3159896 - RNA, 18 nt, Mycobacterium bovis subsp bovis AF2122/97
gcgcaccuugaccgucgc

SEQ ID NO: 3159897 - RNA, 13 nt, Mycobacterium bovis subsp bovis AF2122/97
gcgcacgaaaccg

SEQ ID NO: 3159898 - RNA, 15 nt, Mycobacterium bovis subsp bovis AF2122/97
gcgcacgauagccac

SEQ ID NO: 3159899 - RNA, 17 nt, Mycobacterium bovis subsp bovis AF2122/97
gcgcacgccaccgggac

SEQ ID NO: 3159900 - RNA, 18 nt, Mycobacterium bovis subsp bovis AF2122/97
gcgcacgccaccgggacg

SEQ ID NO: 3159901 - RNA, 14 nt, Mycobacterium bovis subsp bovis AF2122/97
gcgcacgcccgcac

SEQ ID NO: 3159902 - RNA, 21 nt, Mycobacterium bovis subsp bovis AF2122/97
gcgcacgcccugaagggccgc

SEQ ID NO: 3159903 - RNA, 22 nt, Mycobacterium bovis subsp bovis AF2122/97
gcgcacgcccugaagggccgcc

SEQ ID NO: 3159904 - RNA, 23 nt, Mycobacterium bovis subsp bovis AF2122/97
gcgcacgcccugaagggccgccu

SEQ ID NO: 3159905 - RNA, 18 nt, Mycobacterium bovis subsp bovis AF2122/97
gcgcacgcccuggugucg

SEQ ID NO: 3159906 - RNA, 21 nt, Mycobacterium bovis subsp bovis AF2122/97
gcgcacgcgugccgcaaccgg

SEQ ID NO: 3159907 - RNA, 15 nt, Mycobacterium bovis subsp bovis AF2122/97
gcgcacggcccgagc

SEQ ID NO: 3159908 - RNA, 17 nt, Mycobacterium bovis subsp bovis AF2122/97
gcgcacggcccgagccg

SEQ ID NO: 3159909 - RNA, 18 nt, Mycobacterium bovis subsp bovis AF2122/97
gcgcacggcccgagccgc

SEQ ID NO: 3159910 - RNA, 13 nt, Mycobacterium bovis subsp bovis AF2122/97
gcgcacggcggcc

SEQ ID NO: 3159911 - RNA, 14 nt, Mycobacterium bovis subsp bovis AF2122/97
gcgcacggcgucgg

SEQ ID NO: 3159912 - RNA, 19 nt, Mycobacterium bovis subsp bovis AF2122/97
gcgcacggcgucggccacc

SEQ ID NO: 3159913 - RNA, 22 nt, Mycobacterium bovis subsp bovis AF2122/97
gcgcacggcgucggccaccgcc

SEQ ID NO: 3159914 - RNA, 13 nt, Mycobacterium bovis subsp bovis AF2122/97
gcgcacggcuggc

SEQ ID NO: 3159915 - RNA, 14 nt, Mycobacterium bovis subsp bovis AF2122/97
gcgcacggcuggcg

SEQ ID NO: 3159916 - RNA, 12 nt, Mycobacterium bovis subsp bovis AF2122/97
gcgcacgucggg

SEQ ID NO: 3159917 - RNA, 22 nt, Mycobacterium bovis subsp bovis AF2122/97
gcgcacuacucgaacaaccccg

SEQ ID NO: 3159918 - RNA, 22 nt, Mycobacterium bovis subsp bovis AF2122/97
gcgcacucccggauauugccau

SEQ ID NO: 3159919 - RNA, 21 nt, Mycobacterium bovis subsp bovis AF2122/97
gcgcacucccggcucggccag

SEQ ID NO: 3159920 - RNA, 22 nt, Mycobacterium bovis subsp bovis AF2122/97
gcgcacucccggcucggccagc

SEQ ID NO: 3159921 - RNA, 13 nt, Mycobacterium bovis subsp bovis AF2122/97
gcgcacucgacgc

SEQ ID NO: 3159922 - RNA, 16 nt, Mycobacterium bovis subsp bovis AF2122/97
gcgcacucuagccggg

SEQ ID NO: 3159923 - RNA, 23 nt, Mycobacterium bovis subsp bovis AF2122/97
gcgcacucuuuccuuccgcgaug

SEQ ID NO: 3159924 - RNA, 23 nt, Mycobacterium bovis subsp bovis AF2122/97
gcgcacuggggaggccaacccug

SEQ ID NO: 3159925 - RNA, 17 nt, Mycobacterium bovis subsp bovis AF2122/97
gcgcacuugcguggcgu

SEQ ID NO: 3159926 - RNA, 16 nt, Mycobacterium bovis subsp bovis AF2122/97
gcgcagaaacgccgag

SEQ ID NO: 3159927 - RNA, 18 nt, Mycobacterium bovis subsp bovis AF2122/97
gcgcagaaagucgcgcgc

SEQ ID NO: 3159928 - RNA, 19 nt, Mycobacterium bovis subsp bovis AF2122/97
gcgcagaaagucgcgcgcg

SEQ ID NO: 3159929 - RNA, 15 nt, Mycobacterium bovis subsp bovis AF2122/97
gcgcagggcgacauu

SEQ ID NO: 3159930 - RNA, 23 nt, Mycobacterium bovis subsp bovis AF2122/97
gcgcagggcgacauugcgagcgc

SEQ ID NO: 3159931 - RNA, 18 nt, Mycobacterium bovis subsp bovis AF2122/97
gcgcagggcgucggcgaa

SEQ ID NO: 3159932 - RNA, 13 nt, Mycobacterium bovis subsp bovis AF2122/97
gcgcaggggcggc

SEQ ID NO: 3159933 - RNA, 14 nt, Mycobacterium bovis subsp bovis AF2122/97
gcgcaggggcggcg

SEQ ID NO: 3159934 - RNA, 16 nt, Mycobacterium bovis subsp bovis AF2122/97
gcgcaggggcggcgug

SEQ ID NO: 3159935 - RNA, 22 nt, Mycobacterium bovis subsp bovis AF2122/97
gcgcagguagccaucggugcgc

SEQ ID NO: 3159936 - RNA, 19 nt, Mycobacterium bovis subsp bovis AF2122/97
gcgcagguagcgccgcacu

SEQ ID NO: 3159937 - RNA, 15 nt, Mycobacterium bovis subsp bovis AF2122/97
gcgcagguagucgac

SEQ ID NO: 3159938 - RNA, 22 nt, Mycobacterium bovis subsp bovis AF2122/97
gcgcagguagucgacgacgugg

SEQ ID NO: 3159939 - RNA, 21 nt, Mycobacterium bovis subsp bovis AF2122/97
gcgcagguaucgguauaacga

SEQ ID NO: 3159940 - RNA, 18 nt, Mycobacterium bovis subsp bovis AF2122/97
gcgcaggugccuuucggc

SEQ ID NO: 3159941 - RNA, 17 nt, Mycobacterium bovis subsp bovis AF2122/97
gcgcaggugcugggcga

SEQ ID NO: 3159942 - RNA, 23 nt, Mycobacterium bovis subsp bovis AF2122/97
gcgcaguaacgucgucgcgucgc

SEQ ID NO: 3159943 - RNA, 23 nt, Mycobacterium bovis subsp bovis AF2122/97
gcgcaguacuugaccguccaccg

SEQ ID NO: 3159944 - RNA, 18 nt, Mycobacterium bovis subsp bovis AF2122/97
gcgcaguagccgaccagg

SEQ ID NO: 3159945 - RNA, 15 nt, Mycobacterium bovis subsp bovis AF2122/97
gcgcagugcaccgcg

SEQ ID NO: 3159946 - RNA, 18 nt, Mycobacterium bovis subsp bovis AF2122/97
gcgcaguucgucguggau

SEQ ID NO: 3159947 - RNA, 18 nt, Mycobacterium bovis subsp bovis AF2122/97
gcgcaguuggcaccagcc

SEQ ID NO: 3159948 - RNA, 20 nt, Mycobacterium bovis subsp bovis AF2122/97
gcgcaguuggcaccagccgg

SEQ ID NO: 3159949 - RNA, 17 nt, Mycobacterium bovis subsp bovis AF2122/97
gcgcaguuuggcggcgc

SEQ ID NO: 3159950 - RNA, 17 nt, Mycobacterium bovis subsp bovis AF2122/97
gcgcauaccggcgucgu

SEQ ID NO: 3159951 - RNA, 21 nt, Mycobacterium bovis subsp bovis AF2122/97
gcgcauaccuacccgagaacg

SEQ ID NO: 3159952 - RNA, 19 nt, Mycobacterium bovis subsp bovis AF2122/97
gcgcauaggcuuccggcgc

SEQ ID NO: 3159953 - RNA, 20 nt, Mycobacterium bovis subsp bovis AF2122/97
gcgcauaggcuuccggcgcg

SEQ ID NO: 3159954 - RNA, 17 nt, Mycobacterium bovis subsp bovis AF2122/97
gcgcauagggccaccgc

SEQ ID NO: 3159955 - RNA, 23 nt, Mycobacterium bovis subsp bovis AF2122/97
gcgcauagggccaccgccgccug

SEQ ID NO: 3159956 - RNA, 13 nt, Mycobacterium bovis subsp bovis AF2122/97
gcgcaucaacgga

SEQ ID NO: 3159957 - RNA, 22 nt, Mycobacterium bovis subsp bovis AF2122/97
gcgcaucagcuuuugcaccgga

SEQ ID NO: 3159958 - RNA, 17 nt, Mycobacterium bovis subsp bovis AF2122/97
gcgcaucaucgcccacc

SEQ ID NO: 3159959 - RNA, 14 nt, Mycobacterium bovis subsp bovis AF2122/97
gcgcaucccgaagu

SEQ ID NO: 3159960 - RNA, 22 nt, Mycobacterium bovis subsp bovis AF2122/97
gcgcauccgguuuggucgccgc

SEQ ID NO: 3159961 - RNA, 19 nt, Mycobacterium bovis subsp bovis AF2122/97
gcgcauccgucguacacgc

SEQ ID NO: 3159962 - RNA, 14 nt, Mycobacterium bovis subsp bovis AF2122/97
gcgcaucgagcacc

SEQ ID NO: 3159963 - RNA, 17 nt, Mycobacterium bovis subsp bovis AF2122/97
gcgcaucgagcaccucc

SEQ ID NO: 3159964 - RNA, 14 nt, Mycobacterium bovis subsp bovis AF2122/97
gcgcaucgcacggg

SEQ ID NO: 3159965 - RNA, 16 nt, Mycobacterium bovis subsp bovis AF2122/97
gcgcaucgcacgggcc

SEQ ID NO: 3159966 - RNA, 20 nt, Mycobacterium bovis subsp bovis AF2122/97
gcgcaucgcacgggccacca

SEQ ID NO: 3159967 - RNA, 21 nt, Mycobacterium bovis subsp bovis AF2122/97
gcgcaucgcacgggccaccag

SEQ ID NO: 3159968 - RNA, 23 nt, Mycobacterium bovis subsp bovis AF2122/97
gcgcaucgcacgggccaccagcg

SEQ ID NO: 3159969 - RNA, 14 nt, Mycobacterium bovis subsp bovis AF2122/97
gcgcaucgccgaca

SEQ ID NO: 3159970 - RNA, 18 nt, Mycobacterium bovis subsp bovis AF2122/97
gcgcaucgccgacagcgc

SEQ ID NO: 3159971 - RNA, 12 nt, Mycobacterium bovis subsp bovis AF2122/97
gcgcaucgccgc

SEQ ID NO: 3159972 - RNA, 15 nt, Mycobacterium bovis subsp bovis AF2122/97
gcgcaucgccgcugg

SEQ ID NO: 3159973 - RNA, 18 nt, Mycobacterium bovis subsp bovis AF2122/97
gcgcaucggccagcagcg

SEQ ID NO: 3159974 - RNA, 20 nt, Mycobacterium bovis subsp bovis AF2122/97
gcgcaucggccagcagcgac

SEQ ID NO: 3159975 - RNA, 14 nt, Mycobacterium bovis subsp bovis AF2122/97
gcgcaucgucgaaa

SEQ ID NO: 3159976 - RNA, 21 nt, Mycobacterium bovis subsp bovis AF2122/97
gcgcaucugucgcgcggcaau

SEQ ID NO: 3159977 - RNA, 22 nt, Mycobacterium bovis subsp bovis AF2122/97
gcgcaucuuggugccauucgac

SEQ ID NO: 3159978 - RNA, 18 nt, Mycobacterium bovis subsp bovis AF2122/97
gcgcaugcaagucaaacg

SEQ ID NO: 3159979 - RNA, 18 nt, Mycobacterium bovis subsp bovis AF2122/97
gcgcaugccccgaccgcg

SEQ ID NO: 3159980 - RNA, 16 nt, Mycobacterium bovis subsp bovis AF2122/97
gcgcauggccaaaaac

SEQ ID NO: 3159981 - RNA, 18 nt, Mycobacterium bovis subsp bovis AF2122/97
gcgcaugucgauccggcg

SEQ ID NO: 3159982 - RNA, 19 nt, Mycobacterium bovis subsp bovis AF2122/97
gcgcauguuaugagcgcuc

SEQ ID NO: 3159983 - RNA, 22 nt, Mycobacterium bovis subsp bovis AF2122/97
gcgcauguuaugagcgcucggg

SEQ ID NO: 3159984 - RNA, 19 nt, Mycobacterium bovis subsp bovis AF2122/97
gcgcauguugcaggcgcag

SEQ ID NO: 3159985 - RNA, 15 nt, Mycobacterium bovis subsp bovis AF2122/97
gcgcauuccggcgcc

SEQ ID NO: 3159986 - RNA, 18 nt, Mycobacterium bovis subsp bovis AF2122/97
gcgcauucgccgggcggc

SEQ ID NO: 3159987 - RNA, 20 nt, Mycobacterium bovis subsp bovis AF2122/97
gcgcauugccgacgcgcggc

SEQ ID NO: 3159988 - RNA, 22 nt, Mycobacterium bovis subsp bovis AF2122/97
gcgcauugcgcuuccaacacca

SEQ ID NO: 3159989 - RNA, 18 nt, Mycobacterium bovis subsp bovis AF2122/97
gcgcauuucaccggggcc

SEQ ID NO: 3159990 - RNA, 19 nt, Mycobacterium bovis subsp bovis AF2122/97
gcgcauuucggaucucgac

SEQ ID NO: 3159991 - RNA, 18 nt, Mycobacterium bovis subsp bovis AF2122/97
gcgcauuucguggcgcgc

SEQ ID NO: 3159992 - RNA, 17 nt, Mycobacterium bovis subsp bovis AF2122/97
gcgcauuuuucgccagc

SEQ ID NO: 3159993 - RNA, 14 nt, Mycobacterium bovis subsp bovis AF2122/97
gcgccaaaaaggau

SEQ ID NO: 3159994 - RNA, 19 nt, Mycobacterium bovis subsp bovis AF2122/97
gcgccaaaauccgcccacc

SEQ ID NO: 3159995 - RNA, 15 nt, Mycobacterium bovis subsp bovis AF2122/97
gcgccaaacaccccg

SEQ ID NO: 3159996 - RNA, 22 nt, Mycobacterium bovis subsp bovis AF2122/97
gcgccaaacaccccggccuugc

SEQ ID NO: 3159997 - RNA, 20 nt, Mycobacterium bovis subsp bovis AF2122/97
gcgccaaacccggcgggccc

SEQ ID NO: 3159998 - RNA, 21 nt, Mycobacterium bovis subsp bovis AF2122/97
gcgccaaacccggcgggcccg

SEQ ID NO: 3159999 - RNA, 22 nt, Mycobacterium bovis subsp bovis AF2122/97
gcgccaaacccggcgggcccgc

SEQ ID NO: 3160000 - RNA, 13 nt, Mycobacterium bovis subsp bovis AF2122/97
gcgccaacaaccc

SEQ ID NO: 3160001 - RNA, 15 nt, Mycobacterium bovis subsp bovis AF2122/97
gcgccaacgggcugc

SEQ ID NO: 3160002 - RNA, 23 nt, Mycobacterium bovis subsp bovis AF2122/97
gcgccaacucgagaguggccucg

SEQ ID NO: 3160003 - RNA, 16 nt, Mycobacterium bovis subsp bovis AF2122/97
gcgccaagacgucggc

SEQ ID NO: 3160004 - RNA, 18 nt, Mycobacterium bovis subsp bovis AF2122/97
gcgccaagacgucggcgu

SEQ ID NO: 3160005 - RNA, 19 nt, Mycobacterium bovis subsp bovis AF2122/97
gcgccaagacgucggcgug

SEQ ID NO: 3160006 - RNA, 15 nt, Mycobacterium bovis subsp bovis AF2122/97
gcgccaaggcgaugg

SEQ ID NO: 3160007 - RNA, 15 nt, Mycobacterium bovis subsp bovis AF2122/97
gcgccaaguggcgcu

SEQ ID NO: 3160008 - RNA, 18 nt, Mycobacterium bovis subsp bovis AF2122/97
gcgccaaguggcgcucgc

SEQ ID NO: 3160009 - RNA, 15 nt, Mycobacterium bovis subsp bovis AF2122/97
gcgccaaucgcccag

SEQ ID NO: 3160010 - RNA, 22 nt, Mycobacterium bovis subsp bovis AF2122/97
gcgccacaacguugcaccgaga

SEQ ID NO: 3160011 - RNA, 13 nt, Mycobacterium bovis subsp bovis AF2122/97
gcgccacagcagc

SEQ ID NO: 3160012 - RNA, 14 nt, Mycobacterium bovis subsp bovis AF2122/97
gcgccacagcagcg

SEQ ID NO: 3160013 - RNA, 18 nt, Mycobacterium bovis subsp bovis AF2122/97
gcgccacauacaccggcc

SEQ ID NO: 3160014 - RNA, 19 nt, Mycobacterium bovis subsp bovis AF2122/97
gcgccacauacaccggccg

SEQ ID NO: 3160015 - RNA, 20 nt, Mycobacterium bovis subsp bovis AF2122/97
gcgccauaauauugccgccu

SEQ ID NO: 3160016 - RNA, 15 nt, Mycobacterium bovis subsp bovis AF2122/97
gcgccauagccgcga

SEQ ID NO: 3160017 - RNA, 16 nt, Mycobacterium bovis subsp bovis AF2122/97
gcgccauagccgcgac

SEQ ID NO: 3160018 - RNA, 19 nt, Mycobacterium bovis subsp bovis AF2122/97
gcgccauagccgcgacccg

SEQ ID NO: 3160019 - RNA, 21 nt, Mycobacterium bovis subsp bovis AF2122/97
gcgccauauugauuccgaccc

SEQ ID NO: 3160020 - RNA, 22 nt, Mycobacterium bovis subsp bovis AF2122/97
gcgccaucacaucggccucuga

SEQ ID NO: 3160021 - RNA, 13 nt, Mycobacterium bovis subsp bovis AF2122/97
gcgccauccccgc

SEQ ID NO: 3160022 - RNA, 14 nt, Mycobacterium bovis subsp bovis AF2122/97
gcgccauccccgcc

SEQ ID NO: 3160023 - RNA, 17 nt, Mycobacterium bovis subsp bovis AF2122/97
gcgccauccccgccggc

SEQ ID NO: 3160024 - RNA, 17 nt, Mycobacterium bovis subsp bovis AF2122/97
gcgccaucccgccgccc

SEQ ID NO: 3160025 - RNA, 19 nt, Mycobacterium bovis subsp bovis AF2122/97
gcgccaucgaggucguuuc

SEQ ID NO: 3160026 - RNA, 18 nt, Mycobacterium bovis subsp bovis AF2122/97
gcgccaucgaugcgguga

SEQ ID NO: 3160027 - RNA, 15 nt, Mycobacterium bovis subsp bovis AF2122/97
gcgccaugaagccgg

SEQ ID NO: 3160028 - RNA, 16 nt, Mycobacterium bovis subsp bovis AF2122/97
gcgccaugaagccggg

SEQ ID NO: 3160029 - RNA, 23 nt, Mycobacterium bovis subsp bovis AF2122/97
gcgccaugcccucggcgccgaac

SEQ ID NO: 3160030 - RNA, 15 nt, Mycobacterium bovis subsp bovis AF2122/97
gcgccaugcgccaac

SEQ ID NO: 3160031 - RNA, 20 nt, Mycobacterium bovis subsp bovis AF2122/97
gcgccaugcugucguagcgc

SEQ ID NO: 3160032 - RNA, 21 nt, Mycobacterium bovis subsp bovis AF2122/97
gcgccauggaucccacgaguu

SEQ ID NO: 3160033 - RNA, 15 nt, Mycobacterium bovis subsp bovis AF2122/97
gcgccauuccaagac

SEQ ID NO: 3160034 - RNA, 20 nt, Mycobacterium bovis subsp bovis AF2122/97
gcgccauuccaagacguugc

SEQ ID NO: 3160035 - RNA, 16 nt, Mycobacterium bovis subsp bovis AF2122/97
gcgccauucccggugg

SEQ ID NO: 3160036 - RNA, 17 nt, Mycobacterium bovis subsp bovis AF2122/97
gcgccauucccgguggc

SEQ ID NO: 3160037 - RNA, 17 nt, Mycobacterium bovis subsp bovis AF2122/97
gcgccauuggcgccgcc

SEQ ID NO: 3160038 - RNA, 18 nt, Mycobacterium bovis subsp bovis AF2122/97
gcgccauuggcgccgccg

SEQ ID NO: 3160039 - RNA, 20 nt, Mycobacterium bovis subsp bovis AF2122/97
gcgccauuggcgccgccgau

SEQ ID NO: 3160040 - RNA, 12 nt, Mycobacterium bovis subsp bovis AF2122/97
gcgccauuucga

SEQ ID NO: 3160041 - RNA, 21 nt, Mycobacterium bovis subsp bovis AF2122/97
gcgcccacaucgucggcgggc

SEQ ID NO: 3160042 - RNA, 24 nt, Mycobacterium bovis subsp bovis AF2122/97
gcgcccacaucgucggcgggcggc

SEQ ID NO: 3160043 - RNA, 18 nt, Mycobacterium bovis subsp bovis AF2122/97
gcgcccaccagcggcggc

SEQ ID NO: 3160044 - RNA, 14 nt, Mycobacterium bovis subsp bovis AF2122/97
gcgcccaccccggc

SEQ ID NO: 3160045 - RNA, 13 nt, Mycobacterium bovis subsp bovis AF2122/97
gcgcccacccgcg

SEQ ID NO: 3160046 - RNA, 15 nt, Mycobacterium bovis subsp bovis AF2122/97
gcgcccaccgaaacc

SEQ ID NO: 3160047 - RNA, 16 nt, Mycobacterium bovis subsp bovis AF2122/97
gcgcccaccgggcggc

SEQ ID NO: 3160048 - RNA, 17 nt, Mycobacterium bovis subsp bovis AF2122/97
gcgcccaccgggcggcg

SEQ ID NO: 3160049 - RNA, 16 nt, Mycobacterium bovis subsp bovis AF2122/97
gcgcccaccguagacg

SEQ ID NO: 3160050 - RNA, 12 nt, Mycobacterium bovis subsp bovis AF2122/97
gcgcccagcacg

SEQ ID NO: 3160051 - RNA, 20 nt, Mycobacterium bovis subsp bovis AF2122/97
gcgcccagcacguaacccag

SEQ ID NO: 3160052 - RNA, 12 nt, Mycobacterium bovis subsp bovis AF2122/97
gcgcccagcgac

SEQ ID NO: 3160053 - RNA, 14 nt, Mycobacterium bovis subsp bovis AF2122/97
gcgcccagcgccuc

SEQ ID NO: 3160054 - RNA, 23 nt, Mycobacterium bovis subsp bovis AF2122/97
gcgcccagcgcuagccgggcgcg

SEQ ID NO: 3160055 - RNA, 13 nt, Mycobacterium bovis subsp bovis AF2122/97
gcgcccaggaacu

SEQ ID NO: 3160056 - RNA, 19 nt, Mycobacterium bovis subsp bovis AF2122/97
gcgcccaggccgaucagcg

SEQ ID NO: 3160057 - RNA, 23 nt, Mycobacterium bovis subsp bovis AF2122/97
gcgcccaggccgaucagcgcggc

SEQ ID NO: 3160058 - RNA, 20 nt, Mycobacterium bovis subsp bovis AF2122/97
gcgcccauagcugccggccc

SEQ ID NO: 3160059 - RNA, 22 nt, Mycobacterium bovis subsp bovis AF2122/97
gcgcccaucgcgacggcccgau

SEQ ID NO: 3160060 - RNA, 16 nt, Mycobacterium bovis subsp bovis AF2122/97
gcgcccauggccacca

SEQ ID NO: 3160061 - RNA, 13 nt, Mycobacterium bovis subsp bovis AF2122/97
gcgccccaccgcg

SEQ ID NO: 3160062 - RNA, 22 nt, Mycobacterium bovis subsp bovis AF2122/97
gcgccccagggggcgugccgcc

SEQ ID NO: 3160063 - RNA, 22 nt, Mycobacterium bovis subsp bovis AF2122/97
gcgccccaugggggaacccccu

SEQ ID NO: 3160064 - RNA, 18 nt, Mycobacterium bovis subsp bovis AF2122/97
gcgcccccagcagcugcg

SEQ ID NO: 3160065 - RNA, 21 nt, Mycobacterium bovis subsp bovis AF2122/97
gcgcccccgacgacggcaccg

SEQ ID NO: 3160066 - RNA, 22 nt, Mycobacterium bovis subsp bovis AF2122/97
gcgcccccgccauugccgccgg

SEQ ID NO: 3160067 - RNA, 14 nt, Mycobacterium bovis subsp bovis AF2122/97
gcgcccccggugcc

SEQ ID NO: 3160068 - RNA, 12 nt, Mycobacterium bovis subsp bovis AF2122/97
gcgccccggcgc

SEQ ID NO: 3160069 - RNA, 17 nt, Mycobacterium bovis subsp bovis AF2122/97
gcgcccgaagccgggcc

SEQ ID NO: 3160070 - RNA, 21 nt, Mycobacterium bovis subsp bovis AF2122/97
gcgcccgacgaacagcggucc

SEQ ID NO: 3160071 - RNA, 15 nt, Mycobacterium bovis subsp bovis AF2122/97
gcgcccgacggaguu

SEQ ID NO: 3160072 - RNA, 20 nt, Mycobacterium bovis subsp bovis AF2122/97
gcgcccgacggaguucgacg

SEQ ID NO: 3160073 - RNA, 13 nt, Mycobacterium bovis subsp bovis AF2122/97
gcgcccgcaccac

SEQ ID NO: 3160074 - RNA, 15 nt, Mycobacterium bovis subsp bovis AF2122/97
gcgcccgcaccaccg

SEQ ID NO: 3160075 - RNA, 16 nt, Mycobacterium bovis subsp bovis AF2122/97
gcgcccgcaccaccgg

SEQ ID NO: 3160076 - RNA, 13 nt, Mycobacterium bovis subsp bovis AF2122/97
gcgcccgccaccg

SEQ ID NO: 3160077 - RNA, 15 nt, Mycobacterium bovis subsp bovis AF2122/97
gcgcccgccaucagc

SEQ ID NO: 3160078 - RNA, 16 nt, Mycobacterium bovis subsp bovis AF2122/97
gcgcccgccaucagcc

SEQ ID NO: 3160079 - RNA, 19 nt, Mycobacterium bovis subsp bovis AF2122/97
gcgcccgccaucagcccgg

SEQ ID NO: 3160080 - RNA, 14 nt, Mycobacterium bovis subsp bovis AF2122/97
gcgcccgccgcgaa

SEQ ID NO: 3160081 - RNA, 15 nt, Mycobacterium bovis subsp bovis AF2122/97
gcgcccgccgcggca

SEQ ID NO: 3160082 - RNA, 17 nt, Mycobacterium bovis subsp bovis AF2122/97
gcgcccgccggcaaccg

SEQ ID NO: 3160083 - RNA, 21 nt, Mycobacterium bovis subsp bovis AF2122/97
gcgcccgccucgaccgccagc

SEQ ID NO: 3160084 - RNA, 12 nt, Mycobacterium bovis subsp bovis AF2122/97
gcgcccgcgaaa

SEQ ID NO: 3160085 - RNA, 14 nt, Mycobacterium bovis subsp bovis AF2122/97
gcgcccgcgcgcuc

SEQ ID NO: 3160086 - RNA, 13 nt, Mycobacterium bovis subsp bovis AF2122/97
gcgcccgcgcggc

SEQ ID NO: 3160087 - RNA, 13 nt, Mycobacterium bovis subsp bovis AF2122/97
gcgcccgcggccg

SEQ ID NO: 3160088 - RNA, 13 nt, Mycobacterium bovis subsp bovis AF2122/97
gcgcccgcgugac

SEQ ID NO: 3160089 - RNA, 19 nt, Mycobacterium bovis subsp bovis AF2122/97
gcgcccgcguucagggcac

SEQ ID NO: 3160090 - RNA, 12 nt, Mycobacterium bovis subsp bovis AF2122/97
gcgcccgcucgg

SEQ ID NO: 3160091 - RNA, 14 nt, Mycobacterium bovis subsp bovis AF2122/97
gcgcccgcucggcc

SEQ ID NO: 3160092 - RNA, 16 nt, Mycobacterium bovis subsp bovis AF2122/97
gcgcccgcucggccgc

SEQ ID NO: 3160093 - RNA, 17 nt, Mycobacterium bovis subsp bovis AF2122/97
gcgcccgcucggccgca

SEQ ID NO: 3160094 - RNA, 20 nt, Mycobacterium bovis subsp bovis AF2122/97
gcgcccgcucggccgcagcc

SEQ ID NO: 3160095 - RNA, 20 nt, Mycobacterium bovis subsp bovis AF2122/97
gcgcccgcugagccagcucc

SEQ ID NO: 3160096 - RNA, 17 nt, Mycobacterium bovis subsp bovis AF2122/97
gcgcccggauguccgcc

SEQ ID NO: 3160097 - RNA, 19 nt, Mycobacterium bovis subsp bovis AF2122/97
gcgcccggauguccgccga

SEQ ID NO: 3160098 - RNA, 20 nt, Mycobacterium bovis subsp bovis AF2122/97
gcgcccggauguccgccgac

SEQ ID NO: 3160099 - RNA, 14 nt, Mycobacterium bovis subsp bovis AF2122/97
gcgcccggccaagc

SEQ ID NO: 3160100 - RNA, 17 nt, Mycobacterium bovis subsp bovis AF2122/97
gcgcccggcccgccacc

SEQ ID NO: 3160101 - RNA, 16 nt, Mycobacterium bovis subsp bovis AF2122/97
gcgcccggcgcuagcg

SEQ ID NO: 3160102 - RNA, 18 nt, Mycobacterium bovis subsp bovis AF2122/97
gcgccgaucuucgcgcgc

SEQ ID NO: 3160103 - RNA, 17 nt, Mycobacterium bovis subsp bovis AF2122/97
gcgccgaugccggccaa

SEQ ID NO: 3160104 - RNA, 14 nt, Mycobacterium bovis subsp bovis AF2122/97
gcgccgaugucguc

SEQ ID NO: 3160105 - RNA, 17 nt, Mycobacterium bovis subsp bovis AF2122/97
gcgccgauguggccggc

SEQ ID NO: 3160106 - RNA, 18 nt, Mycobacterium bovis subsp bovis AF2122/97
gcgccgauguggccggcg

SEQ ID NO: 3160107 - RNA, 22 nt, Mycobacterium bovis subsp bovis AF2122/97
gcgccgauuccaccgccgacgc

SEQ ID NO: 3160108 - RNA, 15 nt, Mycobacterium bovis subsp bovis AF2122/97
gcgccgcaaccgccg

SEQ ID NO: 3160109 - RNA, 18 nt, Mycobacterium bovis subsp bovis AF2122/97
gcgccgcaaccgccgcgu

SEQ ID NO: 3160110 - RNA, 23 nt, Mycobacterium bovis subsp bovis AF2122/97
gcgccgcaaugacgucgucggcc

SEQ ID NO: 3160111 - RNA, 20 nt, Mycobacterium bovis subsp bovis AF2122/97
gcgccgcacacucucgguga

SEQ ID NO: 3160112 - RNA, 17 nt, Mycobacterium bovis subsp bovis AF2122/97
gcgccgcaccaagcagc

SEQ ID NO: 3160113 - RNA, 18 nt, Mycobacterium bovis subsp bovis AF2122/97
gcgccgcaccaucggcga

SEQ ID NO: 3160114 - RNA, 13 nt, Mycobacterium bovis subsp bovis AF2122/97
gcgccgcacccgg

SEQ ID NO: 3160115 - RNA, 15 nt, Mycobacterium bovis subsp bovis AF2122/97
gcgccgcacccggga

SEQ ID NO: 3160116 - RNA, 14 nt, Mycobacterium bovis subsp bovis AF2122/97
gcgccgcacgccga

SEQ ID NO: 3160117 - RNA, 15 nt, Mycobacterium bovis subsp bovis AF2122/97
gcgccgcacgccgac

SEQ ID NO: 3160118 - RNA, 17 nt, Mycobacterium bovis subsp bovis AF2122/97
gcgccgcacgccgaccg

SEQ ID NO: 3160119 - RNA, 12 nt, Mycobacterium bovis subsp bovis AF2122/97
gcgccgcacggc

SEQ ID NO: 3160120 - RNA, 14 nt, Mycobacterium bovis subsp bovis AF2122/97
gcgccgcacggcga

SEQ ID NO: 3160121 - RNA, 17 nt, Mycobacterium bovis subsp bovis AF2122/97
gcgccgcacggcgacgc

SEQ ID NO: 3160122 - RNA, 13 nt, Mycobacterium bovis subsp bovis AF2122/97
gcgccgcagagca

SEQ ID NO: 3160123 - RNA, 19 nt, Mycobacterium bovis subsp bovis AF2122/97
gcgccgcagaucaccgcca

SEQ ID NO: 3160124 - RNA, 19 nt, Mycobacterium bovis subsp bovis AF2122/97
gcgccgcagcaggugcauc

SEQ ID NO: 3160125 - RNA, 18 nt, Mycobacterium bovis subsp bovis AF2122/97
gcgccgcagcgcguacuu

SEQ ID NO: 3160126 - RNA, 15 nt, Mycobacterium bovis subsp bovis AF2122/97
gcgccgcagggccgc

SEQ ID NO: 3160127 - RNA, 23 nt, Mycobacterium bovis subsp bovis AF2122/97
gcgccgcaucauagacagggccg

SEQ ID NO: 3160128 - RNA, 16 nt, Mycobacterium bovis subsp bovis AF2122/97
gcgccgcaucggcgaa

SEQ ID NO: 3160129 - RNA, 16 nt, Mycobacterium bovis subsp bovis AF2122/97
gcgccgcaugccaccg

SEQ ID NO: 3160130 - RNA, 17 nt, Mycobacterium bovis subsp bovis AF2122/97
gcgccgcaugccaccga

SEQ ID NO: 3160131 - RNA, 18 nt, Mycobacterium bovis subsp bovis AF2122/97
gcgccgcauucgcgacaa

SEQ ID NO: 3160132 - RNA, 22 nt, Mycobacterium bovis subsp bovis AF2122/97
gcgccgcauucgcgacaacucg

SEQ ID NO: 3160133 - RNA, 13 nt, Mycobacterium bovis subsp bovis AF2122/97
gcgccgccacagc

SEQ ID NO: 3160134 - RNA, 15 nt, Mycobacterium bovis subsp bovis AF2122/97
gcgccgccacagcac

SEQ ID NO: 3160135 - RNA, 21 nt, Mycobacterium bovis subsp bovis AF2122/97
gcgccgccaccgaagccgccg

SEQ ID NO: 3160136 - RNA, 22 nt, Mycobacterium bovis subsp bovis AF2122/97
gcgccgccacggaucgcggcgg

SEQ ID NO: 3160137 - RNA, 23 nt, Mycobacterium bovis subsp bovis AF2122/97
gcgccgccacggaucgcggcggc

SEQ ID NO: 3160138 - RNA, 23 nt, Mycobacterium bovis subsp bovis AF2122/97
gcgccgccacgguacauccagag

SEQ ID NO: 3160139 - RNA, 20 nt, Mycobacterium bovis subsp bovis AF2122/97
gcgccgccacugccggcagc

SEQ ID NO: 3160140 - RNA, 13 nt, Mycobacterium bovis subsp bovis AF2122/97
gcgccgccagcac

SEQ ID NO: 3160141 - RNA, 14 nt, Mycobacterium bovis subsp bovis AF2122/97
gcgccgccagcacc

SEQ ID NO: 3160142 - RNA, 15 nt, Mycobacterium bovis subsp bovis AF2122/97
gcgccgccagcacca

SEQ ID NO: 3160143 - RNA, 19 nt, Mycobacterium bovis subsp bovis AF2122/97
gcgccgccagcaccaccgg

SEQ ID NO: 3160144 - RNA, 14 nt, Mycobacterium bovis subsp bovis AF2122/97
gcgccgccagcgcc

SEQ ID NO: 3160145 - RNA, 20 nt, Mycobacterium bovis subsp bovis AF2122/97
gcgccgccagcgccgccggc

SEQ ID NO: 3160146 - RNA, 21 nt, Mycobacterium bovis subsp bovis AF2122/97
gcgccgccagcgccgccggcg

SEQ ID NO: 3160147 - RNA, 22 nt, Mycobacterium bovis subsp bovis AF2122/97
gcgccgccauugccauacagca

SEQ ID NO: 3160148 - RNA, 18 nt, Mycobacterium bovis subsp bovis AF2122/97
gcgccgccauugucgcca

SEQ ID NO: 3160149 - RNA, 13 nt, Mycobacterium bovis subsp bovis AF2122/97
gcgccgcccacgg

SEQ ID NO: 3160150 - RNA, 23 nt, Mycobacterium bovis subsp bovis AF2122/97
gcgccgcccaugccuccagaacc

SEQ ID NO: 3160151 - RNA, 16 nt, Mycobacterium bovis subsp bovis AF2122/97
gcgccgccccgcucgg

SEQ ID NO: 3160152 - RNA, 13 nt, Mycobacterium bovis subsp bovis AF2122/97
gcgccgcccgcgc

SEQ ID NO: 3160153 - RNA, 18 nt, Mycobacterium bovis subsp bovis AF2122/97
gcgccgcccgcgccacca

SEQ ID NO: 3160154 - RNA, 21 nt, Mycobacterium bovis subsp bovis AF2122/97
gcgccgcccgcgccaccagca

SEQ ID NO: 3160155 - RNA, 18 nt, Mycobacterium bovis subsp bovis AF2122/97
gcgccgcccgcgcccccg

SEQ ID NO: 3160156 - RNA, 19 nt, Mycobacterium bovis subsp bovis AF2122/97
gcgccgcccgcgccgccgc

SEQ ID NO: 3160157 - RNA, 14 nt, Mycobacterium bovis subsp bovis AF2122/97
gcgccgcccgcucc

SEQ ID NO: 3160158 - RNA, 20 nt, Mycobacterium bovis subsp bovis AF2122/97
gcgccgcccuugccgccggc

SEQ ID NO: 3160159 - RNA, 23 nt, Mycobacterium bovis subsp bovis AF2122/97
gcgccgcccuugccgccggcccc

SEQ ID NO: 3160160 - RNA, 14 nt, Mycobacterium bovis subsp bovis AF2122/97
gcgccgccgaugcc

SEQ ID NO: 3160161 - RNA, 16 nt, Mycobacterium bovis subsp bovis AF2122/97
gcgccgccgccaccac

SEQ ID NO: 3160162 - RNA, 13 nt, Mycobacterium bovis subsp bovis AF2122/97
gcgccgccgccga

SEQ ID NO: 3160163 - RNA, 16 nt, Mycobacterium bovis subsp bovis AF2122/97
gcgccgccgccgacga

SEQ ID NO: 3160164 - RNA, 17 nt, Mycobacterium bovis subsp bovis AF2122/97
gcgccgccgccgacgaa

SEQ ID NO: 3160165 - RNA, 11 nt, Mycobacterium bovis subsp bovis AF2122/97
gcgccgccgcg

SEQ ID NO: 3160166 - RNA, 12 nt, Mycobacterium bovis subsp bovis AF2122/97
gcgccgccgcga

SEQ ID NO: 3160167 - RNA, 13 nt, Mycobacterium bovis subsp bovis AF2122/97
gcgccgccgcgag

SEQ ID NO: 3160168 - RNA, 20 nt, Mycobacterium bovis subsp bovis AF2122/97
gcgccgccgcgagcgccggc

SEQ ID NO: 3160169 - RNA, 22 nt, Mycobacterium bovis subsp bovis AF2122/97
gcgccgccgcgagcgccggccg

SEQ ID NO: 3160170 - RNA, 20 nt, Mycobacterium bovis subsp bovis AF2122/97
gcgccgccggaagcgccggc

SEQ ID NO: 3160171 - RNA, 15 nt, Mycobacterium bovis subsp bovis AF2122/97
gcgccgccggcaccc

SEQ ID NO: 3160172 - RNA, 13 nt, Mycobacterium bovis subsp bovis AF2122/97
gcgccgccggcgc

SEQ ID NO: 3160173 - RNA, 18 nt, Mycobacterium bovis subsp bovis AF2122/97
gcgccgccggcgccgccc

SEQ ID NO: 3160174 - RNA, 20 nt, Mycobacterium bovis subsp bovis AF2122/97
gcgccgccggcgccgcccgc

SEQ ID NO: 3160175 - RNA, 17 nt, Mycobacterium bovis subsp bovis AF2122/97
gcgccgccggcgccggc

SEQ ID NO: 3160176 - RNA, 14 nt, Mycobacterium bovis subsp bovis AF2122/97
gcgccgccggcgcg

SEQ ID NO: 3160177 - RNA, 15 nt, Mycobacterium bovis subsp bovis AF2122/97
gcgccgccggcggcg

SEQ ID NO: 3160178 - RNA, 17 nt, Mycobacterium bovis subsp bovis AF2122/97
gcgccgccggcggcggu

SEQ ID NO: 3160179 - RNA, 18 nt, Mycobacterium bovis subsp bovis AF2122/97
gcgccgccggcucgccgg

SEQ ID NO: 3160180 - RNA, 19 nt, Mycobacterium bovis subsp bovis AF2122/97
gcgccgccggcucgccggc

SEQ ID NO: 3160181 - RNA, 22 nt, Mycobacterium bovis subsp bovis AF2122/97
gcgccgccggcucgccggcgac

SEQ ID NO: 3160182 - RNA, 17 nt, Mycobacterium bovis subsp bovis AF2122/97
gcgccgccggugccacc

SEQ ID NO: 3160183 - RNA, 18 nt, Mycobacterium bovis subsp bovis AF2122/97
gcgccgccggugccaccg

SEQ ID NO: 3160184 - RNA, 17 nt, Mycobacterium bovis subsp bovis AF2122/97
gcgccgccguccagcgc

SEQ ID NO: 3160185 - RNA, 16 nt, Mycobacterium bovis subsp bovis AF2122/97
gcgccgccgucgccgc

SEQ ID NO: 3160186 - RNA, 21 nt, Mycobacterium bovis subsp bovis AF2122/97
gcgccgccgucguacaccucg

SEQ ID NO: 3160187 - RNA, 19 nt, Mycobacterium bovis subsp bovis AF2122/97
gcgccgccguuaccgccgg

SEQ ID NO: 3160188 - RNA, 21 nt, Mycobacterium bovis subsp bovis AF2122/97
gcgccgccguuaccgccggcg

SEQ ID NO: 3160189 - RNA, 22 nt, Mycobacterium bovis subsp bovis AF2122/97
gcgccggcgguagucggccagc

SEQ ID NO: 3160190 - RNA, 14 nt, Mycobacterium bovis subsp bovis AF2122/97
gcgccggcgucggc

SEQ ID NO: 3160191 - RNA, 15 nt, Mycobacterium bovis subsp bovis AF2122/97
gcgccggcgucggcg

SEQ ID NO: 3160192 - RNA, 21 nt, Mycobacterium bovis subsp bovis AF2122/97
gcgccggcgucggucgucggg

SEQ ID NO: 3160193 - RNA, 14 nt, Mycobacterium bovis subsp bovis AF2122/97
gcgccggcgugcau

SEQ ID NO: 3160194 - RNA, 18 nt, Mycobacterium bovis subsp bovis AF2122/97
gcgccggcgugcaugagc

SEQ ID NO: 3160195 - RNA, 15 nt, Mycobacterium bovis subsp bovis AF2122/97
gcgccggcguugccg

SEQ ID NO: 3160196 - RNA, 18 nt, Mycobacterium bovis subsp bovis AF2122/97
gcgccggcuagggcccug

SEQ ID NO: 3160197 - RNA, 20 nt, Mycobacterium bovis subsp bovis AF2122/97
gcgccggcuagggcccuggc

SEQ ID NO: 3160198 - RNA, 17 nt, Mycobacterium bovis subsp bovis AF2122/97
gcgccggcugccacaca

SEQ ID NO: 3160199 - RNA, 12 nt, Mycobacterium bovis subsp bovis AF2122/97
gcgccggcuggc

SEQ ID NO: 3160200 - RNA, 15 nt, Mycobacterium bovis subsp bovis AF2122/97
gcgccggcuggcggc

SEQ ID NO: 3160201 - RNA, 16 nt, Mycobacterium bovis subsp bovis AF2122/97
gcgccggcuucgggug

SEQ ID NO: 3160202 - RNA, 23 nt, Mycobacterium bovis subsp bovis AF2122/97
gcgccggcuucggguguucgcgc

SEQ ID NO: 3160203 - RNA, 17 nt, Mycobacterium bovis subsp bovis AF2122/97
gcgccggggacacagcg

SEQ ID NO: 3160204 - RNA, 20 nt, Mycobacterium bovis subsp bovis AF2122/97
gcgccggggacacagcgucc

SEQ ID NO: 3160205 - RNA, 15 nt, Mycobacterium bovis subsp bovis AF2122/97
gcgccggggaccacg

SEQ ID NO: 3160206 - RNA, 19 nt, Mycobacterium bovis subsp bovis AF2122/97
gcgccggggauaccgguca

SEQ ID NO: 3160207 - RNA, 16 nt, Mycobacterium bovis subsp bovis AF2122/97
gcgccggggccgccga

SEQ ID NO: 3160208 - RNA, 20 nt, Mycobacterium bovis subsp bovis AF2122/97
gcgccggggccgccgaugcc

SEQ ID NO: 3160209 - RNA, 15 nt, Mycobacterium bovis subsp bovis AF2122/97
gcgccggggcgcagg

SEQ ID NO: 3160210 - RNA, 19 nt, Mycobacterium bovis subsp bovis AF2122/97
gcgccgggggcgccgccgu

SEQ ID NO: 3160211 - RNA, 18 nt, Mycobacterium bovis subsp bovis AF2122/97
gcgccggggggcugcugc

SEQ ID NO: 3160212 - RNA, 19 nt, Mycobacterium bovis subsp bovis AF2122/97
gcgccggggggcugcugcu

SEQ ID NO: 3160213 - RNA, 20 nt, Mycobacterium bovis subsp bovis AF2122/97
gcgccggggggcugcugcuc

SEQ ID NO: 3160214 - RNA, 21 nt, Mycobacterium bovis subsp bovis AF2122/97
gcgccggucagcaauacggcg

SEQ ID NO: 3160215 - RNA, 19 nt, Mycobacterium bovis subsp bovis AF2122/97
gcgccgguccucgucggcg

SEQ ID NO: 3160216 - RNA, 20 nt, Mycobacterium bovis subsp bovis AF2122/97
gcgccgguccucgucggcga

SEQ ID NO: 3160217 - RNA, 13 nt, Mycobacterium bovis subsp bovis AF2122/97
gcgccggucgccg

SEQ ID NO: 3160218 - RNA, 15 nt, Mycobacterium bovis subsp bovis AF2122/97
gcgccggucgccgac

SEQ ID NO: 3160219 - RNA, 17 nt, Mycobacterium bovis subsp bovis AF2122/97
gcgccggucgccgacgg

SEQ ID NO: 3160220 - RNA, 18 nt, Mycobacterium bovis subsp bovis AF2122/97
gcgccggucgccgacggc

SEQ ID NO: 3160221 - RNA, 19 nt, Mycobacterium bovis subsp bovis AF2122/97
gcgccggucgccggcuggg

SEQ ID NO: 3160222 - RNA, 16 nt, Mycobacterium bovis subsp bovis AF2122/97
gcgccggucggaucgg

SEQ ID NO: 3160223 - RNA, 19 nt, Mycobacterium bovis subsp bovis AF2122/97
gcgccggucggaucgguga

SEQ ID NO: 3160224 - RNA, 13 nt, Mycobacterium bovis subsp bovis AF2122/97
gcgccggucguca

SEQ ID NO: 3160225 - RNA, 13 nt, Mycobacterium bovis subsp bovis AF2122/97
gcgccggugccgc

SEQ ID NO: 3160226 - RNA, 14 nt, Mycobacterium bovis subsp bovis AF2122/97
gcgccggugccgcc

SEQ ID NO: 3160227 - RNA, 16 nt, Mycobacterium bovis subsp bovis AF2122/97
gcgccggugccgccgg

SEQ ID NO: 3160228 - RNA, 17 nt, Mycobacterium bovis subsp bovis AF2122/97
gcgccggugccgccggg

SEQ ID NO: 3160229 - RNA, 19 nt, Mycobacterium bovis subsp bovis AF2122/97
gcgccggugccgccgggug

SEQ ID NO: 3160230 - RNA, 15 nt, Mycobacterium bovis subsp bovis AF2122/97
gcgccggugccgccu

SEQ ID NO: 3160231 - RNA, 19 nt, Mycobacterium bovis subsp bovis AF2122/97
gcgccggugccggccaucg

SEQ ID NO: 3160232 - RNA, 12 nt, Mycobacterium bovis subsp bovis AF2122/97
gcgccggugcug

SEQ ID NO: 3160233 - RNA, 17 nt, Mycobacterium bovis subsp bovis AF2122/97
gcgccggugggcggucc

SEQ ID NO: 3160234 - RNA, 20 nt, Mycobacterium bovis subsp bovis AF2122/97
gcgccggugguaacggcggc

SEQ ID NO: 3160235 - RNA, 18 nt, Mycobacterium bovis subsp bovis AF2122/97
gcgccggugguaccggcg

SEQ ID NO: 3160236 - RNA, 13 nt, Mycobacterium bovis subsp bovis AF2122/97
gcgccggugugcg

SEQ ID NO: 3160237 - RNA, 21 nt, Mycobacterium bovis subsp bovis AF2122/97
gcgccggugugcgcaccccgc

SEQ ID NO: 3160238 - RNA, 22 nt, Mycobacterium bovis subsp bovis AF2122/97
gcgccgguuacccggaccgucg

SEQ ID NO: 3160239 - RNA, 23 nt, Mycobacterium bovis subsp bovis AF2122/97
gcgccgguuacccggaccgucgu

SEQ ID NO: 3160240 - RNA, 13 nt, Mycobacterium bovis subsp bovis AF2122/97
gcgccgguuucga

SEQ ID NO: 3160241 - RNA, 19 nt, Mycobacterium bovis subsp bovis AF2122/97
gcgccguaacagccggccg

SEQ ID NO: 3160242 - RNA, 17 nt, Mycobacterium bovis subsp bovis AF2122/97
gcgccguacagcggcgg

SEQ ID NO: 3160243 - RNA, 18 nt, Mycobacterium bovis subsp bovis AF2122/97
gcgccguacagcggcggc

SEQ ID NO: 3160244 - RNA, 19 nt, Mycobacterium bovis subsp bovis AF2122/97
gcgccguacagcggcggcg

SEQ ID NO: 3160245 - RNA, 20 nt, Mycobacterium bovis subsp bovis AF2122/97
gcgccguacagcggcggcgu

SEQ ID NO: 3160246 - RNA, 21 nt, Mycobacterium bovis subsp bovis AF2122/97
gcgccguacagcggcggcguc

SEQ ID NO: 3160247 - RNA, 22 nt, Mycobacterium bovis subsp bovis AF2122/97
gcgccguacguucaccaccgca

SEQ ID NO: 3160248 - RNA, 18 nt, Mycobacterium bovis subsp bovis AF2122/97
gcgccguagaccagcagg

SEQ ID NO: 3160249 - RNA, 16 nt, Mycobacterium bovis subsp bovis AF2122/97
gcgccguagccgagga

SEQ ID NO: 3160250 - RNA, 13 nt, Mycobacterium bovis subsp bovis AF2122/97
gcgccgucaacac

SEQ ID NO: 3160251 - RNA, 14 nt, Mycobacterium bovis subsp bovis AF2122/97
gcgccgucaccgau

SEQ ID NO: 3160252 - RNA, 16 nt, Mycobacterium bovis subsp bovis AF2122/97
gcgccgucaccgaucg

SEQ ID NO: 3160253 - RNA, 12 nt, Mycobacterium bovis subsp bovis AF2122/97
gcgccgucagcc

SEQ ID NO: 3160254 - RNA, 15 nt, Mycobacterium bovis subsp bovis AF2122/97
gcgccgucagcccag

SEQ ID NO: 3160255 - RNA, 17 nt, Mycobacterium bovis subsp bovis AF2122/97
gcgccgucagcccaggu

SEQ ID NO: 3160256 - RNA, 20 nt, Mycobacterium bovis subsp bovis AF2122/97
gcgccgucccgaaacgccgg

SEQ ID NO: 3160257 - RNA, 18 nt, Mycobacterium bovis subsp bovis AF2122/97
gcgccgucgaaauacccg

SEQ ID NO: 3160258 - RNA, 14 nt, Mycobacterium bovis subsp bovis AF2122/97
gcgccgucgaugac

SEQ ID NO: 3160259 - RNA, 13 nt, Mycobacterium bovis subsp bovis AF2122/97
gcgccgucgcagc

SEQ ID NO: 3160260 - RNA, 16 nt, Mycobacterium bovis subsp bovis AF2122/97
gcgccgucgcagccag

SEQ ID NO: 3160261 - RNA, 21 nt, Mycobacterium bovis subsp bovis AF2122/97
gcgccgucggagccggccacc

SEQ ID NO: 3160262 - RNA, 14 nt, Mycobacterium bovis subsp bovis AF2122/97
gcgccgucggccga

SEQ ID NO: 3160263 - RNA, 18 nt, Mycobacterium bovis subsp bovis AF2122/97
gcgccgucgucgaccacg

SEQ ID NO: 3160264 - RNA, 21 nt, Mycobacterium bovis subsp bovis AF2122/97
gcgccgucgucgagcaccacc

SEQ ID NO: 3160265 - RNA, 23 nt, Mycobacterium bovis subsp bovis AF2122/97
gcgccgucgucgagcaccacccg

SEQ ID NO: 3160266 - RNA, 14 nt, Mycobacterium bovis subsp bovis AF2122/97
gcgccgucgucgcg

SEQ ID NO: 3160267 - RNA, 19 nt, Mycobacterium bovis subsp bovis AF2122/97
gcgccgucgucgcgcagua

SEQ ID NO: 3160268 - RNA, 19 nt, Mycobacterium bovis subsp bovis AF2122/97
gcgccgucguugugccggu

SEQ ID NO: 3160269 - RNA, 21 nt, Mycobacterium bovis subsp bovis AF2122/97
gcgccgucguugugccggucg

SEQ ID NO: 3160270 - RNA, 20 nt, Mycobacterium bovis subsp bovis AF2122/97
gcgccgucucgaagcucagc

SEQ ID NO: 3160271 - RNA, 15 nt, Mycobacterium bovis subsp bovis AF2122/97
gcgccgucucgcggu

SEQ ID NO: 3160272 - RNA, 16 nt, Mycobacterium bovis subsp bovis AF2122/97
gcgccgucucgcggug

SEQ ID NO: 3160273 - RNA, 17 nt, Mycobacterium bovis subsp bovis AF2122/97
gcgccgucucgcggugc

SEQ ID NO: 3160274 - RNA, 15 nt, Mycobacterium bovis subsp bovis AF2122/97
gcgccgucucugcca

SEQ ID NO: 3160275 - RNA, 21 nt, Mycobacterium bovis subsp bovis AF2122/97
gcgccgucucugccacgcguu

SEQ ID NO: 3160276 - RNA, 18 nt, Mycobacterium bovis subsp bovis AF2122/97
gcgcgaaccccagccgau

SEQ ID NO: 3160277 - RNA, 14 nt, Mycobacterium bovis subsp bovis AF2122/97
gcgcgaaccgcucc

SEQ ID NO: 3160278 - RNA, 15 nt, Mycobacterium bovis subsp bovis AF2122/97
gcgcgaaccugcucg

SEQ ID NO: 3160279 - RNA, 12 nt, Mycobacterium bovis subsp bovis AF2122/97
gcgcgaacguca

SEQ ID NO: 3160280 - RNA, 20 nt, Mycobacterium bovis subsp bovis AF2122/97
gcgcgaacgucaaccgggcg

SEQ ID NO: 3160281 - RNA, 22 nt, Mycobacterium bovis subsp bovis AF2122/97
gcgcgaacgucaaccgggcggc

SEQ ID NO: 3160282 - RNA, 23 nt, Mycobacterium bovis subsp bovis AF2122/97
gcgcgaacgucaaccgggcggcg

SEQ ID NO: 3160283 - RNA, 18 nt, Mycobacterium bovis subsp bovis AF2122/97
gcgcgaagucuugaccgc

SEQ ID NO: 3160284 - RNA, 21 nt, Mycobacterium bovis subsp bovis AF2122/97
gcgcgaagucuugaccgcacc

SEQ ID NO: 3160285 - RNA, 22 nt, Mycobacterium bovis subsp bovis AF2122/97
gcgcgaagucuugaccgcaccg

SEQ ID NO: 3160286 - RNA, 24 nt, Mycobacterium bovis subsp bovis AF2122/97
gcgcgaagucuugaccgcaccggc

SEQ ID NO: 3160287 - RNA, 15 nt, Mycobacterium bovis subsp bovis AF2122/97
gcgcgaauggucagc

SEQ ID NO: 3160288 - RNA, 22 nt, Mycobacterium bovis subsp bovis AF2122/97
gcgcgaauuccucuguacccca

SEQ ID NO: 3160289 - RNA, 15 nt, Mycobacterium bovis subsp bovis AF2122/97
gcgcgaauucguagg

SEQ ID NO: 3160290 - RNA, 15 nt, Mycobacterium bovis subsp bovis AF2122/97
gcgcgacaacccggc

SEQ ID NO: 3160291 - RNA, 19 nt, Mycobacterium bovis subsp bovis AF2122/97
gcgcgacaacccggcgucg

SEQ ID NO: 3160292 - RNA, 23 nt, Mycobacterium bovis subsp bovis AF2122/97
gcgcgacaacccggcgucgacga

SEQ ID NO: 3160293 - RNA, 22 nt, Mycobacterium bovis subsp bovis AF2122/97
gcgcgacagacagcaccgccgg

SEQ ID NO: 3160294 - RNA, 22 nt, Mycobacterium bovis subsp bovis AF2122/97
gcgcgacagccguggcgcgacg

SEQ ID NO: 3160295 - RNA, 18 nt, Mycobacterium bovis subsp bovis AF2122/97
gcgcgaccaaugcguuga

SEQ ID NO: 3160296 - RNA, 12 nt, Mycobacterium bovis subsp bovis AF2122/97
gcgcgaccaccc

SEQ ID NO: 3160297 - RNA, 14 nt, Mycobacterium bovis subsp bovis AF2122/97
gcgcgaccagaauc

SEQ ID NO: 3160298 - RNA, 14 nt, Mycobacterium bovis subsp bovis AF2122/97
gcgcgaccauaccc

SEQ ID NO: 3160299 - RNA, 11 nt, Mycobacterium bovis subsp bovis AF2122/97
gcgcgaccgaa

SEQ ID NO: 3160300 - RNA, 22 nt, Mycobacterium bovis subsp bovis AF2122/97
gcgcgaccgaaaauucaggcgc

SEQ ID NO: 3160301 - RNA, 16 nt, Mycobacterium bovis subsp bovis AF2122/97
gcgcgaccgaccagcc

SEQ ID NO: 3160302 - RNA, 14 nt, Mycobacterium bovis subsp bovis AF2122/97
gcgcgaccgucagg

SEQ ID NO: 3160303 - RNA, 14 nt, Mycobacterium bovis subsp bovis AF2122/97
gcgcgaccuggucg

SEQ ID NO: 3160304 - RNA, 14 nt, Mycobacterium bovis subsp bovis AF2122/97
gcgcgacggcaacg

SEQ ID NO: 3160305 - RNA, 18 nt, Mycobacterium bovis subsp bovis AF2122/97
gcgcgacggccgggacaa

SEQ ID NO: 3160306 - RNA, 22 nt, Mycobacterium bovis subsp bovis AF2122/97
gcgcgacggucccuucgucacc

SEQ ID NO: 3160307 - RNA, 18 nt, Mycobacterium bovis subsp bovis AF2122/97
gcgcgacguagacgacgu

SEQ ID NO: 3160308 - RNA, 22 nt, Mycobacterium bovis subsp bovis AF2122/97
gcgcgacguagacgacgucggc

SEQ ID NO: 3160309 - RNA, 20 nt, Mycobacterium bovis subsp bovis AF2122/97
gcgcgacguaguugccggcu

SEQ ID NO: 3160310 - RNA, 14 nt, Mycobacterium bovis subsp bovis AF2122/97
gcgcgacguccacc

SEQ ID NO: 3160311 - RNA, 22 nt, Mycobacterium bovis subsp bovis AF2122/97
gcgcgacguccaccagccgguu

SEQ ID NO: 3160312 - RNA, 21 nt, Mycobacterium bovis subsp bovis AF2122/97
gcgcgacugauccucgaugac

SEQ ID NO: 3160313 - RNA, 15 nt, Mycobacterium bovis subsp bovis AF2122/97
gcgcgagaacacccg

SEQ ID NO: 3160314 - RNA, 15 nt, Mycobacterium bovis subsp bovis AF2122/97
gcgcgagagccucca

SEQ ID NO: 3160315 - RNA, 17 nt, Mycobacterium bovis subsp bovis AF2122/97
gcgcgagaucagccggc

SEQ ID NO: 3160316 - RNA, 17 nt, Mycobacterium bovis subsp bovis AF2122/97
gcgcgagcagacacaga

SEQ ID NO: 3160317 - RNA, 15 nt, Mycobacterium bovis subsp bovis AF2122/97
gcgcgagcagacgca

SEQ ID NO: 3160318 - RNA, 17 nt, Mycobacterium bovis subsp bovis AF2122/97
gcgcgagcagacgcaga

SEQ ID NO: 3160319 - RNA, 15 nt, Mycobacterium bovis subsp bovis AF2122/97
gcgcgagcagcuaca

SEQ ID NO: 3160320 - RNA, 16 nt, Mycobacterium bovis subsp bovis AF2122/97
gcgcgagcccgaacca

SEQ ID NO: 3160321 - RNA, 14 nt, Mycobacterium bovis subsp bovis AF2122/97
gcgcgagccgcucc

SEQ ID NO: 3160322 - RNA, 16 nt, Mycobacterium bovis subsp bovis AF2122/97
gcgcgagccgcuccaa

SEQ ID NO: 3160323 - RNA, 15 nt, Mycobacterium bovis subsp bovis AF2122/97
gcgcgagcgauggga

SEQ ID NO: 3160324 - RNA, 17 nt, Mycobacterium bovis subsp bovis AF2122/97
gcgcgaggaacgccggg

SEQ ID NO: 3160325 - RNA, 23 nt, Mycobacterium bovis subsp bovis AF2122/97
gcgcgaggaacgccggggcgaug

SEQ ID NO: 3160326 - RNA, 22 nt, Mycobacterium bovis subsp bovis AF2122/97
gcgcgaggaggcuuacaugccc

SEQ ID NO: 3160327 - RNA, 22 nt, Mycobacterium bovis subsp bovis AF2122/97
gcgcgaggcucguggcgacggc

SEQ ID NO: 3160328 - RNA, 14 nt, Mycobacterium bovis subsp bovis AF2122/97
gcgcgaggggccgg

SEQ ID NO: 3160329 - RNA, 14 nt, Mycobacterium bovis subsp bovis AF2122/97
gcgcgaggucggcg

SEQ ID NO: 3160330 - RNA, 16 nt, Mycobacterium bovis subsp bovis AF2122/97
gcgcgaggucggcggc

SEQ ID NO: 3160331 - RNA, 15 nt, Mycobacterium bovis subsp bovis AF2122/97
gcgcgauagauaccc

SEQ ID NO: 3160332 - RNA, 21 nt, Mycobacterium bovis subsp bovis AF2122/97
gcgcgauagauacccgcggca

SEQ ID NO: 3160333 - RNA, 14 nt, Mycobacterium bovis subsp bovis AF2122/97
gcgcgauaggugcu

SEQ ID NO: 3160334 - RNA, 13 nt, Mycobacterium bovis subsp bovis AF2122/97
gcgcgaucaacgc

SEQ ID NO: 3160335 - RNA, 12 nt, Mycobacterium bovis subsp bovis AF2122/97
gcgcgaucaccg

SEQ ID NO: 3160336 - RNA, 21 nt, Mycobacterium bovis subsp bovis AF2122/97
gcgcgaucaccgagucgacgg

SEQ ID NO: 3160337 - RNA, 19 nt, Mycobacterium bovis subsp bovis AF2122/97
gcgcgaucccaacgcccgg

SEQ ID NO: 3160338 - RNA, 21 nt, Mycobacterium bovis subsp bovis AF2122/97
gcgcgauccccgcgcugagca

SEQ ID NO: 3160339 - RNA, 19 nt, Mycobacterium bovis subsp bovis AF2122/97
gcgcgaucgacgcucggcu

SEQ ID NO: 3160340 - RNA, 14 nt, Mycobacterium bovis subsp bovis AF2122/97
gcgcgaucgcgccc

SEQ ID NO: 3160341 - RNA, 15 nt, Mycobacterium bovis subsp bovis AF2122/97
gcgcgaucgcgguca

SEQ ID NO: 3160342 - RNA, 19 nt, Mycobacterium bovis subsp bovis AF2122/97
gcgcgaucgggccggcgcg

SEQ ID NO: 3160343 - RNA, 21 nt, Mycobacterium bovis subsp bovis AF2122/97
gcgcgaucgggccggcgcggu

SEQ ID NO: 3160344 - RNA, 14 nt, Mycobacterium bovis subsp bovis AF2122/97
gcgcgaucgucgac

SEQ ID NO: 3160345 - RNA, 17 nt, Mycobacterium bovis subsp bovis AF2122/97
gcgcgaucugcucgccc

SEQ ID NO: 3160346 - RNA, 20 nt, Mycobacterium bovis subsp bovis AF2122/97
gcgcgaugaccucggcgaug

SEQ ID NO: 3160347 - RNA, 16 nt, Mycobacterium bovis subsp bovis AF2122/97
gcgcgaugcccacgca

SEQ ID NO: 3160348 - RNA, 20 nt, Mycobacterium bovis subsp bovis AF2122/97
gcgcgaugcuggcgaacucg

SEQ ID NO: 3160349 - RNA, 16 nt, Mycobacterium bovis subsp bovis AF2122/97
gcgcgauggacccaag

SEQ ID NO: 3160350 - RNA, 18 nt, Mycobacterium bovis subsp bovis AF2122/97
gcgcgauggcagcgccga

SEQ ID NO: 3160351 - RNA, 15 nt, Mycobacterium bovis subsp bovis AF2122/97
gcgcgauggccguug

SEQ ID NO: 3160352 - RNA, 17 nt, Mycobacterium bovis subsp bovis AF2122/97
gcgcgauggccguugcc

SEQ ID NO: 3160353 - RNA, 12 nt, Mycobacterium bovis subsp bovis AF2122/97
gcgcgauggcgc

SEQ ID NO: 3160354 - RNA, 20 nt, Mycobacterium bovis subsp bovis AF2122/97
gcgcgaugggagcccggcgg

SEQ ID NO: 3160355 - RNA, 21 nt, Mycobacterium bovis subsp bovis AF2122/97
gcgcgaugggagcccggcggc

SEQ ID NO: 3160356 - RNA, 22 nt, Mycobacterium bovis subsp bovis AF2122/97
gcgcgaugggagcccggcggcc

SEQ ID NO: 3160357 - RNA, 17 nt, Mycobacterium bovis subsp bovis AF2122/97
gcgcgaugucgccggcg

SEQ ID NO: 3160358 - RNA, 21 nt, Mycobacterium bovis subsp bovis AF2122/97
gcgcgaugucgccggcgacca

SEQ ID NO: 3160359 - RNA, 17 nt, Mycobacterium bovis subsp bovis AF2122/97
gcgcgaugucguucgcg

SEQ ID NO: 3160360 - RNA, 19 nt, Mycobacterium bovis subsp bovis AF2122/97
gcgcgaugucguucgcguc

SEQ ID NO: 3160361 - RNA, 14 nt, Mycobacterium bovis subsp bovis AF2122/97
gcgcgcaacccugc

SEQ ID NO: 3160362 - RNA, 18 nt, Mycobacterium bovis subsp bovis AF2122/97
gcgcgccugugccaccgc

SEQ ID NO: 3160363 - RNA, 23 nt, Mycobacterium bovis subsp bovis AF2122/97
gcgcgccuucacgcuggccucca

SEQ ID NO: 3160364 - RNA, 21 nt, Mycobacterium bovis subsp bovis AF2122/97
gcgcgcgaagaucggcgcuag

SEQ ID NO: 3160365 - RNA, 20 nt, Mycobacterium bovis subsp bovis AF2122/97
gcgcgcgaccucgcuggccg

SEQ ID NO: 3160366 - RNA, 12 nt, Mycobacterium bovis subsp bovis AF2122/97
gcgcgcgauggc

SEQ ID NO: 3160367 - RNA, 14 nt, Mycobacterium bovis subsp bovis AF2122/97
gcgcgcgauggcgc

SEQ ID NO: 3160368 - RNA, 12 nt, Mycobacterium bovis subsp bovis AF2122/97
gcgcgcgcccga

SEQ ID NO: 3160369 - RNA, 12 nt, Mycobacterium bovis subsp bovis AF2122/97
gcgcgcgcccgg

SEQ ID NO: 3160370 - RNA, 15 nt, Mycobacterium bovis subsp bovis AF2122/97
gcgcgcgccgcagcg

SEQ ID NO: 3160371 - RNA, 15 nt, Mycobacterium bovis subsp bovis AF2122/97
gcgcgcgccgcuggg

SEQ ID NO: 3160372 - RNA, 20 nt, Mycobacterium bovis subsp bovis AF2122/97
gcgcgcgccgcugggugacc

SEQ ID NO: 3160373 - RNA, 14 nt, Mycobacterium bovis subsp bovis AF2122/97
gcgcgcgcgccggc

SEQ ID NO: 3160374 - RNA, 14 nt, Mycobacterium bovis subsp bovis AF2122/97
gcgcgcggcgacca

SEQ ID NO: 3160375 - RNA, 19 nt, Mycobacterium bovis subsp bovis AF2122/97
gcgcgcggcgaccauaagc

SEQ ID NO: 3160376 - RNA, 14 nt, Mycobacterium bovis subsp bovis AF2122/97
gcgcgcggcgacga

SEQ ID NO: 3160377 - RNA, 12 nt, Mycobacterium bovis subsp bovis AF2122/97
gcgcgcggcgcc

SEQ ID NO: 3160378 - RNA, 17 nt, Mycobacterium bovis subsp bovis AF2122/97
gcgcgcgggguggcggc

SEQ ID NO: 3160379 - RNA, 21 nt, Mycobacterium bovis subsp bovis AF2122/97
gcgcgcggguuacccgcagcg

SEQ ID NO: 3160380 - RNA, 12 nt, Mycobacterium bovis subsp bovis AF2122/97
gcgcgcggucga

SEQ ID NO: 3160381 - RNA, 21 nt, Mycobacterium bovis subsp bovis AF2122/97
gcgcgcggucgagguggcggg

SEQ ID NO: 3160382 - RNA, 16 nt, Mycobacterium bovis subsp bovis AF2122/97
gcgcgcguagcggggg

SEQ ID NO: 3160383 - RNA, 18 nt, Mycobacterium bovis subsp bovis AF2122/97
gcgcgcguagcgggggag

SEQ ID NO: 3160384 - RNA, 20 nt, Mycobacterium bovis subsp bovis AF2122/97
gcgcgcuaccagcucacggc

SEQ ID NO: 3160385 - RNA, 21 nt, Mycobacterium bovis subsp bovis AF2122/97
gcgcgcuaggugcaacaggcg

SEQ ID NO: 3160386 - RNA, 22 nt, Mycobacterium bovis subsp bovis AF2122/97
gcgcgcuaggugcaacaggcgc

SEQ ID NO: 3160387 - RNA, 17 nt, Mycobacterium bovis subsp bovis AF2122/97
gcgcgcucaggucaucg

SEQ ID NO: 3160388 - RNA, 15 nt, Mycobacterium bovis subsp bovis AF2122/97
gcgcgcucaucgacc

SEQ ID NO: 3160389 - RNA, 22 nt, Mycobacterium bovis subsp bovis AF2122/97
gcgcgcucaucgaccgcggccg

SEQ ID NO: 3160390 - RNA, 18 nt, Mycobacterium bovis subsp bovis AF2122/97
gcgcgcucaucgaccggg

SEQ ID NO: 3160391 - RNA, 16 nt, Mycobacterium bovis subsp bovis AF2122/97
gcgcgcucgcccagga

SEQ ID NO: 3160392 - RNA, 13 nt, Mycobacterium bovis subsp bovis AF2122/97
gcgcgcucgcggc

SEQ ID NO: 3160393 - RNA, 14 nt, Mycobacterium bovis subsp bovis AF2122/97
gcgcgcucgcggcu

SEQ ID NO: 3160394 - RNA, 15 nt, Mycobacterium bovis subsp bovis AF2122/97
gcgcgcucgcucacc

SEQ ID NO: 3160395 - RNA, 16 nt, Mycobacterium bovis subsp bovis AF2122/97
gcgcgcucgcucaccg

SEQ ID NO: 3160396 - RNA, 15 nt, Mycobacterium bovis subsp bovis AF2122/97
gcgcgcucggccagc

SEQ ID NO: 3160397 - RNA, 19 nt, Mycobacterium bovis subsp bovis AF2122/97
gcgcgcucguggucgacgu

SEQ ID NO: 3160398 - RNA, 14 nt, Mycobacterium bovis subsp bovis AF2122/97
gcgcgcugagcucg

SEQ ID NO: 3160399 - RNA, 15 nt, Mycobacterium bovis subsp bovis AF2122/97
gcgcgcugagcucga

SEQ ID NO: 3160400 - RNA, 18 nt, Mycobacterium bovis subsp bovis AF2122/97
gcgcgcugagcucgaugu

SEQ ID NO: 3160401 - RNA, 20 nt, Mycobacterium bovis subsp bovis AF2122/97
gcgcgcugagguggcggugc

SEQ ID NO: 3160402 - RNA, 15 nt, Mycobacterium bovis subsp bovis AF2122/97
gcgcgcugauuucuu

SEQ ID NO: 3160403 - RNA, 14 nt, Mycobacterium bovis subsp bovis AF2122/97
gcgcgcugcgcgac

SEQ ID NO: 3160404 - RNA, 12 nt, Mycobacterium bovis subsp bovis AF2122/97
gcgcgcugcgga

SEQ ID NO: 3160405 - RNA, 13 nt, Mycobacterium bovis subsp bovis AF2122/97
gcgcgcuggaccu

SEQ ID NO: 3160406 - RNA, 12 nt, Mycobacterium bovis subsp bovis AF2122/97
gcgcgcuggcca

SEQ ID NO: 3160407 - RNA, 18 nt, Mycobacterium bovis subsp bovis AF2122/97
gcgcgcuggcgggcggcg

SEQ ID NO: 3160408 - RNA, 21 nt, Mycobacterium bovis subsp bovis AF2122/97
gcgcgcugggaagcucggucc

SEQ ID NO: 3160409 - RNA, 21 nt, Mycobacterium bovis subsp bovis AF2122/97
gcgcgcugggcccgagcgcgc

SEQ ID NO: 3160410 - RNA, 23 nt, Mycobacterium bovis subsp bovis AF2122/97
gcgcgcugggcccgagcgcgcgc

SEQ ID NO: 3160411 - RNA, 15 nt, Mycobacterium bovis subsp bovis AF2122/97
gcgcgcugggcgccg

SEQ ID NO: 3160412 - RNA, 14 nt, Mycobacterium bovis subsp bovis AF2122/97
gcgcgcugggcgcg

SEQ ID NO: 3160413 - RNA, 15 nt, Mycobacterium bovis subsp bovis AF2122/97
gcgcgcugggcgcgc

SEQ ID NO: 3160414 - RNA, 16 nt, Mycobacterium bovis subsp bovis AF2122/97
gcgcgcugggcgcgcu

SEQ ID NO: 3160415 - RNA, 17 nt, Mycobacterium bovis subsp bovis AF2122/97
gcgcgcugggcgcgcuc

SEQ ID NO: 3160416 - RNA, 19 nt, Mycobacterium bovis subsp bovis AF2122/97
gcgcgcuucaugagccgcu

SEQ ID NO: 3160417 - RNA, 21 nt, Mycobacterium bovis subsp bovis AF2122/97
gcgcgcuucaugagccgcugc

SEQ ID NO: 3160418 - RNA, 15 nt, Mycobacterium bovis subsp bovis AF2122/97
gcgcgcuugggcacu

SEQ ID NO: 3160419 - RNA, 13 nt, Mycobacterium bovis subsp bovis AF2122/97
gcgcgcuuggggu

SEQ ID NO: 3160420 - RNA, 23 nt, Mycobacterium bovis subsp bovis AF2122/97
gcgcgcuugggguugggcggggu

SEQ ID NO: 3160421 - RNA, 16 nt, Mycobacterium bovis subsp bovis AF2122/97
gcgcggaacgcgucgc

SEQ ID NO: 3160422 - RNA, 22 nt, Mycobacterium bovis subsp bovis AF2122/97
gcgcggacaccuuucuccacac

SEQ ID NO: 3160423 - RNA, 21 nt, Mycobacterium bovis subsp bovis AF2122/97
gcgcggaccagagugguggcg

SEQ ID NO: 3160424 - RNA, 14 nt, Mycobacterium bovis subsp bovis AF2122/97
gcgcggacccagca

SEQ ID NO: 3160425 - RNA, 15 nt, Mycobacterium bovis subsp bovis AF2122/97
gcgcggacccagcac

SEQ ID NO: 3160426 - RNA, 17 nt, Mycobacterium bovis subsp bovis AF2122/97
gcgcggacccagcaccc

SEQ ID NO: 3160427 - RNA, 13 nt, Mycobacterium bovis subsp bovis AF2122/97
gcgcggagacccc

SEQ ID NO: 3160428 - RNA, 15 nt, Mycobacterium bovis subsp bovis AF2122/97
gcgcggagaccccgc

SEQ ID NO: 3160429 - RNA, 14 nt, Mycobacterium bovis subsp bovis AF2122/97
gcgcggagagccug

SEQ ID NO: 3160430 - RNA, 21 nt, Mycobacterium bovis subsp bovis AF2122/97
gcgcggaucaacaggccggcu

SEQ ID NO: 3160431 - RNA, 21 nt, Mycobacterium bovis subsp bovis AF2122/97
gcgcggauggguacgacaccg

SEQ ID NO: 3160432 - RNA, 22 nt, Mycobacterium bovis subsp bovis AF2122/97
gcgcggauucgguuagcgcggc

SEQ ID NO: 3160433 - RNA, 18 nt, Mycobacterium bovis subsp bovis AF2122/97
gcgcggcaaaguuggccg

SEQ ID NO: 3160434 - RNA, 19 nt, Mycobacterium bovis subsp bovis AF2122/97
gcgcggcaaaguuggccgc

SEQ ID NO: 3160435 - RNA, 14 nt, Mycobacterium bovis subsp bovis AF2122/97
gcgcggcaagcucg

SEQ ID NO: 3160436 - RNA, 18 nt, Mycobacterium bovis subsp bovis AF2122/97
gcgcggcaagcucguccg

SEQ ID NO: 3160437 - RNA, 21 nt, Mycobacterium bovis subsp bovis AF2122/97
gcgcggcaccagcaccgucgg

SEQ ID NO: 3160438 - RNA, 17 nt, Mycobacterium bovis subsp bovis AF2122/97
gcgcggcacccggucgg

SEQ ID NO: 3160439 - RNA, 23 nt, Mycobacterium bovis subsp bovis AF2122/97
gcgcggcaccgauggcgcaccgg

SEQ ID NO: 3160440 - RNA, 23 nt, Mycobacterium bovis subsp bovis AF2122/97
gcgcggcacuuuguagcccgcga

SEQ ID NO: 3160441 - RNA, 11 nt, Mycobacterium bovis subsp bovis AF2122/97
gcgcggcaggc

SEQ ID NO: 3160442 - RNA, 21 nt, Mycobacterium bovis subsp bovis AF2122/97
gcgcggcaucccgccacacca

SEQ ID NO: 3160443 - RNA, 20 nt, Mycobacterium bovis subsp bovis AF2122/97
gcgcggccaaucagcccgcc

SEQ ID NO: 3160444 - RNA, 22 nt, Mycobacterium bovis subsp bovis AF2122/97
gcgcggccaaucagcccgccgg

SEQ ID NO: 3160445 - RNA, 23 nt, Mycobacterium bovis subsp bovis AF2122/97
gcgcggccaaucagcccgccgga

SEQ ID NO: 3160446 - RNA, 12 nt, Mycobacterium bovis subsp bovis AF2122/97
gcgcggccaccc

SEQ ID NO: 3160447 - RNA, 15 nt, Mycobacterium bovis subsp bovis AF2122/97
gcgcggccacccgcg

SEQ ID NO: 3160448 - RNA, 23 nt, Mycobacterium bovis subsp bovis AF2122/97
gcgcggccaccucaucgccaucg

SEQ ID NO: 3160449 - RNA, 17 nt, Mycobacterium bovis subsp bovis AF2122/97
gcgcgguaccgguguca

SEQ ID NO: 3160450 - RNA, 16 nt, Mycobacterium bovis subsp bovis AF2122/97
gcgcgguacugcgcag

SEQ ID NO: 3160451 - RNA, 16 nt, Mycobacterium bovis subsp bovis AF2122/97
gcgcgguagcucgucg

SEQ ID NO: 3160452 - RNA, 17 nt, Mycobacterium bovis subsp bovis AF2122/97
gcgcgguagcucgucga

SEQ ID NO: 3160453 - RNA, 21 nt, Mycobacterium bovis subsp bovis AF2122/97
gcgcggucaccgcgucaccgg

SEQ ID NO: 3160454 - RNA, 15 nt, Mycobacterium bovis subsp bovis AF2122/97
gcgcgguccaucccg

SEQ ID NO: 3160455 - RNA, 17 nt, Mycobacterium bovis subsp bovis AF2122/97
gcgcgguccaucccgag

SEQ ID NO: 3160456 - RNA, 15 nt, Mycobacterium bovis subsp bovis AF2122/97
gcgcggucgaccuga

SEQ ID NO: 3160457 - RNA, 21 nt, Mycobacterium bovis subsp bovis AF2122/97
gcgcggucgagguggcgggcg

SEQ ID NO: 3160458 - RNA, 14 nt, Mycobacterium bovis subsp bovis AF2122/97
gcgcggucgcgcga

SEQ ID NO: 3160459 - RNA, 20 nt, Mycobacterium bovis subsp bovis AF2122/97
gcgcggucggagucgagcac

SEQ ID NO: 3160460 - RNA, 14 nt, Mycobacterium bovis subsp bovis AF2122/97
gcgcggucucgagu

SEQ ID NO: 3160461 - RNA, 16 nt, Mycobacterium bovis subsp bovis AF2122/97
gcgcggugaccggguu

SEQ ID NO: 3160462 - RNA, 16 nt, Mycobacterium bovis subsp bovis AF2122/97
gcgcggugacgagcca

SEQ ID NO: 3160463 - RNA, 18 nt, Mycobacterium bovis subsp bovis AF2122/97
gcgcggugaugguuaccg

SEQ ID NO: 3160464 - RNA, 19 nt, Mycobacterium bovis subsp bovis AF2122/97
gcgcggugcccgcgaacga

SEQ ID NO: 3160465 - RNA, 18 nt, Mycobacterium bovis subsp bovis AF2122/97
gcgcggugcccugccggc

SEQ ID NO: 3160466 - RNA, 22 nt, Mycobacterium bovis subsp bovis AF2122/97
gcgcggugcccugccggcagcg

SEQ ID NO: 3160467 - RNA, 16 nt, Mycobacterium bovis subsp bovis AF2122/97
gcgcggugccgccacc

SEQ ID NO: 3160468 - RNA, 18 nt, Mycobacterium bovis subsp bovis AF2122/97
gcgcggugccgccaccgg

SEQ ID NO: 3160469 - RNA, 17 nt, Mycobacterium bovis subsp bovis AF2122/97
gcgcggugccggccguu

SEQ ID NO: 3160470 - RNA, 14 nt, Mycobacterium bovis subsp bovis AF2122/97
gcgcggugccggcg

SEQ ID NO: 3160471 - RNA, 15 nt, Mycobacterium bovis subsp bovis AF2122/97
gcgcggugcgcguga

SEQ ID NO: 3160472 - RNA, 22 nt, Mycobacterium bovis subsp bovis AF2122/97
gcgcggugcgcgugacgaccag

SEQ ID NO: 3160473 - RNA, 23 nt, Mycobacterium bovis subsp bovis AF2122/97
gcgcggugcggccacucgcccga

SEQ ID NO: 3160474 - RNA, 21 nt, Mycobacterium bovis subsp bovis AF2122/97
gcgcgguggcggucgccacac

SEQ ID NO: 3160475 - RNA, 22 nt, Mycobacterium bovis subsp bovis AF2122/97
gcgcgguggcggucgccacacc

SEQ ID NO: 3160476 - RNA, 16 nt, Mycobacterium bovis subsp bovis AF2122/97
gcgcgguggggcgcgc

SEQ ID NO: 3160477 - RNA, 17 nt, Mycobacterium bovis subsp bovis AF2122/97
gcgcgguggggcgcgcc

SEQ ID NO: 3160478 - RNA, 19 nt, Mycobacterium bovis subsp bovis AF2122/97
gcgcgguggggcgcgccgg

SEQ ID NO: 3160479 - RNA, 16 nt, Mycobacterium bovis subsp bovis AF2122/97
gcgcgguggucagcac

SEQ ID NO: 3160480 - RNA, 18 nt, Mycobacterium bovis subsp bovis AF2122/97
gcgcgguggucgcgaccg

SEQ ID NO: 3160481 - RNA, 20 nt, Mycobacterium bovis subsp bovis AF2122/97
gcgcgguggucgcgaccgac

SEQ ID NO: 3160482 - RNA, 18 nt, Mycobacterium bovis subsp bovis AF2122/97
gcgcgguguagagcgcac

SEQ ID NO: 3160483 - RNA, 19 nt, Mycobacterium bovis subsp bovis AF2122/97
gcgcgguuggcugaugacg

SEQ ID NO: 3160484 - RNA, 16 nt, Mycobacterium bovis subsp bovis AF2122/97
gcgcgguuucggcgau

SEQ ID NO: 3160485 - RNA, 17 nt, Mycobacterium bovis subsp bovis AF2122/97
gcgcgguuucggcgaug

SEQ ID NO: 3160486 - RNA, 18 nt, Mycobacterium bovis subsp bovis AF2122/97
gcgcgguuucggcgauga

SEQ ID NO: 3160487 - RNA, 19 nt, Mycobacterium bovis subsp bovis AF2122/97
gcgcgguuuucggcugccg

SEQ ID NO: 3160488 - RNA, 23 nt, Mycobacterium bovis subsp bovis AF2122/97
gcgcguaauccgagcgcggcggc

SEQ ID NO: 3160489 - RNA, 20 nt, Mycobacterium bovis subsp bovis AF2122/97
gcgcguacccgaucagcgac

SEQ ID NO: 3160490 - RNA, 13 nt, Mycobacterium bovis subsp bovis AF2122/97
gcgcguagccaau

SEQ ID NO: 3160491 - RNA, 15 nt, Mycobacterium bovis subsp bovis AF2122/97
gcgcguagcggggga

SEQ ID NO: 3160492 - RNA, 19 nt, Mycobacterium bovis subsp bovis AF2122/97
gcgcguagcgggggagcga

SEQ ID NO: 3160493 - RNA, 21 nt, Mycobacterium bovis subsp bovis AF2122/97
gcgcguaggcccaacgacggc

SEQ ID NO: 3160494 - RNA, 21 nt, Mycobacterium bovis subsp bovis AF2122/97
gcgcguaguaaugcucgacgu

SEQ ID NO: 3160495 - RNA, 18 nt, Mycobacterium bovis subsp bovis AF2122/97
gcgcguaguccgcauccg

SEQ ID NO: 3160496 - RNA, 20 nt, Mycobacterium bovis subsp bovis AF2122/97
gcgcguaucgcgucugggug

SEQ ID NO: 3160497 - RNA, 16 nt, Mycobacterium bovis subsp bovis AF2122/97
gcgcguauggcucacc

SEQ ID NO: 3160498 - RNA, 21 nt, Mycobacterium bovis subsp bovis AF2122/97
gcgcgucacauccgacagcag

SEQ ID NO: 3160499 - RNA, 16 nt, Mycobacterium bovis subsp bovis AF2122/97
gcgcgucagccgcacc

SEQ ID NO: 3160500 - RNA, 19 nt, Mycobacterium bovis subsp bovis AF2122/97
gcgcgucagccgcaccccg

SEQ ID NO: 3160501 - RNA, 14 nt, Mycobacterium bovis subsp bovis AF2122/97
gcgcgucaggccag

SEQ ID NO: 3160502 - RNA, 16 nt, Mycobacterium bovis subsp bovis AF2122/97
gcgcgucaggccagcg

SEQ ID NO: 3160503 - RNA, 17 nt, Mycobacterium bovis subsp bovis AF2122/97
gcgcgucaggccagcgc

SEQ ID NO: 3160504 - RNA, 14 nt, Mycobacterium bovis subsp bovis AF2122/97
gcgcguccccagcg

SEQ ID NO: 3160505 - RNA, 15 nt, Mycobacterium bovis subsp bovis AF2122/97
gcgcguccccagcgc

SEQ ID NO: 3160506 - RNA, 19 nt, Mycobacterium bovis subsp bovis AF2122/97
gcgcguccccagcgccacc

SEQ ID NO: 3160507 - RNA, 14 nt, Mycobacterium bovis subsp bovis AF2122/97
gcgcguccgggcag

SEQ ID NO: 3160508 - RNA, 21 nt, Mycobacterium bovis subsp bovis AF2122/97
gcgcguccgggcagccgcgcc

SEQ ID NO: 3160509 - RNA, 22 nt, Mycobacterium bovis subsp bovis AF2122/97
gcgcguccucgccgcacgccgg

SEQ ID NO: 3160510 - RNA, 15 nt, Mycobacterium bovis subsp bovis AF2122/97
gcgcgucgagcgacc

SEQ ID NO: 3160511 - RNA, 23 nt, Mycobacterium bovis subsp bovis AF2122/97
gcgcgucgaucguuccgcuggac

SEQ ID NO: 3160512 - RNA, 13 nt, Mycobacterium bovis subsp bovis AF2122/97
gcgcgucgccgaa

SEQ ID NO: 3160513 - RNA, 22 nt, Mycobacterium bovis subsp bovis AF2122/97
gcgcgucgcgaaauagcugcgg

SEQ ID NO: 3160514 - RNA, 18 nt, Mycobacterium bovis subsp bovis AF2122/97
gcgcgucgcgaguagcug

SEQ ID NO: 3160515 - RNA, 13 nt, Mycobacterium bovis subsp bovis AF2122/97
gcgcgucgcgugg

SEQ ID NO: 3160516 - RNA, 16 nt, Mycobacterium bovis subsp bovis AF2122/97
gcgcgucgcgugggau

SEQ ID NO: 3160517 - RNA, 16 nt, Mycobacterium bovis subsp bovis AF2122/97
gcgcgucgggaugcgc

SEQ ID NO: 3160518 - RNA, 15 nt, Mycobacterium bovis subsp bovis AF2122/97
gcgcgucgucgcgcu

SEQ ID NO: 3160519 - RNA, 15 nt, Mycobacterium bovis subsp bovis AF2122/97
gcgcgucucgagcgc

SEQ ID NO: 3160520 - RNA, 16 nt, Mycobacterium bovis subsp bovis AF2122/97
gcgcgucucgagcgcg

SEQ ID NO: 3160521 - RNA, 18 nt, Mycobacterium bovis subsp bovis AF2122/97
gcgcgucucgagcgcgcc

SEQ ID NO: 3160522 - RNA, 13 nt, Mycobacterium bovis subsp bovis AF2122/97
gcgcgugacgacc

SEQ ID NO: 3160523 - RNA, 16 nt, Mycobacterium bovis subsp bovis AF2122/97
gcgcgugacgaccagc

SEQ ID NO: 3160524 - RNA, 17 nt, Mycobacterium bovis subsp bovis AF2122/97
gcgcgugacgaccagcc

SEQ ID NO: 3160525 - RNA, 13 nt, Mycobacterium bovis subsp bovis AF2122/97
gcgcgugcagcgg

SEQ ID NO: 3160526 - RNA, 16 nt, Mycobacterium bovis subsp bovis AF2122/97
gcgcgugcagcggcgc

SEQ ID NO: 3160527 - RNA, 14 nt, Mycobacterium bovis subsp bovis AF2122/97
gcgcgugcucgacg

SEQ ID NO: 3160528 - RNA, 22 nt, Mycobacterium bovis subsp bovis AF2122/97
gcgcgugcucgacgcgcaucgc

SEQ ID NO: 3160529 - RNA, 14 nt, Mycobacterium bovis subsp bovis AF2122/97
gcgcgugcuuggca

SEQ ID NO: 3160530 - RNA, 15 nt, Mycobacterium bovis subsp bovis AF2122/97
gcgcguggcagugca

SEQ ID NO: 3160531 - RNA, 19 nt, Mycobacterium bovis subsp bovis AF2122/97
gcgcguggcagugcaggcg

SEQ ID NO: 3160532 - RNA, 21 nt, Mycobacterium bovis subsp bovis AF2122/97
gcgcguggcagugcaggcggc

SEQ ID NO: 3160533 - RNA, 15 nt, Mycobacterium bovis subsp bovis AF2122/97
gcgcgugggcgugca

SEQ ID NO: 3160534 - RNA, 18 nt, Mycobacterium bovis subsp bovis AF2122/97
gcgcgugggcgugcaggc

SEQ ID NO: 3160535 - RNA, 15 nt, Mycobacterium bovis subsp bovis AF2122/97
gcgcgugguaccgcu

SEQ ID NO: 3160536 - RNA, 22 nt, Mycobacterium bovis subsp bovis AF2122/97
gcgcucggugccgcccaggagc

SEQ ID NO: 3160537 - RNA, 14 nt, Mycobacterium bovis subsp bovis AF2122/97
gcgcucgucgcggc

SEQ ID NO: 3160538 - RNA, 15 nt, Mycobacterium bovis subsp bovis AF2122/97
gcgcucgucgcggcc

SEQ ID NO: 3160539 - RNA, 22 nt, Mycobacterium bovis subsp bovis AF2122/97
gcgcucgucuaccccgagccuu

SEQ ID NO: 3160540 - RNA, 16 nt, Mycobacterium bovis subsp bovis AF2122/97
gcgcucguggucgacg

SEQ ID NO: 3160541 - RNA, 22 nt, Mycobacterium bovis subsp bovis AF2122/97
gcgcucguggucgacgugaucg

SEQ ID NO: 3160542 - RNA, 23 nt, Mycobacterium bovis subsp bovis AF2122/97
gcgcucguggucgacgugaucgc

SEQ ID NO: 3160543 - RNA, 17 nt, Mycobacterium bovis subsp bovis AF2122/97
gcgcugaaaugccgucg

SEQ ID NO: 3160544 - RNA, 15 nt, Mycobacterium bovis subsp bovis AF2122/97
gcgcugaacgcgagc

SEQ ID NO: 3160545 - RNA, 16 nt, Mycobacterium bovis subsp bovis AF2122/97
gcgcugaagccgacga

SEQ ID NO: 3160546 - RNA, 16 nt, Mycobacterium bovis subsp bovis AF2122/97
gcgcugagcacgcgga

SEQ ID NO: 3160547 - RNA, 21 nt, Mycobacterium bovis subsp bovis AF2122/97
gcgcugagcacgcggaucgcg

SEQ ID NO: 3160548 - RNA, 18 nt, Mycobacterium bovis subsp bovis AF2122/97
gcgcugagcgacugcagc

SEQ ID NO: 3160549 - RNA, 19 nt, Mycobacterium bovis subsp bovis AF2122/97
gcgcugagcgacugcagcg

SEQ ID NO: 3160550 - RNA, 21 nt, Mycobacterium bovis subsp bovis AF2122/97
gcgcugagcgacugcagcggc

SEQ ID NO: 3160551 - RNA, 15 nt, Mycobacterium bovis subsp bovis AF2122/97
gcgcugaucgcgcgc

SEQ ID NO: 3160552 - RNA, 17 nt, Mycobacterium bovis subsp bovis AF2122/97
gcgcugaucggcagggu

SEQ ID NO: 3160553 - RNA, 18 nt, Mycobacterium bovis subsp bovis AF2122/97
gcgcugaugcuggccaug

SEQ ID NO: 3160554 - RNA, 19 nt, Mycobacterium bovis subsp bovis AF2122/97
gcgcugcaccgggucaacg

SEQ ID NO: 3160555 - RNA, 21 nt, Mycobacterium bovis subsp bovis AF2122/97
gcgcugcaccguagugaacgg

SEQ ID NO: 3160556 - RNA, 11 nt, Mycobacterium bovis subsp bovis AF2122/97
gcgcugcagca

SEQ ID NO: 3160557 - RNA, 13 nt, Mycobacterium bovis subsp bovis AF2122/97
gcgcugcagcacg

SEQ ID NO: 3160558 - RNA, 20 nt, Mycobacterium bovis subsp bovis AF2122/97
gcgcugcagcacggcuucgc

SEQ ID NO: 3160559 - RNA, 14 nt, Mycobacterium bovis subsp bovis AF2122/97
gcgcugcagcaugg

SEQ ID NO: 3160560 - RNA, 17 nt, Mycobacterium bovis subsp bovis AF2122/97
gcgcugcagcauggcuc

SEQ ID NO: 3160561 - RNA, 17 nt, Mycobacterium bovis subsp bovis AF2122/97
gcgcugcagcugaaucg

SEQ ID NO: 3160562 - RNA, 21 nt, Mycobacterium bovis subsp bovis AF2122/97
gcgcugccaguucuuggcgac

SEQ ID NO: 3160563 - RNA, 16 nt, Mycobacterium bovis subsp bovis AF2122/97
gcgcugcccacgccgg

SEQ ID NO: 3160564 - RNA, 22 nt, Mycobacterium bovis subsp bovis AF2122/97
gcgcugcccgccgccccguuca

SEQ ID NO: 3160565 - RNA, 21 nt, Mycobacterium bovis subsp bovis AF2122/97
gcgcugcccgggcugccgccc

SEQ ID NO: 3160566 - RNA, 13 nt, Mycobacterium bovis subsp bovis AF2122/97
gcgcugccggccg

SEQ ID NO: 3160567 - RNA, 14 nt, Mycobacterium bovis subsp bovis AF2122/97
gcgcugccggccgc

SEQ ID NO: 3160568 - RNA, 13 nt, Mycobacterium bovis subsp bovis AF2122/97
gcgcugcgcaccg

SEQ ID NO: 3160569 - RNA, 18 nt, Mycobacterium bovis subsp bovis AF2122/97
gcgcugcgcaccgccgcg

SEQ ID NO: 3160570 - RNA, 21 nt, Mycobacterium bovis subsp bovis AF2122/97
gcgcugcgcaccgccgcgcga

SEQ ID NO: 3160571 - RNA, 16 nt, Mycobacterium bovis subsp bovis AF2122/97
gcgcugcgcgcgaucc

SEQ ID NO: 3160572 - RNA, 20 nt, Mycobacterium bovis subsp bovis AF2122/97
gcgcugcggaucguggcgcc

SEQ ID NO: 3160573 - RNA, 21 nt, Mycobacterium bovis subsp bovis AF2122/97
gcgcugcggaucguggcgccc

SEQ ID NO: 3160574 - RNA, 13 nt, Mycobacterium bovis subsp bovis AF2122/97
gcgcugcggccag

SEQ ID NO: 3160575 - RNA, 16 nt, Mycobacterium bovis subsp bovis AF2122/97
gcgcugcggcccacac

SEQ ID NO: 3160576 - RNA, 19 nt, Mycobacterium bovis subsp bovis AF2122/97
gcgcugcggcccacaccag

SEQ ID NO: 3160577 - RNA, 21 nt, Mycobacterium bovis subsp bovis AF2122/97
gcgcugcggcccacaccagcg

SEQ ID NO: 3160578 - RNA, 12 nt, Mycobacterium bovis subsp bovis AF2122/97
gcgcugcucacg

SEQ ID NO: 3160579 - RNA, 17 nt, Mycobacterium bovis subsp bovis AF2122/97
gcgcugcucacgcagca

SEQ ID NO: 3160580 - RNA, 20 nt, Mycobacterium bovis subsp bovis AF2122/97
gcgcugcucacgcagcagug

SEQ ID NO: 3160581 - RNA, 22 nt, Mycobacterium bovis subsp bovis AF2122/97
gcgcugcucccgaaaagcgccu

SEQ ID NO: 3160582 - RNA, 18 nt, Mycobacterium bovis subsp bovis AF2122/97
gcgcugcucugagcuugg

SEQ ID NO: 3160583 - RNA, 22 nt, Mycobacterium bovis subsp bovis AF2122/97
gcgcugcucugagcuuggucgc

SEQ ID NO: 3160584 - RNA, 21 nt, Mycobacterium bovis subsp bovis AF2122/97
gcgcugcugccgaugugugga

SEQ ID NO: 3160585 - RNA, 15 nt, Mycobacterium bovis subsp bovis AF2122/97
gcgcugcuggcagac

SEQ ID NO: 3160586 - RNA, 18 nt, Mycobacterium bovis subsp bovis AF2122/97
gcgcugcuugaggucccg

SEQ ID NO: 3160587 - RNA, 13 nt, Mycobacterium bovis subsp bovis AF2122/97
gcgcuggaccuga

SEQ ID NO: 3160588 - RNA, 13 nt, Mycobacterium bovis subsp bovis AF2122/97
gcgcuggacggcg

SEQ ID NO: 3160589 - RNA, 21 nt, Mycobacterium bovis subsp bovis AF2122/97
gcgcuggaggacccgcuacga

SEQ ID NO: 3160590 - RNA, 17 nt, Mycobacterium bovis subsp bovis AF2122/97
gcgcuggaggccaccac

SEQ ID NO: 3160591 - RNA, 21 nt, Mycobacterium bovis subsp bovis AF2122/97
gcgcuggaggcuccuggucgc

SEQ ID NO: 3160592 - RNA, 22 nt, Mycobacterium bovis subsp bovis AF2122/97
gcgcuggaugugggcgcucgca

SEQ ID NO: 3160593 - RNA, 16 nt, Mycobacterium bovis subsp bovis AF2122/97
gcgcuggccagcaggg

SEQ ID NO: 3160594 - RNA, 17 nt, Mycobacterium bovis subsp bovis AF2122/97
gcgcuggccagcccggu

SEQ ID NO: 3160595 - RNA, 21 nt, Mycobacterium bovis subsp bovis AF2122/97
gcgcuggcccgccaggucccc

SEQ ID NO: 3160596 - RNA, 14 nt, Mycobacterium bovis subsp bovis AF2122/97
gcgcuggccgucga

SEQ ID NO: 3160597 - RNA, 15 nt, Mycobacterium bovis subsp bovis AF2122/97
gcgcuggcgccgccg

SEQ ID NO: 3160598 - RNA, 17 nt, Mycobacterium bovis subsp bovis AF2122/97
gcgcuggcgccgccggu

SEQ ID NO: 3160599 - RNA, 18 nt, Mycobacterium bovis subsp bovis AF2122/97
gcgcuggcgccgccggug

SEQ ID NO: 3160600 - RNA, 13 nt, Mycobacterium bovis subsp bovis AF2122/97
gcgcuggcgccgg

SEQ ID NO: 3160601 - RNA, 14 nt, Mycobacterium bovis subsp bovis AF2122/97
gcgcuggcgccggc

SEQ ID NO: 3160602 - RNA, 18 nt, Mycobacterium bovis subsp bovis AF2122/97
gcgcuggcgccggccagc

SEQ ID NO: 3160603 - RNA, 13 nt, Mycobacterium bovis subsp bovis AF2122/97
gcgcuggcggcgc

SEQ ID NO: 3160604 - RNA, 15 nt, Mycobacterium bovis subsp bovis AF2122/97
gcgcuggcggcgcag

SEQ ID NO: 3160605 - RNA, 15 nt, Mycobacterium bovis subsp bovis AF2122/97
gcgcuggcgggcagc

SEQ ID NO: 3160606 - RNA, 21 nt, Mycobacterium bovis subsp bovis AF2122/97
gcgcuggcuacccaccggccg

SEQ ID NO: 3160607 - RNA, 21 nt, Mycobacterium bovis subsp bovis AF2122/97
gcgcugggacggucgcucggc

SEQ ID NO: 3160608 - RNA, 21 nt, Mycobacterium bovis subsp bovis AF2122/97
gcgcugggcccaggagaucca

SEQ ID NO: 3160609 - RNA, 17 nt, Mycobacterium bovis subsp bovis AF2122/97
gcgcugggcccgagcgc

SEQ ID NO: 3160610 - RNA, 22 nt, Mycobacterium bovis subsp bovis AF2122/97
gcgcugggcccgagcgcgcgcu

SEQ ID NO: 3160611 - RNA, 17 nt, Mycobacterium bovis subsp bovis AF2122/97
gcgcugggcgccguagc

SEQ ID NO: 3160612 - RNA, 17 nt, Mycobacterium bovis subsp bovis AF2122/97
gcgcugggcgcgcucau

SEQ ID NO: 3160613 - RNA, 20 nt, Mycobacterium bovis subsp bovis AF2122/97
gcgcugggcgcgcucaucga

SEQ ID NO: 3160614 - RNA, 21 nt, Mycobacterium bovis subsp bovis AF2122/97
gcgcugggcgcgcucaucgac

SEQ ID NO: 3160615 - RNA, 16 nt, Mycobacterium bovis subsp bovis AF2122/97
gcgcugggguccgcgu

SEQ ID NO: 3160616 - RNA, 21 nt, Mycobacterium bovis subsp bovis AF2122/97
gcgcugggguccgcgucggcg

SEQ ID NO: 3160617 - RNA, 15 nt, Mycobacterium bovis subsp bovis AF2122/97
gcgcugggucguguc

SEQ ID NO: 3160618 - RNA, 20 nt, Mycobacterium bovis subsp bovis AF2122/97
gcgcugggucgugucgccac

SEQ ID NO: 3160619 - RNA, 18 nt, Mycobacterium bovis subsp bovis AF2122/97
gcgcugggugaugagcgc

SEQ ID NO: 3160620 - RNA, 19 nt, Mycobacterium bovis subsp bovis AF2122/97
gcgcuggucagccgugccg

SEQ ID NO: 3160621 - RNA, 21 nt, Mycobacterium bovis subsp bovis AF2122/97
gcgcuggucagccgugccgug

SEQ ID NO: 3160622 - RNA, 19 nt, Mycobacterium bovis subsp bovis AF2122/97
gcggacaccgcggcgaucu

SEQ ID NO: 3160623 - RNA, 18 nt, Mycobacterium bovis subsp bovis AF2122/97
gcggacaccucgggcgcc

SEQ ID NO: 3160624 - RNA, 22 nt, Mycobacterium bovis subsp bovis AF2122/97
gcggacaccucgggcgcccgcg

SEQ ID NO: 3160625 - RNA, 23 nt, Mycobacterium bovis subsp bovis AF2122/97
gcggacacgaucgcgucggcuac

SEQ ID NO: 3160626 - RNA, 13 nt, Mycobacterium bovis subsp bovis AF2122/97
gcggacagcucgc

SEQ ID NO: 3160627 - RNA, 15 nt, Mycobacterium bovis subsp bovis AF2122/97
gcggacagcucgcgg

SEQ ID NO: 3160628 - RNA, 17 nt, Mycobacterium bovis subsp bovis AF2122/97
gcggacagcucgcggua

SEQ ID NO: 3160629 - RNA, 22 nt, Mycobacterium bovis subsp bovis AF2122/97
gcggacaggauauugaccuucu

SEQ ID NO: 3160630 - RNA, 12 nt, Mycobacterium bovis subsp bovis AF2122/97
gcggacaggccc

SEQ ID NO: 3160631 - RNA, 14 nt, Mycobacterium bovis subsp bovis AF2122/97
gcggacagggcggc

SEQ ID NO: 3160632 - RNA, 17 nt, Mycobacterium bovis subsp bovis AF2122/97
gcggacagggcggcaac

SEQ ID NO: 3160633 - RNA, 18 nt, Mycobacterium bovis subsp bovis AF2122/97
gcggacagggcggcaacg

SEQ ID NO: 3160634 - RNA, 13 nt, Mycobacterium bovis subsp bovis AF2122/97
gcggacaguuccc

SEQ ID NO: 3160635 - RNA, 18 nt, Mycobacterium bovis subsp bovis AF2122/97
gcggacauccgggccgag

SEQ ID NO: 3160636 - RNA, 23 nt, Mycobacterium bovis subsp bovis AF2122/97
gcggacauccgggccgagcgcac

SEQ ID NO: 3160637 - RNA, 14 nt, Mycobacterium bovis subsp bovis AF2122/97
gcggaccacaccgu

SEQ ID NO: 3160638 - RNA, 16 nt, Mycobacterium bovis subsp bovis AF2122/97
gcggaccacaccguca

SEQ ID NO: 3160639 - RNA, 14 nt, Mycobacterium bovis subsp bovis AF2122/97
gcggaccaccgcuc

SEQ ID NO: 3160640 - RNA, 16 nt, Mycobacterium bovis subsp bovis AF2122/97
gcggaccaccgcucgc

SEQ ID NO: 3160641 - RNA, 14 nt, Mycobacterium bovis subsp bovis AF2122/97
gcggacccgaccgu

SEQ ID NO: 3160642 - RNA, 16 nt, Mycobacterium bovis subsp bovis AF2122/97
gcggacccgaccgucg

SEQ ID NO: 3160643 - RNA, 17 nt, Mycobacterium bovis subsp bovis AF2122/97
gcggacccgaccgucgu

SEQ ID NO: 3160644 - RNA, 19 nt, Mycobacterium bovis subsp bovis AF2122/97
gcggacccgaccgucgucg

SEQ ID NO: 3160645 - RNA, 14 nt, Mycobacterium bovis subsp bovis AF2122/97
gcggacccgcagcu

SEQ ID NO: 3160646 - RNA, 21 nt, Mycobacterium bovis subsp bovis AF2122/97
gcggacccgcagcugcggauc

SEQ ID NO: 3160647 - RNA, 20 nt, Mycobacterium bovis subsp bovis AF2122/97
gcggacccgccgugaguagg

SEQ ID NO: 3160648 - RNA, 19 nt, Mycobacterium bovis subsp bovis AF2122/97
gcggacccgcgcgucgccc

SEQ ID NO: 3160649 - RNA, 14 nt, Mycobacterium bovis subsp bovis AF2122/97
gcggacccgcucgc

SEQ ID NO: 3160650 - RNA, 16 nt, Mycobacterium bovis subsp bovis AF2122/97
gcggacccggugaccc

SEQ ID NO: 3160651 - RNA, 22 nt, Mycobacterium bovis subsp bovis AF2122/97
gcggacccggugacccgcuggg

SEQ ID NO: 3160652 - RNA, 14 nt, Mycobacterium bovis subsp bovis AF2122/97
gcggacccgucggc

SEQ ID NO: 3160653 - RNA, 16 nt, Mycobacterium bovis subsp bovis AF2122/97
gcggacccgucggcgu

SEQ ID NO: 3160654 - RNA, 19 nt, Mycobacterium bovis subsp bovis AF2122/97
gcggacccgucggcguggc

SEQ ID NO: 3160655 - RNA, 23 nt, Mycobacterium bovis subsp bovis AF2122/97
gcggacccgucggcguggcugcc

SEQ ID NO: 3160656 - RNA, 22 nt, Mycobacterium bovis subsp bovis AF2122/97
gcggaccgaugacgaucggcgg

SEQ ID NO: 3160657 - RNA, 20 nt, Mycobacterium bovis subsp bovis AF2122/97
gcggaccgauugucggcaac

SEQ ID NO: 3160658 - RNA, 15 nt, Mycobacterium bovis subsp bovis AF2122/97
gcggaccgcagcgug

SEQ ID NO: 3160659 - RNA, 15 nt, Mycobacterium bovis subsp bovis AF2122/97
gcggaccggcgcgcu

SEQ ID NO: 3160660 - RNA, 12 nt, Mycobacterium bovis subsp bovis AF2122/97
gcggaccguccg

SEQ ID NO: 3160661 - RNA, 12 nt, Mycobacterium bovis subsp bovis AF2122/97
gcggaccucggc

SEQ ID NO: 3160662 - RNA, 14 nt, Mycobacterium bovis subsp bovis AF2122/97
gcggaccucggcga

SEQ ID NO: 3160663 - RNA, 15 nt, Mycobacterium bovis subsp bovis AF2122/97
gcggaccucggcgac

SEQ ID NO: 3160664 - RNA, 17 nt, Mycobacterium bovis subsp bovis AF2122/97
gcggaccucggcgaccu

SEQ ID NO: 3160665 - RNA, 15 nt, Mycobacterium bovis subsp bovis AF2122/97
gcggaccugcgccgg

SEQ ID NO: 3160666 - RNA, 12 nt, Mycobacterium bovis subsp bovis AF2122/97
gcggaccuggcg

SEQ ID NO: 3160667 - RNA, 16 nt, Mycobacterium bovis subsp bovis AF2122/97
gcggaccuggcggcgg

SEQ ID NO: 3160668 - RNA, 17 nt, Mycobacterium bovis subsp bovis AF2122/97
gcggaccuggcggcggu

SEQ ID NO: 3160669 - RNA, 21 nt, Mycobacterium bovis subsp bovis AF2122/97
gcggacgaacccguuuugggu

SEQ ID NO: 3160670 - RNA, 17 nt, Mycobacterium bovis subsp bovis AF2122/97
gcggacgcccggcgcac

SEQ ID NO: 3160671 - RNA, 13 nt, Mycobacterium bovis subsp bovis AF2122/97
gcggacgccgcgc

SEQ ID NO: 3160672 - RNA, 15 nt, Mycobacterium bovis subsp bovis AF2122/97
gcggacgccgcgccg

SEQ ID NO: 3160673 - RNA, 18 nt, Mycobacterium bovis subsp bovis AF2122/97
gcggacgccgcgccggcg

SEQ ID NO: 3160674 - RNA, 23 nt, Mycobacterium bovis subsp bovis AF2122/97
gcggacggcguuuccuucgacga

SEQ ID NO: 3160675 - RNA, 23 nt, Mycobacterium bovis subsp bovis AF2122/97
gcggacggugcggucagauucgg

SEQ ID NO: 3160676 - RNA, 14 nt, Mycobacterium bovis subsp bovis AF2122/97
gcggacgucgcccc

SEQ ID NO: 3160677 - RNA, 19 nt, Mycobacterium bovis subsp bovis AF2122/97
gcggacucacgaggcacaa

SEQ ID NO: 3160678 - RNA, 20 nt, Mycobacterium bovis subsp bovis AF2122/97
gcggacucgggcaggcccca

SEQ ID NO: 3160679 - RNA, 15 nt, Mycobacterium bovis subsp bovis AF2122/97
gcggacugacgucga

SEQ ID NO: 3160680 - RNA, 17 nt, Mycobacterium bovis subsp bovis AF2122/97
gcggacuggcauccgcc

SEQ ID NO: 3160681 - RNA, 19 nt, Mycobacterium bovis subsp bovis AF2122/97
gcggacuggcauccgcccc

SEQ ID NO: 3160682 - RNA, 22 nt, Mycobacterium bovis subsp bovis AF2122/97
gcggacuggcauccgccccgcc

SEQ ID NO: 3160683 - RNA, 14 nt, Mycobacterium bovis subsp bovis AF2122/97
gcggacuucgccgc

SEQ ID NO: 3160684 - RNA, 17 nt, Mycobacterium bovis subsp bovis AF2122/97
gcggacuuggcggucgg

SEQ ID NO: 3160685 - RNA, 16 nt, Mycobacterium bovis subsp bovis AF2122/97
gcggagaaaagcgcgc

SEQ ID NO: 3160686 - RNA, 13 nt, Mycobacterium bovis subsp bovis AF2122/97
gcggagaaggcgc

SEQ ID NO: 3160687 - RNA, 16 nt, Mycobacterium bovis subsp bovis AF2122/97
gcggagaaggcgcggg

SEQ ID NO: 3160688 - RNA, 19 nt, Mycobacterium bovis subsp bovis AF2122/97
gcggagaccccgcgcgcuu

SEQ ID NO: 3160689 - RNA, 14 nt, Mycobacterium bovis subsp bovis AF2122/97
gcggagacgaucgc

SEQ ID NO: 3160690 - RNA, 18 nt, Mycobacterium bovis subsp bovis AF2122/97
gcggagacgaucgccagg

SEQ ID NO: 3160691 - RNA, 19 nt, Mycobacterium bovis subsp bovis AF2122/97
gcggagacgaucgccaggc

SEQ ID NO: 3160692 - RNA, 22 nt, Mycobacterium bovis subsp bovis AF2122/97
gcggagacgaucgccaggccga

SEQ ID NO: 3160693 - RNA, 17 nt, Mycobacterium bovis subsp bovis AF2122/97
gcggagagccugcucgc

SEQ ID NO: 3160694 - RNA, 22 nt, Mycobacterium bovis subsp bovis AF2122/97
gcggagagccugcucgcagcgg

SEQ ID NO: 3160695 - RNA, 13 nt, Mycobacterium bovis subsp bovis AF2122/97
gcggagauaccgg

SEQ ID NO: 3160696 - RNA, 14 nt, Mycobacterium bovis subsp bovis AF2122/97
gcggagauaccgga

SEQ ID NO: 3160697 - RNA, 20 nt, Mycobacterium bovis subsp bovis AF2122/97
gcggagcaauuccacgaucg

SEQ ID NO: 3160698 - RNA, 15 nt, Mycobacterium bovis subsp bovis AF2122/97
gcggagccacucggc

SEQ ID NO: 3160699 - RNA, 17 nt, Mycobacterium bovis subsp bovis AF2122/97
gcggagccacucggccc

SEQ ID NO: 3160700 - RNA, 15 nt, Mycobacterium bovis subsp bovis AF2122/97
gcggagccgaugacc

SEQ ID NO: 3160701 - RNA, 15 nt, Mycobacterium bovis subsp bovis AF2122/97
gcggagccgccgcug

SEQ ID NO: 3160702 - RNA, 17 nt, Mycobacterium bovis subsp bovis AF2122/97
gcggagccgggugaggc

SEQ ID NO: 3160703 - RNA, 15 nt, Mycobacterium bovis subsp bovis AF2122/97
gcggagccgucgcau

SEQ ID NO: 3160704 - RNA, 14 nt, Mycobacterium bovis subsp bovis AF2122/97
gcggagcgcccuug

SEQ ID NO: 3160705 - RNA, 15 nt, Mycobacterium bovis subsp bovis AF2122/97
gcggagcgggccagc

SEQ ID NO: 3160706 - RNA, 17 nt, Mycobacterium bovis subsp bovis AF2122/97
gcggagcgggccagcac

SEQ ID NO: 3160707 - RNA, 18 nt, Mycobacterium bovis subsp bovis AF2122/97
gcggagcucacgccgggu

SEQ ID NO: 3160708 - RNA, 15 nt, Mycobacterium bovis subsp bovis AF2122/97
gcggaggcgaccccg

SEQ ID NO: 3160709 - RNA, 21 nt, Mycobacterium bovis subsp bovis AF2122/97
gcggcaaaguuggccgcccga

SEQ ID NO: 3160710 - RNA, 16 nt, Mycobacterium bovis subsp bovis AF2122/97
gcggcaacaaagucgc

SEQ ID NO: 3160711 - RNA, 17 nt, Mycobacterium bovis subsp bovis AF2122/97
gcggcaacaccaccucg

SEQ ID NO: 3160712 - RNA, 12 nt, Mycobacterium bovis subsp bovis AF2122/97
gcggcaacagcg

SEQ ID NO: 3160713 - RNA, 15 nt, Mycobacterium bovis subsp bovis AF2122/97
gcggcaacaugucac

SEQ ID NO: 3160714 - RNA, 16 nt, Mycobacterium bovis subsp bovis AF2122/97
gcggcaaccgccgcca

SEQ ID NO: 3160715 - RNA, 21 nt, Mycobacterium bovis subsp bovis AF2122/97
gcggcaaccgccgccaccagg

SEQ ID NO: 3160716 - RNA, 14 nt, Mycobacterium bovis subsp bovis AF2122/97
gcggcaaccgucga

SEQ ID NO: 3160717 - RNA, 16 nt, Mycobacterium bovis subsp bovis AF2122/97
gcggcaaccgucgaaa

SEQ ID NO: 3160718 - RNA, 21 nt, Mycobacterium bovis subsp bovis AF2122/97
gcggcaaccucaugcacgccg

SEQ ID NO: 3160719 - RNA, 18 nt, Mycobacterium bovis subsp bovis AF2122/97
gcggcaacgaucgacacc

SEQ ID NO: 3160720 - RNA, 17 nt, Mycobacterium bovis subsp bovis AF2122/97
gcggcaacgcggucugc

SEQ ID NO: 3160721 - RNA, 19 nt, Mycobacterium bovis subsp bovis AF2122/97
gcggcaacgcggucugcuc

SEQ ID NO: 3160722 - RNA, 14 nt, Mycobacterium bovis subsp bovis AF2122/97
gcggcaacggcgga

SEQ ID NO: 3160723 - RNA, 15 nt, Mycobacterium bovis subsp bovis AF2122/97
gcggcaacggcggca

SEQ ID NO: 3160724 - RNA, 18 nt, Mycobacterium bovis subsp bovis AF2122/97
gcggcaacggcggcaucg

SEQ ID NO: 3160725 - RNA, 15 nt, Mycobacterium bovis subsp bovis AF2122/97
gcggcaacggcggcg

SEQ ID NO: 3160726 - RNA, 15 nt, Mycobacterium bovis subsp bovis AF2122/97
gcggcaacggcucgu

SEQ ID NO: 3160727 - RNA, 18 nt, Mycobacterium bovis subsp bovis AF2122/97
gcggcaacggcucgucga

SEQ ID NO: 3160728 - RNA, 15 nt, Mycobacterium bovis subsp bovis AF2122/97
gcggcaacgggggcg

SEQ ID NO: 3160729 - RNA, 18 nt, Mycobacterium bovis subsp bovis AF2122/97
gcggcaacgggggcgccg

SEQ ID NO: 3160730 - RNA, 20 nt, Mycobacterium bovis subsp bovis AF2122/97
gcggcaacgggggcgccgga

SEQ ID NO: 3160731 - RNA, 14 nt, Mycobacterium bovis subsp bovis AF2122/97
gcggcaacgguggc

SEQ ID NO: 3160732 - RNA, 21 nt, Mycobacterium bovis subsp bovis AF2122/97
gcggcaacuccggucaacacc

SEQ ID NO: 3160733 - RNA, 15 nt, Mycobacterium bovis subsp bovis AF2122/97
gcggcaagcgcacgc

SEQ ID NO: 3160734 - RNA, 19 nt, Mycobacterium bovis subsp bovis AF2122/97
gcggcaagcucguccggug

SEQ ID NO: 3160735 - RNA, 14 nt, Mycobacterium bovis subsp bovis AF2122/97
gcggcaagggcggc

SEQ ID NO: 3160736 - RNA, 14 nt, Mycobacterium bovis subsp bovis AF2122/97
gcggcaagggcuuc

SEQ ID NO: 3160737 - RNA, 22 nt, Mycobacterium bovis subsp bovis AF2122/97
gcggcaaggguggggccggcgg

SEQ ID NO: 3160738 - RNA, 18 nt, Mycobacterium bovis subsp bovis AF2122/97
gcggcaaggguggugacg

SEQ ID NO: 3160739 - RNA, 23 nt, Mycobacterium bovis subsp bovis AF2122/97
gcggcaaugaggccgucugcggu

SEQ ID NO: 3160740 - RNA, 15 nt, Mycobacterium bovis subsp bovis AF2122/97
gcggcaauggccagc

SEQ ID NO: 3160741 - RNA, 16 nt, Mycobacterium bovis subsp bovis AF2122/97
gcggcaauggccagca

SEQ ID NO: 3160742 - RNA, 21 nt, Mycobacterium bovis subsp bovis AF2122/97
gcggcaauucgggcauggucg

SEQ ID NO: 3160743 - RNA, 22 nt, Mycobacterium bovis subsp bovis AF2122/97
gcggcaauucgggcauggucgc

SEQ ID NO: 3160744 - RNA, 20 nt, Mycobacterium bovis subsp bovis AF2122/97
gcggcaauugcgguucgaac

SEQ ID NO: 3160745 - RNA, 13 nt, Mycobacterium bovis subsp bovis AF2122/97
gcggcacacccau

SEQ ID NO: 3160746 - RNA, 21 nt, Mycobacterium bovis subsp bovis AF2122/97
gcggcacacccaucaccgcca

SEQ ID NO: 3160747 - RNA, 22 nt, Mycobacterium bovis subsp bovis AF2122/97
gcggcacacccaucaccgccag

SEQ ID NO: 3160748 - RNA, 24 nt, Mycobacterium bovis subsp bovis AF2122/97
gcggcacacccaucaccgccagcc

SEQ ID NO: 3160749 - RNA, 21 nt, Mycobacterium bovis subsp bovis AF2122/97
gcggcacaucaugggcgcugc

SEQ ID NO: 3160750 - RNA, 12 nt, Mycobacterium bovis subsp bovis AF2122/97
gcggcaccaccc

SEQ ID NO: 3160751 - RNA, 15 nt, Mycobacterium bovis subsp bovis AF2122/97
gcggcaccacgucga

SEQ ID NO: 3160752 - RNA, 15 nt, Mycobacterium bovis subsp bovis AF2122/97
gcggcaccagcaccg

SEQ ID NO: 3160753 - RNA, 23 nt, Mycobacterium bovis subsp bovis AF2122/97
gcggcaccagcaccgucggggug

SEQ ID NO: 3160754 - RNA, 13 nt, Mycobacterium bovis subsp bovis AF2122/97
gcggcacccaacc

SEQ ID NO: 3160755 - RNA, 14 nt, Mycobacterium bovis subsp bovis AF2122/97
gcggcacccaacca

SEQ ID NO: 3160756 - RNA, 19 nt, Mycobacterium bovis subsp bovis AF2122/97
gcggcacccaaccaggccg

SEQ ID NO: 3160757 - RNA, 24 nt, Mycobacterium bovis subsp bovis AF2122/97
gcggcacccaaccaggccgcgaca

SEQ ID NO: 3160758 - RNA, 20 nt, Mycobacterium bovis subsp bovis AF2122/97
gcggcacccggguggcacgc

SEQ ID NO: 3160759 - RNA, 16 nt, Mycobacterium bovis subsp bovis AF2122/97
gcggcacccggucggc

SEQ ID NO: 3160760 - RNA, 21 nt, Mycobacterium bovis subsp bovis AF2122/97
gcggcaccgauggcgcaccgg

SEQ ID NO: 3160761 - RNA, 23 nt, Mycobacterium bovis subsp bovis AF2122/97
gcggcaccgauggcgcaccggcg

SEQ ID NO: 3160762 - RNA, 14 nt, Mycobacterium bovis subsp bovis AF2122/97
gcggcaccgccccg

SEQ ID NO: 3160763 - RNA, 17 nt, Mycobacterium bovis subsp bovis AF2122/97
gcggcaccgccccgcca

SEQ ID NO: 3160764 - RNA, 18 nt, Mycobacterium bovis subsp bovis AF2122/97
gcggcaccgcgccggcgg

SEQ ID NO: 3160765 - RNA, 17 nt, Mycobacterium bovis subsp bovis AF2122/97
gcggcaccgcggccagc

SEQ ID NO: 3160766 - RNA, 19 nt, Mycobacterium bovis subsp bovis AF2122/97
gcggcaccgcggccagcgg

SEQ ID NO: 3160767 - RNA, 13 nt, Mycobacterium bovis subsp bovis AF2122/97
gcggcaccgcuga

SEQ ID NO: 3160768 - RNA, 19 nt, Mycobacterium bovis subsp bovis AF2122/97
gcggcaccgcuucaggcgc

SEQ ID NO: 3160769 - RNA, 20 nt, Mycobacterium bovis subsp bovis AF2122/97
gcggcaccgcuucaggcgcc

SEQ ID NO: 3160770 - RNA, 13 nt, Mycobacterium bovis subsp bovis AF2122/97
gcggcaccggcuc

SEQ ID NO: 3160771 - RNA, 10 nt, Mycobacterium bovis subsp bovis AF2122/97
gcggcaccuu

SEQ ID NO: 3160772 - RNA, 19 nt, Mycobacterium bovis subsp bovis AF2122/97
gcggcacgaucaaccgggu

SEQ ID NO: 3160773 - RNA, 13 nt, Mycobacterium bovis subsp bovis AF2122/97
gcggcacgaucgg

SEQ ID NO: 3160774 - RNA, 15 nt, Mycobacterium bovis subsp bovis AF2122/97
gcggcacgaucggca

SEQ ID NO: 3160775 - RNA, 16 nt, Mycobacterium bovis subsp bovis AF2122/97
gcggcacgaucggcag

SEQ ID NO: 3160776 - RNA, 14 nt, Mycobacterium bovis subsp bovis AF2122/97
gcggcacgcacgcg

SEQ ID NO: 3160777 - RNA, 15 nt, Mycobacterium bovis subsp bovis AF2122/97
gcggcacgcccacag

SEQ ID NO: 3160778 - RNA, 14 nt, Mycobacterium bovis subsp bovis AF2122/97
gcggcacgcucgcg

SEQ ID NO: 3160779 - RNA, 13 nt, Mycobacterium bovis subsp bovis AF2122/97
gcggcacgcugac

SEQ ID NO: 3160780 - RNA, 15 nt, Mycobacterium bovis subsp bovis AF2122/97
gcggcacgcugaccg

SEQ ID NO: 3160781 - RNA, 22 nt, Mycobacterium bovis subsp bovis AF2122/97
gcggcacgcugaccggaucuga

SEQ ID NO: 3160782 - RNA, 16 nt, Mycobacterium bovis subsp bovis AF2122/97
gcggcacgggcggcca

SEQ ID NO: 3160783 - RNA, 21 nt, Mycobacterium bovis subsp bovis AF2122/97
gcggcacgggcggccauggca

SEQ ID NO: 3160784 - RNA, 14 nt, Mycobacterium bovis subsp bovis AF2122/97
gcggcacggugugc

SEQ ID NO: 3160785 - RNA, 21 nt, Mycobacterium bovis subsp bovis AF2122/97
gcggcacuacgcagccguagc

SEQ ID NO: 3160786 - RNA, 23 nt, Mycobacterium bovis subsp bovis AF2122/97
gcggcacugaucugcguugcggc

SEQ ID NO: 3160787 - RNA, 17 nt, Mycobacterium bovis subsp bovis AF2122/97
gcggcacuggauccggg

SEQ ID NO: 3160788 - RNA, 23 nt, Mycobacterium bovis subsp bovis AF2122/97
gcggcacuuuguagcccgcgauc

SEQ ID NO: 3160789 - RNA, 19 nt, Mycobacterium bovis subsp bovis AF2122/97
gcggcagauacucggcgac

SEQ ID NO: 3160790 - RNA, 20 nt, Mycobacterium bovis subsp bovis AF2122/97
gcggcagcacccacaucagc

SEQ ID NO: 3160791 - RNA, 23 nt, Mycobacterium bovis subsp bovis AF2122/97
gcggcagcauauccgccggcgac

SEQ ID NO: 3160792 - RNA, 14 nt, Mycobacterium bovis subsp bovis AF2122/97
gcggcagcccccgg

SEQ ID NO: 3160793 - RNA, 12 nt, Mycobacterium bovis subsp bovis AF2122/97
gcggcagcccgc

SEQ ID NO: 3160794 - RNA, 14 nt, Mycobacterium bovis subsp bovis AF2122/97
gcggcagccggcgg

SEQ ID NO: 3160795 - RNA, 16 nt, Mycobacterium bovis subsp bovis AF2122/97
gcggcagccggcggag

SEQ ID NO: 3160796 - RNA, 15 nt, Mycobacterium bovis subsp bovis AF2122/97
gcggccaccaccgcc

SEQ ID NO: 3160797 - RNA, 20 nt, Mycobacterium bovis subsp bovis AF2122/97
gcggccaccagaucgcacac

SEQ ID NO: 3160798 - RNA, 22 nt, Mycobacterium bovis subsp bovis AF2122/97
gcggccaccagaucgcacacca

SEQ ID NO: 3160799 - RNA, 15 nt, Mycobacterium bovis subsp bovis AF2122/97
gcggccaccagcgcc

SEQ ID NO: 3160800 - RNA, 15 nt, Mycobacterium bovis subsp bovis AF2122/97
gcggccaccgaggcg

SEQ ID NO: 3160801 - RNA, 19 nt, Mycobacterium bovis subsp bovis AF2122/97
gcggccaccgaggcguuca

SEQ ID NO: 3160802 - RNA, 15 nt, Mycobacterium bovis subsp bovis AF2122/97
gcggccaccgcacgc

SEQ ID NO: 3160803 - RNA, 20 nt, Mycobacterium bovis subsp bovis AF2122/97
gcggccaccgcacgcuggcg

SEQ ID NO: 3160804 - RNA, 21 nt, Mycobacterium bovis subsp bovis AF2122/97
gcggccaccgccgccgccacc

SEQ ID NO: 3160805 - RNA, 20 nt, Mycobacterium bovis subsp bovis AF2122/97
gcggccaccgccgccgccga

SEQ ID NO: 3160806 - RNA, 22 nt, Mycobacterium bovis subsp bovis AF2122/97
gcggccaccgccgccgccgacg

SEQ ID NO: 3160807 - RNA, 17 nt, Mycobacterium bovis subsp bovis AF2122/97
gcggccaccgucagcgc

SEQ ID NO: 3160808 - RNA, 15 nt, Mycobacterium bovis subsp bovis AF2122/97
gcggccacgccgauc

SEQ ID NO: 3160809 - RNA, 19 nt, Mycobacterium bovis subsp bovis AF2122/97
gcggccacgguggcgcaag

SEQ ID NO: 3160810 - RNA, 17 nt, Mycobacterium bovis subsp bovis AF2122/97
gcggccacucgcccgau

SEQ ID NO: 3160811 - RNA, 21 nt, Mycobacterium bovis subsp bovis AF2122/97
gcggccacuuggaugcgaccc

SEQ ID NO: 3160812 - RNA, 22 nt, Mycobacterium bovis subsp bovis AF2122/97
gcggccacuuggaugcgacccg

SEQ ID NO: 3160813 - RNA, 23 nt, Mycobacterium bovis subsp bovis AF2122/97
gcggccacuuggaugcgacccgu

SEQ ID NO: 3160814 - RNA, 20 nt, Mycobacterium bovis subsp bovis AF2122/97
gcggccagagccgcgcgccg

SEQ ID NO: 3160815 - RNA, 18 nt, Mycobacterium bovis subsp bovis AF2122/97
gcggccagcacgucguug

SEQ ID NO: 3160816 - RNA, 16 nt, Mycobacterium bovis subsp bovis AF2122/97
gcggccagcagugcgg

SEQ ID NO: 3160817 - RNA, 17 nt, Mycobacterium bovis subsp bovis AF2122/97
gcggccagcaucgcggu

SEQ ID NO: 3160818 - RNA, 18 nt, Mycobacterium bovis subsp bovis AF2122/97
gcggccagcaucgcggug

SEQ ID NO: 3160819 - RNA, 21 nt, Mycobacterium bovis subsp bovis AF2122/97
gcggccagcaucggguggcga

SEQ ID NO: 3160820 - RNA, 14 nt, Mycobacterium bovis subsp bovis AF2122/97
gcggccagcccacu

SEQ ID NO: 3160821 - RNA, 18 nt, Mycobacterium bovis subsp bovis AF2122/97
gcggccagcccagccggg

SEQ ID NO: 3160822 - RNA, 14 nt, Mycobacterium bovis subsp bovis AF2122/97
gcggccagccgcuc

SEQ ID NO: 3160823 - RNA, 15 nt, Mycobacterium bovis subsp bovis AF2122/97
gcggccagccguuug

SEQ ID NO: 3160824 - RNA, 12 nt, Mycobacterium bovis subsp bovis AF2122/97
gcggccagcgaa

SEQ ID NO: 3160825 - RNA, 12 nt, Mycobacterium bovis subsp bovis AF2122/97
gcggccagcgag

SEQ ID NO: 3160826 - RNA, 19 nt, Mycobacterium bovis subsp bovis AF2122/97
gcggccagcgagaucagca

SEQ ID NO: 3160827 - RNA, 15 nt, Mycobacterium bovis subsp bovis AF2122/97
gcggccagcgcgcgc

SEQ ID NO: 3160828 - RNA, 16 nt, Mycobacterium bovis subsp bovis AF2122/97
gcggccagcgcggcgc

SEQ ID NO: 3160829 - RNA, 16 nt, Mycobacterium bovis subsp bovis AF2122/97
gcggccagcucggcca

SEQ ID NO: 3160830 - RNA, 14 nt, Mycobacterium bovis subsp bovis AF2122/97
gcggccaggcgcga

SEQ ID NO: 3160831 - RNA, 15 nt, Mycobacterium bovis subsp bovis AF2122/97
gcggccaggucgguc

SEQ ID NO: 3160832 - RNA, 16 nt, Mycobacterium bovis subsp bovis AF2122/97
gcggccaguacgucga

SEQ ID NO: 3160833 - RNA, 18 nt, Mycobacterium bovis subsp bovis AF2122/97
gcggccaguacgucgauc

SEQ ID NO: 3160834 - RNA, 15 nt, Mycobacterium bovis subsp bovis AF2122/97
gcggccagugcucgc

SEQ ID NO: 3160835 - RNA, 15 nt, Mycobacterium bovis subsp bovis AF2122/97
gcggccaguucggcg

SEQ ID NO: 3160836 - RNA, 18 nt, Mycobacterium bovis subsp bovis AF2122/97
gcggccauaucgcccacc

SEQ ID NO: 3160837 - RNA, 16 nt, Mycobacterium bovis subsp bovis AF2122/97
gcggccauccggcggc

SEQ ID NO: 3160838 - RNA, 17 nt, Mycobacterium bovis subsp bovis AF2122/97
gcggccauccggcggcg

SEQ ID NO: 3160839 - RNA, 20 nt, Mycobacterium bovis subsp bovis AF2122/97
gcggccauccggcggcggcc

SEQ ID NO: 3160840 - RNA, 15 nt, Mycobacterium bovis subsp bovis AF2122/97
gcggccaucgccgac

SEQ ID NO: 3160841 - RNA, 16 nt, Mycobacterium bovis subsp bovis AF2122/97
gcggccaucgccgaca

SEQ ID NO: 3160842 - RNA, 20 nt, Mycobacterium bovis subsp bovis AF2122/97
gcggccaucgggauggacac

SEQ ID NO: 3160843 - RNA, 18 nt, Mycobacterium bovis subsp bovis AF2122/97
gcggccauggcagcgcgc

SEQ ID NO: 3160844 - RNA, 19 nt, Mycobacterium bovis subsp bovis AF2122/97
gcggccauggcagcgcgcu

SEQ ID NO: 3160845 - RNA, 20 nt, Mycobacterium bovis subsp bovis AF2122/97
gcggccaugucagcggccug

SEQ ID NO: 3160846 - RNA, 19 nt, Mycobacterium bovis subsp bovis AF2122/97
gcggccauuagcagcaccc

SEQ ID NO: 3160847 - RNA, 18 nt, Mycobacterium bovis subsp bovis AF2122/97
gcggccauucggucagcc

SEQ ID NO: 3160848 - RNA, 15 nt, Mycobacterium bovis subsp bovis AF2122/97
gcggcccaaccgguc

SEQ ID NO: 3160849 - RNA, 20 nt, Mycobacterium bovis subsp bovis AF2122/97
gcggcccacaccagcgcagc

SEQ ID NO: 3160850 - RNA, 21 nt, Mycobacterium bovis subsp bovis AF2122/97
gcggcccacaccagcgcagca

SEQ ID NO: 3160851 - RNA, 14 nt, Mycobacterium bovis subsp bovis AF2122/97
gcggcccaccggcc

SEQ ID NO: 3160852 - RNA, 15 nt, Mycobacterium bovis subsp bovis AF2122/97
gcggcccaccggcca

SEQ ID NO: 3160853 - RNA, 14 nt, Mycobacterium bovis subsp bovis AF2122/97
gcggcccacgcgca

SEQ ID NO: 3160854 - RNA, 17 nt, Mycobacterium bovis subsp bovis AF2122/97
gcggcccagguccgcgu

SEQ ID NO: 3160855 - RNA, 20 nt, Mycobacterium bovis subsp bovis AF2122/97
gcggcccaucgaccgaggca

SEQ ID NO: 3160856 - RNA, 19 nt, Mycobacterium bovis subsp bovis AF2122/97
gcggcccaucgggcgccca

SEQ ID NO: 3160857 - RNA, 21 nt, Mycobacterium bovis subsp bovis AF2122/97
gcggccccgacacagcggcgg

SEQ ID NO: 3160858 - RNA, 21 nt, Mycobacterium bovis subsp bovis AF2122/97
gcggccccgacauacgucggg

SEQ ID NO: 3160859 - RNA, 15 nt, Mycobacterium bovis subsp bovis AF2122/97
gcggccccgccguug

SEQ ID NO: 3160860 - RNA, 22 nt, Mycobacterium bovis subsp bovis AF2122/97
gcggccccgccguugccgccga

SEQ ID NO: 3160861 - RNA, 23 nt, Mycobacterium bovis subsp bovis AF2122/97
gcggccccgccguugccgccgac

SEQ ID NO: 3160862 - RNA, 15 nt, Mycobacterium bovis subsp bovis AF2122/97
gcggccccgcgccac

SEQ ID NO: 3160863 - RNA, 21 nt, Mycobacterium bovis subsp bovis AF2122/97
gcggccccggcauugcccgag

SEQ ID NO: 3160864 - RNA, 21 nt, Mycobacterium bovis subsp bovis AF2122/97
gcggcccgacccggccgaugg

SEQ ID NO: 3160865 - RNA, 21 nt, Mycobacterium bovis subsp bovis AF2122/97
gcggcccgaggcucgggccgc

SEQ ID NO: 3160866 - RNA, 21 nt, Mycobacterium bovis subsp bovis AF2122/97
gcggcccgauagaucgcgugg

SEQ ID NO: 3160867 - RNA, 22 nt, Mycobacterium bovis subsp bovis AF2122/97
gcggcccgauagaucgcgugga

SEQ ID NO: 3160868 - RNA, 14 nt, Mycobacterium bovis subsp bovis AF2122/97
gcggcccgaucacc

SEQ ID NO: 3160869 - RNA, 13 nt, Mycobacterium bovis subsp bovis AF2122/97
gcggcccgcagcc

SEQ ID NO: 3160870 - RNA, 22 nt, Mycobacterium bovis subsp bovis AF2122/97
gcggcccgcagcccgccgggcu

SEQ ID NO: 3160871 - RNA, 18 nt, Mycobacterium bovis subsp bovis AF2122/97
gcggcccgcgaauacgag

SEQ ID NO: 3160872 - RNA, 13 nt, Mycobacterium bovis subsp bovis AF2122/97
gcggcccgcucca

SEQ ID NO: 3160873 - RNA, 22 nt, Mycobacterium bovis subsp bovis AF2122/97
gcggcccgcucgaaagcgucga

SEQ ID NO: 3160874 - RNA, 14 nt, Mycobacterium bovis subsp bovis AF2122/97
gcggcccgcucggg

SEQ ID NO: 3160875 - RNA, 17 nt, Mycobacterium bovis subsp bovis AF2122/97
gcggcccgggcucggcg

SEQ ID NO: 3160876 - RNA, 18 nt, Mycobacterium bovis subsp bovis AF2122/97
gcggcccgggcucggcga

SEQ ID NO: 3160877 - RNA, 21 nt, Mycobacterium bovis subsp bovis AF2122/97
gcggcccggguuggccgaaca

SEQ ID NO: 3160878 - RNA, 16 nt, Mycobacterium bovis subsp bovis AF2122/97
gcggcccgguggacag

SEQ ID NO: 3160879 - RNA, 16 nt, Mycobacterium bovis subsp bovis AF2122/97
gcggcccgucaccgcg

SEQ ID NO: 3160880 - RNA, 21 nt, Mycobacterium bovis subsp bovis AF2122/97
gcggcccucgaauucggccgg

SEQ ID NO: 3160881 - RNA, 15 nt, Mycobacterium bovis subsp bovis AF2122/97
gcggcccucgagcag

SEQ ID NO: 3160882 - RNA, 17 nt, Mycobacterium bovis subsp bovis AF2122/97
gcggccucgccggcgcg

SEQ ID NO: 3160883 - RNA, 22 nt, Mycobacterium bovis subsp bovis AF2122/97
gcggccucgccggcgcgcagcc

SEQ ID NO: 3160884 - RNA, 15 nt, Mycobacterium bovis subsp bovis AF2122/97
gcggccucgcugcuc

SEQ ID NO: 3160885 - RNA, 16 nt, Mycobacterium bovis subsp bovis AF2122/97
gcggccucgcugcuca

SEQ ID NO: 3160886 - RNA, 13 nt, Mycobacterium bovis subsp bovis AF2122/97
gcggccucggucu

SEQ ID NO: 3160887 - RNA, 17 nt, Mycobacterium bovis subsp bovis AF2122/97
gcggccucggucuggug

SEQ ID NO: 3160888 - RNA, 13 nt, Mycobacterium bovis subsp bovis AF2122/97
gcggccucgucga

SEQ ID NO: 3160889 - RNA, 19 nt, Mycobacterium bovis subsp bovis AF2122/97
gcggccucguuguagccga

SEQ ID NO: 3160890 - RNA, 12 nt, Mycobacterium bovis subsp bovis AF2122/97
gcggccugaccg

SEQ ID NO: 3160891 - RNA, 17 nt, Mycobacterium bovis subsp bovis AF2122/97
gcggccugaccggcucg

SEQ ID NO: 3160892 - RNA, 17 nt, Mycobacterium bovis subsp bovis AF2122/97
gcggccugcagguuggu

SEQ ID NO: 3160893 - RNA, 16 nt, Mycobacterium bovis subsp bovis AF2122/97
gcggccugcccgccgu

SEQ ID NO: 3160894 - RNA, 20 nt, Mycobacterium bovis subsp bovis AF2122/97
gcggccugcccgccguuacg

SEQ ID NO: 3160895 - RNA, 13 nt, Mycobacterium bovis subsp bovis AF2122/97
gcggccugcucga

SEQ ID NO: 3160896 - RNA, 18 nt, Mycobacterium bovis subsp bovis AF2122/97
gcggccugcucgggggcc

SEQ ID NO: 3160897 - RNA, 16 nt, Mycobacterium bovis subsp bovis AF2122/97
gcggccuggcacccgg

SEQ ID NO: 3160898 - RNA, 16 nt, Mycobacterium bovis subsp bovis AF2122/97
gcggccugggccagcc

SEQ ID NO: 3160899 - RNA, 14 nt, Mycobacterium bovis subsp bovis AF2122/97
gcggccuggucggc

SEQ ID NO: 3160900 - RNA, 18 nt, Mycobacterium bovis subsp bovis AF2122/97
gcggccuggucggccagg

SEQ ID NO: 3160901 - RNA, 17 nt, Mycobacterium bovis subsp bovis AF2122/97
gcggccuguugacccau

SEQ ID NO: 3160902 - RNA, 14 nt, Mycobacterium bovis subsp bovis AF2122/97
gcggccuucggccg

SEQ ID NO: 3160903 - RNA, 17 nt, Mycobacterium bovis subsp bovis AF2122/97
gcggccuucggccggcg

SEQ ID NO: 3160904 - RNA, 15 nt, Mycobacterium bovis subsp bovis AF2122/97
gcggccuugccgggc

SEQ ID NO: 3160905 - RNA, 16 nt, Mycobacterium bovis subsp bovis AF2122/97
gcggccuugccgggcc

SEQ ID NO: 3160906 - RNA, 20 nt, Mycobacterium bovis subsp bovis AF2122/97
gcggccuugcgggcucucgg

SEQ ID NO: 3160907 - RNA, 15 nt, Mycobacterium bovis subsp bovis AF2122/97
gcggccuugcucagc

SEQ ID NO: 3160908 - RNA, 16 nt, Mycobacterium bovis subsp bovis AF2122/97
gcggccuugcucagca

SEQ ID NO: 3160909 - RNA, 18 nt, Mycobacterium bovis subsp bovis AF2122/97
gcggccuuggcgacgucg

SEQ ID NO: 3160910 - RNA, 19 nt, Mycobacterium bovis subsp bovis AF2122/97
gcggccuuggcgacgucgc

SEQ ID NO: 3160911 - RNA, 21 nt, Mycobacterium bovis subsp bovis AF2122/97
gcggccuuggcgacgucgcgg

SEQ ID NO: 3160912 - RNA, 15 nt, Mycobacterium bovis subsp bovis AF2122/97
gcggccuuggcggcc

SEQ ID NO: 3160913 - RNA, 19 nt, Mycobacterium bovis subsp bovis AF2122/97
gcggccuuuuccgggucgu

SEQ ID NO: 3160914 - RNA, 16 nt, Mycobacterium bovis subsp bovis AF2122/97
gcggcgaacaucaccg

SEQ ID NO: 3160915 - RNA, 18 nt, Mycobacterium bovis subsp bovis AF2122/97
gcggcgaacaucaccguc

SEQ ID NO: 3160916 - RNA, 14 nt, Mycobacterium bovis subsp bovis AF2122/97
gcggcgaaccagcg

SEQ ID NO: 3160917 - RNA, 15 nt, Mycobacterium bovis subsp bovis AF2122/97
gcggcgaaccagcgc

SEQ ID NO: 3160918 - RNA, 19 nt, Mycobacterium bovis subsp bovis AF2122/97
gcggcgaaccagcgcgucu

SEQ ID NO: 3160919 - RNA, 22 nt, Mycobacterium bovis subsp bovis AF2122/97
gcggcgaaccagcgcgucucgu

SEQ ID NO: 3160920 - RNA, 21 nt, Mycobacterium bovis subsp bovis AF2122/97
gcggcgaaccgucucgccccc

SEQ ID NO: 3160921 - RNA, 23 nt, Mycobacterium bovis subsp bovis AF2122/97
gcggcgaacucuacgguggugcg

SEQ ID NO: 3160922 - RNA, 16 nt, Mycobacterium bovis subsp bovis AF2122/97
gcggcgaagaagccgg

SEQ ID NO: 3160923 - RNA, 17 nt, Mycobacterium bovis subsp bovis AF2122/97
gcggcgaagaagccggc

SEQ ID NO: 3160924 - RNA, 20 nt, Mycobacterium bovis subsp bovis AF2122/97
gcggcgaagauaucggcacg

SEQ ID NO: 3160925 - RNA, 14 nt, Mycobacterium bovis subsp bovis AF2122/97
gcggcgaagccggg

SEQ ID NO: 3160926 - RNA, 22 nt, Mycobacterium bovis subsp bovis AF2122/97
gcggcgaagucuuucuccccca

SEQ ID NO: 3160927 - RNA, 16 nt, Mycobacterium bovis subsp bovis AF2122/97
gcggcgaagugcaccc

SEQ ID NO: 3160928 - RNA, 13 nt, Mycobacterium bovis subsp bovis AF2122/97
gcggcgacacgcc

SEQ ID NO: 3160929 - RNA, 18 nt, Mycobacterium bovis subsp bovis AF2122/97
gcggcgacauccacaccg

SEQ ID NO: 3160930 - RNA, 14 nt, Mycobacterium bovis subsp bovis AF2122/97
gcggcgaccagauu

SEQ ID NO: 3160931 - RNA, 23 nt, Mycobacterium bovis subsp bovis AF2122/97
gcggcgaccagcucagcugcgga

SEQ ID NO: 3160932 - RNA, 22 nt, Mycobacterium bovis subsp bovis AF2122/97
gcggcgaccauauucagcucgg

SEQ ID NO: 3160933 - RNA, 13 nt, Mycobacterium bovis subsp bovis AF2122/97
gcggcgacccgcc

SEQ ID NO: 3160934 - RNA, 16 nt, Mycobacterium bovis subsp bovis AF2122/97
gcggcgaccgcauccg

SEQ ID NO: 3160935 - RNA, 22 nt, Mycobacterium bovis subsp bovis AF2122/97
gcggcgaccgcauccggucucg

SEQ ID NO: 3160936 - RNA, 16 nt, Mycobacterium bovis subsp bovis AF2122/97
gcggcgaccgccagcg

SEQ ID NO: 3160937 - RNA, 20 nt, Mycobacterium bovis subsp bovis AF2122/97
gcggcgaccgccagcgugga

SEQ ID NO: 3160938 - RNA, 13 nt, Mycobacterium bovis subsp bovis AF2122/97
gcggcgaccguca

SEQ ID NO: 3160939 - RNA, 15 nt, Mycobacterium bovis subsp bovis AF2122/97
gcggcgaccgucaac

SEQ ID NO: 3160940 - RNA, 14 nt, Mycobacterium bovis subsp bovis AF2122/97
gcggcgaccgucga

SEQ ID NO: 3160941 - RNA, 23 nt, Mycobacterium bovis subsp bovis AF2122/97
gcggcgaccgucgauuucgacga

SEQ ID NO: 3160942 - RNA, 19 nt, Mycobacterium bovis subsp bovis AF2122/97
gcggcgaccucggcggcgg

SEQ ID NO: 3160943 - RNA, 20 nt, Mycobacterium bovis subsp bovis AF2122/97
gcggcgaccucggcggcggc

SEQ ID NO: 3160944 - RNA, 15 nt, Mycobacterium bovis subsp bovis AF2122/97
gcggcgacgaccguc

SEQ ID NO: 3160945 - RNA, 17 nt, Mycobacterium bovis subsp bovis AF2122/97
gcggcgacgaccgucgg

SEQ ID NO: 3160946 - RNA, 17 nt, Mycobacterium bovis subsp bovis AF2122/97
gcggcgacgacggccug

SEQ ID NO: 3160947 - RNA, 22 nt, Mycobacterium bovis subsp bovis AF2122/97
gcggcgacgauucgagcgguug

SEQ ID NO: 3160948 - RNA, 17 nt, Mycobacterium bovis subsp bovis AF2122/97
gcggcgacggccgcucg

SEQ ID NO: 3160949 - RNA, 14 nt, Mycobacterium bovis subsp bovis AF2122/97
gcggcgacggcgga

SEQ ID NO: 3160950 - RNA, 21 nt, Mycobacterium bovis subsp bovis AF2122/97
gcggcgacggcggagucgcgc

SEQ ID NO: 3160951 - RNA, 15 nt, Mycobacterium bovis subsp bovis AF2122/97
gcggcgacggcggca

SEQ ID NO: 3160952 - RNA, 16 nt, Mycobacterium bovis subsp bovis AF2122/97
gcggcgacggcggcac

SEQ ID NO: 3160953 - RNA, 18 nt, Mycobacterium bovis subsp bovis AF2122/97
gcggcgacggcggcacgg

SEQ ID NO: 3160954 - RNA, 13 nt, Mycobacterium bovis subsp bovis AF2122/97
gcggcgacggugc

SEQ ID NO: 3160955 - RNA, 18 nt, Mycobacterium bovis subsp bovis AF2122/97
gcggcgacggugccaccg

SEQ ID NO: 3160956 - RNA, 15 nt, Mycobacterium bovis subsp bovis AF2122/97
gcggcgacgucucgc

SEQ ID NO: 3160957 - RNA, 14 nt, Mycobacterium bovis subsp bovis AF2122/97
gcggcgacguggcg

SEQ ID NO: 3160958 - RNA, 15 nt, Mycobacterium bovis subsp bovis AF2122/97
gcggcgacguggcgc

SEQ ID NO: 3160959 - RNA, 21 nt, Mycobacterium bovis subsp bovis AF2122/97
gcggcgacguggcgccgacag

SEQ ID NO: 3160960 - RNA, 18 nt, Mycobacterium bovis subsp bovis AF2122/97
gcggcgacuacggccucg

SEQ ID NO: 3160961 - RNA, 17 nt, Mycobacterium bovis subsp bovis AF2122/97
gcggcgagcaccacccc

SEQ ID NO: 3160962 - RNA, 18 nt, Mycobacterium bovis subsp bovis AF2122/97
gcggcgagcaccacccca

SEQ ID NO: 3160963 - RNA, 21 nt, Mycobacterium bovis subsp bovis AF2122/97
gcggcgagcaccaccccagcg

SEQ ID NO: 3160964 - RNA, 12 nt, Mycobacterium bovis subsp bovis AF2122/97
gcggcgagcgcg

SEQ ID NO: 3160965 - RNA, 21 nt, Mycobacterium bovis subsp bovis AF2122/97
gcggcgagcggccuccagcac

SEQ ID NO: 3160966 - RNA, 21 nt, Mycobacterium bovis subsp bovis AF2122/97
gcggcgaggaaauugcgcaaa

SEQ ID NO: 3160967 - RNA, 16 nt, Mycobacterium bovis subsp bovis AF2122/97
gcggcgaggcgaguca

SEQ ID NO: 3160968 - RNA, 15 nt, Mycobacterium bovis subsp bovis AF2122/97
gcggcgaggcggucg

SEQ ID NO: 3160969 - RNA, 12 nt, Mycobacterium bovis subsp bovis AF2122/97
gcggcgcucguc

SEQ ID NO: 3160970 - RNA, 12 nt, Mycobacterium bovis subsp bovis AF2122/97
gcggcgcugcag

SEQ ID NO: 3160971 - RNA, 15 nt, Mycobacterium bovis subsp bovis AF2122/97
gcggcgcuggccagc

SEQ ID NO: 3160972 - RNA, 12 nt, Mycobacterium bovis subsp bovis AF2122/97
gcggcgcuggcg

SEQ ID NO: 3160973 - RNA, 16 nt, Mycobacterium bovis subsp bovis AF2122/97
gcggcgcuggcgggca

SEQ ID NO: 3160974 - RNA, 14 nt, Mycobacterium bovis subsp bovis AF2122/97
gcggcgcuggcguc

SEQ ID NO: 3160975 - RNA, 13 nt, Mycobacterium bovis subsp bovis AF2122/97
gcggcgcuggcug

SEQ ID NO: 3160976 - RNA, 14 nt, Mycobacterium bovis subsp bovis AF2122/97
gcggcgcugggacg

SEQ ID NO: 3160977 - RNA, 18 nt, Mycobacterium bovis subsp bovis AF2122/97
gcggcggaacaccgacga

SEQ ID NO: 3160978 - RNA, 22 nt, Mycobacterium bovis subsp bovis AF2122/97
gcggcggaacaccgacgacacc

SEQ ID NO: 3160979 - RNA, 17 nt, Mycobacterium bovis subsp bovis AF2122/97
gcggcggaaggcgucga

SEQ ID NO: 3160980 - RNA, 14 nt, Mycobacterium bovis subsp bovis AF2122/97
gcggcggacccgcu

SEQ ID NO: 3160981 - RNA, 16 nt, Mycobacterium bovis subsp bovis AF2122/97
gcggcggaccguccga

SEQ ID NO: 3160982 - RNA, 21 nt, Mycobacterium bovis subsp bovis AF2122/97
gcggcggaccguccgacggcg

SEQ ID NO: 3160983 - RNA, 14 nt, Mycobacterium bovis subsp bovis AF2122/97
gcggcggcaacggc

SEQ ID NO: 3160984 - RNA, 23 nt, Mycobacterium bovis subsp bovis AF2122/97
gcggcggcaacgguggcaacgga

SEQ ID NO: 3160985 - RNA, 16 nt, Mycobacterium bovis subsp bovis AF2122/97
gcggcggcacgcucgc

SEQ ID NO: 3160986 - RNA, 20 nt, Mycobacterium bovis subsp bovis AF2122/97
gcggcggcacuggugcccga

SEQ ID NO: 3160987 - RNA, 16 nt, Mycobacterium bovis subsp bovis AF2122/97
gcggcggcagcggcga

SEQ ID NO: 3160988 - RNA, 20 nt, Mycobacterium bovis subsp bovis AF2122/97
gcggcggcauagugcgacug

SEQ ID NO: 3160989 - RNA, 22 nt, Mycobacterium bovis subsp bovis AF2122/97
gcggcggcaucucgcaccgcgc

SEQ ID NO: 3160990 - RNA, 13 nt, Mycobacterium bovis subsp bovis AF2122/97
gcggcggccagcg

SEQ ID NO: 3160991 - RNA, 13 nt, Mycobacterium bovis subsp bovis AF2122/97
gcggcggccagga

SEQ ID NO: 3160992 - RNA, 19 nt, Mycobacterium bovis subsp bovis AF2122/97
gcggcggcccaucgaccga

SEQ ID NO: 3160993 - RNA, 16 nt, Mycobacterium bovis subsp bovis AF2122/97
gcggcggccccgcgcc

SEQ ID NO: 3160994 - RNA, 20 nt, Mycobacterium bovis subsp bovis AF2122/97
gcggcggccccgcgccaccu

SEQ ID NO: 3160995 - RNA, 14 nt, Mycobacterium bovis subsp bovis AF2122/97
gcggcggcccgcag

SEQ ID NO: 3160996 - RNA, 15 nt, Mycobacterium bovis subsp bovis AF2122/97
gcggcggcccgcagc

SEQ ID NO: 3160997 - RNA, 20 nt, Mycobacterium bovis subsp bovis AF2122/97
gcggcggcccgcagcccgcc

SEQ ID NO: 3160998 - RNA, 21 nt, Mycobacterium bovis subsp bovis AF2122/97
gcggcggcccuaaacaccgcg

SEQ ID NO: 3160999 - RNA, 22 nt, Mycobacterium bovis subsp bovis AF2122/97
gcggcggcccuaaacaccgcga

SEQ ID NO: 3161000 - RNA, 15 nt, Mycobacterium bovis subsp bovis AF2122/97
gcggcggccgcagcg

SEQ ID NO: 3161001 - RNA, 16 nt, Mycobacterium bovis subsp bovis AF2122/97
gcggcggccugggcca

SEQ ID NO: 3161002 - RNA, 18 nt, Mycobacterium bovis subsp bovis AF2122/97
gcggcggccugggccagc

SEQ ID NO: 3161003 - RNA, 15 nt, Mycobacterium bovis subsp bovis AF2122/97
gcggcggcgaacucg

SEQ ID NO: 3161004 - RNA, 13 nt, Mycobacterium bovis subsp bovis AF2122/97
gcggcggcgacua

SEQ ID NO: 3161005 - RNA, 19 nt, Mycobacterium bovis subsp bovis AF2122/97
gcggcggcgauccggucgg

SEQ ID NO: 3161006 - RNA, 13 nt, Mycobacterium bovis subsp bovis AF2122/97
gcggcggcgccgg

SEQ ID NO: 3161007 - RNA, 14 nt, Mycobacterium bovis subsp bovis AF2122/97
gcggcggcgcgauc

SEQ ID NO: 3161008 - RNA, 16 nt, Mycobacterium bovis subsp bovis AF2122/97
gcggcggcgcgaucga

SEQ ID NO: 3161009 - RNA, 19 nt, Mycobacterium bovis subsp bovis AF2122/97
gcggcggcgcgaucgacgc

SEQ ID NO: 3161010 - RNA, 15 nt, Mycobacterium bovis subsp bovis AF2122/97
gcggcggcgcucguc

SEQ ID NO: 3161011 - RNA, 16 nt, Mycobacterium bovis subsp bovis AF2122/97
gcggcggcgcucgucg

SEQ ID NO: 3161012 - RNA, 17 nt, Mycobacterium bovis subsp bovis AF2122/97
gcggcggcgcucgucga

SEQ ID NO: 3161013 - RNA, 12 nt, Mycobacterium bovis subsp bovis AF2122/97
gcggcggcgcug

SEQ ID NO: 3161014 - RNA, 13 nt, Mycobacterium bovis subsp bovis AF2122/97
gcggcggcgcugg

SEQ ID NO: 3161015 - RNA, 15 nt, Mycobacterium bovis subsp bovis AF2122/97
gcggcggcgcuggcg

SEQ ID NO: 3161016 - RNA, 13 nt, Mycobacterium bovis subsp bovis AF2122/97
gcggcggcggagg

SEQ ID NO: 3161017 - RNA, 13 nt, Mycobacterium bovis subsp bovis AF2122/97
gcggcggcggcca

SEQ ID NO: 3161018 - RNA, 14 nt, Mycobacterium bovis subsp bovis AF2122/97
gcggcggcggccau

SEQ ID NO: 3161019 - RNA, 14 nt, Mycobacterium bovis subsp bovis AF2122/97
gcggcggcggcccg

SEQ ID NO: 3161020 - RNA, 15 nt, Mycobacterium bovis subsp bovis AF2122/97
gcggcggcgucggga

SEQ ID NO: 3161021 - RNA, 18 nt, Mycobacterium bovis subsp bovis AF2122/97
gcggcgggagucggucug

SEQ ID NO: 3161022 - RNA, 16 nt, Mycobacterium bovis subsp bovis AF2122/97
gcggcgggcaccguga

SEQ ID NO: 3161023 - RNA, 12 nt, Mycobacterium bovis subsp bovis AF2122/97
gcggcgggcacg

SEQ ID NO: 3161024 - RNA, 14 nt, Mycobacterium bovis subsp bovis AF2122/97
gcggcgggcccgau

SEQ ID NO: 3161025 - RNA, 14 nt, Mycobacterium bovis subsp bovis AF2122/97
gcggcgggcgauga

SEQ ID NO: 3161026 - RNA, 17 nt, Mycobacterium bovis subsp bovis AF2122/97
gcggcgggggcggcggc

SEQ ID NO: 3161027 - RNA, 18 nt, Mycobacterium bovis subsp bovis AF2122/97
gcggcgggggcggcggcu

SEQ ID NO: 3161028 - RNA, 19 nt, Mycobacterium bovis subsp bovis AF2122/97
gcggcgggggcggcggcug

SEQ ID NO: 3161029 - RNA, 17 nt, Mycobacterium bovis subsp bovis AF2122/97
gcggcggguccucgcgg

SEQ ID NO: 3161030 - RNA, 16 nt, Mycobacterium bovis subsp bovis AF2122/97
gcggcgguaccggaau

SEQ ID NO: 3161031 - RNA, 16 nt, Mycobacterium bovis subsp bovis AF2122/97
gcggcggucaccaccg

SEQ ID NO: 3161032 - RNA, 19 nt, Mycobacterium bovis subsp bovis AF2122/97
gcggcggucaccaccgacc

SEQ ID NO: 3161033 - RNA, 23 nt, Mycobacterium bovis subsp bovis AF2122/97
gcggcggucaugggcgcguagcu

SEQ ID NO: 3161034 - RNA, 23 nt, Mycobacterium bovis subsp bovis AF2122/97
gcggcggucccugaagccagcgc

SEQ ID NO: 3161035 - RNA, 15 nt, Mycobacterium bovis subsp bovis AF2122/97
gcggcggucgagcga

SEQ ID NO: 3161036 - RNA, 16 nt, Mycobacterium bovis subsp bovis AF2122/97
gcggcggucgagcgaa

SEQ ID NO: 3161037 - RNA, 17 nt, Mycobacterium bovis subsp bovis AF2122/97
gcggcggucgagcgaac

SEQ ID NO: 3161038 - RNA, 15 nt, Mycobacterium bovis subsp bovis AF2122/97
gcggcggucgagcuc

SEQ ID NO: 3161039 - RNA, 14 nt, Mycobacterium bovis subsp bovis AF2122/97
gcggcggucggcug

SEQ ID NO: 3161040 - RNA, 22 nt, Mycobacterium bovis subsp bovis AF2122/97
gcggcggucggcugggcgaagc

SEQ ID NO: 3161041 - RNA, 17 nt, Mycobacterium bovis subsp bovis AF2122/97
gcggcggucguugccga

SEQ ID NO: 3161042 - RNA, 20 nt, Mycobacterium bovis subsp bovis AF2122/97
gcggcggucucggcgucgac

SEQ ID NO: 3161043 - RNA, 14 nt, Mycobacterium bovis subsp bovis AF2122/97
gcggcggucucguc

SEQ ID NO: 3161044 - RNA, 22 nt, Mycobacterium bovis subsp bovis AF2122/97
gcggcggucucgucaaccugcg

SEQ ID NO: 3161045 - RNA, 17 nt, Mycobacterium bovis subsp bovis AF2122/97
gcggcggugcagcaggg

SEQ ID NO: 3161046 - RNA, 22 nt, Mycobacterium bovis subsp bovis AF2122/97
gcggcggugcagcagggcgcgc

SEQ ID NO: 3161047 - RNA, 18 nt, Mycobacterium bovis subsp bovis AF2122/97
gcggcgguggccagcguc

SEQ ID NO: 3161048 - RNA, 13 nt, Mycobacterium bovis subsp bovis AF2122/97
gcggcgguggcga

SEQ ID NO: 3161049 - RNA, 16 nt, Mycobacterium bovis subsp bovis AF2122/97
gcggcgguggcgaaca

SEQ ID NO: 3161050 - RNA, 20 nt, Mycobacterium bovis subsp bovis AF2122/97
gcggcggugguaccggcgcc

SEQ ID NO: 3161051 - RNA, 23 nt, Mycobacterium bovis subsp bovis AF2122/97
gcggcggugguaccggcgccacc

SEQ ID NO: 3161052 - RNA, 21 nt, Mycobacterium bovis subsp bovis AF2122/97
gcggcgguuaucgucggguca

SEQ ID NO: 3161053 - RNA, 23 nt, Mycobacterium bovis subsp bovis AF2122/97
gcggcgguuaucgucgggucacc

SEQ ID NO: 3161054 - RNA, 16 nt, Mycobacterium bovis subsp bovis AF2122/97
gcggcguaacugugga

SEQ ID NO: 3161055 - RNA, 22 nt, Mycobacterium bovis subsp bovis AF2122/97
gcggcguagcagaaggccgcgg

SEQ ID NO: 3161056 - RNA, 19 nt, Mycobacterium bovis subsp bovis AF2122/97
gcggcuucgucgacaucgc

SEQ ID NO: 3161057 - RNA, 18 nt, Mycobacterium bovis subsp bovis AF2122/97
gcggcuucguggcggcgc

SEQ ID NO: 3161058 - RNA, 18 nt, Mycobacterium bovis subsp bovis AF2122/97
gcggcuugaacagcugau

SEQ ID NO: 3161059 - RNA, 14 nt, Mycobacterium bovis subsp bovis AF2122/97
gcggcuugaucagc

SEQ ID NO: 3161060 - RNA, 19 nt, Mycobacterium bovis subsp bovis AF2122/97
gcggcuugaucagccgcca

SEQ ID NO: 3161061 - RNA, 19 nt, Mycobacterium bovis subsp bovis AF2122/97
gcggcuuggaucucaucca

SEQ ID NO: 3161062 - RNA, 20 nt, Mycobacterium bovis subsp bovis AF2122/97
gcggcuuggccaucacggcg

SEQ ID NO: 3161063 - RNA, 16 nt, Mycobacterium bovis subsp bovis AF2122/97
gcggcuuggccgcccc

SEQ ID NO: 3161064 - RNA, 18 nt, Mycobacterium bovis subsp bovis AF2122/97
gcggcuuggccgccccgg

SEQ ID NO: 3161065 - RNA, 22 nt, Mycobacterium bovis subsp bovis AF2122/97
gcggcuuggccuagccgcggca

SEQ ID NO: 3161066 - RNA, 15 nt, Mycobacterium bovis subsp bovis AF2122/97
gcggcuugggcuugc

SEQ ID NO: 3161067 - RNA, 21 nt, Mycobacterium bovis subsp bovis AF2122/97
gcggcuugucgccccaugcgg

SEQ ID NO: 3161068 - RNA, 18 nt, Mycobacterium bovis subsp bovis AF2122/97
gcggcuugucgcggugcg

SEQ ID NO: 3161069 - RNA, 15 nt, Mycobacterium bovis subsp bovis AF2122/97
gcggcuuucagcgcu

SEQ ID NO: 3161070 - RNA, 19 nt, Mycobacterium bovis subsp bovis AF2122/97
gcggcuuugacgcccggca

SEQ ID NO: 3161071 - RNA, 21 nt, Mycobacterium bovis subsp bovis AF2122/97
gcggcuuugacgcccggcacc

SEQ ID NO: 3161072 - RNA, 17 nt, Mycobacterium bovis subsp bovis AF2122/97
gcggcuuuggccgccgu

SEQ ID NO: 3161073 - RNA, 19 nt, Mycobacterium bovis subsp bovis AF2122/97
gcgggaaaacgggguggca

SEQ ID NO: 3161074 - RNA, 23 nt, Mycobacterium bovis subsp bovis AF2122/97
gcgggaaacccaugcaugcguug

SEQ ID NO: 3161075 - RNA, 13 nt, Mycobacterium bovis subsp bovis AF2122/97
gcgggaaccccag

SEQ ID NO: 3161076 - RNA, 19 nt, Mycobacterium bovis subsp bovis AF2122/97
gcgggaacgagccacgcca

SEQ ID NO: 3161077 - RNA, 18 nt, Mycobacterium bovis subsp bovis AF2122/97
gcgggaacgaugccgccg

SEQ ID NO: 3161078 - RNA, 16 nt, Mycobacterium bovis subsp bovis AF2122/97
gcgggaagaacaucac

SEQ ID NO: 3161079 - RNA, 19 nt, Mycobacterium bovis subsp bovis AF2122/97
gcgggaaggcucaccacgg

SEQ ID NO: 3161080 - RNA, 23 nt, Mycobacterium bovis subsp bovis AF2122/97
gcgggaagucccgaguggccggu

SEQ ID NO: 3161081 - RNA, 21 nt, Mycobacterium bovis subsp bovis AF2122/97
gcgggaaguucgccggucccc

SEQ ID NO: 3161082 - RNA, 19 nt, Mycobacterium bovis subsp bovis AF2122/97
gcgggaaguucgucgguug

SEQ ID NO: 3161083 - RNA, 19 nt, Mycobacterium bovis subsp bovis AF2122/97
gcgggacaaaaucagcagc

SEQ ID NO: 3161084 - RNA, 17 nt, Mycobacterium bovis subsp bovis AF2122/97
gcgggacaacagcaugg

SEQ ID NO: 3161085 - RNA, 17 nt, Mycobacterium bovis subsp bovis AF2122/97
gcgggacaaccgggcgg

SEQ ID NO: 3161086 - RNA, 21 nt, Mycobacterium bovis subsp bovis AF2122/97
gcgggacaccaccgcccgcac

SEQ ID NO: 3161087 - RNA, 14 nt, Mycobacterium bovis subsp bovis AF2122/97
gcgggacacgucgc

SEQ ID NO: 3161088 - RNA, 18 nt, Mycobacterium bovis subsp bovis AF2122/97
gcgggacagauggcggcc

SEQ ID NO: 3161089 - RNA, 21 nt, Mycobacterium bovis subsp bovis AF2122/97
gcgggacauccagugcggugg

SEQ ID NO: 3161090 - RNA, 22 nt, Mycobacterium bovis subsp bovis AF2122/97
gcgggacccgugagcucgucga

SEQ ID NO: 3161091 - RNA, 21 nt, Mycobacterium bovis subsp bovis AF2122/97
gcgggaccgagaacugcucga

SEQ ID NO: 3161092 - RNA, 21 nt, Mycobacterium bovis subsp bovis AF2122/97
gcgggaccuucgagccgcaca

SEQ ID NO: 3161093 - RNA, 18 nt, Mycobacterium bovis subsp bovis AF2122/97
gcgggacgcgacucggcg

SEQ ID NO: 3161094 - RNA, 18 nt, Mycobacterium bovis subsp bovis AF2122/97
gcgggacgucgucguuga

SEQ ID NO: 3161095 - RNA, 17 nt, Mycobacterium bovis subsp bovis AF2122/97
gcgggacugacccugau

SEQ ID NO: 3161096 - RNA, 17 nt, Mycobacterium bovis subsp bovis AF2122/97
gcgggacugcagcgcgg

SEQ ID NO: 3161097 - RNA, 14 nt, Mycobacterium bovis subsp bovis AF2122/97
gcgggacugcggaa

SEQ ID NO: 3161098 - RNA, 19 nt, Mycobacterium bovis subsp bovis AF2122/97
gcgggacugcggaagccac

SEQ ID NO: 3161099 - RNA, 22 nt, Mycobacterium bovis subsp bovis AF2122/97
gcgggacugcggaagccaccga

SEQ ID NO: 3161100 - RNA, 20 nt, Mycobacterium bovis subsp bovis AF2122/97
gcgggagaaaacggcggcgc

SEQ ID NO: 3161101 - RNA, 21 nt, Mycobacterium bovis subsp bovis AF2122/97
gcgggagaaaacggcggcgcc

SEQ ID NO: 3161102 - RNA, 21 nt, Mycobacterium bovis subsp bovis AF2122/97
gcgggagacguaaccgcuggc

SEQ ID NO: 3161103 - RNA, 19 nt, Mycobacterium bovis subsp bovis AF2122/97
gcgggagguacccccagca

SEQ ID NO: 3161104 - RNA, 20 nt, Mycobacterium bovis subsp bovis AF2122/97
gcgggagguacccccagcac

SEQ ID NO: 3161105 - RNA, 14 nt, Mycobacterium bovis subsp bovis AF2122/97
gcgggagucgucga

SEQ ID NO: 3161106 - RNA, 15 nt, Mycobacterium bovis subsp bovis AF2122/97
gcgggauccaggccc

SEQ ID NO: 3161107 - RNA, 17 nt, Mycobacterium bovis subsp bovis AF2122/97
gcgggauccaggcccag

SEQ ID NO: 3161108 - RNA, 15 nt, Mycobacterium bovis subsp bovis AF2122/97
gcgggaucgguggcg

SEQ ID NO: 3161109 - RNA, 19 nt, Mycobacterium bovis subsp bovis AF2122/97
gcgggaucgguggcggcac

SEQ ID NO: 3161110 - RNA, 15 nt, Mycobacterium bovis subsp bovis AF2122/97
gcgggaucugagggc

SEQ ID NO: 3161111 - RNA, 21 nt, Mycobacterium bovis subsp bovis AF2122/97
gcgggaugcagcugcccggcg

SEQ ID NO: 3161112 - RNA, 14 nt, Mycobacterium bovis subsp bovis AF2122/97
gcgggaugcgcgcc

SEQ ID NO: 3161113 - RNA, 15 nt, Mycobacterium bovis subsp bovis AF2122/97
gcgggaugcgcgccc

SEQ ID NO: 3161114 - RNA, 17 nt, Mycobacterium bovis subsp bovis AF2122/97
gcgggaugcgcgcccga

SEQ ID NO: 3161115 - RNA, 15 nt, Mycobacterium bovis subsp bovis AF2122/97
gcgggauggccgccg

SEQ ID NO: 3161116 - RNA, 18 nt, Mycobacterium bovis subsp bovis AF2122/97
gcgggauggccgccgaca

SEQ ID NO: 3161117 - RNA, 14 nt, Mycobacterium bovis subsp bovis AF2122/97
gcgggauggggccc

SEQ ID NO: 3161118 - RNA, 16 nt, Mycobacterium bovis subsp bovis AF2122/97
gcgggauggggcccgc

SEQ ID NO: 3161119 - RNA, 17 nt, Mycobacterium bovis subsp bovis AF2122/97
gcgggauggggcccgca

SEQ ID NO: 3161120 - RNA, 18 nt, Mycobacterium bovis subsp bovis AF2122/97
gcgggauggggcccgcau

SEQ ID NO: 3161121 - RNA, 15 nt, Mycobacterium bovis subsp bovis AF2122/97
gcgggauugccgaga

SEQ ID NO: 3161122 - RNA, 13 nt, Mycobacterium bovis subsp bovis AF2122/97
gcgggauugcgcg

SEQ ID NO: 3161123 - RNA, 19 nt, Mycobacterium bovis subsp bovis AF2122/97
gcgggcaacugcagcaugg

SEQ ID NO: 3161124 - RNA, 21 nt, Mycobacterium bovis subsp bovis AF2122/97
gcgggcaagccggacagauca

SEQ ID NO: 3161125 - RNA, 18 nt, Mycobacterium bovis subsp bovis AF2122/97
gcgggcaagucgcccagc

SEQ ID NO: 3161126 - RNA, 20 nt, Mycobacterium bovis subsp bovis AF2122/97
gcgggcaagucgcccagccg

SEQ ID NO: 3161127 - RNA, 21 nt, Mycobacterium bovis subsp bovis AF2122/97
gcgggcaagucgcccagccga

SEQ ID NO: 3161128 - RNA, 23 nt, Mycobacterium bovis subsp bovis AF2122/97
gcgggcaagucgcccagccgagc

SEQ ID NO: 3161129 - RNA, 16 nt, Mycobacterium bovis subsp bovis AF2122/97
gcgggcaaucaccgcc

SEQ ID NO: 3161130 - RNA, 19 nt, Mycobacterium bovis subsp bovis AF2122/97
gcgggcaaucaccgccggc

SEQ ID NO: 3161131 - RNA, 20 nt, Mycobacterium bovis subsp bovis AF2122/97
gcgggcaaucaccgccggcg

SEQ ID NO: 3161132 - RNA, 22 nt, Mycobacterium bovis subsp bovis AF2122/97
gcgggcaaucaccgccggcggc

SEQ ID NO: 3161133 - RNA, 21 nt, Mycobacterium bovis subsp bovis AF2122/97
gcgggcacaauaggcuccagc

SEQ ID NO: 3161134 - RNA, 14 nt, Mycobacterium bovis subsp bovis AF2122/97
gcgggcacgccgcc

SEQ ID NO: 3161135 - RNA, 16 nt, Mycobacterium bovis subsp bovis AF2122/97
gcgggcacucagcagg

SEQ ID NO: 3161136 - RNA, 17 nt, Mycobacterium bovis subsp bovis AF2122/97
gcgggcacugguggcga

SEQ ID NO: 3161137 - RNA, 21 nt, Mycobacterium bovis subsp bovis AF2122/97
gcgggcacugguggcgauccg

SEQ ID NO: 3161138 - RNA, 17 nt, Mycobacterium bovis subsp bovis AF2122/97
gcgggcagauggugaag

SEQ ID NO: 3161139 - RNA, 15 nt, Mycobacterium bovis subsp bovis AF2122/97
gcgggcagcaggcga

SEQ ID NO: 3161140 - RNA, 20 nt, Mycobacterium bovis subsp bovis AF2122/97
gcgggcagcaggcgaugcgc

SEQ ID NO: 3161141 - RNA, 21 nt, Mycobacterium bovis subsp bovis AF2122/97
gcgggcagccgcccgccagga

SEQ ID NO: 3161142 - RNA, 18 nt, Mycobacterium bovis subsp bovis AF2122/97
gcgggcagcguguaaccg

SEQ ID NO: 3161143 - RNA, 17 nt, Mycobacterium bovis subsp bovis AF2122/97
gcgggcagcuguucggc

SEQ ID NO: 3161144 - RNA, 22 nt, Mycobacterium bovis subsp bovis AF2122/97
gcgggcaguagcuguggcccgc

SEQ ID NO: 3161145 - RNA, 17 nt, Mycobacterium bovis subsp bovis AF2122/97
gcgggcaguggcagccc

SEQ ID NO: 3161146 - RNA, 17 nt, Mycobacterium bovis subsp bovis AF2122/97
gcgggcaguugacccau

SEQ ID NO: 3161147 - RNA, 21 nt, Mycobacterium bovis subsp bovis AF2122/97
gcgggcaguugacccaugccg

SEQ ID NO: 3161148 - RNA, 19 nt, Mycobacterium bovis subsp bovis AF2122/97
gcgggcauaacccgcaccg

SEQ ID NO: 3161149 - RNA, 16 nt, Mycobacterium bovis subsp bovis AF2122/97
gcgggcaugauguuga

SEQ ID NO: 3161150 - RNA, 16 nt, Mycobacterium bovis subsp bovis AF2122/97
gcgggcaugccggcga

SEQ ID NO: 3161151 - RNA, 17 nt, Mycobacterium bovis subsp bovis AF2122/97
gcgggccaaagccguca

SEQ ID NO: 3161152 - RNA, 19 nt, Mycobacterium bovis subsp bovis AF2122/97
gcgggccaaagccgucagc

SEQ ID NO: 3161153 - RNA, 17 nt, Mycobacterium bovis subsp bovis AF2122/97
gcgggccaacucggcga

SEQ ID NO: 3161154 - RNA, 17 nt, Mycobacterium bovis subsp bovis AF2122/97
gcgggccaccacgcgcc

SEQ ID NO: 3161155 - RNA, 19 nt, Mycobacterium bovis subsp bovis AF2122/97
gcgggccaccacgcgccgc

SEQ ID NO: 3161156 - RNA, 11 nt, Mycobacterium bovis subsp bovis AF2122/97
gcgggccaccg

SEQ ID NO: 3161157 - RNA, 16 nt, Mycobacterium bovis subsp bovis AF2122/97
gcgggccaccgcuguc

SEQ ID NO: 3161158 - RNA, 16 nt, Mycobacterium bovis subsp bovis AF2122/97
gcgggccagcacccgc

SEQ ID NO: 3161159 - RNA, 20 nt, Mycobacterium bovis subsp bovis AF2122/97
gcgggccagcacccgcucca

SEQ ID NO: 3161160 - RNA, 22 nt, Mycobacterium bovis subsp bovis AF2122/97
gcgggccagcaccucgaccgcc

SEQ ID NO: 3161161 - RNA, 16 nt, Mycobacterium bovis subsp bovis AF2122/97
gcgggcccacgcccaa

SEQ ID NO: 3161162 - RNA, 15 nt, Mycobacterium bovis subsp bovis AF2122/97
gcgggcccgccggcc

SEQ ID NO: 3161163 - RNA, 16 nt, Mycobacterium bovis subsp bovis AF2122/97
gcgggcccgccggccc

SEQ ID NO: 3161164 - RNA, 20 nt, Mycobacterium bovis subsp bovis AF2122/97
gcgggcccgccggccccgcc

SEQ ID NO: 3161165 - RNA, 12 nt, Mycobacterium bovis subsp bovis AF2122/97
gcgggcccgcgc

SEQ ID NO: 3161166 - RNA, 15 nt, Mycobacterium bovis subsp bovis AF2122/97
gcgggcccgcgcggc

SEQ ID NO: 3161167 - RNA, 16 nt, Mycobacterium bovis subsp bovis AF2122/97
gcgggcccgcgcggcg

SEQ ID NO: 3161168 - RNA, 18 nt, Mycobacterium bovis subsp bovis AF2122/97
gcgggcccgcgcggcggu

SEQ ID NO: 3161169 - RNA, 21 nt, Mycobacterium bovis subsp bovis AF2122/97
gcgggccgaacacaccgggcg

SEQ ID NO: 3161170 - RNA, 17 nt, Mycobacterium bovis subsp bovis AF2122/97
gcgggccgaagccccga

SEQ ID NO: 3161171 - RNA, 17 nt, Mycobacterium bovis subsp bovis AF2122/97
gcgggccgaggccgucg

SEQ ID NO: 3161172 - RNA, 18 nt, Mycobacterium bovis subsp bovis AF2122/97
gcgggccgaggccgucgc

SEQ ID NO: 3161173 - RNA, 20 nt, Mycobacterium bovis subsp bovis AF2122/97
gcgggccgaggccgucgcga

SEQ ID NO: 3161174 - RNA, 19 nt, Mycobacterium bovis subsp bovis AF2122/97
gcgggccgccaggcggccg

SEQ ID NO: 3161175 - RNA, 14 nt, Mycobacterium bovis subsp bovis AF2122/97
gcgggccgccgcaa

SEQ ID NO: 3161176 - RNA, 11 nt, Mycobacterium bovis subsp bovis AF2122/97
gcgggccgcga

SEQ ID NO: 3161177 - RNA, 14 nt, Mycobacterium bovis subsp bovis AF2122/97
gcgggccgcgcggc

SEQ ID NO: 3161178 - RNA, 21 nt, Mycobacterium bovis subsp bovis AF2122/97
gcgggccgcgucgaacugggc

SEQ ID NO: 3161179 - RNA, 16 nt, Mycobacterium bovis subsp bovis AF2122/97
gcgggccggaugacgc

SEQ ID NO: 3161180 - RNA, 14 nt, Mycobacterium bovis subsp bovis AF2122/97
gcgggccggcaucg

SEQ ID NO: 3161181 - RNA, 15 nt, Mycobacterium bovis subsp bovis AF2122/97
gcgggccggucgugc

SEQ ID NO: 3161182 - RNA, 14 nt, Mycobacterium bovis subsp bovis AF2122/97
gcgggccggugaac

SEQ ID NO: 3161183 - RNA, 22 nt, Mycobacterium bovis subsp bovis AF2122/97
gcgggccguagaucccgaagcg

SEQ ID NO: 3161184 - RNA, 17 nt, Mycobacterium bovis subsp bovis AF2122/97
gcgggccuccugcuggc

SEQ ID NO: 3161185 - RNA, 15 nt, Mycobacterium bovis subsp bovis AF2122/97
gcgggccucggcgac

SEQ ID NO: 3161186 - RNA, 18 nt, Mycobacterium bovis subsp bovis AF2122/97
gcgggccucggcgaccau

SEQ ID NO: 3161187 - RNA, 18 nt, Mycobacterium bovis subsp bovis AF2122/97
gcgggccugcacgccggc

SEQ ID NO: 3161188 - RNA, 19 nt, Mycobacterium bovis subsp bovis AF2122/97
gcgggccugcacgccggcg

SEQ ID NO: 3161189 - RNA, 20 nt, Mycobacterium bovis subsp bovis AF2122/97
gcgggccugcacgccggcgc

SEQ ID NO: 3161190 - RNA, 16 nt, Mycobacterium bovis subsp bovis AF2122/97
gcgggccugcgcgauc

SEQ ID NO: 3161191 - RNA, 14 nt, Mycobacterium bovis subsp bovis AF2122/97
gcgggccuggccca

SEQ ID NO: 3161192 - RNA, 21 nt, Mycobacterium bovis subsp bovis AF2122/97
gcgggcgacaucgagaucgcc

SEQ ID NO: 3161193 - RNA, 19 nt, Mycobacterium bovis subsp bovis AF2122/97
gcgggcgaccaccgcggca

SEQ ID NO: 3161194 - RNA, 21 nt, Mycobacterium bovis subsp bovis AF2122/97
gcgggcgagaacccacgcaug

SEQ ID NO: 3161195 - RNA, 22 nt, Mycobacterium bovis subsp bovis AF2122/97
gcgggcgaucgcggcgagcacc

SEQ ID NO: 3161196 - RNA, 14 nt, Mycobacterium bovis subsp bovis AF2122/97
gcgggcgaucggca

SEQ ID NO: 3161197 - RNA, 19 nt, Mycobacterium bovis subsp bovis AF2122/97
gcgggcgaucuuggcgaca

SEQ ID NO: 3161198 - RNA, 21 nt, Mycobacterium bovis subsp bovis AF2122/97
gcgggcgaugacccggaaucc

SEQ ID NO: 3161199 - RNA, 16 nt, Mycobacterium bovis subsp bovis AF2122/97
gcgggcgaugagcgcg

SEQ ID NO: 3161200 - RNA, 19 nt, Mycobacterium bovis subsp bovis AF2122/97
gcgggcgaugagcgcgauc

SEQ ID NO: 3161201 - RNA, 22 nt, Mycobacterium bovis subsp bovis AF2122/97
gcgggcgaugagcgcgaucucc

SEQ ID NO: 3161202 - RNA, 16 nt, Mycobacterium bovis subsp bovis AF2122/97
gcgggcgauggcgagc

SEQ ID NO: 3161203 - RNA, 22 nt, Mycobacterium bovis subsp bovis AF2122/97
gcgggcgauuucggcgccggcg

SEQ ID NO: 3161204 - RNA, 14 nt, Mycobacterium bovis subsp bovis AF2122/97
gcgggcgccccacc

SEQ ID NO: 3161205 - RNA, 18 nt, Mycobacterium bovis subsp bovis AF2122/97
gcgggcgccuuccaggcg

SEQ ID NO: 3161206 - RNA, 21 nt, Mycobacterium bovis subsp bovis AF2122/97
gcgggcgccuuccaggcgggc

SEQ ID NO: 3161207 - RNA, 22 nt, Mycobacterium bovis subsp bovis AF2122/97
gcgggcgccuuccaggcgggcg

SEQ ID NO: 3161208 - RNA, 12 nt, Mycobacterium bovis subsp bovis AF2122/97
gcgggcgccuug

SEQ ID NO: 3161209 - RNA, 22 nt, Mycobacterium bovis subsp bovis AF2122/97
gcgggcgccuuggucgccgccu

SEQ ID NO: 3161210 - RNA, 13 nt, Mycobacterium bovis subsp bovis AF2122/97
gcgggcgcuguag

SEQ ID NO: 3161211 - RNA, 21 nt, Mycobacterium bovis subsp bovis AF2122/97
gcgggcgcuugccggggugug

SEQ ID NO: 3161212 - RNA, 22 nt, Mycobacterium bovis subsp bovis AF2122/97
gcgggcgcuugccggggugugc

SEQ ID NO: 3161213 - RNA, 16 nt, Mycobacterium bovis subsp bovis AF2122/97
gcgggcggaucgccgg

SEQ ID NO: 3161214 - RNA, 13 nt, Mycobacterium bovis subsp bovis AF2122/97
gcgggcggcaccg

SEQ ID NO: 3161215 - RNA, 15 nt, Mycobacterium bovis subsp bovis AF2122/97
gcgggcggcgcuggc

SEQ ID NO: 3161216 - RNA, 16 nt, Mycobacterium bovis subsp bovis AF2122/97
gcgggcgggucugggu

SEQ ID NO: 3161217 - RNA, 21 nt, Mycobacterium bovis subsp bovis AF2122/97
gcgggcgggucugggugguga

SEQ ID NO: 3161218 - RNA, 17 nt, Mycobacterium bovis subsp bovis AF2122/97
gcgggcggugcacaccg

SEQ ID NO: 3161219 - RNA, 18 nt, Mycobacterium bovis subsp bovis AF2122/97
gcgggcggugcacaccgu

SEQ ID NO: 3161220 - RNA, 12 nt, Mycobacterium bovis subsp bovis AF2122/97
gcgggcgguggg

SEQ ID NO: 3161221 - RNA, 13 nt, Mycobacterium bovis subsp bovis AF2122/97
gcgggcggugggc

SEQ ID NO: 3161222 - RNA, 14 nt, Mycobacterium bovis subsp bovis AF2122/97
gcgggcggugggca

SEQ ID NO: 3161223 - RNA, 16 nt, Mycobacterium bovis subsp bovis AF2122/97
gcgggcggugggcagc

SEQ ID NO: 3161224 - RNA, 14 nt, Mycobacterium bovis subsp bovis AF2122/97
gcgggcguccacgc

SEQ ID NO: 3161225 - RNA, 16 nt, Mycobacterium bovis subsp bovis AF2122/97
gcgggcgucccgcaua

SEQ ID NO: 3161226 - RNA, 13 nt, Mycobacterium bovis subsp bovis AF2122/97
gcgggcgucgcgg

SEQ ID NO: 3161227 - RNA, 16 nt, Mycobacterium bovis subsp bovis AF2122/97
gcgggcgugccgacca

SEQ ID NO: 3161228 - RNA, 19 nt, Mycobacterium bovis subsp bovis AF2122/97
gcgggcgugccgaccagca

SEQ ID NO: 3161229 - RNA, 18 nt, Mycobacterium bovis subsp bovis AF2122/97
gcgggucagcgccgagag

SEQ ID NO: 3161230 - RNA, 14 nt, Mycobacterium bovis subsp bovis AF2122/97
gcgggucagcucga

SEQ ID NO: 3161231 - RNA, 20 nt, Mycobacterium bovis subsp bovis AF2122/97
gcgggucagcucgaccugag

SEQ ID NO: 3161232 - RNA, 16 nt, Mycobacterium bovis subsp bovis AF2122/97
gcgggucagcugacgg

SEQ ID NO: 3161233 - RNA, 19 nt, Mycobacterium bovis subsp bovis AF2122/97
gcgggucagcugacgggcc

SEQ ID NO: 3161234 - RNA, 15 nt, Mycobacterium bovis subsp bovis AF2122/97
gcgggucaggccagg

SEQ ID NO: 3161235 - RNA, 16 nt, Mycobacterium bovis subsp bovis AF2122/97
gcggguccagccaccg

SEQ ID NO: 3161236 - RNA, 19 nt, Mycobacterium bovis subsp bovis AF2122/97
gcgggucccaaucgucggc

SEQ ID NO: 3161237 - RNA, 14 nt, Mycobacterium bovis subsp bovis AF2122/97
gcggguccccaccg

SEQ ID NO: 3161238 - RNA, 15 nt, Mycobacterium bovis subsp bovis AF2122/97
gcggguccgacgggc

SEQ ID NO: 3161239 - RNA, 19 nt, Mycobacterium bovis subsp bovis AF2122/97
gcggguccuucugccggga

SEQ ID NO: 3161240 - RNA, 14 nt, Mycobacterium bovis subsp bovis AF2122/97
gcgggucgccgggc

SEQ ID NO: 3161241 - RNA, 18 nt, Mycobacterium bovis subsp bovis AF2122/97
gcgggucgcggcuauggc

SEQ ID NO: 3161242 - RNA, 18 nt, Mycobacterium bovis subsp bovis AF2122/97
gcgggucgcgggugccga

SEQ ID NO: 3161243 - RNA, 16 nt, Mycobacterium bovis subsp bovis AF2122/97
gcgggucggcgaccgc

SEQ ID NO: 3161244 - RNA, 14 nt, Mycobacterium bovis subsp bovis AF2122/97
gcgggucggcggug

SEQ ID NO: 3161245 - RNA, 19 nt, Mycobacterium bovis subsp bovis AF2122/97
gcgggucgugccagcagca

SEQ ID NO: 3161246 - RNA, 18 nt, Mycobacterium bovis subsp bovis AF2122/97
gcgggucuuggcacacag

SEQ ID NO: 3161247 - RNA, 18 nt, Mycobacterium bovis subsp bovis AF2122/97
gcgggugaaucgacaccg

SEQ ID NO: 3161248 - RNA, 20 nt, Mycobacterium bovis subsp bovis AF2122/97
gcgggugaccaacacccccc

SEQ ID NO: 3161249 - RNA, 21 nt, Mycobacterium bovis subsp bovis AF2122/97
gcgggugaggucauagccguu

SEQ ID NO: 3161250 - RNA, 16 nt, Mycobacterium bovis subsp bovis AF2122/97
gcgggugaucuccacc

SEQ ID NO: 3161251 - RNA, 17 nt, Mycobacterium bovis subsp bovis AF2122/97
gcgggugaucuccaccg

SEQ ID NO: 3161252 - RNA, 14 nt, Mycobacterium bovis subsp bovis AF2122/97
gcgggugaugcagu

SEQ ID NO: 3161253 - RNA, 23 nt, Mycobacterium bovis subsp bovis AF2122/97
gcgggugauggaugggucgaccg

SEQ ID NO: 3161254 - RNA, 15 nt, Mycobacterium bovis subsp bovis AF2122/97
gcgggugauguucgu

SEQ ID NO: 3161255 - RNA, 23 nt, Mycobacterium bovis subsp bovis AF2122/97
gcgggugcauucgcaugucggac

SEQ ID NO: 3161256 - RNA, 15 nt, Mycobacterium bovis subsp bovis AF2122/97
gcgggugccagcccg

SEQ ID NO: 3161257 - RNA, 22 nt, Mycobacterium bovis subsp bovis AF2122/97
gcgggugccagcccguugcagg

SEQ ID NO: 3161258 - RNA, 17 nt, Mycobacterium bovis subsp bovis AF2122/97
gcgggugccgagcuggc

SEQ ID NO: 3161259 - RNA, 14 nt, Mycobacterium bovis subsp bovis AF2122/97
gcgggugccgggca

SEQ ID NO: 3161260 - RNA, 15 nt, Mycobacterium bovis subsp bovis AF2122/97
gcgggugcgccggcg

SEQ ID NO: 3161261 - RNA, 19 nt, Mycobacterium bovis subsp bovis AF2122/97
gcgggugcgcgaggucggc

SEQ ID NO: 3161262 - RNA, 12 nt, Mycobacterium bovis subsp bovis AF2122/97
gcgggugcgcug

SEQ ID NO: 3161263 - RNA, 17 nt, Mycobacterium bovis subsp bovis AF2122/97
gcgggugcggacaccga

SEQ ID NO: 3161264 - RNA, 14 nt, Mycobacterium bovis subsp bovis AF2122/97
gcgggugcggauca

SEQ ID NO: 3161265 - RNA, 12 nt, Mycobacterium bovis subsp bovis AF2122/97
gcgggugcuggu

SEQ ID NO: 3161266 - RNA, 21 nt, Mycobacterium bovis subsp bovis AF2122/97
gcggguggaaguacuucgcgg

SEQ ID NO: 3161267 - RNA, 21 nt, Mycobacterium bovis subsp bovis AF2122/97
gcggguggaguuggcugccgg

SEQ ID NO: 3161268 - RNA, 15 nt, Mycobacterium bovis subsp bovis AF2122/97
gcggguggcagcggc

SEQ ID NO: 3161269 - RNA, 16 nt, Mycobacterium bovis subsp bovis AF2122/97
gcggguggcccccgcc

SEQ ID NO: 3161270 - RNA, 16 nt, Mycobacterium bovis subsp bovis AF2122/97
gcggguggcgccggug

SEQ ID NO: 3161271 - RNA, 14 nt, Mycobacterium bovis subsp bovis AF2122/97
gcggguggcggcgu

SEQ ID NO: 3161272 - RNA, 23 nt, Mycobacterium bovis subsp bovis AF2122/97
gcgggugggacaccaucuccgcc

SEQ ID NO: 3161273 - RNA, 17 nt, Mycobacterium bovis subsp bovis AF2122/97
gcgggugggcacaccgg

SEQ ID NO: 3161274 - RNA, 15 nt, Mycobacterium bovis subsp bovis AF2122/97
gcgggugguccagcc

SEQ ID NO: 3161275 - RNA, 11 nt, Mycobacterium bovis subsp bovis AF2122/97
gcgggugguga

SEQ ID NO: 3161276 - RNA, 22 nt, Mycobacterium bovis subsp bovis AF2122/97
gcggguggugaaguagucggcg

SEQ ID NO: 3161277 - RNA, 17 nt, Mycobacterium bovis subsp bovis AF2122/97
gcggguggugccggcgg

SEQ ID NO: 3161278 - RNA, 18 nt, Mycobacterium bovis subsp bovis AF2122/97
gcggguggugccggcgga

SEQ ID NO: 3161279 - RNA, 19 nt, Mycobacterium bovis subsp bovis AF2122/97
gcgggugguuugcgcccug

SEQ ID NO: 3161280 - RNA, 20 nt, Mycobacterium bovis subsp bovis AF2122/97
gcggguguuccacaccaggc

SEQ ID NO: 3161281 - RNA, 23 nt, Mycobacterium bovis subsp bovis AF2122/97
gcggguguuccacaccaggccga

SEQ ID NO: 3161282 - RNA, 18 nt, Mycobacterium bovis subsp bovis AF2122/97
gcggguucaacgcgcgca

SEQ ID NO: 3161283 - RNA, 19 nt, Mycobacterium bovis subsp bovis AF2122/97
gcggguucaacgcgcgcac

SEQ ID NO: 3161284 - RNA, 20 nt, Mycobacterium bovis subsp bovis AF2122/97
gcggguucaacgcgcgcacg

SEQ ID NO: 3161285 - RNA, 21 nt, Mycobacterium bovis subsp bovis AF2122/97
gcggguucacugccggccaac

SEQ ID NO: 3161286 - RNA, 15 nt, Mycobacterium bovis subsp bovis AF2122/97
gcggguugcgcggcu

SEQ ID NO: 3161287 - RNA, 17 nt, Mycobacterium bovis subsp bovis AF2122/97
gcggguugcggucaccg

SEQ ID NO: 3161288 - RNA, 15 nt, Mycobacterium bovis subsp bovis AF2122/97
gcggguugggaccga

SEQ ID NO: 3161289 - RNA, 23 nt, Mycobacterium bovis subsp bovis AF2122/97
gcggguugucuuucacaugcgcc

SEQ ID NO: 3161290 - RNA, 16 nt, Mycobacterium bovis subsp bovis AF2122/97
gcggguuguggcaccc

SEQ ID NO: 3161291 - RNA, 20 nt, Mycobacterium bovis subsp bovis AF2122/97
gcggguuugaucuccaccuu

SEQ ID NO: 3161292 - RNA, 21 nt, Mycobacterium bovis subsp bovis AF2122/97
gcggguuugaucuccaccuuc

SEQ ID NO: 3161293 - RNA, 20 nt, Mycobacterium bovis subsp bovis AF2122/97
gcggguuugccgggcgcugg

SEQ ID NO: 3161294 - RNA, 17 nt, Mycobacterium bovis subsp bovis AF2122/97
gcggguuugcgguaguc

SEQ ID NO: 3161295 - RNA, 19 nt, Mycobacterium bovis subsp bovis AF2122/97
gcggguuuucucgccguug

SEQ ID NO: 3161296 - RNA, 13 nt, Mycobacterium bovis subsp bovis AF2122/97
gcgguaaagcccc

SEQ ID NO: 3161297 - RNA, 23 nt, Mycobacterium bovis subsp bovis AF2122/97
gcgguaaaugccugcccaccuuc

SEQ ID NO: 3161298 - RNA, 15 nt, Mycobacterium bovis subsp bovis AF2122/97
gcgguaagggcgggc

SEQ ID NO: 3161299 - RNA, 16 nt, Mycobacterium bovis subsp bovis AF2122/97
gcgguaagggcgggcu

SEQ ID NO: 3161300 - RNA, 17 nt, Mycobacterium bovis subsp bovis AF2122/97
gcgguaaucgccaccgc

SEQ ID NO: 3161301 - RNA, 14 nt, Mycobacterium bovis subsp bovis AF2122/97
gcgguaauggcgug

SEQ ID NO: 3161302 - RNA, 16 nt, Mycobacterium bovis subsp bovis AF2122/97
gcgguacaccgacacg

SEQ ID NO: 3161303 - RNA, 20 nt, Mycobacterium bovis subsp bovis AF2122/97
gcgguacaccgacacgccgu

SEQ ID NO: 3161304 - RNA, 22 nt, Mycobacterium bovis subsp bovis AF2122/97
gcgguaccaaccugcgcggcga

SEQ ID NO: 3161305 - RNA, 23 nt, Mycobacterium bovis subsp bovis AF2122/97
gcgguaccaucaccgcgccagcc

SEQ ID NO: 3161306 - RNA, 22 nt, Mycobacterium bovis subsp bovis AF2122/97
gcgguacccaccucccgcagcc

SEQ ID NO: 3161307 - RNA, 14 nt, Mycobacterium bovis subsp bovis AF2122/97
gcgguacccgaugu

SEQ ID NO: 3161308 - RNA, 17 nt, Mycobacterium bovis subsp bovis AF2122/97
gcgguaccgccgcugcc

SEQ ID NO: 3161309 - RNA, 15 nt, Mycobacterium bovis subsp bovis AF2122/97
gcgguaccgcucggg

SEQ ID NO: 3161310 - RNA, 18 nt, Mycobacterium bovis subsp bovis AF2122/97
gcgguaccggaaucggcg

SEQ ID NO: 3161311 - RNA, 22 nt, Mycobacterium bovis subsp bovis AF2122/97
gcgguaccggaaucggcggcgg

SEQ ID NO: 3161312 - RNA, 21 nt, Mycobacterium bovis subsp bovis AF2122/97
gcgguaccgggaucccacggc

SEQ ID NO: 3161313 - RNA, 17 nt, Mycobacterium bovis subsp bovis AF2122/97
gcgguaccuagccgcag

SEQ ID NO: 3161314 - RNA, 18 nt, Mycobacterium bovis subsp bovis AF2122/97
gcgguaccuagccgcaga

SEQ ID NO: 3161315 - RNA, 17 nt, Mycobacterium bovis subsp bovis AF2122/97
gcgguccgagcggcauc

SEQ ID NO: 3161316 - RNA, 18 nt, Mycobacterium bovis subsp bovis AF2122/97
gcgguccgagcggcaucg

SEQ ID NO: 3161317 - RNA, 14 nt, Mycobacterium bovis subsp bovis AF2122/97
gcgguccgccgccu

SEQ ID NO: 3161318 - RNA, 18 nt, Mycobacterium bovis subsp bovis AF2122/97
gcgguccgcugccaucgg

SEQ ID NO: 3161319 - RNA, 19 nt, Mycobacterium bovis subsp bovis AF2122/97
gcgguccgcugccaucggc

SEQ ID NO: 3161320 - RNA, 23 nt, Mycobacterium bovis subsp bovis AF2122/97
gcgguccgcugccaucggcacca

SEQ ID NO: 3161321 - RNA, 21 nt, Mycobacterium bovis subsp bovis AF2122/97
gcgguccggaaauuccggcgc

SEQ ID NO: 3161322 - RNA, 22 nt, Mycobacterium bovis subsp bovis AF2122/97
gcgguccggaaauuccggcgcg

SEQ ID NO: 3161323 - RNA, 18 nt, Mycobacterium bovis subsp bovis AF2122/97
gcgguccggaugcgcaac

SEQ ID NO: 3161324 - RNA, 15 nt, Mycobacterium bovis subsp bovis AF2122/97
gcgguccucgagccg

SEQ ID NO: 3161325 - RNA, 15 nt, Mycobacterium bovis subsp bovis AF2122/97
gcgguccucgaucgg

SEQ ID NO: 3161326 - RNA, 24 nt, Mycobacterium bovis subsp bovis AF2122/97
gcgguccugguguagccgagcacg

SEQ ID NO: 3161327 - RNA, 13 nt, Mycobacterium bovis subsp bovis AF2122/97
gcggucgacagcg

SEQ ID NO: 3161328 - RNA, 13 nt, Mycobacterium bovis subsp bovis AF2122/97
gcggucgacgugu

SEQ ID NO: 3161329 - RNA, 14 nt, Mycobacterium bovis subsp bovis AF2122/97
gcggucgacguguu

SEQ ID NO: 3161330 - RNA, 14 nt, Mycobacterium bovis subsp bovis AF2122/97
gcggucgagauguc

SEQ ID NO: 3161331 - RNA, 16 nt, Mycobacterium bovis subsp bovis AF2122/97
gcggucgagccaccca

SEQ ID NO: 3161332 - RNA, 17 nt, Mycobacterium bovis subsp bovis AF2122/97
gcggucgagccacccac

SEQ ID NO: 3161333 - RNA, 14 nt, Mycobacterium bovis subsp bovis AF2122/97
gcggucgagcucgu

SEQ ID NO: 3161334 - RNA, 19 nt, Mycobacterium bovis subsp bovis AF2122/97
gcggucgagguggcgggcg

SEQ ID NO: 3161335 - RNA, 14 nt, Mycobacterium bovis subsp bovis AF2122/97
gcggucgauagcgg

SEQ ID NO: 3161336 - RNA, 12 nt, Mycobacterium bovis subsp bovis AF2122/97
gcggucgaucac

SEQ ID NO: 3161337 - RNA, 15 nt, Mycobacterium bovis subsp bovis AF2122/97
gcggucgaucacacg

SEQ ID NO: 3161338 - RNA, 21 nt, Mycobacterium bovis subsp bovis AF2122/97
gcggucgaucauggcggcagc

SEQ ID NO: 3161339 - RNA, 20 nt, Mycobacterium bovis subsp bovis AF2122/97
gcggucgaucugacugacgg

SEQ ID NO: 3161340 - RNA, 18 nt, Mycobacterium bovis subsp bovis AF2122/97
gcggucgcagcagaccac

SEQ ID NO: 3161341 - RNA, 19 nt, Mycobacterium bovis subsp bovis AF2122/97
gcggucgcagcagaccaca

SEQ ID NO: 3161342 - RNA, 15 nt, Mycobacterium bovis subsp bovis AF2122/97
gcggucgccacaccc

SEQ ID NO: 3161343 - RNA, 18 nt, Mycobacterium bovis subsp bovis AF2122/97
gcggucgccacacccgcg

SEQ ID NO: 3161344 - RNA, 19 nt, Mycobacterium bovis subsp bovis AF2122/97
gcggucgccacacccgcga

SEQ ID NO: 3161345 - RNA, 13 nt, Mycobacterium bovis subsp bovis AF2122/97
gcggucgccaccg

SEQ ID NO: 3161346 - RNA, 18 nt, Mycobacterium bovis subsp bovis AF2122/97
gcggucgcccgcuaccaa

SEQ ID NO: 3161347 - RNA, 18 nt, Mycobacterium bovis subsp bovis AF2122/97
gcggucgccgcgcguucc

SEQ ID NO: 3161348 - RNA, 18 nt, Mycobacterium bovis subsp bovis AF2122/97
gcggucgcgcccucagcc

SEQ ID NO: 3161349 - RNA, 20 nt, Mycobacterium bovis subsp bovis AF2122/97
gcggucgcgcccucagccgc

SEQ ID NO: 3161350 - RNA, 15 nt, Mycobacterium bovis subsp bovis AF2122/97
gcggucgcgcgaugg

SEQ ID NO: 3161351 - RNA, 12 nt, Mycobacterium bovis subsp bovis AF2122/97
gcggucgcguac

SEQ ID NO: 3161352 - RNA, 13 nt, Mycobacterium bovis subsp bovis AF2122/97
gcggucgcuaucc

SEQ ID NO: 3161353 - RNA, 18 nt, Mycobacterium bovis subsp bovis AF2122/97
gcggucggaaugccgucg

SEQ ID NO: 3161354 - RNA, 19 nt, Mycobacterium bovis subsp bovis AF2122/97
gcggucggaaugccgucgc

SEQ ID NO: 3161355 - RNA, 21 nt, Mycobacterium bovis subsp bovis AF2122/97
gcggucggaccacccggcgcg

SEQ ID NO: 3161356 - RNA, 15 nt, Mycobacterium bovis subsp bovis AF2122/97
gcggucggcagaccg

SEQ ID NO: 3161357 - RNA, 16 nt, Mycobacterium bovis subsp bovis AF2122/97
gcggucggcagcgacg

SEQ ID NO: 3161358 - RNA, 22 nt, Mycobacterium bovis subsp bovis AF2122/97
gcggucggcagcgacgccggcc

SEQ ID NO: 3161359 - RNA, 17 nt, Mycobacterium bovis subsp bovis AF2122/97
gcggucggccaccaacu

SEQ ID NO: 3161360 - RNA, 19 nt, Mycobacterium bovis subsp bovis AF2122/97
gcggucggcgaccaccagc

SEQ ID NO: 3161361 - RNA, 20 nt, Mycobacterium bovis subsp bovis AF2122/97
gcggucggcgaccaccagcg

SEQ ID NO: 3161362 - RNA, 14 nt, Mycobacterium bovis subsp bovis AF2122/97
gcggucggcgacgu

SEQ ID NO: 3161363 - RNA, 15 nt, Mycobacterium bovis subsp bovis AF2122/97
gcggucggcgacgua

SEQ ID NO: 3161364 - RNA, 22 nt, Mycobacterium bovis subsp bovis AF2122/97
gcggucggcgacguagacgguc

SEQ ID NO: 3161365 - RNA, 17 nt, Mycobacterium bovis subsp bovis AF2122/97
gcggucggcggccgcca

SEQ ID NO: 3161366 - RNA, 13 nt, Mycobacterium bovis subsp bovis AF2122/97
gcggucgggcccg

SEQ ID NO: 3161367 - RNA, 16 nt, Mycobacterium bovis subsp bovis AF2122/97
gcggucgggcccggcg

SEQ ID NO: 3161368 - RNA, 16 nt, Mycobacterium bovis subsp bovis AF2122/97
gcggucggucaccaug

SEQ ID NO: 3161369 - RNA, 22 nt, Mycobacterium bovis subsp bovis AF2122/97
gcggucguccccgucgcuggcc

SEQ ID NO: 3161370 - RNA, 15 nt, Mycobacterium bovis subsp bovis AF2122/97
gcggucgugaucagc

SEQ ID NO: 3161371 - RNA, 19 nt, Mycobacterium bovis subsp bovis AF2122/97
gcggucgugaucagcagga

SEQ ID NO: 3161372 - RNA, 22 nt, Mycobacterium bovis subsp bovis AF2122/97
gcggucgugaucagcaggacga

SEQ ID NO: 3161373 - RNA, 22 nt, Mycobacterium bovis subsp bovis AF2122/97
gcggucgugccccgcggucucg

SEQ ID NO: 3161374 - RNA, 22 nt, Mycobacterium bovis subsp bovis AF2122/97
gcggucguugauuucggcggcg

SEQ ID NO: 3161375 - RNA, 15 nt, Mycobacterium bovis subsp bovis AF2122/97
gcggucguugccgac

SEQ ID NO: 3161376 - RNA, 17 nt, Mycobacterium bovis subsp bovis AF2122/97
gcggucguugccgaccg

SEQ ID NO: 3161377 - RNA, 18 nt, Mycobacterium bovis subsp bovis AF2122/97
gcggucucagugcucgcc

SEQ ID NO: 3161378 - RNA, 21 nt, Mycobacterium bovis subsp bovis AF2122/97
gcggucucggcgucgaccagu

SEQ ID NO: 3161379 - RNA, 21 nt, Mycobacterium bovis subsp bovis AF2122/97
gcggucucggugccgagcacu

SEQ ID NO: 3161380 - RNA, 16 nt, Mycobacterium bovis subsp bovis AF2122/97
gcggucugcgcgucgc

SEQ ID NO: 3161381 - RNA, 19 nt, Mycobacterium bovis subsp bovis AF2122/97
gcggucugcgcgucgcgug

SEQ ID NO: 3161382 - RNA, 17 nt, Mycobacterium bovis subsp bovis AF2122/97
gcggucugcuccaggcg

SEQ ID NO: 3161383 - RNA, 18 nt, Mycobacterium bovis subsp bovis AF2122/97
gcggucugcuccaggcgc

SEQ ID NO: 3161384 - RNA, 21 nt, Mycobacterium bovis subsp bovis AF2122/97
gcggucugcuccaggcgcgcc

SEQ ID NO: 3161385 - RNA, 23 nt, Mycobacterium bovis subsp bovis AF2122/97
gcggucugcuccaggcgcgccgc

SEQ ID NO: 3161386 - RNA, 22 nt, Mycobacterium bovis subsp bovis AF2122/97
gcggucuggacaucggccggcg

SEQ ID NO: 3161387 - RNA, 14 nt, Mycobacterium bovis subsp bovis AF2122/97
gcggucuugccgca

SEQ ID NO: 3161388 - RNA, 16 nt, Mycobacterium bovis subsp bovis AF2122/97
gcggucuugccgcagg

SEQ ID NO: 3161389 - RNA, 17 nt, Mycobacterium bovis subsp bovis AF2122/97
gcggucuuggcgcgccc

SEQ ID NO: 3161390 - RNA, 16 nt, Mycobacterium bovis subsp bovis AF2122/97
gcggucuuguccagga

SEQ ID NO: 3161391 - RNA, 20 nt, Mycobacterium bovis subsp bovis AF2122/97
gcggucuuugagccgguagc

SEQ ID NO: 3161392 - RNA, 19 nt, Mycobacterium bovis subsp bovis AF2122/97
gcggugaaaucgcacagcg

SEQ ID NO: 3161393 - RNA, 20 nt, Mycobacterium bovis subsp bovis AF2122/97
gcggugaacaccgccucugc

SEQ ID NO: 3161394 - RNA, 16 nt, Mycobacterium bovis subsp bovis AF2122/97
gcggugaacugcuggc

SEQ ID NO: 3161395 - RNA, 21 nt, Mycobacterium bovis subsp bovis AF2122/97
gcggugaacuucuccaccagc

SEQ ID NO: 3161396 - RNA, 22 nt, Mycobacterium bovis subsp bovis AF2122/97
gcggugaacuucuccaccagcg

SEQ ID NO: 3161397 - RNA, 23 nt, Mycobacterium bovis subsp bovis AF2122/97
gcggugaaggccccgccgguggc

SEQ ID NO: 3161398 - RNA, 19 nt, Mycobacterium bovis subsp bovis AF2122/97
gcggugaauccgugcaggg

SEQ ID NO: 3161399 - RNA, 21 nt, Mycobacterium bovis subsp bovis AF2122/97
gcggugaauccgugcagggca

SEQ ID NO: 3161400 - RNA, 13 nt, Mycobacterium bovis subsp bovis AF2122/97
gcggugaccaccc

SEQ ID NO: 3161401 - RNA, 19 nt, Mycobacterium bovis subsp bovis AF2122/97
gcgguggugagugcgucuc

SEQ ID NO: 3161402 - RNA, 14 nt, Mycobacterium bovis subsp bovis AF2122/97
gcgguggugccgcg

SEQ ID NO: 3161403 - RNA, 17 nt, Mycobacterium bovis subsp bovis AF2122/97
gcgguggugucgcucgc

SEQ ID NO: 3161404 - RNA, 15 nt, Mycobacterium bovis subsp bovis AF2122/97
gcgguguaacccgga

SEQ ID NO: 3161405 - RNA, 22 nt, Mycobacterium bovis subsp bovis AF2122/97
gcgguguaacccggaaccagcc

SEQ ID NO: 3161406 - RNA, 18 nt, Mycobacterium bovis subsp bovis AF2122/97
gcgguguagaagcgggcg

SEQ ID NO: 3161407 - RNA, 21 nt, Mycobacterium bovis subsp bovis AF2122/97
gcgguguagaagcgggcgucg

SEQ ID NO: 3161408 - RNA, 22 nt, Mycobacterium bovis subsp bovis AF2122/97
gcgguguagaagcgggcgucgc

SEQ ID NO: 3161409 - RNA, 18 nt, Mycobacterium bovis subsp bovis AF2122/97
gcgguguagagcgcaccg

SEQ ID NO: 3161410 - RNA, 19 nt, Mycobacterium bovis subsp bovis AF2122/97
gcgguguagccgcgguaga

SEQ ID NO: 3161411 - RNA, 16 nt, Mycobacterium bovis subsp bovis AF2122/97
gcgguguagccggcgc

SEQ ID NO: 3161412 - RNA, 20 nt, Mycobacterium bovis subsp bovis AF2122/97
gcgguguagccggcgccgcc

SEQ ID NO: 3161413 - RNA, 16 nt, Mycobacterium bovis subsp bovis AF2122/97
gcgguguagggcggcg

SEQ ID NO: 3161414 - RNA, 19 nt, Mycobacterium bovis subsp bovis AF2122/97
gcgguguagggcggcguug

SEQ ID NO: 3161415 - RNA, 14 nt, Mycobacterium bovis subsp bovis AF2122/97
gcggugucacgacc

SEQ ID NO: 3161416 - RNA, 18 nt, Mycobacterium bovis subsp bovis AF2122/97
gcggugucacgacccaag

SEQ ID NO: 3161417 - RNA, 20 nt, Mycobacterium bovis subsp bovis AF2122/97
gcgguguccuacuuuuccac

SEQ ID NO: 3161418 - RNA, 16 nt, Mycobacterium bovis subsp bovis AF2122/97
gcggugucggcgccga

SEQ ID NO: 3161419 - RNA, 18 nt, Mycobacterium bovis subsp bovis AF2122/97
gcggugucgucgagguca

SEQ ID NO: 3161420 - RNA, 16 nt, Mycobacterium bovis subsp bovis AF2122/97
gcggugugcagggacc

SEQ ID NO: 3161421 - RNA, 15 nt, Mycobacterium bovis subsp bovis AF2122/97
gcggugugcggcagc

SEQ ID NO: 3161422 - RNA, 18 nt, Mycobacterium bovis subsp bovis AF2122/97
gcggugugugcaagccga

SEQ ID NO: 3161423 - RNA, 21 nt, Mycobacterium bovis subsp bovis AF2122/97
gcggugugugcaagccgaaca

SEQ ID NO: 3161424 - RNA, 15 nt, Mycobacterium bovis subsp bovis AF2122/97
gcgguguugcccgac

SEQ ID NO: 3161425 - RNA, 15 nt, Mycobacterium bovis subsp bovis AF2122/97
gcgguguugccggag

SEQ ID NO: 3161426 - RNA, 23 nt, Mycobacterium bovis subsp bovis AF2122/97
gcgguguugcucccggccgccga

SEQ ID NO: 3161427 - RNA, 14 nt, Mycobacterium bovis subsp bovis AF2122/97
gcgguguuggacgc

SEQ ID NO: 3161428 - RNA, 22 nt, Mycobacterium bovis subsp bovis AF2122/97
gcgguguuggacgcgggccgac

SEQ ID NO: 3161429 - RNA, 16 nt, Mycobacterium bovis subsp bovis AF2122/97
gcgguuagaucacccg

SEQ ID NO: 3161430 - RNA, 20 nt, Mycobacterium bovis subsp bovis AF2122/97
gcgguuagaucacccgcagc

SEQ ID NO: 3161431 - RNA, 21 nt, Mycobacterium bovis subsp bovis AF2122/97
gcgguuagaucacccgcagcc

SEQ ID NO: 3161432 - RNA, 16 nt, Mycobacterium bovis subsp bovis AF2122/97
gcgguuagcagccgcu

SEQ ID NO: 3161433 - RNA, 18 nt, Mycobacterium bovis subsp bovis AF2122/97
gcgguuagcagccgcuga

SEQ ID NO: 3161434 - RNA, 14 nt, Mycobacterium bovis subsp bovis AF2122/97
gcgguuaucgccga

SEQ ID NO: 3161435 - RNA, 15 nt, Mycobacterium bovis subsp bovis AF2122/97
gcgguuaucgccgag

SEQ ID NO: 3161436 - RNA, 18 nt, Mycobacterium bovis subsp bovis AF2122/97
gcgguuccggccggcucc

SEQ ID NO: 3161437 - RNA, 18 nt, Mycobacterium bovis subsp bovis AF2122/97
gcgguucgaacgcgaucg

SEQ ID NO: 3161438 - RNA, 24 nt, Mycobacterium bovis subsp bovis AF2122/97
gcgguucgaugacaggcuuggcau

SEQ ID NO: 3161439 - RNA, 17 nt, Mycobacterium bovis subsp bovis AF2122/97
gcgguucgcugcggcgg

SEQ ID NO: 3161440 - RNA, 15 nt, Mycobacterium bovis subsp bovis AF2122/97
gcgguucggugaucg

SEQ ID NO: 3161441 - RNA, 16 nt, Mycobacterium bovis subsp bovis AF2122/97
gcgguucucgagcucg

SEQ ID NO: 3161442 - RNA, 17 nt, Mycobacterium bovis subsp bovis AF2122/97
gcgguugacccacagca

SEQ ID NO: 3161443 - RNA, 20 nt, Mycobacterium bovis subsp bovis AF2122/97
gcgguugaguugcagaccgg

SEQ ID NO: 3161444 - RNA, 13 nt, Mycobacterium bovis subsp bovis AF2122/97
gcgguugaugcgg

SEQ ID NO: 3161445 - RNA, 17 nt, Mycobacterium bovis subsp bovis AF2122/97
gcgguugaugcggccgc

SEQ ID NO: 3161446 - RNA, 19 nt, Mycobacterium bovis subsp bovis AF2122/97
gcgguugcaaaccgcugcg

SEQ ID NO: 3161447 - RNA, 13 nt, Mycobacterium bovis subsp bovis AF2122/97
gcgguugccccga

SEQ ID NO: 3161448 - RNA, 16 nt, Mycobacterium bovis subsp bovis AF2122/97
gcgguugcccgagcgg

SEQ ID NO: 3161449 - RNA, 18 nt, Mycobacterium bovis subsp bovis AF2122/97
gcgguugccgucugcggu

SEQ ID NO: 3161450 - RNA, 19 nt, Mycobacterium bovis subsp bovis AF2122/97
gcgguuggaucggcggccg

SEQ ID NO: 3161451 - RNA, 14 nt, Mycobacterium bovis subsp bovis AF2122/97
gcgguuggcggcga

SEQ ID NO: 3161452 - RNA, 20 nt, Mycobacterium bovis subsp bovis AF2122/97
gcgguuggcggcgaugguau

SEQ ID NO: 3161453 - RNA, 15 nt, Mycobacterium bovis subsp bovis AF2122/97
gcgguugggcgaaau

SEQ ID NO: 3161454 - RNA, 16 nt, Mycobacterium bovis subsp bovis AF2122/97
gcgguuguccggucgc

SEQ ID NO: 3161455 - RNA, 16 nt, Mycobacterium bovis subsp bovis AF2122/97
gcgguuguccuccgac

SEQ ID NO: 3161456 - RNA, 19 nt, Mycobacterium bovis subsp bovis AF2122/97
gcgguuucaccgacgacgc

SEQ ID NO: 3161457 - RNA, 22 nt, Mycobacterium bovis subsp bovis AF2122/97
gcgguuuccgcacgaucgcccg

SEQ ID NO: 3161458 - RNA, 18 nt, Mycobacterium bovis subsp bovis AF2122/97
gcgguuuucgccggaucg

SEQ ID NO: 3161459 - RNA, 18 nt, Mycobacterium bovis subsp bovis AF2122/97
gcgguuuucggcugccgc

SEQ ID NO: 3161460 - RNA, 23 nt, Mycobacterium bovis subsp bovis AF2122/97
gcguaauccacacacagccggug

SEQ ID NO: 3161461 - RNA, 17 nt, Mycobacterium bovis subsp bovis AF2122/97
gcguaauccgagcgcgg

SEQ ID NO: 3161462 - RNA, 21 nt, Mycobacterium bovis subsp bovis AF2122/97
gcguaauccgagcgcggcggc

SEQ ID NO: 3161463 - RNA, 22 nt, Mycobacterium bovis subsp bovis AF2122/97
gcguaauccgagcgcggcggcg

SEQ ID NO: 3161464 - RNA, 16 nt, Mycobacterium bovis subsp bovis AF2122/97
gcguaauucgacuucg

SEQ ID NO: 3161465 - RNA, 23 nt, Mycobacterium bovis subsp bovis AF2122/97
gcguaauuuggcuugcgccgaaa

SEQ ID NO: 3161466 - RNA, 16 nt, Mycobacterium bovis subsp bovis AF2122/97
gcguacaaaccgucgg

SEQ ID NO: 3161467 - RNA, 13 nt, Mycobacterium bovis subsp bovis AF2122/97
gcguacagcaccg

SEQ ID NO: 3161468 - RNA, 20 nt, Mycobacterium bovis subsp bovis AF2122/97
gcguacaggccggccaccac

SEQ ID NO: 3161469 - RNA, 23 nt, Mycobacterium bovis subsp bovis AF2122/97
gcguaccaauucccgcgcggcgu

SEQ ID NO: 3161470 - RNA, 18 nt, Mycobacterium bovis subsp bovis AF2122/97
gcguaccagcuggccacu

SEQ ID NO: 3161471 - RNA, 16 nt, Mycobacterium bovis subsp bovis AF2122/97
gcguacccgaucagcg

SEQ ID NO: 3161472 - RNA, 21 nt, Mycobacterium bovis subsp bovis AF2122/97
gcguacccguuaugcgccgcc

SEQ ID NO: 3161473 - RNA, 22 nt, Mycobacterium bovis subsp bovis AF2122/97
gcguacccguuaugcgccgccc

SEQ ID NO: 3161474 - RNA, 14 nt, Mycobacterium bovis subsp bovis AF2122/97
gcguacucccccga

SEQ ID NO: 3161475 - RNA, 23 nt, Mycobacterium bovis subsp bovis AF2122/97
gcguacucccccgaaccugcggc

SEQ ID NO: 3161476 - RNA, 18 nt, Mycobacterium bovis subsp bovis AF2122/97
gcguacucggcauccagg

SEQ ID NO: 3161477 - RNA, 16 nt, Mycobacterium bovis subsp bovis AF2122/97
gcguacucgugaugaa

SEQ ID NO: 3161478 - RNA, 19 nt, Mycobacterium bovis subsp bovis AF2122/97
gcguacugguccgcacggu

SEQ ID NO: 3161479 - RNA, 20 nt, Mycobacterium bovis subsp bovis AF2122/97
gcguacuucgcuggaaaccu

SEQ ID NO: 3161480 - RNA, 17 nt, Mycobacterium bovis subsp bovis AF2122/97
gcguagacguagaaugc

SEQ ID NO: 3161481 - RNA, 21 nt, Mycobacterium bovis subsp bovis AF2122/97
gcguagagccgaucaccgccg

SEQ ID NO: 3161482 - RNA, 20 nt, Mycobacterium bovis subsp bovis AF2122/97
gcguagaucaucuggcuggu

SEQ ID NO: 3161483 - RNA, 15 nt, Mycobacterium bovis subsp bovis AF2122/97
gcguagcaacccagg

SEQ ID NO: 3161484 - RNA, 13 nt, Mycobacterium bovis subsp bovis AF2122/97
gcguagcaggucg

SEQ ID NO: 3161485 - RNA, 17 nt, Mycobacterium bovis subsp bovis AF2122/97
gcguagcgaccucgccg

SEQ ID NO: 3161486 - RNA, 19 nt, Mycobacterium bovis subsp bovis AF2122/97
gcguagcgaccucgccgcg

SEQ ID NO: 3161487 - RNA, 16 nt, Mycobacterium bovis subsp bovis AF2122/97
gcguccaggugcgccg

SEQ ID NO: 3161488 - RNA, 19 nt, Mycobacterium bovis subsp bovis AF2122/97
gcguccaguccgaucaccc

SEQ ID NO: 3161489 - RNA, 14 nt, Mycobacterium bovis subsp bovis AF2122/97
gcguccaucaccag

SEQ ID NO: 3161490 - RNA, 16 nt, Mycobacterium bovis subsp bovis AF2122/97
gcguccaucaccagca

SEQ ID NO: 3161491 - RNA, 15 nt, Mycobacterium bovis subsp bovis AF2122/97
gcguccauccgcagc

SEQ ID NO: 3161492 - RNA, 16 nt, Mycobacterium bovis subsp bovis AF2122/97
gcguccauccgcagca

SEQ ID NO: 3161493 - RNA, 15 nt, Mycobacterium bovis subsp bovis AF2122/97
gcguccaucgcgcgc

SEQ ID NO: 3161494 - RNA, 20 nt, Mycobacterium bovis subsp bovis AF2122/97
gcguccaucgcgcgccgacc

SEQ ID NO: 3161495 - RNA, 19 nt, Mycobacterium bovis subsp bovis AF2122/97
gcguccaucucggaccaca

SEQ ID NO: 3161496 - RNA, 20 nt, Mycobacterium bovis subsp bovis AF2122/97
gcguccauggucgcgccacc

SEQ ID NO: 3161497 - RNA, 18 nt, Mycobacterium bovis subsp bovis AF2122/97
gcgucccaaucgggaucg

SEQ ID NO: 3161498 - RNA, 22 nt, Mycobacterium bovis subsp bovis AF2122/97
gcgucccaaucgggaucgcugc

SEQ ID NO: 3161499 - RNA, 15 nt, Mycobacterium bovis subsp bovis AF2122/97
gcguccccagcgcca

SEQ ID NO: 3161500 - RNA, 17 nt, Mycobacterium bovis subsp bovis AF2122/97
gcguccccagcgccacc

SEQ ID NO: 3161501 - RNA, 14 nt, Mycobacterium bovis subsp bovis AF2122/97
gcgucccgccgcac

SEQ ID NO: 3161502 - RNA, 17 nt, Mycobacterium bovis subsp bovis AF2122/97
gcgucccgccgcaccgc

SEQ ID NO: 3161503 - RNA, 16 nt, Mycobacterium bovis subsp bovis AF2122/97
gcgucccggcggucag

SEQ ID NO: 3161504 - RNA, 20 nt, Mycobacterium bovis subsp bovis AF2122/97
gcgucccggcggucagcggc

SEQ ID NO: 3161505 - RNA, 16 nt, Mycobacterium bovis subsp bovis AF2122/97
gcgucccggucgccaa

SEQ ID NO: 3161506 - RNA, 16 nt, Mycobacterium bovis subsp bovis AF2122/97
gcguccgaaccaccug

SEQ ID NO: 3161507 - RNA, 14 nt, Mycobacterium bovis subsp bovis AF2122/97
gcguccgacaacga

SEQ ID NO: 3161508 - RNA, 13 nt, Mycobacterium bovis subsp bovis AF2122/97
gcguccgcccagc

SEQ ID NO: 3161509 - RNA, 14 nt, Mycobacterium bovis subsp bovis AF2122/97
gcguccgcccagca

SEQ ID NO: 3161510 - RNA, 19 nt, Mycobacterium bovis subsp bovis AF2122/97
gcguccgcccagccgcagc

SEQ ID NO: 3161511 - RNA, 14 nt, Mycobacterium bovis subsp bovis AF2122/97
gcguccgccggcga

SEQ ID NO: 3161512 - RNA, 14 nt, Mycobacterium bovis subsp bovis AF2122/97
gcguccgcgaucug

SEQ ID NO: 3161513 - RNA, 16 nt, Mycobacterium bovis subsp bovis AF2122/97
gcguccgggcagccgc

SEQ ID NO: 3161514 - RNA, 20 nt, Mycobacterium bovis subsp bovis AF2122/97
gcguccgggcucgcgcucga

SEQ ID NO: 3161515 - RNA, 19 nt, Mycobacterium bovis subsp bovis AF2122/97
gcguccggguggcacacca

SEQ ID NO: 3161516 - RNA, 17 nt, Mycobacterium bovis subsp bovis AF2122/97
gcguccggugcaccagg

SEQ ID NO: 3161517 - RNA, 21 nt, Mycobacterium bovis subsp bovis AF2122/97
gcguccggugcugguccagcc

SEQ ID NO: 3161518 - RNA, 18 nt, Mycobacterium bovis subsp bovis AF2122/97
gcguccguagcgauucug

SEQ ID NO: 3161519 - RNA, 15 nt, Mycobacterium bovis subsp bovis AF2122/97
gcguccgucggcgaa

SEQ ID NO: 3161520 - RNA, 16 nt, Mycobacterium bovis subsp bovis AF2122/97
gcguccgucgucggcg

SEQ ID NO: 3161521 - RNA, 17 nt, Mycobacterium bovis subsp bovis AF2122/97
gcguccgucucgcaggc

SEQ ID NO: 3161522 - RNA, 19 nt, Mycobacterium bovis subsp bovis AF2122/97
gcguccgucucgcaggcgc

SEQ ID NO: 3161523 - RNA, 20 nt, Mycobacterium bovis subsp bovis AF2122/97
gcguccgucucgcaggcgca

SEQ ID NO: 3161524 - RNA, 16 nt, Mycobacterium bovis subsp bovis AF2122/97
gcguccucgcccuggc

SEQ ID NO: 3161525 - RNA, 18 nt, Mycobacterium bovis subsp bovis AF2122/97
gcguccucgccgcacgcc

SEQ ID NO: 3161526 - RNA, 14 nt, Mycobacterium bovis subsp bovis AF2122/97
gcguccugcucgcg

SEQ ID NO: 3161527 - RNA, 13 nt, Mycobacterium bovis subsp bovis AF2122/97
gcguccuggugag

SEQ ID NO: 3161528 - RNA, 16 nt, Mycobacterium bovis subsp bovis AF2122/97
gcguccuugcgcagca

SEQ ID NO: 3161529 - RNA, 16 nt, Mycobacterium bovis subsp bovis AF2122/97
gcguccuugggcgucg

SEQ ID NO: 3161530 - RNA, 23 nt, Mycobacterium bovis subsp bovis AF2122/97
gcgucgaaaagccgugcaccagc

SEQ ID NO: 3161531 - RNA, 16 nt, Mycobacterium bovis subsp bovis AF2122/97
gcgucgaaccagucga

SEQ ID NO: 3161532 - RNA, 21 nt, Mycobacterium bovis subsp bovis AF2122/97
gcgucgaacugggcgcccgcg

SEQ ID NO: 3161533 - RNA, 20 nt, Mycobacterium bovis subsp bovis AF2122/97
gcgucgaagaccgccuccac

SEQ ID NO: 3161534 - RNA, 14 nt, Mycobacterium bovis subsp bovis AF2122/97
gcgucgaagccggg

SEQ ID NO: 3161535 - RNA, 18 nt, Mycobacterium bovis subsp bovis AF2122/97
gcgucgaaggugaccagg

SEQ ID NO: 3161536 - RNA, 16 nt, Mycobacterium bovis subsp bovis AF2122/97
gcgucgacaacacgcc

SEQ ID NO: 3161537 - RNA, 17 nt, Mycobacterium bovis subsp bovis AF2122/97
gcgucgacacacccacc

SEQ ID NO: 3161538 - RNA, 22 nt, Mycobacterium bovis subsp bovis AF2122/97
gcgucgacagauugcucggugg

SEQ ID NO: 3161539 - RNA, 22 nt, Mycobacterium bovis subsp bovis AF2122/97
gcgucgaccaagguguccagca

SEQ ID NO: 3161540 - RNA, 13 nt, Mycobacterium bovis subsp bovis AF2122/97
gcgucgaccacgc

SEQ ID NO: 3161541 - RNA, 23 nt, Mycobacterium bovis subsp bovis AF2122/97
gcgucgacccagaacaugccgga

SEQ ID NO: 3161542 - RNA, 13 nt, Mycobacterium bovis subsp bovis AF2122/97
gcgucgacccgaa

SEQ ID NO: 3161543 - RNA, 15 nt, Mycobacterium bovis subsp bovis AF2122/97
gcgucgaccgcggcc

SEQ ID NO: 3161544 - RNA, 19 nt, Mycobacterium bovis subsp bovis AF2122/97
gcgucgaccggaaccagcg

SEQ ID NO: 3161545 - RNA, 15 nt, Mycobacterium bovis subsp bovis AF2122/97
gcgucgaccggacaa

SEQ ID NO: 3161546 - RNA, 18 nt, Mycobacterium bovis subsp bovis AF2122/97
gcgucgaccucgcgggcg

SEQ ID NO: 3161547 - RNA, 19 nt, Mycobacterium bovis subsp bovis AF2122/97
gcgucgacgucgacggcga

SEQ ID NO: 3161548 - RNA, 19 nt, Mycobacterium bovis subsp bovis AF2122/97
gcgucgacugcgugccgca

SEQ ID NO: 3161549 - RNA, 14 nt, Mycobacterium bovis subsp bovis AF2122/97
gcgucgacuggccg

SEQ ID NO: 3161550 - RNA, 21 nt, Mycobacterium bovis subsp bovis AF2122/97
gcgucgacuggccguuucggc

SEQ ID NO: 3161551 - RNA, 15 nt, Mycobacterium bovis subsp bovis AF2122/97
gcgucgagcagcacc

SEQ ID NO: 3161552 - RNA, 19 nt, Mycobacterium bovis subsp bovis AF2122/97
gcgucgagcagcaccaccc

SEQ ID NO: 3161553 - RNA, 23 nt, Mycobacterium bovis subsp bovis AF2122/97
gcgucgagccggauucggcugcc

SEQ ID NO: 3161554 - RNA, 18 nt, Mycobacterium bovis subsp bovis AF2122/97
gcgucgagcgacccccag

SEQ ID NO: 3161555 - RNA, 20 nt, Mycobacterium bovis subsp bovis AF2122/97
gcgucgagcgacccccagcg

SEQ ID NO: 3161556 - RNA, 23 nt, Mycobacterium bovis subsp bovis AF2122/97
gcgucgagcgacccccagcgccc

SEQ ID NO: 3161557 - RNA, 22 nt, Mycobacterium bovis subsp bovis AF2122/97
gcgucgagguggcgcacaucgc

SEQ ID NO: 3161558 - RNA, 17 nt, Mycobacterium bovis subsp bovis AF2122/97
gcgucgagugccgccac

SEQ ID NO: 3161559 - RNA, 18 nt, Mycobacterium bovis subsp bovis AF2122/97
gcgucgagugccgccacc

SEQ ID NO: 3161560 - RNA, 21 nt, Mycobacterium bovis subsp bovis AF2122/97
gcgucgagugccgccaccgcc

SEQ ID NO: 3161561 - RNA, 16 nt, Mycobacterium bovis subsp bovis AF2122/97
gcgucgaguggccgug

SEQ ID NO: 3161562 - RNA, 18 nt, Mycobacterium bovis subsp bovis AF2122/97
gcgucgauaaccuggcgg

SEQ ID NO: 3161563 - RNA, 17 nt, Mycobacterium bovis subsp bovis AF2122/97
gcgucgaucacgucguc

SEQ ID NO: 3161564 - RNA, 15 nt, Mycobacterium bovis subsp bovis AF2122/97
gcgucgaucagggcc

SEQ ID NO: 3161565 - RNA, 20 nt, Mycobacterium bovis subsp bovis AF2122/97
gcgucgaucagggccccacc

SEQ ID NO: 3161566 - RNA, 16 nt, Mycobacterium bovis subsp bovis AF2122/97
gcgucgaucguuccgc

SEQ ID NO: 3161567 - RNA, 17 nt, Mycobacterium bovis subsp bovis AF2122/97
gcgucgaucguuccgcu

SEQ ID NO: 3161568 - RNA, 18 nt, Mycobacterium bovis subsp bovis AF2122/97
gcgucgaugccggcugcc

SEQ ID NO: 3161569 - RNA, 18 nt, Mycobacterium bovis subsp bovis AF2122/97
gcgucgaugcgcugcuca

SEQ ID NO: 3161570 - RNA, 12 nt, Mycobacterium bovis subsp bovis AF2122/97
gcgucgaugcgg

SEQ ID NO: 3161571 - RNA, 19 nt, Mycobacterium bovis subsp bovis AF2122/97
gcgucgaugcgggccauca

SEQ ID NO: 3161572 - RNA, 16 nt, Mycobacterium bovis subsp bovis AF2122/97
gcgucgcacgcgcgca

SEQ ID NO: 3161573 - RNA, 19 nt, Mycobacterium bovis subsp bovis AF2122/97
gcgucgcacgcgcgcaggc

SEQ ID NO: 3161574 - RNA, 20 nt, Mycobacterium bovis subsp bovis AF2122/97
gcgucgugcgauucacacuc

SEQ ID NO: 3161575 - RNA, 17 nt, Mycobacterium bovis subsp bovis AF2122/97
gcgucgugcgcggccgg

SEQ ID NO: 3161576 - RNA, 15 nt, Mycobacterium bovis subsp bovis AF2122/97
gcgucguggucggcg

SEQ ID NO: 3161577 - RNA, 22 nt, Mycobacterium bovis subsp bovis AF2122/97
gcgucguggucggcgaccccga

SEQ ID NO: 3161578 - RNA, 17 nt, Mycobacterium bovis subsp bovis AF2122/97
gcgucgugguggccacg

SEQ ID NO: 3161579 - RNA, 16 nt, Mycobacterium bovis subsp bovis AF2122/97
gcgucguucgcgggug

SEQ ID NO: 3161580 - RNA, 20 nt, Mycobacterium bovis subsp bovis AF2122/97
gcgucguugucgucgccggc

SEQ ID NO: 3161581 - RNA, 22 nt, Mycobacterium bovis subsp bovis AF2122/97
gcgucguugucgucgccggcgg

SEQ ID NO: 3161582 - RNA, 23 nt, Mycobacterium bovis subsp bovis AF2122/97
gcgucguugucgucgccggcggc

SEQ ID NO: 3161583 - RNA, 16 nt, Mycobacterium bovis subsp bovis AF2122/97
gcgucguuugggugcg

SEQ ID NO: 3161584 - RNA, 18 nt, Mycobacterium bovis subsp bovis AF2122/97
gcgucuccagcuggguga

SEQ ID NO: 3161585 - RNA, 18 nt, Mycobacterium bovis subsp bovis AF2122/97
gcgucucgagcgcgccgc

SEQ ID NO: 3161586 - RNA, 23 nt, Mycobacterium bovis subsp bovis AF2122/97
gcgucucgaucaccucgcgggug

SEQ ID NO: 3161587 - RNA, 23 nt, Mycobacterium bovis subsp bovis AF2122/97
gcgucucgaugagcgcgaaguac

SEQ ID NO: 3161588 - RNA, 15 nt, Mycobacterium bovis subsp bovis AF2122/97
gcgucucgcagcaac

SEQ ID NO: 3161589 - RNA, 14 nt, Mycobacterium bovis subsp bovis AF2122/97
gcgucucgccggga

SEQ ID NO: 3161590 - RNA, 20 nt, Mycobacterium bovis subsp bovis AF2122/97
gcgucucgcgcagccggguc

SEQ ID NO: 3161591 - RNA, 20 nt, Mycobacterium bovis subsp bovis AF2122/97
gcgucucggaggcgaccacg

SEQ ID NO: 3161592 - RNA, 18 nt, Mycobacterium bovis subsp bovis AF2122/97
gcgucugacaucgucgac

SEQ ID NO: 3161593 - RNA, 13 nt, Mycobacterium bovis subsp bovis AF2122/97
gcgucugagcgcc

SEQ ID NO: 3161594 - RNA, 17 nt, Mycobacterium bovis subsp bovis AF2122/97
gcgucugcagcgggcgu

SEQ ID NO: 3161595 - RNA, 17 nt, Mycobacterium bovis subsp bovis AF2122/97
gcgucugcccgcccagc

SEQ ID NO: 3161596 - RNA, 14 nt, Mycobacterium bovis subsp bovis AF2122/97
gcgucugcgauccc

SEQ ID NO: 3161597 - RNA, 21 nt, Mycobacterium bovis subsp bovis AF2122/97
gcgucugcgaucccgaucgcg

SEQ ID NO: 3161598 - RNA, 22 nt, Mycobacterium bovis subsp bovis AF2122/97
gcgucugcgaucccgaucgcgc

SEQ ID NO: 3161599 - RNA, 19 nt, Mycobacterium bovis subsp bovis AF2122/97
gcgucugcgguggccuguc

SEQ ID NO: 3161600 - RNA, 23 nt, Mycobacterium bovis subsp bovis AF2122/97
gcgucugcucaccagcggucagc

SEQ ID NO: 3161601 - RNA, 17 nt, Mycobacterium bovis subsp bovis AF2122/97
gcgucugcucgccagcc

SEQ ID NO: 3161602 - RNA, 16 nt, Mycobacterium bovis subsp bovis AF2122/97
gcgucugcucgccagg

SEQ ID NO: 3161603 - RNA, 17 nt, Mycobacterium bovis subsp bovis AF2122/97
gcgucugcucgccaggc

SEQ ID NO: 3161604 - RNA, 18 nt, Mycobacterium bovis subsp bovis AF2122/97
gcgucugcucgccaggca

SEQ ID NO: 3161605 - RNA, 18 nt, Mycobacterium bovis subsp bovis AF2122/97
gcgucugcucgccaggcc

SEQ ID NO: 3161606 - RNA, 21 nt, Mycobacterium bovis subsp bovis AF2122/97
gcgucugcucgccgggcagcu

SEQ ID NO: 3161607 - RNA, 13 nt, Mycobacterium bovis subsp bovis AF2122/97
gcgucugcucgcg

SEQ ID NO: 3161608 - RNA, 16 nt, Mycobacterium bovis subsp bovis AF2122/97
gcgucugcucgcgccc

SEQ ID NO: 3161609 - RNA, 12 nt, Mycobacterium bovis subsp bovis AF2122/97
gcgucugcucgg

SEQ ID NO: 3161610 - RNA, 18 nt, Mycobacterium bovis subsp bovis AF2122/97
gcgucugcucggcaucgg

SEQ ID NO: 3161611 - RNA, 15 nt, Mycobacterium bovis subsp bovis AF2122/97
gcgucugcucggcgg

SEQ ID NO: 3161612 - RNA, 20 nt, Mycobacterium bovis subsp bovis AF2122/97
gcgucugcucggcggugccg

SEQ ID NO: 3161613 - RNA, 18 nt, Mycobacterium bovis subsp bovis AF2122/97
gcgucugcugaccggagu

SEQ ID NO: 3161614 - RNA, 14 nt, Mycobacterium bovis subsp bovis AF2122/97
gcgucugcuggcgc

SEQ ID NO: 3161615 - RNA, 16 nt, Mycobacterium bovis subsp bovis AF2122/97
gcgucugggugcaggu

SEQ ID NO: 3161616 - RNA, 14 nt, Mycobacterium bovis subsp bovis AF2122/97
gcgucuggucagcc

SEQ ID NO: 3161617 - RNA, 16 nt, Mycobacterium bovis subsp bovis AF2122/97
gcgucuggucagccgc

SEQ ID NO: 3161618 - RNA, 14 nt, Mycobacterium bovis subsp bovis AF2122/97
gcgucuguaccacg

SEQ ID NO: 3161619 - RNA, 21 nt, Mycobacterium bovis subsp bovis AF2122/97
gcgucuucagguccaccgcug

SEQ ID NO: 3161620 - RNA, 16 nt, Mycobacterium bovis subsp bovis AF2122/97
gcgucuuccucggcca

SEQ ID NO: 3161621 - RNA, 19 nt, Mycobacterium bovis subsp bovis AF2122/97
gcgucuuccucggccaccc

SEQ ID NO: 3161622 - RNA, 20 nt, Mycobacterium bovis subsp bovis AF2122/97
gcgucuuccucggccacccg

SEQ ID NO: 3161623 - RNA, 21 nt, Mycobacterium bovis subsp bovis AF2122/97
gcgucuuccucggccacccgc

SEQ ID NO: 3161624 - RNA, 18 nt, Mycobacterium bovis subsp bovis AF2122/97
gcgucuucggucgcggcc

SEQ ID NO: 3161625 - RNA, 20 nt, Mycobacterium bovis subsp bovis AF2122/97
gcgucuucggucgcggccuc

SEQ ID NO: 3161626 - RNA, 16 nt, Mycobacterium bovis subsp bovis AF2122/97
gcgucuugcaucagcg

SEQ ID NO: 3161627 - RNA, 16 nt, Mycobacterium bovis subsp bovis AF2122/97
gcgucuuggaaggcgc

SEQ ID NO: 3161628 - RNA, 22 nt, Mycobacterium bovis subsp bovis AF2122/97
gcgucuuggaaggcgcgcgccc

SEQ ID NO: 3161629 - RNA, 22 nt, Mycobacterium bovis subsp bovis AF2122/97
gcgugaacaagauucgcucacc

SEQ ID NO: 3161630 - RNA, 14 nt, Mycobacterium bovis subsp bovis AF2122/97
gcgugaacugaggg

SEQ ID NO: 3161631 - RNA, 19 nt, Mycobacterium bovis subsp bovis AF2122/97
gcgugaacugagggcggaa

SEQ ID NO: 3161632 - RNA, 14 nt, Mycobacterium bovis subsp bovis AF2122/97
gcgugacagggcgg

SEQ ID NO: 3161633 - RNA, 17 nt, Mycobacterium bovis subsp bovis AF2122/97
gcgugacagggcggcaa

SEQ ID NO: 3161634 - RNA, 13 nt, Mycobacterium bovis subsp bovis AF2122/97
gcgugaccaccgc

SEQ ID NO: 3161635 - RNA, 16 nt, Mycobacterium bovis subsp bovis AF2122/97
gcgugaccaccgccga

SEQ ID NO: 3161636 - RNA, 17 nt, Mycobacterium bovis subsp bovis AF2122/97
gcgugaccaccgccgac

SEQ ID NO: 3161637 - RNA, 18 nt, Mycobacterium bovis subsp bovis AF2122/97
gcgugaccaccgccgaca

SEQ ID NO: 3161638 - RNA, 15 nt, Mycobacterium bovis subsp bovis AF2122/97
gcgugacccgacaug

SEQ ID NO: 3161639 - RNA, 17 nt, Mycobacterium bovis subsp bovis AF2122/97
gcgugaccgugccgucg

SEQ ID NO: 3161640 - RNA, 14 nt, Mycobacterium bovis subsp bovis AF2122/97
gcgugaccuaccuc

SEQ ID NO: 3161641 - RNA, 16 nt, Mycobacterium bovis subsp bovis AF2122/97
gcgugacgaccagccc

SEQ ID NO: 3161642 - RNA, 17 nt, Mycobacterium bovis subsp bovis AF2122/97
gcgugacgaccagcccc

SEQ ID NO: 3161643 - RNA, 17 nt, Mycobacterium bovis subsp bovis AF2122/97
gcgugacgcuaacgucg

SEQ ID NO: 3161644 - RNA, 16 nt, Mycobacterium bovis subsp bovis AF2122/97
gcgugacugguggcgc

SEQ ID NO: 3161645 - RNA, 19 nt, Mycobacterium bovis subsp bovis AF2122/97
gcgugacugguggcgccaa

SEQ ID NO: 3161646 - RNA, 21 nt, Mycobacterium bovis subsp bovis AF2122/97
gcgugagccaugccgcucggc

SEQ ID NO: 3161647 - RNA, 14 nt, Mycobacterium bovis subsp bovis AF2122/97
gcgugagcgccgcg

SEQ ID NO: 3161648 - RNA, 17 nt, Mycobacterium bovis subsp bovis AF2122/97
gcgugagcgccgcggcg

SEQ ID NO: 3161649 - RNA, 21 nt, Mycobacterium bovis subsp bovis AF2122/97
gcgugagcgccgcggcgacgu

SEQ ID NO: 3161650 - RNA, 17 nt, Mycobacterium bovis subsp bovis AF2122/97
gcgugagcugcucgagc

SEQ ID NO: 3161651 - RNA, 12 nt, Mycobacterium bovis subsp bovis AF2122/97
gcgugaucccgc

SEQ ID NO: 3161652 - RNA, 18 nt, Mycobacterium bovis subsp bovis AF2122/97
gcgugaugcgggcucggc

SEQ ID NO: 3161653 - RNA, 15 nt, Mycobacterium bovis subsp bovis AF2122/97
gcgugauggcggcgc

SEQ ID NO: 3161654 - RNA, 12 nt, Mycobacterium bovis subsp bovis AF2122/97
gcgugcacaccc

SEQ ID NO: 3161655 - RNA, 16 nt, Mycobacterium bovis subsp bovis AF2122/97
gcgugcacaggucagc

SEQ ID NO: 3161656 - RNA, 20 nt, Mycobacterium bovis subsp bovis AF2122/97
gcgugcaccauacucaccga

SEQ ID NO: 3161657 - RNA, 18 nt, Mycobacterium bovis subsp bovis AF2122/97
gcgugcacggggaccuug

SEQ ID NO: 3161658 - RNA, 20 nt, Mycobacterium bovis subsp bovis AF2122/97
gcgugcagaauccguucgac

SEQ ID NO: 3161659 - RNA, 15 nt, Mycobacterium bovis subsp bovis AF2122/97
gcgugcagacccggu

SEQ ID NO: 3161660 - RNA, 22 nt, Mycobacterium bovis subsp bovis AF2122/97
gcgugggaugucgagcguggcg

SEQ ID NO: 3161661 - RNA, 13 nt, Mycobacterium bovis subsp bovis AF2122/97
gcgugggcacagc

SEQ ID NO: 3161662 - RNA, 17 nt, Mycobacterium bovis subsp bovis AF2122/97
gcgugggcaccccgcgg

SEQ ID NO: 3161663 - RNA, 20 nt, Mycobacterium bovis subsp bovis AF2122/97
gcgugggcacuugcccgucg

SEQ ID NO: 3161664 - RNA, 22 nt, Mycobacterium bovis subsp bovis AF2122/97
gcgugggcacuugcccgucggc

SEQ ID NO: 3161665 - RNA, 12 nt, Mycobacterium bovis subsp bovis AF2122/97
gcgugggcagcg

SEQ ID NO: 3161666 - RNA, 23 nt, Mycobacterium bovis subsp bovis AF2122/97
gcgugggcagcgcgaucaccgag

SEQ ID NO: 3161667 - RNA, 15 nt, Mycobacterium bovis subsp bovis AF2122/97
gcgugggcauucccg

SEQ ID NO: 3161668 - RNA, 14 nt, Mycobacterium bovis subsp bovis AF2122/97
gcgugggccugcgc

SEQ ID NO: 3161669 - RNA, 14 nt, Mycobacterium bovis subsp bovis AF2122/97
gcgugggcgcggcg

SEQ ID NO: 3161670 - RNA, 15 nt, Mycobacterium bovis subsp bovis AF2122/97
gcgugggcgcggcgc

SEQ ID NO: 3161671 - RNA, 16 nt, Mycobacterium bovis subsp bovis AF2122/97
gcgugggcgcggcgcc

SEQ ID NO: 3161672 - RNA, 14 nt, Mycobacterium bovis subsp bovis AF2122/97
gcguggggccgcca

SEQ ID NO: 3161673 - RNA, 16 nt, Mycobacterium bovis subsp bovis AF2122/97
gcguggggccgccacc

SEQ ID NO: 3161674 - RNA, 16 nt, Mycobacterium bovis subsp bovis AF2122/97
gcgugggugucggcua

SEQ ID NO: 3161675 - RNA, 21 nt, Mycobacterium bovis subsp bovis AF2122/97
gcgugguaccgcuuguccacc

SEQ ID NO: 3161676 - RNA, 16 nt, Mycobacterium bovis subsp bovis AF2122/97
gcgugguauccgccgu

SEQ ID NO: 3161677 - RNA, 17 nt, Mycobacterium bovis subsp bovis AF2122/97
gcgugguaucgccggga

SEQ ID NO: 3161678 - RNA, 23 nt, Mycobacterium bovis subsp bovis AF2122/97
gcguggucaccccuucgccagcg

SEQ ID NO: 3161679 - RNA, 24 nt, Mycobacterium bovis subsp bovis AF2122/97
gcguggucaccccuucgccagcgc

SEQ ID NO: 3161680 - RNA, 14 nt, Mycobacterium bovis subsp bovis AF2122/97
gcguggucgccccg

SEQ ID NO: 3161681 - RNA, 15 nt, Mycobacterium bovis subsp bovis AF2122/97
gcguggucgcgcggc

SEQ ID NO: 3161682 - RNA, 16 nt, Mycobacterium bovis subsp bovis AF2122/97
gcguggucgcgcggca

SEQ ID NO: 3161683 - RNA, 19 nt, Mycobacterium bovis subsp bovis AF2122/97
gcguggucgcgcggcaccg

SEQ ID NO: 3161684 - RNA, 15 nt, Mycobacterium bovis subsp bovis AF2122/97
gcguggucggcgaac

SEQ ID NO: 3161685 - RNA, 18 nt, Mycobacterium bovis subsp bovis AF2122/97
gcguggucgggaacccgg

SEQ ID NO: 3161686 - RNA, 19 nt, Mycobacterium bovis subsp bovis AF2122/97
gcguggucgggaacccggu

SEQ ID NO: 3161687 - RNA, 18 nt, Mycobacterium bovis subsp bovis AF2122/97
gcguggucucggucagcc

SEQ ID NO: 3161688 - RNA, 21 nt, Mycobacterium bovis subsp bovis AF2122/97
gcguggugagccucggcgagc

SEQ ID NO: 3161689 - RNA, 12 nt, Mycobacterium bovis subsp bovis AF2122/97
gcguggugcuga

SEQ ID NO: 3161690 - RNA, 18 nt, Mycobacterium bovis subsp bovis AF2122/97
gcguggugcugaccgcgc

SEQ ID NO: 3161691 - RNA, 19 nt, Mycobacterium bovis subsp bovis AF2122/97
gcguggugcugaccgcgcc

SEQ ID NO: 3161692 - RNA, 15 nt, Mycobacterium bovis subsp bovis AF2122/97
gcguggugggcggga

SEQ ID NO: 3161693 - RNA, 14 nt, Mycobacterium bovis subsp bovis AF2122/97
gcgugguucggucg

SEQ ID NO: 3161694 - RNA, 19 nt, Mycobacterium bovis subsp bovis AF2122/97
gcguguaaccccaggcgcu

SEQ ID NO: 3161695 - RNA, 22 nt, Mycobacterium bovis subsp bovis AF2122/97
gcguguaaccccaggcgcugcc

SEQ ID NO: 3161696 - RNA, 23 nt, Mycobacterium bovis subsp bovis AF2122/97
gcguguaaccccaggcgcugccg

SEQ ID NO: 3161697 - RNA, 19 nt, Mycobacterium bovis subsp bovis AF2122/97
gcguguagccugcggcggu

SEQ ID NO: 3161698 - RNA, 16 nt, Mycobacterium bovis subsp bovis AF2122/97
gcguguccgccgaacu

SEQ ID NO: 3161699 - RNA, 19 nt, Mycobacterium bovis subsp bovis AF2122/97
gcguguccuuugccaccuc

SEQ ID NO: 3161700 - RNA, 22 nt, Mycobacterium bovis subsp bovis AF2122/97
gcguguccuuugccaccucggc

SEQ ID NO: 3161701 - RNA, 14 nt, Mycobacterium bovis subsp bovis AF2122/97
gcgugucgacuccg

SEQ ID NO: 3161702 - RNA, 14 nt, Mycobacterium bovis subsp bovis AF2122/97
gcgugucgaugcgg

SEQ ID NO: 3161703 - RNA, 18 nt, Mycobacterium bovis subsp bovis AF2122/97
gcgugucgaugcgggcug

SEQ ID NO: 3161704 - RNA, 13 nt, Mycobacterium bovis subsp bovis AF2122/97
gcgugucgccgau

SEQ ID NO: 3161705 - RNA, 12 nt, Mycobacterium bovis subsp bovis AF2122/97
gcgugucgccgc

SEQ ID NO: 3161706 - RNA, 17 nt, Mycobacterium bovis subsp bovis AF2122/97
gcgugucgccgccacca

SEQ ID NO: 3161707 - RNA, 18 nt, Mycobacterium bovis subsp bovis AF2122/97
gcgugucgccgccaccag

SEQ ID NO: 3161708 - RNA, 13 nt, Mycobacterium bovis subsp bovis AF2122/97
gcgugucgcgucg

SEQ ID NO: 3161709 - RNA, 17 nt, Mycobacterium bovis subsp bovis AF2122/97
gcgugucgcgucgugcg

SEQ ID NO: 3161710 - RNA, 20 nt, Mycobacterium bovis subsp bovis AF2122/97
gcgugucgggaacgaguacg

SEQ ID NO: 3161711 - RNA, 13 nt, Mycobacterium bovis subsp bovis AF2122/97
gcgugucgucgcg

SEQ ID NO: 3161712 - RNA, 23 nt, Mycobacterium bovis subsp bovis AF2122/97
gcgugucguugccagggcgggcg

SEQ ID NO: 3161713 - RNA, 16 nt, Mycobacterium bovis subsp bovis AF2122/97
gcgugucugcccgagg

SEQ ID NO: 3161714 - RNA, 18 nt, Mycobacterium bovis subsp bovis AF2122/97
gcgugucugggaccccgc

SEQ ID NO: 3161715 - RNA, 23 nt, Mycobacterium bovis subsp bovis AF2122/97
gcgugucugggaccccgcugcga

SEQ ID NO: 3161716 - RNA, 21 nt, Mycobacterium bovis subsp bovis AF2122/97
gcgugucuguacaacgacacg

SEQ ID NO: 3161717 - RNA, 17 nt, Mycobacterium bovis subsp bovis AF2122/97
gcgugucuugucgcgca

SEQ ID NO: 3161718 - RNA, 12 nt, Mycobacterium bovis subsp bovis AF2122/97
gcgugugcucgu

SEQ ID NO: 3161719 - RNA, 15 nt, Mycobacterium bovis subsp bovis AF2122/97
gcguguggagcucgc

SEQ ID NO: 3161720 - RNA, 17 nt, Mycobacterium bovis subsp bovis AF2122/97
gcguguggagcucgcgg

SEQ ID NO: 3161721 - RNA, 20 nt, Mycobacterium bovis subsp bovis AF2122/97
gcguguggagcucgcggcgc

SEQ ID NO: 3161722 - RNA, 12 nt, Mycobacterium bovis subsp bovis AF2122/97
gcguguggcgca

SEQ ID NO: 3161723 - RNA, 22 nt, Mycobacterium bovis subsp bovis AF2122/97
gcguguggcuuugacugcuggg

SEQ ID NO: 3161724 - RNA, 16 nt, Mycobacterium bovis subsp bovis AF2122/97
gcguguugcguucggu

SEQ ID NO: 3161725 - RNA, 20 nt, Mycobacterium bovis subsp bovis AF2122/97
gcguuaaugcuucgcgucga

SEQ ID NO: 3161726 - RNA, 23 nt, Mycobacterium bovis subsp bovis AF2122/97
gcguuaccaccgucaccgccggc

SEQ ID NO: 3161727 - RNA, 19 nt, Mycobacterium bovis subsp bovis AF2122/97
gcguuacccaucgccacac

SEQ ID NO: 3161728 - RNA, 20 nt, Mycobacterium bovis subsp bovis AF2122/97
gcguuacccaucgccacacc

SEQ ID NO: 3161729 - RNA, 21 nt, Mycobacterium bovis subsp bovis AF2122/97
gcguuacccaucgccacaccc

SEQ ID NO: 3161730 - RNA, 14 nt, Mycobacterium bovis subsp bovis AF2122/97
gcguuacgccgcga

SEQ ID NO: 3161731 - RNA, 14 nt, Mycobacterium bovis subsp bovis AF2122/97
gcguuacgcucggc

SEQ ID NO: 3161732 - RNA, 14 nt, Mycobacterium bovis subsp bovis AF2122/97
gcguuaucgucggc

SEQ ID NO: 3161733 - RNA, 19 nt, Mycobacterium bovis subsp bovis AF2122/97
gcguucaacaccgccgacc

SEQ ID NO: 3161734 - RNA, 23 nt, Mycobacterium bovis subsp bovis AF2122/97
gcguucaacaccgccgaccuagu

SEQ ID NO: 3161735 - RNA, 21 nt, Mycobacterium bovis subsp bovis AF2122/97
gcguucaccacgaucgcgagc

SEQ ID NO: 3161736 - RNA, 19 nt, Mycobacterium bovis subsp bovis AF2122/97
gcguucagcggccagcagu

SEQ ID NO: 3161737 - RNA, 19 nt, Mycobacterium bovis subsp bovis AF2122/97
gcguucaggaugccaggac

SEQ ID NO: 3161738 - RNA, 22 nt, Mycobacterium bovis subsp bovis AF2122/97
gcguucagguguugacgccaac

SEQ ID NO: 3161739 - RNA, 23 nt, Mycobacterium bovis subsp bovis AF2122/97
gcguucagugauucggccugagc

SEQ ID NO: 3161740 - RNA, 16 nt, Mycobacterium bovis subsp bovis AF2122/97
gcguuccacacagauc

SEQ ID NO: 3161741 - RNA, 17 nt, Mycobacterium bovis subsp bovis AF2122/97
gcguuccaguccccgcc

SEQ ID NO: 3161742 - RNA, 14 nt, Mycobacterium bovis subsp bovis AF2122/97
gcguuccaucgccg

SEQ ID NO: 3161743 - RNA, 16 nt, Mycobacterium bovis subsp bovis AF2122/97
gcguuccaucgccgac

SEQ ID NO: 3161744 - RNA, 17 nt, Mycobacterium bovis subsp bovis AF2122/97
gcguuccaucgccgacg

SEQ ID NO: 3161745 - RNA, 19 nt, Mycobacterium bovis subsp bovis AF2122/97
gcguuccaucgccgacgcc

SEQ ID NO: 3161746 - RNA, 16 nt, Mycobacterium bovis subsp bovis AF2122/97
gcguuguugaccagca

SEQ ID NO: 3161747 - RNA, 18 nt, Mycobacterium bovis subsp bovis AF2122/97
gcguuguugaccagcacg

SEQ ID NO: 3161748 - RNA, 16 nt, Mycobacterium bovis subsp bovis AF2122/97
gcguuguugggcgagg

SEQ ID NO: 3161749 - RNA, 23 nt, Mycobacterium bovis subsp bovis AF2122/97
gcguuguugucgcauuucgacga

SEQ ID NO: 3161750 - RNA, 21 nt, Mycobacterium bovis subsp bovis AF2122/97
gcguuuagucuccggcgucgg

SEQ ID NO: 3161751 - RNA, 19 nt, Mycobacterium bovis subsp bovis AF2122/97
gcguuuauaccucgccgcc

SEQ ID NO: 3161752 - RNA, 21 nt, Mycobacterium bovis subsp bovis AF2122/97
gcguuuaucagcaagagccgc

SEQ ID NO: 3161753 - RNA, 21 nt, Mycobacterium bovis subsp bovis AF2122/97
gcguuucgaaccgcacgguga

SEQ ID NO: 3161754 - RNA, 22 nt, Mycobacterium bovis subsp bovis AF2122/97
gcguuugagaacaacgggaucc

SEQ ID NO: 3161755 - RNA, 14 nt, Mycobacterium bovis subsp bovis AF2122/97
gcguuugccggccg

SEQ ID NO: 3161756 - RNA, 14 nt, Mycobacterium bovis subsp bovis AF2122/97
gcguuugcuggcgg

SEQ ID NO: 3161757 - RNA, 21 nt, Mycobacterium bovis subsp bovis AF2122/97
gcuaacagauuguccggccgg

SEQ ID NO: 3161758 - RNA, 20 nt, Mycobacterium bovis subsp bovis AF2122/97
gcuaaccacggugugcuacc

SEQ ID NO: 3161759 - RNA, 14 nt, Mycobacterium bovis subsp bovis AF2122/97
gcuaaccuuggcga

SEQ ID NO: 3161760 - RNA, 20 nt, Mycobacterium bovis subsp bovis AF2122/97
gcuaacgaagccagaucagc

SEQ ID NO: 3161761 - RNA, 19 nt, Mycobacterium bovis subsp bovis AF2122/97
gcuaacgcaccugcgcgcg

SEQ ID NO: 3161762 - RNA, 21 nt, Mycobacterium bovis subsp bovis AF2122/97
gcuaacgcaccugcgcgcggc

SEQ ID NO: 3161763 - RNA, 17 nt, Mycobacterium bovis subsp bovis AF2122/97
gcuaacuccccagacau

SEQ ID NO: 3161764 - RNA, 20 nt, Mycobacterium bovis subsp bovis AF2122/97
gcuaacuccccagacaucca

SEQ ID NO: 3161765 - RNA, 14 nt, Mycobacterium bovis subsp bovis AF2122/97
gcuaacuggcccgg

SEQ ID NO: 3161766 - RNA, 21 nt, Mycobacterium bovis subsp bovis AF2122/97
gcuaagccuucggugucgccg

SEQ ID NO: 3161767 - RNA, 23 nt, Mycobacterium bovis subsp bovis AF2122/97
gcuaaguccccgcuuggcgagcc

SEQ ID NO: 3161768 - RNA, 16 nt, Mycobacterium bovis subsp bovis AF2122/97
gcuaauagcucgccgg

SEQ ID NO: 3161769 - RNA, 18 nt, Mycobacterium bovis subsp bovis AF2122/97
gcuaauagcucgccggcg

SEQ ID NO: 3161770 - RNA, 20 nt, Mycobacterium bovis subsp bovis AF2122/97
gcuaauggauccagcccgac

SEQ ID NO: 3161771 - RNA, 13 nt, Mycobacterium bovis subsp bovis AF2122/97
gcuaauugcggcc

SEQ ID NO: 3161772 - RNA, 18 nt, Mycobacterium bovis subsp bovis AF2122/97
gcuaauugcggccgccgg

SEQ ID NO: 3161773 - RNA, 19 nt, Mycobacterium bovis subsp bovis AF2122/97
gcuaauugcggccgccggg

SEQ ID NO: 3161774 - RNA, 17 nt, Mycobacterium bovis subsp bovis AF2122/97
gcuacagcuugcguagc

SEQ ID NO: 3161775 - RNA, 14 nt, Mycobacterium bovis subsp bovis AF2122/97
gcuacaucggcggc

SEQ ID NO: 3161776 - RNA, 15 nt, Mycobacterium bovis subsp bovis AF2122/97
gcuacaucggcggcg

SEQ ID NO: 3161777 - RNA, 18 nt, Mycobacterium bovis subsp bovis AF2122/97
gcuaccaccgcaccugcg

SEQ ID NO: 3161778 - RNA, 23 nt, Mycobacterium bovis subsp bovis AF2122/97
gcuaccagccauagugcggcagc

SEQ ID NO: 3161779 - RNA, 13 nt, Mycobacterium bovis subsp bovis AF2122/97
gcuacccauggcc

SEQ ID NO: 3161780 - RNA, 16 nt, Mycobacterium bovis subsp bovis AF2122/97
gcuaccccagccggca

SEQ ID NO: 3161781 - RNA, 17 nt, Mycobacterium bovis subsp bovis AF2122/97
gcuaccccagccggcag

SEQ ID NO: 3161782 - RNA, 22 nt, Mycobacterium bovis subsp bovis AF2122/97
gcuaccccagccggcagcagcg

SEQ ID NO: 3161783 - RNA, 16 nt, Mycobacterium bovis subsp bovis AF2122/97
gcuacccccgauggcg

SEQ ID NO: 3161784 - RNA, 19 nt, Mycobacterium bovis subsp bovis AF2122/97
gcuacccccgauggcgucg

SEQ ID NO: 3161785 - RNA, 21 nt, Mycobacterium bovis subsp bovis AF2122/97
gcuacccccgauggcgucgcc

SEQ ID NO: 3161786 - RNA, 22 nt, Mycobacterium bovis subsp bovis AF2122/97
gcuacccccgauggcgucgccg

SEQ ID NO: 3161787 - RNA, 18 nt, Mycobacterium bovis subsp bovis AF2122/97
gcuaccccgacggcgacc

SEQ ID NO: 3161788 - RNA, 13 nt, Mycobacterium bovis subsp bovis AF2122/97
gcuaccccgcaga

SEQ ID NO: 3161789 - RNA, 17 nt, Mycobacterium bovis subsp bovis AF2122/97
gcuaccccggcggucag

SEQ ID NO: 3161790 - RNA, 13 nt, Mycobacterium bovis subsp bovis AF2122/97
gcuacccgagccg

SEQ ID NO: 3161791 - RNA, 16 nt, Mycobacterium bovis subsp bovis AF2122/97
gcuacccgagccggca

SEQ ID NO: 3161792 - RNA, 18 nt, Mycobacterium bovis subsp bovis AF2122/97
gcuacccggacagggcgg

SEQ ID NO: 3161793 - RNA, 20 nt, Mycobacterium bovis subsp bovis AF2122/97
gcuacccggacagggcggcg

SEQ ID NO: 3161794 - RNA, 21 nt, Mycobacterium bovis subsp bovis AF2122/97
gcuacccggacagggcggcga

SEQ ID NO: 3161795 - RNA, 17 nt, Mycobacterium bovis subsp bovis AF2122/97
gcuacccgggccaggcu

SEQ ID NO: 3161796 - RNA, 21 nt, Mycobacterium bovis subsp bovis AF2122/97
gcuaccgaacaguaggccucc

SEQ ID NO: 3161797 - RNA, 22 nt, Mycobacterium bovis subsp bovis AF2122/97
gcuaccgaacaguaggccuccg

SEQ ID NO: 3161798 - RNA, 23 nt, Mycobacterium bovis subsp bovis AF2122/97
gcuaccgaacaguaggccuccgc

SEQ ID NO: 3161799 - RNA, 13 nt, Mycobacterium bovis subsp bovis AF2122/97
gcuaccgaucgcc

SEQ ID NO: 3161800 - RNA, 15 nt, Mycobacterium bovis subsp bovis AF2122/97
gcuaccgcaggugcc

SEQ ID NO: 3161801 - RNA, 12 nt, Mycobacterium bovis subsp bovis AF2122/97
gcuaccgcccgc

SEQ ID NO: 3161802 - RNA, 13 nt, Mycobacterium bovis subsp bovis AF2122/97
gcuaccgcccgcg

SEQ ID NO: 3161803 - RNA, 14 nt, Mycobacterium bovis subsp bovis AF2122/97
gcuaccgcccgcgc

SEQ ID NO: 3161804 - RNA, 19 nt, Mycobacterium bovis subsp bovis AF2122/97
gcuaccgcccgcgccaccg

SEQ ID NO: 3161805 - RNA, 22 nt, Mycobacterium bovis subsp bovis AF2122/97
gcuaccgcccgcgccaccggca

SEQ ID NO: 3161806 - RNA, 13 nt, Mycobacterium bovis subsp bovis AF2122/97
gcuaccgccgacc

SEQ ID NO: 3161807 - RNA, 12 nt, Mycobacterium bovis subsp bovis AF2122/97
gcuaccgccggg

SEQ ID NO: 3161808 - RNA, 21 nt, Mycobacterium bovis subsp bovis AF2122/97
gcuaccgccuugucggcgaug

SEQ ID NO: 3161809 - RNA, 18 nt, Mycobacterium bovis subsp bovis AF2122/97
gcuaccgcgcucccggcg

SEQ ID NO: 3161810 - RNA, 11 nt, Mycobacterium bovis subsp bovis AF2122/97
gcuaccggcgc

SEQ ID NO: 3161811 - RNA, 16 nt, Mycobacterium bovis subsp bovis AF2122/97
gcuaccggcgccgcgc

SEQ ID NO: 3161812 - RNA, 18 nt, Mycobacterium bovis subsp bovis AF2122/97
gcuaccuaacccgcgccg

SEQ ID NO: 3161813 - RNA, 13 nt, Mycobacterium bovis subsp bovis AF2122/97
gcuaccuccgcca

SEQ ID NO: 3161814 - RNA, 15 nt, Mycobacterium bovis subsp bovis AF2122/97
gcuaccuccgccacc

SEQ ID NO: 3161815 - RNA, 21 nt, Mycobacterium bovis subsp bovis AF2122/97
gcuaccuuggacucggcggga

SEQ ID NO: 3161816 - RNA, 17 nt, Mycobacterium bovis subsp bovis AF2122/97
gcuaccuuguccggccc

SEQ ID NO: 3161817 - RNA, 22 nt, Mycobacterium bovis subsp bovis AF2122/97
gcuacgccccacugccgugccg

SEQ ID NO: 3161818 - RNA, 20 nt, Mycobacterium bovis subsp bovis AF2122/97
gcuacgccggcccgaggcgg

SEQ ID NO: 3161819 - RNA, 14 nt, Mycobacterium bovis subsp bovis AF2122/97
gcuacgcgaucagc

SEQ ID NO: 3161820 - RNA, 20 nt, Mycobacterium bovis subsp bovis AF2122/97
gcuacgcgaucagcugggca

SEQ ID NO: 3161821 - RNA, 13 nt, Mycobacterium bovis subsp bovis AF2122/97
gcuacgcgcgccc

SEQ ID NO: 3161822 - RNA, 13 nt, Mycobacterium bovis subsp bovis AF2122/97
gcuacgcgcgcuc

SEQ ID NO: 3161823 - RNA, 14 nt, Mycobacterium bovis subsp bovis AF2122/97
gcuacgcgcgcucg

SEQ ID NO: 3161824 - RNA, 16 nt, Mycobacterium bovis subsp bovis AF2122/97
gcuacgcgcgcucgcu

SEQ ID NO: 3161825 - RNA, 17 nt, Mycobacterium bovis subsp bovis AF2122/97
gcuacgcggccgagguc

SEQ ID NO: 3161826 - RNA, 18 nt, Mycobacterium bovis subsp bovis AF2122/97
gcuacgcggccgagguca

SEQ ID NO: 3161827 - RNA, 23 nt, Mycobacterium bovis subsp bovis AF2122/97
gcuacggccagugccaucgccau

SEQ ID NO: 3161828 - RNA, 20 nt, Mycobacterium bovis subsp bovis AF2122/97
gcuacggcgacacgccagcc

SEQ ID NO: 3161829 - RNA, 12 nt, Mycobacterium bovis subsp bovis AF2122/97
gcuacggcgucc

SEQ ID NO: 3161830 - RNA, 18 nt, Mycobacterium bovis subsp bovis AF2122/97
gcuacgggccgcgguacc

SEQ ID NO: 3161831 - RNA, 15 nt, Mycobacterium bovis subsp bovis AF2122/97
gcuacggggcggucg

SEQ ID NO: 3161832 - RNA, 22 nt, Mycobacterium bovis subsp bovis AF2122/97
gcucaagucucccggccgcacc

SEQ ID NO: 3161833 - RNA, 19 nt, Mycobacterium bovis subsp bovis AF2122/97
gcucaaugaucgcggcggc

SEQ ID NO: 3161834 - RNA, 21 nt, Mycobacterium bovis subsp bovis AF2122/97
gcucaaugcggucaacgacag

SEQ ID NO: 3161835 - RNA, 15 nt, Mycobacterium bovis subsp bovis AF2122/97
gcucacaagccgugc

SEQ ID NO: 3161836 - RNA, 13 nt, Mycobacterium bovis subsp bovis AF2122/97
gcucacaauggcu

SEQ ID NO: 3161837 - RNA, 19 nt, Mycobacterium bovis subsp bovis AF2122/97
gcucacacucggccgggcu

SEQ ID NO: 3161838 - RNA, 16 nt, Mycobacterium bovis subsp bovis AF2122/97
gcucacagcacagcgc

SEQ ID NO: 3161839 - RNA, 18 nt, Mycobacterium bovis subsp bovis AF2122/97
gcucacagcacagcgcag

SEQ ID NO: 3161840 - RNA, 19 nt, Mycobacterium bovis subsp bovis AF2122/97
gcucacagcacagcgcagc

SEQ ID NO: 3161841 - RNA, 20 nt, Mycobacterium bovis subsp bovis AF2122/97
gcucacauacagcaggccgc

SEQ ID NO: 3161842 - RNA, 17 nt, Mycobacterium bovis subsp bovis AF2122/97
gcucacaugcccgcacc

SEQ ID NO: 3161843 - RNA, 21 nt, Mycobacterium bovis subsp bovis AF2122/97
gcucacauucaacagauccga

SEQ ID NO: 3161844 - RNA, 22 nt, Mycobacterium bovis subsp bovis AF2122/97
gcucacauucaacagauccgac

SEQ ID NO: 3161845 - RNA, 18 nt, Mycobacterium bovis subsp bovis AF2122/97
gcucaccaaggucggcga

SEQ ID NO: 3161846 - RNA, 20 nt, Mycobacterium bovis subsp bovis AF2122/97
gcucaccaaggucggcgauc

SEQ ID NO: 3161847 - RNA, 12 nt, Mycobacterium bovis subsp bovis AF2122/97
gcucaccacauc

SEQ ID NO: 3161848 - RNA, 13 nt, Mycobacterium bovis subsp bovis AF2122/97
gcucaccaccgac

SEQ ID NO: 3161849 - RNA, 21 nt, Mycobacterium bovis subsp bovis AF2122/97
gcucaccaccgaccucgacgc

SEQ ID NO: 3161850 - RNA, 12 nt, Mycobacterium bovis subsp bovis AF2122/97
gcucaccagcuc

SEQ ID NO: 3161851 - RNA, 13 nt, Mycobacterium bovis subsp bovis AF2122/97
gcucaccagcucc

SEQ ID NO: 3161852 - RNA, 15 nt, Mycobacterium bovis subsp bovis AF2122/97
gcucaccagcuccuc

SEQ ID NO: 3161853 - RNA, 15 nt, Mycobacterium bovis subsp bovis AF2122/97
gcucaccaggcgagc

SEQ ID NO: 3161854 - RNA, 20 nt, Mycobacterium bovis subsp bovis AF2122/97
gcucaccaggcgagccggcg

SEQ ID NO: 3161855 - RNA, 23 nt, Mycobacterium bovis subsp bovis AF2122/97
gcucaccaggcgagccggcgcgc

SEQ ID NO: 3161856 - RNA, 16 nt, Mycobacterium bovis subsp bovis AF2122/97
gcucaccaucucgcaa

SEQ ID NO: 3161857 - RNA, 17 nt, Mycobacterium bovis subsp bovis AF2122/97
gcucacccggagcaccc

SEQ ID NO: 3161858 - RNA, 13 nt, Mycobacterium bovis subsp bovis AF2122/97
gcucacccggcgu

SEQ ID NO: 3161859 - RNA, 18 nt, Mycobacterium bovis subsp bovis AF2122/97
gcucacccgucgucaagu

SEQ ID NO: 3161860 - RNA, 15 nt, Mycobacterium bovis subsp bovis AF2122/97
gcucacccugcucga

SEQ ID NO: 3161861 - RNA, 18 nt, Mycobacterium bovis subsp bovis AF2122/97
gcucaccgaaacgaugcg

SEQ ID NO: 3161862 - RNA, 17 nt, Mycobacterium bovis subsp bovis AF2122/97
gcucaccgacaugacgc

SEQ ID NO: 3161863 - RNA, 18 nt, Mycobacterium bovis subsp bovis AF2122/97
gcucaccgacgcugacca

SEQ ID NO: 3161864 - RNA, 13 nt, Mycobacterium bovis subsp bovis AF2122/97
gcucaccgagccg

SEQ ID NO: 3161865 - RNA, 19 nt, Mycobacterium bovis subsp bovis AF2122/97
gcucaccgaucccgcggcc

SEQ ID NO: 3161866 - RNA, 18 nt, Mycobacterium bovis subsp bovis AF2122/97
gcucaccgcacaccugcg

SEQ ID NO: 3161867 - RNA, 17 nt, Mycobacterium bovis subsp bovis AF2122/97
gcucaccgcgcaucauc

SEQ ID NO: 3161868 - RNA, 20 nt, Mycobacterium bovis subsp bovis AF2122/97
gcucaccgcgcaucaucgcc

SEQ ID NO: 3161869 - RNA, 14 nt, Mycobacterium bovis subsp bovis AF2122/97
gcucaccggcgucg

SEQ ID NO: 3161870 - RNA, 15 nt, Mycobacterium bovis subsp bovis AF2122/97
gcucaccggcuggug

SEQ ID NO: 3161871 - RNA, 18 nt, Mycobacterium bovis subsp bovis AF2122/97
gcucaccggcuggugcca

SEQ ID NO: 3161872 - RNA, 20 nt, Mycobacterium bovis subsp bovis AF2122/97
gcucaccggcuggugccaac

SEQ ID NO: 3161873 - RNA, 13 nt, Mycobacterium bovis subsp bovis AF2122/97
gcucaccggggcc

SEQ ID NO: 3161874 - RNA, 22 nt, Mycobacterium bovis subsp bovis AF2122/97
gcucaccggggccgucggcaau

SEQ ID NO: 3161875 - RNA, 14 nt, Mycobacterium bovis subsp bovis AF2122/97
gcucaccggggucg

SEQ ID NO: 3161876 - RNA, 21 nt, Mycobacterium bovis subsp bovis AF2122/97
gcucaccuuuggccgcgaccg

SEQ ID NO: 3161877 - RNA, 19 nt, Mycobacterium bovis subsp bovis AF2122/97
gcucacgaccggccaacgc

SEQ ID NO: 3161878 - RNA, 15 nt, Mycobacterium bovis subsp bovis AF2122/97
gcucacgaucacccg

SEQ ID NO: 3161879 - RNA, 17 nt, Mycobacterium bovis subsp bovis AF2122/97
gcucacgaucugcgcgu

SEQ ID NO: 3161880 - RNA, 22 nt, Mycobacterium bovis subsp bovis AF2122/97
gcucacgccggguguggcuuga

SEQ ID NO: 3161881 - RNA, 15 nt, Mycobacterium bovis subsp bovis AF2122/97
gcucacgcuccgccg

SEQ ID NO: 3161882 - RNA, 16 nt, Mycobacterium bovis subsp bovis AF2122/97
gcucacggacgcuggg

SEQ ID NO: 3161883 - RNA, 18 nt, Mycobacterium bovis subsp bovis AF2122/97
gcucacggacgcugggcg

SEQ ID NO: 3161884 - RNA, 23 nt, Mycobacterium bovis subsp bovis AF2122/97
gcucacggacgcugggcgguagc

SEQ ID NO: 3161885 - RNA, 18 nt, Mycobacterium bovis subsp bovis AF2122/97
gcucacggcggaagaagu

SEQ ID NO: 3161886 - RNA, 12 nt, Mycobacterium bovis subsp bovis AF2122/97
gcucacggcggc

SEQ ID NO: 3161887 - RNA, 13 nt, Mycobacterium bovis subsp bovis AF2122/97
gcucacggcggcg

SEQ ID NO: 3161888 - RNA, 17 nt, Mycobacterium bovis subsp bovis AF2122/97
gcucacggcggcgaacu

SEQ ID NO: 3161889 - RNA, 20 nt, Mycobacterium bovis subsp bovis AF2122/97
gcucacgguggccgcaucga

SEQ ID NO: 3161890 - RNA, 18 nt, Mycobacterium bovis subsp bovis AF2122/97
gcucacguaaccagugac

SEQ ID NO: 3161891 - RNA, 19 nt, Mycobacterium bovis subsp bovis AF2122/97
gcucacguaaccagugacc

SEQ ID NO: 3161892 - RNA, 13 nt, Mycobacterium bovis subsp bovis AF2122/97
gcucacuacccgc

SEQ ID NO: 3161893 - RNA, 19 nt, Mycobacterium bovis subsp bovis AF2122/97
gcucacuacccgcaacgag

SEQ ID NO: 3161894 - RNA, 20 nt, Mycobacterium bovis subsp bovis AF2122/97
gcucacuggcgauaucggcc

SEQ ID NO: 3161895 - RNA, 14 nt, Mycobacterium bovis subsp bovis AF2122/97
gcucacuggugacc

SEQ ID NO: 3161896 - RNA, 21 nt, Mycobacterium bovis subsp bovis AF2122/97
gcucacuggugacccugauga

SEQ ID NO: 3161897 - RNA, 17 nt, Mycobacterium bovis subsp bovis AF2122/97
gcucacuucacgccgcc

SEQ ID NO: 3161898 - RNA, 21 nt, Mycobacterium bovis subsp bovis AF2122/97
gcucagcaacgucacgucgac

SEQ ID NO: 3161899 - RNA, 19 nt, Mycobacterium bovis subsp bovis AF2122/97
gcucagccguccgggcggc

SEQ ID NO: 3161900 - RNA, 22 nt, Mycobacterium bovis subsp bovis AF2122/97
gcucagccguccgggcggccuc

SEQ ID NO: 3161901 - RNA, 14 nt, Mycobacterium bovis subsp bovis AF2122/97
gcucagccguucgc

SEQ ID NO: 3161902 - RNA, 17 nt, Mycobacterium bovis subsp bovis AF2122/97
gcucagcgaugcggccc

SEQ ID NO: 3161903 - RNA, 21 nt, Mycobacterium bovis subsp bovis AF2122/97
gcucagcgaugcggcccucga

SEQ ID NO: 3161904 - RNA, 14 nt, Mycobacterium bovis subsp bovis AF2122/97
gcucagcgcgcgcc

SEQ ID NO: 3161905 - RNA, 15 nt, Mycobacterium bovis subsp bovis AF2122/97
gcucagcgcgcgccg

SEQ ID NO: 3161906 - RNA, 23 nt, Mycobacterium bovis subsp bovis AF2122/97
gcucagcgcgcgccgcuggguga

SEQ ID NO: 3161907 - RNA, 16 nt, Mycobacterium bovis subsp bovis AF2122/97
gcucagcgcggccacg

SEQ ID NO: 3161908 - RNA, 20 nt, Mycobacterium bovis subsp bovis AF2122/97
gcucagcgcggccacgccga

SEQ ID NO: 3161909 - RNA, 14 nt, Mycobacterium bovis subsp bovis AF2122/97
gcucagcgcggccc

SEQ ID NO: 3161910 - RNA, 14 nt, Mycobacterium bovis subsp bovis AF2122/97
gcucagcggcgacc

SEQ ID NO: 3161911 - RNA, 21 nt, Mycobacterium bovis subsp bovis AF2122/97
gcucagcggcgaccgcauccg

SEQ ID NO: 3161912 - RNA, 22 nt, Mycobacterium bovis subsp bovis AF2122/97
gcucagcuaaaaaccgcugccg

SEQ ID NO: 3161913 - RNA, 15 nt, Mycobacterium bovis subsp bovis AF2122/97
gcucagcuggucggc

SEQ ID NO: 3161914 - RNA, 17 nt, Mycobacterium bovis subsp bovis AF2122/97
gcucagcuggucggcuu

SEQ ID NO: 3161915 - RNA, 23 nt, Mycobacterium bovis subsp bovis AF2122/97
gcucagcuucuuaccgcgggccg

SEQ ID NO: 3161916 - RNA, 22 nt, Mycobacterium bovis subsp bovis AF2122/97
gcucaggaacaaugagaucggg

SEQ ID NO: 3161917 - RNA, 19 nt, Mycobacterium bovis subsp bovis AF2122/97
gcucaggacgaacgcuggc

SEQ ID NO: 3161918 - RNA, 16 nt, Mycobacterium bovis subsp bovis AF2122/97
gcuccgauuccgaacu

SEQ ID NO: 3161919 - RNA, 23 nt, Mycobacterium bovis subsp bovis AF2122/97
gcuccgauuccgaacuggucgac

SEQ ID NO: 3161920 - RNA, 24 nt, Mycobacterium bovis subsp bovis AF2122/97
gcuccgauuccgaacuggucgacg

SEQ ID NO: 3161921 - RNA, 21 nt, Mycobacterium bovis subsp bovis AF2122/97
gcuccgccagaauugccggcg

SEQ ID NO: 3161922 - RNA, 22 nt, Mycobacterium bovis subsp bovis AF2122/97
gcuccgccagaauugccggcga

SEQ ID NO: 3161923 - RNA, 12 nt, Mycobacterium bovis subsp bovis AF2122/97
gcuccgccgccg

SEQ ID NO: 3161924 - RNA, 13 nt, Mycobacterium bovis subsp bovis AF2122/97
gcuccgccgcggg

SEQ ID NO: 3161925 - RNA, 22 nt, Mycobacterium bovis subsp bovis AF2122/97
gcuccgccggguuggcgccggc

SEQ ID NO: 3161926 - RNA, 23 nt, Mycobacterium bovis subsp bovis AF2122/97
gcuccgccggguuggcgccggcc

SEQ ID NO: 3161927 - RNA, 18 nt, Mycobacterium bovis subsp bovis AF2122/97
gcuccgccgucgccgccg

SEQ ID NO: 3161928 - RNA, 21 nt, Mycobacterium bovis subsp bovis AF2122/97
gcuccgccgucgccgccggcg

SEQ ID NO: 3161929 - RNA, 22 nt, Mycobacterium bovis subsp bovis AF2122/97
gcuccgccgucgccgccggcgc

SEQ ID NO: 3161930 - RNA, 15 nt, Mycobacterium bovis subsp bovis AF2122/97
gcuccgccguugccg

SEQ ID NO: 3161931 - RNA, 19 nt, Mycobacterium bovis subsp bovis AF2122/97
gcuccgccguugccgccgc

SEQ ID NO: 3161932 - RNA, 19 nt, Mycobacterium bovis subsp bovis AF2122/97
gcuccgccugccgcugguc

SEQ ID NO: 3161933 - RNA, 19 nt, Mycobacterium bovis subsp bovis AF2122/97
gcuccgcgccgccccgcuc

SEQ ID NO: 3161934 - RNA, 15 nt, Mycobacterium bovis subsp bovis AF2122/97
gcuccgcggcgcagc

SEQ ID NO: 3161935 - RNA, 13 nt, Mycobacterium bovis subsp bovis AF2122/97
gcuccggccggcc

SEQ ID NO: 3161936 - RNA, 17 nt, Mycobacterium bovis subsp bovis AF2122/97
gcuccggcgcgacgccc

SEQ ID NO: 3161937 - RNA, 15 nt, Mycobacterium bovis subsp bovis AF2122/97
gcuccggcggcagcg

SEQ ID NO: 3161938 - RNA, 14 nt, Mycobacterium bovis subsp bovis AF2122/97
gcuccggcggugcc

SEQ ID NO: 3161939 - RNA, 14 nt, Mycobacterium bovis subsp bovis AF2122/97
gcuccggcucgaca

SEQ ID NO: 3161940 - RNA, 17 nt, Mycobacterium bovis subsp bovis AF2122/97
gcuccgggaauggcgac

SEQ ID NO: 3161941 - RNA, 18 nt, Mycobacterium bovis subsp bovis AF2122/97
gcuccgggaauggcgacc

SEQ ID NO: 3161942 - RNA, 15 nt, Mycobacterium bovis subsp bovis AF2122/97
gcuccgggcgcucgg

SEQ ID NO: 3161943 - RNA, 15 nt, Mycobacterium bovis subsp bovis AF2122/97
gcuccgggucgacga

SEQ ID NO: 3161944 - RNA, 22 nt, Mycobacterium bovis subsp bovis AF2122/97
gcuccgggucgacgacgucgcg

SEQ ID NO: 3161945 - RNA, 22 nt, Mycobacterium bovis subsp bovis AF2122/97
gcuccggucggguuucgucgcg

SEQ ID NO: 3161946 - RNA, 21 nt, Mycobacterium bovis subsp bovis AF2122/97
gcuccguaaacgaggucgccg

SEQ ID NO: 3161947 - RNA, 21 nt, Mycobacterium bovis subsp bovis AF2122/97
gcuccguggugcuagcgccgc

SEQ ID NO: 3161948 - RNA, 21 nt, Mycobacterium bovis subsp bovis AF2122/97
gcuccgugguugccgaagccg

SEQ ID NO: 3161949 - RNA, 23 nt, Mycobacterium bovis subsp bovis AF2122/97
gcuccguuguccagcgcgacguc

SEQ ID NO: 3161950 - RNA, 23 nt, Mycobacterium bovis subsp bovis AF2122/97
gcuccuaucacuggacucuucgg

SEQ ID NO: 3161951 - RNA, 20 nt, Mycobacterium bovis subsp bovis AF2122/97
gcuccuauggcaagcggccg

SEQ ID NO: 3161952 - RNA, 13 nt, Mycobacterium bovis subsp bovis AF2122/97
gcuccucagccac

SEQ ID NO: 3161953 - RNA, 20 nt, Mycobacterium bovis subsp bovis AF2122/97
gcuccucagccaccgcgguc

SEQ ID NO: 3161954 - RNA, 19 nt, Mycobacterium bovis subsp bovis AF2122/97
gcuccucauagagcggcac

SEQ ID NO: 3161955 - RNA, 20 nt, Mycobacterium bovis subsp bovis AF2122/97
gcuccucauagagcggcacc

SEQ ID NO: 3161956 - RNA, 20 nt, Mycobacterium bovis subsp bovis AF2122/97
gcuccuccccggcccgcuca

SEQ ID NO: 3161957 - RNA, 15 nt, Mycobacterium bovis subsp bovis AF2122/97
gcuccuccggcacca

SEQ ID NO: 3161958 - RNA, 18 nt, Mycobacterium bovis subsp bovis AF2122/97
gcuccuccggcaccaacg

SEQ ID NO: 3161959 - RNA, 18 nt, Mycobacterium bovis subsp bovis AF2122/97
gcuccuccgguaucggcg

SEQ ID NO: 3161960 - RNA, 15 nt, Mycobacterium bovis subsp bovis AF2122/97
gcuccucgcgagucg

SEQ ID NO: 3161961 - RNA, 18 nt, Mycobacterium bovis subsp bovis AF2122/97
gcuccucgcgagucggcg

SEQ ID NO: 3161962 - RNA, 19 nt, Mycobacterium bovis subsp bovis AF2122/97
gcuccucgcgagucggcgg

SEQ ID NO: 3161963 - RNA, 16 nt, Mycobacterium bovis subsp bovis AF2122/97
gcuccucgcgcucgcc

SEQ ID NO: 3161964 - RNA, 17 nt, Mycobacterium bovis subsp bovis AF2122/97
gcuccucgcgcucgccg

SEQ ID NO: 3161965 - RNA, 18 nt, Mycobacterium bovis subsp bovis AF2122/97
gcuccucgcgggcggcgu

SEQ ID NO: 3161966 - RNA, 15 nt, Mycobacterium bovis subsp bovis AF2122/97
gcuccucgcgguagu

SEQ ID NO: 3161967 - RNA, 14 nt, Mycobacterium bovis subsp bovis AF2122/97
gcuccucggccagc

SEQ ID NO: 3161968 - RNA, 17 nt, Mycobacterium bovis subsp bovis AF2122/97
gcuccucgugcucggcc

SEQ ID NO: 3161969 - RNA, 20 nt, Mycobacterium bovis subsp bovis AF2122/97
gcuccucgugcucggccaga

SEQ ID NO: 3161970 - RNA, 24 nt, Mycobacterium bovis subsp bovis AF2122/97
gcuccugcucgucgagccgaccgc

SEQ ID NO: 3161971 - RNA, 22 nt, Mycobacterium bovis subsp bovis AF2122/97
gcuccuggucgccgugggccug

SEQ ID NO: 3161972 - RNA, 17 nt, Mycobacterium bovis subsp bovis AF2122/97
gcuccuguaacugcucc

SEQ ID NO: 3161973 - RNA, 20 nt, Mycobacterium bovis subsp bovis AF2122/97
gcuccuguaacugcuccugg

SEQ ID NO: 3161974 - RNA, 18 nt, Mycobacterium bovis subsp bovis AF2122/97
gcuccuugaggucaccca

SEQ ID NO: 3161975 - RNA, 16 nt, Mycobacterium bovis subsp bovis AF2122/97
gcuccuuggcccagcg

SEQ ID NO: 3161976 - RNA, 19 nt, Mycobacterium bovis subsp bovis AF2122/97
gcuccuuggcccagcggua

SEQ ID NO: 3161977 - RNA, 20 nt, Mycobacterium bovis subsp bovis AF2122/97
gcuccuuggcccagcgguag

SEQ ID NO: 3161978 - RNA, 24 nt, Mycobacterium bovis subsp bovis AF2122/97
gcuccuuggcuaacaccgcaggca

SEQ ID NO: 3161979 - RNA, 16 nt, Mycobacterium bovis subsp bovis AF2122/97
gcucgaaacgcccuug

SEQ ID NO: 3161980 - RNA, 17 nt, Mycobacterium bovis subsp bovis AF2122/97
gcucgaaacgcccuugu

SEQ ID NO: 3161981 - RNA, 24 nt, Mycobacterium bovis subsp bovis AF2122/97
gcucgaaauccugguggcagacau

SEQ ID NO: 3161982 - RNA, 18 nt, Mycobacterium bovis subsp bovis AF2122/97
gcucgaaaucgcacagcg

SEQ ID NO: 3161983 - RNA, 21 nt, Mycobacterium bovis subsp bovis AF2122/97
gcucgaaaucgcacagcgcag

SEQ ID NO: 3161984 - RNA, 14 nt, Mycobacterium bovis subsp bovis AF2122/97
gcucgaacagcucg

SEQ ID NO: 3161985 - RNA, 23 nt, Mycobacterium bovis subsp bovis AF2122/97
gcucgaacuccccggucgccgcg

SEQ ID NO: 3161986 - RNA, 15 nt, Mycobacterium bovis subsp bovis AF2122/97
gcucgaaucgucacg

SEQ ID NO: 3161987 - RNA, 17 nt, Mycobacterium bovis subsp bovis AF2122/97
gcucgacaaccacggca

SEQ ID NO: 3161988 - RNA, 13 nt, Mycobacterium bovis subsp bovis AF2122/97
gcucgacaacugc

SEQ ID NO: 3161989 - RNA, 18 nt, Mycobacterium bovis subsp bovis AF2122/97
gcucgaccagacgcugcc

SEQ ID NO: 3161990 - RNA, 21 nt, Mycobacterium bovis subsp bovis AF2122/97
gcucgaccaggaacggcucgg

SEQ ID NO: 3161991 - RNA, 21 nt, Mycobacterium bovis subsp bovis AF2122/97
gcucgaccaugccgucgucgg

SEQ ID NO: 3161992 - RNA, 16 nt, Mycobacterium bovis subsp bovis AF2122/97
gcucgaccgcccggcu

SEQ ID NO: 3161993 - RNA, 14 nt, Mycobacterium bovis subsp bovis AF2122/97
gcucgaccugaggc

SEQ ID NO: 3161994 - RNA, 20 nt, Mycobacterium bovis subsp bovis AF2122/97
gcucgaccugaggcaccucg

SEQ ID NO: 3161995 - RNA, 23 nt, Mycobacterium bovis subsp bovis AF2122/97
gcucgaccugaggcaccucggcc

SEQ ID NO: 3161996 - RNA, 15 nt, Mycobacterium bovis subsp bovis AF2122/97
gcucgacgacgggcg

SEQ ID NO: 3161997 - RNA, 21 nt, Mycobacterium bovis subsp bovis AF2122/97
gcucgacgacgggcgccaacg

SEQ ID NO: 3161998 - RNA, 17 nt, Mycobacterium bovis subsp bovis AF2122/97
gcucgacgaucugcagc

SEQ ID NO: 3161999 - RNA, 20 nt, Mycobacterium bovis subsp bovis AF2122/97
gcucgacgaucugcagcacu

SEQ ID NO: 3162000 - RNA, 21 nt, Mycobacterium bovis subsp bovis AF2122/97
gcucgacgaugcggucaacgc

SEQ ID NO: 3162001 - RNA, 14 nt, Mycobacterium bovis subsp bovis AF2122/97
gcucgacgcccgcc

SEQ ID NO: 3162002 - RNA, 16 nt, Mycobacterium bovis subsp bovis AF2122/97
gcucgacgcccgccac

SEQ ID NO: 3162003 - RNA, 17 nt, Mycobacterium bovis subsp bovis AF2122/97
gcucgacgcccgccacc

SEQ ID NO: 3162004 - RNA, 16 nt, Mycobacterium bovis subsp bovis AF2122/97
gcucgccgacccgccg

SEQ ID NO: 3162005 - RNA, 17 nt, Mycobacterium bovis subsp bovis AF2122/97
gcucgccgacccgccgc

SEQ ID NO: 3162006 - RNA, 20 nt, Mycobacterium bovis subsp bovis AF2122/97
gcucgccgagcugugcgcag

SEQ ID NO: 3162007 - RNA, 15 nt, Mycobacterium bovis subsp bovis AF2122/97
gcucgccgaggaaau

SEQ ID NO: 3162008 - RNA, 18 nt, Mycobacterium bovis subsp bovis AF2122/97
gcucgccgauaucugcca

SEQ ID NO: 3162009 - RNA, 14 nt, Mycobacterium bovis subsp bovis AF2122/97
gcucgccgaugcug

SEQ ID NO: 3162010 - RNA, 23 nt, Mycobacterium bovis subsp bovis AF2122/97
gcucgccgccauuaggcgcggug

SEQ ID NO: 3162011 - RNA, 12 nt, Mycobacterium bovis subsp bovis AF2122/97
gcucgccggcac

SEQ ID NO: 3162012 - RNA, 13 nt, Mycobacterium bovis subsp bovis AF2122/97
gcucgccggcacc

SEQ ID NO: 3162013 - RNA, 14 nt, Mycobacterium bovis subsp bovis AF2122/97
gcucgccggcaccg

SEQ ID NO: 3162014 - RNA, 12 nt, Mycobacterium bovis subsp bovis AF2122/97
gcucgccggcca

SEQ ID NO: 3162015 - RNA, 14 nt, Mycobacterium bovis subsp bovis AF2122/97
gcucgccggcgaac

SEQ ID NO: 3162016 - RNA, 13 nt, Mycobacterium bovis subsp bovis AF2122/97
gcucgccggcgac

SEQ ID NO: 3162017 - RNA, 13 nt, Mycobacterium bovis subsp bovis AF2122/97
gcucgccggcgcg

SEQ ID NO: 3162018 - RNA, 17 nt, Mycobacterium bovis subsp bovis AF2122/97
gcucgccggcgcgcacc

SEQ ID NO: 3162019 - RNA, 20 nt, Mycobacterium bovis subsp bovis AF2122/97
gcucgccggcgcgcaccccg

SEQ ID NO: 3162020 - RNA, 12 nt, Mycobacterium bovis subsp bovis AF2122/97
gcucgccggcgg

SEQ ID NO: 3162021 - RNA, 23 nt, Mycobacterium bovis subsp bovis AF2122/97
gcucgccgggcuuaggccgcggc

SEQ ID NO: 3162022 - RNA, 13 nt, Mycobacterium bovis subsp bovis AF2122/97
gcucgccggguca

SEQ ID NO: 3162023 - RNA, 21 nt, Mycobacterium bovis subsp bovis AF2122/97
gcucgccgggucagcccggcg

SEQ ID NO: 3162024 - RNA, 14 nt, Mycobacterium bovis subsp bovis AF2122/97
gcucgccggugucc

SEQ ID NO: 3162025 - RNA, 21 nt, Mycobacterium bovis subsp bovis AF2122/97
gcucgccgguguccuuggccg

SEQ ID NO: 3162026 - RNA, 20 nt, Mycobacterium bovis subsp bovis AF2122/97
gcucgccguaagcaccagcc

SEQ ID NO: 3162027 - RNA, 20 nt, Mycobacterium bovis subsp bovis AF2122/97
gcucgccgucguacucgacc

SEQ ID NO: 3162028 - RNA, 14 nt, Mycobacterium bovis subsp bovis AF2122/97
gcucgccgugacca

SEQ ID NO: 3162029 - RNA, 16 nt, Mycobacterium bovis subsp bovis AF2122/97
gcucgccgugaccagg

SEQ ID NO: 3162030 - RNA, 21 nt, Mycobacterium bovis subsp bovis AF2122/97
gcucgccgugaccaggugcca

SEQ ID NO: 3162031 - RNA, 13 nt, Mycobacterium bovis subsp bovis AF2122/97
gcucgccguggug

SEQ ID NO: 3162032 - RNA, 15 nt, Mycobacterium bovis subsp bovis AF2122/97
gcucgccguggugga

SEQ ID NO: 3162033 - RNA, 23 nt, Mycobacterium bovis subsp bovis AF2122/97
gcucgccgugguggaugagccgg

SEQ ID NO: 3162034 - RNA, 20 nt, Mycobacterium bovis subsp bovis AF2122/97
gcucgccguugaugucggca

SEQ ID NO: 3162035 - RNA, 16 nt, Mycobacterium bovis subsp bovis AF2122/97
gcucgccucgauggcg

SEQ ID NO: 3162036 - RNA, 15 nt, Mycobacterium bovis subsp bovis AF2122/97
gcucgcgaaggggcg

SEQ ID NO: 3162037 - RNA, 14 nt, Mycobacterium bovis subsp bovis AF2122/97
gcucgcgaggcucg

SEQ ID NO: 3162038 - RNA, 21 nt, Mycobacterium bovis subsp bovis AF2122/97
gcucgcgaggcucgcguggcc

SEQ ID NO: 3162039 - RNA, 23 nt, Mycobacterium bovis subsp bovis AF2122/97
gcucgcgaggcucgcguggccgc

SEQ ID NO: 3162040 - RNA, 17 nt, Mycobacterium bovis subsp bovis AF2122/97
gcucgcgaucgcaguga

SEQ ID NO: 3162041 - RNA, 22 nt, Mycobacterium bovis subsp bovis AF2122/97
gcucgcgaucgcagugagcagc

SEQ ID NO: 3162042 - RNA, 14 nt, Mycobacterium bovis subsp bovis AF2122/97
gcucgcgcaaggcg

SEQ ID NO: 3162043 - RNA, 16 nt, Mycobacterium bovis subsp bovis AF2122/97
gcucgcgcaaggcgcc

SEQ ID NO: 3162044 - RNA, 20 nt, Mycobacterium bovis subsp bovis AF2122/97
gcucgcgcacccagcccagc

SEQ ID NO: 3162045 - RNA, 21 nt, Mycobacterium bovis subsp bovis AF2122/97
gcucgcgcacccagcccagcc

SEQ ID NO: 3162046 - RNA, 18 nt, Mycobacterium bovis subsp bovis AF2122/97
gcucgcgcacccugcgug

SEQ ID NO: 3162047 - RNA, 23 nt, Mycobacterium bovis subsp bovis AF2122/97
gcucgcgcacccugcgugcggcg

SEQ ID NO: 3162048 - RNA, 20 nt, Mycobacterium bovis subsp bovis AF2122/97
gcucgcgccaggucggugac

SEQ ID NO: 3162049 - RNA, 20 nt, Mycobacterium bovis subsp bovis AF2122/97
gcucgcgcccgcuaacuggc

SEQ ID NO: 3162050 - RNA, 12 nt, Mycobacterium bovis subsp bovis AF2122/97
gcucgcgcgcug

SEQ ID NO: 3162051 - RNA, 14 nt, Mycobacterium bovis subsp bovis AF2122/97
gcucgcgcgcuggg

SEQ ID NO: 3162052 - RNA, 19 nt, Mycobacterium bovis subsp bovis AF2122/97
gcucgcgcgcugggcgcgc

SEQ ID NO: 3162053 - RNA, 20 nt, Mycobacterium bovis subsp bovis AF2122/97
gcucgcgcgguagucgucgc

SEQ ID NO: 3162054 - RNA, 17 nt, Mycobacterium bovis subsp bovis AF2122/97
gcucgcgcucgauggcg

SEQ ID NO: 3162055 - RNA, 22 nt, Mycobacterium bovis subsp bovis AF2122/97
gcucgcgcucguuagcggcggg

SEQ ID NO: 3162056 - RNA, 14 nt, Mycobacterium bovis subsp bovis AF2122/97
gcucgcggcgacca

SEQ ID NO: 3162057 - RNA, 13 nt, Mycobacterium bovis subsp bovis AF2122/97
gcucgcggcgcag

SEQ ID NO: 3162058 - RNA, 16 nt, Mycobacterium bovis subsp bovis AF2122/97
gcucgcggcggcgcug

SEQ ID NO: 3162059 - RNA, 19 nt, Mycobacterium bovis subsp bovis AF2122/97
gcucgcggcggcgcuggcg

SEQ ID NO: 3162060 - RNA, 23 nt, Mycobacterium bovis subsp bovis AF2122/97
gcucgcggcuucaguccggcccc

SEQ ID NO: 3162061 - RNA, 14 nt, Mycobacterium bovis subsp bovis AF2122/97
gcucgcgggccgcg

SEQ ID NO: 3162062 - RNA, 13 nt, Mycobacterium bovis subsp bovis AF2122/97
gcucgcggguacc

SEQ ID NO: 3162063 - RNA, 21 nt, Mycobacterium bovis subsp bovis AF2122/97
gcucgcgguaguuaacccagg

SEQ ID NO: 3162064 - RNA, 11 nt, Mycobacterium bovis subsp bovis AF2122/97
gcucgcggugg

SEQ ID NO: 3162065 - RNA, 13 nt, Mycobacterium bovis subsp bovis AF2122/97
gcucgcggugggc

SEQ ID NO: 3162066 - RNA, 19 nt, Mycobacterium bovis subsp bovis AF2122/97
gcucgcgguuuuggucgcg

SEQ ID NO: 3162067 - RNA, 17 nt, Mycobacterium bovis subsp bovis AF2122/97
gcucgcguggccgccgg

SEQ ID NO: 3162068 - RNA, 21 nt, Mycobacterium bovis subsp bovis AF2122/97
gcucgcguggccgccggcgcu

SEQ ID NO: 3162069 - RNA, 16 nt, Mycobacterium bovis subsp bovis AF2122/97
gcucgcucaccggcgc

SEQ ID NO: 3162070 - RNA, 15 nt, Mycobacterium bovis subsp bovis AF2122/97
gcucgcucaccggcu

SEQ ID NO: 3162071 - RNA, 19 nt, Mycobacterium bovis subsp bovis AF2122/97
gcucgcucaccggcuggug

SEQ ID NO: 3162072 - RNA, 20 nt, Mycobacterium bovis subsp bovis AF2122/97
gcucgcucaccggcuggugc

SEQ ID NO: 3162073 - RNA, 21 nt, Mycobacterium bovis subsp bovis AF2122/97
gcucgcucaccggcuggugcc

SEQ ID NO: 3162074 - RNA, 15 nt, Mycobacterium bovis subsp bovis AF2122/97
gcucgcucacgccgu

SEQ ID NO: 3162075 - RNA, 17 nt, Mycobacterium bovis subsp bovis AF2122/97
gcucgcucugcgcggcu

SEQ ID NO: 3162076 - RNA, 14 nt, Mycobacterium bovis subsp bovis AF2122/97
gcucgcugaccuug

SEQ ID NO: 3162077 - RNA, 12 nt, Mycobacterium bovis subsp bovis AF2122/97
gcucgcugacgg

SEQ ID NO: 3162078 - RNA, 19 nt, Mycobacterium bovis subsp bovis AF2122/97
gcucgcugaucaggucuuc

SEQ ID NO: 3162079 - RNA, 20 nt, Mycobacterium bovis subsp bovis AF2122/97
gcucgcugaugcaucccaac

SEQ ID NO: 3162080 - RNA, 13 nt, Mycobacterium bovis subsp bovis AF2122/97
gcucgcugcacca

SEQ ID NO: 3162081 - RNA, 14 nt, Mycobacterium bovis subsp bovis AF2122/97
gcucgcugcaccag

SEQ ID NO: 3162082 - RNA, 16 nt, Mycobacterium bovis subsp bovis AF2122/97
gcucgcugcaccagcu

SEQ ID NO: 3162083 - RNA, 15 nt, Mycobacterium bovis subsp bovis AF2122/97
gcucgcugcagcagg

SEQ ID NO: 3162084 - RNA, 15 nt, Mycobacterium bovis subsp bovis AF2122/97
gcucgcugcgcgccc

SEQ ID NO: 3162085 - RNA, 15 nt, Mycobacterium bovis subsp bovis AF2122/97
gcucgcuggcgcuga

SEQ ID NO: 3162086 - RNA, 17 nt, Mycobacterium bovis subsp bovis AF2122/97
gcucgcuggcgcugaug

SEQ ID NO: 3162087 - RNA, 21 nt, Mycobacterium bovis subsp bovis AF2122/97
gcucgcuggcgcugaugcugg

SEQ ID NO: 3162088 - RNA, 18 nt, Mycobacterium bovis subsp bovis AF2122/97
gcucgcuucaggcaccgg

SEQ ID NO: 3162089 - RNA, 20 nt, Mycobacterium bovis subsp bovis AF2122/97
gcucgcuucaggcaccggau

SEQ ID NO: 3162090 - RNA, 17 nt, Mycobacterium bovis subsp bovis AF2122/97
gcucggaaaccgccccg

SEQ ID NO: 3162091 - RNA, 16 nt, Mycobacterium bovis subsp bovis AF2122/97
gcucgguaggccggca

SEQ ID NO: 3162092 - RNA, 19 nt, Mycobacterium bovis subsp bovis AF2122/97
gcucgguaggccggcaaga

SEQ ID NO: 3162093 - RNA, 19 nt, Mycobacterium bovis subsp bovis AF2122/97
gcucggucaacgcuucggc

SEQ ID NO: 3162094 - RNA, 16 nt, Mycobacterium bovis subsp bovis AF2122/97
gcucggucagcgucag

SEQ ID NO: 3162095 - RNA, 18 nt, Mycobacterium bovis subsp bovis AF2122/97
gcucgguccccgcagcuc

SEQ ID NO: 3162096 - RNA, 19 nt, Mycobacterium bovis subsp bovis AF2122/97
gcucgguccuugccguaga

SEQ ID NO: 3162097 - RNA, 13 nt, Mycobacterium bovis subsp bovis AF2122/97
gcucggucgaugc

SEQ ID NO: 3162098 - RNA, 14 nt, Mycobacterium bovis subsp bovis AF2122/97
gcucggucgccacc

SEQ ID NO: 3162099 - RNA, 15 nt, Mycobacterium bovis subsp bovis AF2122/97
gcucggucgccaccg

SEQ ID NO: 3162100 - RNA, 21 nt, Mycobacterium bovis subsp bovis AF2122/97
gcucggucggcagcuccagca

SEQ ID NO: 3162101 - RNA, 20 nt, Mycobacterium bovis subsp bovis AF2122/97
gcucggucuccaccaccgac

SEQ ID NO: 3162102 - RNA, 15 nt, Mycobacterium bovis subsp bovis AF2122/97
gcucggucucgucgc

SEQ ID NO: 3162103 - RNA, 21 nt, Mycobacterium bovis subsp bovis AF2122/97
gcucggugacaagcggcccgc

SEQ ID NO: 3162104 - RNA, 22 nt, Mycobacterium bovis subsp bovis AF2122/97
gcucggugacaagcggcccgcu

SEQ ID NO: 3162105 - RNA, 18 nt, Mycobacterium bovis subsp bovis AF2122/97
gcucggugacccccgaga

SEQ ID NO: 3162106 - RNA, 15 nt, Mycobacterium bovis subsp bovis AF2122/97
gcucggugacguaga

SEQ ID NO: 3162107 - RNA, 18 nt, Mycobacterium bovis subsp bovis AF2122/97
gcucggugaugcccagcg

SEQ ID NO: 3162108 - RNA, 21 nt, Mycobacterium bovis subsp bovis AF2122/97
gcucggugcgccagaucaccg

SEQ ID NO: 3162109 - RNA, 15 nt, Mycobacterium bovis subsp bovis AF2122/97
gcucggugcugcgcc

SEQ ID NO: 3162110 - RNA, 15 nt, Mycobacterium bovis subsp bovis AF2122/97
gcucgguggcgccgg

SEQ ID NO: 3162111 - RNA, 13 nt, Mycobacterium bovis subsp bovis AF2122/97
gcucgguggcgga

SEQ ID NO: 3162112 - RNA, 17 nt, Mycobacterium bovis subsp bovis AF2122/97
gcucgguuagcccgauc

SEQ ID NO: 3162113 - RNA, 21 nt, Mycobacterium bovis subsp bovis AF2122/97
gcucguaaccuucgaccucca

SEQ ID NO: 3162114 - RNA, 20 nt, Mycobacterium bovis subsp bovis AF2122/97
gcucguagaaucggcucagc

SEQ ID NO: 3162115 - RNA, 21 nt, Mycobacterium bovis subsp bovis AF2122/97
gcucguagacuugcugcuccu

SEQ ID NO: 3162116 - RNA, 22 nt, Mycobacterium bovis subsp bovis AF2122/97
gcucguagcggcggcgcccggc

SEQ ID NO: 3162117 - RNA, 23 nt, Mycobacterium bovis subsp bovis AF2122/97
gcucgucacgugucccgcaugca

SEQ ID NO: 3162118 - RNA, 19 nt, Mycobacterium bovis subsp bovis AF2122/97
gcucgucagguuccgcgac

SEQ ID NO: 3162119 - RNA, 20 nt, Mycobacterium bovis subsp bovis AF2122/97
gcucguccaagccggccacg

SEQ ID NO: 3162120 - RNA, 20 nt, Mycobacterium bovis subsp bovis AF2122/97
gcucguccaccccgauccgc

SEQ ID NO: 3162121 - RNA, 17 nt, Mycobacterium bovis subsp bovis AF2122/97
gcucguccaggucggcc

SEQ ID NO: 3162122 - RNA, 19 nt, Mycobacterium bovis subsp bovis AF2122/97
gcucguccaggucggccgc

SEQ ID NO: 3162123 - RNA, 19 nt, Mycobacterium bovis subsp bovis AF2122/97
gcucguccggugcgauccc

SEQ ID NO: 3162124 - RNA, 21 nt, Mycobacterium bovis subsp bovis AF2122/97
gcucguccggugcgaucccac

SEQ ID NO: 3162125 - RNA, 21 nt, Mycobacterium bovis subsp bovis AF2122/97
gcucguccucgucuucgucgg

SEQ ID NO: 3162126 - RNA, 16 nt, Mycobacterium bovis subsp bovis AF2122/97
gcucgucgaacauggc

SEQ ID NO: 3162127 - RNA, 21 nt, Mycobacterium bovis subsp bovis AF2122/97
gcucgucgaaguagccgacgu

SEQ ID NO: 3162128 - RNA, 13 nt, Mycobacterium bovis subsp bovis AF2122/97
gcucgucgagccg

SEQ ID NO: 3162129 - RNA, 16 nt, Mycobacterium bovis subsp bovis AF2122/97
gcucgucgagccgacc

SEQ ID NO: 3162130 - RNA, 19 nt, Mycobacterium bovis subsp bovis AF2122/97
gcucgucgagccgaccgcg

SEQ ID NO: 3162131 - RNA, 17 nt, Mycobacterium bovis subsp bovis AF2122/97
gcucgucgaguggauca

SEQ ID NO: 3162132 - RNA, 13 nt, Mycobacterium bovis subsp bovis AF2122/97
gcucgucgauccc

SEQ ID NO: 3162133 - RNA, 16 nt, Mycobacterium bovis subsp bovis AF2122/97
gcucgucgaucuccuc

SEQ ID NO: 3162134 - RNA, 13 nt, Mycobacterium bovis subsp bovis AF2122/97
gcucgucgcggcc

SEQ ID NO: 3162135 - RNA, 22 nt, Mycobacterium bovis subsp bovis AF2122/97
gcucgucgcggcccgcgaauac

SEQ ID NO: 3162136 - RNA, 14 nt, Mycobacterium bovis subsp bovis AF2122/97
gcucgucggccacc

SEQ ID NO: 3162137 - RNA, 20 nt, Mycobacterium bovis subsp bovis AF2122/97
gcucgucggccaccgcggcg

SEQ ID NO: 3162138 - RNA, 23 nt, Mycobacterium bovis subsp bovis AF2122/97
gcucgucggcgauggccagcacg

SEQ ID NO: 3162139 - RNA, 18 nt, Mycobacterium bovis subsp bovis AF2122/97
gcucgucggcgccggcgg

SEQ ID NO: 3162140 - RNA, 22 nt, Mycobacterium bovis subsp bovis AF2122/97
gcucgucggcgccggcggccgc

SEQ ID NO: 3162141 - RNA, 20 nt, Mycobacterium bovis subsp bovis AF2122/97
gcucgucggucaccgaaugc

SEQ ID NO: 3162142 - RNA, 12 nt, Mycobacterium bovis subsp bovis AF2122/97
gcucgucguaca

SEQ ID NO: 3162143 - RNA, 20 nt, Mycobacterium bovis subsp bovis AF2122/97
gcucgucguacaugggcaga

SEQ ID NO: 3162144 - RNA, 14 nt, Mycobacterium bovis subsp bovis AF2122/97
gcucgucgucaccg

SEQ ID NO: 3162145 - RNA, 17 nt, Mycobacterium bovis subsp bovis AF2122/97
gcucgucgucgauccag

SEQ ID NO: 3162146 - RNA, 21 nt, Mycobacterium bovis subsp bovis AF2122/97
gcucgucgucgauccagccca

SEQ ID NO: 3162147 - RNA, 19 nt, Mycobacterium bovis subsp bovis AF2122/97
gcucgucgugagucacccg

SEQ ID NO: 3162148 - RNA, 16 nt, Mycobacterium bovis subsp bovis AF2122/97
gcucgucuuggcggcg

SEQ ID NO: 3162149 - RNA, 17 nt, Mycobacterium bovis subsp bovis AF2122/97
gcucgucuuggcggcgg

SEQ ID NO: 3162150 - RNA, 17 nt, Mycobacterium bovis subsp bovis AF2122/97
gcucgucuugggccggg

SEQ ID NO: 3162151 - RNA, 16 nt, Mycobacterium bovis subsp bovis AF2122/97
gcucguggcgacggcg

SEQ ID NO: 3162152 - RNA, 18 nt, Mycobacterium bovis subsp bovis AF2122/97
gcucguggguaccgagca

SEQ ID NO: 3162153 - RNA, 16 nt, Mycobacterium bovis subsp bovis AF2122/97
gcucguggucgacgug

SEQ ID NO: 3162154 - RNA, 17 nt, Mycobacterium bovis subsp bovis AF2122/97
gcucguggucgacguga

SEQ ID NO: 3162155 - RNA, 16 nt, Mycobacterium bovis subsp bovis AF2122/97
gcucguuacgccgagc

SEQ ID NO: 3162156 - RNA, 19 nt, Mycobacterium bovis subsp bovis AF2122/97
gcucguuagcggcgggcac

SEQ ID NO: 3162157 - RNA, 16 nt, Mycobacterium bovis subsp bovis AF2122/97
gcucguuccggcgguc

SEQ ID NO: 3162158 - RNA, 17 nt, Mycobacterium bovis subsp bovis AF2122/97
gcucguucgugcagccc

SEQ ID NO: 3162159 - RNA, 14 nt, Mycobacterium bovis subsp bovis AF2122/97
gcucguugcgggcg

SEQ ID NO: 3162160 - RNA, 15 nt, Mycobacterium bovis subsp bovis AF2122/97
gcucguugcuggcgg

SEQ ID NO: 3162161 - RNA, 20 nt, Mycobacterium bovis subsp bovis AF2122/97
gcucguugcuggcggccagc

SEQ ID NO: 3162162 - RNA, 18 nt, Mycobacterium bovis subsp bovis AF2122/97
gcucguugguucagcucg

SEQ ID NO: 3162163 - RNA, 15 nt, Mycobacterium bovis subsp bovis AF2122/97
gcucuacucgcggcc

SEQ ID NO: 3162164 - RNA, 22 nt, Mycobacterium bovis subsp bovis AF2122/97
gcucuacucgcggccggcgucg

SEQ ID NO: 3162165 - RNA, 20 nt, Mycobacterium bovis subsp bovis AF2122/97
gcucuaucgggaagccgccg

SEQ ID NO: 3162166 - RNA, 16 nt, Mycobacterium bovis subsp bovis AF2122/97
gcucucauagcgacgg

SEQ ID NO: 3162167 - RNA, 17 nt, Mycobacterium bovis subsp bovis AF2122/97
gcucucauagcgacggc

SEQ ID NO: 3162168 - RNA, 14 nt, Mycobacterium bovis subsp bovis AF2122/97
gcucuccggugauc

SEQ ID NO: 3162169 - RNA, 19 nt, Mycobacterium bovis subsp bovis AF2122/97
gcucuccggugaucaccga

SEQ ID NO: 3162170 - RNA, 14 nt, Mycobacterium bovis subsp bovis AF2122/97
gcucucgaguccag

SEQ ID NO: 3162171 - RNA, 17 nt, Mycobacterium bovis subsp bovis AF2122/97
gcucucgaguccaggca

SEQ ID NO: 3162172 - RNA, 18 nt, Mycobacterium bovis subsp bovis AF2122/97
gcucucgaguccaggcag

SEQ ID NO: 3162173 - RNA, 15 nt, Mycobacterium bovis subsp bovis AF2122/97
gcucucggcacccgg

SEQ ID NO: 3162174 - RNA, 16 nt, Mycobacterium bovis subsp bovis AF2122/97
gcucucggcacccggc

SEQ ID NO: 3162175 - RNA, 13 nt, Mycobacterium bovis subsp bovis AF2122/97
gcucucggcgaau

SEQ ID NO: 3162176 - RNA, 23 nt, Mycobacterium bovis subsp bovis AF2122/97
gcucucggcgauuuugcgucgcg

SEQ ID NO: 3162177 - RNA, 16 nt, Mycobacterium bovis subsp bovis AF2122/97
gcugacgcccuccugg

SEQ ID NO: 3162178 - RNA, 19 nt, Mycobacterium bovis subsp bovis AF2122/97
gcugacgcccuccuggcgg

SEQ ID NO: 3162179 - RNA, 13 nt, Mycobacterium bovis subsp bovis AF2122/97
gcugacgccgagc

SEQ ID NO: 3162180 - RNA, 15 nt, Mycobacterium bovis subsp bovis AF2122/97
gcugacgccgagcug

SEQ ID NO: 3162181 - RNA, 16 nt, Mycobacterium bovis subsp bovis AF2122/97
gcugacggccugcaac

SEQ ID NO: 3162182 - RNA, 23 nt, Mycobacterium bovis subsp bovis AF2122/97
gcugacgguucggucggggagcu

SEQ ID NO: 3162183 - RNA, 16 nt, Mycobacterium bovis subsp bovis AF2122/97
gcugacgugucggcug

SEQ ID NO: 3162184 - RNA, 18 nt, Mycobacterium bovis subsp bovis AF2122/97
gcugacgugucggcugcu

SEQ ID NO: 3162185 - RNA, 18 nt, Mycobacterium bovis subsp bovis AF2122/97
gcugacuagggucaccga

SEQ ID NO: 3162186 - RNA, 16 nt, Mycobacterium bovis subsp bovis AF2122/97
gcugacuccugcggca

SEQ ID NO: 3162187 - RNA, 20 nt, Mycobacterium bovis subsp bovis AF2122/97
gcugacuccugcggcaccgc

SEQ ID NO: 3162188 - RNA, 17 nt, Mycobacterium bovis subsp bovis AF2122/97
gcugagcaaguccugca

SEQ ID NO: 3162189 - RNA, 17 nt, Mycobacterium bovis subsp bovis AF2122/97
gcugagcaccugagccu

SEQ ID NO: 3162190 - RNA, 14 nt, Mycobacterium bovis subsp bovis AF2122/97
gcugagcacgcgga

SEQ ID NO: 3162191 - RNA, 17 nt, Mycobacterium bovis subsp bovis AF2122/97
gcugagcacggcgcggc

SEQ ID NO: 3162192 - RNA, 19 nt, Mycobacterium bovis subsp bovis AF2122/97
gcugagcacggcgcggcgg

SEQ ID NO: 3162193 - RNA, 17 nt, Mycobacterium bovis subsp bovis AF2122/97
gcugagcagcgccgcgu

SEQ ID NO: 3162194 - RNA, 16 nt, Mycobacterium bovis subsp bovis AF2122/97
gcugagcagcgcggcc

SEQ ID NO: 3162195 - RNA, 15 nt, Mycobacterium bovis subsp bovis AF2122/97
gcugagcccgccgcg

SEQ ID NO: 3162196 - RNA, 17 nt, Mycobacterium bovis subsp bovis AF2122/97
gcugagcccgccgcgac

SEQ ID NO: 3162197 - RNA, 18 nt, Mycobacterium bovis subsp bovis AF2122/97
gcugagcccugcgccucg

SEQ ID NO: 3162198 - RNA, 22 nt, Mycobacterium bovis subsp bovis AF2122/97
gcugagccgcaucuggccggcg

SEQ ID NO: 3162199 - RNA, 16 nt, Mycobacterium bovis subsp bovis AF2122/97
gcugagccgcucaucg

SEQ ID NO: 3162200 - RNA, 16 nt, Mycobacterium bovis subsp bovis AF2122/97
gcugagccggucauag

SEQ ID NO: 3162201 - RNA, 13 nt, Mycobacterium bovis subsp bovis AF2122/97
gcugagccgucgg

SEQ ID NO: 3162202 - RNA, 16 nt, Mycobacterium bovis subsp bovis AF2122/97
gcugagccgucggcgc

SEQ ID NO: 3162203 - RNA, 17 nt, Mycobacterium bovis subsp bovis AF2122/97
gcugagccgucggcgcc

SEQ ID NO: 3162204 - RNA, 14 nt, Mycobacterium bovis subsp bovis AF2122/97
gcugagcgccaggc

SEQ ID NO: 3162205 - RNA, 22 nt, Mycobacterium bovis subsp bovis AF2122/97
gcugagcgcgcggguggcggcg

SEQ ID NO: 3162206 - RNA, 15 nt, Mycobacterium bovis subsp bovis AF2122/97
gcugagcggacucga

SEQ ID NO: 3162207 - RNA, 21 nt, Mycobacterium bovis subsp bovis AF2122/97
gcugagcucgaugucagcggc

SEQ ID NO: 3162208 - RNA, 23 nt, Mycobacterium bovis subsp bovis AF2122/97
gcugagcucgaugucagcggccg

SEQ ID NO: 3162209 - RNA, 14 nt, Mycobacterium bovis subsp bovis AF2122/97
gcugagcugcucgc

SEQ ID NO: 3162210 - RNA, 18 nt, Mycobacterium bovis subsp bovis AF2122/97
gcugagcugcucgccggc

SEQ ID NO: 3162211 - RNA, 19 nt, Mycobacterium bovis subsp bovis AF2122/97
gcugagcugcucgccggcc

SEQ ID NO: 3162212 - RNA, 16 nt, Mycobacterium bovis subsp bovis AF2122/97
gcugaggaacgccggc

SEQ ID NO: 3162213 - RNA, 17 nt, Mycobacterium bovis subsp bovis AF2122/97
gcugaggaagcggcggc

SEQ ID NO: 3162214 - RNA, 20 nt, Mycobacterium bovis subsp bovis AF2122/97
gcugaggaagcggcggcaac

SEQ ID NO: 3162215 - RNA, 16 nt, Mycobacterium bovis subsp bovis AF2122/97
gcugaggcggcgacga

SEQ ID NO: 3162216 - RNA, 12 nt, Mycobacterium bovis subsp bovis AF2122/97
gcugagggugga

SEQ ID NO: 3162217 - RNA, 20 nt, Mycobacterium bovis subsp bovis AF2122/97
gcugagguauugggcgcggc

SEQ ID NO: 3162218 - RNA, 20 nt, Mycobacterium bovis subsp bovis AF2122/97
gcugagguggcggugcggcg

SEQ ID NO: 3162219 - RNA, 20 nt, Mycobacterium bovis subsp bovis AF2122/97
gcugaguccccaggugggca

SEQ ID NO: 3162220 - RNA, 22 nt, Mycobacterium bovis subsp bovis AF2122/97
gcugaguccccaggugggcagc

SEQ ID NO: 3162221 - RNA, 24 nt, Mycobacterium bovis subsp bovis AF2122/97
gcugagucgguucagccacgcagc

SEQ ID NO: 3162222 - RNA, 15 nt, Mycobacterium bovis subsp bovis AF2122/97
gcugauagcggucgg

SEQ ID NO: 3162223 - RNA, 21 nt, Mycobacterium bovis subsp bovis AF2122/97
gcugauagcggucggucacca

SEQ ID NO: 3162224 - RNA, 17 nt, Mycobacterium bovis subsp bovis AF2122/97
gcugauaguggcgcgcg

SEQ ID NO: 3162225 - RNA, 20 nt, Mycobacterium bovis subsp bovis AF2122/97
gcugauaguggcgcgcggcg

SEQ ID NO: 3162226 - RNA, 21 nt, Mycobacterium bovis subsp bovis AF2122/97
gcugauaguggcgcgcggcgc

SEQ ID NO: 3162227 - RNA, 12 nt, Mycobacterium bovis subsp bovis AF2122/97
gcugaucaacag

SEQ ID NO: 3162228 - RNA, 19 nt, Mycobacterium bovis subsp bovis AF2122/97
gcugaucaaggcgcucccg

SEQ ID NO: 3162229 - RNA, 21 nt, Mycobacterium bovis subsp bovis AF2122/97
gcugaucagcaugcggccaug

SEQ ID NO: 3162230 - RNA, 16 nt, Mycobacterium bovis subsp bovis AF2122/97
gcugaucaggucuucg

SEQ ID NO: 3162231 - RNA, 22 nt, Mycobacterium bovis subsp bovis AF2122/97
gcugaucaggucuucgauggcc

SEQ ID NO: 3162232 - RNA, 12 nt, Mycobacterium bovis subsp bovis AF2122/97
gcugauccaagu

SEQ ID NO: 3162233 - RNA, 19 nt, Mycobacterium bovis subsp bovis AF2122/97
gcugaucccagaucggcgu

SEQ ID NO: 3162234 - RNA, 16 nt, Mycobacterium bovis subsp bovis AF2122/97
gcugauccgggcgccg

SEQ ID NO: 3162235 - RNA, 21 nt, Mycobacterium bovis subsp bovis AF2122/97
gcugauccggguggcgucacc

SEQ ID NO: 3162236 - RNA, 17 nt, Mycobacterium bovis subsp bovis AF2122/97
gcugaucgcgcgcaccg

SEQ ID NO: 3162237 - RNA, 18 nt, Mycobacterium bovis subsp bovis AF2122/97
gcugaucgcgcgcaccgg

SEQ ID NO: 3162238 - RNA, 19 nt, Mycobacterium bovis subsp bovis AF2122/97
gcugaucgcgcgcaccggg

SEQ ID NO: 3162239 - RNA, 16 nt, Mycobacterium bovis subsp bovis AF2122/97
gcugaucugccgccgc

SEQ ID NO: 3162240 - RNA, 20 nt, Mycobacterium bovis subsp bovis AF2122/97
gcugaucugccgccgcggcc

SEQ ID NO: 3162241 - RNA, 22 nt, Mycobacterium bovis subsp bovis AF2122/97
gcugaucuuggcaagccaagcg

SEQ ID NO: 3162242 - RNA, 18 nt, Mycobacterium bovis subsp bovis AF2122/97
gcugaugaaacgccgucg

SEQ ID NO: 3162243 - RNA, 18 nt, Mycobacterium bovis subsp bovis AF2122/97
gcugaugcccuugcggaa

SEQ ID NO: 3162244 - RNA, 12 nt, Mycobacterium bovis subsp bovis AF2122/97
gcugaugccguc

SEQ ID NO: 3162245 - RNA, 21 nt, Mycobacterium bovis subsp bovis AF2122/97
gcugaugccgucuuugucacg

SEQ ID NO: 3162246 - RNA, 16 nt, Mycobacterium bovis subsp bovis AF2122/97
gcugaugccuggucgc

SEQ ID NO: 3162247 - RNA, 19 nt, Mycobacterium bovis subsp bovis AF2122/97
gcugaugcgcugggccagg

SEQ ID NO: 3162248 - RNA, 19 nt, Mycobacterium bovis subsp bovis AF2122/97
gcugaugcgguagucgccg

SEQ ID NO: 3162249 - RNA, 20 nt, Mycobacterium bovis subsp bovis AF2122/97
gcugaugcgguagucgccga

SEQ ID NO: 3162250 - RNA, 16 nt, Mycobacterium bovis subsp bovis AF2122/97
gcugauggacggugcg

SEQ ID NO: 3162251 - RNA, 14 nt, Mycobacterium bovis subsp bovis AF2122/97
gcugauggugccga

SEQ ID NO: 3162252 - RNA, 17 nt, Mycobacterium bovis subsp bovis AF2122/97
gcugauggugccgaacc

SEQ ID NO: 3162253 - RNA, 15 nt, Mycobacterium bovis subsp bovis AF2122/97
gcugauggugcugcg

SEQ ID NO: 3162254 - RNA, 14 nt, Mycobacterium bovis subsp bovis AF2122/97
gcugaugucgccgg

SEQ ID NO: 3162255 - RNA, 20 nt, Mycobacterium bovis subsp bovis AF2122/97
gcugauuaccgacaccgugu

SEQ ID NO: 3162256 - RNA, 17 nt, Mycobacterium bovis subsp bovis AF2122/97
gcugauugcgaccgcgc

SEQ ID NO: 3162257 - RNA, 23 nt, Mycobacterium bovis subsp bovis AF2122/97
gcugauugcgaccgcgccaacag

SEQ ID NO: 3162258 - RNA, 16 nt, Mycobacterium bovis subsp bovis AF2122/97
gcugauugcggucguc

SEQ ID NO: 3162259 - RNA, 15 nt, Mycobacterium bovis subsp bovis AF2122/97
gcugauuggcccacc

SEQ ID NO: 3162260 - RNA, 22 nt, Mycobacterium bovis subsp bovis AF2122/97
gcugauuggcccaccgccguug

SEQ ID NO: 3162261 - RNA, 13 nt, Mycobacterium bovis subsp bovis AF2122/97
gcugcaacaucga

SEQ ID NO: 3162262 - RNA, 18 nt, Mycobacterium bovis subsp bovis AF2122/97
gcugcaaccagcggcaca

SEQ ID NO: 3162263 - RNA, 16 nt, Mycobacterium bovis subsp bovis AF2122/97
gcugcccgggcugccg

SEQ ID NO: 3162264 - RNA, 19 nt, Mycobacterium bovis subsp bovis AF2122/97
gcugccgaacaguucggcg

SEQ ID NO: 3162265 - RNA, 18 nt, Mycobacterium bovis subsp bovis AF2122/97
gcugccgaagcggccacc

SEQ ID NO: 3162266 - RNA, 19 nt, Mycobacterium bovis subsp bovis AF2122/97
gcugccgaagcggccaccg

SEQ ID NO: 3162267 - RNA, 12 nt, Mycobacterium bovis subsp bovis AF2122/97
gcugccgaccuu

SEQ ID NO: 3162268 - RNA, 16 nt, Mycobacterium bovis subsp bovis AF2122/97
gcugccgacuccucgu

SEQ ID NO: 3162269 - RNA, 16 nt, Mycobacterium bovis subsp bovis AF2122/97
gcugccgagaucccag

SEQ ID NO: 3162270 - RNA, 23 nt, Mycobacterium bovis subsp bovis AF2122/97
gcugccgauacagcacauccagc

SEQ ID NO: 3162271 - RNA, 17 nt, Mycobacterium bovis subsp bovis AF2122/97
gcugccgauagcgcggc

SEQ ID NO: 3162272 - RNA, 20 nt, Mycobacterium bovis subsp bovis AF2122/97
gcugccgcaaacgcggcguc

SEQ ID NO: 3162273 - RNA, 19 nt, Mycobacterium bovis subsp bovis AF2122/97
gcugccgcaccaaggccgc

SEQ ID NO: 3162274 - RNA, 23 nt, Mycobacterium bovis subsp bovis AF2122/97
gcugccgcaccaaggccgccugc

SEQ ID NO: 3162275 - RNA, 16 nt, Mycobacterium bovis subsp bovis AF2122/97
gcugccgcacccccuc

SEQ ID NO: 3162276 - RNA, 13 nt, Mycobacterium bovis subsp bovis AF2122/97
gcugccgcaccgg

SEQ ID NO: 3162277 - RNA, 15 nt, Mycobacterium bovis subsp bovis AF2122/97
gcugccgcaccggug

SEQ ID NO: 3162278 - RNA, 16 nt, Mycobacterium bovis subsp bovis AF2122/97
gcugccgcaccggugc

SEQ ID NO: 3162279 - RNA, 15 nt, Mycobacterium bovis subsp bovis AF2122/97
gcugccgcaucggca

SEQ ID NO: 3162280 - RNA, 18 nt, Mycobacterium bovis subsp bovis AF2122/97
gcugccgcaucggcaagg

SEQ ID NO: 3162281 - RNA, 19 nt, Mycobacterium bovis subsp bovis AF2122/97
gcugccgcaugcgcuccgg

SEQ ID NO: 3162282 - RNA, 20 nt, Mycobacterium bovis subsp bovis AF2122/97
gcugccgcaugcgcuccggc

SEQ ID NO: 3162283 - RNA, 21 nt, Mycobacterium bovis subsp bovis AF2122/97
gcugccgcaugcgcuccggcg

SEQ ID NO: 3162284 - RNA, 14 nt, Mycobacterium bovis subsp bovis AF2122/97
gcugccgccaggcu

SEQ ID NO: 3162285 - RNA, 19 nt, Mycobacterium bovis subsp bovis AF2122/97
gcugccgccaggcucgagg

SEQ ID NO: 3162286 - RNA, 19 nt, Mycobacterium bovis subsp bovis AF2122/97
gcugccgcccaugccggga

SEQ ID NO: 3162287 - RNA, 16 nt, Mycobacterium bovis subsp bovis AF2122/97
gcugccgcccuugccg

SEQ ID NO: 3162288 - RNA, 20 nt, Mycobacterium bovis subsp bovis AF2122/97
gcugccgccgagcuggcgcg

SEQ ID NO: 3162289 - RNA, 19 nt, Mycobacterium bovis subsp bovis AF2122/97
gcugccgccgaucgacacc

SEQ ID NO: 3162290 - RNA, 20 nt, Mycobacterium bovis subsp bovis AF2122/97
gcugccgccgaucgacaccc

SEQ ID NO: 3162291 - RNA, 13 nt, Mycobacterium bovis subsp bovis AF2122/97
gcugccgccgccg

SEQ ID NO: 3162292 - RNA, 16 nt, Mycobacterium bovis subsp bovis AF2122/97
gcugccgccgccgccg

SEQ ID NO: 3162293 - RNA, 18 nt, Mycobacterium bovis subsp bovis AF2122/97
gcugccgccgccgccggc

SEQ ID NO: 3162294 - RNA, 14 nt, Mycobacterium bovis subsp bovis AF2122/97
gcugccgccgccgg

SEQ ID NO: 3162295 - RNA, 17 nt, Mycobacterium bovis subsp bovis AF2122/97
gcugccgccgccggcgg

SEQ ID NO: 3162296 - RNA, 13 nt, Mycobacterium bovis subsp bovis AF2122/97
gcugccgccggug

SEQ ID NO: 3162297 - RNA, 11 nt, Mycobacterium bovis subsp bovis AF2122/97
gcugccgccgu

SEQ ID NO: 3162298 - RNA, 14 nt, Mycobacterium bovis subsp bovis AF2122/97
gcugccgccgucgc

SEQ ID NO: 3162299 - RNA, 21 nt, Mycobacterium bovis subsp bovis AF2122/97
gcugccgccuuggucgcgucg

SEQ ID NO: 3162300 - RNA, 24 nt, Mycobacterium bovis subsp bovis AF2122/97
gcugccgccuuggucgcgucggcu

SEQ ID NO: 3162301 - RNA, 14 nt, Mycobacterium bovis subsp bovis AF2122/97
gcugccgcgcgcug

SEQ ID NO: 3162302 - RNA, 17 nt, Mycobacterium bovis subsp bovis AF2122/97
gcugccgcgcgcugccg

SEQ ID NO: 3162303 - RNA, 17 nt, Mycobacterium bovis subsp bovis AF2122/97
gcugccgcgcggcgaga

SEQ ID NO: 3162304 - RNA, 13 nt, Mycobacterium bovis subsp bovis AF2122/97
gcugccgcggccg

SEQ ID NO: 3162305 - RNA, 19 nt, Mycobacterium bovis subsp bovis AF2122/97
gcugccgcggccggcgugc

SEQ ID NO: 3162306 - RNA, 22 nt, Mycobacterium bovis subsp bovis AF2122/97
gcugccgcucgaccccgcgcug

SEQ ID NO: 3162307 - RNA, 12 nt, Mycobacterium bovis subsp bovis AF2122/97
gcugccgcugcg

SEQ ID NO: 3162308 - RNA, 22 nt, Mycobacterium bovis subsp bovis AF2122/97
gcugccgcugcgccgucgcagc

SEQ ID NO: 3162309 - RNA, 16 nt, Mycobacterium bovis subsp bovis AF2122/97
gcugccggagacaccc

SEQ ID NO: 3162310 - RNA, 17 nt, Mycobacterium bovis subsp bovis AF2122/97
gcugccggagacacccg

SEQ ID NO: 3162311 - RNA, 15 nt, Mycobacterium bovis subsp bovis AF2122/97
gcugccggcaacagc

SEQ ID NO: 3162312 - RNA, 19 nt, Mycobacterium bovis subsp bovis AF2122/97
gcugccggcaacagcucgc

SEQ ID NO: 3162313 - RNA, 13 nt, Mycobacterium bovis subsp bovis AF2122/97
gcugccggcacca

SEQ ID NO: 3162314 - RNA, 16 nt, Mycobacterium bovis subsp bovis AF2122/97
gcugccggcaccaacc

SEQ ID NO: 3162315 - RNA, 19 nt, Mycobacterium bovis subsp bovis AF2122/97
gcugccggcaccaaccacc

SEQ ID NO: 3162316 - RNA, 20 nt, Mycobacterium bovis subsp bovis AF2122/97
gcugccggcacgcaugccgg

SEQ ID NO: 3162317 - RNA, 24 nt, Mycobacterium bovis subsp bovis AF2122/97
gcugccggcagcguccgaaccacc

SEQ ID NO: 3162318 - RNA, 16 nt, Mycobacterium bovis subsp bovis AF2122/97
gcugccggccagacgg

SEQ ID NO: 3162319 - RNA, 22 nt, Mycobacterium bovis subsp bovis AF2122/97
gcugccggccagacggugcagc

SEQ ID NO: 3162320 - RNA, 15 nt, Mycobacterium bovis subsp bovis AF2122/97
gcugccggcccacca

SEQ ID NO: 3162321 - RNA, 17 nt, Mycobacterium bovis subsp bovis AF2122/97
gcugccggcccaccagg

SEQ ID NO: 3162322 - RNA, 13 nt, Mycobacterium bovis subsp bovis AF2122/97
gcugccggcgccg

SEQ ID NO: 3162323 - RNA, 14 nt, Mycobacterium bovis subsp bovis AF2122/97
gcugccggcgccgc

SEQ ID NO: 3162324 - RNA, 19 nt, Mycobacterium bovis subsp bovis AF2122/97
gcugccggcgccgccacug

SEQ ID NO: 3162325 - RNA, 20 nt, Mycobacterium bovis subsp bovis AF2122/97
gcugccggcugacgaccaac

SEQ ID NO: 3162326 - RNA, 21 nt, Mycobacterium bovis subsp bovis AF2122/97
gcugccgguagcacagcagca

SEQ ID NO: 3162327 - RNA, 18 nt, Mycobacterium bovis subsp bovis AF2122/97
gcugccgguggcggcggc

SEQ ID NO: 3162328 - RNA, 12 nt, Mycobacterium bovis subsp bovis AF2122/97
gcugccggugua

SEQ ID NO: 3162329 - RNA, 17 nt, Mycobacterium bovis subsp bovis AF2122/97
gcugccggugugcggcg

SEQ ID NO: 3162330 - RNA, 20 nt, Mycobacterium bovis subsp bovis AF2122/97
gcugccggugugcggcguac

SEQ ID NO: 3162331 - RNA, 23 nt, Mycobacterium bovis subsp bovis AF2122/97
gcugccgguguuguaggccgggc

SEQ ID NO: 3162332 - RNA, 20 nt, Mycobacterium bovis subsp bovis AF2122/97
gcugccguauccaggcgugc

SEQ ID NO: 3162333 - RNA, 22 nt, Mycobacterium bovis subsp bovis AF2122/97
gcugccguauccaggcgugcau

SEQ ID NO: 3162334 - RNA, 18 nt, Mycobacterium bovis subsp bovis AF2122/97
gcugccgucagcugaccg

SEQ ID NO: 3162335 - RNA, 14 nt, Mycobacterium bovis subsp bovis AF2122/97
gcugccgucggaga

SEQ ID NO: 3162336 - RNA, 22 nt, Mycobacterium bovis subsp bovis AF2122/97
gcugccgucggagaccagcucg

SEQ ID NO: 3162337 - RNA, 16 nt, Mycobacterium bovis subsp bovis AF2122/97
gcugccgucggugccg

SEQ ID NO: 3162338 - RNA, 16 nt, Mycobacterium bovis subsp bovis AF2122/97
gcugccguggcggcag

SEQ ID NO: 3162339 - RNA, 11 nt, Mycobacterium bovis subsp bovis AF2122/97
gcugccguuga

SEQ ID NO: 3162340 - RNA, 18 nt, Mycobacterium bovis subsp bovis AF2122/97
gcugccucccuuccgcgc

SEQ ID NO: 3162341 - RNA, 13 nt, Mycobacterium bovis subsp bovis AF2122/97
gcugccugccgcg

SEQ ID NO: 3162342 - RNA, 18 nt, Mycobacterium bovis subsp bovis AF2122/97
gcugccuggccgggaccg

SEQ ID NO: 3162343 - RNA, 19 nt, Mycobacterium bovis subsp bovis AF2122/97
gcugccuucggcgagcggu

SEQ ID NO: 3162344 - RNA, 12 nt, Mycobacterium bovis subsp bovis AF2122/97
gcugccuucuuu

SEQ ID NO: 3162345 - RNA, 19 nt, Mycobacterium bovis subsp bovis AF2122/97
gcugccuucuuugccggcg

SEQ ID NO: 3162346 - RNA, 20 nt, Mycobacterium bovis subsp bovis AF2122/97
gcugccuucuuugccggcgc

SEQ ID NO: 3162347 - RNA, 17 nt, Mycobacterium bovis subsp bovis AF2122/97
gcugccuuggcgcggca

SEQ ID NO: 3162348 - RNA, 19 nt, Mycobacterium bovis subsp bovis AF2122/97
gcugccuuggcgcggcacc

SEQ ID NO: 3162349 - RNA, 20 nt, Mycobacterium bovis subsp bovis AF2122/97
gcugcgaagccgagcaucag

SEQ ID NO: 3162350 - RNA, 14 nt, Mycobacterium bovis subsp bovis AF2122/97
gcugcucgccggcc

SEQ ID NO: 3162351 - RNA, 20 nt, Mycobacterium bovis subsp bovis AF2122/97
gcugcucggucaggcggcug

SEQ ID NO: 3162352 - RNA, 19 nt, Mycobacterium bovis subsp bovis AF2122/97
gcugcucgucgugagacug

SEQ ID NO: 3162353 - RNA, 20 nt, Mycobacterium bovis subsp bovis AF2122/97
gcugcucgucuuggcggcgg

SEQ ID NO: 3162354 - RNA, 17 nt, Mycobacterium bovis subsp bovis AF2122/97
gcugcucgugagcccca

SEQ ID NO: 3162355 - RNA, 20 nt, Mycobacterium bovis subsp bovis AF2122/97
gcugcucgugagccccagcg

SEQ ID NO: 3162356 - RNA, 22 nt, Mycobacterium bovis subsp bovis AF2122/97
gcugcucgugagccccagcgac

SEQ ID NO: 3162357 - RNA, 20 nt, Mycobacterium bovis subsp bovis AF2122/97
gcugcucuccgucgcgcacg

SEQ ID NO: 3162358 - RNA, 22 nt, Mycobacterium bovis subsp bovis AF2122/97
gcugcucugagcuuggucgccg

SEQ ID NO: 3162359 - RNA, 21 nt, Mycobacterium bovis subsp bovis AF2122/97
gcugcucuggacggucauccg

SEQ ID NO: 3162360 - RNA, 14 nt, Mycobacterium bovis subsp bovis AF2122/97
gcugcugaacaccg

SEQ ID NO: 3162361 - RNA, 15 nt, Mycobacterium bovis subsp bovis AF2122/97
gcugcugccgauaca

SEQ ID NO: 3162362 - RNA, 14 nt, Mycobacterium bovis subsp bovis AF2122/97
gcugcugccgcacc

SEQ ID NO: 3162363 - RNA, 15 nt, Mycobacterium bovis subsp bovis AF2122/97
gcugcugccgcaccg

SEQ ID NO: 3162364 - RNA, 19 nt, Mycobacterium bovis subsp bovis AF2122/97
gcugcugccgcaccggugc

SEQ ID NO: 3162365 - RNA, 16 nt, Mycobacterium bovis subsp bovis AF2122/97
gcugcugccguggcgg

SEQ ID NO: 3162366 - RNA, 17 nt, Mycobacterium bovis subsp bovis AF2122/97
gcugcugccguggcggc

SEQ ID NO: 3162367 - RNA, 13 nt, Mycobacterium bovis subsp bovis AF2122/97
gcugcugcgcgag

SEQ ID NO: 3162368 - RNA, 16 nt, Mycobacterium bovis subsp bovis AF2122/97
gcugcugcucggccug

SEQ ID NO: 3162369 - RNA, 15 nt, Mycobacterium bovis subsp bovis AF2122/97
gcugcuggcagacca

SEQ ID NO: 3162370 - RNA, 16 nt, Mycobacterium bovis subsp bovis AF2122/97
gcugcuggcgcgccug

SEQ ID NO: 3162371 - RNA, 23 nt, Mycobacterium bovis subsp bovis AF2122/97
gcugcugucgauuucgccgucgc

SEQ ID NO: 3162372 - RNA, 21 nt, Mycobacterium bovis subsp bovis AF2122/97
gcugcuucuucggacagcagc

SEQ ID NO: 3162373 - RNA, 14 nt, Mycobacterium bovis subsp bovis AF2122/97
gcugcuugcgcccg

SEQ ID NO: 3162374 - RNA, 16 nt, Mycobacterium bovis subsp bovis AF2122/97
gcugcuugcgcccggc

SEQ ID NO: 3162375 - RNA, 23 nt, Mycobacterium bovis subsp bovis AF2122/97
gcugcuugcgcccggccugcugg

SEQ ID NO: 3162376 - RNA, 19 nt, Mycobacterium bovis subsp bovis AF2122/97
gcugcuuggcggucugcgc

SEQ ID NO: 3162377 - RNA, 22 nt, Mycobacterium bovis subsp bovis AF2122/97
gcugcuuggucgcccagccacu

SEQ ID NO: 3162378 - RNA, 23 nt, Mycobacterium bovis subsp bovis AF2122/97
gcuggaaucgaaaaggugcacca

SEQ ID NO: 3162379 - RNA, 19 nt, Mycobacterium bovis subsp bovis AF2122/97
gcuggacaacggcggucug

SEQ ID NO: 3162380 - RNA, 18 nt, Mycobacterium bovis subsp bovis AF2122/97
gcuggaccacucgccggc

SEQ ID NO: 3162381 - RNA, 19 nt, Mycobacterium bovis subsp bovis AF2122/97
gcuggaccacucgccggcg

SEQ ID NO: 3162382 - RNA, 24 nt, Mycobacterium bovis subsp bovis AF2122/97
gcuggaccacucgccggcggacgc

SEQ ID NO: 3162383 - RNA, 14 nt, Mycobacterium bovis subsp bovis AF2122/97
gcuggacccgcaug

SEQ ID NO: 3162384 - RNA, 19 nt, Mycobacterium bovis subsp bovis AF2122/97
gcuggaccuccgacgugcc

SEQ ID NO: 3162385 - RNA, 22 nt, Mycobacterium bovis subsp bovis AF2122/97
gcuggaccugaugagcucaccg

SEQ ID NO: 3162386 - RNA, 21 nt, Mycobacterium bovis subsp bovis AF2122/97
gcuggacggccuccaucgcga

SEQ ID NO: 3162387 - RNA, 21 nt, Mycobacterium bovis subsp bovis AF2122/97
gcuggacuaucgccgcgcguc

SEQ ID NO: 3162388 - RNA, 18 nt, Mycobacterium bovis subsp bovis AF2122/97
gcuggacuccggucagcg

SEQ ID NO: 3162389 - RNA, 16 nt, Mycobacterium bovis subsp bovis AF2122/97
gcuggaggccaccacc

SEQ ID NO: 3162390 - RNA, 21 nt, Mycobacterium bovis subsp bovis AF2122/97
gcuggaggcgaucugcuacca

SEQ ID NO: 3162391 - RNA, 20 nt, Mycobacterium bovis subsp bovis AF2122/97
gcuggaggugaacucguuca

SEQ ID NO: 3162392 - RNA, 16 nt, Mycobacterium bovis subsp bovis AF2122/97
gcuggaguaggugugc

SEQ ID NO: 3162393 - RNA, 19 nt, Mycobacterium bovis subsp bovis AF2122/97
gcuggaguaggugugcggg

SEQ ID NO: 3162394 - RNA, 14 nt, Mycobacterium bovis subsp bovis AF2122/97
gcuggaucaacccg

SEQ ID NO: 3162395 - RNA, 18 nt, Mycobacterium bovis subsp bovis AF2122/97
gcuggaucaacccggccu

SEQ ID NO: 3162396 - RNA, 21 nt, Mycobacterium bovis subsp bovis AF2122/97
gcuggaucaacccggccuucu

SEQ ID NO: 3162397 - RNA, 17 nt, Mycobacterium bovis subsp bovis AF2122/97
gcuggaucucguuggug

SEQ ID NO: 3162398 - RNA, 23 nt, Mycobacterium bovis subsp bovis AF2122/97
gcuggaucuucgacaggccaccg

SEQ ID NO: 3162399 - RNA, 18 nt, Mycobacterium bovis subsp bovis AF2122/97
gcuggauguaguuggcga

SEQ ID NO: 3162400 - RNA, 22 nt, Mycobacterium bovis subsp bovis AF2122/97
gcuggauguaguuggcgaccug

SEQ ID NO: 3162401 - RNA, 21 nt, Mycobacterium bovis subsp bovis AF2122/97
gcuggaugucgucgacgauca

SEQ ID NO: 3162402 - RNA, 18 nt, Mycobacterium bovis subsp bovis AF2122/97
gcuggaugugggcgcucg

SEQ ID NO: 3162403 - RNA, 22 nt, Mycobacterium bovis subsp bovis AF2122/97
gcuggcaacgccgcgccguucc

SEQ ID NO: 3162404 - RNA, 19 nt, Mycobacterium bovis subsp bovis AF2122/97
gcuggcaaucccgcggucg

SEQ ID NO: 3162405 - RNA, 18 nt, Mycobacterium bovis subsp bovis AF2122/97
gcuggcaccagcacacuc

SEQ ID NO: 3162406 - RNA, 14 nt, Mycobacterium bovis subsp bovis AF2122/97
gcuggcagacucga

SEQ ID NO: 3162407 - RNA, 20 nt, Mycobacterium bovis subsp bovis AF2122/97
gcuggcagcuccucgcgcuc

SEQ ID NO: 3162408 - RNA, 23 nt, Mycobacterium bovis subsp bovis AF2122/97
gcuggcauaucccuugccguccu

SEQ ID NO: 3162409 - RNA, 17 nt, Mycobacterium bovis subsp bovis AF2122/97
gcuggcaucccgggcag

SEQ ID NO: 3162410 - RNA, 18 nt, Mycobacterium bovis subsp bovis AF2122/97
gcuggcaugccggcgugc

SEQ ID NO: 3162411 - RNA, 19 nt, Mycobacterium bovis subsp bovis AF2122/97
gcuggccaccgcaucgccg

SEQ ID NO: 3162412 - RNA, 21 nt, Mycobacterium bovis subsp bovis AF2122/97
gcuggccaccgcaucgccgaa

SEQ ID NO: 3162413 - RNA, 16 nt, Mycobacterium bovis subsp bovis AF2122/97
gcuggccacgauccgc

SEQ ID NO: 3162414 - RNA, 23 nt, Mycobacterium bovis subsp bovis AF2122/97
gcuggccacucacauuggccagg

SEQ ID NO: 3162415 - RNA, 12 nt, Mycobacterium bovis subsp bovis AF2122/97
gcuggccagcac

SEQ ID NO: 3162416 - RNA, 16 nt, Mycobacterium bovis subsp bovis AF2122/97
gcuggccagcacaccg

SEQ ID NO: 3162417 - RNA, 18 nt, Mycobacterium bovis subsp bovis AF2122/97
gcuggccagcacaccguc

SEQ ID NO: 3162418 - RNA, 23 nt, Mycobacterium bovis subsp bovis AF2122/97
gcuggccagcacaccgucgacga

SEQ ID NO: 3162419 - RNA, 12 nt, Mycobacterium bovis subsp bovis AF2122/97
gcuggccagcgc

SEQ ID NO: 3162420 - RNA, 14 nt, Mycobacterium bovis subsp bovis AF2122/97
gcuggccagcgcgc

SEQ ID NO: 3162421 - RNA, 15 nt, Mycobacterium bovis subsp bovis AF2122/97
gcuggccagcgcgcu

SEQ ID NO: 3162422 - RNA, 18 nt, Mycobacterium bovis subsp bovis AF2122/97
gcuggccagcugcggcuc

SEQ ID NO: 3162423 - RNA, 20 nt, Mycobacterium bovis subsp bovis AF2122/97
gcuggccagguugccgucgg

SEQ ID NO: 3162424 - RNA, 21 nt, Mycobacterium bovis subsp bovis AF2122/97
gcuggccagguugccgucggc

SEQ ID NO: 3162425 - RNA, 14 nt, Mycobacterium bovis subsp bovis AF2122/97
gcuggcccaacauc

SEQ ID NO: 3162426 - RNA, 21 nt, Mycobacterium bovis subsp bovis AF2122/97
gcuggcccaauugcgccgagc

SEQ ID NO: 3162427 - RNA, 12 nt, Mycobacterium bovis subsp bovis AF2122/97
gcuggcccagcg

SEQ ID NO: 3162428 - RNA, 20 nt, Mycobacterium bovis subsp bovis AF2122/97
gcuggcccgaaucucgcccc

SEQ ID NO: 3162429 - RNA, 21 nt, Mycobacterium bovis subsp bovis AF2122/97
gcuggcccgaaucucgccccc

SEQ ID NO: 3162430 - RNA, 18 nt, Mycobacterium bovis subsp bovis AF2122/97
gcuggcccgcacgaaccg

SEQ ID NO: 3162431 - RNA, 12 nt, Mycobacterium bovis subsp bovis AF2122/97
gcuggcccgcau

SEQ ID NO: 3162432 - RNA, 16 nt, Mycobacterium bovis subsp bovis AF2122/97
gcuggcccgcaugccg

SEQ ID NO: 3162433 - RNA, 18 nt, Mycobacterium bovis subsp bovis AF2122/97
gcuggcccgcaugccggc

SEQ ID NO: 3162434 - RNA, 20 nt, Mycobacterium bovis subsp bovis AF2122/97
gcuggcccgccagaacggcg

SEQ ID NO: 3162435 - RNA, 23 nt, Mycobacterium bovis subsp bovis AF2122/97
gcuggcccgcucauaccgggagg

SEQ ID NO: 3162436 - RNA, 16 nt, Mycobacterium bovis subsp bovis AF2122/97
gcugggcgccaccauc

SEQ ID NO: 3162437 - RNA, 23 nt, Mycobacterium bovis subsp bovis AF2122/97
gcugggcgccaugcgccaacccg

SEQ ID NO: 3162438 - RNA, 16 nt, Mycobacterium bovis subsp bovis AF2122/97
gcugggcgccgcgcuc

SEQ ID NO: 3162439 - RNA, 23 nt, Mycobacterium bovis subsp bovis AF2122/97
gcugggcgcgcucaucgaccggg

SEQ ID NO: 3162440 - RNA, 22 nt, Mycobacterium bovis subsp bovis AF2122/97
gcugggcgguagcuuccgcgac

SEQ ID NO: 3162441 - RNA, 22 nt, Mycobacterium bovis subsp bovis AF2122/97
gcugggcggucggaaugccguc

SEQ ID NO: 3162442 - RNA, 21 nt, Mycobacterium bovis subsp bovis AF2122/97
gcugggcugauggacggugcg

SEQ ID NO: 3162443 - RNA, 17 nt, Mycobacterium bovis subsp bovis AF2122/97
gcugggcuucgagugcg

SEQ ID NO: 3162444 - RNA, 20 nt, Mycobacterium bovis subsp bovis AF2122/97
gcuggggccccgcgccggcc

SEQ ID NO: 3162445 - RNA, 14 nt, Mycobacterium bovis subsp bovis AF2122/97
gcuggggcgcccga

SEQ ID NO: 3162446 - RNA, 19 nt, Mycobacterium bovis subsp bovis AF2122/97
gcugggggauaccgcuggg

SEQ ID NO: 3162447 - RNA, 21 nt, Mycobacterium bovis subsp bovis AF2122/97
gcugggggauaccgcuggguc

SEQ ID NO: 3162448 - RNA, 22 nt, Mycobacterium bovis subsp bovis AF2122/97
gcuggggucaaagcacucguag

SEQ ID NO: 3162449 - RNA, 16 nt, Mycobacterium bovis subsp bovis AF2122/97
gcugggguccgcgucg

SEQ ID NO: 3162450 - RNA, 18 nt, Mycobacterium bovis subsp bovis AF2122/97
gcugggguccgcgucggc

SEQ ID NO: 3162451 - RNA, 18 nt, Mycobacterium bovis subsp bovis AF2122/97
gcuggguaugcacccagg

SEQ ID NO: 3162452 - RNA, 20 nt, Mycobacterium bovis subsp bovis AF2122/97
gcugggucagguugucggcg

SEQ ID NO: 3162453 - RNA, 13 nt, Mycobacterium bovis subsp bovis AF2122/97
gcugggucgccgu

SEQ ID NO: 3162454 - RNA, 14 nt, Mycobacterium bovis subsp bovis AF2122/97
gcugggugcgcgaa

SEQ ID NO: 3162455 - RNA, 20 nt, Mycobacterium bovis subsp bovis AF2122/97
gcuggguggccaaccaaccg

SEQ ID NO: 3162456 - RNA, 15 nt, Mycobacterium bovis subsp bovis AF2122/97
gcuggguggccccuu

SEQ ID NO: 3162457 - RNA, 21 nt, Mycobacterium bovis subsp bovis AF2122/97
gcugguaggucaccggucacc

SEQ ID NO: 3162458 - RNA, 20 nt, Mycobacterium bovis subsp bovis AF2122/97
gcugguauagcucacggugg

SEQ ID NO: 3162459 - RNA, 23 nt, Mycobacterium bovis subsp bovis AF2122/97
gcugguaucgagcaccccgacgu

SEQ ID NO: 3162460 - RNA, 21 nt, Mycobacterium bovis subsp bovis AF2122/97
gcuggucaagaaaggcaaccg

SEQ ID NO: 3162461 - RNA, 17 nt, Mycobacterium bovis subsp bovis AF2122/97
gcuggucaccaucaccg

SEQ ID NO: 3162462 - RNA, 15 nt, Mycobacterium bovis subsp bovis AF2122/97
gcuggucagcggcgc

SEQ ID NO: 3162463 - RNA, 15 nt, Mycobacterium bovis subsp bovis AF2122/97
gcuggucagguaucg

SEQ ID NO: 3162464 - RNA, 18 nt, Mycobacterium bovis subsp bovis AF2122/97
gcuggucagguaucgggg

SEQ ID NO: 3162465 - RNA, 14 nt, Mycobacterium bovis subsp bovis AF2122/97
gcuggucccacacc

SEQ ID NO: 3162466 - RNA, 23 nt, Mycobacterium bovis subsp bovis AF2122/97
gcugguccuccaaggcggucacc

SEQ ID NO: 3162467 - RNA, 21 nt, Mycobacterium bovis subsp bovis AF2122/97
gcugguccuccuucgguggug

SEQ ID NO: 3162468 - RNA, 22 nt, Mycobacterium bovis subsp bovis AF2122/97
gcugguccuccuucgguggugg

SEQ ID NO: 3162469 - RNA, 13 nt, Mycobacterium bovis subsp bovis AF2122/97
gcuggucgagcag

SEQ ID NO: 3162470 - RNA, 12 nt, Mycobacterium bovis subsp bovis AF2122/97
gcuggucgaugg

SEQ ID NO: 3162471 - RNA, 12 nt, Mycobacterium bovis subsp bovis AF2122/97
gcuggucgccgc

SEQ ID NO: 3162472 - RNA, 14 nt, Mycobacterium bovis subsp bovis AF2122/97
gcuggucgccgcgg

SEQ ID NO: 3162473 - RNA, 15 nt, Mycobacterium bovis subsp bovis AF2122/97
gcuggucgccgcggc

SEQ ID NO: 3162474 - RNA, 18 nt, Mycobacterium bovis subsp bovis AF2122/97
gcuggucgccgcggcagc

SEQ ID NO: 3162475 - RNA, 13 nt, Mycobacterium bovis subsp bovis AF2122/97
gcuggucgccguc

SEQ ID NO: 3162476 - RNA, 15 nt, Mycobacterium bovis subsp bovis AF2122/97
gcuggucgccgucga

SEQ ID NO: 3162477 - RNA, 20 nt, Mycobacterium bovis subsp bovis AF2122/97
gcuggucgccgucgaagcgg

SEQ ID NO: 3162478 - RNA, 16 nt, Mycobacterium bovis subsp bovis AF2122/97
gcuggucgcgguggcg

SEQ ID NO: 3162479 - RNA, 14 nt, Mycobacterium bovis subsp bovis AF2122/97
gcuggucggagacc

SEQ ID NO: 3162480 - RNA, 20 nt, Mycobacterium bovis subsp bovis AF2122/97
gcuggucggcuaccgccgac

SEQ ID NO: 3162481 - RNA, 13 nt, Mycobacterium bovis subsp bovis AF2122/97
gcuggucggucaa

SEQ ID NO: 3162482 - RNA, 14 nt, Mycobacterium bovis subsp bovis AF2122/97
gcuggucgugggcc

SEQ ID NO: 3162483 - RNA, 20 nt, Mycobacterium bovis subsp bovis AF2122/97
gcuggucuacccgcggcgcg

SEQ ID NO: 3162484 - RNA, 18 nt, Mycobacterium bovis subsp bovis AF2122/97
gcuggugaucugcugggc

SEQ ID NO: 3162485 - RNA, 19 nt, Mycobacterium bovis subsp bovis AF2122/97
gcuggugauucgcagccga

SEQ ID NO: 3162486 - RNA, 21 nt, Mycobacterium bovis subsp bovis AF2122/97
gcuggugcagaauucggcgcg

SEQ ID NO: 3162487 - RNA, 15 nt, Mycobacterium bovis subsp bovis AF2122/97
gcuggugccaacugc

SEQ ID NO: 3162488 - RNA, 17 nt, Mycobacterium bovis subsp bovis AF2122/97
gcuggugccaacugcgc

SEQ ID NO: 3162489 - RNA, 18 nt, Mycobacterium bovis subsp bovis AF2122/97
gcuggugcgcccaucaug

SEQ ID NO: 3162490 - RNA, 12 nt, Mycobacterium bovis subsp bovis AF2122/97
gcugguggcggc

SEQ ID NO: 3162491 - RNA, 18 nt, Mycobacterium bovis subsp bovis AF2122/97
gcugguggcggcgacacg

SEQ ID NO: 3162492 - RNA, 20 nt, Mycobacterium bovis subsp bovis AF2122/97
gcugguggcggcgacacgcc

SEQ ID NO: 3162493 - RNA, 12 nt, Mycobacterium bovis subsp bovis AF2122/97
gcugguggcggu

SEQ ID NO: 3162494 - RNA, 16 nt, Mycobacterium bovis subsp bovis AF2122/97
gcugguggcggucacc

SEQ ID NO: 3162495 - RNA, 18 nt, Mycobacterium bovis subsp bovis AF2122/97
gcuggugggacgcggccg

SEQ ID NO: 3162496 - RNA, 19 nt, Mycobacterium bovis subsp bovis AF2122/97
gcuggugggacgcggccga

SEQ ID NO: 3162497 - RNA, 19 nt, Mycobacterium bovis subsp bovis AF2122/97
gcuggugggggagcggccg

SEQ ID NO: 3162498 - RNA, 13 nt, Mycobacterium bovis subsp bovis AF2122/97
gcuggugguaucg

SEQ ID NO: 3162499 - RNA, 16 nt, Mycobacterium bovis subsp bovis AF2122/97
gcugguggugcgugga

SEQ ID NO: 3162500 - RNA, 14 nt, Mycobacterium bovis subsp bovis AF2122/97
gcugguguccagcc

SEQ ID NO: 3162501 - RNA, 15 nt, Mycobacterium bovis subsp bovis AF2122/97
gcugguguccagcca

SEQ ID NO: 3162502 - RNA, 17 nt, Mycobacterium bovis subsp bovis AF2122/97
gcugguguccagccagg

SEQ ID NO: 3162503 - RNA, 16 nt, Mycobacterium bovis subsp bovis AF2122/97
gcuggugucggcucga

SEQ ID NO: 3162504 - RNA, 16 nt, Mycobacterium bovis subsp bovis AF2122/97
gcuggugugucccggg

SEQ ID NO: 3162505 - RNA, 13 nt, Mycobacterium bovis subsp bovis AF2122/97
gcugguucaacac

SEQ ID NO: 3162506 - RNA, 21 nt, Mycobacterium bovis subsp bovis AF2122/97
gcugguugaacauguccagug

SEQ ID NO: 3162507 - RNA, 14 nt, Mycobacterium bovis subsp bovis AF2122/97
gcugguugaccgag

SEQ ID NO: 3162508 - RNA, 14 nt, Mycobacterium bovis subsp bovis AF2122/97
gcugguuggcgccg

SEQ ID NO: 3162509 - RNA, 16 nt, Mycobacterium bovis subsp bovis AF2122/97
gcuguaacacccggcc

SEQ ID NO: 3162510 - RNA, 18 nt, Mycobacterium bovis subsp bovis AF2122/97
gcuguaacacccggccgc

SEQ ID NO: 3162511 - RNA, 23 nt, Mycobacterium bovis subsp bovis AF2122/97
gcuguaacacccggccgccgaaa

SEQ ID NO: 3162512 - RNA, 20 nt, Mycobacterium bovis subsp bovis AF2122/97
gcuguacaacgccgucgucg

SEQ ID NO: 3162513 - RNA, 22 nt, Mycobacterium bovis subsp bovis AF2122/97
gcuguacccgaccagcaccaga

SEQ ID NO: 3162514 - RNA, 18 nt, Mycobacterium bovis subsp bovis AF2122/97
gcuguaccuccaggaucg

SEQ ID NO: 3162515 - RNA, 19 nt, Mycobacterium bovis subsp bovis AF2122/97
gcuguacugccccagcaca

SEQ ID NO: 3162516 - RNA, 17 nt, Mycobacterium bovis subsp bovis AF2122/97
gcuguacugcggugcca

SEQ ID NO: 3162517 - RNA, 20 nt, Mycobacterium bovis subsp bovis AF2122/97
gcuguaggccagcccggcgu

SEQ ID NO: 3162518 - RNA, 13 nt, Mycobacterium bovis subsp bovis AF2122/97
gcuguaggcgacc

SEQ ID NO: 3162519 - RNA, 20 nt, Mycobacterium bovis subsp bovis AF2122/97
gcuguaggcgauaucgcccg

SEQ ID NO: 3162520 - RNA, 17 nt, Mycobacterium bovis subsp bovis AF2122/97
gcuguagucgcgccucg

SEQ ID NO: 3162521 - RNA, 23 nt, Mycobacterium bovis subsp bovis AF2122/97
gcuguauuucaauucucgagcaa

SEQ ID NO: 3162522 - RNA, 18 nt, Mycobacterium bovis subsp bovis AF2122/97
gcuuagcgcgaaagcgcc

SEQ ID NO: 3162523 - RNA, 18 nt, Mycobacterium bovis subsp bovis AF2122/97
gcuuagcgcgggccuggc

SEQ ID NO: 3162524 - RNA, 20 nt, Mycobacterium bovis subsp bovis AF2122/97
gcuuagcugccgucggugcc

SEQ ID NO: 3162525 - RNA, 19 nt, Mycobacterium bovis subsp bovis AF2122/97
gcuuagggcgcccgccccg

SEQ ID NO: 3162526 - RNA, 15 nt, Mycobacterium bovis subsp bovis AF2122/97
gcuuaugcacgacgg

SEQ ID NO: 3162527 - RNA, 20 nt, Mycobacterium bovis subsp bovis AF2122/97
gcuuaugcgucugcucgccc

SEQ ID NO: 3162528 - RNA, 21 nt, Mycobacterium bovis subsp bovis AF2122/97
gcuuaugcgucugcucgccgg

SEQ ID NO: 3162529 - RNA, 13 nt, Mycobacterium bovis subsp bovis AF2122/97
gcuucaacaccgg

SEQ ID NO: 3162530 - RNA, 18 nt, Mycobacterium bovis subsp bovis AF2122/97
gcuucaacaccggcaucg

SEQ ID NO: 3162531 - RNA, 22 nt, Mycobacterium bovis subsp bovis AF2122/97
gcuucaagauuaccgaagcccg

SEQ ID NO: 3162532 - RNA, 12 nt, Mycobacterium bovis subsp bovis AF2122/97
gcuucaaugucg

SEQ ID NO: 3162533 - RNA, 15 nt, Mycobacterium bovis subsp bovis AF2122/97
gcuucacagccacca

SEQ ID NO: 3162534 - RNA, 19 nt, Mycobacterium bovis subsp bovis AF2122/97
gcuucacagccaccagccg

SEQ ID NO: 3162535 - RNA, 24 nt, Mycobacterium bovis subsp bovis AF2122/97
gcuucacagccaccagccgggcaa

SEQ ID NO: 3162536 - RNA, 18 nt, Mycobacterium bovis subsp bovis AF2122/97
gcuucacccaaccccgcc

SEQ ID NO: 3162537 - RNA, 21 nt, Mycobacterium bovis subsp bovis AF2122/97
gcuucacgggccguccaggac

SEQ ID NO: 3162538 - RNA, 14 nt, Mycobacterium bovis subsp bovis AF2122/97
gcuucagcacgcgg

SEQ ID NO: 3162539 - RNA, 16 nt, Mycobacterium bovis subsp bovis AF2122/97
gcuucaggcaucaccg

SEQ ID NO: 3162540 - RNA, 16 nt, Mycobacterium bovis subsp bovis AF2122/97
gcuucaucuggcgccg

SEQ ID NO: 3162541 - RNA, 16 nt, Mycobacterium bovis subsp bovis AF2122/97
gcuuccaacaccaacg

SEQ ID NO: 3162542 - RNA, 17 nt, Mycobacterium bovis subsp bovis AF2122/97
gcuuccaacucggcggc

SEQ ID NO: 3162543 - RNA, 12 nt, Mycobacterium bovis subsp bovis AF2122/97
gcuuccagcauc

SEQ ID NO: 3162544 - RNA, 15 nt, Mycobacterium bovis subsp bovis AF2122/97
gcuuccagcaucagu

SEQ ID NO: 3162545 - RNA, 16 nt, Mycobacterium bovis subsp bovis AF2122/97
gcuuccagccacagcc

SEQ ID NO: 3162546 - RNA, 19 nt, Mycobacterium bovis subsp bovis AF2122/97
gcuuccauaacgacucgcg

SEQ ID NO: 3162547 - RNA, 17 nt, Mycobacterium bovis subsp bovis AF2122/97
gcuuccaucgccacugu

SEQ ID NO: 3162548 - RNA, 14 nt, Mycobacterium bovis subsp bovis AF2122/97
gcuucccccggucc

SEQ ID NO: 3162549 - RNA, 20 nt, Mycobacterium bovis subsp bovis AF2122/97
gcuuccccgguagcguucgg

SEQ ID NO: 3162550 - RNA, 14 nt, Mycobacterium bovis subsp bovis AF2122/97
gcuucccgcuggug

SEQ ID NO: 3162551 - RNA, 16 nt, Mycobacterium bovis subsp bovis AF2122/97
gcuucccggaagcgcc

SEQ ID NO: 3162552 - RNA, 23 nt, Mycobacterium bovis subsp bovis AF2122/97
gcuuccgcgacgcucgcugcagc

SEQ ID NO: 3162553 - RNA, 10 nt, Mycobacterium bovis subsp bovis AF2122/97
gcuuccgcgc

SEQ ID NO: 3162554 - RNA, 20 nt, Mycobacterium bovis subsp bovis AF2122/97
gcuuccgcugaacaccgugg

SEQ ID NO: 3162555 - RNA, 18 nt, Mycobacterium bovis subsp bovis AF2122/97
gcuuccgggacuaccacc

SEQ ID NO: 3162556 - RNA, 20 nt, Mycobacterium bovis subsp bovis AF2122/97
gcuuccgggacuaccacccg

SEQ ID NO: 3162557 - RNA, 15 nt, Mycobacterium bovis subsp bovis AF2122/97
gcuuccgguccagcg

SEQ ID NO: 3162558 - RNA, 17 nt, Mycobacterium bovis subsp bovis AF2122/97
gcuuccgguccagcggc

SEQ ID NO: 3162559 - RNA, 20 nt, Mycobacterium bovis subsp bovis AF2122/97
gcuuccgguccagcggccgc

SEQ ID NO: 3162560 - RNA, 23 nt, Mycobacterium bovis subsp bovis AF2122/97
gcuuccgguccagcggccgccgc

SEQ ID NO: 3162561 - RNA, 15 nt, Mycobacterium bovis subsp bovis AF2122/97
gcuuccucgcgagcu

SEQ ID NO: 3162562 - RNA, 17 nt, Mycobacterium bovis subsp bovis AF2122/97
gcuucgaagcgaucgcc

SEQ ID NO: 3162563 - RNA, 19 nt, Mycobacterium bovis subsp bovis AF2122/97
gcuucgaagcgaucgccgg

SEQ ID NO: 3162564 - RNA, 18 nt, Mycobacterium bovis subsp bovis AF2122/97
gcuucgaccaucaccacg

SEQ ID NO: 3162565 - RNA, 15 nt, Mycobacterium bovis subsp bovis AF2122/97
gcuucgaccguggug

SEQ ID NO: 3162566 - RNA, 15 nt, Mycobacterium bovis subsp bovis AF2122/97
gcuucgacggcggcc

SEQ ID NO: 3162567 - RNA, 13 nt, Mycobacterium bovis subsp bovis AF2122/97
gcuucgagcaccg

SEQ ID NO: 3162568 - RNA, 18 nt, Mycobacterium bovis subsp bovis AF2122/97
gcuucgagguggcugcgc

SEQ ID NO: 3162569 - RNA, 20 nt, Mycobacterium bovis subsp bovis AF2122/97
gcuucgagguggcugcgccg

SEQ ID NO: 3162570 - RNA, 18 nt, Mycobacterium bovis subsp bovis AF2122/97
gcuucgaguuuggcgacg

SEQ ID NO: 3162571 - RNA, 13 nt, Mycobacterium bovis subsp bovis AF2122/97
gcuucgauagaag

SEQ ID NO: 3162572 - RNA, 13 nt, Mycobacterium bovis subsp bovis AF2122/97
gcuucgaugggca

SEQ ID NO: 3162573 - RNA, 19 nt, Mycobacterium bovis subsp bovis AF2122/97
gcuucgcaagucauccagg

SEQ ID NO: 3162574 - RNA, 17 nt, Mycobacterium bovis subsp bovis AF2122/97
gcuucgccaacugcggc

SEQ ID NO: 3162575 - RNA, 16 nt, Mycobacterium bovis subsp bovis AF2122/97
gcuucgccacaccaug

SEQ ID NO: 3162576 - RNA, 17 nt, Mycobacterium bovis subsp bovis AF2122/97
gcuucgcccagagccgc

SEQ ID NO: 3162577 - RNA, 12 nt, Mycobacterium bovis subsp bovis AF2122/97
gcuucgccgagu

SEQ ID NO: 3162578 - RNA, 20 nt, Mycobacterium bovis subsp bovis AF2122/97
gcuucgcgguuggcggcgau

SEQ ID NO: 3162579 - RNA, 14 nt, Mycobacterium bovis subsp bovis AF2122/97
gcuucggagaccgc

SEQ ID NO: 3162580 - RNA, 22 nt, Mycobacterium bovis subsp bovis AF2122/97
gcuucggagaccgccucgucga

SEQ ID NO: 3162581 - RNA, 23 nt, Mycobacterium bovis subsp bovis AF2122/97
gcuucggcaccgacugcugucac

SEQ ID NO: 3162582 - RNA, 21 nt, Mycobacterium bovis subsp bovis AF2122/97
gcuucggcagcucccgccacg

SEQ ID NO: 3162583 - RNA, 15 nt, Mycobacterium bovis subsp bovis AF2122/97
gcuucggccagauca

SEQ ID NO: 3162584 - RNA, 21 nt, Mycobacterium bovis subsp bovis AF2122/97
gcuucggcgagcgcaucggcc

SEQ ID NO: 3162585 - RNA, 12 nt, Mycobacterium bovis subsp bovis AF2122/97
gcuucggcggcc

SEQ ID NO: 3162586 - RNA, 17 nt, Mycobacterium bovis subsp bovis AF2122/97
gcuucggcggccgagcg

SEQ ID NO: 3162587 - RNA, 18 nt, Mycobacterium bovis subsp bovis AF2122/97
gcuucggcggccgagcgc

SEQ ID NO: 3162588 - RNA, 14 nt, Mycobacterium bovis subsp bovis AF2122/97
gcuucggcggucgc

SEQ ID NO: 3162589 - RNA, 17 nt, Mycobacterium bovis subsp bovis AF2122/97
gcuucggcggucgccgc

SEQ ID NO: 3162590 - RNA, 12 nt, Mycobacterium bovis subsp bovis AF2122/97
gcuucggcgucc

SEQ ID NO: 3162591 - RNA, 14 nt, Mycobacterium bovis subsp bovis AF2122/97
gcuucggcgugcgu

SEQ ID NO: 3162592 - RNA, 13 nt, Mycobacterium bovis subsp bovis AF2122/97
gcuucggcuggcg

SEQ ID NO: 3162593 - RNA, 13 nt, Mycobacterium bovis subsp bovis AF2122/97
gcuucggugaccc

SEQ ID NO: 3162594 - RNA, 16 nt, Mycobacterium bovis subsp bovis AF2122/97
gcuucggugagcgggc

SEQ ID NO: 3162595 - RNA, 21 nt, Mycobacterium bovis subsp bovis AF2122/97
gcuucgguucuguuccagaag

SEQ ID NO: 3162596 - RNA, 15 nt, Mycobacterium bovis subsp bovis AF2122/97
gcuucguccaccgcg

SEQ ID NO: 3162597 - RNA, 17 nt, Mycobacterium bovis subsp bovis AF2122/97
gcuucguccaccgcgau

SEQ ID NO: 3162598 - RNA, 23 nt, Mycobacterium bovis subsp bovis AF2122/97
gcuucguccagcgaucccgguga

SEQ ID NO: 3162599 - RNA, 15 nt, Mycobacterium bovis subsp bovis AF2122/97
gcuucgucggccagc

SEQ ID NO: 3162600 - RNA, 17 nt, Mycobacterium bovis subsp bovis AF2122/97
gcuucgucggccagcag

SEQ ID NO: 3162601 - RNA, 20 nt, Mycobacterium bovis subsp bovis AF2122/97
gcuucgucggccagcagcaa

SEQ ID NO: 3162602 - RNA, 16 nt, Mycobacterium bovis subsp bovis AF2122/97
gcuucgucggccggca

SEQ ID NO: 3162603 - RNA, 18 nt, Mycobacterium bovis subsp bovis AF2122/97
gcuucgucggccggcacc

SEQ ID NO: 3162604 - RNA, 19 nt, Mycobacterium bovis subsp bovis AF2122/97
gcuucgucggccggcaccc

SEQ ID NO: 3162605 - RNA, 22 nt, Mycobacterium bovis subsp bovis AF2122/97
gcuucgucggccggcaccccac

SEQ ID NO: 3162606 - RNA, 17 nt, Mycobacterium bovis subsp bovis AF2122/97
gcuucguggcggcgcgc

SEQ ID NO: 3162607 - RNA, 12 nt, Mycobacterium bovis subsp bovis AF2122/97
gcuucuccucca

SEQ ID NO: 3162608 - RNA, 17 nt, Mycobacterium bovis subsp bovis AF2122/97
gcuucuccuccagagac

SEQ ID NO: 3162609 - RNA, 17 nt, Mycobacterium bovis subsp bovis AF2122/97
gcuuggcgcggcccacc

SEQ ID NO: 3162610 - RNA, 13 nt, Mycobacterium bovis subsp bovis AF2122/97
gcuuggcggccag

SEQ ID NO: 3162611 - RNA, 23 nt, Mycobacterium bovis subsp bovis AF2122/97
gcuuggcggccagcgugucccaa

SEQ ID NO: 3162612 - RNA, 13 nt, Mycobacterium bovis subsp bovis AF2122/97
gcuuggcgggacc

SEQ ID NO: 3162613 - RNA, 14 nt, Mycobacterium bovis subsp bovis AF2122/97
gcuuggcgggaccg

SEQ ID NO: 3162614 - RNA, 17 nt, Mycobacterium bovis subsp bovis AF2122/97
gcuuggcgggaccguga

SEQ ID NO: 3162615 - RNA, 13 nt, Mycobacterium bovis subsp bovis AF2122/97
gcuuggcgugacc

SEQ ID NO: 3162616 - RNA, 16 nt, Mycobacterium bovis subsp bovis AF2122/97
gcuuggcgugaccuac

SEQ ID NO: 3162617 - RNA, 17 nt, Mycobacterium bovis subsp bovis AF2122/97
gcuugggauuugggcga

SEQ ID NO: 3162618 - RNA, 13 nt, Mycobacterium bovis subsp bovis AF2122/97
gcuugggccagcg

SEQ ID NO: 3162619 - RNA, 13 nt, Mycobacterium bovis subsp bovis AF2122/97
gcuugggccaggc

SEQ ID NO: 3162620 - RNA, 15 nt, Mycobacterium bovis subsp bovis AF2122/97
gcuugggccaggccc

SEQ ID NO: 3162621 - RNA, 14 nt, Mycobacterium bovis subsp bovis AF2122/97
gcuugggccccuug

SEQ ID NO: 3162622 - RNA, 15 nt, Mycobacterium bovis subsp bovis AF2122/97
gcuugggccggugca

SEQ ID NO: 3162623 - RNA, 13 nt, Mycobacterium bovis subsp bovis AF2122/97
gcuugggccuggg

SEQ ID NO: 3162624 - RNA, 14 nt, Mycobacterium bovis subsp bovis AF2122/97
gcuuggggucaccc

SEQ ID NO: 3162625 - RNA, 16 nt, Mycobacterium bovis subsp bovis AF2122/97
gcuugggguugggcgg

SEQ ID NO: 3162626 - RNA, 23 nt, Mycobacterium bovis subsp bovis AF2122/97
gcuugggugccucgccaaccuuu

SEQ ID NO: 3162627 - RNA, 21 nt, Mycobacterium bovis subsp bovis AF2122/97
gcuuggucaaaaagcucggcc

SEQ ID NO: 3162628 - RNA, 19 nt, Mycobacterium bovis subsp bovis AF2122/97
gcuuggucgccaugucggc

SEQ ID NO: 3162629 - RNA, 18 nt, Mycobacterium bovis subsp bovis AF2122/97
gcuuggucgcccagccac

SEQ ID NO: 3162630 - RNA, 16 nt, Mycobacterium bovis subsp bovis AF2122/97
gcuuggucgccgggca

SEQ ID NO: 3162631 - RNA, 17 nt, Mycobacterium bovis subsp bovis AF2122/97
gcuuggucgccgggcag

SEQ ID NO: 3162632 - RNA, 19 nt, Mycobacterium bovis subsp bovis AF2122/97
gcuuggugaaccgcgcggc

SEQ ID NO: 3162633 - RNA, 22 nt, Mycobacterium bovis subsp bovis AF2122/97
gcuuggugaacguuuccagcug

SEQ ID NO: 3162634 - RNA, 19 nt, Mycobacterium bovis subsp bovis AF2122/97
gcuuggugcccaaggcaga

SEQ ID NO: 3162635 - RNA, 15 nt, Mycobacterium bovis subsp bovis AF2122/97
gcuuggugcccagcg

SEQ ID NO: 3162636 - RNA, 19 nt, Mycobacterium bovis subsp bovis AF2122/97
gcuugguggcguggcccuc

SEQ ID NO: 3162637 - RNA, 15 nt, Mycobacterium bovis subsp bovis AF2122/97
gcuugucagccgcga

SEQ ID NO: 3162638 - RNA, 16 nt, Mycobacterium bovis subsp bovis AF2122/97
gcuuguccaccgugcg

SEQ ID NO: 3162639 - RNA, 21 nt, Mycobacterium bovis subsp bovis AF2122/97
gcuuguccggugguggcgacc

SEQ ID NO: 3162640 - RNA, 20 nt, Mycobacterium bovis subsp bovis AF2122/97
gcuuguccgugagcaguucg

SEQ ID NO: 3162641 - RNA, 14 nt, Mycobacterium bovis subsp bovis AF2122/97
gcuugucgaccacg

SEQ ID NO: 3162642 - RNA, 15 nt, Mycobacterium bovis subsp bovis AF2122/97
gcuugucgaccacga

SEQ ID NO: 3162643 - RNA, 19 nt, Mycobacterium bovis subsp bovis AF2122/97
gcuugucgaccacgaccgu

SEQ ID NO: 3162644 - RNA, 15 nt, Mycobacterium bovis subsp bovis AF2122/97
gcuugucgccccaug

SEQ ID NO: 3162645 - RNA, 18 nt, Mycobacterium bovis subsp bovis AF2122/97
gcuugucgccccaugcgg

SEQ ID NO: 3162646 - RNA, 13 nt, Mycobacterium bovis subsp bovis AF2122/97
gcuugucgccgcg

SEQ ID NO: 3162647 - RNA, 14 nt, Mycobacterium bovis subsp bovis AF2122/97
gcuugucgcggugc

SEQ ID NO: 3162648 - RNA, 16 nt, Mycobacterium bovis subsp bovis AF2122/97
gcuugucgggcaccgg

SEQ ID NO: 3162649 - RNA, 15 nt, Mycobacterium bovis subsp bovis AF2122/97
gcuugugacaccaca

SEQ ID NO: 3162650 - RNA, 22 nt, Mycobacterium bovis subsp bovis AF2122/97
gcuugugacaccacaucgggcc

SEQ ID NO: 3162651 - RNA, 14 nt, Mycobacterium bovis subsp bovis AF2122/97
gcuuguucaucauc

SEQ ID NO: 3162652 - RNA, 14 nt, Mycobacterium bovis subsp bovis AF2122/97
gcuuguugcagcgg

SEQ ID NO: 3162653 - RNA, 16 nt, Mycobacterium bovis subsp bovis AF2122/97
gcuuguugcgcgacgc

SEQ ID NO: 3162654 - RNA, 20 nt, Mycobacterium bovis subsp bovis AF2122/97
gcuuguugcgcgacgccgcg

SEQ ID NO: 3162655 - RNA, 17 nt, Mycobacterium bovis subsp bovis AF2122/97
gcuuguuuuccaccagc

SEQ ID NO: 3162656 - RNA, 20 nt, Mycobacterium bovis subsp bovis AF2122/97
gcuuuaaccgcgucaucacc

SEQ ID NO: 3162657 - RNA, 22 nt, Mycobacterium bovis subsp bovis AF2122/97
gcuuuaaccgcgucaucaccgg

SEQ ID NO: 3162658 - RNA, 16 nt, Mycobacterium bovis subsp bovis AF2122/97
gcuuuaaucguggcac

SEQ ID NO: 3162659 - RNA, 19 nt, Mycobacterium bovis subsp bovis AF2122/97
gcuuuagugucugcucgcg

SEQ ID NO: 3162660 - RNA, 14 nt, Mycobacterium bovis subsp bovis AF2122/97
gcuuucagcaccgg

SEQ ID NO: 3162661 - RNA, 14 nt, Mycobacterium bovis subsp bovis AF2122/97
gcuuucgaagaacg

SEQ ID NO: 3162662 - RNA, 20 nt, Mycobacterium bovis subsp bovis AF2122/97
gcuuucgagugcagcggcgc

SEQ ID NO: 3162663 - RNA, 22 nt, Mycobacterium bovis subsp bovis AF2122/97
gcuuucgagugcagcggcgcag

SEQ ID NO: 3162664 - RNA, 19 nt, Mycobacterium bovis subsp bovis AF2122/97
gcuuucgauauagccgccg

SEQ ID NO: 3162665 - RNA, 22 nt, Mycobacterium bovis subsp bovis AF2122/97
gcuuucgauauagccgccggug

SEQ ID NO: 3162666 - RNA, 17 nt, Mycobacterium bovis subsp bovis AF2122/97
gcuuucgcgucugcucg

SEQ ID NO: 3162667 - RNA, 20 nt, Mycobacterium bovis subsp bovis AF2122/97
gcuuucgcgugcggcugcca

SEQ ID NO: 3162668 - RNA, 16 nt, Mycobacterium bovis subsp bovis AF2122/97
gcuuucuuggcgggcg

SEQ ID NO: 3162669 - RNA, 20 nt, Mycobacterium bovis subsp bovis AF2122/97
gcuuucuuggcgggcgccuu

SEQ ID NO: 3162670 - RNA, 17 nt, Mycobacterium bovis subsp bovis AF2122/97
gcuuugaauugcgcgcc

SEQ ID NO: 3162671 - RNA, 15 nt, Mycobacterium bovis subsp bovis AF2122/97
gcuuugacgcccggc

SEQ ID NO: 3162672 - RNA, 17 nt, Mycobacterium bovis subsp bovis AF2122/97
gcuuugacgcccucggc

SEQ ID NO: 3162673 - RNA, 18 nt, Mycobacterium bovis subsp bovis AF2122/97
gcuuugacgcccucggcg

SEQ ID NO: 3162674 - RNA, 21 nt, Mycobacterium bovis subsp bovis AF2122/97
gcuuugacgcccucggcgacc

SEQ ID NO: 3162675 - RNA, 14 nt, Mycobacterium bovis subsp bovis AF2122/97
gcuuugagccgcuc

SEQ ID NO: 3162676 - RNA, 20 nt, Mycobacterium bovis subsp bovis AF2122/97
gcuuugagucccgguagacc

SEQ ID NO: 3162677 - RNA, 21 nt, Mycobacterium bovis subsp bovis AF2122/97
gcuuugagucccgguagacca

SEQ ID NO: 3162678 - RNA, 15 nt, Mycobacterium bovis subsp bovis AF2122/97
gcuuugcacagcggc

SEQ ID NO: 3162679 - RNA, 19 nt, Mycobacterium bovis subsp bovis AF2122/97
gcuuugcacagcggcaucg

SEQ ID NO: 3162680 - RNA, 14 nt, Mycobacterium bovis subsp bovis AF2122/97
gcuuugccaacaaa

SEQ ID NO: 3162681 - RNA, 13 nt, Mycobacterium bovis subsp bovis AF2122/97
gcuuugcuugccg

SEQ ID NO: 3162682 - RNA, 24 nt, Mycobacterium bovis subsp bovis AF2122/97
gcuuuggccgccguggcgucggcg

SEQ ID NO: 3162683 - RNA, 16 nt, Mycobacterium bovis subsp bovis AF2122/97
gcuuuggguccgggcg

SEQ ID NO: 3162684 - RNA, 16 nt, Mycobacterium bovis subsp bovis AF2122/97
gcuuuuacgucugcuc

SEQ ID NO: 3162685 - RNA, 20 nt, Mycobacterium bovis subsp bovis AF2122/97
gcuuuugcgucugcucgcca

SEQ ID NO: 3162686 - RNA, 19 nt, Mycobacterium bovis subsp bovis AF2122/97
gcuuuugcgucugcucgcg

SEQ ID NO: 3162687 - RNA, 21 nt, Mycobacterium bovis subsp bovis AF2122/97
gcuuuugcgucugcucgcgca

SEQ ID NO: 3162688 - RNA, 20 nt, Mycobacterium bovis subsp bovis AF2122/97
gcuuuugcgucuucucggcg

SEQ ID NO: 3162689 - RNA, 21 nt, Mycobacterium bovis subsp bovis AF2122/97
ggaaaacugaguugagcgcca

SEQ ID NO: 3162690 - RNA, 20 nt, Mycobacterium bovis subsp bovis AF2122/97
ggaaaaugauagcggcgcag

SEQ ID NO: 3162691 - RNA, 14 nt, Mycobacterium bovis subsp bovis AF2122/97
ggaaacaagcaagc

SEQ ID NO: 3162692 - RNA, 15 nt, Mycobacterium bovis subsp bovis AF2122/97
ggaaacaccggcuug

SEQ ID NO: 3162693 - RNA, 21 nt, Mycobacterium bovis subsp bovis AF2122/97
ggaaacaucguucugacggcu

SEQ ID NO: 3162694 - RNA, 16 nt, Mycobacterium bovis subsp bovis AF2122/97
ggaaaccacagcgcca

SEQ ID NO: 3162695 - RNA, 21 nt, Mycobacterium bovis subsp bovis AF2122/97
ggaaaccaucgccagccggcg

SEQ ID NO: 3162696 - RNA, 23 nt, Mycobacterium bovis subsp bovis AF2122/97
ggaagaaaccgcagucgcggcag

SEQ ID NO: 3162697 - RNA, 21 nt, Mycobacterium bovis subsp bovis AF2122/97
ggaagaacucguugagcagcu

SEQ ID NO: 3162698 - RNA, 18 nt, Mycobacterium bovis subsp bovis AF2122/97
ggaagaccucgaccugga

SEQ ID NO: 3162699 - RNA, 14 nt, Mycobacterium bovis subsp bovis AF2122/97
ggaagacggugcgg

SEQ ID NO: 3162700 - RNA, 20 nt, Mycobacterium bovis subsp bovis AF2122/97
ggaagagccgggcucgucga

SEQ ID NO: 3162701 - RNA, 23 nt, Mycobacterium bovis subsp bovis AF2122/97
ggaagaucaccucccgcggcacc

SEQ ID NO: 3162702 - RNA, 17 nt, Mycobacterium bovis subsp bovis AF2122/97
ggaagcccacgaucgcg

SEQ ID NO: 3162703 - RNA, 21 nt, Mycobacterium bovis subsp bovis AF2122/97
ggaagcccgaugcgccaccgg

SEQ ID NO: 3162704 - RNA, 21 nt, Mycobacterium bovis subsp bovis AF2122/97
ggaagcccggcagaugcagcg

SEQ ID NO: 3162705 - RNA, 11 nt, Mycobacterium bovis subsp bovis AF2122/97
ggaagccgacc

SEQ ID NO: 3162706 - RNA, 16 nt, Mycobacterium bovis subsp bovis AF2122/97
ggaagccgacgaccag

SEQ ID NO: 3162707 - RNA, 17 nt, Mycobacterium bovis subsp bovis AF2122/97
ggaagccgacgaccagc

SEQ ID NO: 3162708 - RNA, 11 nt, Mycobacterium bovis subsp bovis AF2122/97
ggaagccgcac

SEQ ID NO: 3162709 - RNA, 17 nt, Mycobacterium bovis subsp bovis AF2122/97
ggaagccgcaccgcugu

SEQ ID NO: 3162710 - RNA, 17 nt, Mycobacterium bovis subsp bovis AF2122/97
ggaagccugcgggccgg

SEQ ID NO: 3162711 - RNA, 13 nt, Mycobacterium bovis subsp bovis AF2122/97
ggaagcgagcagc

SEQ ID NO: 3162712 - RNA, 15 nt, Mycobacterium bovis subsp bovis AF2122/97
ggaagcgagcagcuc

SEQ ID NO: 3162713 - RNA, 21 nt, Mycobacterium bovis subsp bovis AF2122/97
ggaagcgcaaugcgcgacggu

SEQ ID NO: 3162714 - RNA, 23 nt, Mycobacterium bovis subsp bovis AF2122/97
ggaagcgcaaugcgcgacgguca

SEQ ID NO: 3162715 - RNA, 20 nt, Mycobacterium bovis subsp bovis AF2122/97
ggaagcgccaaacccggcgg

SEQ ID NO: 3162716 - RNA, 16 nt, Mycobacterium bovis subsp bovis AF2122/97
ggaagcgccggccgau

SEQ ID NO: 3162717 - RNA, 13 nt, Mycobacterium bovis subsp bovis AF2122/97
ggaagcggcggcc

SEQ ID NO: 3162718 - RNA, 17 nt, Mycobacterium bovis subsp bovis AF2122/97
ggaagcgguugacccac

SEQ ID NO: 3162719 - RNA, 13 nt, Mycobacterium bovis subsp bovis AF2122/97
ggaagcgugcggu

SEQ ID NO: 3162720 - RNA, 12 nt, Mycobacterium bovis subsp bovis AF2122/97
ggaaggagaucc

SEQ ID NO: 3162721 - RNA, 12 nt, Mycobacterium bovis subsp bovis AF2122/97
ggaaggcgggca

SEQ ID NO: 3162722 - RNA, 18 nt, Mycobacterium bovis subsp bovis AF2122/97
ggaagggcuaucguggcg

SEQ ID NO: 3162723 - RNA, 20 nt, Mycobacterium bovis subsp bovis AF2122/97
ggaaggggcucagcgguggc

SEQ ID NO: 3162724 - RNA, 15 nt, Mycobacterium bovis subsp bovis AF2122/97
ggaaggucagcgccc

SEQ ID NO: 3162725 - RNA, 19 nt, Mycobacterium bovis subsp bovis AF2122/97
ggaaggucgacaugggucg

SEQ ID NO: 3162726 - RNA, 21 nt, Mycobacterium bovis subsp bovis AF2122/97
ggaaggugaucacgucggcgu

SEQ ID NO: 3162727 - RNA, 14 nt, Mycobacterium bovis subsp bovis AF2122/97
ggaagguugaacgc

SEQ ID NO: 3162728 - RNA, 19 nt, Mycobacterium bovis subsp bovis AF2122/97
ggaaguaaggcacgggugu

SEQ ID NO: 3162729 - RNA, 17 nt, Mycobacterium bovis subsp bovis AF2122/97
ggaaguacacggcggcc

SEQ ID NO: 3162730 - RNA, 19 nt, Mycobacterium bovis subsp bovis AF2122/97
ggaaguacgcgacgggccg

SEQ ID NO: 3162731 - RNA, 22 nt, Mycobacterium bovis subsp bovis AF2122/97
ggaaguacuccacccaggccga

SEQ ID NO: 3162732 - RNA, 18 nt, Mycobacterium bovis subsp bovis AF2122/97
ggaaguacuucgcggcgg

SEQ ID NO: 3162733 - RNA, 17 nt, Mycobacterium bovis subsp bovis AF2122/97
ggaaguaucgccggccg

SEQ ID NO: 3162734 - RNA, 19 nt, Mycobacterium bovis subsp bovis AF2122/97
ggaaguccagcuggccggg

SEQ ID NO: 3162735 - RNA, 22 nt, Mycobacterium bovis subsp bovis AF2122/97
ggaagucccgaguggccggugg

SEQ ID NO: 3162736 - RNA, 14 nt, Mycobacterium bovis subsp bovis AF2122/97
ggaagucccgccgu

SEQ ID NO: 3162737 - RNA, 13 nt, Mycobacterium bovis subsp bovis AF2122/97
ggaagucgggccg

SEQ ID NO: 3162738 - RNA, 16 nt, Mycobacterium bovis subsp bovis AF2122/97
ggaagugcggugagau

SEQ ID NO: 3162739 - RNA, 17 nt, Mycobacterium bovis subsp bovis AF2122/97
ggaaguuggcugagcag

SEQ ID NO: 3162740 - RNA, 14 nt, Mycobacterium bovis subsp bovis AF2122/97
ggaauacagcuuga

SEQ ID NO: 3162741 - RNA, 17 nt, Mycobacterium bovis subsp bovis AF2122/97
ggaauacgcgccgccgg

SEQ ID NO: 3162742 - RNA, 15 nt, Mycobacterium bovis subsp bovis AF2122/97
ggaauacgcugcugg

SEQ ID NO: 3162743 - RNA, 23 nt, Mycobacterium bovis subsp bovis AF2122/97
ggaauacgcugcuggucuugccg

SEQ ID NO: 3162744 - RNA, 20 nt, Mycobacterium bovis subsp bovis AF2122/97
ggaauagcaacgcugcggca

SEQ ID NO: 3162745 - RNA, 13 nt, Mycobacterium bovis subsp bovis AF2122/97
ggaauagcggcgc

SEQ ID NO: 3162746 - RNA, 14 nt, Mycobacterium bovis subsp bovis AF2122/97
ggaaucagcacccc

SEQ ID NO: 3162747 - RNA, 21 nt, Mycobacterium bovis subsp bovis AF2122/97
ggaaucagugaagacaccagg

SEQ ID NO: 3162748 - RNA, 21 nt, Mycobacterium bovis subsp bovis AF2122/97
ggaauccgaacucgcgggcga

SEQ ID NO: 3162749 - RNA, 17 nt, Mycobacterium bovis subsp bovis AF2122/97
ggaauccggccagaccc

SEQ ID NO: 3162750 - RNA, 18 nt, Mycobacterium bovis subsp bovis AF2122/97
ggaauccuggccgccgcc

SEQ ID NO: 3162751 - RNA, 14 nt, Mycobacterium bovis subsp bovis AF2122/97
ggaaucgaugaucg

SEQ ID NO: 3162752 - RNA, 15 nt, Mycobacterium bovis subsp bovis AF2122/97
ggaaucgcaccgugu

SEQ ID NO: 3162753 - RNA, 22 nt, Mycobacterium bovis subsp bovis AF2122/97
ggaaucgcgagcuuggccggca

SEQ ID NO: 3162754 - RNA, 18 nt, Mycobacterium bovis subsp bovis AF2122/97
ggaaucgcggagccagga

SEQ ID NO: 3162755 - RNA, 20 nt, Mycobacterium bovis subsp bovis AF2122/97
ggaaucgguuucgaccugcg

SEQ ID NO: 3162756 - RNA, 13 nt, Mycobacterium bovis subsp bovis AF2122/97
ggaaucgucgcgg

SEQ ID NO: 3162757 - RNA, 15 nt, Mycobacterium bovis subsp bovis AF2122/97
ggaaucgucgcggcc

SEQ ID NO: 3162758 - RNA, 20 nt, Mycobacterium bovis subsp bovis AF2122/97
ggaaucgucgcggccgucgc

SEQ ID NO: 3162759 - RNA, 14 nt, Mycobacterium bovis subsp bovis AF2122/97
ggaaugaucggcgu

SEQ ID NO: 3162760 - RNA, 16 nt, Mycobacterium bovis subsp bovis AF2122/97
ggaaugccgucgccgg

SEQ ID NO: 3162761 - RNA, 13 nt, Mycobacterium bovis subsp bovis AF2122/97
ggaaugcuggggc

SEQ ID NO: 3162762 - RNA, 14 nt, Mycobacterium bovis subsp bovis AF2122/97
ggaaugcuggggcc

SEQ ID NO: 3162763 - RNA, 17 nt, Mycobacterium bovis subsp bovis AF2122/97
ggaauggcgccggccgg

SEQ ID NO: 3162764 - RNA, 14 nt, Mycobacterium bovis subsp bovis AF2122/97
ggaauggucccggg

SEQ ID NO: 3162765 - RNA, 11 nt, Mycobacterium bovis subsp bovis AF2122/97
ggaaugucgaa

SEQ ID NO: 3162766 - RNA, 22 nt, Mycobacterium bovis subsp bovis AF2122/97
ggaauguugcgagugagcucag

SEQ ID NO: 3162767 - RNA, 14 nt, Mycobacterium bovis subsp bovis AF2122/97
ggaauucccgcagg

SEQ ID NO: 3162768 - RNA, 19 nt, Mycobacterium bovis subsp bovis AF2122/97
ggaauuccgcuaccgcaca

SEQ ID NO: 3162769 - RNA, 20 nt, Mycobacterium bovis subsp bovis AF2122/97
ggacaaaaucagcagccccc

SEQ ID NO: 3162770 - RNA, 22 nt, Mycobacterium bovis subsp bovis AF2122/97
ggacaaaaucagcagcccccgc

SEQ ID NO: 3162771 - RNA, 20 nt, Mycobacterium bovis subsp bovis AF2122/97
ggacaaagccgaacgacagc

SEQ ID NO: 3162772 - RNA, 15 nt, Mycobacterium bovis subsp bovis AF2122/97
ggacaaagccgucgc

SEQ ID NO: 3162773 - RNA, 21 nt, Mycobacterium bovis subsp bovis AF2122/97
ggacaaagccgucgcgacguc

SEQ ID NO: 3162774 - RNA, 14 nt, Mycobacterium bovis subsp bovis AF2122/97
ggacaaagcugcuc

SEQ ID NO: 3162775 - RNA, 16 nt, Mycobacterium bovis subsp bovis AF2122/97
ggacaaagcugcucgu

SEQ ID NO: 3162776 - RNA, 22 nt, Mycobacterium bovis subsp bovis AF2122/97
ggacaaaucgaugaccgucgca

SEQ ID NO: 3162777 - RNA, 13 nt, Mycobacterium bovis subsp bovis AF2122/97
ggacaacagcaug

SEQ ID NO: 3162778 - RNA, 21 nt, Mycobacterium bovis subsp bovis AF2122/97
ggacaacagcuuggagaucgc

SEQ ID NO: 3162779 - RNA, 17 nt, Mycobacterium bovis subsp bovis AF2122/97
ggacaacccguagggug

SEQ ID NO: 3162780 - RNA, 18 nt, Mycobacterium bovis subsp bovis AF2122/97
ggacaaccgggcgggacu

SEQ ID NO: 3162781 - RNA, 23 nt, Mycobacterium bovis subsp bovis AF2122/97
ggacaaccgggcgggacucggcg

SEQ ID NO: 3162782 - RNA, 15 nt, Mycobacterium bovis subsp bovis AF2122/97
ggacaaccucgucga

SEQ ID NO: 3162783 - RNA, 16 nt, Mycobacterium bovis subsp bovis AF2122/97
ggaccagcaccgccgc

SEQ ID NO: 3162784 - RNA, 18 nt, Mycobacterium bovis subsp bovis AF2122/97
ggaccagcaccgccgcgc

SEQ ID NO: 3162785 - RNA, 20 nt, Mycobacterium bovis subsp bovis AF2122/97
ggaccagcaccgccgcgccg

SEQ ID NO: 3162786 - RNA, 21 nt, Mycobacterium bovis subsp bovis AF2122/97
ggaccagcaccgccgcgccgg

SEQ ID NO: 3162787 - RNA, 22 nt, Mycobacterium bovis subsp bovis AF2122/97
ggaccagcaccgccgcgccggc

SEQ ID NO: 3162788 - RNA, 13 nt, Mycobacterium bovis subsp bovis AF2122/97
ggaccagcgcccc

SEQ ID NO: 3162789 - RNA, 16 nt, Mycobacterium bovis subsp bovis AF2122/97
ggaccagcgccccggc

SEQ ID NO: 3162790 - RNA, 17 nt, Mycobacterium bovis subsp bovis AF2122/97
ggaccagcguggggccg

SEQ ID NO: 3162791 - RNA, 18 nt, Mycobacterium bovis subsp bovis AF2122/97
ggaccagcugccggcgac

SEQ ID NO: 3162792 - RNA, 17 nt, Mycobacterium bovis subsp bovis AF2122/97
ggaccaggccaacggcg

SEQ ID NO: 3162793 - RNA, 16 nt, Mycobacterium bovis subsp bovis AF2122/97
ggaccaggccgcgcgc

SEQ ID NO: 3162794 - RNA, 17 nt, Mycobacterium bovis subsp bovis AF2122/97
ggaccauagccugcgcc

SEQ ID NO: 3162795 - RNA, 16 nt, Mycobacterium bovis subsp bovis AF2122/97
ggaccauagucgccgu

SEQ ID NO: 3162796 - RNA, 17 nt, Mycobacterium bovis subsp bovis AF2122/97
ggaccauagucgccguc

SEQ ID NO: 3162797 - RNA, 19 nt, Mycobacterium bovis subsp bovis AF2122/97
ggaccaucagcgucgacgu

SEQ ID NO: 3162798 - RNA, 22 nt, Mycobacterium bovis subsp bovis AF2122/97
ggaccaucccgccgaucacugu

SEQ ID NO: 3162799 - RNA, 13 nt, Mycobacterium bovis subsp bovis AF2122/97
ggaccaucgccag

SEQ ID NO: 3162800 - RNA, 17 nt, Mycobacterium bovis subsp bovis AF2122/97
ggaccaucgccaggccc

SEQ ID NO: 3162801 - RNA, 22 nt, Mycobacterium bovis subsp bovis AF2122/97
ggaccaucuccggugugaucgg

SEQ ID NO: 3162802 - RNA, 16 nt, Mycobacterium bovis subsp bovis AF2122/97
ggaccauuaccguggg

SEQ ID NO: 3162803 - RNA, 14 nt, Mycobacterium bovis subsp bovis AF2122/97
ggacccacccgcac

SEQ ID NO: 3162804 - RNA, 18 nt, Mycobacterium bovis subsp bovis AF2122/97
ggacccacccgcaccgcc

SEQ ID NO: 3162805 - RNA, 19 nt, Mycobacterium bovis subsp bovis AF2122/97
ggacccacccgcaccgccg

SEQ ID NO: 3162806 - RNA, 21 nt, Mycobacterium bovis subsp bovis AF2122/97
ggacccacccgcaccgccggc

SEQ ID NO: 3162807 - RNA, 19 nt, Mycobacterium bovis subsp bovis AF2122/97
ggacccaccgucacccccg

SEQ ID NO: 3162808 - RNA, 16 nt, Mycobacterium bovis subsp bovis AF2122/97
ggacccagccagcugg

SEQ ID NO: 3162809 - RNA, 24 nt, Mycobacterium bovis subsp bovis AF2122/97
ggacccagccagcuggacuccggu

SEQ ID NO: 3162810 - RNA, 13 nt, Mycobacterium bovis subsp bovis AF2122/97
ggacccagcggcg

SEQ ID NO: 3162811 - RNA, 18 nt, Mycobacterium bovis subsp bovis AF2122/97
ggacccaugagcccguga

SEQ ID NO: 3162812 - RNA, 13 nt, Mycobacterium bovis subsp bovis AF2122/97
ggaccccgccagc

SEQ ID NO: 3162813 - RNA, 18 nt, Mycobacterium bovis subsp bovis AF2122/97
ggaccccgcugcgacguu

SEQ ID NO: 3162814 - RNA, 16 nt, Mycobacterium bovis subsp bovis AF2122/97
ggacccgaccgucguc

SEQ ID NO: 3162815 - RNA, 13 nt, Mycobacterium bovis subsp bovis AF2122/97
ggacccgcagcug

SEQ ID NO: 3162816 - RNA, 16 nt, Mycobacterium bovis subsp bovis AF2122/97
ggacccgcagcugcgg

SEQ ID NO: 3162817 - RNA, 15 nt, Mycobacterium bovis subsp bovis AF2122/97
ggacccgccagggca

SEQ ID NO: 3162818 - RNA, 14 nt, Mycobacterium bovis subsp bovis AF2122/97
ggacccgcccaggc

SEQ ID NO: 3162819 - RNA, 16 nt, Mycobacterium bovis subsp bovis AF2122/97
ggacccgcccuugccg

SEQ ID NO: 3162820 - RNA, 20 nt, Mycobacterium bovis subsp bovis AF2122/97
ggacccgcccuugccgccga

SEQ ID NO: 3162821 - RNA, 21 nt, Mycobacterium bovis subsp bovis AF2122/97
ggacccgcccuugccgccgag

SEQ ID NO: 3162822 - RNA, 15 nt, Mycobacterium bovis subsp bovis AF2122/97
ggacccggaccuucg

SEQ ID NO: 3162823 - RNA, 15 nt, Mycobacterium bovis subsp bovis AF2122/97
ggacccggccggccc

SEQ ID NO: 3162824 - RNA, 16 nt, Mycobacterium bovis subsp bovis AF2122/97
ggacccugcgccgcca

SEQ ID NO: 3162825 - RNA, 15 nt, Mycobacterium bovis subsp bovis AF2122/97
ggaccgaccaccgcg

SEQ ID NO: 3162826 - RNA, 21 nt, Mycobacterium bovis subsp bovis AF2122/97
ggaccgaucuuggccaccgcc

SEQ ID NO: 3162827 - RNA, 18 nt, Mycobacterium bovis subsp bovis AF2122/97
ggaccgaugacgaucggc

SEQ ID NO: 3162828 - RNA, 22 nt, Mycobacterium bovis subsp bovis AF2122/97
ggaccgauggcucacaugcccg

SEQ ID NO: 3162829 - RNA, 22 nt, Mycobacterium bovis subsp bovis AF2122/97
ggaccgcaacgacggccgucgc

SEQ ID NO: 3162830 - RNA, 19 nt, Mycobacterium bovis subsp bovis AF2122/97
ggaccgccccggccaggac

SEQ ID NO: 3162831 - RNA, 20 nt, Mycobacterium bovis subsp bovis AF2122/97
ggaccgccccggccaggaca

SEQ ID NO: 3162832 - RNA, 19 nt, Mycobacterium bovis subsp bovis AF2122/97
ggaccgcgacggcgccggc

SEQ ID NO: 3162833 - RNA, 15 nt, Mycobacterium bovis subsp bovis AF2122/97
ggaccgcgcccagac

SEQ ID NO: 3162834 - RNA, 23 nt, Mycobacterium bovis subsp bovis AF2122/97
ggaccgcgccgaucaccaccggc

SEQ ID NO: 3162835 - RNA, 12 nt, Mycobacterium bovis subsp bovis AF2122/97
ggaccgcgguga

SEQ ID NO: 3162836 - RNA, 24 nt, Mycobacterium bovis subsp bovis AF2122/97
ggaccgcgguggccagaucgaacg

SEQ ID NO: 3162837 - RNA, 22 nt, Mycobacterium bovis subsp bovis AF2122/97
ggaccgcucgaugucccgagcc

SEQ ID NO: 3162838 - RNA, 17 nt, Mycobacterium bovis subsp bovis AF2122/97
ggaccgcucgucgccgg

SEQ ID NO: 3162839 - RNA, 20 nt, Mycobacterium bovis subsp bovis AF2122/97
ggaccgcucgucgccggugg

SEQ ID NO: 3162840 - RNA, 13 nt, Mycobacterium bovis subsp bovis AF2122/97
ggaccgcucugcg

SEQ ID NO: 3162841 - RNA, 19 nt, Mycobacterium bovis subsp bovis AF2122/97
ggaccgcucugcggccacg

SEQ ID NO: 3162842 - RNA, 17 nt, Mycobacterium bovis subsp bovis AF2122/97
ggaccggcaggccggcg

SEQ ID NO: 3162843 - RNA, 15 nt, Mycobacterium bovis subsp bovis AF2122/97
ggaccggccuggcuc

SEQ ID NO: 3162844 - RNA, 14 nt, Mycobacterium bovis subsp bovis AF2122/97
ggaccggcugcagg

SEQ ID NO: 3162845 - RNA, 17 nt, Mycobacterium bovis subsp bovis AF2122/97
ggaccggcuuccccagc

SEQ ID NO: 3162846 - RNA, 11 nt, Mycobacterium bovis subsp bovis AF2122/97
ggaccggucga

SEQ ID NO: 3162847 - RNA, 15 nt, Mycobacterium bovis subsp bovis AF2122/97
ggaccggucgacagc

SEQ ID NO: 3162848 - RNA, 14 nt, Mycobacterium bovis subsp bovis AF2122/97
ggaccggugccagc

SEQ ID NO: 3162849 - RNA, 21 nt, Mycobacterium bovis subsp bovis AF2122/97
ggaccggugugcacgcgggcg

SEQ ID NO: 3162850 - RNA, 15 nt, Mycobacterium bovis subsp bovis AF2122/97
ggaccguccgacggc

SEQ ID NO: 3162851 - RNA, 17 nt, Mycobacterium bovis subsp bovis AF2122/97
ggaccguccgacggcgg

SEQ ID NO: 3162852 - RNA, 16 nt, Mycobacterium bovis subsp bovis AF2122/97
ggaccgucgccgguga

SEQ ID NO: 3162853 - RNA, 19 nt, Mycobacterium bovis subsp bovis AF2122/97
ggaccgucuuuggugccga

SEQ ID NO: 3162854 - RNA, 20 nt, Mycobacterium bovis subsp bovis AF2122/97
ggaccgugacguaucgccgc

SEQ ID NO: 3162855 - RNA, 21 nt, Mycobacterium bovis subsp bovis AF2122/97
ggaccuauuggucgcucgcgg

SEQ ID NO: 3162856 - RNA, 23 nt, Mycobacterium bovis subsp bovis AF2122/97
ggaccuauuggucgcucgcgguc

SEQ ID NO: 3162857 - RNA, 22 nt, Mycobacterium bovis subsp bovis AF2122/97
ggaccuccgacgugcccccgua

SEQ ID NO: 3162858 - RNA, 13 nt, Mycobacterium bovis subsp bovis AF2122/97
ggaccucggcgau

SEQ ID NO: 3162859 - RNA, 15 nt, Mycobacterium bovis subsp bovis AF2122/97
ggaccuggcggcggu

SEQ ID NO: 3162860 - RNA, 18 nt, Mycobacterium bovis subsp bovis AF2122/97
ggacgaaaaaaucgugcg

SEQ ID NO: 3162861 - RNA, 14 nt, Mycobacterium bovis subsp bovis AF2122/97
ggacgaaacgaucg

SEQ ID NO: 3162862 - RNA, 19 nt, Mycobacterium bovis subsp bovis AF2122/97
ggacgaacaacgcgacgaa

SEQ ID NO: 3162863 - RNA, 20 nt, Mycobacterium bovis subsp bovis AF2122/97
ggacgaacaacgcgacgaag

SEQ ID NO: 3162864 - RNA, 15 nt, Mycobacterium bovis subsp bovis AF2122/97
ggacgaacacaccgg

SEQ ID NO: 3162865 - RNA, 16 nt, Mycobacterium bovis subsp bovis AF2122/97
ggacgaacgccgucga

SEQ ID NO: 3162866 - RNA, 14 nt, Mycobacterium bovis subsp bovis AF2122/97
ggacgaacgcgccg

SEQ ID NO: 3162867 - RNA, 19 nt, Mycobacterium bovis subsp bovis AF2122/97
ggacgaagcaccucccgau

SEQ ID NO: 3162868 - RNA, 16 nt, Mycobacterium bovis subsp bovis AF2122/97
ggacgaaucccgcgcc

SEQ ID NO: 3162869 - RNA, 16 nt, Mycobacterium bovis subsp bovis AF2122/97
ggacgaccaugccgau

SEQ ID NO: 3162870 - RNA, 16 nt, Mycobacterium bovis subsp bovis AF2122/97
ggacgucgugaccggc

SEQ ID NO: 3162871 - RNA, 20 nt, Mycobacterium bovis subsp bovis AF2122/97
ggacgugaccagaucgacgc

SEQ ID NO: 3162872 - RNA, 12 nt, Mycobacterium bovis subsp bovis AF2122/97
ggacgugacgau

SEQ ID NO: 3162873 - RNA, 12 nt, Mycobacterium bovis subsp bovis AF2122/97
ggacgugccggg

SEQ ID NO: 3162874 - RNA, 14 nt, Mycobacterium bovis subsp bovis AF2122/97
ggacguggacuuug

SEQ ID NO: 3162875 - RNA, 21 nt, Mycobacterium bovis subsp bovis AF2122/97
ggacguggacuuuggugucgc

SEQ ID NO: 3162876 - RNA, 20 nt, Mycobacterium bovis subsp bovis AF2122/97
ggacgugguguaucgacggc

SEQ ID NO: 3162877 - RNA, 22 nt, Mycobacterium bovis subsp bovis AF2122/97
ggacgugguguaucgacggcgg

SEQ ID NO: 3162878 - RNA, 15 nt, Mycobacterium bovis subsp bovis AF2122/97
ggacguuucagccgg

SEQ ID NO: 3162879 - RNA, 18 nt, Mycobacterium bovis subsp bovis AF2122/97
ggacguuucagccgggug

SEQ ID NO: 3162880 - RNA, 20 nt, Mycobacterium bovis subsp bovis AF2122/97
ggacguuugagaccccaacc

SEQ ID NO: 3162881 - RNA, 17 nt, Mycobacterium bovis subsp bovis AF2122/97
ggacuaccgccggcggc

SEQ ID NO: 3162882 - RNA, 14 nt, Mycobacterium bovis subsp bovis AF2122/97
ggacucacgcagcg

SEQ ID NO: 3162883 - RNA, 15 nt, Mycobacterium bovis subsp bovis AF2122/97
ggacucacgcagcgc

SEQ ID NO: 3162884 - RNA, 14 nt, Mycobacterium bovis subsp bovis AF2122/97
ggacucaucggcgu

SEQ ID NO: 3162885 - RNA, 18 nt, Mycobacterium bovis subsp bovis AF2122/97
ggacuccaaagccgugcc

SEQ ID NO: 3162886 - RNA, 14 nt, Mycobacterium bovis subsp bovis AF2122/97
ggacuccggccgca

SEQ ID NO: 3162887 - RNA, 12 nt, Mycobacterium bovis subsp bovis AF2122/97
ggacucgccgac

SEQ ID NO: 3162888 - RNA, 20 nt, Mycobacterium bovis subsp bovis AF2122/97
ggacucggcggaagaccgga

SEQ ID NO: 3162889 - RNA, 17 nt, Mycobacterium bovis subsp bovis AF2122/97
ggacucgggcaggcccc

SEQ ID NO: 3162890 - RNA, 17 nt, Mycobacterium bovis subsp bovis AF2122/97
ggacucugccacccagc

SEQ ID NO: 3162891 - RNA, 23 nt, Mycobacterium bovis subsp bovis AF2122/97
ggacucugccacccagcacgcgc

SEQ ID NO: 3162892 - RNA, 18 nt, Mycobacterium bovis subsp bovis AF2122/97
ggacugcagcgccucgac

SEQ ID NO: 3162893 - RNA, 13 nt, Mycobacterium bovis subsp bovis AF2122/97
ggacugcagcgcg

SEQ ID NO: 3162894 - RNA, 13 nt, Mycobacterium bovis subsp bovis AF2122/97
ggacugccgcagg

SEQ ID NO: 3162895 - RNA, 14 nt, Mycobacterium bovis subsp bovis AF2122/97
ggacugcgccaccg

SEQ ID NO: 3162896 - RNA, 21 nt, Mycobacterium bovis subsp bovis AF2122/97
ggacugcgccaccggugaggc

SEQ ID NO: 3162897 - RNA, 22 nt, Mycobacterium bovis subsp bovis AF2122/97
ggacugcggcccgacccggccg

SEQ ID NO: 3162898 - RNA, 21 nt, Mycobacterium bovis subsp bovis AF2122/97
ggacuggcaccgccagccacc

SEQ ID NO: 3162899 - RNA, 20 nt, Mycobacterium bovis subsp bovis AF2122/97
ggacugggccaggucggcga

SEQ ID NO: 3162900 - RNA, 18 nt, Mycobacterium bovis subsp bovis AF2122/97
ggacugucccaccaggua

SEQ ID NO: 3162901 - RNA, 18 nt, Mycobacterium bovis subsp bovis AF2122/97
ggacugugggggcgcacc

SEQ ID NO: 3162902 - RNA, 20 nt, Mycobacterium bovis subsp bovis AF2122/97
ggacuucggugagcagggcg

SEQ ID NO: 3162903 - RNA, 22 nt, Mycobacterium bovis subsp bovis AF2122/97
ggacuucggugagcagggcggc

SEQ ID NO: 3162904 - RNA, 22 nt, Mycobacterium bovis subsp bovis AF2122/97
ggacuucguuccgugccgagcu

SEQ ID NO: 3162905 - RNA, 16 nt, Mycobacterium bovis subsp bovis AF2122/97
ggacuugcgagccgua

SEQ ID NO: 3162906 - RNA, 15 nt, Mycobacterium bovis subsp bovis AF2122/97
ggacuuuccggcgca

SEQ ID NO: 3162907 - RNA, 16 nt, Mycobacterium bovis subsp bovis AF2122/97
ggacuuuccggcgcag

SEQ ID NO: 3162908 - RNA, 17 nt, Mycobacterium bovis subsp bovis AF2122/97
ggacuuuggugucgcuc

SEQ ID NO: 3162909 - RNA, 16 nt, Mycobacterium bovis subsp bovis AF2122/97
ggagaaaacggcggcg

SEQ ID NO: 3162910 - RNA, 22 nt, Mycobacterium bovis subsp bovis AF2122/97
ggagaacacgucgacaccgagg

SEQ ID NO: 3162911 - RNA, 20 nt, Mycobacterium bovis subsp bovis AF2122/97
ggagaagauuuucucggugc

SEQ ID NO: 3162912 - RNA, 16 nt, Mycobacterium bovis subsp bovis AF2122/97
ggagaaggcgcgggcg

SEQ ID NO: 3162913 - RNA, 23 nt, Mycobacterium bovis subsp bovis AF2122/97
ggagaauuaguuucguccccaga

SEQ ID NO: 3162914 - RNA, 19 nt, Mycobacterium bovis subsp bovis AF2122/97
ggagacacccgccaggccg

SEQ ID NO: 3162915 - RNA, 22 nt, Mycobacterium bovis subsp bovis AF2122/97
ggagacacccgccaggccgcgc

SEQ ID NO: 3162916 - RNA, 16 nt, Mycobacterium bovis subsp bovis AF2122/97
ggagacaccgcaacgc

SEQ ID NO: 3162917 - RNA, 13 nt, Mycobacterium bovis subsp bovis AF2122/97
ggagaccagcucg

SEQ ID NO: 3162918 - RNA, 14 nt, Mycobacterium bovis subsp bovis AF2122/97
ggagacccgggugc

SEQ ID NO: 3162919 - RNA, 15 nt, Mycobacterium bovis subsp bovis AF2122/97
ggagaccugucggua

SEQ ID NO: 3162920 - RNA, 18 nt, Mycobacterium bovis subsp bovis AF2122/97
ggagacgaucgccaggcc

SEQ ID NO: 3162921 - RNA, 19 nt, Mycobacterium bovis subsp bovis AF2122/97
ggagacgaucgccaggccg

SEQ ID NO: 3162922 - RNA, 15 nt, Mycobacterium bovis subsp bovis AF2122/97
ggagacgcugcgcgc

SEQ ID NO: 3162923 - RNA, 18 nt, Mycobacterium bovis subsp bovis AF2122/97
ggagacguuuugcggccc

SEQ ID NO: 3162924 - RNA, 11 nt, Mycobacterium bovis subsp bovis AF2122/97
ggagagccggu

SEQ ID NO: 3162925 - RNA, 23 nt, Mycobacterium bovis subsp bovis AF2122/97
ggagagccgguagaucagcgccu

SEQ ID NO: 3162926 - RNA, 21 nt, Mycobacterium bovis subsp bovis AF2122/97
ggagagccugcucgcagcggg

SEQ ID NO: 3162927 - RNA, 21 nt, Mycobacterium bovis subsp bovis AF2122/97
ggagauacauuucccagucau

SEQ ID NO: 3162928 - RNA, 14 nt, Mycobacterium bovis subsp bovis AF2122/97
ggagaucaccucgg

SEQ ID NO: 3162929 - RNA, 20 nt, Mycobacterium bovis subsp bovis AF2122/97
ggagaucaccucggugccgg

SEQ ID NO: 3162930 - RNA, 13 nt, Mycobacterium bovis subsp bovis AF2122/97
ggagaucacgccg

SEQ ID NO: 3162931 - RNA, 16 nt, Mycobacterium bovis subsp bovis AF2122/97
ggagaucacgccgacg

SEQ ID NO: 3162932 - RNA, 13 nt, Mycobacterium bovis subsp bovis AF2122/97
ggagauccagggc

SEQ ID NO: 3162933 - RNA, 17 nt, Mycobacterium bovis subsp bovis AF2122/97
ggagaucgaucgacagc

SEQ ID NO: 3162934 - RNA, 18 nt, Mycobacterium bovis subsp bovis AF2122/97
ggagaucgccgccggcgc

SEQ ID NO: 3162935 - RNA, 21 nt, Mycobacterium bovis subsp bovis AF2122/97
ggagaugaucaugugguggcg

SEQ ID NO: 3162936 - RNA, 20 nt, Mycobacterium bovis subsp bovis AF2122/97
ggagauguaguccucggugg

SEQ ID NO: 3162937 - RNA, 19 nt, Mycobacterium bovis subsp bovis AF2122/97
ggagcaccgaccagggccg

SEQ ID NO: 3162938 - RNA, 21 nt, Mycobacterium bovis subsp bovis AF2122/97
ggagcaccucgaagugcaggu

SEQ ID NO: 3162939 - RNA, 20 nt, Mycobacterium bovis subsp bovis AF2122/97
ggagcagccgaaccggcacc

SEQ ID NO: 3162940 - RNA, 12 nt, Mycobacterium bovis subsp bovis AF2122/97
ggagcagggcuc

SEQ ID NO: 3162941 - RNA, 23 nt, Mycobacterium bovis subsp bovis AF2122/97
ggagccacucggcccggcaggac

SEQ ID NO: 3162942 - RNA, 16 nt, Mycobacterium bovis subsp bovis AF2122/97
ggagccaggacgacgc

SEQ ID NO: 3162943 - RNA, 21 nt, Mycobacterium bovis subsp bovis AF2122/97
ggagcccaguaagccacgggc

SEQ ID NO: 3162944 - RNA, 17 nt, Mycobacterium bovis subsp bovis AF2122/97
ggagccccugucaacgc

SEQ ID NO: 3162945 - RNA, 15 nt, Mycobacterium bovis subsp bovis AF2122/97
ggagcccgagcucac

SEQ ID NO: 3162946 - RNA, 16 nt, Mycobacterium bovis subsp bovis AF2122/97
ggagcccgagcucacc

SEQ ID NO: 3162947 - RNA, 19 nt, Mycobacterium bovis subsp bovis AF2122/97
ggagcccgagcucaccgca

SEQ ID NO: 3162948 - RNA, 21 nt, Mycobacterium bovis subsp bovis AF2122/97
ggagcccgagcucgccgcagc

SEQ ID NO: 3162949 - RNA, 12 nt, Mycobacterium bovis subsp bovis AF2122/97
ggagcccggcau

SEQ ID NO: 3162950 - RNA, 14 nt, Mycobacterium bovis subsp bovis AF2122/97
ggagcccggcggcc

SEQ ID NO: 3162951 - RNA, 16 nt, Mycobacterium bovis subsp bovis AF2122/97
ggagcccguccaggcc

SEQ ID NO: 3162952 - RNA, 16 nt, Mycobacterium bovis subsp bovis AF2122/97
ggagccgaucacgcug

SEQ ID NO: 3162953 - RNA, 19 nt, Mycobacterium bovis subsp bovis AF2122/97
ggagccgaugaccugcccg

SEQ ID NO: 3162954 - RNA, 15 nt, Mycobacterium bovis subsp bovis AF2122/97
ggagccgcacccgaa

SEQ ID NO: 3162955 - RNA, 22 nt, Mycobacterium bovis subsp bovis AF2122/97
ggagccgcccaagccgccggcg

SEQ ID NO: 3162956 - RNA, 24 nt, Mycobacterium bovis subsp bovis AF2122/97
ggagucgucguguuggccgggucg

SEQ ID NO: 3162957 - RNA, 21 nt, Mycobacterium bovis subsp bovis AF2122/97
ggagucuucggcgacaggccg

SEQ ID NO: 3162958 - RNA, 17 nt, Mycobacterium bovis subsp bovis AF2122/97
ggagugaggcugugccc

SEQ ID NO: 3162959 - RNA, 21 nt, Mycobacterium bovis subsp bovis AF2122/97
ggagugaggcugugccccagg

SEQ ID NO: 3162960 - RNA, 12 nt, Mycobacterium bovis subsp bovis AF2122/97
ggaguggccggg

SEQ ID NO: 3162961 - RNA, 14 nt, Mycobacterium bovis subsp bovis AF2122/97
ggaguggccgggcg

SEQ ID NO: 3162962 - RNA, 17 nt, Mycobacterium bovis subsp bovis AF2122/97
ggagugguacggcucgg

SEQ ID NO: 3162963 - RNA, 15 nt, Mycobacterium bovis subsp bovis AF2122/97
ggaguucgcgcagca

SEQ ID NO: 3162964 - RNA, 17 nt, Mycobacterium bovis subsp bovis AF2122/97
ggaguucucgcugauca

SEQ ID NO: 3162965 - RNA, 22 nt, Mycobacterium bovis subsp bovis AF2122/97
ggaguucucgcugaucagcaug

SEQ ID NO: 3162966 - RNA, 13 nt, Mycobacterium bovis subsp bovis AF2122/97
ggaguugaagaag

SEQ ID NO: 3162967 - RNA, 15 nt, Mycobacterium bovis subsp bovis AF2122/97
ggaguugaucuccac

SEQ ID NO: 3162968 - RNA, 23 nt, Mycobacterium bovis subsp bovis AF2122/97
ggaguugaucuccacggcggugc

SEQ ID NO: 3162969 - RNA, 18 nt, Mycobacterium bovis subsp bovis AF2122/97
ggaguugcgacgauacac

SEQ ID NO: 3162970 - RNA, 16 nt, Mycobacterium bovis subsp bovis AF2122/97
ggaguugucgacggcc

SEQ ID NO: 3162971 - RNA, 20 nt, Mycobacterium bovis subsp bovis AF2122/97
ggaguugucgacggccaccc

SEQ ID NO: 3162972 - RNA, 19 nt, Mycobacterium bovis subsp bovis AF2122/97
ggaguuuuucgggguggcg

SEQ ID NO: 3162973 - RNA, 19 nt, Mycobacterium bovis subsp bovis AF2122/97
ggauaaacugccgcggcac

SEQ ID NO: 3162974 - RNA, 19 nt, Mycobacterium bovis subsp bovis AF2122/97
ggauaacccagcaccacaa

SEQ ID NO: 3162975 - RNA, 16 nt, Mycobacterium bovis subsp bovis AF2122/97
ggauaacccagcggcg

SEQ ID NO: 3162976 - RNA, 19 nt, Mycobacterium bovis subsp bovis AF2122/97
ggauacauuucgucgucgc

SEQ ID NO: 3162977 - RNA, 23 nt, Mycobacterium bovis subsp bovis AF2122/97
ggauacccuuugcacgguggcaa

SEQ ID NO: 3162978 - RNA, 19 nt, Mycobacterium bovis subsp bovis AF2122/97
ggauaccgcugggucgccg

SEQ ID NO: 3162979 - RNA, 20 nt, Mycobacterium bovis subsp bovis AF2122/97
ggauaccgcugggucgccgu

SEQ ID NO: 3162980 - RNA, 13 nt, Mycobacterium bovis subsp bovis AF2122/97
ggauaccggucag

SEQ ID NO: 3162981 - RNA, 16 nt, Mycobacterium bovis subsp bovis AF2122/97
ggauacggugcgacga

SEQ ID NO: 3162982 - RNA, 16 nt, Mycobacterium bovis subsp bovis AF2122/97
ggauagccucggcggc

SEQ ID NO: 3162983 - RNA, 20 nt, Mycobacterium bovis subsp bovis AF2122/97
ggauagcgucgucccagcgc

SEQ ID NO: 3162984 - RNA, 18 nt, Mycobacterium bovis subsp bovis AF2122/97
ggauaggccgcgcggcgg

SEQ ID NO: 3162985 - RNA, 23 nt, Mycobacterium bovis subsp bovis AF2122/97
ggauaggccgcgcggcggcgccg

SEQ ID NO: 3162986 - RNA, 17 nt, Mycobacterium bovis subsp bovis AF2122/97
ggauaguucaccacaug

SEQ ID NO: 3162987 - RNA, 18 nt, Mycobacterium bovis subsp bovis AF2122/97
ggauaguuuucggccgcc

SEQ ID NO: 3162988 - RNA, 13 nt, Mycobacterium bovis subsp bovis AF2122/97
ggauaucacgacg

SEQ ID NO: 3162989 - RNA, 15 nt, Mycobacterium bovis subsp bovis AF2122/97
ggauaucacgacgcc

SEQ ID NO: 3162990 - RNA, 19 nt, Mycobacterium bovis subsp bovis AF2122/97
ggauaucagcaacagcagg

SEQ ID NO: 3162991 - RNA, 13 nt, Mycobacterium bovis subsp bovis AF2122/97
ggauaucgucgac

SEQ ID NO: 3162992 - RNA, 17 nt, Mycobacterium bovis subsp bovis AF2122/97
ggaucaaaaccucgugc

SEQ ID NO: 3162993 - RNA, 14 nt, Mycobacterium bovis subsp bovis AF2122/97
ggaucaacccggcc

SEQ ID NO: 3162994 - RNA, 17 nt, Mycobacterium bovis subsp bovis AF2122/97
ggaucaaccggcccucc

SEQ ID NO: 3162995 - RNA, 14 nt, Mycobacterium bovis subsp bovis AF2122/97
ggaucaccaucgcc

SEQ ID NO: 3162996 - RNA, 19 nt, Mycobacterium bovis subsp bovis AF2122/97
ggaucaccaucgccgccgc

SEQ ID NO: 3162997 - RNA, 21 nt, Mycobacterium bovis subsp bovis AF2122/97
ggaucaccaucgccgccgcgc

SEQ ID NO: 3162998 - RNA, 14 nt, Mycobacterium bovis subsp bovis AF2122/97
ggaucacccgccgc

SEQ ID NO: 3162999 - RNA, 15 nt, Mycobacterium bovis subsp bovis AF2122/97
ggaucacccgccgcg

SEQ ID NO: 3163000 - RNA, 16 nt, Mycobacterium bovis subsp bovis AF2122/97
ggaucacccgccgcgu

SEQ ID NO: 3163001 - RNA, 12 nt, Mycobacterium bovis subsp bovis AF2122/97
ggaucaccgauc

SEQ ID NO: 3163002 - RNA, 14 nt, Mycobacterium bovis subsp bovis AF2122/97
ggaucacgccgccg

SEQ ID NO: 3163003 - RNA, 15 nt, Mycobacterium bovis subsp bovis AF2122/97
ggaucacgccgccgg

SEQ ID NO: 3163004 - RNA, 20 nt, Mycobacterium bovis subsp bovis AF2122/97
ggaucacucccccacacacc

SEQ ID NO: 3163005 - RNA, 16 nt, Mycobacterium bovis subsp bovis AF2122/97
ggaucagaacgcggcc

SEQ ID NO: 3163006 - RNA, 15 nt, Mycobacterium bovis subsp bovis AF2122/97
ggaucagcccgcgca

SEQ ID NO: 3163007 - RNA, 16 nt, Mycobacterium bovis subsp bovis AF2122/97
ggaucagcccggacgu

SEQ ID NO: 3163008 - RNA, 19 nt, Mycobacterium bovis subsp bovis AF2122/97
ggaucagccgugcgggccg

SEQ ID NO: 3163009 - RNA, 20 nt, Mycobacterium bovis subsp bovis AF2122/97
ggaucagcgaguggucccgu

SEQ ID NO: 3163010 - RNA, 17 nt, Mycobacterium bovis subsp bovis AF2122/97
ggaucagcgugucgccg

SEQ ID NO: 3163011 - RNA, 21 nt, Mycobacterium bovis subsp bovis AF2122/97
ggaucaucaagggugcgucgc

SEQ ID NO: 3163012 - RNA, 20 nt, Mycobacterium bovis subsp bovis AF2122/97
ggaucauccuucgccggcgc

SEQ ID NO: 3163013 - RNA, 14 nt, Mycobacterium bovis subsp bovis AF2122/97
ggaucaucgccgcg

SEQ ID NO: 3163014 - RNA, 16 nt, Mycobacterium bovis subsp bovis AF2122/97
ggaucaugaccaucga

SEQ ID NO: 3163015 - RNA, 19 nt, Mycobacterium bovis subsp bovis AF2122/97
ggaucauguucggccacca

SEQ ID NO: 3163016 - RNA, 20 nt, Mycobacterium bovis subsp bovis AF2122/97
ggauccacccagugccacgc

SEQ ID NO: 3163017 - RNA, 19 nt, Mycobacterium bovis subsp bovis AF2122/97
ggauccagaaacugcucgg

SEQ ID NO: 3163018 - RNA, 12 nt, Mycobacterium bovis subsp bovis AF2122/97
ggauccagcagg

SEQ ID NO: 3163019 - RNA, 13 nt, Mycobacterium bovis subsp bovis AF2122/97
ggauccagcaggc

SEQ ID NO: 3163020 - RNA, 16 nt, Mycobacterium bovis subsp bovis AF2122/97
ggauccaggcccagcc

SEQ ID NO: 3163021 - RNA, 20 nt, Mycobacterium bovis subsp bovis AF2122/97
ggauccaggcccagccgagc

SEQ ID NO: 3163022 - RNA, 21 nt, Mycobacterium bovis subsp bovis AF2122/97
ggaucccacgaguuggccaag

SEQ ID NO: 3163023 - RNA, 15 nt, Mycobacterium bovis subsp bovis AF2122/97
ggaucccagcgcagc

SEQ ID NO: 3163024 - RNA, 19 nt, Mycobacterium bovis subsp bovis AF2122/97
ggaucccagugccagugcc

SEQ ID NO: 3163025 - RNA, 23 nt, Mycobacterium bovis subsp bovis AF2122/97
ggaucccagugccagugccagcg

SEQ ID NO: 3163026 - RNA, 14 nt, Mycobacterium bovis subsp bovis AF2122/97
ggaucccccgcgcg

SEQ ID NO: 3163027 - RNA, 16 nt, Mycobacterium bovis subsp bovis AF2122/97
ggaucccgaggcgccc

SEQ ID NO: 3163028 - RNA, 18 nt, Mycobacterium bovis subsp bovis AF2122/97
ggaucccgaggcgcccaa

SEQ ID NO: 3163029 - RNA, 16 nt, Mycobacterium bovis subsp bovis AF2122/97
ggaucccgccgcugcc

SEQ ID NO: 3163030 - RNA, 20 nt, Mycobacterium bovis subsp bovis AF2122/97
ggaucccgccggugugcccg

SEQ ID NO: 3163031 - RNA, 15 nt, Mycobacterium bovis subsp bovis AF2122/97
ggaucccgcugcacg

SEQ ID NO: 3163032 - RNA, 18 nt, Mycobacterium bovis subsp bovis AF2122/97
ggaucccgguggcagcac

SEQ ID NO: 3163033 - RNA, 23 nt, Mycobacterium bovis subsp bovis AF2122/97
ggaucccugugccagcagcagcg

SEQ ID NO: 3163034 - RNA, 17 nt, Mycobacterium bovis subsp bovis AF2122/97
ggauccgaagagccagc

SEQ ID NO: 3163035 - RNA, 18 nt, Mycobacterium bovis subsp bovis AF2122/97
ggauccgaagagccagca

SEQ ID NO: 3163036 - RNA, 17 nt, Mycobacterium bovis subsp bovis AF2122/97
ggauccgaccccgcgcc

SEQ ID NO: 3163037 - RNA, 15 nt, Mycobacterium bovis subsp bovis AF2122/97
ggauccgauccgcac

SEQ ID NO: 3163038 - RNA, 15 nt, Mycobacterium bovis subsp bovis AF2122/97
ggauccgcaccacgc

SEQ ID NO: 3163039 - RNA, 22 nt, Mycobacterium bovis subsp bovis AF2122/97
ggauccgcaccacgcccgacga

SEQ ID NO: 3163040 - RNA, 12 nt, Mycobacterium bovis subsp bovis AF2122/97
ggauccgcgcgc

SEQ ID NO: 3163041 - RNA, 15 nt, Mycobacterium bovis subsp bovis AF2122/97
ggauccggaagcccu

SEQ ID NO: 3163042 - RNA, 20 nt, Mycobacterium bovis subsp bovis AF2122/97
ggauccggcagcagccggcg

SEQ ID NO: 3163043 - RNA, 15 nt, Mycobacterium bovis subsp bovis AF2122/97
ggaucuggcgcagca

SEQ ID NO: 3163044 - RNA, 18 nt, Mycobacterium bovis subsp bovis AF2122/97
ggaucugggcucgguccu

SEQ ID NO: 3163045 - RNA, 15 nt, Mycobacterium bovis subsp bovis AF2122/97
ggaucugguccagug

SEQ ID NO: 3163046 - RNA, 18 nt, Mycobacterium bovis subsp bovis AF2122/97
ggaucugguugaaccggu

SEQ ID NO: 3163047 - RNA, 15 nt, Mycobacterium bovis subsp bovis AF2122/97
ggaucuuggccagca

SEQ ID NO: 3163048 - RNA, 16 nt, Mycobacterium bovis subsp bovis AF2122/97
ggaucuuggccagcag

SEQ ID NO: 3163049 - RNA, 19 nt, Mycobacterium bovis subsp bovis AF2122/97
ggaucuuggccagcagcgc

SEQ ID NO: 3163050 - RNA, 22 nt, Mycobacterium bovis subsp bovis AF2122/97
ggaugaaguguuuggcguuggg

SEQ ID NO: 3163051 - RNA, 20 nt, Mycobacterium bovis subsp bovis AF2122/97
ggaugaauuuggugaaguga

SEQ ID NO: 3163052 - RNA, 15 nt, Mycobacterium bovis subsp bovis AF2122/97
ggaugacaccgaccg

SEQ ID NO: 3163053 - RNA, 23 nt, Mycobacterium bovis subsp bovis AF2122/97
ggaugaccuuggccgugcccgaa

SEQ ID NO: 3163054 - RNA, 14 nt, Mycobacterium bovis subsp bovis AF2122/97
ggaugacgcccagg

SEQ ID NO: 3163055 - RNA, 14 nt, Mycobacterium bovis subsp bovis AF2122/97
ggaugagcucggcc

SEQ ID NO: 3163056 - RNA, 21 nt, Mycobacterium bovis subsp bovis AF2122/97
ggaugaguucgucguggagcu

SEQ ID NO: 3163057 - RNA, 14 nt, Mycobacterium bovis subsp bovis AF2122/97
ggaugcagcugccc

SEQ ID NO: 3163058 - RNA, 23 nt, Mycobacterium bovis subsp bovis AF2122/97
ggaugcaugucaaguucgccagc

SEQ ID NO: 3163059 - RNA, 19 nt, Mycobacterium bovis subsp bovis AF2122/97
ggaugcccguagacgccga

SEQ ID NO: 3163060 - RNA, 20 nt, Mycobacterium bovis subsp bovis AF2122/97
ggaugcccguagacgccgag

SEQ ID NO: 3163061 - RNA, 22 nt, Mycobacterium bovis subsp bovis AF2122/97
ggaugcccguagacgccgagca

SEQ ID NO: 3163062 - RNA, 15 nt, Mycobacterium bovis subsp bovis AF2122/97
ggaugccggucggcg

SEQ ID NO: 3163063 - RNA, 14 nt, Mycobacterium bovis subsp bovis AF2122/97
ggaugccguuggcg

SEQ ID NO: 3163064 - RNA, 19 nt, Mycobacterium bovis subsp bovis AF2122/97
ggaugccuaccgugcuggc

SEQ ID NO: 3163065 - RNA, 17 nt, Mycobacterium bovis subsp bovis AF2122/97
ggaugcgacagcgcugg

SEQ ID NO: 3163066 - RNA, 16 nt, Mycobacterium bovis subsp bovis AF2122/97
ggaugcgaugcgcgcc

SEQ ID NO: 3163067 - RNA, 17 nt, Mycobacterium bovis subsp bovis AF2122/97
ggaugcgaugcgcgccg

SEQ ID NO: 3163068 - RNA, 21 nt, Mycobacterium bovis subsp bovis AF2122/97
ggaugcgccgcacggcgacgc

SEQ ID NO: 3163069 - RNA, 13 nt, Mycobacterium bovis subsp bovis AF2122/97
ggaugcgcgcccg

SEQ ID NO: 3163070 - RNA, 13 nt, Mycobacterium bovis subsp bovis AF2122/97
ggaugcgcggcgg

SEQ ID NO: 3163071 - RNA, 18 nt, Mycobacterium bovis subsp bovis AF2122/97
ggaugcgcuuccaucgcc

SEQ ID NO: 3163072 - RNA, 12 nt, Mycobacterium bovis subsp bovis AF2122/97
ggaugcggucga

SEQ ID NO: 3163073 - RNA, 14 nt, Mycobacterium bovis subsp bovis AF2122/97
ggaugcucgaucca

SEQ ID NO: 3163074 - RNA, 15 nt, Mycobacterium bovis subsp bovis AF2122/97
ggaugcucgauccac

SEQ ID NO: 3163075 - RNA, 16 nt, Mycobacterium bovis subsp bovis AF2122/97
ggaugcugagcgccag

SEQ ID NO: 3163076 - RNA, 19 nt, Mycobacterium bovis subsp bovis AF2122/97
ggaugcugagcgccaggcc

SEQ ID NO: 3163077 - RNA, 18 nt, Mycobacterium bovis subsp bovis AF2122/97
ggaugcugucagacggcg

SEQ ID NO: 3163078 - RNA, 17 nt, Mycobacterium bovis subsp bovis AF2122/97
ggaugcugucagcagcc

SEQ ID NO: 3163079 - RNA, 15 nt, Mycobacterium bovis subsp bovis AF2122/97
ggauggaaggcggcc

SEQ ID NO: 3163080 - RNA, 14 nt, Mycobacterium bovis subsp bovis AF2122/97
ggauggacaccacc

SEQ ID NO: 3163081 - RNA, 22 nt, Mycobacterium bovis subsp bovis AF2122/97
ggauggacggcagccagccacc

SEQ ID NO: 3163082 - RNA, 13 nt, Mycobacterium bovis subsp bovis AF2122/97
ggauggccgccga

SEQ ID NO: 3163083 - RNA, 14 nt, Mycobacterium bovis subsp bovis AF2122/97
ggauggccgccgac

SEQ ID NO: 3163084 - RNA, 16 nt, Mycobacterium bovis subsp bovis AF2122/97
ggauggcgcccugcgc

SEQ ID NO: 3163085 - RNA, 17 nt, Mycobacterium bovis subsp bovis AF2122/97
ggauggcgcccugcgcc

SEQ ID NO: 3163086 - RNA, 20 nt, Mycobacterium bovis subsp bovis AF2122/97
ggauggcgucgaccacaggc

SEQ ID NO: 3163087 - RNA, 17 nt, Mycobacterium bovis subsp bovis AF2122/97
ggauggcucacccaggc

SEQ ID NO: 3163088 - RNA, 19 nt, Mycobacterium bovis subsp bovis AF2122/97
ggauggcucacccaggcgc

SEQ ID NO: 3163089 - RNA, 15 nt, Mycobacterium bovis subsp bovis AF2122/97
ggauggcuggccagc

SEQ ID NO: 3163090 - RNA, 22 nt, Mycobacterium bovis subsp bovis AF2122/97
ggaugggaccuugaucgagcag

SEQ ID NO: 3163091 - RNA, 22 nt, Mycobacterium bovis subsp bovis AF2122/97
ggaugggagccacugcggcaug

SEQ ID NO: 3163092 - RNA, 15 nt, Mycobacterium bovis subsp bovis AF2122/97
ggaugggcucgacgu

SEQ ID NO: 3163093 - RNA, 17 nt, Mycobacterium bovis subsp bovis AF2122/97
ggaugggcugcgcgucg

SEQ ID NO: 3163094 - RNA, 16 nt, Mycobacterium bovis subsp bovis AF2122/97
ggauggucagcagcuc

SEQ ID NO: 3163095 - RNA, 22 nt, Mycobacterium bovis subsp bovis AF2122/97
ggauguaguuggcgaccugcgc

SEQ ID NO: 3163096 - RNA, 23 nt, Mycobacterium bovis subsp bovis AF2122/97
ggauguaguuggcgaccugcgcg

SEQ ID NO: 3163097 - RNA, 20 nt, Mycobacterium bovis subsp bovis AF2122/97
ggaugucccaugcacggccg

SEQ ID NO: 3163098 - RNA, 18 nt, Mycobacterium bovis subsp bovis AF2122/97
ggauguccgcggccacca

SEQ ID NO: 3163099 - RNA, 20 nt, Mycobacterium bovis subsp bovis AF2122/97
ggauguccuugaaccagcgc

SEQ ID NO: 3163100 - RNA, 21 nt, Mycobacterium bovis subsp bovis AF2122/97
ggauguccuugaaccagcgcg

SEQ ID NO: 3163101 - RNA, 19 nt, Mycobacterium bovis subsp bovis AF2122/97
ggaugucgacgagcaccgc

SEQ ID NO: 3163102 - RNA, 23 nt, Mycobacterium bovis subsp bovis AF2122/97
ggaugucgacgagcaccgcgccg

SEQ ID NO: 3163103 - RNA, 19 nt, Mycobacterium bovis subsp bovis AF2122/97
ggaugucgagcguggcgac

SEQ ID NO: 3163104 - RNA, 13 nt, Mycobacterium bovis subsp bovis AF2122/97
ggaugucgauggg

SEQ ID NO: 3163105 - RNA, 15 nt, Mycobacterium bovis subsp bovis AF2122/97
ggaugucgucgacca

SEQ ID NO: 3163106 - RNA, 19 nt, Mycobacterium bovis subsp bovis AF2122/97
ggaugucgucgaccaggcc

SEQ ID NO: 3163107 - RNA, 15 nt, Mycobacterium bovis subsp bovis AF2122/97
ggaugucgucgacga

SEQ ID NO: 3163108 - RNA, 17 nt, Mycobacterium bovis subsp bovis AF2122/97
ggaugucucggcaccac

SEQ ID NO: 3163109 - RNA, 13 nt, Mycobacterium bovis subsp bovis AF2122/97
ggaugugccgcgc

SEQ ID NO: 3163110 - RNA, 18 nt, Mycobacterium bovis subsp bovis AF2122/97
ggaugugccgcgcacggc

SEQ ID NO: 3163111 - RNA, 17 nt, Mycobacterium bovis subsp bovis AF2122/97
ggaugugggcgcucgca

SEQ ID NO: 3163112 - RNA, 21 nt, Mycobacterium bovis subsp bovis AF2122/97
ggaugugggcgcucgcaucau

SEQ ID NO: 3163113 - RNA, 19 nt, Mycobacterium bovis subsp bovis AF2122/97
ggaugugguuggugcuggc

SEQ ID NO: 3163114 - RNA, 15 nt, Mycobacterium bovis subsp bovis AF2122/97
ggaugugucggcgag

SEQ ID NO: 3163115 - RNA, 19 nt, Mycobacterium bovis subsp bovis AF2122/97
ggaugugugagucccacgc

SEQ ID NO: 3163116 - RNA, 16 nt, Mycobacterium bovis subsp bovis AF2122/97
ggauucacgcaccggc

SEQ ID NO: 3163117 - RNA, 21 nt, Mycobacterium bovis subsp bovis AF2122/97
ggauucagcgcagcaacuggg

SEQ ID NO: 3163118 - RNA, 23 nt, Mycobacterium bovis subsp bovis AF2122/97
ggauucaucacgggacgacggca

SEQ ID NO: 3163119 - RNA, 16 nt, Mycobacterium bovis subsp bovis AF2122/97
ggauucauggcggcau

SEQ ID NO: 3163120 - RNA, 19 nt, Mycobacterium bovis subsp bovis AF2122/97
ggauucccgcccagcagca

SEQ ID NO: 3163121 - RNA, 18 nt, Mycobacterium bovis subsp bovis AF2122/97
ggauuccgcacccccguc

SEQ ID NO: 3163122 - RNA, 21 nt, Mycobacterium bovis subsp bovis AF2122/97
ggauucgaagccgagcuccuc

SEQ ID NO: 3163123 - RNA, 17 nt, Mycobacterium bovis subsp bovis AF2122/97
ggauucggcagcggcgc

SEQ ID NO: 3163124 - RNA, 15 nt, Mycobacterium bovis subsp bovis AF2122/97
ggauucggcggucgc

SEQ ID NO: 3163125 - RNA, 16 nt, Mycobacterium bovis subsp bovis AF2122/97
ggauucgggcgccgca

SEQ ID NO: 3163126 - RNA, 18 nt, Mycobacterium bovis subsp bovis AF2122/97
ggauucgggcgccgcagc

SEQ ID NO: 3163127 - RNA, 21 nt, Mycobacterium bovis subsp bovis AF2122/97
ggauugacgcgacgagccgca

SEQ ID NO: 3163128 - RNA, 13 nt, Mycobacterium bovis subsp bovis AF2122/97
ggauugagcacgc

SEQ ID NO: 3163129 - RNA, 18 nt, Mycobacterium bovis subsp bovis AF2122/97
ggcaagcacgcgacggcg

SEQ ID NO: 3163130 - RNA, 12 nt, Mycobacterium bovis subsp bovis AF2122/97
ggcaagcacggc

SEQ ID NO: 3163131 - RNA, 22 nt, Mycobacterium bovis subsp bovis AF2122/97
ggcaagcacggcgucgaugucg

SEQ ID NO: 3163132 - RNA, 16 nt, Mycobacterium bovis subsp bovis AF2122/97
ggcaagcacgguggcc

SEQ ID NO: 3163133 - RNA, 21 nt, Mycobacterium bovis subsp bovis AF2122/97
ggcaagcacgguggccgagcc

SEQ ID NO: 3163134 - RNA, 13 nt, Mycobacterium bovis subsp bovis AF2122/97
ggcaagcagucgg

SEQ ID NO: 3163135 - RNA, 14 nt, Mycobacterium bovis subsp bovis AF2122/97
ggcaagccagcacu

SEQ ID NO: 3163136 - RNA, 22 nt, Mycobacterium bovis subsp bovis AF2122/97
ggcaagccauucacgagccgcu

SEQ ID NO: 3163137 - RNA, 15 nt, Mycobacterium bovis subsp bovis AF2122/97
ggcaagcccaaaaag

SEQ ID NO: 3163138 - RNA, 23 nt, Mycobacterium bovis subsp bovis AF2122/97
ggcaagcccaaaaagaccgccgc

SEQ ID NO: 3163139 - RNA, 23 nt, Mycobacterium bovis subsp bovis AF2122/97
ggcaagccguucugucccggcgc

SEQ ID NO: 3163140 - RNA, 20 nt, Mycobacterium bovis subsp bovis AF2122/97
ggcaagccuaaaaccccgag

SEQ ID NO: 3163141 - RNA, 13 nt, Mycobacterium bovis subsp bovis AF2122/97
ggcaagccugcgc

SEQ ID NO: 3163142 - RNA, 12 nt, Mycobacterium bovis subsp bovis AF2122/97
ggcaagcgcaga

SEQ ID NO: 3163143 - RNA, 21 nt, Mycobacterium bovis subsp bovis AF2122/97
ggcaagcgugacccgccggcg

SEQ ID NO: 3163144 - RNA, 19 nt, Mycobacterium bovis subsp bovis AF2122/97
ggcaagcugaccgccagcg

SEQ ID NO: 3163145 - RNA, 20 nt, Mycobacterium bovis subsp bovis AF2122/97
ggcaagcugaccgccagcgg

SEQ ID NO: 3163146 - RNA, 15 nt, Mycobacterium bovis subsp bovis AF2122/97
ggcaaggacguggcg

SEQ ID NO: 3163147 - RNA, 21 nt, Mycobacterium bovis subsp bovis AF2122/97
ggcaaggcauccaacgcggcg

SEQ ID NO: 3163148 - RNA, 21 nt, Mycobacterium bovis subsp bovis AF2122/97
ggcaaggccaccgucgcggcg

SEQ ID NO: 3163149 - RNA, 13 nt, Mycobacterium bovis subsp bovis AF2122/97
ggcaaggcggcgg

SEQ ID NO: 3163150 - RNA, 16 nt, Mycobacterium bovis subsp bovis AF2122/97
ggcaagggcauacagc

SEQ ID NO: 3163151 - RNA, 19 nt, Mycobacterium bovis subsp bovis AF2122/97
ggcaaggucaacccgcacc

SEQ ID NO: 3163152 - RNA, 15 nt, Mycobacterium bovis subsp bovis AF2122/97
ggcaaggucgcggcc

SEQ ID NO: 3163153 - RNA, 22 nt, Mycobacterium bovis subsp bovis AF2122/97
ggcaaguagucgaaggucagca

SEQ ID NO: 3163154 - RNA, 14 nt, Mycobacterium bovis subsp bovis AF2122/97
ggcaagucaacacc

SEQ ID NO: 3163155 - RNA, 20 nt, Mycobacterium bovis subsp bovis AF2122/97
ggcaagucaacaccgcggcc

SEQ ID NO: 3163156 - RNA, 13 nt, Mycobacterium bovis subsp bovis AF2122/97
ggcaagucgacgc

SEQ ID NO: 3163157 - RNA, 18 nt, Mycobacterium bovis subsp bovis AF2122/97
ggcaagucgacgccgcag

SEQ ID NO: 3163158 - RNA, 19 nt, Mycobacterium bovis subsp bovis AF2122/97
ggcaagucgacgccgcagc

SEQ ID NO: 3163159 - RNA, 21 nt, Mycobacterium bovis subsp bovis AF2122/97
ggcaagucgcccagccgagcg

SEQ ID NO: 3163160 - RNA, 15 nt, Mycobacterium bovis subsp bovis AF2122/97
ggcaauacccgccgc

SEQ ID NO: 3163161 - RNA, 16 nt, Mycobacterium bovis subsp bovis AF2122/97
ggcaauacccgccgcg

SEQ ID NO: 3163162 - RNA, 15 nt, Mycobacterium bovis subsp bovis AF2122/97
ggcaauaccgccagc

SEQ ID NO: 3163163 - RNA, 20 nt, Mycobacterium bovis subsp bovis AF2122/97
ggcaauaccgccagcgccac

SEQ ID NO: 3163164 - RNA, 23 nt, Mycobacterium bovis subsp bovis AF2122/97
ggcaauagccggguugccugcgc

SEQ ID NO: 3163165 - RNA, 23 nt, Mycobacterium bovis subsp bovis AF2122/97
ggcaaucacaucaaagucggcgu

SEQ ID NO: 3163166 - RNA, 18 nt, Mycobacterium bovis subsp bovis AF2122/97
ggcaaucaccgccggcgg

SEQ ID NO: 3163167 - RNA, 21 nt, Mycobacterium bovis subsp bovis AF2122/97
ggcaaucaucucccgaccgcc

SEQ ID NO: 3163168 - RNA, 16 nt, Mycobacterium bovis subsp bovis AF2122/97
ggcaaucccgcggucg

SEQ ID NO: 3163169 - RNA, 22 nt, Mycobacterium bovis subsp bovis AF2122/97
ggcaaucgcucugugucgccga

SEQ ID NO: 3163170 - RNA, 14 nt, Mycobacterium bovis subsp bovis AF2122/97
ggcaaucggcggca

SEQ ID NO: 3163171 - RNA, 19 nt, Mycobacterium bovis subsp bovis AF2122/97
ggcaaugacuugcgacccg

SEQ ID NO: 3163172 - RNA, 16 nt, Mycobacterium bovis subsp bovis AF2122/97
ggcaaugcccgaccgg

SEQ ID NO: 3163173 - RNA, 13 nt, Mycobacterium bovis subsp bovis AF2122/97
ggcaaugccgcgg

SEQ ID NO: 3163174 - RNA, 15 nt, Mycobacterium bovis subsp bovis AF2122/97
ggcaaugccgcggcc

SEQ ID NO: 3163175 - RNA, 16 nt, Mycobacterium bovis subsp bovis AF2122/97
ggcaaugccgcggcca

SEQ ID NO: 3163176 - RNA, 21 nt, Mycobacterium bovis subsp bovis AF2122/97
ggcaauggccagcaccacggc

SEQ ID NO: 3163177 - RNA, 15 nt, Mycobacterium bovis subsp bovis AF2122/97
ggcaaugucgacacc

SEQ ID NO: 3163178 - RNA, 15 nt, Mycobacterium bovis subsp bovis AF2122/97
ggcaauuccgccgag

SEQ ID NO: 3163179 - RNA, 17 nt, Mycobacterium bovis subsp bovis AF2122/97
ggcaauuccgccgagcg

SEQ ID NO: 3163180 - RNA, 15 nt, Mycobacterium bovis subsp bovis AF2122/97
ggcacaacaucgccg

SEQ ID NO: 3163181 - RNA, 17 nt, Mycobacterium bovis subsp bovis AF2122/97
ggcacaacaucgccgca

SEQ ID NO: 3163182 - RNA, 17 nt, Mycobacterium bovis subsp bovis AF2122/97
ggcacaaucaccgccgc

SEQ ID NO: 3163183 - RNA, 20 nt, Mycobacterium bovis subsp bovis AF2122/97
ggcacaaucggauagccgug

SEQ ID NO: 3163184 - RNA, 22 nt, Mycobacterium bovis subsp bovis AF2122/97
ggcacaaucggauagccgugcu

SEQ ID NO: 3163185 - RNA, 23 nt, Mycobacterium bovis subsp bovis AF2122/97
ggcacaaucggauagccgugcug

SEQ ID NO: 3163186 - RNA, 13 nt, Mycobacterium bovis subsp bovis AF2122/97
ggcacaaucggcg

SEQ ID NO: 3163187 - RNA, 18 nt, Mycobacterium bovis subsp bovis AF2122/97
ggcacacccaucaccgcc

SEQ ID NO: 3163188 - RNA, 21 nt, Mycobacterium bovis subsp bovis AF2122/97
ggcacacccaucaccgccagc

SEQ ID NO: 3163189 - RNA, 16 nt, Mycobacterium bovis subsp bovis AF2122/97
ggcacacccgcaccgg

SEQ ID NO: 3163190 - RNA, 15 nt, Mycobacterium bovis subsp bovis AF2122/97
ggcacacccuccaca

SEQ ID NO: 3163191 - RNA, 21 nt, Mycobacterium bovis subsp bovis AF2122/97
ggcacacccuccacagcggcc

SEQ ID NO: 3163192 - RNA, 22 nt, Mycobacterium bovis subsp bovis AF2122/97
ggcacacggccuugccgaucag

SEQ ID NO: 3163193 - RNA, 18 nt, Mycobacterium bovis subsp bovis AF2122/97
ggcacacuccugcaccau

SEQ ID NO: 3163194 - RNA, 23 nt, Mycobacterium bovis subsp bovis AF2122/97
ggcacacuguuacuccgacggcc

SEQ ID NO: 3163195 - RNA, 18 nt, Mycobacterium bovis subsp bovis AF2122/97
ggcacagccaguaaaaag

SEQ ID NO: 3163196 - RNA, 14 nt, Mycobacterium bovis subsp bovis AF2122/97
ggcacaggcggcca

SEQ ID NO: 3163197 - RNA, 16 nt, Mycobacterium bovis subsp bovis AF2122/97
ggcacaggcggccagc

SEQ ID NO: 3163198 - RNA, 14 nt, Mycobacterium bovis subsp bovis AF2122/97
ggcacaguccgcga

SEQ ID NO: 3163199 - RNA, 18 nt, Mycobacterium bovis subsp bovis AF2122/97
ggcacaucgcgaaaccgg

SEQ ID NO: 3163200 - RNA, 15 nt, Mycobacterium bovis subsp bovis AF2122/97
ggcacaugcgcgucc

SEQ ID NO: 3163201 - RNA, 16 nt, Mycobacterium bovis subsp bovis AF2122/97
ggcacauugaucgacg

SEQ ID NO: 3163202 - RNA, 18 nt, Mycobacterium bovis subsp bovis AF2122/97
ggcacauugaucgacggc

SEQ ID NO: 3163203 - RNA, 19 nt, Mycobacterium bovis subsp bovis AF2122/97
ggcaccaacgccaccgucg

SEQ ID NO: 3163204 - RNA, 20 nt, Mycobacterium bovis subsp bovis AF2122/97
ggcaccaauaccgcacccgc

SEQ ID NO: 3163205 - RNA, 22 nt, Mycobacterium bovis subsp bovis AF2122/97
ggcaccaauaccgcacccgcuc

SEQ ID NO: 3163206 - RNA, 19 nt, Mycobacterium bovis subsp bovis AF2122/97
ggcaccaaugcggugacaa

SEQ ID NO: 3163207 - RNA, 18 nt, Mycobacterium bovis subsp bovis AF2122/97
ggcaccaccaagcucggc

SEQ ID NO: 3163208 - RNA, 20 nt, Mycobacterium bovis subsp bovis AF2122/97
ggcaccaccaagcucggcca

SEQ ID NO: 3163209 - RNA, 23 nt, Mycobacterium bovis subsp bovis AF2122/97
ggcaccaccaagcucggccagca

SEQ ID NO: 3163210 - RNA, 18 nt, Mycobacterium bovis subsp bovis AF2122/97
ggcaccaccacaccggag

SEQ ID NO: 3163211 - RNA, 19 nt, Mycobacterium bovis subsp bovis AF2122/97
ggcaccaccacaccggagc

SEQ ID NO: 3163212 - RNA, 20 nt, Mycobacterium bovis subsp bovis AF2122/97
ggcaccaccacaccggagcc

SEQ ID NO: 3163213 - RNA, 14 nt, Mycobacterium bovis subsp bovis AF2122/97
ggcaccaccccgag

SEQ ID NO: 3163214 - RNA, 18 nt, Mycobacterium bovis subsp bovis AF2122/97
ggcaccaccccgaggccg

SEQ ID NO: 3163215 - RNA, 13 nt, Mycobacterium bovis subsp bovis AF2122/97
ggcaccggcgauc

SEQ ID NO: 3163216 - RNA, 11 nt, Mycobacterium bovis subsp bovis AF2122/97
ggcaccggcgg

SEQ ID NO: 3163217 - RNA, 12 nt, Mycobacterium bovis subsp bovis AF2122/97
ggcaccggcggc

SEQ ID NO: 3163218 - RNA, 13 nt, Mycobacterium bovis subsp bovis AF2122/97
ggcaccggcggcg

SEQ ID NO: 3163219 - RNA, 12 nt, Mycobacterium bovis subsp bovis AF2122/97
ggcaccggcggu

SEQ ID NO: 3163220 - RNA, 15 nt, Mycobacterium bovis subsp bovis AF2122/97
ggcaccggcggucug

SEQ ID NO: 3163221 - RNA, 16 nt, Mycobacterium bovis subsp bovis AF2122/97
ggcaccggcggucugc

SEQ ID NO: 3163222 - RNA, 20 nt, Mycobacterium bovis subsp bovis AF2122/97
ggcaccggcggucugcagug

SEQ ID NO: 3163223 - RNA, 18 nt, Mycobacterium bovis subsp bovis AF2122/97
ggcaccggggcugcccgc

SEQ ID NO: 3163224 - RNA, 20 nt, Mycobacterium bovis subsp bovis AF2122/97
ggcaccgguuugacguccag

SEQ ID NO: 3163225 - RNA, 19 nt, Mycobacterium bovis subsp bovis AF2122/97
ggcaccgguuuucgccggc

SEQ ID NO: 3163226 - RNA, 19 nt, Mycobacterium bovis subsp bovis AF2122/97
ggcaccguagagcaugccg

SEQ ID NO: 3163227 - RNA, 21 nt, Mycobacterium bovis subsp bovis AF2122/97
ggcaccguagagcaugccgcc

SEQ ID NO: 3163228 - RNA, 15 nt, Mycobacterium bovis subsp bovis AF2122/97
ggcaccgucagacca

SEQ ID NO: 3163229 - RNA, 16 nt, Mycobacterium bovis subsp bovis AF2122/97
ggcaccgucagaccau

SEQ ID NO: 3163230 - RNA, 19 nt, Mycobacterium bovis subsp bovis AF2122/97
ggcaccgucggaacugacc

SEQ ID NO: 3163231 - RNA, 19 nt, Mycobacterium bovis subsp bovis AF2122/97
ggcaccgucucgcaccgcg

SEQ ID NO: 3163232 - RNA, 16 nt, Mycobacterium bovis subsp bovis AF2122/97
ggcaccgugcgggggg

SEQ ID NO: 3163233 - RNA, 18 nt, Mycobacterium bovis subsp bovis AF2122/97
ggcaccguguagcugcgg

SEQ ID NO: 3163234 - RNA, 15 nt, Mycobacterium bovis subsp bovis AF2122/97
ggcaccuauagggac

SEQ ID NO: 3163235 - RNA, 14 nt, Mycobacterium bovis subsp bovis AF2122/97
ggcaccuccagcac

SEQ ID NO: 3163236 - RNA, 20 nt, Mycobacterium bovis subsp bovis AF2122/97
ggcaccucccgggcgagccg

SEQ ID NO: 3163237 - RNA, 17 nt, Mycobacterium bovis subsp bovis AF2122/97
ggcaccuggauccacca

SEQ ID NO: 3163238 - RNA, 17 nt, Mycobacterium bovis subsp bovis AF2122/97
ggcaccuggucggccgc

SEQ ID NO: 3163239 - RNA, 18 nt, Mycobacterium bovis subsp bovis AF2122/97
ggcaccuggucggccgca

SEQ ID NO: 3163240 - RNA, 19 nt, Mycobacterium bovis subsp bovis AF2122/97
ggcaccuuggccggccccg

SEQ ID NO: 3163241 - RNA, 20 nt, Mycobacterium bovis subsp bovis AF2122/97
ggcaccuuggccggccccgc

SEQ ID NO: 3163242 - RNA, 20 nt, Mycobacterium bovis subsp bovis AF2122/97
ggcaccuuguagcgggcaag

SEQ ID NO: 3163243 - RNA, 12 nt, Mycobacterium bovis subsp bovis AF2122/97
ggcacgacccgg

SEQ ID NO: 3163244 - RNA, 18 nt, Mycobacterium bovis subsp bovis AF2122/97
ggcacgacccgggaagga

SEQ ID NO: 3163245 - RNA, 17 nt, Mycobacterium bovis subsp bovis AF2122/97
ggcacgaccgcucccgg

SEQ ID NO: 3163246 - RNA, 19 nt, Mycobacterium bovis subsp bovis AF2122/97
ggcacgaccgcucccggug

SEQ ID NO: 3163247 - RNA, 21 nt, Mycobacterium bovis subsp bovis AF2122/97
ggcacgacgccggccuggccg

SEQ ID NO: 3163248 - RNA, 17 nt, Mycobacterium bovis subsp bovis AF2122/97
ggcacgaucaaccgggu

SEQ ID NO: 3163249 - RNA, 14 nt, Mycobacterium bovis subsp bovis AF2122/97
ggcacgaucgccaa

SEQ ID NO: 3163250 - RNA, 15 nt, Mycobacterium bovis subsp bovis AF2122/97
ggcacgcacgcgguu

SEQ ID NO: 3163251 - RNA, 22 nt, Mycobacterium bovis subsp bovis AF2122/97
ggcacgcacgcgguucaccacg

SEQ ID NO: 3163252 - RNA, 13 nt, Mycobacterium bovis subsp bovis AF2122/97
ggcacgccauacc

SEQ ID NO: 3163253 - RNA, 19 nt, Mycobacterium bovis subsp bovis AF2122/97
ggcacgccauaccggcugg

SEQ ID NO: 3163254 - RNA, 22 nt, Mycobacterium bovis subsp bovis AF2122/97
ggcacgccauaccggcuggcca

SEQ ID NO: 3163255 - RNA, 14 nt, Mycobacterium bovis subsp bovis AF2122/97
ggcacgcccucguc

SEQ ID NO: 3163256 - RNA, 18 nt, Mycobacterium bovis subsp bovis AF2122/97
ggcacgcccucgucgauc

SEQ ID NO: 3163257 - RNA, 23 nt, Mycobacterium bovis subsp bovis AF2122/97
ggcacgccgaccgguggcaccgg

SEQ ID NO: 3163258 - RNA, 13 nt, Mycobacterium bovis subsp bovis AF2122/97
ggcacgccggcgg

SEQ ID NO: 3163259 - RNA, 15 nt, Mycobacterium bovis subsp bovis AF2122/97
ggcacgccggcggcg

SEQ ID NO: 3163260 - RNA, 16 nt, Mycobacterium bovis subsp bovis AF2122/97
ggcacgccggcggcgg

SEQ ID NO: 3163261 - RNA, 20 nt, Mycobacterium bovis subsp bovis AF2122/97
ggcacgccgggcaucggcgg

SEQ ID NO: 3163262 - RNA, 15 nt, Mycobacterium bovis subsp bovis AF2122/97
ggcacgcgaggcgcu

SEQ ID NO: 3163263 - RNA, 12 nt, Mycobacterium bovis subsp bovis AF2122/97
ggcacgcggcga

SEQ ID NO: 3163264 - RNA, 14 nt, Mycobacterium bovis subsp bovis AF2122/97
ggcacgcugaccgg

SEQ ID NO: 3163265 - RNA, 19 nt, Mycobacterium bovis subsp bovis AF2122/97
ggcacggaacgcgagguga

SEQ ID NO: 3163266 - RNA, 22 nt, Mycobacterium bovis subsp bovis AF2122/97
ggcacggaaguacuccacccag

SEQ ID NO: 3163267 - RNA, 20 nt, Mycobacterium bovis subsp bovis AF2122/97
ggcacggaccgcgucgcggg

SEQ ID NO: 3163268 - RNA, 17 nt, Mycobacterium bovis subsp bovis AF2122/97
ggcacggagaccgugga

SEQ ID NO: 3163269 - RNA, 18 nt, Mycobacterium bovis subsp bovis AF2122/97
ggcacggaugcgauggcc

SEQ ID NO: 3163270 - RNA, 24 nt, Mycobacterium bovis subsp bovis AF2122/97
ggcacggaugcgauggccgacgcu

SEQ ID NO: 3163271 - RNA, 22 nt, Mycobacterium bovis subsp bovis AF2122/97
ggcacggccccugccacgacga

SEQ ID NO: 3163272 - RNA, 14 nt, Mycobacterium bovis subsp bovis AF2122/97
ggcacggccgucga

SEQ ID NO: 3163273 - RNA, 17 nt, Mycobacterium bovis subsp bovis AF2122/97
ggcacggccgucgacga

SEQ ID NO: 3163274 - RNA, 15 nt, Mycobacterium bovis subsp bovis AF2122/97
ggcacgggcggccau

SEQ ID NO: 3163275 - RNA, 14 nt, Mycobacterium bovis subsp bovis AF2122/97
ggcacgggcgucgu

SEQ ID NO: 3163276 - RNA, 16 nt, Mycobacterium bovis subsp bovis AF2122/97
ggcacgggcgucgucg

SEQ ID NO: 3163277 - RNA, 22 nt, Mycobacterium bovis subsp bovis AF2122/97
ggcacgggucgucaugccaguc

SEQ ID NO: 3163278 - RNA, 19 nt, Mycobacterium bovis subsp bovis AF2122/97
ggcacggugaacggcaagg

SEQ ID NO: 3163279 - RNA, 13 nt, Mycobacterium bovis subsp bovis AF2122/97
ggcacggugucgc

SEQ ID NO: 3163280 - RNA, 21 nt, Mycobacterium bovis subsp bovis AF2122/97
ggcacggugucgcgcgaccug

SEQ ID NO: 3163281 - RNA, 19 nt, Mycobacterium bovis subsp bovis AF2122/97
ggcacguccgaucggcgcg

SEQ ID NO: 3163282 - RNA, 22 nt, Mycobacterium bovis subsp bovis AF2122/97
ggcacguccgaucggcgcgccg

SEQ ID NO: 3163283 - RNA, 20 nt, Mycobacterium bovis subsp bovis AF2122/97
ggcacgucgagcgugaaccu

SEQ ID NO: 3163284 - RNA, 18 nt, Mycobacterium bovis subsp bovis AF2122/97
ggcacgucgcccccggcc

SEQ ID NO: 3163285 - RNA, 12 nt, Mycobacterium bovis subsp bovis AF2122/97
ggcacguggcga

SEQ ID NO: 3163286 - RNA, 15 nt, Mycobacterium bovis subsp bovis AF2122/97
ggcacguggcgaccg

SEQ ID NO: 3163287 - RNA, 17 nt, Mycobacterium bovis subsp bovis AF2122/97
ggcacguggcgaccggc

SEQ ID NO: 3163288 - RNA, 19 nt, Mycobacterium bovis subsp bovis AF2122/97
ggcacguggcgaccggcga

SEQ ID NO: 3163289 - RNA, 16 nt, Mycobacterium bovis subsp bovis AF2122/97
ggcacguucagccagg

SEQ ID NO: 3163290 - RNA, 20 nt, Mycobacterium bovis subsp bovis AF2122/97
ggcacguucagccaggcgug

SEQ ID NO: 3163291 - RNA, 18 nt, Mycobacterium bovis subsp bovis AF2122/97
ggcacguugugaucguca

SEQ ID NO: 3163292 - RNA, 19 nt, Mycobacterium bovis subsp bovis AF2122/97
ggcacguugugaucgucag

SEQ ID NO: 3163293 - RNA, 22 nt, Mycobacterium bovis subsp bovis AF2122/97
ggcacguuuacauagaccaccg

SEQ ID NO: 3163294 - RNA, 14 nt, Mycobacterium bovis subsp bovis AF2122/97
ggcacuacgcagcc

SEQ ID NO: 3163295 - RNA, 19 nt, Mycobacterium bovis subsp bovis AF2122/97
ggcacuagcgagccggcgc

SEQ ID NO: 3163296 - RNA, 13 nt, Mycobacterium bovis subsp bovis AF2122/97
ggcacuccaccgg

SEQ ID NO: 3163297 - RNA, 16 nt, Mycobacterium bovis subsp bovis AF2122/97
ggcacuccaccgggau

SEQ ID NO: 3163298 - RNA, 20 nt, Mycobacterium bovis subsp bovis AF2122/97
ggcacuccaccgggauagcc

SEQ ID NO: 3163299 - RNA, 15 nt, Mycobacterium bovis subsp bovis AF2122/97
ggcacuccagcggcg

SEQ ID NO: 3163300 - RNA, 16 nt, Mycobacterium bovis subsp bovis AF2122/97
ggcacuccagcggcgg

SEQ ID NO: 3163301 - RNA, 17 nt, Mycobacterium bovis subsp bovis AF2122/97
ggcacuccagcggcggg

SEQ ID NO: 3163302 - RNA, 13 nt, Mycobacterium bovis subsp bovis AF2122/97
ggcagcccggcgg

SEQ ID NO: 3163303 - RNA, 18 nt, Mycobacterium bovis subsp bovis AF2122/97
ggcagcccggcggccgcu

SEQ ID NO: 3163304 - RNA, 16 nt, Mycobacterium bovis subsp bovis AF2122/97
ggcagcccgggcgugg

SEQ ID NO: 3163305 - RNA, 20 nt, Mycobacterium bovis subsp bovis AF2122/97
ggcagcccggugugcugcac

SEQ ID NO: 3163306 - RNA, 13 nt, Mycobacterium bovis subsp bovis AF2122/97
ggcagcccgucgg

SEQ ID NO: 3163307 - RNA, 23 nt, Mycobacterium bovis subsp bovis AF2122/97
ggcagcccucugguggcgcugaa

SEQ ID NO: 3163308 - RNA, 17 nt, Mycobacterium bovis subsp bovis AF2122/97
ggcagccgaagcgcccg

SEQ ID NO: 3163309 - RNA, 13 nt, Mycobacterium bovis subsp bovis AF2122/97
ggcagccgcccgc

SEQ ID NO: 3163310 - RNA, 16 nt, Mycobacterium bovis subsp bovis AF2122/97
ggcagccgcccgccag

SEQ ID NO: 3163311 - RNA, 15 nt, Mycobacterium bovis subsp bovis AF2122/97
ggcagccgcgccgcg

SEQ ID NO: 3163312 - RNA, 18 nt, Mycobacterium bovis subsp bovis AF2122/97
ggcagccgcgccgcggcc

SEQ ID NO: 3163313 - RNA, 19 nt, Mycobacterium bovis subsp bovis AF2122/97
ggcagccgcgccgcggccc

SEQ ID NO: 3163314 - RNA, 14 nt, Mycobacterium bovis subsp bovis AF2122/97
ggcagccggcuugg

SEQ ID NO: 3163315 - RNA, 15 nt, Mycobacterium bovis subsp bovis AF2122/97
ggcagccgggcggca

SEQ ID NO: 3163316 - RNA, 20 nt, Mycobacterium bovis subsp bovis AF2122/97
ggcagccgggcggcagcggc

SEQ ID NO: 3163317 - RNA, 14 nt, Mycobacterium bovis subsp bovis AF2122/97
ggcagccgggcguc

SEQ ID NO: 3163318 - RNA, 16 nt, Mycobacterium bovis subsp bovis AF2122/97
ggcagccgggcgucgc

SEQ ID NO: 3163319 - RNA, 12 nt, Mycobacterium bovis subsp bovis AF2122/97
ggcagccugcug

SEQ ID NO: 3163320 - RNA, 13 nt, Mycobacterium bovis subsp bovis AF2122/97
ggcagccugcugc

SEQ ID NO: 3163321 - RNA, 17 nt, Mycobacterium bovis subsp bovis AF2122/97
ggcagccuggccucgcc

SEQ ID NO: 3163322 - RNA, 16 nt, Mycobacterium bovis subsp bovis AF2122/97
ggcagcgaccgucguc

SEQ ID NO: 3163323 - RNA, 19 nt, Mycobacterium bovis subsp bovis AF2122/97
ggcagcgaccgucguccag

SEQ ID NO: 3163324 - RNA, 13 nt, Mycobacterium bovis subsp bovis AF2122/97
ggcagcgacgccg

SEQ ID NO: 3163325 - RNA, 16 nt, Mycobacterium bovis subsp bovis AF2122/97
ggcagcgacgccggcc

SEQ ID NO: 3163326 - RNA, 20 nt, Mycobacterium bovis subsp bovis AF2122/97
ggcagcgagacuucgacgcg

SEQ ID NO: 3163327 - RNA, 16 nt, Mycobacterium bovis subsp bovis AF2122/97
ggcagcgagucgacgu

SEQ ID NO: 3163328 - RNA, 19 nt, Mycobacterium bovis subsp bovis AF2122/97
ggcagcgagucgacgucga

SEQ ID NO: 3163329 - RNA, 21 nt, Mycobacterium bovis subsp bovis AF2122/97
ggcagcgcccagaucgccgag

SEQ ID NO: 3163330 - RNA, 14 nt, Mycobacterium bovis subsp bovis AF2122/97
ggcagcgcccccgg

SEQ ID NO: 3163331 - RNA, 16 nt, Mycobacterium bovis subsp bovis AF2122/97
ggcagcgccgcagcga

SEQ ID NO: 3163332 - RNA, 23 nt, Mycobacterium bovis subsp bovis AF2122/97
ggcagcgccggucggaucgguga

SEQ ID NO: 3163333 - RNA, 21 nt, Mycobacterium bovis subsp bovis AF2122/97
ggcagcgcgaggcucguggcg

SEQ ID NO: 3163334 - RNA, 16 nt, Mycobacterium bovis subsp bovis AF2122/97
ggcagcgcgcccgaca

SEQ ID NO: 3163335 - RNA, 12 nt, Mycobacterium bovis subsp bovis AF2122/97
ggcagcgcggcc

SEQ ID NO: 3163336 - RNA, 15 nt, Mycobacterium bovis subsp bovis AF2122/97
ggcagcgcggccacc

SEQ ID NO: 3163337 - RNA, 16 nt, Mycobacterium bovis subsp bovis AF2122/97
ggcagcgcggccaccc

SEQ ID NO: 3163338 - RNA, 15 nt, Mycobacterium bovis subsp bovis AF2122/97
ggcagcgcggccagu

SEQ ID NO: 3163339 - RNA, 14 nt, Mycobacterium bovis subsp bovis AF2122/97
ggcagcgcggccgg

SEQ ID NO: 3163340 - RNA, 15 nt, Mycobacterium bovis subsp bovis AF2122/97
ggcagcgcggccggg

SEQ ID NO: 3163341 - RNA, 13 nt, Mycobacterium bovis subsp bovis AF2122/97
ggcagcgcuggcu

SEQ ID NO: 3163342 - RNA, 21 nt, Mycobacterium bovis subsp bovis AF2122/97
ggcagcggaccgcugccugcc

SEQ ID NO: 3163343 - RNA, 17 nt, Mycobacterium bovis subsp bovis AF2122/97
ggcagcggcaucggcca

SEQ ID NO: 3163344 - RNA, 15 nt, Mycobacterium bovis subsp bovis AF2122/97
ggcagcggccuccgg

SEQ ID NO: 3163345 - RNA, 16 nt, Mycobacterium bovis subsp bovis AF2122/97
ggcagcggccuccggg

SEQ ID NO: 3163346 - RNA, 19 nt, Mycobacterium bovis subsp bovis AF2122/97
ggcagcggcgaucaggcgg

SEQ ID NO: 3163347 - RNA, 18 nt, Mycobacterium bovis subsp bovis AF2122/97
ggcagcggcgaucggagg

SEQ ID NO: 3163348 - RNA, 15 nt, Mycobacterium bovis subsp bovis AF2122/97
ggcagcggcgcgcug

SEQ ID NO: 3163349 - RNA, 12 nt, Mycobacterium bovis subsp bovis AF2122/97
ggcagcggcggu

SEQ ID NO: 3163350 - RNA, 13 nt, Mycobacterium bovis subsp bovis AF2122/97
ggcagcggcgucg

SEQ ID NO: 3163351 - RNA, 13 nt, Mycobacterium bovis subsp bovis AF2122/97
ggcagcgggacug

SEQ ID NO: 3163352 - RNA, 19 nt, Mycobacterium bovis subsp bovis AF2122/97
ggcagcgggacugcggaag

SEQ ID NO: 3163353 - RNA, 20 nt, Mycobacterium bovis subsp bovis AF2122/97
ggcagcgggacugcggaagc

SEQ ID NO: 3163354 - RNA, 12 nt, Mycobacterium bovis subsp bovis AF2122/97
ggcagcgggccg

SEQ ID NO: 3163355 - RNA, 23 nt, Mycobacterium bovis subsp bovis AF2122/97
ggcagcggguuugccgggcgcug

SEQ ID NO: 3163356 - RNA, 14 nt, Mycobacterium bovis subsp bovis AF2122/97
ggcagcggugcugg

SEQ ID NO: 3163357 - RNA, 22 nt, Mycobacterium bovis subsp bovis AF2122/97
ggcagcggugcugguggcggca

SEQ ID NO: 3163358 - RNA, 14 nt, Mycobacterium bovis subsp bovis AF2122/97
ggcagcgguggcaa

SEQ ID NO: 3163359 - RNA, 14 nt, Mycobacterium bovis subsp bovis AF2122/97
ggcagcgguggcuu

SEQ ID NO: 3163360 - RNA, 15 nt, Mycobacterium bovis subsp bovis AF2122/97
ggcagcgguggcuug

SEQ ID NO: 3163361 - RNA, 16 nt, Mycobacterium bovis subsp bovis AF2122/97
ggcagcgguguagccg

SEQ ID NO: 3163362 - RNA, 17 nt, Mycobacterium bovis subsp bovis AF2122/97
ggcagcgguguagccgg

SEQ ID NO: 3163363 - RNA, 18 nt, Mycobacterium bovis subsp bovis AF2122/97
ggcagcgguguagccggc

SEQ ID NO: 3163364 - RNA, 19 nt, Mycobacterium bovis subsp bovis AF2122/97
ggcagcgguguagccggcg

SEQ ID NO: 3163365 - RNA, 16 nt, Mycobacterium bovis subsp bovis AF2122/97
ggcagcguagugcugc

SEQ ID NO: 3163366 - RNA, 19 nt, Mycobacterium bovis subsp bovis AF2122/97
ggcagcgucacccugucgc

SEQ ID NO: 3163367 - RNA, 17 nt, Mycobacterium bovis subsp bovis AF2122/97
ggcagcgucgucgacga

SEQ ID NO: 3163368 - RNA, 19 nt, Mycobacterium bovis subsp bovis AF2122/97
ggcagcgucgucgacgaca

SEQ ID NO: 3163369 - RNA, 17 nt, Mycobacterium bovis subsp bovis AF2122/97
ggcagcguugacgguca

SEQ ID NO: 3163370 - RNA, 15 nt, Mycobacterium bovis subsp bovis AF2122/97
ggcagcuacggggcg

SEQ ID NO: 3163371 - RNA, 22 nt, Mycobacterium bovis subsp bovis AF2122/97
ggcagcucccgccacgucgccg

SEQ ID NO: 3163372 - RNA, 16 nt, Mycobacterium bovis subsp bovis AF2122/97
ggcagcuccgccgccg

SEQ ID NO: 3163373 - RNA, 17 nt, Mycobacterium bovis subsp bovis AF2122/97
ggcagcuccgccgccga

SEQ ID NO: 3163374 - RNA, 20 nt, Mycobacterium bovis subsp bovis AF2122/97
ggcagcuccgccgccgacgg

SEQ ID NO: 3163375 - RNA, 21 nt, Mycobacterium bovis subsp bovis AF2122/97
ggcagcuccucgcgcucgccg

SEQ ID NO: 3163376 - RNA, 22 nt, Mycobacterium bovis subsp bovis AF2122/97
ggcagcuccucgcgcucgccgg

SEQ ID NO: 3163377 - RNA, 18 nt, Mycobacterium bovis subsp bovis AF2122/97
ggcagcucggggcacaag

SEQ ID NO: 3163378 - RNA, 22 nt, Mycobacterium bovis subsp bovis AF2122/97
ggcagcuggucggugggcuugc

SEQ ID NO: 3163379 - RNA, 19 nt, Mycobacterium bovis subsp bovis AF2122/97
ggcagcuucaacaccggca

SEQ ID NO: 3163380 - RNA, 22 nt, Mycobacterium bovis subsp bovis AF2122/97
ggcagcuucucgccgacgaacu

SEQ ID NO: 3163381 - RNA, 22 nt, Mycobacterium bovis subsp bovis AF2122/97
ggcagcuugcagugccgccggc

SEQ ID NO: 3163382 - RNA, 23 nt, Mycobacterium bovis subsp bovis AF2122/97
ggcagcuugcagugccgccggcc

SEQ ID NO: 3163383 - RNA, 20 nt, Mycobacterium bovis subsp bovis AF2122/97
ggcagcuugccaaucaccgu

SEQ ID NO: 3163384 - RNA, 22 nt, Mycobacterium bovis subsp bovis AF2122/97
ggcagcuuggacucaucggcgu

SEQ ID NO: 3163385 - RNA, 19 nt, Mycobacterium bovis subsp bovis AF2122/97
ggcaggaaacucagguccg

SEQ ID NO: 3163386 - RNA, 19 nt, Mycobacterium bovis subsp bovis AF2122/97
ggcaggaaucgggucagca

SEQ ID NO: 3163387 - RNA, 16 nt, Mycobacterium bovis subsp bovis AF2122/97
ggcaggaaugccgcgg

SEQ ID NO: 3163388 - RNA, 16 nt, Mycobacterium bovis subsp bovis AF2122/97
ggcaggagaacacauc

SEQ ID NO: 3163389 - RNA, 14 nt, Mycobacterium bovis subsp bovis AF2122/97
ggcaucaccgacgc

SEQ ID NO: 3163390 - RNA, 22 nt, Mycobacterium bovis subsp bovis AF2122/97
ggcaucaccgacgcgucggcga

SEQ ID NO: 3163391 - RNA, 16 nt, Mycobacterium bovis subsp bovis AF2122/97
ggcaucaccgccgcgg

SEQ ID NO: 3163392 - RNA, 18 nt, Mycobacterium bovis subsp bovis AF2122/97
ggcaucaccgccgcggcc

SEQ ID NO: 3163393 - RNA, 21 nt, Mycobacterium bovis subsp bovis AF2122/97
ggcaucaccgccgcggccgcc

SEQ ID NO: 3163394 - RNA, 23 nt, Mycobacterium bovis subsp bovis AF2122/97
ggcaucaccgccgcggccgccgu

SEQ ID NO: 3163395 - RNA, 13 nt, Mycobacterium bovis subsp bovis AF2122/97
ggcaucaccuggc

SEQ ID NO: 3163396 - RNA, 17 nt, Mycobacterium bovis subsp bovis AF2122/97
ggcaucaggccgcgcgg

SEQ ID NO: 3163397 - RNA, 21 nt, Mycobacterium bovis subsp bovis AF2122/97
ggcaucaucagcggcgccgca

SEQ ID NO: 3163398 - RNA, 14 nt, Mycobacterium bovis subsp bovis AF2122/97
ggcaucaucgacgc

SEQ ID NO: 3163399 - RNA, 22 nt, Mycobacterium bovis subsp bovis AF2122/97
ggcaucaucgcugugcgcuggu

SEQ ID NO: 3163400 - RNA, 14 nt, Mycobacterium bovis subsp bovis AF2122/97
ggcauccagcagcg

SEQ ID NO: 3163401 - RNA, 17 nt, Mycobacterium bovis subsp bovis AF2122/97
ggcauccagcagcgccu

SEQ ID NO: 3163402 - RNA, 22 nt, Mycobacterium bovis subsp bovis AF2122/97
ggcauccccaguugugcggcca

SEQ ID NO: 3163403 - RNA, 11 nt, Mycobacterium bovis subsp bovis AF2122/97
ggcaucccgcc

SEQ ID NO: 3163404 - RNA, 22 nt, Mycobacterium bovis subsp bovis AF2122/97
ggcaucccgggcaguccaggca

SEQ ID NO: 3163405 - RNA, 17 nt, Mycobacterium bovis subsp bovis AF2122/97
ggcauccgccccgcccg

SEQ ID NO: 3163406 - RNA, 18 nt, Mycobacterium bovis subsp bovis AF2122/97
ggcauccgccccgcccgc

SEQ ID NO: 3163407 - RNA, 21 nt, Mycobacterium bovis subsp bovis AF2122/97
ggcauccgccccgcccgcacc

SEQ ID NO: 3163408 - RNA, 18 nt, Mycobacterium bovis subsp bovis AF2122/97
ggcauccucugaaccagc

SEQ ID NO: 3163409 - RNA, 22 nt, Mycobacterium bovis subsp bovis AF2122/97
ggcauccugcacgacccgcugg

SEQ ID NO: 3163410 - RNA, 14 nt, Mycobacterium bovis subsp bovis AF2122/97
ggcauccuucacca

SEQ ID NO: 3163411 - RNA, 17 nt, Mycobacterium bovis subsp bovis AF2122/97
ggcaucgaacgcccuga

SEQ ID NO: 3163412 - RNA, 12 nt, Mycobacterium bovis subsp bovis AF2122/97
ggcaucgacgcg

SEQ ID NO: 3163413 - RNA, 17 nt, Mycobacterium bovis subsp bovis AF2122/97
ggcaucgagacgagcca

SEQ ID NO: 3163414 - RNA, 18 nt, Mycobacterium bovis subsp bovis AF2122/97
ggcaucgaguucggcccg

SEQ ID NO: 3163415 - RNA, 14 nt, Mycobacterium bovis subsp bovis AF2122/97
ggcaucgccgagcu

SEQ ID NO: 3163416 - RNA, 23 nt, Mycobacterium bovis subsp bovis AF2122/97
ggcaucgccuccaggcgccaccc

SEQ ID NO: 3163417 - RNA, 17 nt, Mycobacterium bovis subsp bovis AF2122/97
ggcaucgcgagccagcu

SEQ ID NO: 3163418 - RNA, 19 nt, Mycobacterium bovis subsp bovis AF2122/97
ggcaucgcgagccagcugc

SEQ ID NO: 3163419 - RNA, 21 nt, Mycobacterium bovis subsp bovis AF2122/97
ggcaucgcgagccagcugcuc

SEQ ID NO: 3163420 - RNA, 19 nt, Mycobacterium bovis subsp bovis AF2122/97
ggcaucgcgcaaccgggcg

SEQ ID NO: 3163421 - RNA, 20 nt, Mycobacterium bovis subsp bovis AF2122/97
ggcaucgcgcgcggcuccgu

SEQ ID NO: 3163422 - RNA, 14 nt, Mycobacterium bovis subsp bovis AF2122/97
ggcaucgcggaagc

SEQ ID NO: 3163423 - RNA, 20 nt, Mycobacterium bovis subsp bovis AF2122/97
ggcaucgcggaagcgggcga

SEQ ID NO: 3163424 - RNA, 17 nt, Mycobacterium bovis subsp bovis AF2122/97
ggcaucgcgggcggcgc

SEQ ID NO: 3163425 - RNA, 22 nt, Mycobacterium bovis subsp bovis AF2122/97
ggcaucggagauacgggccacc

SEQ ID NO: 3163426 - RNA, 23 nt, Mycobacterium bovis subsp bovis AF2122/97
ggcaucggagauacgggccaccg

SEQ ID NO: 3163427 - RNA, 11 nt, Mycobacterium bovis subsp bovis AF2122/97
ggcaucggcca

SEQ ID NO: 3163428 - RNA, 14 nt, Mycobacterium bovis subsp bovis AF2122/97
ggcaucggccaccu

SEQ ID NO: 3163429 - RNA, 16 nt, Mycobacterium bovis subsp bovis AF2122/97
ggcaucggccaccugu

SEQ ID NO: 3163430 - RNA, 14 nt, Mycobacterium bovis subsp bovis AF2122/97
ggcaucggccaucu

SEQ ID NO: 3163431 - RNA, 23 nt, Mycobacterium bovis subsp bovis AF2122/97
ggcaucggccuguucgccgucgc

SEQ ID NO: 3163432 - RNA, 15 nt, Mycobacterium bovis subsp bovis AF2122/97
ggcaucggcggcaac

SEQ ID NO: 3163433 - RNA, 20 nt, Mycobacterium bovis subsp bovis AF2122/97
ggcaucggcggcaacggcgg

SEQ ID NO: 3163434 - RNA, 16 nt, Mycobacterium bovis subsp bovis AF2122/97
ggcaucggcggcaagg

SEQ ID NO: 3163435 - RNA, 20 nt, Mycobacterium bovis subsp bovis AF2122/97
ggcaucggcggcgucuucgu

SEQ ID NO: 3163436 - RNA, 13 nt, Mycobacterium bovis subsp bovis AF2122/97
ggcaucggugcgg

SEQ ID NO: 3163437 - RNA, 17 nt, Mycobacterium bovis subsp bovis AF2122/97
ggcaucuccaccgucgc

SEQ ID NO: 3163438 - RNA, 23 nt, Mycobacterium bovis subsp bovis AF2122/97
ggcaucuccaccgucgccgccgg

SEQ ID NO: 3163439 - RNA, 16 nt, Mycobacterium bovis subsp bovis AF2122/97
ggcaugaccgcugccg

SEQ ID NO: 3163440 - RNA, 20 nt, Mycobacterium bovis subsp bovis AF2122/97
ggcaugacgaaugcgggugg

SEQ ID NO: 3163441 - RNA, 19 nt, Mycobacterium bovis subsp bovis AF2122/97
ggcaugauccccguugacc

SEQ ID NO: 3163442 - RNA, 23 nt, Mycobacterium bovis subsp bovis AF2122/97
ggcaugauccccguugacccaga

SEQ ID NO: 3163443 - RNA, 20 nt, Mycobacterium bovis subsp bovis AF2122/97
ggcaugauuuuucgcaguga

SEQ ID NO: 3163444 - RNA, 18 nt, Mycobacterium bovis subsp bovis AF2122/97
ggcaugcagaucucacgg

SEQ ID NO: 3163445 - RNA, 21 nt, Mycobacterium bovis subsp bovis AF2122/97
ggcaugcagaucucacggagg

SEQ ID NO: 3163446 - RNA, 14 nt, Mycobacterium bovis subsp bovis AF2122/97
ggcaugcagcccca

SEQ ID NO: 3163447 - RNA, 17 nt, Mycobacterium bovis subsp bovis AF2122/97
ggcaugcagccccacuu

SEQ ID NO: 3163448 - RNA, 12 nt, Mycobacterium bovis subsp bovis AF2122/97
ggcaugccacac

SEQ ID NO: 3163449 - RNA, 16 nt, Mycobacterium bovis subsp bovis AF2122/97
ggcaugcccgcgguga

SEQ ID NO: 3163450 - RNA, 13 nt, Mycobacterium bovis subsp bovis AF2122/97
ggcaugccgcccg

SEQ ID NO: 3163451 - RNA, 14 nt, Mycobacterium bovis subsp bovis AF2122/97
ggcaugccggcgaa

SEQ ID NO: 3163452 - RNA, 17 nt, Mycobacterium bovis subsp bovis AF2122/97
ggcaugccggcgugcgg

SEQ ID NO: 3163453 - RNA, 20 nt, Mycobacterium bovis subsp bovis AF2122/97
ggcaugcgacagaugccggg

SEQ ID NO: 3163454 - RNA, 20 nt, Mycobacterium bovis subsp bovis AF2122/97
ggcaugcggaucggcggacc

SEQ ID NO: 3163455 - RNA, 14 nt, Mycobacterium bovis subsp bovis AF2122/97
ggcaugcgugccgg

SEQ ID NO: 3163456 - RNA, 15 nt, Mycobacterium bovis subsp bovis AF2122/97
ggcaugcgugccggc

SEQ ID NO: 3163457 - RNA, 18 nt, Mycobacterium bovis subsp bovis AF2122/97
ggcaugcuggcgaucgcg

SEQ ID NO: 3163458 - RNA, 16 nt, Mycobacterium bovis subsp bovis AF2122/97
ggcauggccuggguug

SEQ ID NO: 3163459 - RNA, 22 nt, Mycobacterium bovis subsp bovis AF2122/97
ggcauggcgaacacgucggcca

SEQ ID NO: 3163460 - RNA, 22 nt, Mycobacterium bovis subsp bovis AF2122/97
ggcaugggcccugcacagcagc

SEQ ID NO: 3163461 - RNA, 15 nt, Mycobacterium bovis subsp bovis AF2122/97
ggcaugggccggcgc

SEQ ID NO: 3163462 - RNA, 21 nt, Mycobacterium bovis subsp bovis AF2122/97
ggcaugggccggcgccgcacc

SEQ ID NO: 3163463 - RNA, 15 nt, Mycobacterium bovis subsp bovis AF2122/97
ggcauggucaggcgg

SEQ ID NO: 3163464 - RNA, 16 nt, Mycobacterium bovis subsp bovis AF2122/97
ggcauggucaggcggc

SEQ ID NO: 3163465 - RNA, 21 nt, Mycobacterium bovis subsp bovis AF2122/97
ggcauggucaggcggccgucg

SEQ ID NO: 3163466 - RNA, 14 nt, Mycobacterium bovis subsp bovis AF2122/97
ggcauggucgccgg

SEQ ID NO: 3163467 - RNA, 13 nt, Mycobacterium bovis subsp bovis AF2122/97
ggcaugguggugg

SEQ ID NO: 3163468 - RNA, 14 nt, Mycobacterium bovis subsp bovis AF2122/97
ggcauggugguggc

SEQ ID NO: 3163469 - RNA, 16 nt, Mycobacterium bovis subsp bovis AF2122/97
ggcauguaccgaccgc

SEQ ID NO: 3163470 - RNA, 17 nt, Mycobacterium bovis subsp bovis AF2122/97
ggcauguaccgaccgcg

SEQ ID NO: 3163471 - RNA, 19 nt, Mycobacterium bovis subsp bovis AF2122/97
ggcauguaccgaccgcguu

SEQ ID NO: 3163472 - RNA, 22 nt, Mycobacterium bovis subsp bovis AF2122/97
ggcauguauuucgugccggcgu

SEQ ID NO: 3163473 - RNA, 13 nt, Mycobacterium bovis subsp bovis AF2122/97
ggcaugucgccga

SEQ ID NO: 3163474 - RNA, 20 nt, Mycobacterium bovis subsp bovis AF2122/97
ggcaugucgccgaacgccac

SEQ ID NO: 3163475 - RNA, 11 nt, Mycobacterium bovis subsp bovis AF2122/97
ggccaccaccu

SEQ ID NO: 3163476 - RNA, 16 nt, Mycobacterium bovis subsp bovis AF2122/97
ggccaccacgcgccgc

SEQ ID NO: 3163477 - RNA, 17 nt, Mycobacterium bovis subsp bovis AF2122/97
ggccaccacgugcgcgu

SEQ ID NO: 3163478 - RNA, 12 nt, Mycobacterium bovis subsp bovis AF2122/97
ggccaccacugc

SEQ ID NO: 3163479 - RNA, 22 nt, Mycobacterium bovis subsp bovis AF2122/97
ggccaccacugcgcccgccacg

SEQ ID NO: 3163480 - RNA, 14 nt, Mycobacterium bovis subsp bovis AF2122/97
ggccaccagaacca

SEQ ID NO: 3163481 - RNA, 23 nt, Mycobacterium bovis subsp bovis AF2122/97
ggccaccagaucgcacaccaaca

SEQ ID NO: 3163482 - RNA, 14 nt, Mycobacterium bovis subsp bovis AF2122/97
ggccaccagcaugc

SEQ ID NO: 3163483 - RNA, 20 nt, Mycobacterium bovis subsp bovis AF2122/97
ggccaccagcccgaugaucc

SEQ ID NO: 3163484 - RNA, 11 nt, Mycobacterium bovis subsp bovis AF2122/97
ggccaccagcg

SEQ ID NO: 3163485 - RNA, 15 nt, Mycobacterium bovis subsp bovis AF2122/97
ggccaccagcgcccg

SEQ ID NO: 3163486 - RNA, 18 nt, Mycobacterium bovis subsp bovis AF2122/97
ggccaccagcgcccggcc

SEQ ID NO: 3163487 - RNA, 21 nt, Mycobacterium bovis subsp bovis AF2122/97
ggccaccagcgcccggcccgc

SEQ ID NO: 3163488 - RNA, 14 nt, Mycobacterium bovis subsp bovis AF2122/97
ggccaccagggcca

SEQ ID NO: 3163489 - RNA, 21 nt, Mycobacterium bovis subsp bovis AF2122/97
ggccaccagggccaccgcgcc

SEQ ID NO: 3163490 - RNA, 16 nt, Mycobacterium bovis subsp bovis AF2122/97
ggccaccaggugccgu

SEQ ID NO: 3163491 - RNA, 16 nt, Mycobacterium bovis subsp bovis AF2122/97
ggccaccaguccgaug

SEQ ID NO: 3163492 - RNA, 13 nt, Mycobacterium bovis subsp bovis AF2122/97
ggccaccaucgcc

SEQ ID NO: 3163493 - RNA, 14 nt, Mycobacterium bovis subsp bovis AF2122/97
ggccaccaucgccg

SEQ ID NO: 3163494 - RNA, 17 nt, Mycobacterium bovis subsp bovis AF2122/97
ggccaccaucgccgccg

SEQ ID NO: 3163495 - RNA, 19 nt, Mycobacterium bovis subsp bovis AF2122/97
ggccaccaucgccgccguu

SEQ ID NO: 3163496 - RNA, 22 nt, Mycobacterium bovis subsp bovis AF2122/97
ggccaccaucgccgccguugcc

SEQ ID NO: 3163497 - RNA, 22 nt, Mycobacterium bovis subsp bovis AF2122/97
ggccaccccgaccucccggcaa

SEQ ID NO: 3163498 - RNA, 17 nt, Mycobacterium bovis subsp bovis AF2122/97
ggccacccgcaggucgc

SEQ ID NO: 3163499 - RNA, 20 nt, Mycobacterium bovis subsp bovis AF2122/97
ggccacccgcgaagccgcca

SEQ ID NO: 3163500 - RNA, 15 nt, Mycobacterium bovis subsp bovis AF2122/97
ggccacccgcgacga

SEQ ID NO: 3163501 - RNA, 19 nt, Mycobacterium bovis subsp bovis AF2122/97
ggccacccgcgcgaugcug

SEQ ID NO: 3163502 - RNA, 18 nt, Mycobacterium bovis subsp bovis AF2122/97
ggccacccggccgcgcgg

SEQ ID NO: 3163503 - RNA, 22 nt, Mycobacterium bovis subsp bovis AF2122/97
ggccacccggccgcgcggggug

SEQ ID NO: 3163504 - RNA, 15 nt, Mycobacterium bovis subsp bovis AF2122/97
ggccacccgguggcg

SEQ ID NO: 3163505 - RNA, 13 nt, Mycobacterium bovis subsp bovis AF2122/97
ggccaccgaacgc

SEQ ID NO: 3163506 - RNA, 17 nt, Mycobacterium bovis subsp bovis AF2122/97
ggccaccgaacgcggcc

SEQ ID NO: 3163507 - RNA, 20 nt, Mycobacterium bovis subsp bovis AF2122/97
ggccaccgaacgcggccacc

SEQ ID NO: 3163508 - RNA, 21 nt, Mycobacterium bovis subsp bovis AF2122/97
ggccaccgaccgcaugaucgc

SEQ ID NO: 3163509 - RNA, 13 nt, Mycobacterium bovis subsp bovis AF2122/97
ggccaccgaggcg

SEQ ID NO: 3163510 - RNA, 17 nt, Mycobacterium bovis subsp bovis AF2122/97
ggccaccgagucgauca

SEQ ID NO: 3163511 - RNA, 17 nt, Mycobacterium bovis subsp bovis AF2122/97
ggccaccgcagacgccg

SEQ ID NO: 3163512 - RNA, 17 nt, Mycobacterium bovis subsp bovis AF2122/97
ggccaccgcaucgccga

SEQ ID NO: 3163513 - RNA, 13 nt, Mycobacterium bovis subsp bovis AF2122/97
ggccaccgccgcc

SEQ ID NO: 3163514 - RNA, 17 nt, Mycobacterium bovis subsp bovis AF2122/97
ggccaccgccgccgcca

SEQ ID NO: 3163515 - RNA, 18 nt, Mycobacterium bovis subsp bovis AF2122/97
ggccaccgccgccgccga

SEQ ID NO: 3163516 - RNA, 18 nt, Mycobacterium bovis subsp bovis AF2122/97
ggccaccgccgccugccc

SEQ ID NO: 3163517 - RNA, 19 nt, Mycobacterium bovis subsp bovis AF2122/97
ggccaccgccgccugcccg

SEQ ID NO: 3163518 - RNA, 16 nt, Mycobacterium bovis subsp bovis AF2122/97
ggccaccgcgcaaccc

SEQ ID NO: 3163519 - RNA, 14 nt, Mycobacterium bovis subsp bovis AF2122/97
ggccaccgcgccgu

SEQ ID NO: 3163520 - RNA, 23 nt, Mycobacterium bovis subsp bovis AF2122/97
ggccaccggaauccuggccgccg

SEQ ID NO: 3163521 - RNA, 22 nt, Mycobacterium bovis subsp bovis AF2122/97
ggccaccggacgaaacgaucgc

SEQ ID NO: 3163522 - RNA, 23 nt, Mycobacterium bovis subsp bovis AF2122/97
ggccaccggacgaaacgaucgcg

SEQ ID NO: 3163523 - RNA, 15 nt, Mycobacterium bovis subsp bovis AF2122/97
ggccaccggcgaccg

SEQ ID NO: 3163524 - RNA, 13 nt, Mycobacterium bovis subsp bovis AF2122/97
ggccaccggcgcc

SEQ ID NO: 3163525 - RNA, 15 nt, Mycobacterium bovis subsp bovis AF2122/97
ggccaccggcgccgu

SEQ ID NO: 3163526 - RNA, 16 nt, Mycobacterium bovis subsp bovis AF2122/97
ggccaccggcggucug

SEQ ID NO: 3163527 - RNA, 13 nt, Mycobacterium bovis subsp bovis AF2122/97
ggccaccggcguc

SEQ ID NO: 3163528 - RNA, 23 nt, Mycobacterium bovis subsp bovis AF2122/97
ggccaccggcugcaaccagcggc

SEQ ID NO: 3163529 - RNA, 20 nt, Mycobacterium bovis subsp bovis AF2122/97
ggccaccguaaacagcgcgc

SEQ ID NO: 3163530 - RNA, 17 nt, Mycobacterium bovis subsp bovis AF2122/97
ggccaccguagccagca

SEQ ID NO: 3163531 - RNA, 12 nt, Mycobacterium bovis subsp bovis AF2122/97
ggccaccguccc

SEQ ID NO: 3163532 - RNA, 18 nt, Mycobacterium bovis subsp bovis AF2122/97
ggccaccgucgcggcggc

SEQ ID NO: 3163533 - RNA, 20 nt, Mycobacterium bovis subsp bovis AF2122/97
ggccaccgucgcggcggcac

SEQ ID NO: 3163534 - RNA, 16 nt, Mycobacterium bovis subsp bovis AF2122/97
ggccaccuccgaggcc

SEQ ID NO: 3163535 - RNA, 23 nt, Mycobacterium bovis subsp bovis AF2122/97
ggccaccuccgaggccgccaucg

SEQ ID NO: 3163536 - RNA, 16 nt, Mycobacterium bovis subsp bovis AF2122/97
ggccaccucuucucgg

SEQ ID NO: 3163537 - RNA, 16 nt, Mycobacterium bovis subsp bovis AF2122/97
ggccaccugcucgucg

SEQ ID NO: 3163538 - RNA, 16 nt, Mycobacterium bovis subsp bovis AF2122/97
ggccaccugcuggccg

SEQ ID NO: 3163539 - RNA, 20 nt, Mycobacterium bovis subsp bovis AF2122/97
ggccaccuugugcaggccca

SEQ ID NO: 3163540 - RNA, 16 nt, Mycobacterium bovis subsp bovis AF2122/97
ggccacgaacccucag

SEQ ID NO: 3163541 - RNA, 18 nt, Mycobacterium bovis subsp bovis AF2122/97
ggccacgaacccucagcc

SEQ ID NO: 3163542 - RNA, 17 nt, Mycobacterium bovis subsp bovis AF2122/97
ggccacgaauccgauca

SEQ ID NO: 3163543 - RNA, 15 nt, Mycobacterium bovis subsp bovis AF2122/97
ggccacgaccucggg

SEQ ID NO: 3163544 - RNA, 18 nt, Mycobacterium bovis subsp bovis AF2122/97
ggccacgaugaucccaag

SEQ ID NO: 3163545 - RNA, 16 nt, Mycobacterium bovis subsp bovis AF2122/97
ggccacgcaccgggug

SEQ ID NO: 3163546 - RNA, 22 nt, Mycobacterium bovis subsp bovis AF2122/97
ggccacgcauuccagcaggcca

SEQ ID NO: 3163547 - RNA, 13 nt, Mycobacterium bovis subsp bovis AF2122/97
ggccacgcccagg

SEQ ID NO: 3163548 - RNA, 14 nt, Mycobacterium bovis subsp bovis AF2122/97
ggccacgcccaggc

SEQ ID NO: 3163549 - RNA, 14 nt, Mycobacterium bovis subsp bovis AF2122/97
ggccacgccggcgu

SEQ ID NO: 3163550 - RNA, 21 nt, Mycobacterium bovis subsp bovis AF2122/97
ggccacgcgcacucgacgcca

SEQ ID NO: 3163551 - RNA, 21 nt, Mycobacterium bovis subsp bovis AF2122/97
ggccacgcuucuuccgcgcgc

SEQ ID NO: 3163552 - RNA, 23 nt, Mycobacterium bovis subsp bovis AF2122/97
ggccacgcuucuuccgcgcgccg

SEQ ID NO: 3163553 - RNA, 20 nt, Mycobacterium bovis subsp bovis AF2122/97
ggccacggaaguaucgccgg

SEQ ID NO: 3163554 - RNA, 22 nt, Mycobacterium bovis subsp bovis AF2122/97
ggccacggaaguaucgccggcc

SEQ ID NO: 3163555 - RNA, 16 nt, Mycobacterium bovis subsp bovis AF2122/97
ggccacggcgucggcc

SEQ ID NO: 3163556 - RNA, 18 nt, Mycobacterium bovis subsp bovis AF2122/97
ggccacggcgucggccac

SEQ ID NO: 3163557 - RNA, 19 nt, Mycobacterium bovis subsp bovis AF2122/97
ggccacggcgucggccacc

SEQ ID NO: 3163558 - RNA, 20 nt, Mycobacterium bovis subsp bovis AF2122/97
ggccacggcgucggccaccc

SEQ ID NO: 3163559 - RNA, 17 nt, Mycobacterium bovis subsp bovis AF2122/97
ggccacggggcugccgg

SEQ ID NO: 3163560 - RNA, 16 nt, Mycobacterium bovis subsp bovis AF2122/97
ggccacgguccggccc

SEQ ID NO: 3163561 - RNA, 22 nt, Mycobacterium bovis subsp bovis AF2122/97
ggccacguagcagcagacgacg

SEQ ID NO: 3163562 - RNA, 13 nt, Mycobacterium bovis subsp bovis AF2122/97
ggccagccgacgc

SEQ ID NO: 3163563 - RNA, 16 nt, Mycobacterium bovis subsp bovis AF2122/97
ggccagccgacgcggc

SEQ ID NO: 3163564 - RNA, 17 nt, Mycobacterium bovis subsp bovis AF2122/97
ggccagccgacgcggcg

SEQ ID NO: 3163565 - RNA, 19 nt, Mycobacterium bovis subsp bovis AF2122/97
ggccagccgacgcggcggg

SEQ ID NO: 3163566 - RNA, 15 nt, Mycobacterium bovis subsp bovis AF2122/97
ggccagccgcacggu

SEQ ID NO: 3163567 - RNA, 17 nt, Mycobacterium bovis subsp bovis AF2122/97
ggccagccgcuccacgu

SEQ ID NO: 3163568 - RNA, 22 nt, Mycobacterium bovis subsp bovis AF2122/97
ggccagccguucucgcccaccc

SEQ ID NO: 3163569 - RNA, 15 nt, Mycobacterium bovis subsp bovis AF2122/97
ggccagccuaccggc

SEQ ID NO: 3163570 - RNA, 16 nt, Mycobacterium bovis subsp bovis AF2122/97
ggccagccuaccggcu

SEQ ID NO: 3163571 - RNA, 22 nt, Mycobacterium bovis subsp bovis AF2122/97
ggccagcgaugugaaccgggca

SEQ ID NO: 3163572 - RNA, 13 nt, Mycobacterium bovis subsp bovis AF2122/97
ggccagcgcccgc

SEQ ID NO: 3163573 - RNA, 18 nt, Mycobacterium bovis subsp bovis AF2122/97
ggccagcgccucggcauc

SEQ ID NO: 3163574 - RNA, 13 nt, Mycobacterium bovis subsp bovis AF2122/97
ggccagcgcgccc

SEQ ID NO: 3163575 - RNA, 16 nt, Mycobacterium bovis subsp bovis AF2122/97
ggccagcgcgcccgcg

SEQ ID NO: 3163576 - RNA, 12 nt, Mycobacterium bovis subsp bovis AF2122/97
ggccagcgcggc

SEQ ID NO: 3163577 - RNA, 13 nt, Mycobacterium bovis subsp bovis AF2122/97
ggccagcgcggcg

SEQ ID NO: 3163578 - RNA, 19 nt, Mycobacterium bovis subsp bovis AF2122/97
ggccagcgcggcgcgcggg

SEQ ID NO: 3163579 - RNA, 22 nt, Mycobacterium bovis subsp bovis AF2122/97
ggccagcgcggcgcgcggggcc

SEQ ID NO: 3163580 - RNA, 17 nt, Mycobacterium bovis subsp bovis AF2122/97
ggccagcgcucaccggc

SEQ ID NO: 3163581 - RNA, 19 nt, Mycobacterium bovis subsp bovis AF2122/97
ggccagcgcucaccggcgu

SEQ ID NO: 3163582 - RNA, 21 nt, Mycobacterium bovis subsp bovis AF2122/97
ggccagcgcucaccggcgucg

SEQ ID NO: 3163583 - RNA, 20 nt, Mycobacterium bovis subsp bovis AF2122/97
ggccagcgcuucgucggccg

SEQ ID NO: 3163584 - RNA, 22 nt, Mycobacterium bovis subsp bovis AF2122/97
ggccagcgcuucgucggccggc

SEQ ID NO: 3163585 - RNA, 24 nt, Mycobacterium bovis subsp bovis AF2122/97
ggccagcgcuucgucggccggcac

SEQ ID NO: 3163586 - RNA, 11 nt, Mycobacterium bovis subsp bovis AF2122/97
ggccagcggca

SEQ ID NO: 3163587 - RNA, 18 nt, Mycobacterium bovis subsp bovis AF2122/97
ggccagcggcagccuggc

SEQ ID NO: 3163588 - RNA, 11 nt, Mycobacterium bovis subsp bovis AF2122/97
ggccagcggcc

SEQ ID NO: 3163589 - RNA, 21 nt, Mycobacterium bovis subsp bovis AF2122/97
ggccagcgggaacacaccgca

SEQ ID NO: 3163590 - RNA, 23 nt, Mycobacterium bovis subsp bovis AF2122/97
ggccagcgggaacacaccgcaua

SEQ ID NO: 3163591 - RNA, 13 nt, Mycobacterium bovis subsp bovis AF2122/97
ggccagcggguga

SEQ ID NO: 3163592 - RNA, 22 nt, Mycobacterium bovis subsp bovis AF2122/97
ggccagcgggugaaucgacacc

SEQ ID NO: 3163593 - RNA, 18 nt, Mycobacterium bovis subsp bovis AF2122/97
ggccagcgguaaugccag

SEQ ID NO: 3163594 - RNA, 23 nt, Mycobacterium bovis subsp bovis AF2122/97
ggccagcgguaaugccagcggca

SEQ ID NO: 3163595 - RNA, 19 nt, Mycobacterium bovis subsp bovis AF2122/97
ggccagcgucaacagcgug

SEQ ID NO: 3163596 - RNA, 20 nt, Mycobacterium bovis subsp bovis AF2122/97
ggccagcgucaacagcgugg

SEQ ID NO: 3163597 - RNA, 19 nt, Mycobacterium bovis subsp bovis AF2122/97
ggccagcgugucccaacgc

SEQ ID NO: 3163598 - RNA, 22 nt, Mycobacterium bovis subsp bovis AF2122/97
ggccagcgugucccaacgccac

SEQ ID NO: 3163599 - RNA, 17 nt, Mycobacterium bovis subsp bovis AF2122/97
ggccagcguguccgcca

SEQ ID NO: 3163600 - RNA, 12 nt, Mycobacterium bovis subsp bovis AF2122/97
ggccagcucccg

SEQ ID NO: 3163601 - RNA, 23 nt, Mycobacterium bovis subsp bovis AF2122/97
ggccagcucccgggcggcggccu

SEQ ID NO: 3163602 - RNA, 16 nt, Mycobacterium bovis subsp bovis AF2122/97
ggccagcuccgccugc

SEQ ID NO: 3163603 - RNA, 21 nt, Mycobacterium bovis subsp bovis AF2122/97
ggccagcuccucagccaccgc

SEQ ID NO: 3163604 - RNA, 17 nt, Mycobacterium bovis subsp bovis AF2122/97
ggccagcucgcgggccg

SEQ ID NO: 3163605 - RNA, 14 nt, Mycobacterium bovis subsp bovis AF2122/97
ggccagcucggcca

SEQ ID NO: 3163606 - RNA, 22 nt, Mycobacterium bovis subsp bovis AF2122/97
ggccagcucuucggggaugacg

SEQ ID NO: 3163607 - RNA, 21 nt, Mycobacterium bovis subsp bovis AF2122/97
ggccagcugcagcagacccgg

SEQ ID NO: 3163608 - RNA, 15 nt, Mycobacterium bovis subsp bovis AF2122/97
ggccagcugcggcuc

SEQ ID NO: 3163609 - RNA, 19 nt, Mycobacterium bovis subsp bovis AF2122/97
ggccagcugcggcuccggc

SEQ ID NO: 3163610 - RNA, 22 nt, Mycobacterium bovis subsp bovis AF2122/97
ggccagcugcggcuccggcggc

SEQ ID NO: 3163611 - RNA, 12 nt, Mycobacterium bovis subsp bovis AF2122/97
ggccagcugcgu

SEQ ID NO: 3163612 - RNA, 14 nt, Mycobacterium bovis subsp bovis AF2122/97
ggccagcugcgugg

SEQ ID NO: 3163613 - RNA, 18 nt, Mycobacterium bovis subsp bovis AF2122/97
ggccagcugcguggcgaa

SEQ ID NO: 3163614 - RNA, 21 nt, Mycobacterium bovis subsp bovis AF2122/97
ggccagcuugagguccgucgc

SEQ ID NO: 3163615 - RNA, 22 nt, Mycobacterium bovis subsp bovis AF2122/97
ggccagcuugcggagccgccgc

SEQ ID NO: 3163616 - RNA, 17 nt, Mycobacterium bovis subsp bovis AF2122/97
ggccaggaagucccggg

SEQ ID NO: 3163617 - RNA, 19 nt, Mycobacterium bovis subsp bovis AF2122/97
ggccaggaagucccgggca

SEQ ID NO: 3163618 - RNA, 20 nt, Mycobacterium bovis subsp bovis AF2122/97
ggccaggaguuugaccaccu

SEQ ID NO: 3163619 - RNA, 14 nt, Mycobacterium bovis subsp bovis AF2122/97
ggccaggcccagcu

SEQ ID NO: 3163620 - RNA, 17 nt, Mycobacterium bovis subsp bovis AF2122/97
ggccaggcccucgacgg

SEQ ID NO: 3163621 - RNA, 19 nt, Mycobacterium bovis subsp bovis AF2122/97
ggccaggcccucgacggcg

SEQ ID NO: 3163622 - RNA, 21 nt, Mycobacterium bovis subsp bovis AF2122/97
ggccaggcccucgacggcguc

SEQ ID NO: 3163623 - RNA, 21 nt, Mycobacterium bovis subsp bovis AF2122/97
ggccaggccgaugccgaccuu

SEQ ID NO: 3163624 - RNA, 15 nt, Mycobacterium bovis subsp bovis AF2122/97
ggccaggccggcggc

SEQ ID NO: 3163625 - RNA, 16 nt, Mycobacterium bovis subsp bovis AF2122/97
ggccaggccggcggcg

SEQ ID NO: 3163626 - RNA, 15 nt, Mycobacterium bovis subsp bovis AF2122/97
ggccaggccgucggc

SEQ ID NO: 3163627 - RNA, 13 nt, Mycobacterium bovis subsp bovis AF2122/97
ggccaggcgaagu

SEQ ID NO: 3163628 - RNA, 20 nt, Mycobacterium bovis subsp bovis AF2122/97
ggccaggcgguacgggucgc

SEQ ID NO: 3163629 - RNA, 22 nt, Mycobacterium bovis subsp bovis AF2122/97
ggccaggcgguacgggucgccg

SEQ ID NO: 3163630 - RNA, 16 nt, Mycobacterium bovis subsp bovis AF2122/97
ggccaggcugcgcagu

SEQ ID NO: 3163631 - RNA, 18 nt, Mycobacterium bovis subsp bovis AF2122/97
ggccaggcuggccaacuu

SEQ ID NO: 3163632 - RNA, 14 nt, Mycobacterium bovis subsp bovis AF2122/97
ggccagggcaccca

SEQ ID NO: 3163633 - RNA, 16 nt, Mycobacterium bovis subsp bovis AF2122/97
ggccagggcgguggcc

SEQ ID NO: 3163634 - RNA, 15 nt, Mycobacterium bovis subsp bovis AF2122/97
ggccaggggcgcagc

SEQ ID NO: 3163635 - RNA, 16 nt, Mycobacterium bovis subsp bovis AF2122/97
ggccagggucagcucg

SEQ ID NO: 3163636 - RNA, 14 nt, Mycobacterium bovis subsp bovis AF2122/97
ggccagggugcccu

SEQ ID NO: 3163637 - RNA, 17 nt, Mycobacterium bovis subsp bovis AF2122/97
ggccaggguguugaucu

SEQ ID NO: 3163638 - RNA, 20 nt, Mycobacterium bovis subsp bovis AF2122/97
ggccagguaauugccgaccg

SEQ ID NO: 3163639 - RNA, 21 nt, Mycobacterium bovis subsp bovis AF2122/97
ggccagguaauugccgaccgc

SEQ ID NO: 3163640 - RNA, 23 nt, Mycobacterium bovis subsp bovis AF2122/97
ggccagguaauugccgaccgccu

SEQ ID NO: 3163641 - RNA, 18 nt, Mycobacterium bovis subsp bovis AF2122/97
ggccaggucagccgcgcg

SEQ ID NO: 3163642 - RNA, 15 nt, Mycobacterium bovis subsp bovis AF2122/97
ggccaggucgacacc

SEQ ID NO: 3163643 - RNA, 14 nt, Mycobacterium bovis subsp bovis AF2122/97
ggccaggucgacgg

SEQ ID NO: 3163644 - RNA, 23 nt, Mycobacterium bovis subsp bovis AF2122/97
ggccaggucgagcaccggcugcg

SEQ ID NO: 3163645 - RNA, 20 nt, Mycobacterium bovis subsp bovis AF2122/97
ggccaggucgccuuucauag

SEQ ID NO: 3163646 - RNA, 16 nt, Mycobacterium bovis subsp bovis AF2122/97
ggccaggucggccacc

SEQ ID NO: 3163647 - RNA, 17 nt, Mycobacterium bovis subsp bovis AF2122/97
ggccagguggcgagcgc

SEQ ID NO: 3163648 - RNA, 14 nt, Mycobacterium bovis subsp bovis AF2122/97
ggcccagcggccgc

SEQ ID NO: 3163649 - RNA, 20 nt, Mycobacterium bovis subsp bovis AF2122/97
ggcccagcuagguccgaacu

SEQ ID NO: 3163650 - RNA, 21 nt, Mycobacterium bovis subsp bovis AF2122/97
ggcccaggacagcagccgccg

SEQ ID NO: 3163651 - RNA, 23 nt, Mycobacterium bovis subsp bovis AF2122/97
ggcccaggacagcagccgccggc

SEQ ID NO: 3163652 - RNA, 21 nt, Mycobacterium bovis subsp bovis AF2122/97
ggcccagugggacuggcguga

SEQ ID NO: 3163653 - RNA, 23 nt, Mycobacterium bovis subsp bovis AF2122/97
ggcccaguuccgcugcggugccg

SEQ ID NO: 3163654 - RNA, 17 nt, Mycobacterium bovis subsp bovis AF2122/97
ggcccauaccgauggug

SEQ ID NO: 3163655 - RNA, 18 nt, Mycobacterium bovis subsp bovis AF2122/97
ggcccauacgugccgccg

SEQ ID NO: 3163656 - RNA, 19 nt, Mycobacterium bovis subsp bovis AF2122/97
ggcccaucgaccgaggcac

SEQ ID NO: 3163657 - RNA, 17 nt, Mycobacterium bovis subsp bovis AF2122/97
ggcccaucgcccggugc

SEQ ID NO: 3163658 - RNA, 22 nt, Mycobacterium bovis subsp bovis AF2122/97
ggcccaucgcgacuagacgccg

SEQ ID NO: 3163659 - RNA, 15 nt, Mycobacterium bovis subsp bovis AF2122/97
ggcccaucgggcgcc

SEQ ID NO: 3163660 - RNA, 16 nt, Mycobacterium bovis subsp bovis AF2122/97
ggcccaucgggcgccc

SEQ ID NO: 3163661 - RNA, 19 nt, Mycobacterium bovis subsp bovis AF2122/97
ggcccaucuucggacgcca

SEQ ID NO: 3163662 - RNA, 22 nt, Mycobacterium bovis subsp bovis AF2122/97
ggcccaucuucggacgccagcu

SEQ ID NO: 3163663 - RNA, 16 nt, Mycobacterium bovis subsp bovis AF2122/97
ggcccaugcagcggcg

SEQ ID NO: 3163664 - RNA, 22 nt, Mycobacterium bovis subsp bovis AF2122/97
ggcccauucaucuugcggcagc

SEQ ID NO: 3163665 - RNA, 22 nt, Mycobacterium bovis subsp bovis AF2122/97
ggcccauugucgaucaccugca

SEQ ID NO: 3163666 - RNA, 21 nt, Mycobacterium bovis subsp bovis AF2122/97
ggccccaagcgugcugccgcc

SEQ ID NO: 3163667 - RNA, 22 nt, Mycobacterium bovis subsp bovis AF2122/97
ggccccaccgacagccccauca

SEQ ID NO: 3163668 - RNA, 17 nt, Mycobacterium bovis subsp bovis AF2122/97
ggccccaccggcacccc

SEQ ID NO: 3163669 - RNA, 18 nt, Mycobacterium bovis subsp bovis AF2122/97
ggccccaccggcaccccc

SEQ ID NO: 3163670 - RNA, 15 nt, Mycobacterium bovis subsp bovis AF2122/97
ggccccaccggugcc

SEQ ID NO: 3163671 - RNA, 16 nt, Mycobacterium bovis subsp bovis AF2122/97
ggccccaccggugccg

SEQ ID NO: 3163672 - RNA, 17 nt, Mycobacterium bovis subsp bovis AF2122/97
ggccccaccggugccgc

SEQ ID NO: 3163673 - RNA, 21 nt, Mycobacterium bovis subsp bovis AF2122/97
ggccccacuggugcagcgccg

SEQ ID NO: 3163674 - RNA, 16 nt, Mycobacterium bovis subsp bovis AF2122/97
ggccccaggggcacca

SEQ ID NO: 3163675 - RNA, 13 nt, Mycobacterium bovis subsp bovis AF2122/97
ggcccccaguucg

SEQ ID NO: 3163676 - RNA, 15 nt, Mycobacterium bovis subsp bovis AF2122/97
ggcccccaguucggc

SEQ ID NO: 3163677 - RNA, 18 nt, Mycobacterium bovis subsp bovis AF2122/97
ggcccccaguucggcguc

SEQ ID NO: 3163678 - RNA, 12 nt, Mycobacterium bovis subsp bovis AF2122/97
ggccccccgcgc

SEQ ID NO: 3163679 - RNA, 13 nt, Mycobacterium bovis subsp bovis AF2122/97
ggccccccgcgcc

SEQ ID NO: 3163680 - RNA, 12 nt, Mycobacterium bovis subsp bovis AF2122/97
ggcccccgacgg

SEQ ID NO: 3163681 - RNA, 15 nt, Mycobacterium bovis subsp bovis AF2122/97
ggcccccgacuccgg

SEQ ID NO: 3163682 - RNA, 13 nt, Mycobacterium bovis subsp bovis AF2122/97
ggcccccggucga

SEQ ID NO: 3163683 - RNA, 14 nt, Mycobacterium bovis subsp bovis AF2122/97
ggcccccucggcgu

SEQ ID NO: 3163684 - RNA, 18 nt, Mycobacterium bovis subsp bovis AF2122/97
ggccccgaaacgauggcc

SEQ ID NO: 3163685 - RNA, 18 nt, Mycobacterium bovis subsp bovis AF2122/97
ggccccgacacagcggcg

SEQ ID NO: 3163686 - RNA, 19 nt, Mycobacterium bovis subsp bovis AF2122/97
ggccccgacacagcggcgg

SEQ ID NO: 3163687 - RNA, 19 nt, Mycobacterium bovis subsp bovis AF2122/97
ggccccgacggucaacgac

SEQ ID NO: 3163688 - RNA, 13 nt, Mycobacterium bovis subsp bovis AF2122/97
ggccccgaucccg

SEQ ID NO: 3163689 - RNA, 14 nt, Mycobacterium bovis subsp bovis AF2122/97
ggccccgaucccga

SEQ ID NO: 3163690 - RNA, 19 nt, Mycobacterium bovis subsp bovis AF2122/97
ggccccgauggcgauacgc

SEQ ID NO: 3163691 - RNA, 12 nt, Mycobacterium bovis subsp bovis AF2122/97
ggccccgccagc

SEQ ID NO: 3163692 - RNA, 15 nt, Mycobacterium bovis subsp bovis AF2122/97
ggccccgccagcgcc

SEQ ID NO: 3163693 - RNA, 20 nt, Mycobacterium bovis subsp bovis AF2122/97
ggccccgccagcgccgccga

SEQ ID NO: 3163694 - RNA, 15 nt, Mycobacterium bovis subsp bovis AF2122/97
ggccccgccagcggc

SEQ ID NO: 3163695 - RNA, 18 nt, Mycobacterium bovis subsp bovis AF2122/97
ggccccgccagcggcagc

SEQ ID NO: 3163696 - RNA, 14 nt, Mycobacterium bovis subsp bovis AF2122/97
ggccccgcccgcgc

SEQ ID NO: 3163697 - RNA, 15 nt, Mycobacterium bovis subsp bovis AF2122/97
ggccccgccgaugcc

SEQ ID NO: 3163698 - RNA, 20 nt, Mycobacterium bovis subsp bovis AF2122/97
ggccccgccgaugccgccgg

SEQ ID NO: 3163699 - RNA, 22 nt, Mycobacterium bovis subsp bovis AF2122/97
ggccccgccgaugccgccggcc

SEQ ID NO: 3163700 - RNA, 17 nt, Mycobacterium bovis subsp bovis AF2122/97
ggccccgccgccggugc

SEQ ID NO: 3163701 - RNA, 12 nt, Mycobacterium bovis subsp bovis AF2122/97
ggccccgccggc

SEQ ID NO: 3163702 - RNA, 13 nt, Mycobacterium bovis subsp bovis AF2122/97
ggccccgccggcc

SEQ ID NO: 3163703 - RNA, 15 nt, Mycobacterium bovis subsp bovis AF2122/97
ggccccgccggcccc

SEQ ID NO: 3163704 - RNA, 20 nt, Mycobacterium bovis subsp bovis AF2122/97
ggccccgccggccccgccgu

SEQ ID NO: 3163705 - RNA, 21 nt, Mycobacterium bovis subsp bovis AF2122/97
ggccccgccggccccgccguc

SEQ ID NO: 3163706 - RNA, 14 nt, Mycobacterium bovis subsp bovis AF2122/97
ggccccgccggcgc

SEQ ID NO: 3163707 - RNA, 21 nt, Mycobacterium bovis subsp bovis AF2122/97
ggccccgccggcgccgcccaa

SEQ ID NO: 3163708 - RNA, 16 nt, Mycobacterium bovis subsp bovis AF2122/97
ggccccgccgguggcc

SEQ ID NO: 3163709 - RNA, 21 nt, Mycobacterium bovis subsp bovis AF2122/97
ggccccgccgucacccccgau

SEQ ID NO: 3163710 - RNA, 18 nt, Mycobacterium bovis subsp bovis AF2122/97
ggccccgccgucaccgcc

SEQ ID NO: 3163711 - RNA, 14 nt, Mycobacterium bovis subsp bovis AF2122/97
ggccccgccgucgc

SEQ ID NO: 3163712 - RNA, 16 nt, Mycobacterium bovis subsp bovis AF2122/97
ggccccgccguugccg

SEQ ID NO: 3163713 - RNA, 21 nt, Mycobacterium bovis subsp bovis AF2122/97
ggccccgccguugccgccgac

SEQ ID NO: 3163714 - RNA, 21 nt, Mycobacterium bovis subsp bovis AF2122/97
ggccccgccguuuccgccgcc

SEQ ID NO: 3163715 - RNA, 22 nt, Mycobacterium bovis subsp bovis AF2122/97
ggccccgccguuuccgccgccg

SEQ ID NO: 3163716 - RNA, 13 nt, Mycobacterium bovis subsp bovis AF2122/97
ggccccgcgccgg

SEQ ID NO: 3163717 - RNA, 14 nt, Mycobacterium bovis subsp bovis AF2122/97
ggccccgcgccggc

SEQ ID NO: 3163718 - RNA, 15 nt, Mycobacterium bovis subsp bovis AF2122/97
ggccccgcgccggcc

SEQ ID NO: 3163719 - RNA, 16 nt, Mycobacterium bovis subsp bovis AF2122/97
ggccccgcgccggccg

SEQ ID NO: 3163720 - RNA, 17 nt, Mycobacterium bovis subsp bovis AF2122/97
ggccccgcgccggccgc

SEQ ID NO: 3163721 - RNA, 18 nt, Mycobacterium bovis subsp bovis AF2122/97
ggccccgcgccggccgca

SEQ ID NO: 3163722 - RNA, 16 nt, Mycobacterium bovis subsp bovis AF2122/97
ggccccgcggcgccgc

SEQ ID NO: 3163723 - RNA, 15 nt, Mycobacterium bovis subsp bovis AF2122/97
ggccccggccgcguc

SEQ ID NO: 3163724 - RNA, 15 nt, Mycobacterium bovis subsp bovis AF2122/97
ggccccggcugucgg

SEQ ID NO: 3163725 - RNA, 13 nt, Mycobacterium bovis subsp bovis AF2122/97
ggccccgggaagu

SEQ ID NO: 3163726 - RNA, 15 nt, Mycobacterium bovis subsp bovis AF2122/97
ggccccgggcgguga

SEQ ID NO: 3163727 - RNA, 17 nt, Mycobacterium bovis subsp bovis AF2122/97
ggccccggggugccccc

SEQ ID NO: 3163728 - RNA, 22 nt, Mycobacterium bovis subsp bovis AF2122/97
ggccccggggugcccccggugc

SEQ ID NO: 3163729 - RNA, 19 nt, Mycobacterium bovis subsp bovis AF2122/97
ggccccggugacgccgucg

SEQ ID NO: 3163730 - RNA, 20 nt, Mycobacterium bovis subsp bovis AF2122/97
ggccccggugacgccgucga

SEQ ID NO: 3163731 - RNA, 19 nt, Mycobacterium bovis subsp bovis AF2122/97
ggccccgguggugcugccg

SEQ ID NO: 3163732 - RNA, 20 nt, Mycobacterium bovis subsp bovis AF2122/97
ggccccgguggugcugccga

SEQ ID NO: 3163733 - RNA, 20 nt, Mycobacterium bovis subsp bovis AF2122/97
ggccccucccuggcucguga

SEQ ID NO: 3163734 - RNA, 17 nt, Mycobacterium bovis subsp bovis AF2122/97
ggccccuggccgccgca

SEQ ID NO: 3163735 - RNA, 16 nt, Mycobacterium bovis subsp bovis AF2122/97
ggcccgggcggccagc

SEQ ID NO: 3163736 - RNA, 18 nt, Mycobacterium bovis subsp bovis AF2122/97
ggcccgggucuccggcgc

SEQ ID NO: 3163737 - RNA, 12 nt, Mycobacterium bovis subsp bovis AF2122/97
ggcccgggugac

SEQ ID NO: 3163738 - RNA, 16 nt, Mycobacterium bovis subsp bovis AF2122/97
ggcccgggugacggga

SEQ ID NO: 3163739 - RNA, 22 nt, Mycobacterium bovis subsp bovis AF2122/97
ggcccggguugagguaggggca

SEQ ID NO: 3163740 - RNA, 18 nt, Mycobacterium bovis subsp bovis AF2122/97
ggcccggucuugggcgcg

SEQ ID NO: 3163741 - RNA, 19 nt, Mycobacterium bovis subsp bovis AF2122/97
ggcccggucuugggcgcgg

SEQ ID NO: 3163742 - RNA, 22 nt, Mycobacterium bovis subsp bovis AF2122/97
ggcccggucuugggcgcgggug

SEQ ID NO: 3163743 - RNA, 12 nt, Mycobacterium bovis subsp bovis AF2122/97
ggcccggugcuc

SEQ ID NO: 3163744 - RNA, 20 nt, Mycobacterium bovis subsp bovis AF2122/97
ggcccggugcucaagcgcgu

SEQ ID NO: 3163745 - RNA, 19 nt, Mycobacterium bovis subsp bovis AF2122/97
ggcccguagcguccgcgcc

SEQ ID NO: 3163746 - RNA, 21 nt, Mycobacterium bovis subsp bovis AF2122/97
ggcccguagcugcgcagcgca

SEQ ID NO: 3163747 - RNA, 23 nt, Mycobacterium bovis subsp bovis AF2122/97
ggcccgucacaaugcccaggcuc

SEQ ID NO: 3163748 - RNA, 18 nt, Mycobacterium bovis subsp bovis AF2122/97
ggcccgucacgcccgcga

SEQ ID NO: 3163749 - RNA, 22 nt, Mycobacterium bovis subsp bovis AF2122/97
ggcccgucauacucgacaccga

SEQ ID NO: 3163750 - RNA, 15 nt, Mycobacterium bovis subsp bovis AF2122/97
ggcccguccugcggg

SEQ ID NO: 3163751 - RNA, 12 nt, Mycobacterium bovis subsp bovis AF2122/97
ggcccgucgcgu

SEQ ID NO: 3163752 - RNA, 19 nt, Mycobacterium bovis subsp bovis AF2122/97
ggcccgucgcgucgaccgg

SEQ ID NO: 3163753 - RNA, 13 nt, Mycobacterium bovis subsp bovis AF2122/97
ggcccgucggcgu

SEQ ID NO: 3163754 - RNA, 16 nt, Mycobacterium bovis subsp bovis AF2122/97
ggcccgucggcgugcg

SEQ ID NO: 3163755 - RNA, 22 nt, Mycobacterium bovis subsp bovis AF2122/97
ggcccgucggcgugcggacuga

SEQ ID NO: 3163756 - RNA, 17 nt, Mycobacterium bovis subsp bovis AF2122/97
ggcccgucgugaccgac

SEQ ID NO: 3163757 - RNA, 21 nt, Mycobacterium bovis subsp bovis AF2122/97
ggcccgugccacagcucgccg

SEQ ID NO: 3163758 - RNA, 12 nt, Mycobacterium bovis subsp bovis AF2122/97
ggcccgugcggu

SEQ ID NO: 3163759 - RNA, 16 nt, Mycobacterium bovis subsp bovis AF2122/97
ggcccguucgaccgug

SEQ ID NO: 3163760 - RNA, 21 nt, Mycobacterium bovis subsp bovis AF2122/97
ggcccuaucguuaucgacacc

SEQ ID NO: 3163761 - RNA, 19 nt, Mycobacterium bovis subsp bovis AF2122/97
ggcccuccacugcgagcgc

SEQ ID NO: 3163762 - RNA, 22 nt, Mycobacterium bovis subsp bovis AF2122/97
ggcccuccacugcgagcgccgg

SEQ ID NO: 3163763 - RNA, 23 nt, Mycobacterium bovis subsp bovis AF2122/97
ggcccuccggcgcagcgaccggu

SEQ ID NO: 3163764 - RNA, 20 nt, Mycobacterium bovis subsp bovis AF2122/97
ggcccuccgggcccaucgcc

SEQ ID NO: 3163765 - RNA, 13 nt, Mycobacterium bovis subsp bovis AF2122/97
ggcccuccucggu

SEQ ID NO: 3163766 - RNA, 15 nt, Mycobacterium bovis subsp bovis AF2122/97
ggcccuccucgguga

SEQ ID NO: 3163767 - RNA, 19 nt, Mycobacterium bovis subsp bovis AF2122/97
ggcccucgagcagugccgu

SEQ ID NO: 3163768 - RNA, 13 nt, Mycobacterium bovis subsp bovis AF2122/97
ggcccucgccaga

SEQ ID NO: 3163769 - RNA, 14 nt, Mycobacterium bovis subsp bovis AF2122/97
ggcccucggcgauc

SEQ ID NO: 3163770 - RNA, 20 nt, Mycobacterium bovis subsp bovis AF2122/97
ggcccucgggacugcgcggc

SEQ ID NO: 3163771 - RNA, 22 nt, Mycobacterium bovis subsp bovis AF2122/97
ggcccugaccucauguccgccg

SEQ ID NO: 3163772 - RNA, 15 nt, Mycobacterium bovis subsp bovis AF2122/97
ggcccugagcugccg

SEQ ID NO: 3163773 - RNA, 18 nt, Mycobacterium bovis subsp bovis AF2122/97
ggcccugcacagcagcgu

SEQ ID NO: 3163774 - RNA, 20 nt, Mycobacterium bovis subsp bovis AF2122/97
ggcccugcacagcagcguca

SEQ ID NO: 3163775 - RNA, 14 nt, Mycobacterium bovis subsp bovis AF2122/97
ggcccugccgacgc

SEQ ID NO: 3163776 - RNA, 18 nt, Mycobacterium bovis subsp bovis AF2122/97
ggcccugccgacgcucca

SEQ ID NO: 3163777 - RNA, 19 nt, Mycobacterium bovis subsp bovis AF2122/97
ggcccugccgacgcuccag

SEQ ID NO: 3163778 - RNA, 15 nt, Mycobacterium bovis subsp bovis AF2122/97
ggcccugccgccggc

SEQ ID NO: 3163779 - RNA, 16 nt, Mycobacterium bovis subsp bovis AF2122/97
ggcccugccgccggcc

SEQ ID NO: 3163780 - RNA, 21 nt, Mycobacterium bovis subsp bovis AF2122/97
ggcccugcggccacgguggcg

SEQ ID NO: 3163781 - RNA, 12 nt, Mycobacterium bovis subsp bovis AF2122/97
ggcccugcuccu

SEQ ID NO: 3163782 - RNA, 20 nt, Mycobacterium bovis subsp bovis AF2122/97
ggcccugcuccucgcgggcg

SEQ ID NO: 3163783 - RNA, 21 nt, Mycobacterium bovis subsp bovis AF2122/97
ggcccugcuccucgcgggcgg

SEQ ID NO: 3163784 - RNA, 14 nt, Mycobacterium bovis subsp bovis AF2122/97
ggcccuggccaccc

SEQ ID NO: 3163785 - RNA, 15 nt, Mycobacterium bovis subsp bovis AF2122/97
ggcccuggccagccc

SEQ ID NO: 3163786 - RNA, 20 nt, Mycobacterium bovis subsp bovis AF2122/97
ggcccuggccagcccgagcu

SEQ ID NO: 3163787 - RNA, 13 nt, Mycobacterium bovis subsp bovis AF2122/97
ggcccuggccgcg

SEQ ID NO: 3163788 - RNA, 15 nt, Mycobacterium bovis subsp bovis AF2122/97
ggcccuggccgcgcc

SEQ ID NO: 3163789 - RNA, 16 nt, Mycobacterium bovis subsp bovis AF2122/97
ggcccuggccgcgccg

SEQ ID NO: 3163790 - RNA, 16 nt, Mycobacterium bovis subsp bovis AF2122/97
ggcccuggcgaccagc

SEQ ID NO: 3163791 - RNA, 14 nt, Mycobacterium bovis subsp bovis AF2122/97
ggcccuggcggccc

SEQ ID NO: 3163792 - RNA, 13 nt, Mycobacterium bovis subsp bovis AF2122/97
ggcccuguucggc

SEQ ID NO: 3163793 - RNA, 17 nt, Mycobacterium bovis subsp bovis AF2122/97
ggcccuugcucguccag

SEQ ID NO: 3163794 - RNA, 18 nt, Mycobacterium bovis subsp bovis AF2122/97
ggcccuugcucguccagg

SEQ ID NO: 3163795 - RNA, 19 nt, Mycobacterium bovis subsp bovis AF2122/97
ggcccuuguggaguacggc

SEQ ID NO: 3163796 - RNA, 21 nt, Mycobacterium bovis subsp bovis AF2122/97
ggcccuuguggaguacggcga

SEQ ID NO: 3163797 - RNA, 23 nt, Mycobacterium bovis subsp bovis AF2122/97
ggcccuuguggaguacggcgaug

SEQ ID NO: 3163798 - RNA, 21 nt, Mycobacterium bovis subsp bovis AF2122/97
ggcccuuguuggccugcaacg

SEQ ID NO: 3163799 - RNA, 23 nt, Mycobacterium bovis subsp bovis AF2122/97
ggccgaaaacgacaucaccaccg

SEQ ID NO: 3163800 - RNA, 22 nt, Mycobacterium bovis subsp bovis AF2122/97
ggccgaaacuucgcccgggccg

SEQ ID NO: 3163801 - RNA, 19 nt, Mycobacterium bovis subsp bovis AF2122/97
ggccgaaagagccagcggc

SEQ ID NO: 3163802 - RNA, 21 nt, Mycobacterium bovis subsp bovis AF2122/97
ggccgaaagagccagcggcac

SEQ ID NO: 3163803 - RNA, 15 nt, Mycobacterium bovis subsp bovis AF2122/97
ggccgaaagccaggc

SEQ ID NO: 3163804 - RNA, 17 nt, Mycobacterium bovis subsp bovis AF2122/97
ggccgaaagccaggcgg

SEQ ID NO: 3163805 - RNA, 13 nt, Mycobacterium bovis subsp bovis AF2122/97
ggccgaaauccag

SEQ ID NO: 3163806 - RNA, 15 nt, Mycobacterium bovis subsp bovis AF2122/97
ggccgaacacaccgg

SEQ ID NO: 3163807 - RNA, 18 nt, Mycobacterium bovis subsp bovis AF2122/97
ggccgaacacaccgggcg

SEQ ID NO: 3163808 - RNA, 12 nt, Mycobacterium bovis subsp bovis AF2122/97
ggccgaacagca

SEQ ID NO: 3163809 - RNA, 17 nt, Mycobacterium bovis subsp bovis AF2122/97
ggccgaacagcugcccg

SEQ ID NO: 3163810 - RNA, 22 nt, Mycobacterium bovis subsp bovis AF2122/97
ggccgaacagcugcccgccagc

SEQ ID NO: 3163811 - RNA, 23 nt, Mycobacterium bovis subsp bovis AF2122/97
ggccgaacagcugcccgccagcg

SEQ ID NO: 3163812 - RNA, 16 nt, Mycobacterium bovis subsp bovis AF2122/97
ggccgaacccaccacg

SEQ ID NO: 3163813 - RNA, 17 nt, Mycobacterium bovis subsp bovis AF2122/97
ggccgaacccaccacga

SEQ ID NO: 3163814 - RNA, 16 nt, Mycobacterium bovis subsp bovis AF2122/97
ggccgaaccguucggc

SEQ ID NO: 3163815 - RNA, 23 nt, Mycobacterium bovis subsp bovis AF2122/97
ggccgaacgacggguccgggcca

SEQ ID NO: 3163816 - RNA, 13 nt, Mycobacterium bovis subsp bovis AF2122/97
ggccgaacggguc

SEQ ID NO: 3163817 - RNA, 17 nt, Mycobacterium bovis subsp bovis AF2122/97
ggccgaacgggucggcg

SEQ ID NO: 3163818 - RNA, 18 nt, Mycobacterium bovis subsp bovis AF2122/97
ggccgaacgggucggcga

SEQ ID NO: 3163819 - RNA, 19 nt, Mycobacterium bovis subsp bovis AF2122/97
ggccgaacguggcucggcg

SEQ ID NO: 3163820 - RNA, 22 nt, Mycobacterium bovis subsp bovis AF2122/97
ggccgaacguggcucggcgggu

SEQ ID NO: 3163821 - RNA, 19 nt, Mycobacterium bovis subsp bovis AF2122/97
ggccgcauauugcggcgcc

SEQ ID NO: 3163822 - RNA, 20 nt, Mycobacterium bovis subsp bovis AF2122/97
ggccgcauauugcggcgccg

SEQ ID NO: 3163823 - RNA, 22 nt, Mycobacterium bovis subsp bovis AF2122/97
ggccgcauccccgguacgucga

SEQ ID NO: 3163824 - RNA, 20 nt, Mycobacterium bovis subsp bovis AF2122/97
ggccgcaucgccucaccacg

SEQ ID NO: 3163825 - RNA, 14 nt, Mycobacterium bovis subsp bovis AF2122/97
ggccgcaucgguca

SEQ ID NO: 3163826 - RNA, 23 nt, Mycobacterium bovis subsp bovis AF2122/97
ggccgcaucggucaaugccacua

SEQ ID NO: 3163827 - RNA, 15 nt, Mycobacterium bovis subsp bovis AF2122/97
ggccgcaugccacgg

SEQ ID NO: 3163828 - RNA, 17 nt, Mycobacterium bovis subsp bovis AF2122/97
ggccgcauuagccugcg

SEQ ID NO: 3163829 - RNA, 19 nt, Mycobacterium bovis subsp bovis AF2122/97
ggccgccaacuucaccacc

SEQ ID NO: 3163830 - RNA, 20 nt, Mycobacterium bovis subsp bovis AF2122/97
ggccgccaacuucaccaccc

SEQ ID NO: 3163831 - RNA, 14 nt, Mycobacterium bovis subsp bovis AF2122/97
ggccgccacaccgc

SEQ ID NO: 3163832 - RNA, 17 nt, Mycobacterium bovis subsp bovis AF2122/97
ggccgccacaccgccgc

SEQ ID NO: 3163833 - RNA, 20 nt, Mycobacterium bovis subsp bovis AF2122/97
ggccgccacaccgccgccaa

SEQ ID NO: 3163834 - RNA, 19 nt, Mycobacterium bovis subsp bovis AF2122/97
ggccgccaccagcgcgagc

SEQ ID NO: 3163835 - RNA, 14 nt, Mycobacterium bovis subsp bovis AF2122/97
ggccgccacccgca

SEQ ID NO: 3163836 - RNA, 15 nt, Mycobacterium bovis subsp bovis AF2122/97
ggccgccaccgcacg

SEQ ID NO: 3163837 - RNA, 17 nt, Mycobacterium bovis subsp bovis AF2122/97
ggccgccaccgcgacga

SEQ ID NO: 3163838 - RNA, 20 nt, Mycobacterium bovis subsp bovis AF2122/97
ggccgccaccgcgacgagcg

SEQ ID NO: 3163839 - RNA, 16 nt, Mycobacterium bovis subsp bovis AF2122/97
ggccgccaccgucacc

SEQ ID NO: 3163840 - RNA, 19 nt, Mycobacterium bovis subsp bovis AF2122/97
ggccgccaccgucaccgcc

SEQ ID NO: 3163841 - RNA, 13 nt, Mycobacterium bovis subsp bovis AF2122/97
ggccgccaccucc

SEQ ID NO: 3163842 - RNA, 17 nt, Mycobacterium bovis subsp bovis AF2122/97
ggccgccaccucccagg

SEQ ID NO: 3163843 - RNA, 23 nt, Mycobacterium bovis subsp bovis AF2122/97
ggccgccacucgcccgcugccgu

SEQ ID NO: 3163844 - RNA, 16 nt, Mycobacterium bovis subsp bovis AF2122/97
ggccgccagcagcuuc

SEQ ID NO: 3163845 - RNA, 21 nt, Mycobacterium bovis subsp bovis AF2122/97
ggccgccagccccacccgcau

SEQ ID NO: 3163846 - RNA, 14 nt, Mycobacterium bovis subsp bovis AF2122/97
ggccgccagccggc

SEQ ID NO: 3163847 - RNA, 12 nt, Mycobacterium bovis subsp bovis AF2122/97
ggccgccagcgc

SEQ ID NO: 3163848 - RNA, 13 nt, Mycobacterium bovis subsp bovis AF2122/97
ggccgccagcgca

SEQ ID NO: 3163849 - RNA, 14 nt, Mycobacterium bovis subsp bovis AF2122/97
ggccgccagcgcgc

SEQ ID NO: 3163850 - RNA, 17 nt, Mycobacterium bovis subsp bovis AF2122/97
ggccgccagcgcggcca

SEQ ID NO: 3163851 - RNA, 14 nt, Mycobacterium bovis subsp bovis AF2122/97
ggccgccagcggag

SEQ ID NO: 3163852 - RNA, 18 nt, Mycobacterium bovis subsp bovis AF2122/97
ggccgccagcggcgaguc

SEQ ID NO: 3163853 - RNA, 21 nt, Mycobacterium bovis subsp bovis AF2122/97
ggccgccagcggcgaguccac

SEQ ID NO: 3163854 - RNA, 13 nt, Mycobacterium bovis subsp bovis AF2122/97
ggccgccagcugc

SEQ ID NO: 3163855 - RNA, 17 nt, Mycobacterium bovis subsp bovis AF2122/97
ggccgccaggaaucccu

SEQ ID NO: 3163856 - RNA, 14 nt, Mycobacterium bovis subsp bovis AF2122/97
ggccgccaggcggc

SEQ ID NO: 3163857 - RNA, 18 nt, Mycobacterium bovis subsp bovis AF2122/97
ggccgccaggcggccggg

SEQ ID NO: 3163858 - RNA, 20 nt, Mycobacterium bovis subsp bovis AF2122/97
ggccgccaguccgaucgccg

SEQ ID NO: 3163859 - RNA, 21 nt, Mycobacterium bovis subsp bovis AF2122/97
ggccgccaguccgaucgccga

SEQ ID NO: 3163860 - RNA, 19 nt, Mycobacterium bovis subsp bovis AF2122/97
ggccgccauccccuggcca

SEQ ID NO: 3163861 - RNA, 22 nt, Mycobacterium bovis subsp bovis AF2122/97
ggccgccauccccuggccagca

SEQ ID NO: 3163862 - RNA, 19 nt, Mycobacterium bovis subsp bovis AF2122/97
ggccgcccagaccgccgac

SEQ ID NO: 3163863 - RNA, 22 nt, Mycobacterium bovis subsp bovis AF2122/97
ggccgcccagaccgccgacgcc

SEQ ID NO: 3163864 - RNA, 22 nt, Mycobacterium bovis subsp bovis AF2122/97
ggccgccccaggcugguccggg

SEQ ID NO: 3163865 - RNA, 20 nt, Mycobacterium bovis subsp bovis AF2122/97
ggccgccccggccgcuggcg

SEQ ID NO: 3163866 - RNA, 23 nt, Mycobacterium bovis subsp bovis AF2122/97
ggccgcccgcuccaacacccgcc

SEQ ID NO: 3163867 - RNA, 17 nt, Mycobacterium bovis subsp bovis AF2122/97
ggccgcccgcugcggcg

SEQ ID NO: 3163868 - RNA, 18 nt, Mycobacterium bovis subsp bovis AF2122/97
ggccgcccgcugcggcgg

SEQ ID NO: 3163869 - RNA, 19 nt, Mycobacterium bovis subsp bovis AF2122/97
ggccgcccggacccaaagc

SEQ ID NO: 3163870 - RNA, 15 nt, Mycobacterium bovis subsp bovis AF2122/97
ggccgcccggcgagc

SEQ ID NO: 3163871 - RNA, 16 nt, Mycobacterium bovis subsp bovis AF2122/97
ggccgcccggcgagca

SEQ ID NO: 3163872 - RNA, 18 nt, Mycobacterium bovis subsp bovis AF2122/97
ggccgcccggcgagcagg

SEQ ID NO: 3163873 - RNA, 21 nt, Mycobacterium bovis subsp bovis AF2122/97
ggccgcccuggccgcccagac

SEQ ID NO: 3163874 - RNA, 18 nt, Mycobacterium bovis subsp bovis AF2122/97
ggccgccgaaacucacca

SEQ ID NO: 3163875 - RNA, 19 nt, Mycobacterium bovis subsp bovis AF2122/97
ggccgccgaacacaccgag

SEQ ID NO: 3163876 - RNA, 21 nt, Mycobacterium bovis subsp bovis AF2122/97
ggccgccgaauccgacgucga

SEQ ID NO: 3163877 - RNA, 14 nt, Mycobacterium bovis subsp bovis AF2122/97
ggccgccgacaacc

SEQ ID NO: 3163878 - RNA, 18 nt, Mycobacterium bovis subsp bovis AF2122/97
ggccgccgacaaccccgc

SEQ ID NO: 3163879 - RNA, 12 nt, Mycobacterium bovis subsp bovis AF2122/97
ggccgccgacgu

SEQ ID NO: 3163880 - RNA, 23 nt, Mycobacterium bovis subsp bovis AF2122/97
ggccgccgacuccccgccgggca

SEQ ID NO: 3163881 - RNA, 15 nt, Mycobacterium bovis subsp bovis AF2122/97
ggccgccgagacgac

SEQ ID NO: 3163882 - RNA, 12 nt, Mycobacterium bovis subsp bovis AF2122/97
ggccgccgagga

SEQ ID NO: 3163883 - RNA, 23 nt, Mycobacterium bovis subsp bovis AF2122/97
ggccgccgaggacacauugacca

SEQ ID NO: 3163884 - RNA, 17 nt, Mycobacterium bovis subsp bovis AF2122/97
ggccgccgaugccaccg

SEQ ID NO: 3163885 - RNA, 13 nt, Mycobacterium bovis subsp bovis AF2122/97
ggccgccgcagcu

SEQ ID NO: 3163886 - RNA, 14 nt, Mycobacterium bovis subsp bovis AF2122/97
ggccgccgcagcuc

SEQ ID NO: 3163887 - RNA, 23 nt, Mycobacterium bovis subsp bovis AF2122/97
ggccgccgccaguccggacggca

SEQ ID NO: 3163888 - RNA, 15 nt, Mycobacterium bovis subsp bovis AF2122/97
ggccgccgccccggc

SEQ ID NO: 3163889 - RNA, 16 nt, Mycobacterium bovis subsp bovis AF2122/97
ggccgccgcgauggcc

SEQ ID NO: 3163890 - RNA, 20 nt, Mycobacterium bovis subsp bovis AF2122/97
ggccgccgcgauggccccug

SEQ ID NO: 3163891 - RNA, 14 nt, Mycobacterium bovis subsp bovis AF2122/97
ggccgccgcgcacc

SEQ ID NO: 3163892 - RNA, 22 nt, Mycobacterium bovis subsp bovis AF2122/97
ggccgccgcgcaccgcgggauc

SEQ ID NO: 3163893 - RNA, 13 nt, Mycobacterium bovis subsp bovis AF2122/97
ggccgccgcgccg

SEQ ID NO: 3163894 - RNA, 15 nt, Mycobacterium bovis subsp bovis AF2122/97
ggccgccgcgccggu

SEQ ID NO: 3163895 - RNA, 16 nt, Mycobacterium bovis subsp bovis AF2122/97
ggccgccgcgccggug

SEQ ID NO: 3163896 - RNA, 17 nt, Mycobacterium bovis subsp bovis AF2122/97
ggccgccgcgccggugu

SEQ ID NO: 3163897 - RNA, 13 nt, Mycobacterium bovis subsp bovis AF2122/97
ggccgccgcggcc

SEQ ID NO: 3163898 - RNA, 18 nt, Mycobacterium bovis subsp bovis AF2122/97
ggccgccgcggccggcgc

SEQ ID NO: 3163899 - RNA, 22 nt, Mycobacterium bovis subsp bovis AF2122/97
ggccgccgcggccggcgcucgc

SEQ ID NO: 3163900 - RNA, 13 nt, Mycobacterium bovis subsp bovis AF2122/97
ggccgccgcggga

SEQ ID NO: 3163901 - RNA, 21 nt, Mycobacterium bovis subsp bovis AF2122/97
ggccgccgcgggacaccaccg

SEQ ID NO: 3163902 - RNA, 22 nt, Mycobacterium bovis subsp bovis AF2122/97
ggccgccgcgggacaccaccgc

SEQ ID NO: 3163903 - RNA, 15 nt, Mycobacterium bovis subsp bovis AF2122/97
ggccgccgcugccgc

SEQ ID NO: 3163904 - RNA, 18 nt, Mycobacterium bovis subsp bovis AF2122/97
ggccgccggacccgucga

SEQ ID NO: 3163905 - RNA, 14 nt, Mycobacterium bovis subsp bovis AF2122/97
ggccgccggccccg

SEQ ID NO: 3163906 - RNA, 12 nt, Mycobacterium bovis subsp bovis AF2122/97
ggccgccggcgc

SEQ ID NO: 3163907 - RNA, 19 nt, Mycobacterium bovis subsp bovis AF2122/97
ggccgcuggggcgcccgag

SEQ ID NO: 3163908 - RNA, 23 nt, Mycobacterium bovis subsp bovis AF2122/97
ggccgcugucguaccgcucggcg

SEQ ID NO: 3163909 - RNA, 15 nt, Mycobacterium bovis subsp bovis AF2122/97
ggccgcugugggcga

SEQ ID NO: 3163910 - RNA, 21 nt, Mycobacterium bovis subsp bovis AF2122/97
ggccgcugugggcgagucggg

SEQ ID NO: 3163911 - RNA, 13 nt, Mycobacterium bovis subsp bovis AF2122/97
ggccgcuugcccc

SEQ ID NO: 3163912 - RNA, 17 nt, Mycobacterium bovis subsp bovis AF2122/97
ggccgcuugccccgccu

SEQ ID NO: 3163913 - RNA, 19 nt, Mycobacterium bovis subsp bovis AF2122/97
ggccgcuuggccgcugccu

SEQ ID NO: 3163914 - RNA, 14 nt, Mycobacterium bovis subsp bovis AF2122/97
ggccgcuuggcgua

SEQ ID NO: 3163915 - RNA, 15 nt, Mycobacterium bovis subsp bovis AF2122/97
ggccgcuuugcgcgg

SEQ ID NO: 3163916 - RNA, 18 nt, Mycobacterium bovis subsp bovis AF2122/97
ggccgcuuugcgcgguca

SEQ ID NO: 3163917 - RNA, 20 nt, Mycobacterium bovis subsp bovis AF2122/97
ggccgcuuugcgcggucagc

SEQ ID NO: 3163918 - RNA, 17 nt, Mycobacterium bovis subsp bovis AF2122/97
ggccgcuuuucgauggu

SEQ ID NO: 3163919 - RNA, 18 nt, Mycobacterium bovis subsp bovis AF2122/97
ggccgcuuuucgauggug

SEQ ID NO: 3163920 - RNA, 19 nt, Mycobacterium bovis subsp bovis AF2122/97
ggccggaagauccgggccu

SEQ ID NO: 3163921 - RNA, 23 nt, Mycobacterium bovis subsp bovis AF2122/97
ggccggaagauccgggccuugcg

SEQ ID NO: 3163922 - RNA, 14 nt, Mycobacterium bovis subsp bovis AF2122/97
ggccggaauacccg

SEQ ID NO: 3163923 - RNA, 20 nt, Mycobacterium bovis subsp bovis AF2122/97
ggccggaccaucagcgucga

SEQ ID NO: 3163924 - RNA, 23 nt, Mycobacterium bovis subsp bovis AF2122/97
ggccggaccaucagcgucgacgu

SEQ ID NO: 3163925 - RNA, 19 nt, Mycobacterium bovis subsp bovis AF2122/97
ggccggacgggugcgggcc

SEQ ID NO: 3163926 - RNA, 16 nt, Mycobacterium bovis subsp bovis AF2122/97
ggccggagccgccggc

SEQ ID NO: 3163927 - RNA, 17 nt, Mycobacterium bovis subsp bovis AF2122/97
ggccggagccgccggcc

SEQ ID NO: 3163928 - RNA, 13 nt, Mycobacterium bovis subsp bovis AF2122/97
ggccggagccggu

SEQ ID NO: 3163929 - RNA, 18 nt, Mycobacterium bovis subsp bovis AF2122/97
ggccggagccggugccga

SEQ ID NO: 3163930 - RNA, 21 nt, Mycobacterium bovis subsp bovis AF2122/97
ggccggagccggugccgacgg

SEQ ID NO: 3163931 - RNA, 12 nt, Mycobacterium bovis subsp bovis AF2122/97
ggccggagcgca

SEQ ID NO: 3163932 - RNA, 14 nt, Mycobacterium bovis subsp bovis AF2122/97
ggccggagcgcacc

SEQ ID NO: 3163933 - RNA, 21 nt, Mycobacterium bovis subsp bovis AF2122/97
ggccggaggcuugcaacaccc

SEQ ID NO: 3163934 - RNA, 13 nt, Mycobacterium bovis subsp bovis AF2122/97
ggccggagucgac

SEQ ID NO: 3163935 - RNA, 15 nt, Mycobacterium bovis subsp bovis AF2122/97
ggccggagucgacga

SEQ ID NO: 3163936 - RNA, 17 nt, Mycobacterium bovis subsp bovis AF2122/97
ggccggagucgacgacg

SEQ ID NO: 3163937 - RNA, 19 nt, Mycobacterium bovis subsp bovis AF2122/97
ggccggauacggcgacacc

SEQ ID NO: 3163938 - RNA, 20 nt, Mycobacterium bovis subsp bovis AF2122/97
ggccggauacgggcugacga

SEQ ID NO: 3163939 - RNA, 22 nt, Mycobacterium bovis subsp bovis AF2122/97
ggccggaugacgcccagggcgu

SEQ ID NO: 3163940 - RNA, 13 nt, Mycobacterium bovis subsp bovis AF2122/97
ggccggaugagcg

SEQ ID NO: 3163941 - RNA, 14 nt, Mycobacterium bovis subsp bovis AF2122/97
ggccggaugggcgu

SEQ ID NO: 3163942 - RNA, 19 nt, Mycobacterium bovis subsp bovis AF2122/97
ggccggaugucgacgagca

SEQ ID NO: 3163943 - RNA, 18 nt, Mycobacterium bovis subsp bovis AF2122/97
ggccggcaacggcgcgcc

SEQ ID NO: 3163944 - RNA, 23 nt, Mycobacterium bovis subsp bovis AF2122/97
ggccggcaacggcgcgccgacca

SEQ ID NO: 3163945 - RNA, 13 nt, Mycobacterium bovis subsp bovis AF2122/97
ggccggcaagcag

SEQ ID NO: 3163946 - RNA, 14 nt, Mycobacterium bovis subsp bovis AF2122/97
ggccggcaccccac

SEQ ID NO: 3163947 - RNA, 19 nt, Mycobacterium bovis subsp bovis AF2122/97
ggccggcaccccacggcca

SEQ ID NO: 3163948 - RNA, 13 nt, Mycobacterium bovis subsp bovis AF2122/97
ggccggcaccgca

SEQ ID NO: 3163949 - RNA, 18 nt, Mycobacterium bovis subsp bovis AF2122/97
ggccggcaccgcagcgga

SEQ ID NO: 3163950 - RNA, 15 nt, Mycobacterium bovis subsp bovis AF2122/97
ggccggcacgaccgc

SEQ ID NO: 3163951 - RNA, 23 nt, Mycobacterium bovis subsp bovis AF2122/97
ggccggcagcuugcagugccgcc

SEQ ID NO: 3163952 - RNA, 20 nt, Mycobacterium bovis subsp bovis AF2122/97
ggccggcauccgguucgccg

SEQ ID NO: 3163953 - RNA, 12 nt, Mycobacterium bovis subsp bovis AF2122/97
ggccggcauggc

SEQ ID NO: 3163954 - RNA, 15 nt, Mycobacterium bovis subsp bovis AF2122/97
ggccggcauggcggc

SEQ ID NO: 3163955 - RNA, 20 nt, Mycobacterium bovis subsp bovis AF2122/97
ggccggcauggcggcauagc

SEQ ID NO: 3163956 - RNA, 12 nt, Mycobacterium bovis subsp bovis AF2122/97
ggccggccacca

SEQ ID NO: 3163957 - RNA, 19 nt, Mycobacterium bovis subsp bovis AF2122/97
ggccggccaccaguccgau

SEQ ID NO: 3163958 - RNA, 13 nt, Mycobacterium bovis subsp bovis AF2122/97
ggccggccagcac

SEQ ID NO: 3163959 - RNA, 20 nt, Mycobacterium bovis subsp bovis AF2122/97
ggccggcccggguaucgcca

SEQ ID NO: 3163960 - RNA, 12 nt, Mycobacterium bovis subsp bovis AF2122/97
ggccggccgccg

SEQ ID NO: 3163961 - RNA, 11 nt, Mycobacterium bovis subsp bovis AF2122/97
ggccggccgcg

SEQ ID NO: 3163962 - RNA, 14 nt, Mycobacterium bovis subsp bovis AF2122/97
ggccggccgcgauc

SEQ ID NO: 3163963 - RNA, 19 nt, Mycobacterium bovis subsp bovis AF2122/97
ggccggccgcucaccccgc

SEQ ID NO: 3163964 - RNA, 11 nt, Mycobacterium bovis subsp bovis AF2122/97
ggccggccggu

SEQ ID NO: 3163965 - RNA, 15 nt, Mycobacterium bovis subsp bovis AF2122/97
ggccggccgguggcc

SEQ ID NO: 3163966 - RNA, 17 nt, Mycobacterium bovis subsp bovis AF2122/97
ggccggcgcagugcgac

SEQ ID NO: 3163967 - RNA, 14 nt, Mycobacterium bovis subsp bovis AF2122/97
ggccggcgccgcac

SEQ ID NO: 3163968 - RNA, 15 nt, Mycobacterium bovis subsp bovis AF2122/97
ggccggcgccgcacc

SEQ ID NO: 3163969 - RNA, 17 nt, Mycobacterium bovis subsp bovis AF2122/97
ggccggcgccggcgcgu

SEQ ID NO: 3163970 - RNA, 13 nt, Mycobacterium bovis subsp bovis AF2122/97
ggccggcgcggcg

SEQ ID NO: 3163971 - RNA, 15 nt, Mycobacterium bovis subsp bovis AF2122/97
ggccggcgcggucuc

SEQ ID NO: 3163972 - RNA, 15 nt, Mycobacterium bovis subsp bovis AF2122/97
ggccggcggccgccc

SEQ ID NO: 3163973 - RNA, 12 nt, Mycobacterium bovis subsp bovis AF2122/97
ggccggcggcgg

SEQ ID NO: 3163974 - RNA, 17 nt, Mycobacterium bovis subsp bovis AF2122/97
ggccggcggcggcgcuc

SEQ ID NO: 3163975 - RNA, 22 nt, Mycobacterium bovis subsp bovis AF2122/97
ggccggcggcggcgcucggcca

SEQ ID NO: 3163976 - RNA, 18 nt, Mycobacterium bovis subsp bovis AF2122/97
ggccggcgggccugcccg

SEQ ID NO: 3163977 - RNA, 18 nt, Mycobacterium bovis subsp bovis AF2122/97
ggccggcggucagcagcg

SEQ ID NO: 3163978 - RNA, 17 nt, Mycobacterium bovis subsp bovis AF2122/97
ggccggcggucgccagu

SEQ ID NO: 3163979 - RNA, 20 nt, Mycobacterium bovis subsp bovis AF2122/97
ggccggcggucgggcccggc

SEQ ID NO: 3163980 - RNA, 18 nt, Mycobacterium bovis subsp bovis AF2122/97
ggccggcguagcggcgau

SEQ ID NO: 3163981 - RNA, 23 nt, Mycobacterium bovis subsp bovis AF2122/97
ggccggcguagcggcgauaccgg

SEQ ID NO: 3163982 - RNA, 20 nt, Mycobacterium bovis subsp bovis AF2122/97
ggccggcgucagccccgacu

SEQ ID NO: 3163983 - RNA, 14 nt, Mycobacterium bovis subsp bovis AF2122/97
ggccggcgucggcg

SEQ ID NO: 3163984 - RNA, 17 nt, Mycobacterium bovis subsp bovis AF2122/97
ggccggcgugccagcac

SEQ ID NO: 3163985 - RNA, 11 nt, Mycobacterium bovis subsp bovis AF2122/97
ggccggcguug

SEQ ID NO: 3163986 - RNA, 20 nt, Mycobacterium bovis subsp bovis AF2122/97
ggccggcuagggcagcagcc

SEQ ID NO: 3163987 - RNA, 20 nt, Mycobacterium bovis subsp bovis AF2122/97
ggccggcucagucacgcacu

SEQ ID NO: 3163988 - RNA, 19 nt, Mycobacterium bovis subsp bovis AF2122/97
ggccggcucgccgacccgc

SEQ ID NO: 3163989 - RNA, 12 nt, Mycobacterium bovis subsp bovis AF2122/97
ggccggcucgcu

SEQ ID NO: 3163990 - RNA, 18 nt, Mycobacterium bovis subsp bovis AF2122/97
ggccggcucguccgggca

SEQ ID NO: 3163991 - RNA, 19 nt, Mycobacterium bovis subsp bovis AF2122/97
ggccggcucguccgggcag

SEQ ID NO: 3163992 - RNA, 16 nt, Mycobacterium bovis subsp bovis AF2122/97
ggccgggaaccucgcg

SEQ ID NO: 3163993 - RNA, 16 nt, Mycobacterium bovis subsp bovis AF2122/97
ggccgggacagcgccg

SEQ ID NO: 3163994 - RNA, 23 nt, Mycobacterium bovis subsp bovis AF2122/97
ggccgucgaacgguagcacgguc

SEQ ID NO: 3163995 - RNA, 20 nt, Mycobacterium bovis subsp bovis AF2122/97
ggccgucgaagacgaacgug

SEQ ID NO: 3163996 - RNA, 19 nt, Mycobacterium bovis subsp bovis AF2122/97
ggccgucgacgcauggguc

SEQ ID NO: 3163997 - RNA, 15 nt, Mycobacterium bovis subsp bovis AF2122/97
ggccgucgaugaucu

SEQ ID NO: 3163998 - RNA, 14 nt, Mycobacterium bovis subsp bovis AF2122/97
ggccgucgccgaag

SEQ ID NO: 3163999 - RNA, 12 nt, Mycobacterium bovis subsp bovis AF2122/97
ggccgucgccgu

SEQ ID NO: 3164000 - RNA, 20 nt, Mycobacterium bovis subsp bovis AF2122/97
ggccgucgcgaaacaccaga

SEQ ID NO: 3164001 - RNA, 22 nt, Mycobacterium bovis subsp bovis AF2122/97
ggccgucgcgaaacaccagaca

SEQ ID NO: 3164002 - RNA, 23 nt, Mycobacterium bovis subsp bovis AF2122/97
ggccgucgcgaaacaccagacac

SEQ ID NO: 3164003 - RNA, 23 nt, Mycobacterium bovis subsp bovis AF2122/97
ggccgucgcgggacaacagcaug

SEQ ID NO: 3164004 - RNA, 15 nt, Mycobacterium bovis subsp bovis AF2122/97
ggccgucgcuggugg

SEQ ID NO: 3164005 - RNA, 15 nt, Mycobacterium bovis subsp bovis AF2122/97
ggccgucggccggau

SEQ ID NO: 3164006 - RNA, 14 nt, Mycobacterium bovis subsp bovis AF2122/97
ggccgucggcgggc

SEQ ID NO: 3164007 - RNA, 13 nt, Mycobacterium bovis subsp bovis AF2122/97
ggccgucggcguc

SEQ ID NO: 3164008 - RNA, 17 nt, Mycobacterium bovis subsp bovis AF2122/97
ggccgucgggacggcca

SEQ ID NO: 3164009 - RNA, 22 nt, Mycobacterium bovis subsp bovis AF2122/97
ggccgucgggugcagcacggcg

SEQ ID NO: 3164010 - RNA, 24 nt, Mycobacterium bovis subsp bovis AF2122/97
ggccgucgggugcagcacggcgcc

SEQ ID NO: 3164011 - RNA, 19 nt, Mycobacterium bovis subsp bovis AF2122/97
ggccgucgucggucaccga

SEQ ID NO: 3164012 - RNA, 19 nt, Mycobacterium bovis subsp bovis AF2122/97
ggccgucguugccggcgac

SEQ ID NO: 3164013 - RNA, 14 nt, Mycobacterium bovis subsp bovis AF2122/97
ggccgucucgccgu

SEQ ID NO: 3164014 - RNA, 17 nt, Mycobacterium bovis subsp bovis AF2122/97
ggccgucucgccgugga

SEQ ID NO: 3164015 - RNA, 22 nt, Mycobacterium bovis subsp bovis AF2122/97
ggccgugaagggauccggaagc

SEQ ID NO: 3164016 - RNA, 17 nt, Mycobacterium bovis subsp bovis AF2122/97
ggccgugaauucgccga

SEQ ID NO: 3164017 - RNA, 23 nt, Mycobacterium bovis subsp bovis AF2122/97
ggccgugacccucagcaccgcug

SEQ ID NO: 3164018 - RNA, 14 nt, Mycobacterium bovis subsp bovis AF2122/97
ggccgugaccgagc

SEQ ID NO: 3164019 - RNA, 18 nt, Mycobacterium bovis subsp bovis AF2122/97
ggccgugaccgagccgcg

SEQ ID NO: 3164020 - RNA, 22 nt, Mycobacterium bovis subsp bovis AF2122/97
ggccgugaccgagccgcgaugc

SEQ ID NO: 3164021 - RNA, 21 nt, Mycobacterium bovis subsp bovis AF2122/97
ggccgugaugccacggcgucg

SEQ ID NO: 3164022 - RNA, 14 nt, Mycobacterium bovis subsp bovis AF2122/97
ggccgugccgccga

SEQ ID NO: 3164023 - RNA, 17 nt, Mycobacterium bovis subsp bovis AF2122/97
ggccgugccgccgacac

SEQ ID NO: 3164024 - RNA, 18 nt, Mycobacterium bovis subsp bovis AF2122/97
ggccguggaaagccggcg

SEQ ID NO: 3164025 - RNA, 17 nt, Mycobacterium bovis subsp bovis AF2122/97
ggccguggccucgaugu

SEQ ID NO: 3164026 - RNA, 15 nt, Mycobacterium bovis subsp bovis AF2122/97
ggccguggcggacgg

SEQ ID NO: 3164027 - RNA, 17 nt, Mycobacterium bovis subsp bovis AF2122/97
ggccguggcggacggcg

SEQ ID NO: 3164028 - RNA, 19 nt, Mycobacterium bovis subsp bovis AF2122/97
ggccguggcggacggcguc

SEQ ID NO: 3164029 - RNA, 15 nt, Mycobacterium bovis subsp bovis AF2122/97
ggccguggcuggacc

SEQ ID NO: 3164030 - RNA, 24 nt, Mycobacterium bovis subsp bovis AF2122/97
ggccguggcuggacccgcauggcg

SEQ ID NO: 3164031 - RNA, 17 nt, Mycobacterium bovis subsp bovis AF2122/97
ggccgugguggucucga

SEQ ID NO: 3164032 - RNA, 18 nt, Mycobacterium bovis subsp bovis AF2122/97
ggccguguacgugcucgu

SEQ ID NO: 3164033 - RNA, 15 nt, Mycobacterium bovis subsp bovis AF2122/97
ggccguguccgccgg

SEQ ID NO: 3164034 - RNA, 20 nt, Mycobacterium bovis subsp bovis AF2122/97
ggccguuccacaucaaaacg

SEQ ID NO: 3164035 - RNA, 16 nt, Mycobacterium bovis subsp bovis AF2122/97
ggccguugacgguguc

SEQ ID NO: 3164036 - RNA, 23 nt, Mycobacterium bovis subsp bovis AF2122/97
ggccguugaggaacuccgcgauc

SEQ ID NO: 3164037 - RNA, 19 nt, Mycobacterium bovis subsp bovis AF2122/97
ggccguugcccgacucggc

SEQ ID NO: 3164038 - RNA, 21 nt, Mycobacterium bovis subsp bovis AF2122/97
ggccguugcuauucgccagcg

SEQ ID NO: 3164039 - RNA, 19 nt, Mycobacterium bovis subsp bovis AF2122/97
ggccguugggccaccggcg

SEQ ID NO: 3164040 - RNA, 16 nt, Mycobacterium bovis subsp bovis AF2122/97
ggccguugugcgguug

SEQ ID NO: 3164041 - RNA, 15 nt, Mycobacterium bovis subsp bovis AF2122/97
ggccguuucggcgcc

SEQ ID NO: 3164042 - RNA, 20 nt, Mycobacterium bovis subsp bovis AF2122/97
ggccuaacgaguaggcggcu

SEQ ID NO: 3164043 - RNA, 17 nt, Mycobacterium bovis subsp bovis AF2122/97
ggccuaccaggcgcggc

SEQ ID NO: 3164044 - RNA, 22 nt, Mycobacterium bovis subsp bovis AF2122/97
ggccuaccaggcgcggcccagg

SEQ ID NO: 3164045 - RNA, 16 nt, Mycobacterium bovis subsp bovis AF2122/97
ggccuagccgauggcu

SEQ ID NO: 3164046 - RNA, 14 nt, Mycobacterium bovis subsp bovis AF2122/97
ggccuagccgcggc

SEQ ID NO: 3164047 - RNA, 17 nt, Mycobacterium bovis subsp bovis AF2122/97
ggccuagccgcggcacc

SEQ ID NO: 3164048 - RNA, 19 nt, Mycobacterium bovis subsp bovis AF2122/97
ggccuagccgcggcaccgc

SEQ ID NO: 3164049 - RNA, 15 nt, Mycobacterium bovis subsp bovis AF2122/97
ggccuagcgcggcga

SEQ ID NO: 3164050 - RNA, 17 nt, Mycobacterium bovis subsp bovis AF2122/97
ggccuaggacaccggca

SEQ ID NO: 3164051 - RNA, 14 nt, Mycobacterium bovis subsp bovis AF2122/97
ggccuaggccgagg

SEQ ID NO: 3164052 - RNA, 13 nt, Mycobacterium bovis subsp bovis AF2122/97
ggccuagggcggc

SEQ ID NO: 3164053 - RNA, 16 nt, Mycobacterium bovis subsp bovis AF2122/97
ggccuagggcggcggc

SEQ ID NO: 3164054 - RNA, 18 nt, Mycobacterium bovis subsp bovis AF2122/97
ggccuaggucgacgccga

SEQ ID NO: 3164055 - RNA, 23 nt, Mycobacterium bovis subsp bovis AF2122/97
ggccuaucccgaaucucacccac

SEQ ID NO: 3164056 - RNA, 22 nt, Mycobacterium bovis subsp bovis AF2122/97
ggccucaaguugguucaccgcg

SEQ ID NO: 3164057 - RNA, 13 nt, Mycobacterium bovis subsp bovis AF2122/97
ggccucagcccgg

SEQ ID NO: 3164058 - RNA, 18 nt, Mycobacterium bovis subsp bovis AF2122/97
ggccucagcccggccagc

SEQ ID NO: 3164059 - RNA, 19 nt, Mycobacterium bovis subsp bovis AF2122/97
ggccucagcccggccagcc

SEQ ID NO: 3164060 - RNA, 15 nt, Mycobacterium bovis subsp bovis AF2122/97
ggccucagcuacccc

SEQ ID NO: 3164061 - RNA, 18 nt, Mycobacterium bovis subsp bovis AF2122/97
ggccucauccaccgaugg

SEQ ID NO: 3164062 - RNA, 21 nt, Mycobacterium bovis subsp bovis AF2122/97
ggccucauccaccgauggcgc

SEQ ID NO: 3164063 - RNA, 22 nt, Mycobacterium bovis subsp bovis AF2122/97
ggccucaugcuaggccaccggc

SEQ ID NO: 3164064 - RNA, 19 nt, Mycobacterium bovis subsp bovis AF2122/97
ggccuccaagcccgccgga

SEQ ID NO: 3164065 - RNA, 18 nt, Mycobacterium bovis subsp bovis AF2122/97
ggccuccacccgccacgg

SEQ ID NO: 3164066 - RNA, 14 nt, Mycobacterium bovis subsp bovis AF2122/97
ggccuccagcaccc

SEQ ID NO: 3164067 - RNA, 18 nt, Mycobacterium bovis subsp bovis AF2122/97
ggccucccacucacccag

SEQ ID NO: 3164068 - RNA, 14 nt, Mycobacterium bovis subsp bovis AF2122/97
ggccucccccaaac

SEQ ID NO: 3164069 - RNA, 19 nt, Mycobacterium bovis subsp bovis AF2122/97
ggccuccccgaccugcaag

SEQ ID NO: 3164070 - RNA, 14 nt, Mycobacterium bovis subsp bovis AF2122/97
ggccucccgggccg

SEQ ID NO: 3164071 - RNA, 15 nt, Mycobacterium bovis subsp bovis AF2122/97
ggccuccgcugccgc

SEQ ID NO: 3164072 - RNA, 21 nt, Mycobacterium bovis subsp bovis AF2122/97
ggccuccgcugccgcccgcgc

SEQ ID NO: 3164073 - RNA, 19 nt, Mycobacterium bovis subsp bovis AF2122/97
ggccuccuccccgaccgcc

SEQ ID NO: 3164074 - RNA, 11 nt, Mycobacterium bovis subsp bovis AF2122/97
ggccuccucgu

SEQ ID NO: 3164075 - RNA, 16 nt, Mycobacterium bovis subsp bovis AF2122/97
ggccuccucgucgcuc

SEQ ID NO: 3164076 - RNA, 14 nt, Mycobacterium bovis subsp bovis AF2122/97
ggccuccugcuggc

SEQ ID NO: 3164077 - RNA, 23 nt, Mycobacterium bovis subsp bovis AF2122/97
ggccucgaagggcuugucgccgg

SEQ ID NO: 3164078 - RNA, 12 nt, Mycobacterium bovis subsp bovis AF2122/97
ggccucgaccgc

SEQ ID NO: 3164079 - RNA, 13 nt, Mycobacterium bovis subsp bovis AF2122/97
ggccucgaccgcc

SEQ ID NO: 3164080 - RNA, 13 nt, Mycobacterium bovis subsp bovis AF2122/97
ggccugggccgca

SEQ ID NO: 3164081 - RNA, 14 nt, Mycobacterium bovis subsp bovis AF2122/97
ggccugggccgcac

SEQ ID NO: 3164082 - RNA, 16 nt, Mycobacterium bovis subsp bovis AF2122/97
ggccuggggcagccgg

SEQ ID NO: 3164083 - RNA, 16 nt, Mycobacterium bovis subsp bovis AF2122/97
ggccugguacucccgc

SEQ ID NO: 3164084 - RNA, 20 nt, Mycobacterium bovis subsp bovis AF2122/97
ggccugguacucccgcgauc

SEQ ID NO: 3164085 - RNA, 17 nt, Mycobacterium bovis subsp bovis AF2122/97
ggccuggucggccaggu

SEQ ID NO: 3164086 - RNA, 15 nt, Mycobacterium bovis subsp bovis AF2122/97
ggccugucaggcggc

SEQ ID NO: 3164087 - RNA, 18 nt, Mycobacterium bovis subsp bovis AF2122/97
ggccugucaggcggcgga

SEQ ID NO: 3164088 - RNA, 20 nt, Mycobacterium bovis subsp bovis AF2122/97
ggccugucaggcggcggacc

SEQ ID NO: 3164089 - RNA, 17 nt, Mycobacterium bovis subsp bovis AF2122/97
ggccugucccgcacccg

SEQ ID NO: 3164090 - RNA, 14 nt, Mycobacterium bovis subsp bovis AF2122/97
ggccugucgaagau

SEQ ID NO: 3164091 - RNA, 21 nt, Mycobacterium bovis subsp bovis AF2122/97
ggccugucgaagauccagcgc

SEQ ID NO: 3164092 - RNA, 13 nt, Mycobacterium bovis subsp bovis AF2122/97
ggccuguuccauu

SEQ ID NO: 3164093 - RNA, 15 nt, Mycobacterium bovis subsp bovis AF2122/97
ggccuguucgagauc

SEQ ID NO: 3164094 - RNA, 19 nt, Mycobacterium bovis subsp bovis AF2122/97
ggccuguucgagaucgccg

SEQ ID NO: 3164095 - RNA, 20 nt, Mycobacterium bovis subsp bovis AF2122/97
ggccuguucgagaucgccga

SEQ ID NO: 3164096 - RNA, 18 nt, Mycobacterium bovis subsp bovis AF2122/97
ggccuguucgccgucgcu

SEQ ID NO: 3164097 - RNA, 23 nt, Mycobacterium bovis subsp bovis AF2122/97
ggccuguuuaccuuccucgcccu

SEQ ID NO: 3164098 - RNA, 17 nt, Mycobacterium bovis subsp bovis AF2122/97
ggccuuauucacccggu

SEQ ID NO: 3164099 - RNA, 13 nt, Mycobacterium bovis subsp bovis AF2122/97
ggccuucagcuca

SEQ ID NO: 3164100 - RNA, 16 nt, Mycobacterium bovis subsp bovis AF2122/97
ggccuucagcucacca

SEQ ID NO: 3164101 - RNA, 22 nt, Mycobacterium bovis subsp bovis AF2122/97
ggccuucgccgacuagcugggg

SEQ ID NO: 3164102 - RNA, 14 nt, Mycobacterium bovis subsp bovis AF2122/97
ggccuucggccggc

SEQ ID NO: 3164103 - RNA, 16 nt, Mycobacterium bovis subsp bovis AF2122/97
ggccuucggccggcgu

SEQ ID NO: 3164104 - RNA, 18 nt, Mycobacterium bovis subsp bovis AF2122/97
ggccuucuccccgaucag

SEQ ID NO: 3164105 - RNA, 18 nt, Mycobacterium bovis subsp bovis AF2122/97
ggccuugacgcacgacug

SEQ ID NO: 3164106 - RNA, 22 nt, Mycobacterium bovis subsp bovis AF2122/97
ggccuugacgcacgacugugcg

SEQ ID NO: 3164107 - RNA, 18 nt, Mycobacterium bovis subsp bovis AF2122/97
ggccuugaucaccgugcg

SEQ ID NO: 3164108 - RNA, 14 nt, Mycobacterium bovis subsp bovis AF2122/97
ggccuugaucggca

SEQ ID NO: 3164109 - RNA, 22 nt, Mycobacterium bovis subsp bovis AF2122/97
ggccuugaucgugcuggcgacg

SEQ ID NO: 3164110 - RNA, 13 nt, Mycobacterium bovis subsp bovis AF2122/97
ggccuugccaccg

SEQ ID NO: 3164111 - RNA, 15 nt, Mycobacterium bovis subsp bovis AF2122/97
ggccuugccgccggc

SEQ ID NO: 3164112 - RNA, 20 nt, Mycobacterium bovis subsp bovis AF2122/97
ggccuugccgccggcgccgc

SEQ ID NO: 3164113 - RNA, 22 nt, Mycobacterium bovis subsp bovis AF2122/97
ggccuugcgcacaggcgcgauc

SEQ ID NO: 3164114 - RNA, 19 nt, Mycobacterium bovis subsp bovis AF2122/97
ggccuugcgggcucucggc

SEQ ID NO: 3164115 - RNA, 19 nt, Mycobacterium bovis subsp bovis AF2122/97
ggccuugcgucaucggcuc

SEQ ID NO: 3164116 - RNA, 18 nt, Mycobacterium bovis subsp bovis AF2122/97
ggccuuggcaggugucgg

SEQ ID NO: 3164117 - RNA, 13 nt, Mycobacterium bovis subsp bovis AF2122/97
ggccuuggcgacg

SEQ ID NO: 3164118 - RNA, 13 nt, Mycobacterium bovis subsp bovis AF2122/97
ggccuuggcggcg

SEQ ID NO: 3164119 - RNA, 14 nt, Mycobacterium bovis subsp bovis AF2122/97
ggccuuggcggcgg

SEQ ID NO: 3164120 - RNA, 14 nt, Mycobacterium bovis subsp bovis AF2122/97
ggccuugggcggca

SEQ ID NO: 3164121 - RNA, 16 nt, Mycobacterium bovis subsp bovis AF2122/97
ggccuuggugcggccg

SEQ ID NO: 3164122 - RNA, 15 nt, Mycobacterium bovis subsp bovis AF2122/97
ggccuugugcucgau

SEQ ID NO: 3164123 - RNA, 16 nt, Mycobacterium bovis subsp bovis AF2122/97
ggccuuuccagcaccc

SEQ ID NO: 3164124 - RNA, 13 nt, Mycobacterium bovis subsp bovis AF2122/97
ggccuuugagcgc

SEQ ID NO: 3164125 - RNA, 16 nt, Mycobacterium bovis subsp bovis AF2122/97
ggccuuugagcgcggc

SEQ ID NO: 3164126 - RNA, 21 nt, Mycobacterium bovis subsp bovis AF2122/97
ggcgaaaagacugcgccgccg

SEQ ID NO: 3164127 - RNA, 18 nt, Mycobacterium bovis subsp bovis AF2122/97
ggcgaaaauugcuccacc

SEQ ID NO: 3164128 - RNA, 19 nt, Mycobacterium bovis subsp bovis AF2122/97
ggcgaaaauugcuccacca

SEQ ID NO: 3164129 - RNA, 14 nt, Mycobacterium bovis subsp bovis AF2122/97
ggcgaaaucgucga

SEQ ID NO: 3164130 - RNA, 18 nt, Mycobacterium bovis subsp bovis AF2122/97
ggcgaaaucgucgaaccg

SEQ ID NO: 3164131 - RNA, 23 nt, Mycobacterium bovis subsp bovis AF2122/97
ggcgaacagcaugauccgcuggg

SEQ ID NO: 3164132 - RNA, 21 nt, Mycobacterium bovis subsp bovis AF2122/97
ggcgaacagugacgccacgac

SEQ ID NO: 3164133 - RNA, 17 nt, Mycobacterium bovis subsp bovis AF2122/97
ggcgaacaucaccgucg

SEQ ID NO: 3164134 - RNA, 22 nt, Mycobacterium bovis subsp bovis AF2122/97
ggcgaacaucaccgucgcccgg

SEQ ID NO: 3164135 - RNA, 18 nt, Mycobacterium bovis subsp bovis AF2122/97
ggcgaaccacggcagcca

SEQ ID NO: 3164136 - RNA, 15 nt, Mycobacterium bovis subsp bovis AF2122/97
ggcgaaccagcgcgu

SEQ ID NO: 3164137 - RNA, 16 nt, Mycobacterium bovis subsp bovis AF2122/97
ggcgaacccuccgcag

SEQ ID NO: 3164138 - RNA, 18 nt, Mycobacterium bovis subsp bovis AF2122/97
ggcgaacccuccgcagcu

SEQ ID NO: 3164139 - RNA, 16 nt, Mycobacterium bovis subsp bovis AF2122/97
ggcgaaccgcuccaca

SEQ ID NO: 3164140 - RNA, 19 nt, Mycobacterium bovis subsp bovis AF2122/97
ggcgaaccgucagcgcgcc

SEQ ID NO: 3164141 - RNA, 20 nt, Mycobacterium bovis subsp bovis AF2122/97
ggcgaaccgucagcgcgccg

SEQ ID NO: 3164142 - RNA, 17 nt, Mycobacterium bovis subsp bovis AF2122/97
ggcgaaccuugguugcc

SEQ ID NO: 3164143 - RNA, 18 nt, Mycobacterium bovis subsp bovis AF2122/97
ggcgaacgcguccagcgc

SEQ ID NO: 3164144 - RNA, 20 nt, Mycobacterium bovis subsp bovis AF2122/97
ggcgaacgcguccagcgcgg

SEQ ID NO: 3164145 - RNA, 22 nt, Mycobacterium bovis subsp bovis AF2122/97
ggcgaacgcuucaccucgucga

SEQ ID NO: 3164146 - RNA, 21 nt, Mycobacterium bovis subsp bovis AF2122/97
ggcgaacggcaccgcgcccac

SEQ ID NO: 3164147 - RNA, 20 nt, Mycobacterium bovis subsp bovis AF2122/97
ggcgaacucgaggucgagcg

SEQ ID NO: 3164148 - RNA, 17 nt, Mycobacterium bovis subsp bovis AF2122/97
ggcgaacucgcgccgag

SEQ ID NO: 3164149 - RNA, 19 nt, Mycobacterium bovis subsp bovis AF2122/97
ggcgaacucgcgccgagcc

SEQ ID NO: 3164150 - RNA, 15 nt, Mycobacterium bovis subsp bovis AF2122/97
ggcgaacugggugcg

SEQ ID NO: 3164151 - RNA, 16 nt, Mycobacterium bovis subsp bovis AF2122/97
ggcgaacugguagccc

SEQ ID NO: 3164152 - RNA, 21 nt, Mycobacterium bovis subsp bovis AF2122/97
ggcgaagaacaacaucgccau

SEQ ID NO: 3164153 - RNA, 23 nt, Mycobacterium bovis subsp bovis AF2122/97
ggcgaagcgggacugcagcgcgg

SEQ ID NO: 3164154 - RNA, 20 nt, Mycobacterium bovis subsp bovis AF2122/97
ggcgaagcgggcgugcucgg

SEQ ID NO: 3164155 - RNA, 14 nt, Mycobacterium bovis subsp bovis AF2122/97
ggcgaagcuugacg

SEQ ID NO: 3164156 - RNA, 15 nt, Mycobacterium bovis subsp bovis AF2122/97
ggcgaagcuugacgu

SEQ ID NO: 3164157 - RNA, 14 nt, Mycobacterium bovis subsp bovis AF2122/97
ggcgaaggccagca

SEQ ID NO: 3164158 - RNA, 20 nt, Mycobacterium bovis subsp bovis AF2122/97
ggcgaaggccgcgcgcaggg

SEQ ID NO: 3164159 - RNA, 15 nt, Mycobacterium bovis subsp bovis AF2122/97
ggcgaaggucuggcc

SEQ ID NO: 3164160 - RNA, 18 nt, Mycobacterium bovis subsp bovis AF2122/97
ggcgaagguguccuccag

SEQ ID NO: 3164161 - RNA, 17 nt, Mycobacterium bovis subsp bovis AF2122/97
ggcgaagucacgcaccc

SEQ ID NO: 3164162 - RNA, 16 nt, Mycobacterium bovis subsp bovis AF2122/97
ggcgaagucgacucgc

SEQ ID NO: 3164163 - RNA, 15 nt, Mycobacterium bovis subsp bovis AF2122/97
ggcgaagucgagugc

SEQ ID NO: 3164164 - RNA, 22 nt, Mycobacterium bovis subsp bovis AF2122/97
ggcgaagucgucgaggucacgc

SEQ ID NO: 3164165 - RNA, 18 nt, Mycobacterium bovis subsp bovis AF2122/97
ggcgaauacgaccgucgc

SEQ ID NO: 3164166 - RNA, 22 nt, Mycobacterium bovis subsp bovis AF2122/97
ggcgacgaaguccccguagucg

SEQ ID NO: 3164167 - RNA, 12 nt, Mycobacterium bovis subsp bovis AF2122/97
ggcgacgacauc

SEQ ID NO: 3164168 - RNA, 11 nt, Mycobacterium bovis subsp bovis AF2122/97
ggcgacgaccc

SEQ ID NO: 3164169 - RNA, 16 nt, Mycobacterium bovis subsp bovis AF2122/97
ggcgacgaccgucggc

SEQ ID NO: 3164170 - RNA, 21 nt, Mycobacterium bovis subsp bovis AF2122/97
ggcgacgagaucugcgauggg

SEQ ID NO: 3164171 - RNA, 17 nt, Mycobacterium bovis subsp bovis AF2122/97
ggcgacgaucucgccgc

SEQ ID NO: 3164172 - RNA, 20 nt, Mycobacterium bovis subsp bovis AF2122/97
ggcgacgaucucgccgccag

SEQ ID NO: 3164173 - RNA, 21 nt, Mycobacterium bovis subsp bovis AF2122/97
ggcgacgaucucgccgccagc

SEQ ID NO: 3164174 - RNA, 22 nt, Mycobacterium bovis subsp bovis AF2122/97
ggcgacgaucucgccgccagcg

SEQ ID NO: 3164175 - RNA, 19 nt, Mycobacterium bovis subsp bovis AF2122/97
ggcgacgaugccgggucgc

SEQ ID NO: 3164176 - RNA, 18 nt, Mycobacterium bovis subsp bovis AF2122/97
ggcgacgaugucgagcgc

SEQ ID NO: 3164177 - RNA, 23 nt, Mycobacterium bovis subsp bovis AF2122/97
ggcgacgccaguguugcgcugcg

SEQ ID NO: 3164178 - RNA, 13 nt, Mycobacterium bovis subsp bovis AF2122/97
ggcgacgcgccgg

SEQ ID NO: 3164179 - RNA, 15 nt, Mycobacterium bovis subsp bovis AF2122/97
ggcgacgcgccgguu

SEQ ID NO: 3164180 - RNA, 20 nt, Mycobacterium bovis subsp bovis AF2122/97
ggcgacgcgccgguucagac

SEQ ID NO: 3164181 - RNA, 17 nt, Mycobacterium bovis subsp bovis AF2122/97
ggcgacgcuaccgccgg

SEQ ID NO: 3164182 - RNA, 19 nt, Mycobacterium bovis subsp bovis AF2122/97
ggcgacgcuaccgccggag

SEQ ID NO: 3164183 - RNA, 21 nt, Mycobacterium bovis subsp bovis AF2122/97
ggcgacggccaagaucggcgc

SEQ ID NO: 3164184 - RNA, 15 nt, Mycobacterium bovis subsp bovis AF2122/97
ggcgacggccagcgc

SEQ ID NO: 3164185 - RNA, 21 nt, Mycobacterium bovis subsp bovis AF2122/97
ggcgacggccagcgcgucggg

SEQ ID NO: 3164186 - RNA, 20 nt, Mycobacterium bovis subsp bovis AF2122/97
ggcgacggcccucgagcagc

SEQ ID NO: 3164187 - RNA, 13 nt, Mycobacterium bovis subsp bovis AF2122/97
ggcgacggcgaug

SEQ ID NO: 3164188 - RNA, 14 nt, Mycobacterium bovis subsp bovis AF2122/97
ggcgacggcggcac

SEQ ID NO: 3164189 - RNA, 18 nt, Mycobacterium bovis subsp bovis AF2122/97
ggcgacggcggcacgggc

SEQ ID NO: 3164190 - RNA, 21 nt, Mycobacterium bovis subsp bovis AF2122/97
ggcgacggcggcgucgaugag

SEQ ID NO: 3164191 - RNA, 19 nt, Mycobacterium bovis subsp bovis AF2122/97
ggcgacggcgucacccgca

SEQ ID NO: 3164192 - RNA, 14 nt, Mycobacterium bovis subsp bovis AF2122/97
ggcgacggcgucga

SEQ ID NO: 3164193 - RNA, 15 nt, Mycobacterium bovis subsp bovis AF2122/97
ggcgacggcucuacc

SEQ ID NO: 3164194 - RNA, 18 nt, Mycobacterium bovis subsp bovis AF2122/97
ggcgacgggucgggcaac

SEQ ID NO: 3164195 - RNA, 16 nt, Mycobacterium bovis subsp bovis AF2122/97
ggcgacggugccaccg

SEQ ID NO: 3164196 - RNA, 19 nt, Mycobacterium bovis subsp bovis AF2122/97
ggcgacggugccaccgcga

SEQ ID NO: 3164197 - RNA, 17 nt, Mycobacterium bovis subsp bovis AF2122/97
ggcgacgucaucgccga

SEQ ID NO: 3164198 - RNA, 21 nt, Mycobacterium bovis subsp bovis AF2122/97
ggcgacgucaucgccgacccg

SEQ ID NO: 3164199 - RNA, 23 nt, Mycobacterium bovis subsp bovis AF2122/97
ggcgacgucaucgccgacccgcc

SEQ ID NO: 3164200 - RNA, 14 nt, Mycobacterium bovis subsp bovis AF2122/97
ggcgacgucgacaa

SEQ ID NO: 3164201 - RNA, 14 nt, Mycobacterium bovis subsp bovis AF2122/97
ggcgacgucggcgg

SEQ ID NO: 3164202 - RNA, 16 nt, Mycobacterium bovis subsp bovis AF2122/97
ggcgacgucggcggcu

SEQ ID NO: 3164203 - RNA, 19 nt, Mycobacterium bovis subsp bovis AF2122/97
ggcgacgucucgcaugcuc

SEQ ID NO: 3164204 - RNA, 16 nt, Mycobacterium bovis subsp bovis AF2122/97
ggcgacguggcgccga

SEQ ID NO: 3164205 - RNA, 15 nt, Mycobacterium bovis subsp bovis AF2122/97
ggcgacuacccagcc

SEQ ID NO: 3164206 - RNA, 15 nt, Mycobacterium bovis subsp bovis AF2122/97
ggcgacuacggccuc

SEQ ID NO: 3164207 - RNA, 19 nt, Mycobacterium bovis subsp bovis AF2122/97
ggcgacucgaggaccugcu

SEQ ID NO: 3164208 - RNA, 13 nt, Mycobacterium bovis subsp bovis AF2122/97
ggcgacucggugc

SEQ ID NO: 3164209 - RNA, 17 nt, Mycobacterium bovis subsp bovis AF2122/97
ggcgacucgugucugcc

SEQ ID NO: 3164210 - RNA, 16 nt, Mycobacterium bovis subsp bovis AF2122/97
ggcgacugcgucggcg

SEQ ID NO: 3164211 - RNA, 17 nt, Mycobacterium bovis subsp bovis AF2122/97
ggcgacugcgucggcgg

SEQ ID NO: 3164212 - RNA, 19 nt, Mycobacterium bovis subsp bovis AF2122/97
ggcgacuucuucgcgcaac

SEQ ID NO: 3164213 - RNA, 19 nt, Mycobacterium bovis subsp bovis AF2122/97
ggcgagaaacacgacagcc

SEQ ID NO: 3164214 - RNA, 12 nt, Mycobacterium bovis subsp bovis AF2122/97
ggcgagaagcgu

SEQ ID NO: 3164215 - RNA, 18 nt, Mycobacterium bovis subsp bovis AF2122/97
ggcgagacauugacgagg

SEQ ID NO: 3164216 - RNA, 20 nt, Mycobacterium bovis subsp bovis AF2122/97
ggcgagacauugacgaggcg

SEQ ID NO: 3164217 - RNA, 18 nt, Mycobacterium bovis subsp bovis AF2122/97
ggcgagcaacucguccag

SEQ ID NO: 3164218 - RNA, 19 nt, Mycobacterium bovis subsp bovis AF2122/97
ggcgagcaacucguccagc

SEQ ID NO: 3164219 - RNA, 18 nt, Mycobacterium bovis subsp bovis AF2122/97
ggcgagcacaugcugccg

SEQ ID NO: 3164220 - RNA, 13 nt, Mycobacterium bovis subsp bovis AF2122/97
ggcgagcaccacc

SEQ ID NO: 3164221 - RNA, 22 nt, Mycobacterium bovis subsp bovis AF2122/97
ggcgagcaccaccccagcggcc

SEQ ID NO: 3164222 - RNA, 13 nt, Mycobacterium bovis subsp bovis AF2122/97
ggcgagcacccgc

SEQ ID NO: 3164223 - RNA, 18 nt, Mycobacterium bovis subsp bovis AF2122/97
ggcgagcaccgugcccug

SEQ ID NO: 3164224 - RNA, 20 nt, Mycobacterium bovis subsp bovis AF2122/97
ggcgagcagacgcaaaagcc

SEQ ID NO: 3164225 - RNA, 22 nt, Mycobacterium bovis subsp bovis AF2122/97
ggcgagcagacgcauaagcccc

SEQ ID NO: 3164226 - RNA, 12 nt, Mycobacterium bovis subsp bovis AF2122/97
ggcgagcagaga

SEQ ID NO: 3164227 - RNA, 21 nt, Mycobacterium bovis subsp bovis AF2122/97
ggcgagcagagaacuccgcca

SEQ ID NO: 3164228 - RNA, 13 nt, Mycobacterium bovis subsp bovis AF2122/97
ggcgagcagcagg

SEQ ID NO: 3164229 - RNA, 16 nt, Mycobacterium bovis subsp bovis AF2122/97
ggcgagcaggccguug

SEQ ID NO: 3164230 - RNA, 20 nt, Mycobacterium bovis subsp bovis AF2122/97
ggcgagcagucgcaaaagcc

SEQ ID NO: 3164231 - RNA, 20 nt, Mycobacterium bovis subsp bovis AF2122/97
ggcgagcaucucgacaucgg

SEQ ID NO: 3164232 - RNA, 23 nt, Mycobacterium bovis subsp bovis AF2122/97
ggcgagcaucucgacaucggcca

SEQ ID NO: 3164233 - RNA, 13 nt, Mycobacterium bovis subsp bovis AF2122/97
ggcgagcaugccg

SEQ ID NO: 3164234 - RNA, 14 nt, Mycobacterium bovis subsp bovis AF2122/97
ggcgagccacggca

SEQ ID NO: 3164235 - RNA, 21 nt, Mycobacterium bovis subsp bovis AF2122/97
ggcgagccagcuucccgcugg

SEQ ID NO: 3164236 - RNA, 13 nt, Mycobacterium bovis subsp bovis AF2122/97
ggcgagccggcgc

SEQ ID NO: 3164237 - RNA, 17 nt, Mycobacterium bovis subsp bovis AF2122/97
ggcgagccgugccagca

SEQ ID NO: 3164238 - RNA, 21 nt, Mycobacterium bovis subsp bovis AF2122/97
ggcgagcgcaucggccaacac

SEQ ID NO: 3164239 - RNA, 11 nt, Mycobacterium bovis subsp bovis AF2122/97
ggcgagcgcgc

SEQ ID NO: 3164240 - RNA, 12 nt, Mycobacterium bovis subsp bovis AF2122/97
ggcgagcgcgcc

SEQ ID NO: 3164241 - RNA, 13 nt, Mycobacterium bovis subsp bovis AF2122/97
ggcgagcgcggcc

SEQ ID NO: 3164242 - RNA, 23 nt, Mycobacterium bovis subsp bovis AF2122/97
ggcgagcgcggccugcaccagcg

SEQ ID NO: 3164243 - RNA, 16 nt, Mycobacterium bovis subsp bovis AF2122/97
ggcgagcggccuccag

SEQ ID NO: 3164244 - RNA, 18 nt, Mycobacterium bovis subsp bovis AF2122/97
ggcgagcggccuccagca

SEQ ID NO: 3164245 - RNA, 24 nt, Mycobacterium bovis subsp bovis AF2122/97
ggcgagcggccuccagcacccggu

SEQ ID NO: 3164246 - RNA, 22 nt, Mycobacterium bovis subsp bovis AF2122/97
ggcgagcgucgggcuaauccag

SEQ ID NO: 3164247 - RNA, 17 nt, Mycobacterium bovis subsp bovis AF2122/97
ggcgagcguuuggacgg

SEQ ID NO: 3164248 - RNA, 20 nt, Mycobacterium bovis subsp bovis AF2122/97
ggcgagcuaacacccgagca

SEQ ID NO: 3164249 - RNA, 23 nt, Mycobacterium bovis subsp bovis AF2122/97
ggcgagcuccgaugccgacggcg

SEQ ID NO: 3164250 - RNA, 20 nt, Mycobacterium bovis subsp bovis AF2122/97
ggcgagcucggccccgccgc

SEQ ID NO: 3164251 - RNA, 21 nt, Mycobacterium bovis subsp bovis AF2122/97
ggcgagcucggccccgccgcc

SEQ ID NO: 3164252 - RNA, 19 nt, Mycobacterium bovis subsp bovis AF2122/97
ggcgauggcgagcuggcgu

SEQ ID NO: 3164253 - RNA, 14 nt, Mycobacterium bovis subsp bovis AF2122/97
ggcgauggcggcau

SEQ ID NO: 3164254 - RNA, 15 nt, Mycobacterium bovis subsp bovis AF2122/97
ggcgauggcggcauc

SEQ ID NO: 3164255 - RNA, 21 nt, Mycobacterium bovis subsp bovis AF2122/97
ggcgaugggccgguccggggc

SEQ ID NO: 3164256 - RNA, 23 nt, Mycobacterium bovis subsp bovis AF2122/97
ggcgaugggucugguguccaccg

SEQ ID NO: 3164257 - RNA, 15 nt, Mycobacterium bovis subsp bovis AF2122/97
ggcgauggucuccuc

SEQ ID NO: 3164258 - RNA, 19 nt, Mycobacterium bovis subsp bovis AF2122/97
ggcgauuaccggcacgccg

SEQ ID NO: 3164259 - RNA, 15 nt, Mycobacterium bovis subsp bovis AF2122/97
ggcgauuacggccag

SEQ ID NO: 3164260 - RNA, 20 nt, Mycobacterium bovis subsp bovis AF2122/97
ggcgauucgcaaucagcugg

SEQ ID NO: 3164261 - RNA, 20 nt, Mycobacterium bovis subsp bovis AF2122/97
ggcgauucugcgucugcucg

SEQ ID NO: 3164262 - RNA, 23 nt, Mycobacterium bovis subsp bovis AF2122/97
ggcgauucugcgucugcucggcg

SEQ ID NO: 3164263 - RNA, 19 nt, Mycobacterium bovis subsp bovis AF2122/97
ggcgauucugugucugcuc

SEQ ID NO: 3164264 - RNA, 20 nt, Mycobacterium bovis subsp bovis AF2122/97
ggcgauucugugucugcucg

SEQ ID NO: 3164265 - RNA, 22 nt, Mycobacterium bovis subsp bovis AF2122/97
ggcgauucugugucugcucgcg

SEQ ID NO: 3164266 - RNA, 22 nt, Mycobacterium bovis subsp bovis AF2122/97
ggcgauuuccaucgcgaccucg

SEQ ID NO: 3164267 - RNA, 20 nt, Mycobacterium bovis subsp bovis AF2122/97
ggcgauuuugcgucugcucg

SEQ ID NO: 3164268 - RNA, 23 nt, Mycobacterium bovis subsp bovis AF2122/97
ggcgauuuugcgucugcucgcca

SEQ ID NO: 3164269 - RNA, 22 nt, Mycobacterium bovis subsp bovis AF2122/97
ggcgauuuugcgucugcucgcg

SEQ ID NO: 3164270 - RNA, 23 nt, Mycobacterium bovis subsp bovis AF2122/97
ggcgauuuugcgucugcucggcg

SEQ ID NO: 3164271 - RNA, 21 nt, Mycobacterium bovis subsp bovis AF2122/97
ggcgcaacaccucguaugccg

SEQ ID NO: 3164272 - RNA, 23 nt, Mycobacterium bovis subsp bovis AF2122/97
ggcgcaaccaauaggugucgacg

SEQ ID NO: 3164273 - RNA, 22 nt, Mycobacterium bovis subsp bovis AF2122/97
ggcgcaacgccauaccagcguu

SEQ ID NO: 3164274 - RNA, 17 nt, Mycobacterium bovis subsp bovis AF2122/97
ggcgcaagaaugccgcc

SEQ ID NO: 3164275 - RNA, 18 nt, Mycobacterium bovis subsp bovis AF2122/97
ggcgcaagaaugccgccg

SEQ ID NO: 3164276 - RNA, 22 nt, Mycobacterium bovis subsp bovis AF2122/97
ggcgcaagaaugccgccgacgg

SEQ ID NO: 3164277 - RNA, 15 nt, Mycobacterium bovis subsp bovis AF2122/97
ggcgcaagcagcccg

SEQ ID NO: 3164278 - RNA, 13 nt, Mycobacterium bovis subsp bovis AF2122/97
ggcgcaagcgccg

SEQ ID NO: 3164279 - RNA, 16 nt, Mycobacterium bovis subsp bovis AF2122/97
ggcgcaagcgccgcgc

SEQ ID NO: 3164280 - RNA, 13 nt, Mycobacterium bovis subsp bovis AF2122/97
ggcgcaaucaacg

SEQ ID NO: 3164281 - RNA, 23 nt, Mycobacterium bovis subsp bovis AF2122/97
ggcgcaaucaacgucacccccuu

SEQ ID NO: 3164282 - RNA, 21 nt, Mycobacterium bovis subsp bovis AF2122/97
ggcgcacaacccgucgagccg

SEQ ID NO: 3164283 - RNA, 14 nt, Mycobacterium bovis subsp bovis AF2122/97
ggcgcacagcgagc

SEQ ID NO: 3164284 - RNA, 22 nt, Mycobacterium bovis subsp bovis AF2122/97
ggcgcaccacaccacgguggcc

SEQ ID NO: 3164285 - RNA, 12 nt, Mycobacterium bovis subsp bovis AF2122/97
ggcgcaccaccg

SEQ ID NO: 3164286 - RNA, 13 nt, Mycobacterium bovis subsp bovis AF2122/97
ggcgcaccaccgc

SEQ ID NO: 3164287 - RNA, 21 nt, Mycobacterium bovis subsp bovis AF2122/97
ggcgcaccaccgccccgcgcc

SEQ ID NO: 3164288 - RNA, 23 nt, Mycobacterium bovis subsp bovis AF2122/97
ggcgcaccaccgccccgcgccca

SEQ ID NO: 3164289 - RNA, 17 nt, Mycobacterium bovis subsp bovis AF2122/97
ggcgcaccaucgcggcc

SEQ ID NO: 3164290 - RNA, 22 nt, Mycobacterium bovis subsp bovis AF2122/97
ggcgcaccaucgcggccgcugg

SEQ ID NO: 3164291 - RNA, 23 nt, Mycobacterium bovis subsp bovis AF2122/97
ggcgcaccaucgcggccgcuggg

SEQ ID NO: 3164292 - RNA, 20 nt, Mycobacterium bovis subsp bovis AF2122/97
ggcgcaccggagucgcccgg

SEQ ID NO: 3164293 - RNA, 13 nt, Mycobacterium bovis subsp bovis AF2122/97
ggcgcaccggcgu

SEQ ID NO: 3164294 - RNA, 19 nt, Mycobacterium bovis subsp bovis AF2122/97
ggcgcaccggcgucggcgc

SEQ ID NO: 3164295 - RNA, 23 nt, Mycobacterium bovis subsp bovis AF2122/97
ggcgcaccuccugcgagugcggc

SEQ ID NO: 3164296 - RNA, 18 nt, Mycobacterium bovis subsp bovis AF2122/97
ggcgcaccugggcugccg

SEQ ID NO: 3164297 - RNA, 17 nt, Mycobacterium bovis subsp bovis AF2122/97
ggcgcacgaaaccgcag

SEQ ID NO: 3164298 - RNA, 20 nt, Mycobacterium bovis subsp bovis AF2122/97
ggcgcacgaaaccgcagcgc

SEQ ID NO: 3164299 - RNA, 22 nt, Mycobacterium bovis subsp bovis AF2122/97
ggcgcacgaaaccgcagcgcga

SEQ ID NO: 3164300 - RNA, 22 nt, Mycobacterium bovis subsp bovis AF2122/97
ggcgcacgauggugugcagcaa

SEQ ID NO: 3164301 - RNA, 14 nt, Mycobacterium bovis subsp bovis AF2122/97
ggcgcacgcccgca

SEQ ID NO: 3164302 - RNA, 19 nt, Mycobacterium bovis subsp bovis AF2122/97
ggcgcacgguccacggugg

SEQ ID NO: 3164303 - RNA, 16 nt, Mycobacterium bovis subsp bovis AF2122/97
ggcgcagagucaacgu

SEQ ID NO: 3164304 - RNA, 16 nt, Mycobacterium bovis subsp bovis AF2122/97
ggcgcagaucgugcac

SEQ ID NO: 3164305 - RNA, 12 nt, Mycobacterium bovis subsp bovis AF2122/97
ggcgcagcaccg

SEQ ID NO: 3164306 - RNA, 11 nt, Mycobacterium bovis subsp bovis AF2122/97
ggcgcagccgg

SEQ ID NO: 3164307 - RNA, 20 nt, Mycobacterium bovis subsp bovis AF2122/97
ggcgcagccugccgaugacg

SEQ ID NO: 3164308 - RNA, 12 nt, Mycobacterium bovis subsp bovis AF2122/97
ggcgcagcgcca

SEQ ID NO: 3164309 - RNA, 13 nt, Mycobacterium bovis subsp bovis AF2122/97
ggcgcagcgccag

SEQ ID NO: 3164310 - RNA, 14 nt, Mycobacterium bovis subsp bovis AF2122/97
ggcgcagcgccagc

SEQ ID NO: 3164311 - RNA, 19 nt, Mycobacterium bovis subsp bovis AF2122/97
ggcgcagcgugagugcagc

SEQ ID NO: 3164312 - RNA, 17 nt, Mycobacterium bovis subsp bovis AF2122/97
ggcgcagcuaacccgcc

SEQ ID NO: 3164313 - RNA, 16 nt, Mycobacterium bovis subsp bovis AF2122/97
ggcgcagcucaccgac

SEQ ID NO: 3164314 - RNA, 23 nt, Mycobacterium bovis subsp bovis AF2122/97
ggcgcagcucaccgacggagauc

SEQ ID NO: 3164315 - RNA, 16 nt, Mycobacterium bovis subsp bovis AF2122/97
ggcgcagcugggugcg

SEQ ID NO: 3164316 - RNA, 19 nt, Mycobacterium bovis subsp bovis AF2122/97
ggcgcagcugggugcgcca

SEQ ID NO: 3164317 - RNA, 15 nt, Mycobacterium bovis subsp bovis AF2122/97
ggcgcagcugguagc

SEQ ID NO: 3164318 - RNA, 20 nt, Mycobacterium bovis subsp bovis AF2122/97
ggcgcagcugguagcgcacc

SEQ ID NO: 3164319 - RNA, 20 nt, Mycobacterium bovis subsp bovis AF2122/97
ggcgcagggacugugggggc

SEQ ID NO: 3164320 - RNA, 21 nt, Mycobacterium bovis subsp bovis AF2122/97
ggcgcagggacugugggggcg

SEQ ID NO: 3164321 - RNA, 23 nt, Mycobacterium bovis subsp bovis AF2122/97
ggcgcagguagcggguugggacc

SEQ ID NO: 3164322 - RNA, 12 nt, Mycobacterium bovis subsp bovis AF2122/97
ggcgcagguaua

SEQ ID NO: 3164323 - RNA, 18 nt, Mycobacterium bovis subsp bovis AF2122/97
ggcgcagguucucggugc

SEQ ID NO: 3164324 - RNA, 20 nt, Mycobacterium bovis subsp bovis AF2122/97
ggcgcagguucucggugccg

SEQ ID NO: 3164325 - RNA, 16 nt, Mycobacterium bovis subsp bovis AF2122/97
ggcgcaguagaugccg

SEQ ID NO: 3164326 - RNA, 16 nt, Mycobacterium bovis subsp bovis AF2122/97
ggcgcaguagccgacc

SEQ ID NO: 3164327 - RNA, 17 nt, Mycobacterium bovis subsp bovis AF2122/97
ggcgcauaccggcgucg

SEQ ID NO: 3164328 - RNA, 18 nt, Mycobacterium bovis subsp bovis AF2122/97
ggcgcauaccggcgucgu

SEQ ID NO: 3164329 - RNA, 14 nt, Mycobacterium bovis subsp bovis AF2122/97
ggcgcauaggcggc

SEQ ID NO: 3164330 - RNA, 18 nt, Mycobacterium bovis subsp bovis AF2122/97
ggcgcauaggcggccauc

SEQ ID NO: 3164331 - RNA, 16 nt, Mycobacterium bovis subsp bovis AF2122/97
ggcgcauagggccacc

SEQ ID NO: 3164332 - RNA, 17 nt, Mycobacterium bovis subsp bovis AF2122/97
ggcgcauagggccaccg

SEQ ID NO: 3164333 - RNA, 13 nt, Mycobacterium bovis subsp bovis AF2122/97
ggcgcaucaccac

SEQ ID NO: 3164334 - RNA, 15 nt, Mycobacterium bovis subsp bovis AF2122/97
ggcgcauuccggcgc

SEQ ID NO: 3164335 - RNA, 21 nt, Mycobacterium bovis subsp bovis AF2122/97
ggcgcauuccggcgccaggau

SEQ ID NO: 3164336 - RNA, 22 nt, Mycobacterium bovis subsp bovis AF2122/97
ggcgccaacgcaacggugauca

SEQ ID NO: 3164337 - RNA, 20 nt, Mycobacterium bovis subsp bovis AF2122/97
ggcgccaauucagcggcaac

SEQ ID NO: 3164338 - RNA, 16 nt, Mycobacterium bovis subsp bovis AF2122/97
ggcgccgacaccggcu

SEQ ID NO: 3164339 - RNA, 19 nt, Mycobacterium bovis subsp bovis AF2122/97
ggcgccgaccacauuccgc

SEQ ID NO: 3164340 - RNA, 21 nt, Mycobacterium bovis subsp bovis AF2122/97
ggcgccgacgacuccggcaag

SEQ ID NO: 3164341 - RNA, 19 nt, Mycobacterium bovis subsp bovis AF2122/97
ggcgccgagcagcccgcgg

SEQ ID NO: 3164342 - RNA, 13 nt, Mycobacterium bovis subsp bovis AF2122/97
ggcgccgaggucg

SEQ ID NO: 3164343 - RNA, 17 nt, Mycobacterium bovis subsp bovis AF2122/97
ggcgccgauaccggcgg

SEQ ID NO: 3164344 - RNA, 14 nt, Mycobacterium bovis subsp bovis AF2122/97
ggcgccgaugaccg

SEQ ID NO: 3164345 - RNA, 19 nt, Mycobacterium bovis subsp bovis AF2122/97
ggcgccgaugaccgcaacc

SEQ ID NO: 3164346 - RNA, 21 nt, Mycobacterium bovis subsp bovis AF2122/97
ggcgccgaugaccgcaaccgg

SEQ ID NO: 3164347 - RNA, 19 nt, Mycobacterium bovis subsp bovis AF2122/97
ggcgccgaugccggccaag

SEQ ID NO: 3164348 - RNA, 21 nt, Mycobacterium bovis subsp bovis AF2122/97
ggcgccgauuuugggaucgug

SEQ ID NO: 3164349 - RNA, 20 nt, Mycobacterium bovis subsp bovis AF2122/97
ggcgccgcaaucagacggcg

SEQ ID NO: 3164350 - RNA, 21 nt, Mycobacterium bovis subsp bovis AF2122/97
ggcgccgcaaucagacggcga

SEQ ID NO: 3164351 - RNA, 24 nt, Mycobacterium bovis subsp bovis AF2122/97
ggcgccgcaccaagcagcgaccag

SEQ ID NO: 3164352 - RNA, 14 nt, Mycobacterium bovis subsp bovis AF2122/97
ggcgccgcacccac

SEQ ID NO: 3164353 - RNA, 22 nt, Mycobacterium bovis subsp bovis AF2122/97
ggcgccgcagaucaccgccagc

SEQ ID NO: 3164354 - RNA, 13 nt, Mycobacterium bovis subsp bovis AF2122/97
ggcgccgcagggc

SEQ ID NO: 3164355 - RNA, 17 nt, Mycobacterium bovis subsp bovis AF2122/97
ggcgccgcagggccgcg

SEQ ID NO: 3164356 - RNA, 17 nt, Mycobacterium bovis subsp bovis AF2122/97
ggcgccgcauaccagua

SEQ ID NO: 3164357 - RNA, 15 nt, Mycobacterium bovis subsp bovis AF2122/97
ggcgccgccaagggc

SEQ ID NO: 3164358 - RNA, 21 nt, Mycobacterium bovis subsp bovis AF2122/97
ggcgccgccacugccggcagc

SEQ ID NO: 3164359 - RNA, 22 nt, Mycobacterium bovis subsp bovis AF2122/97
ggcgccgccacugccggcagcg

SEQ ID NO: 3164360 - RNA, 23 nt, Mycobacterium bovis subsp bovis AF2122/97
ggcgccgccacugccggcagcgc

SEQ ID NO: 3164361 - RNA, 19 nt, Mycobacterium bovis subsp bovis AF2122/97
ggcgccgccagcaccaccg

SEQ ID NO: 3164362 - RNA, 21 nt, Mycobacterium bovis subsp bovis AF2122/97
ggcgccgccagcaccaccggc

SEQ ID NO: 3164363 - RNA, 16 nt, Mycobacterium bovis subsp bovis AF2122/97
ggcgccgccaucaaca

SEQ ID NO: 3164364 - RNA, 12 nt, Mycobacterium bovis subsp bovis AF2122/97
ggcgccgccauu

SEQ ID NO: 3164365 - RNA, 14 nt, Mycobacterium bovis subsp bovis AF2122/97
ggcgccgcccagca

SEQ ID NO: 3164366 - RNA, 15 nt, Mycobacterium bovis subsp bovis AF2122/97
ggcgccgcccgcgcc

SEQ ID NO: 3164367 - RNA, 19 nt, Mycobacterium bovis subsp bovis AF2122/97
ggcgccgcccgcgccgccg

SEQ ID NO: 3164368 - RNA, 19 nt, Mycobacterium bovis subsp bovis AF2122/97
ggcgccgcccuugccgccg

SEQ ID NO: 3164369 - RNA, 14 nt, Mycobacterium bovis subsp bovis AF2122/97
ggcgccgccgaucc

SEQ ID NO: 3164370 - RNA, 15 nt, Mycobacterium bovis subsp bovis AF2122/97
ggcgccgccggcacc

SEQ ID NO: 3164371 - RNA, 18 nt, Mycobacterium bovis subsp bovis AF2122/97
ggcgccgccggcacccgc

SEQ ID NO: 3164372 - RNA, 19 nt, Mycobacterium bovis subsp bovis AF2122/97
ggcgccgccggcaccgccg

SEQ ID NO: 3164373 - RNA, 17 nt, Mycobacterium bovis subsp bovis AF2122/97
ggcgccgccggcaccgg

SEQ ID NO: 3164374 - RNA, 15 nt, Mycobacterium bovis subsp bovis AF2122/97
ggcgccgccggcgcc

SEQ ID NO: 3164375 - RNA, 14 nt, Mycobacterium bovis subsp bovis AF2122/97
ggcgccgccggugc

SEQ ID NO: 3164376 - RNA, 19 nt, Mycobacterium bovis subsp bovis AF2122/97
ggcgccgccggugccaccg

SEQ ID NO: 3164377 - RNA, 22 nt, Mycobacterium bovis subsp bovis AF2122/97
ggcgccgccggugccaccgacg

SEQ ID NO: 3164378 - RNA, 15 nt, Mycobacterium bovis subsp bovis AF2122/97
ggcgccgccgucgcc

SEQ ID NO: 3164379 - RNA, 19 nt, Mycobacterium bovis subsp bovis AF2122/97
ggcgccgccgugcggguuc

SEQ ID NO: 3164380 - RNA, 22 nt, Mycobacterium bovis subsp bovis AF2122/97
ggcgccgccguucccgccggcg

SEQ ID NO: 3164381 - RNA, 23 nt, Mycobacterium bovis subsp bovis AF2122/97
ggcgccgccguucccgccggcgc

SEQ ID NO: 3164382 - RNA, 16 nt, Mycobacterium bovis subsp bovis AF2122/97
ggcgccgccguugccg

SEQ ID NO: 3164383 - RNA, 18 nt, Mycobacterium bovis subsp bovis AF2122/97
ggcgccgccguugccgcc

SEQ ID NO: 3164384 - RNA, 18 nt, Mycobacterium bovis subsp bovis AF2122/97
ggcgccgccuggacgccg

SEQ ID NO: 3164385 - RNA, 22 nt, Mycobacterium bovis subsp bovis AF2122/97
ggcgccgccuggacgccgccgg

SEQ ID NO: 3164386 - RNA, 19 nt, Mycobacterium bovis subsp bovis AF2122/97
ggcgccgcgccgauuccac

SEQ ID NO: 3164387 - RNA, 14 nt, Mycobacterium bovis subsp bovis AF2122/97
ggcgccgcgcucga

SEQ ID NO: 3164388 - RNA, 16 nt, Mycobacterium bovis subsp bovis AF2122/97
ggcgccgcgcucgacg

SEQ ID NO: 3164389 - RNA, 15 nt, Mycobacterium bovis subsp bovis AF2122/97
ggcgccgcggcuggg

SEQ ID NO: 3164390 - RNA, 17 nt, Mycobacterium bovis subsp bovis AF2122/97
ggcgccgcggcuggggg

SEQ ID NO: 3164391 - RNA, 23 nt, Mycobacterium bovis subsp bovis AF2122/97
ggcgccgcuaggugacgccgcca

SEQ ID NO: 3164392 - RNA, 18 nt, Mycobacterium bovis subsp bovis AF2122/97
ggcgccggaacgagcggc

SEQ ID NO: 3164393 - RNA, 17 nt, Mycobacterium bovis subsp bovis AF2122/97
ggcgccggagccgccca

SEQ ID NO: 3164394 - RNA, 16 nt, Mycobacterium bovis subsp bovis AF2122/97
ggcgccggaggcggcg

SEQ ID NO: 3164395 - RNA, 17 nt, Mycobacterium bovis subsp bovis AF2122/97
ggcgccggcaucgguca

SEQ ID NO: 3164396 - RNA, 22 nt, Mycobacterium bovis subsp bovis AF2122/97
ggcgccggcaucuccaccgucg

SEQ ID NO: 3164397 - RNA, 14 nt, Mycobacterium bovis subsp bovis AF2122/97
ggcgccggccagcc

SEQ ID NO: 3164398 - RNA, 15 nt, Mycobacterium bovis subsp bovis AF2122/97
ggcgccggccagcca

SEQ ID NO: 3164399 - RNA, 18 nt, Mycobacterium bovis subsp bovis AF2122/97
ggcgccggccagccagcg

SEQ ID NO: 3164400 - RNA, 11 nt, Mycobacterium bovis subsp bovis AF2122/97
ggcgccggccg

SEQ ID NO: 3164401 - RNA, 14 nt, Mycobacterium bovis subsp bovis AF2122/97
ggcgccggccggca

SEQ ID NO: 3164402 - RNA, 15 nt, Mycobacterium bovis subsp bovis AF2122/97
ggcgccggccggcag

SEQ ID NO: 3164403 - RNA, 15 nt, Mycobacterium bovis subsp bovis AF2122/97
ggcgccggcgcccgg

SEQ ID NO: 3164404 - RNA, 18 nt, Mycobacterium bovis subsp bovis AF2122/97
ggcgccggcgcgucggca

SEQ ID NO: 3164405 - RNA, 19 nt, Mycobacterium bovis subsp bovis AF2122/97
ggcgccggcgcugcugcca

SEQ ID NO: 3164406 - RNA, 15 nt, Mycobacterium bovis subsp bovis AF2122/97
ggcgccggcguccgg

SEQ ID NO: 3164407 - RNA, 18 nt, Mycobacterium bovis subsp bovis AF2122/97
ggcgccggcgucggcgcc

SEQ ID NO: 3164408 - RNA, 22 nt, Mycobacterium bovis subsp bovis AF2122/97
ggcgccggcgucggcgcccagc

SEQ ID NO: 3164409 - RNA, 20 nt, Mycobacterium bovis subsp bovis AF2122/97
ggcgccggggaccacgguga

SEQ ID NO: 3164410 - RNA, 22 nt, Mycobacterium bovis subsp bovis AF2122/97
ggcgccggggauaccggucagc

SEQ ID NO: 3164411 - RNA, 15 nt, Mycobacterium bovis subsp bovis AF2122/97
ggcgccggggccgcc

SEQ ID NO: 3164412 - RNA, 16 nt, Mycobacterium bovis subsp bovis AF2122/97
ggcgccggggccgccg

SEQ ID NO: 3164413 - RNA, 17 nt, Mycobacterium bovis subsp bovis AF2122/97
ggcgccggggccgccga

SEQ ID NO: 3164414 - RNA, 12 nt, Mycobacterium bovis subsp bovis AF2122/97
ggcgccgggggc

SEQ ID NO: 3164415 - RNA, 19 nt, Mycobacterium bovis subsp bovis AF2122/97
ggcgccggggggcugcugc

SEQ ID NO: 3164416 - RNA, 12 nt, Mycobacterium bovis subsp bovis AF2122/97
ggcgccggguca

SEQ ID NO: 3164417 - RNA, 16 nt, Mycobacterium bovis subsp bovis AF2122/97
ggcgccggugccgccg

SEQ ID NO: 3164418 - RNA, 17 nt, Mycobacterium bovis subsp bovis AF2122/97
ggcgccggugccgccgg

SEQ ID NO: 3164419 - RNA, 12 nt, Mycobacterium bovis subsp bovis AF2122/97
ggcgccgguggu

SEQ ID NO: 3164420 - RNA, 23 nt, Mycobacterium bovis subsp bovis AF2122/97
ggcgccggugguaacggcggcca

SEQ ID NO: 3164421 - RNA, 23 nt, Mycobacterium bovis subsp bovis AF2122/97
ggcgccgguguuuccgaaacccg

SEQ ID NO: 3164422 - RNA, 16 nt, Mycobacterium bovis subsp bovis AF2122/97
ggcgccgguuacccgg

SEQ ID NO: 3164423 - RNA, 17 nt, Mycobacterium bovis subsp bovis AF2122/97
ggcgccgguuucgaggc

SEQ ID NO: 3164424 - RNA, 21 nt, Mycobacterium bovis subsp bovis AF2122/97
ggcgcgcugcacggaaucgca

SEQ ID NO: 3164425 - RNA, 16 nt, Mycobacterium bovis subsp bovis AF2122/97
ggcgcgcugcccacgg

SEQ ID NO: 3164426 - RNA, 12 nt, Mycobacterium bovis subsp bovis AF2122/97
ggcgcgcuggcg

SEQ ID NO: 3164427 - RNA, 19 nt, Mycobacterium bovis subsp bovis AF2122/97
ggcgcgcuggcgggcggcg

SEQ ID NO: 3164428 - RNA, 19 nt, Mycobacterium bovis subsp bovis AF2122/97
ggcgcggaacgcgucgccg

SEQ ID NO: 3164429 - RNA, 18 nt, Mycobacterium bovis subsp bovis AF2122/97
ggcgcggacccgccguga

SEQ ID NO: 3164430 - RNA, 23 nt, Mycobacterium bovis subsp bovis AF2122/97
ggcgcggagagccugcucgcagc

SEQ ID NO: 3164431 - RNA, 22 nt, Mycobacterium bovis subsp bovis AF2122/97
ggcgcggagugcccagggccga

SEQ ID NO: 3164432 - RNA, 18 nt, Mycobacterium bovis subsp bovis AF2122/97
ggcgcggcacccggucgg

SEQ ID NO: 3164433 - RNA, 20 nt, Mycobacterium bovis subsp bovis AF2122/97
ggcgcggcacccggucggcc

SEQ ID NO: 3164434 - RNA, 15 nt, Mycobacterium bovis subsp bovis AF2122/97
ggcgcggcccaccuc

SEQ ID NO: 3164435 - RNA, 14 nt, Mycobacterium bovis subsp bovis AF2122/97
ggcgcggccgcagc

SEQ ID NO: 3164436 - RNA, 19 nt, Mycobacterium bovis subsp bovis AF2122/97
ggcgcggccgcagccagca

SEQ ID NO: 3164437 - RNA, 14 nt, Mycobacterium bovis subsp bovis AF2122/97
ggcgcggccgugaa

SEQ ID NO: 3164438 - RNA, 20 nt, Mycobacterium bovis subsp bovis AF2122/97
ggcgcggccgugaacggcgc

SEQ ID NO: 3164439 - RNA, 21 nt, Mycobacterium bovis subsp bovis AF2122/97
ggcgcggccgugaacggcgcg

SEQ ID NO: 3164440 - RNA, 20 nt, Mycobacterium bovis subsp bovis AF2122/97
ggcgcggcggaccguccgac

SEQ ID NO: 3164441 - RNA, 15 nt, Mycobacterium bovis subsp bovis AF2122/97
ggcgcgggccaccac

SEQ ID NO: 3164442 - RNA, 17 nt, Mycobacterium bovis subsp bovis AF2122/97
ggcgcgggccaccacgc

SEQ ID NO: 3164443 - RNA, 12 nt, Mycobacterium bovis subsp bovis AF2122/97
ggcgcgggccgg

SEQ ID NO: 3164444 - RNA, 13 nt, Mycobacterium bovis subsp bovis AF2122/97
ggcgcgggccggc

SEQ ID NO: 3164445 - RNA, 14 nt, Mycobacterium bovis subsp bovis AF2122/97
ggcgcgggccggcg

SEQ ID NO: 3164446 - RNA, 15 nt, Mycobacterium bovis subsp bovis AF2122/97
ggcgcgggccggcga

SEQ ID NO: 3164447 - RNA, 15 nt, Mycobacterium bovis subsp bovis AF2122/97
ggcgcgggcgacguc

SEQ ID NO: 3164448 - RNA, 15 nt, Mycobacterium bovis subsp bovis AF2122/97
ggcgcgggcgccggg

SEQ ID NO: 3164449 - RNA, 14 nt, Mycobacterium bovis subsp bovis AF2122/97
ggcgcggggccgcc

SEQ ID NO: 3164450 - RNA, 15 nt, Mycobacterium bovis subsp bovis AF2122/97
ggcgcggggccgccg

SEQ ID NO: 3164451 - RNA, 23 nt, Mycobacterium bovis subsp bovis AF2122/97
ggcgcggggcggccugcccgccg

SEQ ID NO: 3164452 - RNA, 15 nt, Mycobacterium bovis subsp bovis AF2122/97
ggcgcgggucggcga

SEQ ID NO: 3164453 - RNA, 16 nt, Mycobacterium bovis subsp bovis AF2122/97
ggcgcgggucggcgac

SEQ ID NO: 3164454 - RNA, 17 nt, Mycobacterium bovis subsp bovis AF2122/97
ggcgcgggucggcgacc

SEQ ID NO: 3164455 - RNA, 13 nt, Mycobacterium bovis subsp bovis AF2122/97
ggcgcgggugacc

SEQ ID NO: 3164456 - RNA, 19 nt, Mycobacterium bovis subsp bovis AF2122/97
ggcgcgggugaccaggcgg

SEQ ID NO: 3164457 - RNA, 16 nt, Mycobacterium bovis subsp bovis AF2122/97
ggcgcgggugcggauc

SEQ ID NO: 3164458 - RNA, 17 nt, Mycobacterium bovis subsp bovis AF2122/97
ggcgcgguaccgcucgg

SEQ ID NO: 3164459 - RNA, 16 nt, Mycobacterium bovis subsp bovis AF2122/97
ggcgcgguaccggugu

SEQ ID NO: 3164460 - RNA, 20 nt, Mycobacterium bovis subsp bovis AF2122/97
ggcgcggucaccgcgucacc

SEQ ID NO: 3164461 - RNA, 16 nt, Mycobacterium bovis subsp bovis AF2122/97
ggcgcggucgaagcug

SEQ ID NO: 3164462 - RNA, 20 nt, Mycobacterium bovis subsp bovis AF2122/97
ggcgcggucgaccugagccc

SEQ ID NO: 3164463 - RNA, 15 nt, Mycobacterium bovis subsp bovis AF2122/97
ggcgcggugccggcg

SEQ ID NO: 3164464 - RNA, 19 nt, Mycobacterium bovis subsp bovis AF2122/97
ggcgcggugcgcucacugg

SEQ ID NO: 3164465 - RNA, 20 nt, Mycobacterium bovis subsp bovis AF2122/97
ggcgcgguuucggcgucacc

SEQ ID NO: 3164466 - RNA, 23 nt, Mycobacterium bovis subsp bovis AF2122/97
ggcgcgguuucggcgucaccgug

SEQ ID NO: 3164467 - RNA, 22 nt, Mycobacterium bovis subsp bovis AF2122/97
ggcgcgucauggcgaguacggc

SEQ ID NO: 3164468 - RNA, 17 nt, Mycobacterium bovis subsp bovis AF2122/97
ggcgcguccgggcucgc

SEQ ID NO: 3164469 - RNA, 17 nt, Mycobacterium bovis subsp bovis AF2122/97
ggcgcguccucgccgca

SEQ ID NO: 3164470 - RNA, 22 nt, Mycobacterium bovis subsp bovis AF2122/97
ggcgcguccucgccgcacgccg

SEQ ID NO: 3164471 - RNA, 13 nt, Mycobacterium bovis subsp bovis AF2122/97
ggcgcgucgacaa

SEQ ID NO: 3164472 - RNA, 14 nt, Mycobacterium bovis subsp bovis AF2122/97
ggcgcgucggcacc

SEQ ID NO: 3164473 - RNA, 22 nt, Mycobacterium bovis subsp bovis AF2122/97
ggcgcgucggcguuggggcucg

SEQ ID NO: 3164474 - RNA, 18 nt, Mycobacterium bovis subsp bovis AF2122/97
ggcgcgugcagcggcgcc

SEQ ID NO: 3164475 - RNA, 20 nt, Mycobacterium bovis subsp bovis AF2122/97
ggcgcguucgucgucgcuga

SEQ ID NO: 3164476 - RNA, 18 nt, Mycobacterium bovis subsp bovis AF2122/97
ggcgcguugcaccauucg

SEQ ID NO: 3164477 - RNA, 13 nt, Mycobacterium bovis subsp bovis AF2122/97
ggcgcuaccagcc

SEQ ID NO: 3164478 - RNA, 21 nt, Mycobacterium bovis subsp bovis AF2122/97
ggcgcuaccagccauagugcg

SEQ ID NO: 3164479 - RNA, 24 nt, Mycobacterium bovis subsp bovis AF2122/97
ggcgcuagccagggaucagccgug

SEQ ID NO: 3164480 - RNA, 13 nt, Mycobacterium bovis subsp bovis AF2122/97
ggcgcuagcgccg

SEQ ID NO: 3164481 - RNA, 16 nt, Mycobacterium bovis subsp bovis AF2122/97
ggcgcuagcgccgcgc

SEQ ID NO: 3164482 - RNA, 18 nt, Mycobacterium bovis subsp bovis AF2122/97
ggcgcuagcgccgcgcuu

SEQ ID NO: 3164483 - RNA, 14 nt, Mycobacterium bovis subsp bovis AF2122/97
ggcgcuagcugcug

SEQ ID NO: 3164484 - RNA, 15 nt, Mycobacterium bovis subsp bovis AF2122/97
ggcgcuaggaacgcc

SEQ ID NO: 3164485 - RNA, 19 nt, Mycobacterium bovis subsp bovis AF2122/97
ggcgcucacaauggcucug

SEQ ID NO: 3164486 - RNA, 18 nt, Mycobacterium bovis subsp bovis AF2122/97
ggcgcucacccgccgcgg

SEQ ID NO: 3164487 - RNA, 12 nt, Mycobacterium bovis subsp bovis AF2122/97
ggcgcucagcgc

SEQ ID NO: 3164488 - RNA, 19 nt, Mycobacterium bovis subsp bovis AF2122/97
ggcgcucagcgcggccacg

SEQ ID NO: 3164489 - RNA, 21 nt, Mycobacterium bovis subsp bovis AF2122/97
ggcgcucauaggccggcgguc

SEQ ID NO: 3164490 - RNA, 13 nt, Mycobacterium bovis subsp bovis AF2122/97
ggcgcucaucacc

SEQ ID NO: 3164491 - RNA, 22 nt, Mycobacterium bovis subsp bovis AF2122/97
ggcgcucaugggcgccaucccg

SEQ ID NO: 3164492 - RNA, 13 nt, Mycobacterium bovis subsp bovis AF2122/97
ggcgcuccuucag

SEQ ID NO: 3164493 - RNA, 13 nt, Mycobacterium bovis subsp bovis AF2122/97
ggcgcucgcgcgc

SEQ ID NO: 3164494 - RNA, 16 nt, Mycobacterium bovis subsp bovis AF2122/97
ggcgcucgcgcgcugg

SEQ ID NO: 3164495 - RNA, 17 nt, Mycobacterium bovis subsp bovis AF2122/97
ggcgcucgcgcgcuggg

SEQ ID NO: 3164496 - RNA, 18 nt, Mycobacterium bovis subsp bovis AF2122/97
ggcgcucgcgcgcugggc

SEQ ID NO: 3164497 - RNA, 23 nt, Mycobacterium bovis subsp bovis AF2122/97
ggcgcucgcgcgcugggcgcgcu

SEQ ID NO: 3164498 - RNA, 20 nt, Mycobacterium bovis subsp bovis AF2122/97
ggcgcucgcggcggcgcugg

SEQ ID NO: 3164499 - RNA, 23 nt, Mycobacterium bovis subsp bovis AF2122/97
ggcgcucgcggcggcgcuggcgg

SEQ ID NO: 3164500 - RNA, 14 nt, Mycobacterium bovis subsp bovis AF2122/97
ggcgcucggcgagc

SEQ ID NO: 3164501 - RNA, 17 nt, Mycobacterium bovis subsp bovis AF2122/97
ggcgcucggcgagcaac

SEQ ID NO: 3164502 - RNA, 17 nt, Mycobacterium bovis subsp bovis AF2122/97
ggcgcucgucgcggccc

SEQ ID NO: 3164503 - RNA, 22 nt, Mycobacterium bovis subsp bovis AF2122/97
ggcgcucucguguaucgagcgg

SEQ ID NO: 3164504 - RNA, 20 nt, Mycobacterium bovis subsp bovis AF2122/97
ggcgcugaacgcgagcaaca

SEQ ID NO: 3164505 - RNA, 15 nt, Mycobacterium bovis subsp bovis AF2122/97
ggcgcugagggugcu

SEQ ID NO: 3164506 - RNA, 11 nt, Mycobacterium bovis subsp bovis AF2122/97
ggcgcugaucg

SEQ ID NO: 3164507 - RNA, 19 nt, Mycobacterium bovis subsp bovis AF2122/97
ggcgcugaucgcgcgcacc

SEQ ID NO: 3164508 - RNA, 18 nt, Mycobacterium bovis subsp bovis AF2122/97
ggcgcugaucggcagggu

SEQ ID NO: 3164509 - RNA, 20 nt, Mycobacterium bovis subsp bovis AF2122/97
ggcgcugaugcgcugggcca

SEQ ID NO: 3164510 - RNA, 17 nt, Mycobacterium bovis subsp bovis AF2122/97
ggcgcugaugcuggcca

SEQ ID NO: 3164511 - RNA, 19 nt, Mycobacterium bovis subsp bovis AF2122/97
ggcggcaacccugcccggc

SEQ ID NO: 3164512 - RNA, 18 nt, Mycobacterium bovis subsp bovis AF2122/97
ggcggcaaccgccgccac

SEQ ID NO: 3164513 - RNA, 22 nt, Mycobacterium bovis subsp bovis AF2122/97
ggcggcaaccucaugcacgccg

SEQ ID NO: 3164514 - RNA, 15 nt, Mycobacterium bovis subsp bovis AF2122/97
ggcggcaacggcggc

SEQ ID NO: 3164515 - RNA, 17 nt, Mycobacterium bovis subsp bovis AF2122/97
ggcggcaacggcggcaa

SEQ ID NO: 3164516 - RNA, 18 nt, Mycobacterium bovis subsp bovis AF2122/97
ggcggcaacggcggcauc

SEQ ID NO: 3164517 - RNA, 18 nt, Mycobacterium bovis subsp bovis AF2122/97
ggcggcaacggcggcgac

SEQ ID NO: 3164518 - RNA, 16 nt, Mycobacterium bovis subsp bovis AF2122/97
ggcggcaagcucgacg

SEQ ID NO: 3164519 - RNA, 17 nt, Mycobacterium bovis subsp bovis AF2122/97
ggcggcaagcucgacga

SEQ ID NO: 3164520 - RNA, 16 nt, Mycobacterium bovis subsp bovis AF2122/97
ggcggcaagggcggca

SEQ ID NO: 3164521 - RNA, 14 nt, Mycobacterium bovis subsp bovis AF2122/97
ggcggcaagggugg

SEQ ID NO: 3164522 - RNA, 22 nt, Mycobacterium bovis subsp bovis AF2122/97
ggcggcaaggguggggccggcg

SEQ ID NO: 3164523 - RNA, 14 nt, Mycobacterium bovis subsp bovis AF2122/97
ggcggcacgcucgc

SEQ ID NO: 3164524 - RNA, 15 nt, Mycobacterium bovis subsp bovis AF2122/97
ggcggcacgcucgcg

SEQ ID NO: 3164525 - RNA, 16 nt, Mycobacterium bovis subsp bovis AF2122/97
ggcggcacgcucgcgc

SEQ ID NO: 3164526 - RNA, 19 nt, Mycobacterium bovis subsp bovis AF2122/97
ggcggcacgcucgcgcacc

SEQ ID NO: 3164527 - RNA, 16 nt, Mycobacterium bovis subsp bovis AF2122/97
ggcggcacgggcggcc

SEQ ID NO: 3164528 - RNA, 16 nt, Mycobacterium bovis subsp bovis AF2122/97
ggcggcacuggauccg

SEQ ID NO: 3164529 - RNA, 21 nt, Mycobacterium bovis subsp bovis AF2122/97
ggcggcacuggauccgggagu

SEQ ID NO: 3164530 - RNA, 14 nt, Mycobacterium bovis subsp bovis AF2122/97
ggcggcagcgaggc

SEQ ID NO: 3164531 - RNA, 17 nt, Mycobacterium bovis subsp bovis AF2122/97
ggcggcagcggcguagc

SEQ ID NO: 3164532 - RNA, 18 nt, Mycobacterium bovis subsp bovis AF2122/97
ggcggcagcggugcuggu

SEQ ID NO: 3164533 - RNA, 22 nt, Mycobacterium bovis subsp bovis AF2122/97
ggcggcaggaaucgggucagca

SEQ ID NO: 3164534 - RNA, 15 nt, Mycobacterium bovis subsp bovis AF2122/97
ggcggcaggccggcc

SEQ ID NO: 3164535 - RNA, 18 nt, Mycobacterium bovis subsp bovis AF2122/97
ggcggcaggugcggcggc

SEQ ID NO: 3164536 - RNA, 16 nt, Mycobacterium bovis subsp bovis AF2122/97
ggcggcagguguuggu

SEQ ID NO: 3164537 - RNA, 17 nt, Mycobacterium bovis subsp bovis AF2122/97
ggcggcauacauccagg

SEQ ID NO: 3164538 - RNA, 14 nt, Mycobacterium bovis subsp bovis AF2122/97
ggcggcauccccag

SEQ ID NO: 3164539 - RNA, 23 nt, Mycobacterium bovis subsp bovis AF2122/97
ggcggcauccugcacgacccgcu

SEQ ID NO: 3164540 - RNA, 13 nt, Mycobacterium bovis subsp bovis AF2122/97
ggcggcaucgaua

SEQ ID NO: 3164541 - RNA, 13 nt, Mycobacterium bovis subsp bovis AF2122/97
ggcggcaucggcg

SEQ ID NO: 3164542 - RNA, 14 nt, Mycobacterium bovis subsp bovis AF2122/97
ggcggcaucggcgg

SEQ ID NO: 3164543 - RNA, 17 nt, Mycobacterium bovis subsp bovis AF2122/97
ggcggcaucucgcaccg

SEQ ID NO: 3164544 - RNA, 15 nt, Mycobacterium bovis subsp bovis AF2122/97
ggcggcaugcucacc

SEQ ID NO: 3164545 - RNA, 19 nt, Mycobacterium bovis subsp bovis AF2122/97
ggcggcauuggcggugccg

SEQ ID NO: 3164546 - RNA, 13 nt, Mycobacterium bovis subsp bovis AF2122/97
ggcggccaacgac

SEQ ID NO: 3164547 - RNA, 20 nt, Mycobacterium bovis subsp bovis AF2122/97
ggcggccaacgacgacccgu

SEQ ID NO: 3164548 - RNA, 13 nt, Mycobacterium bovis subsp bovis AF2122/97
ggcggccaacggc

SEQ ID NO: 3164549 - RNA, 18 nt, Mycobacterium bovis subsp bovis AF2122/97
ggcggccaaggucgaccc

SEQ ID NO: 3164550 - RNA, 13 nt, Mycobacterium bovis subsp bovis AF2122/97
ggcggccaccagc

SEQ ID NO: 3164551 - RNA, 11 nt, Mycobacterium bovis subsp bovis AF2122/97
ggcggccaccg

SEQ ID NO: 3164552 - RNA, 12 nt, Mycobacterium bovis subsp bovis AF2122/97
ggcggccaccgc

SEQ ID NO: 3164553 - RNA, 14 nt, Mycobacterium bovis subsp bovis AF2122/97
ggcggccaccgcac

SEQ ID NO: 3164554 - RNA, 22 nt, Mycobacterium bovis subsp bovis AF2122/97
ggcggccaccgcacgcuggcgg

SEQ ID NO: 3164555 - RNA, 16 nt, Mycobacterium bovis subsp bovis AF2122/97
ggcggccaccgucagc

SEQ ID NO: 3164556 - RNA, 17 nt, Mycobacterium bovis subsp bovis AF2122/97
ggcggccaccgucagcg

SEQ ID NO: 3164557 - RNA, 23 nt, Mycobacterium bovis subsp bovis AF2122/97
ggcggccaccgucagcgcgaccg

SEQ ID NO: 3164558 - RNA, 19 nt, Mycobacterium bovis subsp bovis AF2122/97
ggcggccaccucuucucgg

SEQ ID NO: 3164559 - RNA, 16 nt, Mycobacterium bovis subsp bovis AF2122/97
ggcggccacgccggcg

SEQ ID NO: 3164560 - RNA, 12 nt, Mycobacterium bovis subsp bovis AF2122/97
ggcggccacguc

SEQ ID NO: 3164561 - RNA, 12 nt, Mycobacterium bovis subsp bovis AF2122/97
ggcggccagcac

SEQ ID NO: 3164562 - RNA, 17 nt, Mycobacterium bovis subsp bovis AF2122/97
ggcggccagcacgucgu

SEQ ID NO: 3164563 - RNA, 13 nt, Mycobacterium bovis subsp bovis AF2122/97
ggcggccagcgca

SEQ ID NO: 3164564 - RNA, 19 nt, Mycobacterium bovis subsp bovis AF2122/97
ggcggccagcgcaccgccg

SEQ ID NO: 3164565 - RNA, 13 nt, Mycobacterium bovis subsp bovis AF2122/97
ggcggccagcgcg

SEQ ID NO: 3164566 - RNA, 14 nt, Mycobacterium bovis subsp bovis AF2122/97
ggcggccagcgcgc

SEQ ID NO: 3164567 - RNA, 14 nt, Mycobacterium bovis subsp bovis AF2122/97
ggcggccagcucgg

SEQ ID NO: 3164568 - RNA, 16 nt, Mycobacterium bovis subsp bovis AF2122/97
ggcggccagcucggcc

SEQ ID NO: 3164569 - RNA, 16 nt, Mycobacterium bovis subsp bovis AF2122/97
ggcggccagcugcagc

SEQ ID NO: 3164570 - RNA, 23 nt, Mycobacterium bovis subsp bovis AF2122/97
ggcggccaggugcaggcuucugg

SEQ ID NO: 3164571 - RNA, 23 nt, Mycobacterium bovis subsp bovis AF2122/97
ggcggccaguucggcggccgccg

SEQ ID NO: 3164572 - RNA, 13 nt, Mycobacterium bovis subsp bovis AF2122/97
ggcggccauggug

SEQ ID NO: 3164573 - RNA, 18 nt, Mycobacterium bovis subsp bovis AF2122/97
ggcggccaugucagcggc

SEQ ID NO: 3164574 - RNA, 19 nt, Mycobacterium bovis subsp bovis AF2122/97
ggcggccauucggucagcc

SEQ ID NO: 3164575 - RNA, 12 nt, Mycobacterium bovis subsp bovis AF2122/97
ggcggcccaccg

SEQ ID NO: 3164576 - RNA, 14 nt, Mycobacterium bovis subsp bovis AF2122/97
ggcggcccaccggc

SEQ ID NO: 3164577 - RNA, 20 nt, Mycobacterium bovis subsp bovis AF2122/97
ggcggcccaccggccacucg

SEQ ID NO: 3164578 - RNA, 22 nt, Mycobacterium bovis subsp bovis AF2122/97
ggcggccccaggggcaccagcg

SEQ ID NO: 3164579 - RNA, 14 nt, Mycobacterium bovis subsp bovis AF2122/97
ggcggccccgcgcc

SEQ ID NO: 3164580 - RNA, 21 nt, Mycobacterium bovis subsp bovis AF2122/97
ggcggccccgcgccaccuccc

SEQ ID NO: 3164581 - RNA, 12 nt, Mycobacterium bovis subsp bovis AF2122/97
ggcggccccggc

SEQ ID NO: 3164582 - RNA, 14 nt, Mycobacterium bovis subsp bovis AF2122/97
ggcggccccggcau

SEQ ID NO: 3164583 - RNA, 12 nt, Mycobacterium bovis subsp bovis AF2122/97
ggcggcccgaua

SEQ ID NO: 3164584 - RNA, 21 nt, Mycobacterium bovis subsp bovis AF2122/97
ggcggcccgcagcccgccggg

SEQ ID NO: 3164585 - RNA, 14 nt, Mycobacterium bovis subsp bovis AF2122/97
ggcggcccgcucgg

SEQ ID NO: 3164586 - RNA, 22 nt, Mycobacterium bovis subsp bovis AF2122/97
ggcggcccgcucgggguugcuc

SEQ ID NO: 3164587 - RNA, 19 nt, Mycobacterium bovis subsp bovis AF2122/97
ggcggcccguuugccgguu

SEQ ID NO: 3164588 - RNA, 19 nt, Mycobacterium bovis subsp bovis AF2122/97
ggcggcccuaaacaccgcg

SEQ ID NO: 3164589 - RNA, 12 nt, Mycobacterium bovis subsp bovis AF2122/97
ggcggccgagcg

SEQ ID NO: 3164590 - RNA, 16 nt, Mycobacterium bovis subsp bovis AF2122/97
ggcggccgagcgcacc

SEQ ID NO: 3164591 - RNA, 14 nt, Mycobacterium bovis subsp bovis AF2122/97
ggcggccgcagcgg

SEQ ID NO: 3164592 - RNA, 15 nt, Mycobacterium bovis subsp bovis AF2122/97
ggcggccgcagcggc

SEQ ID NO: 3164593 - RNA, 16 nt, Mycobacterium bovis subsp bovis AF2122/97
ggcggccgcagcggcc

SEQ ID NO: 3164594 - RNA, 20 nt, Mycobacterium bovis subsp bovis AF2122/97
ggcggccgccaucagccgcu

SEQ ID NO: 3164595 - RNA, 21 nt, Mycobacterium bovis subsp bovis AF2122/97
ggcggccgcgaccagcgccgc

SEQ ID NO: 3164596 - RNA, 12 nt, Mycobacterium bovis subsp bovis AF2122/97
ggcggccgcggc

SEQ ID NO: 3164597 - RNA, 17 nt, Mycobacterium bovis subsp bovis AF2122/97
ggcggccggcacgggcg

SEQ ID NO: 3164598 - RNA, 21 nt, Mycobacterium bovis subsp bovis AF2122/97
ggcggcguuaccaccgucacc

SEQ ID NO: 3164599 - RNA, 18 nt, Mycobacterium bovis subsp bovis AF2122/97
ggcggcguugagcuggcg

SEQ ID NO: 3164600 - RNA, 19 nt, Mycobacterium bovis subsp bovis AF2122/97
ggcggcguugagcuggcgg

SEQ ID NO: 3164601 - RNA, 19 nt, Mycobacterium bovis subsp bovis AF2122/97
ggcggcguugugcaaugug

SEQ ID NO: 3164602 - RNA, 16 nt, Mycobacterium bovis subsp bovis AF2122/97
ggcggcguuugaggca

SEQ ID NO: 3164603 - RNA, 18 nt, Mycobacterium bovis subsp bovis AF2122/97
ggcggcuaggcaccagcg

SEQ ID NO: 3164604 - RNA, 20 nt, Mycobacterium bovis subsp bovis AF2122/97
ggcggcucaaccucuggcgg

SEQ ID NO: 3164605 - RNA, 22 nt, Mycobacterium bovis subsp bovis AF2122/97
ggcggcucaaccucuggcggcg

SEQ ID NO: 3164606 - RNA, 12 nt, Mycobacterium bovis subsp bovis AF2122/97
ggcggcucacga

SEQ ID NO: 3164607 - RNA, 14 nt, Mycobacterium bovis subsp bovis AF2122/97
ggcggcuccaccgg

SEQ ID NO: 3164608 - RNA, 22 nt, Mycobacterium bovis subsp bovis AF2122/97
ggcggcuccaccgggcccgccg

SEQ ID NO: 3164609 - RNA, 14 nt, Mycobacterium bovis subsp bovis AF2122/97
ggcggcucgggugc

SEQ ID NO: 3164610 - RNA, 22 nt, Mycobacterium bovis subsp bovis AF2122/97
ggcggcucuagaucgccgagcg

SEQ ID NO: 3164611 - RNA, 15 nt, Mycobacterium bovis subsp bovis AF2122/97
ggcggcugaacggca

SEQ ID NO: 3164612 - RNA, 23 nt, Mycobacterium bovis subsp bovis AF2122/97
ggcggcugaacggcagccgaagc

SEQ ID NO: 3164613 - RNA, 12 nt, Mycobacterium bovis subsp bovis AF2122/97
ggcggcugcacg

SEQ ID NO: 3164614 - RNA, 18 nt, Mycobacterium bovis subsp bovis AF2122/97
ggcggcugcagccgaccg

SEQ ID NO: 3164615 - RNA, 14 nt, Mycobacterium bovis subsp bovis AF2122/97
ggcggcugccgguu

SEQ ID NO: 3164616 - RNA, 18 nt, Mycobacterium bovis subsp bovis AF2122/97
ggcggcuggcccgcaugc

SEQ ID NO: 3164617 - RNA, 12 nt, Mycobacterium bovis subsp bovis AF2122/97
ggcggcugucgg

SEQ ID NO: 3164618 - RNA, 17 nt, Mycobacterium bovis subsp bovis AF2122/97
ggcggcugucggccggg

SEQ ID NO: 3164619 - RNA, 20 nt, Mycobacterium bovis subsp bovis AF2122/97
ggcggcuguggucgcugcug

SEQ ID NO: 3164620 - RNA, 19 nt, Mycobacterium bovis subsp bovis AF2122/97
ggcggcuguugcggcggcg

SEQ ID NO: 3164621 - RNA, 22 nt, Mycobacterium bovis subsp bovis AF2122/97
ggcggcuucaaagaggauccgc

SEQ ID NO: 3164622 - RNA, 18 nt, Mycobacterium bovis subsp bovis AF2122/97
ggcggcuuccucgagcga

SEQ ID NO: 3164623 - RNA, 14 nt, Mycobacterium bovis subsp bovis AF2122/97
ggcggcuucgcccc

SEQ ID NO: 3164624 - RNA, 15 nt, Mycobacterium bovis subsp bovis AF2122/97
ggcggcuucgccgac

SEQ ID NO: 3164625 - RNA, 13 nt, Mycobacterium bovis subsp bovis AF2122/97
ggcggcuuggccg

SEQ ID NO: 3164626 - RNA, 21 nt, Mycobacterium bovis subsp bovis AF2122/97
ggcggcuuggccgccccggcc

SEQ ID NO: 3164627 - RNA, 17 nt, Mycobacterium bovis subsp bovis AF2122/97
ggcggcuuuggccgccg

SEQ ID NO: 3164628 - RNA, 15 nt, Mycobacterium bovis subsp bovis AF2122/97
ggcgggaacgaucga

SEQ ID NO: 3164629 - RNA, 16 nt, Mycobacterium bovis subsp bovis AF2122/97
ggcgggaacgggcaaa

SEQ ID NO: 3164630 - RNA, 18 nt, Mycobacterium bovis subsp bovis AF2122/97
ggcgggaacggugccgau

SEQ ID NO: 3164631 - RNA, 20 nt, Mycobacterium bovis subsp bovis AF2122/97
ggcgggaacggugccgaucg

SEQ ID NO: 3164632 - RNA, 17 nt, Mycobacterium bovis subsp bovis AF2122/97
ggcgggacaaccgggcg

SEQ ID NO: 3164633 - RNA, 16 nt, Mycobacterium bovis subsp bovis AF2122/97
ggcgggagucgucgag

SEQ ID NO: 3164634 - RNA, 15 nt, Mycobacterium bovis subsp bovis AF2122/97
ggcgggaucgagagc

SEQ ID NO: 3164635 - RNA, 21 nt, Mycobacterium bovis subsp bovis AF2122/97
ggcgggaucgagagccgaccg

SEQ ID NO: 3164636 - RNA, 16 nt, Mycobacterium bovis subsp bovis AF2122/97
ggcgggaugcgcgccc

SEQ ID NO: 3164637 - RNA, 21 nt, Mycobacterium bovis subsp bovis AF2122/97
ggcgggaugcgcgcccgacga

SEQ ID NO: 3164638 - RNA, 16 nt, Mycobacterium bovis subsp bovis AF2122/97
ggcgggauggccgccg

SEQ ID NO: 3164639 - RNA, 21 nt, Mycobacterium bovis subsp bovis AF2122/97
ggcgggcaaucaccgccggcg

SEQ ID NO: 3164640 - RNA, 22 nt, Mycobacterium bovis subsp bovis AF2122/97
ggcgggcaaucaccgccggcgg

SEQ ID NO: 3164641 - RNA, 19 nt, Mycobacterium bovis subsp bovis AF2122/97
ggcgggcacaccgcaccug

SEQ ID NO: 3164642 - RNA, 14 nt, Mycobacterium bovis subsp bovis AF2122/97
ggcgggcacgcaca

SEQ ID NO: 3164643 - RNA, 16 nt, Mycobacterium bovis subsp bovis AF2122/97
ggcgggcacucagcag

SEQ ID NO: 3164644 - RNA, 19 nt, Mycobacterium bovis subsp bovis AF2122/97
ggcgggccaccguaaacag

SEQ ID NO: 3164645 - RNA, 15 nt, Mycobacterium bovis subsp bovis AF2122/97
ggcgggcccgccggc

SEQ ID NO: 3164646 - RNA, 21 nt, Mycobacterium bovis subsp bovis AF2122/97
ggcgggcccgccggccccgcc

SEQ ID NO: 3164647 - RNA, 13 nt, Mycobacterium bovis subsp bovis AF2122/97
ggcgggccgcgcg

SEQ ID NO: 3164648 - RNA, 15 nt, Mycobacterium bovis subsp bovis AF2122/97
ggcgggccucggcga

SEQ ID NO: 3164649 - RNA, 18 nt, Mycobacterium bovis subsp bovis AF2122/97
ggcgggcgagugucagca

SEQ ID NO: 3164650 - RNA, 20 nt, Mycobacterium bovis subsp bovis AF2122/97
ggcgggcgaucuuggcgaca

SEQ ID NO: 3164651 - RNA, 18 nt, Mycobacterium bovis subsp bovis AF2122/97
ggcgggcgauuucggcgc

SEQ ID NO: 3164652 - RNA, 20 nt, Mycobacterium bovis subsp bovis AF2122/97
ggcgggcgauuucggcgccg

SEQ ID NO: 3164653 - RNA, 11 nt, Mycobacterium bovis subsp bovis AF2122/97
ggcgggcggca

SEQ ID NO: 3164654 - RNA, 12 nt, Mycobacterium bovis subsp bovis AF2122/97
ggcgggcggugg

SEQ ID NO: 3164655 - RNA, 20 nt, Mycobacterium bovis subsp bovis AF2122/97
ggcgggcggugggcagcagc

SEQ ID NO: 3164656 - RNA, 24 nt, Mycobacterium bovis subsp bovis AF2122/97
ggcgggcucuacucgcggccggcg

SEQ ID NO: 3164657 - RNA, 12 nt, Mycobacterium bovis subsp bovis AF2122/97
ggcgggcugguu

SEQ ID NO: 3164658 - RNA, 16 nt, Mycobacterium bovis subsp bovis AF2122/97
ggcgggcuuggcgucg

SEQ ID NO: 3164659 - RNA, 17 nt, Mycobacterium bovis subsp bovis AF2122/97
ggcgggcuuggcgucga

SEQ ID NO: 3164660 - RNA, 20 nt, Mycobacterium bovis subsp bovis AF2122/97
ggcgggcuuggcgucgacgu

SEQ ID NO: 3164661 - RNA, 16 nt, Mycobacterium bovis subsp bovis AF2122/97
ggcggggacggcggca

SEQ ID NO: 3164662 - RNA, 17 nt, Mycobacterium bovis subsp bovis AF2122/97
ggcggggaucagcgagu

SEQ ID NO: 3164663 - RNA, 12 nt, Mycobacterium bovis subsp bovis AF2122/97
ggcggggcaacu

SEQ ID NO: 3164664 - RNA, 12 nt, Mycobacterium bovis subsp bovis AF2122/97
ggcggggcagaa

SEQ ID NO: 3164665 - RNA, 18 nt, Mycobacterium bovis subsp bovis AF2122/97
ggcggggcggacucacga

SEQ ID NO: 3164666 - RNA, 14 nt, Mycobacterium bovis subsp bovis AF2122/97
ggcgggggagccca

SEQ ID NO: 3164667 - RNA, 15 nt, Mycobacterium bovis subsp bovis AF2122/97
ggcgggggcggcggc

SEQ ID NO: 3164668 - RNA, 23 nt, Mycobacterium bovis subsp bovis AF2122/97
ggcgggggcgucgccgccgggca

SEQ ID NO: 3164669 - RNA, 14 nt, Mycobacterium bovis subsp bovis AF2122/97
ggcggggugagggg

SEQ ID NO: 3164670 - RNA, 18 nt, Mycobacterium bovis subsp bovis AF2122/97
ggcgggguugaucaccga

SEQ ID NO: 3164671 - RNA, 22 nt, Mycobacterium bovis subsp bovis AF2122/97
ggcgggguugaucaccgacacc

SEQ ID NO: 3164672 - RNA, 17 nt, Mycobacterium bovis subsp bovis AF2122/97
ggcggguaagcgaccga

SEQ ID NO: 3164673 - RNA, 19 nt, Mycobacterium bovis subsp bovis AF2122/97
ggcggguaagcgaccgacg

SEQ ID NO: 3164674 - RNA, 12 nt, Mycobacterium bovis subsp bovis AF2122/97
ggcgggucccgc

SEQ ID NO: 3164675 - RNA, 14 nt, Mycobacterium bovis subsp bovis AF2122/97
ggcggguccucgcg

SEQ ID NO: 3164676 - RNA, 13 nt, Mycobacterium bovis subsp bovis AF2122/97
ggcgggugccgag

SEQ ID NO: 3164677 - RNA, 15 nt, Mycobacterium bovis subsp bovis AF2122/97
ggcgggugccgagcu

SEQ ID NO: 3164678 - RNA, 15 nt, Mycobacterium bovis subsp bovis AF2122/97
ggcgggugcggcgau

SEQ ID NO: 3164679 - RNA, 16 nt, Mycobacterium bovis subsp bovis AF2122/97
ggcggguggugcggcc

SEQ ID NO: 3164680 - RNA, 20 nt, Mycobacterium bovis subsp bovis AF2122/97
ggcggguugcagacugcggc

SEQ ID NO: 3164681 - RNA, 20 nt, Mycobacterium bovis subsp bovis AF2122/97
ggcggguuucgcucgcaccg

SEQ ID NO: 3164682 - RNA, 18 nt, Mycobacterium bovis subsp bovis AF2122/97
ggcggguuuucucgccgu

SEQ ID NO: 3164683 - RNA, 24 nt, Mycobacterium bovis subsp bovis AF2122/97
ggcgguaaguacuagccggucggg

SEQ ID NO: 3164684 - RNA, 22 nt, Mycobacterium bovis subsp bovis AF2122/97
ggcgguacaccgacacgccguu

SEQ ID NO: 3164685 - RNA, 21 nt, Mycobacterium bovis subsp bovis AF2122/97
ggcgguguugcucccggccgc

SEQ ID NO: 3164686 - RNA, 23 nt, Mycobacterium bovis subsp bovis AF2122/97
ggcgguguugcucccggccgccg

SEQ ID NO: 3164687 - RNA, 17 nt, Mycobacterium bovis subsp bovis AF2122/97
ggcgguuccggccggcu

SEQ ID NO: 3164688 - RNA, 15 nt, Mycobacterium bovis subsp bovis AF2122/97
ggcgguugaucgccg

SEQ ID NO: 3164689 - RNA, 16 nt, Mycobacterium bovis subsp bovis AF2122/97
ggcgguugaucgccgg

SEQ ID NO: 3164690 - RNA, 22 nt, Mycobacterium bovis subsp bovis AF2122/97
ggcgguugaucgccggccugcu

SEQ ID NO: 3164691 - RNA, 19 nt, Mycobacterium bovis subsp bovis AF2122/97
ggcgguugcccgagcggcu

SEQ ID NO: 3164692 - RNA, 16 nt, Mycobacterium bovis subsp bovis AF2122/97
ggcguaauugucgaug

SEQ ID NO: 3164693 - RNA, 13 nt, Mycobacterium bovis subsp bovis AF2122/97
ggcguacagcgcc

SEQ ID NO: 3164694 - RNA, 15 nt, Mycobacterium bovis subsp bovis AF2122/97
ggcguacagcgccug

SEQ ID NO: 3164695 - RNA, 15 nt, Mycobacterium bovis subsp bovis AF2122/97
ggcguaccagcuggc

SEQ ID NO: 3164696 - RNA, 16 nt, Mycobacterium bovis subsp bovis AF2122/97
ggcguaccuucgagcg

SEQ ID NO: 3164697 - RNA, 15 nt, Mycobacterium bovis subsp bovis AF2122/97
ggcguacucggcauc

SEQ ID NO: 3164698 - RNA, 17 nt, Mycobacterium bovis subsp bovis AF2122/97
ggcguacucggcgcgca

SEQ ID NO: 3164699 - RNA, 14 nt, Mycobacterium bovis subsp bovis AF2122/97
ggcguacucgguga

SEQ ID NO: 3164700 - RNA, 17 nt, Mycobacterium bovis subsp bovis AF2122/97
ggcguacuucgacagcg

SEQ ID NO: 3164701 - RNA, 21 nt, Mycobacterium bovis subsp bovis AF2122/97
ggcguagacguccgcggucgc

SEQ ID NO: 3164702 - RNA, 21 nt, Mycobacterium bovis subsp bovis AF2122/97
ggcguagaucaucuggcuggu

SEQ ID NO: 3164703 - RNA, 17 nt, Mycobacterium bovis subsp bovis AF2122/97
ggcguagaugcgcccgg

SEQ ID NO: 3164704 - RNA, 21 nt, Mycobacterium bovis subsp bovis AF2122/97
ggcguagcccaugccgaugcc

SEQ ID NO: 3164705 - RNA, 21 nt, Mycobacterium bovis subsp bovis AF2122/97
ggcguagguccuugucggccc

SEQ ID NO: 3164706 - RNA, 19 nt, Mycobacterium bovis subsp bovis AF2122/97
ggcgucaagcaaguccacc

SEQ ID NO: 3164707 - RNA, 22 nt, Mycobacterium bovis subsp bovis AF2122/97
ggcgucaagccacacccggcgu

SEQ ID NO: 3164708 - RNA, 12 nt, Mycobacterium bovis subsp bovis AF2122/97
ggcgucaccccg

SEQ ID NO: 3164709 - RNA, 20 nt, Mycobacterium bovis subsp bovis AF2122/97
ggcgucacccgcaacgacug

SEQ ID NO: 3164710 - RNA, 12 nt, Mycobacterium bovis subsp bovis AF2122/97
ggcgucaccgcc

SEQ ID NO: 3164711 - RNA, 13 nt, Mycobacterium bovis subsp bovis AF2122/97
ggcgucaccgccg

SEQ ID NO: 3164712 - RNA, 22 nt, Mycobacterium bovis subsp bovis AF2122/97
ggcgucacgguggacgauacgc

SEQ ID NO: 3164713 - RNA, 13 nt, Mycobacterium bovis subsp bovis AF2122/97
ggcgucagcagca

SEQ ID NO: 3164714 - RNA, 14 nt, Mycobacterium bovis subsp bovis AF2122/97
ggcgucagcagcaa

SEQ ID NO: 3164715 - RNA, 21 nt, Mycobacterium bovis subsp bovis AF2122/97
ggcgucagcaguucggcgaug

SEQ ID NO: 3164716 - RNA, 22 nt, Mycobacterium bovis subsp bovis AF2122/97
ggcgucaggccagagucgcccg

SEQ ID NO: 3164717 - RNA, 23 nt, Mycobacterium bovis subsp bovis AF2122/97
ggcgucagugcagaagacaagug

SEQ ID NO: 3164718 - RNA, 22 nt, Mycobacterium bovis subsp bovis AF2122/97
ggcgucaucgacuugccgccgc

SEQ ID NO: 3164719 - RNA, 18 nt, Mycobacterium bovis subsp bovis AF2122/97
ggcgucaugaacgaucgg

SEQ ID NO: 3164720 - RNA, 22 nt, Mycobacterium bovis subsp bovis AF2122/97
ggcgucaugaacgaucggacca

SEQ ID NO: 3164721 - RNA, 16 nt, Mycobacterium bovis subsp bovis AF2122/97
ggcgucaugcccaggu

SEQ ID NO: 3164722 - RNA, 16 nt, Mycobacterium bovis subsp bovis AF2122/97
ggcguccacgcugacc

SEQ ID NO: 3164723 - RNA, 18 nt, Mycobacterium bovis subsp bovis AF2122/97
ggcguccaucgccaccgc

SEQ ID NO: 3164724 - RNA, 16 nt, Mycobacterium bovis subsp bovis AF2122/97
ggcguccaucgcgcgc

SEQ ID NO: 3164725 - RNA, 18 nt, Mycobacterium bovis subsp bovis AF2122/97
ggcgucccaaucgggauc

SEQ ID NO: 3164726 - RNA, 16 nt, Mycobacterium bovis subsp bovis AF2122/97
ggcgucccagggcaca

SEQ ID NO: 3164727 - RNA, 14 nt, Mycobacterium bovis subsp bovis AF2122/97
ggcgucccgcccgg

SEQ ID NO: 3164728 - RNA, 14 nt, Mycobacterium bovis subsp bovis AF2122/97
ggcgucccggcggu

SEQ ID NO: 3164729 - RNA, 15 nt, Mycobacterium bovis subsp bovis AF2122/97
ggcgucccggcgguc

SEQ ID NO: 3164730 - RNA, 22 nt, Mycobacterium bovis subsp bovis AF2122/97
ggcgucccggcggucagcggcu

SEQ ID NO: 3164731 - RNA, 20 nt, Mycobacterium bovis subsp bovis AF2122/97
ggcguccgcccagcacccuc

SEQ ID NO: 3164732 - RNA, 13 nt, Mycobacterium bovis subsp bovis AF2122/97
ggcguccgccggc

SEQ ID NO: 3164733 - RNA, 15 nt, Mycobacterium bovis subsp bovis AF2122/97
ggcguccgccggcga

SEQ ID NO: 3164734 - RNA, 21 nt, Mycobacterium bovis subsp bovis AF2122/97
ggcguccgggaucuccccaau

SEQ ID NO: 3164735 - RNA, 14 nt, Mycobacterium bovis subsp bovis AF2122/97
ggcguccucgucga

SEQ ID NO: 3164736 - RNA, 21 nt, Mycobacterium bovis subsp bovis AF2122/97
ggcguccuugcgcagcaccag

SEQ ID NO: 3164737 - RNA, 18 nt, Mycobacterium bovis subsp bovis AF2122/97
ggcgucgaaaccggucuc

SEQ ID NO: 3164738 - RNA, 14 nt, Mycobacterium bovis subsp bovis AF2122/97
ggcgucgaacucau

SEQ ID NO: 3164739 - RNA, 22 nt, Mycobacterium bovis subsp bovis AF2122/97
ggcgucgaagaccgccuccacc

SEQ ID NO: 3164740 - RNA, 16 nt, Mycobacterium bovis subsp bovis AF2122/97
ggcgucgaagacggca

SEQ ID NO: 3164741 - RNA, 18 nt, Mycobacterium bovis subsp bovis AF2122/97
ggcgucgaauaggccgcg

SEQ ID NO: 3164742 - RNA, 21 nt, Mycobacterium bovis subsp bovis AF2122/97
ggcgucgaauucagcugcacc

SEQ ID NO: 3164743 - RNA, 16 nt, Mycobacterium bovis subsp bovis AF2122/97
ggcgucgaccacaggc

SEQ ID NO: 3164744 - RNA, 15 nt, Mycobacterium bovis subsp bovis AF2122/97
ggcgucgaccaguuc

SEQ ID NO: 3164745 - RNA, 12 nt, Mycobacterium bovis subsp bovis AF2122/97
ggcgucgaccgc

SEQ ID NO: 3164746 - RNA, 17 nt, Mycobacterium bovis subsp bovis AF2122/97
ggcgucgaccgcggccc

SEQ ID NO: 3164747 - RNA, 18 nt, Mycobacterium bovis subsp bovis AF2122/97
ggcgucgaccgcggcccg

SEQ ID NO: 3164748 - RNA, 22 nt, Mycobacterium bovis subsp bovis AF2122/97
ggcgucgaccucgcgggcgauc

SEQ ID NO: 3164749 - RNA, 16 nt, Mycobacterium bovis subsp bovis AF2122/97
ggcgucgacgauuccc

SEQ ID NO: 3164750 - RNA, 12 nt, Mycobacterium bovis subsp bovis AF2122/97
ggcgucgacggc

SEQ ID NO: 3164751 - RNA, 14 nt, Mycobacterium bovis subsp bovis AF2122/97
ggcgucgacgucga

SEQ ID NO: 3164752 - RNA, 20 nt, Mycobacterium bovis subsp bovis AF2122/97
ggcgucgacugcgugccgca

SEQ ID NO: 3164753 - RNA, 22 nt, Mycobacterium bovis subsp bovis AF2122/97
ggcgucgacugcgugccgcacc

SEQ ID NO: 3164754 - RNA, 14 nt, Mycobacterium bovis subsp bovis AF2122/97
ggcgucgacuggcc

SEQ ID NO: 3164755 - RNA, 23 nt, Mycobacterium bovis subsp bovis AF2122/97
ggcgucgagauagucggccggcg

SEQ ID NO: 3164756 - RNA, 23 nt, Mycobacterium bovis subsp bovis AF2122/97
ggcgucgagcucguccucgucuu

SEQ ID NO: 3164757 - RNA, 19 nt, Mycobacterium bovis subsp bovis AF2122/97
ggcgucgagggagcgccgc

SEQ ID NO: 3164758 - RNA, 20 nt, Mycobacterium bovis subsp bovis AF2122/97
ggcgucgagguuuuucgaug

SEQ ID NO: 3164759 - RNA, 23 nt, Mycobacterium bovis subsp bovis AF2122/97
ggcgucgaguaguucgucgacgu

SEQ ID NO: 3164760 - RNA, 20 nt, Mycobacterium bovis subsp bovis AF2122/97
ggcgucgauaaccuggcggu

SEQ ID NO: 3164761 - RNA, 23 nt, Mycobacterium bovis subsp bovis AF2122/97
ggcgucgaucaacaacagccgca

SEQ ID NO: 3164762 - RNA, 16 nt, Mycobacterium bovis subsp bovis AF2122/97
ggcgucgaugacgacg

SEQ ID NO: 3164763 - RNA, 23 nt, Mycobacterium bovis subsp bovis AF2122/97
ggcgucgaugacgacgccgucgg

SEQ ID NO: 3164764 - RNA, 19 nt, Mycobacterium bovis subsp bovis AF2122/97
ggcgucgaugccggcugcc

SEQ ID NO: 3164765 - RNA, 16 nt, Mycobacterium bovis subsp bovis AF2122/97
ggcgucgaugcgggcc

SEQ ID NO: 3164766 - RNA, 21 nt, Mycobacterium bovis subsp bovis AF2122/97
ggcgucgauggccacccggug

SEQ ID NO: 3164767 - RNA, 23 nt, Mycobacterium bovis subsp bovis AF2122/97
ggcgucgauggccacccgguggc

SEQ ID NO: 3164768 - RNA, 23 nt, Mycobacterium bovis subsp bovis AF2122/97
ggcgucgaugucauccgacaagc

SEQ ID NO: 3164769 - RNA, 17 nt, Mycobacterium bovis subsp bovis AF2122/97
ggcgucgcaacccggcc

SEQ ID NO: 3164770 - RNA, 15 nt, Mycobacterium bovis subsp bovis AF2122/97
ggcgucgccgccauu

SEQ ID NO: 3164771 - RNA, 21 nt, Mycobacterium bovis subsp bovis AF2122/97
ggcgugucgccgccaccagcg

SEQ ID NO: 3164772 - RNA, 15 nt, Mycobacterium bovis subsp bovis AF2122/97
ggcgugucgcgucgc

SEQ ID NO: 3164773 - RNA, 18 nt, Mycobacterium bovis subsp bovis AF2122/97
ggcgugucgcgucgcagg

SEQ ID NO: 3164774 - RNA, 22 nt, Mycobacterium bovis subsp bovis AF2122/97
ggcgugucguugccagggcggg

SEQ ID NO: 3164775 - RNA, 12 nt, Mycobacterium bovis subsp bovis AF2122/97
ggcgugucugcc

SEQ ID NO: 3164776 - RNA, 14 nt, Mycobacterium bovis subsp bovis AF2122/97
ggcgugucugcccg

SEQ ID NO: 3164777 - RNA, 15 nt, Mycobacterium bovis subsp bovis AF2122/97
ggcguguucugaucg

SEQ ID NO: 3164778 - RNA, 18 nt, Mycobacterium bovis subsp bovis AF2122/97
ggcguuaaugcuucgcgu

SEQ ID NO: 3164779 - RNA, 22 nt, Mycobacterium bovis subsp bovis AF2122/97
ggcguuaccaccgucaccgccg

SEQ ID NO: 3164780 - RNA, 15 nt, Mycobacterium bovis subsp bovis AF2122/97
ggcguuagucgauca

SEQ ID NO: 3164781 - RNA, 13 nt, Mycobacterium bovis subsp bovis AF2122/97
ggcguucaccacg

SEQ ID NO: 3164782 - RNA, 13 nt, Mycobacterium bovis subsp bovis AF2122/97
ggcguucaccugc

SEQ ID NO: 3164783 - RNA, 21 nt, Mycobacterium bovis subsp bovis AF2122/97
ggcguucccccggcaccgccg

SEQ ID NO: 3164784 - RNA, 24 nt, Mycobacterium bovis subsp bovis AF2122/97
ggcguuccccgagaacggcgggcg

SEQ ID NO: 3164785 - RNA, 21 nt, Mycobacterium bovis subsp bovis AF2122/97
ggcguucccgccauugccgcc

SEQ ID NO: 3164786 - RNA, 19 nt, Mycobacterium bovis subsp bovis AF2122/97
ggcguucgacucgaccgcg

SEQ ID NO: 3164787 - RNA, 22 nt, Mycobacterium bovis subsp bovis AF2122/97
ggcguucgacucgaccgcgacg

SEQ ID NO: 3164788 - RNA, 14 nt, Mycobacterium bovis subsp bovis AF2122/97
ggcguucgaugcca

SEQ ID NO: 3164789 - RNA, 23 nt, Mycobacterium bovis subsp bovis AF2122/97
ggcguucugcgcccguccgcgcg

SEQ ID NO: 3164790 - RNA, 21 nt, Mycobacterium bovis subsp bovis AF2122/97
ggcguugaacugugcggcagc

SEQ ID NO: 3164791 - RNA, 16 nt, Mycobacterium bovis subsp bovis AF2122/97
ggcguugaccagcacg

SEQ ID NO: 3164792 - RNA, 13 nt, Mycobacterium bovis subsp bovis AF2122/97
ggcguugacgauc

SEQ ID NO: 3164793 - RNA, 19 nt, Mycobacterium bovis subsp bovis AF2122/97
ggcguugagcuggcgguug

SEQ ID NO: 3164794 - RNA, 16 nt, Mycobacterium bovis subsp bovis AF2122/97
ggcguugaucgacauc

SEQ ID NO: 3164795 - RNA, 22 nt, Mycobacterium bovis subsp bovis AF2122/97
ggcguugaucgacaucaccacc

SEQ ID NO: 3164796 - RNA, 15 nt, Mycobacterium bovis subsp bovis AF2122/97
ggcguugccaccgga

SEQ ID NO: 3164797 - RNA, 18 nt, Mycobacterium bovis subsp bovis AF2122/97
ggcguugccaccggagcc

SEQ ID NO: 3164798 - RNA, 15 nt, Mycobacterium bovis subsp bovis AF2122/97
ggcguugccgccggc

SEQ ID NO: 3164799 - RNA, 22 nt, Mycobacterium bovis subsp bovis AF2122/97
ggcguugccgccggcuccaccc

SEQ ID NO: 3164800 - RNA, 14 nt, Mycobacterium bovis subsp bovis AF2122/97
ggcguugccgccug

SEQ ID NO: 3164801 - RNA, 23 nt, Mycobacterium bovis subsp bovis AF2122/97
ggcguugcugaugucgccggugu

SEQ ID NO: 3164802 - RNA, 15 nt, Mycobacterium bovis subsp bovis AF2122/97
ggcguuggcgacgaa

SEQ ID NO: 3164803 - RNA, 16 nt, Mycobacterium bovis subsp bovis AF2122/97
ggcguuggcggcaagg

SEQ ID NO: 3164804 - RNA, 19 nt, Mycobacterium bovis subsp bovis AF2122/97
ggcguuggcggcaagggug

SEQ ID NO: 3164805 - RNA, 17 nt, Mycobacterium bovis subsp bovis AF2122/97
ggcguuggcggcuucgc

SEQ ID NO: 3164806 - RNA, 16 nt, Mycobacterium bovis subsp bovis AF2122/97
ggcguugggaucgcgc

SEQ ID NO: 3164807 - RNA, 20 nt, Mycobacterium bovis subsp bovis AF2122/97
ggcguugguagccagggcga

SEQ ID NO: 3164808 - RNA, 22 nt, Mycobacterium bovis subsp bovis AF2122/97
ggcguugguagccagggcgauc

SEQ ID NO: 3164809 - RNA, 17 nt, Mycobacterium bovis subsp bovis AF2122/97
ggcguugguggucugcc

SEQ ID NO: 3164810 - RNA, 22 nt, Mycobacterium bovis subsp bovis AF2122/97
ggcguugucccccagaugcugg

SEQ ID NO: 3164811 - RNA, 15 nt, Mycobacterium bovis subsp bovis AF2122/97
ggcguugucgacgaa

SEQ ID NO: 3164812 - RNA, 16 nt, Mycobacterium bovis subsp bovis AF2122/97
ggcguugugaccgccg

SEQ ID NO: 3164813 - RNA, 21 nt, Mycobacterium bovis subsp bovis AF2122/97
ggcguuguuaucgaagcccga

SEQ ID NO: 3164814 - RNA, 23 nt, Mycobacterium bovis subsp bovis AF2122/97
ggcguuguuaucgaagcccgagu

SEQ ID NO: 3164815 - RNA, 17 nt, Mycobacterium bovis subsp bovis AF2122/97
ggcguuguugcggaucg

SEQ ID NO: 3164816 - RNA, 17 nt, Mycobacterium bovis subsp bovis AF2122/97
ggcguuugaugcgggcg

SEQ ID NO: 3164817 - RNA, 19 nt, Mycobacterium bovis subsp bovis AF2122/97
ggcguuugaugcgggcggc

SEQ ID NO: 3164818 - RNA, 15 nt, Mycobacterium bovis subsp bovis AF2122/97
ggcguuugccggccg

SEQ ID NO: 3164819 - RNA, 18 nt, Mycobacterium bovis subsp bovis AF2122/97
ggcguuugccggccgauu

SEQ ID NO: 3164820 - RNA, 20 nt, Mycobacterium bovis subsp bovis AF2122/97
ggcuaacaccgcaggcacau

SEQ ID NO: 3164821 - RNA, 20 nt, Mycobacterium bovis subsp bovis AF2122/97
ggcuaauagcucgccggcga

SEQ ID NO: 3164822 - RNA, 23 nt, Mycobacterium bovis subsp bovis AF2122/97
ggcuaaugcgacccgguccacgc

SEQ ID NO: 3164823 - RNA, 14 nt, Mycobacterium bovis subsp bovis AF2122/97
ggcuacaucggcgg

SEQ ID NO: 3164824 - RNA, 17 nt, Mycobacterium bovis subsp bovis AF2122/97
ggcuacccaauaggcga

SEQ ID NO: 3164825 - RNA, 15 nt, Mycobacterium bovis subsp bovis AF2122/97
ggcuaccccagggag

SEQ ID NO: 3164826 - RNA, 20 nt, Mycobacterium bovis subsp bovis AF2122/97
ggcuaccgcaggugccaccu

SEQ ID NO: 3164827 - RNA, 17 nt, Mycobacterium bovis subsp bovis AF2122/97
ggcuaccgccgaccgga

SEQ ID NO: 3164828 - RNA, 12 nt, Mycobacterium bovis subsp bovis AF2122/97
ggcuaccgcgcu

SEQ ID NO: 3164829 - RNA, 21 nt, Mycobacterium bovis subsp bovis AF2122/97
ggcuaccgcgcucccggcguc

SEQ ID NO: 3164830 - RNA, 18 nt, Mycobacterium bovis subsp bovis AF2122/97
ggcuaccggcgccgcgcg

SEQ ID NO: 3164831 - RNA, 16 nt, Mycobacterium bovis subsp bovis AF2122/97
ggcuaccuaacccgca

SEQ ID NO: 3164832 - RNA, 17 nt, Mycobacterium bovis subsp bovis AF2122/97
ggcuaccuaacccgcac

SEQ ID NO: 3164833 - RNA, 18 nt, Mycobacterium bovis subsp bovis AF2122/97
ggcuaccuaacccgcacc

SEQ ID NO: 3164834 - RNA, 23 nt, Mycobacterium bovis subsp bovis AF2122/97
ggcuaccuuguccggcccguagc

SEQ ID NO: 3164835 - RNA, 14 nt, Mycobacterium bovis subsp bovis AF2122/97
ggcuacgacggcgc

SEQ ID NO: 3164836 - RNA, 15 nt, Mycobacterium bovis subsp bovis AF2122/97
ggcuacgacggcgcc

SEQ ID NO: 3164837 - RNA, 18 nt, Mycobacterium bovis subsp bovis AF2122/97
ggcuacgccccacugccg

SEQ ID NO: 3164838 - RNA, 15 nt, Mycobacterium bovis subsp bovis AF2122/97
ggcuacgccuccuuc

SEQ ID NO: 3164839 - RNA, 17 nt, Mycobacterium bovis subsp bovis AF2122/97
ggcuacggcugcccguu

SEQ ID NO: 3164840 - RNA, 20 nt, Mycobacterium bovis subsp bovis AF2122/97
ggcuacggcugcccguucug

SEQ ID NO: 3164841 - RNA, 14 nt, Mycobacterium bovis subsp bovis AF2122/97
ggcuacgggccgcg

SEQ ID NO: 3164842 - RNA, 15 nt, Mycobacterium bovis subsp bovis AF2122/97
ggcuacgggccgcgg

SEQ ID NO: 3164843 - RNA, 17 nt, Mycobacterium bovis subsp bovis AF2122/97
ggcuacgggccgcggua

SEQ ID NO: 3164844 - RNA, 22 nt, Mycobacterium bovis subsp bovis AF2122/97
ggcuacgggccgcuccagguag

SEQ ID NO: 3164845 - RNA, 22 nt, Mycobacterium bovis subsp bovis AF2122/97
ggcuagauaacccaaccgcgcc

SEQ ID NO: 3164846 - RNA, 23 nt, Mycobacterium bovis subsp bovis AF2122/97
ggcuagcagagacaugccggcga

SEQ ID NO: 3164847 - RNA, 15 nt, Mycobacterium bovis subsp bovis AF2122/97
ggcuagcugaugccu

SEQ ID NO: 3164848 - RNA, 15 nt, Mycobacterium bovis subsp bovis AF2122/97
ggcuaggcaccagcg

SEQ ID NO: 3164849 - RNA, 19 nt, Mycobacterium bovis subsp bovis AF2122/97
ggcuaggcaccagcggauc

SEQ ID NO: 3164850 - RNA, 18 nt, Mycobacterium bovis subsp bovis AF2122/97
ggcuaggccaagccgcgg

SEQ ID NO: 3164851 - RNA, 13 nt, Mycobacterium bovis subsp bovis AF2122/97
ggcuaggccagca

SEQ ID NO: 3164852 - RNA, 16 nt, Mycobacterium bovis subsp bovis AF2122/97
ggcuaggccagcacgg

SEQ ID NO: 3164853 - RNA, 13 nt, Mycobacterium bovis subsp bovis AF2122/97
ggcuaggcggcgu

SEQ ID NO: 3164854 - RNA, 15 nt, Mycobacterium bovis subsp bovis AF2122/97
ggcuagggcagcagc

SEQ ID NO: 3164855 - RNA, 16 nt, Mycobacterium bovis subsp bovis AF2122/97
ggcuaggucagcgggc

SEQ ID NO: 3164856 - RNA, 16 nt, Mycobacterium bovis subsp bovis AF2122/97
ggcuaguugccaacac

SEQ ID NO: 3164857 - RNA, 20 nt, Mycobacterium bovis subsp bovis AF2122/97
ggcuccuccgguaucggcga

SEQ ID NO: 3164858 - RNA, 21 nt, Mycobacterium bovis subsp bovis AF2122/97
ggcuccuccgguaucggcgac

SEQ ID NO: 3164859 - RNA, 14 nt, Mycobacterium bovis subsp bovis AF2122/97
ggcuccucgugcac

SEQ ID NO: 3164860 - RNA, 21 nt, Mycobacterium bovis subsp bovis AF2122/97
ggcuccucgugcacgcacagc

SEQ ID NO: 3164861 - RNA, 17 nt, Mycobacterium bovis subsp bovis AF2122/97
ggcuccuggucgccgug

SEQ ID NO: 3164862 - RNA, 17 nt, Mycobacterium bovis subsp bovis AF2122/97
ggcucgaaccgacgcgu

SEQ ID NO: 3164863 - RNA, 14 nt, Mycobacterium bovis subsp bovis AF2122/97
ggcucgacgaugcg

SEQ ID NO: 3164864 - RNA, 22 nt, Mycobacterium bovis subsp bovis AF2122/97
ggcucgacgaugcggucaacgc

SEQ ID NO: 3164865 - RNA, 20 nt, Mycobacterium bovis subsp bovis AF2122/97
ggcucgacgcgucgccggcc

SEQ ID NO: 3164866 - RNA, 18 nt, Mycobacterium bovis subsp bovis AF2122/97
ggcucgacguauuggcgc

SEQ ID NO: 3164867 - RNA, 21 nt, Mycobacterium bovis subsp bovis AF2122/97
ggcucgacguauuggcgcagc

SEQ ID NO: 3164868 - RNA, 23 nt, Mycobacterium bovis subsp bovis AF2122/97
ggcucgacguauuggcgcagcau

SEQ ID NO: 3164869 - RNA, 15 nt, Mycobacterium bovis subsp bovis AF2122/97
ggcucgacugccacc

SEQ ID NO: 3164870 - RNA, 13 nt, Mycobacterium bovis subsp bovis AF2122/97
ggcucgagccgcc

SEQ ID NO: 3164871 - RNA, 17 nt, Mycobacterium bovis subsp bovis AF2122/97
ggcucgagucgcagcac

SEQ ID NO: 3164872 - RNA, 23 nt, Mycobacterium bovis subsp bovis AF2122/97
ggcucgcaccgugaguacucggu

SEQ ID NO: 3164873 - RNA, 21 nt, Mycobacterium bovis subsp bovis AF2122/97
ggcucgcauguucuccacgcc

SEQ ID NO: 3164874 - RNA, 18 nt, Mycobacterium bovis subsp bovis AF2122/97
ggcucgcauucggcgagc

SEQ ID NO: 3164875 - RNA, 21 nt, Mycobacterium bovis subsp bovis AF2122/97
ggcucgcccgcuacggcagcc

SEQ ID NO: 3164876 - RNA, 18 nt, Mycobacterium bovis subsp bovis AF2122/97
ggcucgccgacccgccgc

SEQ ID NO: 3164877 - RNA, 20 nt, Mycobacterium bovis subsp bovis AF2122/97
ggcucgccgacccgccgcgg

SEQ ID NO: 3164878 - RNA, 23 nt, Mycobacterium bovis subsp bovis AF2122/97
ggcucgccgacccgccgcggaca

SEQ ID NO: 3164879 - RNA, 18 nt, Mycobacterium bovis subsp bovis AF2122/97
ggcucgccggcgcgcacc

SEQ ID NO: 3164880 - RNA, 14 nt, Mycobacterium bovis subsp bovis AF2122/97
ggcucgccggcggc

SEQ ID NO: 3164881 - RNA, 13 nt, Mycobacterium bovis subsp bovis AF2122/97
ggcucgcucgccg

SEQ ID NO: 3164882 - RNA, 16 nt, Mycobacterium bovis subsp bovis AF2122/97
ggcucgcucgccgagc

SEQ ID NO: 3164883 - RNA, 21 nt, Mycobacterium bovis subsp bovis AF2122/97
ggcucgcugaucuggggcacc

SEQ ID NO: 3164884 - RNA, 16 nt, Mycobacterium bovis subsp bovis AF2122/97
ggcucgcugcaacauc

SEQ ID NO: 3164885 - RNA, 17 nt, Mycobacterium bovis subsp bovis AF2122/97
ggcucgcugcaccagcu

SEQ ID NO: 3164886 - RNA, 18 nt, Mycobacterium bovis subsp bovis AF2122/97
ggcucgcugcaccagcug

SEQ ID NO: 3164887 - RNA, 14 nt, Mycobacterium bovis subsp bovis AF2122/97
ggcucggcaggccc

SEQ ID NO: 3164888 - RNA, 12 nt, Mycobacterium bovis subsp bovis AF2122/97
ggcucggccacc

SEQ ID NO: 3164889 - RNA, 13 nt, Mycobacterium bovis subsp bovis AF2122/97
ggcucggccaccg

SEQ ID NO: 3164890 - RNA, 13 nt, Mycobacterium bovis subsp bovis AF2122/97
ggcucggccagcc

SEQ ID NO: 3164891 - RNA, 16 nt, Mycobacterium bovis subsp bovis AF2122/97
ggcucggccagccagc

SEQ ID NO: 3164892 - RNA, 17 nt, Mycobacterium bovis subsp bovis AF2122/97
ggcucggcccccgagag

SEQ ID NO: 3164893 - RNA, 24 nt, Mycobacterium bovis subsp bovis AF2122/97
ggcucggcgaaacccgggaucagc

SEQ ID NO: 3164894 - RNA, 13 nt, Mycobacterium bovis subsp bovis AF2122/97
ggcucggcgcagc

SEQ ID NO: 3164895 - RNA, 13 nt, Mycobacterium bovis subsp bovis AF2122/97
ggcucggcggccc

SEQ ID NO: 3164896 - RNA, 13 nt, Mycobacterium bovis subsp bovis AF2122/97
ggcucggcggcgc

SEQ ID NO: 3164897 - RNA, 13 nt, Mycobacterium bovis subsp bovis AF2122/97
ggcucggcgucgc

SEQ ID NO: 3164898 - RNA, 15 nt, Mycobacterium bovis subsp bovis AF2122/97
ggcucggcgucgccg

SEQ ID NO: 3164899 - RNA, 16 nt, Mycobacterium bovis subsp bovis AF2122/97
ggcucggcgucgccgc

SEQ ID NO: 3164900 - RNA, 18 nt, Mycobacterium bovis subsp bovis AF2122/97
ggcucgggcagcgucacc

SEQ ID NO: 3164901 - RNA, 21 nt, Mycobacterium bovis subsp bovis AF2122/97
ggcucgggugcgcccggccaa

SEQ ID NO: 3164902 - RNA, 18 nt, Mycobacterium bovis subsp bovis AF2122/97
ggcucggguggccagcgg

SEQ ID NO: 3164903 - RNA, 15 nt, Mycobacterium bovis subsp bovis AF2122/97
ggcucggucggcagc

SEQ ID NO: 3164904 - RNA, 18 nt, Mycobacterium bovis subsp bovis AF2122/97
ggcucggucggcagcucc

SEQ ID NO: 3164905 - RNA, 12 nt, Mycobacterium bovis subsp bovis AF2122/97
ggcucggugcgc

SEQ ID NO: 3164906 - RNA, 17 nt, Mycobacterium bovis subsp bovis AF2122/97
ggcucgguggcgccggg

SEQ ID NO: 3164907 - RNA, 20 nt, Mycobacterium bovis subsp bovis AF2122/97
ggcucgguggcgccggggcg

SEQ ID NO: 3164908 - RNA, 13 nt, Mycobacterium bovis subsp bovis AF2122/97
ggcucgguggcgg

SEQ ID NO: 3164909 - RNA, 18 nt, Mycobacterium bovis subsp bovis AF2122/97
ggcucgucgaugucgacg

SEQ ID NO: 3164910 - RNA, 20 nt, Mycobacterium bovis subsp bovis AF2122/97
ggcucgugauagggaagggg

SEQ ID NO: 3164911 - RNA, 16 nt, Mycobacterium bovis subsp bovis AF2122/97
ggcucguggcgacggc

SEQ ID NO: 3164912 - RNA, 17 nt, Mycobacterium bovis subsp bovis AF2122/97
ggcucguggcgacggcg

SEQ ID NO: 3164913 - RNA, 15 nt, Mycobacterium bovis subsp bovis AF2122/97
ggcucguguccgccg

SEQ ID NO: 3164914 - RNA, 20 nt, Mycobacterium bovis subsp bovis AF2122/97
ggcucuaccgguccgucacc

SEQ ID NO: 3164915 - RNA, 18 nt, Mycobacterium bovis subsp bovis AF2122/97
ggcucuacucgcggccgg

SEQ ID NO: 3164916 - RNA, 17 nt, Mycobacterium bovis subsp bovis AF2122/97
ggcucuagaucgccgag

SEQ ID NO: 3164917 - RNA, 14 nt, Mycobacterium bovis subsp bovis AF2122/97
ggcucucacgagcg

SEQ ID NO: 3164918 - RNA, 13 nt, Mycobacterium bovis subsp bovis AF2122/97
ggcucuccgguga

SEQ ID NO: 3164919 - RNA, 18 nt, Mycobacterium bovis subsp bovis AF2122/97
ggcucugaggucaccggc

SEQ ID NO: 3164920 - RNA, 21 nt, Mycobacterium bovis subsp bovis AF2122/97
ggcucugaggucaccggcgac

SEQ ID NO: 3164921 - RNA, 23 nt, Mycobacterium bovis subsp bovis AF2122/97
ggcucugaugguguacacgucgc

SEQ ID NO: 3164922 - RNA, 22 nt, Mycobacterium bovis subsp bovis AF2122/97
ggcucugcugccagccgaagcc

SEQ ID NO: 3164923 - RNA, 16 nt, Mycobacterium bovis subsp bovis AF2122/97
ggcucuguagcgucgc

SEQ ID NO: 3164924 - RNA, 19 nt, Mycobacterium bovis subsp bovis AF2122/97
ggcucuguagcgucgcacc

SEQ ID NO: 3164925 - RNA, 16 nt, Mycobacterium bovis subsp bovis AF2122/97
ggcugaaacauccccg

SEQ ID NO: 3164926 - RNA, 18 nt, Mycobacterium bovis subsp bovis AF2122/97
ggcugaaacguccuugaa

SEQ ID NO: 3164927 - RNA, 15 nt, Mycobacterium bovis subsp bovis AF2122/97
ggcugaacggcagcc

SEQ ID NO: 3164928 - RNA, 22 nt, Mycobacterium bovis subsp bovis AF2122/97
ggcugaauucggcgagcgcccu

SEQ ID NO: 3164929 - RNA, 23 nt, Mycobacterium bovis subsp bovis AF2122/97
ggcugaccgaauggccgccgcag

SEQ ID NO: 3164930 - RNA, 16 nt, Mycobacterium bovis subsp bovis AF2122/97
ggcugaccgacccgga

SEQ ID NO: 3164931 - RNA, 14 nt, Mycobacterium bovis subsp bovis AF2122/97
ggcugaccgccacc

SEQ ID NO: 3164932 - RNA, 15 nt, Mycobacterium bovis subsp bovis AF2122/97
ggcugaccgccaccc

SEQ ID NO: 3164933 - RNA, 19 nt, Mycobacterium bovis subsp bovis AF2122/97
ggcugaccggggcgcccgg

SEQ ID NO: 3164934 - RNA, 20 nt, Mycobacterium bovis subsp bovis AF2122/97
ggcugaccggggcgcccggc

SEQ ID NO: 3164935 - RNA, 22 nt, Mycobacterium bovis subsp bovis AF2122/97
ggcugaccguggcgccggucgc

SEQ ID NO: 3164936 - RNA, 16 nt, Mycobacterium bovis subsp bovis AF2122/97
ggcugaccucccaccc

SEQ ID NO: 3164937 - RNA, 19 nt, Mycobacterium bovis subsp bovis AF2122/97
ggcugaccucccacccccg

SEQ ID NO: 3164938 - RNA, 20 nt, Mycobacterium bovis subsp bovis AF2122/97
ggcugaccucccacccccgg

SEQ ID NO: 3164939 - RNA, 23 nt, Mycobacterium bovis subsp bovis AF2122/97
ggcugaccucccacccccgguuc

SEQ ID NO: 3164940 - RNA, 15 nt, Mycobacterium bovis subsp bovis AF2122/97
ggcugagcccgccgc

SEQ ID NO: 3164941 - RNA, 16 nt, Mycobacterium bovis subsp bovis AF2122/97
ggcugagcgugcggug

SEQ ID NO: 3164942 - RNA, 19 nt, Mycobacterium bovis subsp bovis AF2122/97
ggcugaggcggcgacgacc

SEQ ID NO: 3164943 - RNA, 14 nt, Mycobacterium bovis subsp bovis AF2122/97
ggcugggcgccacc

SEQ ID NO: 3164944 - RNA, 19 nt, Mycobacterium bovis subsp bovis AF2122/97
ggcuggggccccgcgccgg

SEQ ID NO: 3164945 - RNA, 12 nt, Mycobacterium bovis subsp bovis AF2122/97
ggcugguagcug

SEQ ID NO: 3164946 - RNA, 17 nt, Mycobacterium bovis subsp bovis AF2122/97
ggcugguaucgagcacc

SEQ ID NO: 3164947 - RNA, 12 nt, Mycobacterium bovis subsp bovis AF2122/97
ggcuggucaccc

SEQ ID NO: 3164948 - RNA, 22 nt, Mycobacterium bovis subsp bovis AF2122/97
ggcuggucacccguaucggguu

SEQ ID NO: 3164949 - RNA, 20 nt, Mycobacterium bovis subsp bovis AF2122/97
ggcuggucaggaucgcaccg

SEQ ID NO: 3164950 - RNA, 20 nt, Mycobacterium bovis subsp bovis AF2122/97
ggcugguccgggugccggug

SEQ ID NO: 3164951 - RNA, 13 nt, Mycobacterium bovis subsp bovis AF2122/97
ggcuggucgccgu

SEQ ID NO: 3164952 - RNA, 18 nt, Mycobacterium bovis subsp bovis AF2122/97
ggcuggucuacccgcggc

SEQ ID NO: 3164953 - RNA, 13 nt, Mycobacterium bovis subsp bovis AF2122/97
ggcuggugcaggu

SEQ ID NO: 3164954 - RNA, 19 nt, Mycobacterium bovis subsp bovis AF2122/97
ggcuggugccaacugcgcc

SEQ ID NO: 3164955 - RNA, 15 nt, Mycobacterium bovis subsp bovis AF2122/97
ggcuggugcuacugg

SEQ ID NO: 3164956 - RNA, 18 nt, Mycobacterium bovis subsp bovis AF2122/97
ggcugguucaacaccggu

SEQ ID NO: 3164957 - RNA, 16 nt, Mycobacterium bovis subsp bovis AF2122/97
ggcugguuucggccgc

SEQ ID NO: 3164958 - RNA, 18 nt, Mycobacterium bovis subsp bovis AF2122/97
ggcugguuucggggacca

SEQ ID NO: 3164959 - RNA, 19 nt, Mycobacterium bovis subsp bovis AF2122/97
ggcuguaaaaaugcuucgc

SEQ ID NO: 3164960 - RNA, 20 nt, Mycobacterium bovis subsp bovis AF2122/97
ggcuguacccgaccagcacc

SEQ ID NO: 3164961 - RNA, 20 nt, Mycobacterium bovis subsp bovis AF2122/97
ggcuguacucgcggcgcggc

SEQ ID NO: 3164962 - RNA, 21 nt, Mycobacterium bovis subsp bovis AF2122/97
ggcuguacucgcggcgcggcc

SEQ ID NO: 3164963 - RNA, 22 nt, Mycobacterium bovis subsp bovis AF2122/97
ggcuguacucgcggcgcggccg

SEQ ID NO: 3164964 - RNA, 22 nt, Mycobacterium bovis subsp bovis AF2122/97
ggcuguaguccgcuacugcgac

SEQ ID NO: 3164965 - RNA, 21 nt, Mycobacterium bovis subsp bovis AF2122/97
ggcuguagucgauguacaccg

SEQ ID NO: 3164966 - RNA, 14 nt, Mycobacterium bovis subsp bovis AF2122/97
ggcugucacaagcc

SEQ ID NO: 3164967 - RNA, 18 nt, Mycobacterium bovis subsp bovis AF2122/97
ggcugucacaagccugcc

SEQ ID NO: 3164968 - RNA, 13 nt, Mycobacterium bovis subsp bovis AF2122/97
ggcuguccaccga

SEQ ID NO: 3164969 - RNA, 15 nt, Mycobacterium bovis subsp bovis AF2122/97
ggcuguccgaccucg

SEQ ID NO: 3164970 - RNA, 16 nt, Mycobacterium bovis subsp bovis AF2122/97
ggcuguccgaccucgc

SEQ ID NO: 3164971 - RNA, 22 nt, Mycobacterium bovis subsp bovis AF2122/97
ggcuguccgaccucgccgcgcg

SEQ ID NO: 3164972 - RNA, 17 nt, Mycobacterium bovis subsp bovis AF2122/97
ggcuguccgcgggccgc

SEQ ID NO: 3164973 - RNA, 22 nt, Mycobacterium bovis subsp bovis AF2122/97
ggcugugauguuguucagcagg

SEQ ID NO: 3164974 - RNA, 18 nt, Mycobacterium bovis subsp bovis AF2122/97
ggcugugcccgaucagcc

SEQ ID NO: 3164975 - RNA, 15 nt, Mycobacterium bovis subsp bovis AF2122/97
ggcuguggccagcau

SEQ ID NO: 3164976 - RNA, 13 nt, Mycobacterium bovis subsp bovis AF2122/97
ggcuguggucgcu

SEQ ID NO: 3164977 - RNA, 13 nt, Mycobacterium bovis subsp bovis AF2122/97
ggcuguucaccuc

SEQ ID NO: 3164978 - RNA, 22 nt, Mycobacterium bovis subsp bovis AF2122/97
ggcuguucgcgccauacuggcg

SEQ ID NO: 3164979 - RNA, 23 nt, Mycobacterium bovis subsp bovis AF2122/97
ggcuguucgcgccauacuggcgg

SEQ ID NO: 3164980 - RNA, 20 nt, Mycobacterium bovis subsp bovis AF2122/97
ggcuguucggccauggcggc

SEQ ID NO: 3164981 - RNA, 16 nt, Mycobacterium bovis subsp bovis AF2122/97
ggcuguucucgccgaa

SEQ ID NO: 3164982 - RNA, 18 nt, Mycobacterium bovis subsp bovis AF2122/97
ggcuguugacgccacgac

SEQ ID NO: 3164983 - RNA, 14 nt, Mycobacterium bovis subsp bovis AF2122/97
ggcuguugcggcgg

SEQ ID NO: 3164984 - RNA, 16 nt, Mycobacterium bovis subsp bovis AF2122/97
ggcuuaaggcccuggc

SEQ ID NO: 3164985 - RNA, 13 nt, Mycobacterium bovis subsp bovis AF2122/97
ggcuuaccggcgg

SEQ ID NO: 3164986 - RNA, 13 nt, Mycobacterium bovis subsp bovis AF2122/97
ggcuuagcggcuu

SEQ ID NO: 3164987 - RNA, 17 nt, Mycobacterium bovis subsp bovis AF2122/97
ggcuuaugcgucugcuc

SEQ ID NO: 3164988 - RNA, 21 nt, Mycobacterium bovis subsp bovis AF2122/97
ggcuuaugcgucugcucgccg

SEQ ID NO: 3164989 - RNA, 13 nt, Mycobacterium bovis subsp bovis AF2122/97
ggcuuauugcccg

SEQ ID NO: 3164990 - RNA, 19 nt, Mycobacterium bovis subsp bovis AF2122/97
ggcuucacccaaccccgcc

SEQ ID NO: 3164991 - RNA, 21 nt, Mycobacterium bovis subsp bovis AF2122/97
ggcuucacccaaccccgccgg

SEQ ID NO: 3164992 - RNA, 22 nt, Mycobacterium bovis subsp bovis AF2122/97
ggcuucacccaaccccgccggc

SEQ ID NO: 3164993 - RNA, 21 nt, Mycobacterium bovis subsp bovis AF2122/97
ggcuucaguccggcccccgac

SEQ ID NO: 3164994 - RNA, 23 nt, Mycobacterium bovis subsp bovis AF2122/97
ggcuuccaacucggcggccagcg

SEQ ID NO: 3164995 - RNA, 13 nt, Mycobacterium bovis subsp bovis AF2122/97
ggcuuccagccac

SEQ ID NO: 3164996 - RNA, 17 nt, Mycobacterium bovis subsp bovis AF2122/97
ggcuuccagccacagcc

SEQ ID NO: 3164997 - RNA, 23 nt, Mycobacterium bovis subsp bovis AF2122/97
ggcuuccagcucgggggcgccgg

SEQ ID NO: 3164998 - RNA, 21 nt, Mycobacterium bovis subsp bovis AF2122/97
ggcuuccccagcaguucgccg

SEQ ID NO: 3164999 - RNA, 19 nt, Mycobacterium bovis subsp bovis AF2122/97
ggcuuccggcgcgaccggu

SEQ ID NO: 3165000 - RNA, 14 nt, Mycobacterium bovis subsp bovis AF2122/97
ggcuuccgggguga

SEQ ID NO: 3165001 - RNA, 13 nt, Mycobacterium bovis subsp bovis AF2122/97
ggcuuccuccucg

SEQ ID NO: 3165002 - RNA, 15 nt, Mycobacterium bovis subsp bovis AF2122/97
ggcuuccuccucggc

SEQ ID NO: 3165003 - RNA, 23 nt, Mycobacterium bovis subsp bovis AF2122/97
ggcuucgaagcgaucgccggccg

SEQ ID NO: 3165004 - RNA, 19 nt, Mycobacterium bovis subsp bovis AF2122/97
ggcuucgacaaccucgagu

SEQ ID NO: 3165005 - RNA, 15 nt, Mycobacterium bovis subsp bovis AF2122/97
ggcuucgacggcggc

SEQ ID NO: 3165006 - RNA, 18 nt, Mycobacterium bovis subsp bovis AF2122/97
ggcuucgacggcggccaa

SEQ ID NO: 3165007 - RNA, 22 nt, Mycobacterium bovis subsp bovis AF2122/97
ggcuucgaugucguaccgggcg

SEQ ID NO: 3165008 - RNA, 11 nt, Mycobacterium bovis subsp bovis AF2122/97
ggcuucgccga

SEQ ID NO: 3165009 - RNA, 12 nt, Mycobacterium bovis subsp bovis AF2122/97
ggcuucgccgcg

SEQ ID NO: 3165010 - RNA, 15 nt, Mycobacterium bovis subsp bovis AF2122/97
ggcuucggcagccgc

SEQ ID NO: 3165011 - RNA, 15 nt, Mycobacterium bovis subsp bovis AF2122/97
ggcuucggcgaaccc

SEQ ID NO: 3165012 - RNA, 21 nt, Mycobacterium bovis subsp bovis AF2122/97
ggcuucggcgaacccuccgca

SEQ ID NO: 3165013 - RNA, 16 nt, Mycobacterium bovis subsp bovis AF2122/97
ggcuucguccaccgcg

SEQ ID NO: 3165014 - RNA, 15 nt, Mycobacterium bovis subsp bovis AF2122/97
ggcuucuagcccguu

SEQ ID NO: 3165015 - RNA, 19 nt, Mycobacterium bovis subsp bovis AF2122/97
ggcuucucguucguaggga

SEQ ID NO: 3165016 - RNA, 19 nt, Mycobacterium bovis subsp bovis AF2122/97
ggcuucuugaccacgaacg

SEQ ID NO: 3165017 - RNA, 23 nt, Mycobacterium bovis subsp bovis AF2122/97
ggcuugacccuugggcaccaccc

SEQ ID NO: 3165018 - RNA, 20 nt, Mycobacterium bovis subsp bovis AF2122/97
ggcuugacgcccgggcaccg

SEQ ID NO: 3165019 - RNA, 15 nt, Mycobacterium bovis subsp bovis AF2122/97
ggcuugacugcacac

SEQ ID NO: 3165020 - RNA, 17 nt, Mycobacterium bovis subsp bovis AF2122/97
ggcuugacugcacacca

SEQ ID NO: 3165021 - RNA, 21 nt, Mycobacterium bovis subsp bovis AF2122/97
ggcuugacugcacaccaccgc

SEQ ID NO: 3165022 - RNA, 19 nt, Mycobacterium bovis subsp bovis AF2122/97
ggcuugagguaggucacca

SEQ ID NO: 3165023 - RNA, 14 nt, Mycobacterium bovis subsp bovis AF2122/97
ggcuugcaacaccc

SEQ ID NO: 3165024 - RNA, 18 nt, Mycobacterium bovis subsp bovis AF2122/97
ggcuugcaacaccccgag

SEQ ID NO: 3165025 - RNA, 14 nt, Mycobacterium bovis subsp bovis AF2122/97
ggcuugccccgccg

SEQ ID NO: 3165026 - RNA, 20 nt, Mycobacterium bovis subsp bovis AF2122/97
ggcuugccgauggcgguggc

SEQ ID NO: 3165027 - RNA, 15 nt, Mycobacterium bovis subsp bovis AF2122/97
ggcuugccgcgcacc

SEQ ID NO: 3165028 - RNA, 17 nt, Mycobacterium bovis subsp bovis AF2122/97
ggcuugccugcgccgag

SEQ ID NO: 3165029 - RNA, 16 nt, Mycobacterium bovis subsp bovis AF2122/97
gggaccggcaggccgg

SEQ ID NO: 3165030 - RNA, 19 nt, Mycobacterium bovis subsp bovis AF2122/97
gggaccggcaggccggcgu

SEQ ID NO: 3165031 - RNA, 23 nt, Mycobacterium bovis subsp bovis AF2122/97
gggaccgugacguaucgccgcgg

SEQ ID NO: 3165032 - RNA, 20 nt, Mycobacterium bovis subsp bovis AF2122/97
gggaccuauuggucgcucgc

SEQ ID NO: 3165033 - RNA, 22 nt, Mycobacterium bovis subsp bovis AF2122/97
gggaccuugaucgagcagggug

SEQ ID NO: 3165034 - RNA, 20 nt, Mycobacterium bovis subsp bovis AF2122/97
gggacgaaucccgcgcccgg

SEQ ID NO: 3165035 - RNA, 22 nt, Mycobacterium bovis subsp bovis AF2122/97
gggacgaaucccgcgcccggcc

SEQ ID NO: 3165036 - RNA, 16 nt, Mycobacterium bovis subsp bovis AF2122/97
gggacgauucucgagu

SEQ ID NO: 3165037 - RNA, 12 nt, Mycobacterium bovis subsp bovis AF2122/97
gggacgccgccc

SEQ ID NO: 3165038 - RNA, 13 nt, Mycobacterium bovis subsp bovis AF2122/97
gggacgccgcggc

SEQ ID NO: 3165039 - RNA, 17 nt, Mycobacterium bovis subsp bovis AF2122/97
gggacgcgagugcguga

SEQ ID NO: 3165040 - RNA, 14 nt, Mycobacterium bovis subsp bovis AF2122/97
gggacgcggccgag

SEQ ID NO: 3165041 - RNA, 13 nt, Mycobacterium bovis subsp bovis AF2122/97
gggacggcggcaa

SEQ ID NO: 3165042 - RNA, 13 nt, Mycobacterium bovis subsp bovis AF2122/97
gggacggcggcga

SEQ ID NO: 3165043 - RNA, 15 nt, Mycobacterium bovis subsp bovis AF2122/97
gggacggcggcgagg

SEQ ID NO: 3165044 - RNA, 17 nt, Mycobacterium bovis subsp bovis AF2122/97
gggacggcggcgaggcg

SEQ ID NO: 3165045 - RNA, 13 nt, Mycobacterium bovis subsp bovis AF2122/97
gggacgggcggcc

SEQ ID NO: 3165046 - RNA, 13 nt, Mycobacterium bovis subsp bovis AF2122/97
gggacgggucgcc

SEQ ID NO: 3165047 - RNA, 18 nt, Mycobacterium bovis subsp bovis AF2122/97
gggacggucgcucggcau

SEQ ID NO: 3165048 - RNA, 19 nt, Mycobacterium bovis subsp bovis AF2122/97
gggacgucgacuucgcccg

SEQ ID NO: 3165049 - RNA, 12 nt, Mycobacterium bovis subsp bovis AF2122/97
gggacgugcccg

SEQ ID NO: 3165050 - RNA, 15 nt, Mycobacterium bovis subsp bovis AF2122/97
gggacgugcccggug

SEQ ID NO: 3165051 - RNA, 17 nt, Mycobacterium bovis subsp bovis AF2122/97
gggacguuguccaccgc

SEQ ID NO: 3165052 - RNA, 22 nt, Mycobacterium bovis subsp bovis AF2122/97
gggacucauggccggucugcug

SEQ ID NO: 3165053 - RNA, 22 nt, Mycobacterium bovis subsp bovis AF2122/97
gggacugugggggcgcaccgag

SEQ ID NO: 3165054 - RNA, 12 nt, Mycobacterium bovis subsp bovis AF2122/97
gggacuucccgc

SEQ ID NO: 3165055 - RNA, 16 nt, Mycobacterium bovis subsp bovis AF2122/97
gggacuucgugccucg

SEQ ID NO: 3165056 - RNA, 17 nt, Mycobacterium bovis subsp bovis AF2122/97
gggacuucgugccucgg

SEQ ID NO: 3165057 - RNA, 17 nt, Mycobacterium bovis subsp bovis AF2122/97
gggagaccgcggccggc

SEQ ID NO: 3165058 - RNA, 20 nt, Mycobacterium bovis subsp bovis AF2122/97
gggagcaccgaccagggccg

SEQ ID NO: 3165059 - RNA, 15 nt, Mycobacterium bovis subsp bovis AF2122/97
gggagcacuacccca

SEQ ID NO: 3165060 - RNA, 17 nt, Mycobacterium bovis subsp bovis AF2122/97
gggagcagagaaaccgc

SEQ ID NO: 3165061 - RNA, 21 nt, Mycobacterium bovis subsp bovis AF2122/97
gggagccaccggcgucgacgu

SEQ ID NO: 3165062 - RNA, 14 nt, Mycobacterium bovis subsp bovis AF2122/97
gggagccacugcgg

SEQ ID NO: 3165063 - RNA, 20 nt, Mycobacterium bovis subsp bovis AF2122/97
gggagcccgagcucaccgca

SEQ ID NO: 3165064 - RNA, 17 nt, Mycobacterium bovis subsp bovis AF2122/97
gggagcccggcggcccg

SEQ ID NO: 3165065 - RNA, 13 nt, Mycobacterium bovis subsp bovis AF2122/97
gggagcgaacggc

SEQ ID NO: 3165066 - RNA, 14 nt, Mycobacterium bovis subsp bovis AF2122/97
gggagcggcguguc

SEQ ID NO: 3165067 - RNA, 15 nt, Mycobacterium bovis subsp bovis AF2122/97
gggagcggcugcacg

SEQ ID NO: 3165068 - RNA, 18 nt, Mycobacterium bovis subsp bovis AF2122/97
gggagcggcugcggcaac

SEQ ID NO: 3165069 - RNA, 17 nt, Mycobacterium bovis subsp bovis AF2122/97
gggagcugaccacuucg

SEQ ID NO: 3165070 - RNA, 15 nt, Mycobacterium bovis subsp bovis AF2122/97
gggaggcagcgcgag

SEQ ID NO: 3165071 - RNA, 20 nt, Mycobacterium bovis subsp bovis AF2122/97
gggaggcgcggucgaccuga

SEQ ID NO: 3165072 - RNA, 17 nt, Mycobacterium bovis subsp bovis AF2122/97
gggaguacgggagccgg

SEQ ID NO: 3165073 - RNA, 20 nt, Mycobacterium bovis subsp bovis AF2122/97
gggaguccggccgacccgga

SEQ ID NO: 3165074 - RNA, 13 nt, Mycobacterium bovis subsp bovis AF2122/97
gggagucgucggc

SEQ ID NO: 3165075 - RNA, 12 nt, Mycobacterium bovis subsp bovis AF2122/97
gggagucgucgu

SEQ ID NO: 3165076 - RNA, 23 nt, Mycobacterium bovis subsp bovis AF2122/97
gggagucgucguguuggccgggu

SEQ ID NO: 3165077 - RNA, 23 nt, Mycobacterium bovis subsp bovis AF2122/97
gggaguguguccgaaggcuuguc

SEQ ID NO: 3165078 - RNA, 19 nt, Mycobacterium bovis subsp bovis AF2122/97
gggaguucaucgcacgaaa

SEQ ID NO: 3165079 - RNA, 14 nt, Mycobacterium bovis subsp bovis AF2122/97
gggaguucgcaccc

SEQ ID NO: 3165080 - RNA, 21 nt, Mycobacterium bovis subsp bovis AF2122/97
gggaguucggggugcgcccag

SEQ ID NO: 3165081 - RNA, 16 nt, Mycobacterium bovis subsp bovis AF2122/97
gggaguugaucuccac

SEQ ID NO: 3165082 - RNA, 19 nt, Mycobacterium bovis subsp bovis AF2122/97
gggaguugaucuccacggc

SEQ ID NO: 3165083 - RNA, 18 nt, Mycobacterium bovis subsp bovis AF2122/97
gggauacucgucgucggc

SEQ ID NO: 3165084 - RNA, 14 nt, Mycobacterium bovis subsp bovis AF2122/97
gggauagacgaccc

SEQ ID NO: 3165085 - RNA, 22 nt, Mycobacterium bovis subsp bovis AF2122/97
gggauagacgaccccggugagc

SEQ ID NO: 3165086 - RNA, 13 nt, Mycobacterium bovis subsp bovis AF2122/97
gggauaggccgug

SEQ ID NO: 3165087 - RNA, 15 nt, Mycobacterium bovis subsp bovis AF2122/97
gggauaggccguggu

SEQ ID NO: 3165088 - RNA, 21 nt, Mycobacterium bovis subsp bovis AF2122/97
gggauaggccguggucgaggg

SEQ ID NO: 3165089 - RNA, 20 nt, Mycobacterium bovis subsp bovis AF2122/97
gggauaguuuucggccgcca

SEQ ID NO: 3165090 - RNA, 17 nt, Mycobacterium bovis subsp bovis AF2122/97
gggauauccggucgcuc

SEQ ID NO: 3165091 - RNA, 21 nt, Mycobacterium bovis subsp bovis AF2122/97
gggaucacaccccaggcaccc

SEQ ID NO: 3165092 - RNA, 12 nt, Mycobacterium bovis subsp bovis AF2122/97
gggaucaccccg

SEQ ID NO: 3165093 - RNA, 16 nt, Mycobacterium bovis subsp bovis AF2122/97
gggaucagccgugcgg

SEQ ID NO: 3165094 - RNA, 16 nt, Mycobacterium bovis subsp bovis AF2122/97
gggaucaggcugggca

SEQ ID NO: 3165095 - RNA, 13 nt, Mycobacterium bovis subsp bovis AF2122/97
gggaucaugacca

SEQ ID NO: 3165096 - RNA, 22 nt, Mycobacterium bovis subsp bovis AF2122/97
gggaucaugaccaucgaggcga

SEQ ID NO: 3165097 - RNA, 17 nt, Mycobacterium bovis subsp bovis AF2122/97
gggauccagcaggccgg

SEQ ID NO: 3165098 - RNA, 18 nt, Mycobacterium bovis subsp bovis AF2122/97
gggauccagcaggccggg

SEQ ID NO: 3165099 - RNA, 17 nt, Mycobacterium bovis subsp bovis AF2122/97
gggaucccagcgcagcg

SEQ ID NO: 3165100 - RNA, 15 nt, Mycobacterium bovis subsp bovis AF2122/97
gggauccgcgcgcug

SEQ ID NO: 3165101 - RNA, 17 nt, Mycobacterium bovis subsp bovis AF2122/97
gggauccgcgcgcugga

SEQ ID NO: 3165102 - RNA, 16 nt, Mycobacterium bovis subsp bovis AF2122/97
gggaucgagagccgac

SEQ ID NO: 3165103 - RNA, 14 nt, Mycobacterium bovis subsp bovis AF2122/97
gggaucgcccaggc

SEQ ID NO: 3165104 - RNA, 21 nt, Mycobacterium bovis subsp bovis AF2122/97
gggaucgcccaggcgcgacgu

SEQ ID NO: 3165105 - RNA, 17 nt, Mycobacterium bovis subsp bovis AF2122/97
gggaucgccguccagca

SEQ ID NO: 3165106 - RNA, 20 nt, Mycobacterium bovis subsp bovis AF2122/97
gggaucgcgcagcgccgcca

SEQ ID NO: 3165107 - RNA, 17 nt, Mycobacterium bovis subsp bovis AF2122/97
gggaucguccggccggg

SEQ ID NO: 3165108 - RNA, 18 nt, Mycobacterium bovis subsp bovis AF2122/97
gggaucgugccggcgaac

SEQ ID NO: 3165109 - RNA, 21 nt, Mycobacterium bovis subsp bovis AF2122/97
gggaucuagaggcggcccccg

SEQ ID NO: 3165110 - RNA, 18 nt, Mycobacterium bovis subsp bovis AF2122/97
gggaucuauuggaugcga

SEQ ID NO: 3165111 - RNA, 19 nt, Mycobacterium bovis subsp bovis AF2122/97
gggaucucgaaggccgcca

SEQ ID NO: 3165112 - RNA, 20 nt, Mycobacterium bovis subsp bovis AF2122/97
gggaucugagggcucggugg

SEQ ID NO: 3165113 - RNA, 23 nt, Mycobacterium bovis subsp bovis AF2122/97
gggaugaucaccgggcccgacgc

SEQ ID NO: 3165114 - RNA, 13 nt, Mycobacterium bovis subsp bovis AF2122/97
gggaugcucaccg

SEQ ID NO: 3165115 - RNA, 15 nt, Mycobacterium bovis subsp bovis AF2122/97
gggauggacaccacc

SEQ ID NO: 3165116 - RNA, 23 nt, Mycobacterium bovis subsp bovis AF2122/97
gggcagcaucaacaccggcuggu

SEQ ID NO: 3165117 - RNA, 18 nt, Mycobacterium bovis subsp bovis AF2122/97
gggcagccccuccgcgcc

SEQ ID NO: 3165118 - RNA, 14 nt, Mycobacterium bovis subsp bovis AF2122/97
gggcagccgcacgg

SEQ ID NO: 3165119 - RNA, 14 nt, Mycobacterium bovis subsp bovis AF2122/97
gggcagccgcgccg

SEQ ID NO: 3165120 - RNA, 18 nt, Mycobacterium bovis subsp bovis AF2122/97
gggcagccgcgccgcggc

SEQ ID NO: 3165121 - RNA, 16 nt, Mycobacterium bovis subsp bovis AF2122/97
gggcagcgacggcagc

SEQ ID NO: 3165122 - RNA, 23 nt, Mycobacterium bovis subsp bovis AF2122/97
gggcagcgaucuugguggccuca

SEQ ID NO: 3165123 - RNA, 15 nt, Mycobacterium bovis subsp bovis AF2122/97
gggcagcgccaggcc

SEQ ID NO: 3165124 - RNA, 21 nt, Mycobacterium bovis subsp bovis AF2122/97
gggcagcgcgugcuguggaug

SEQ ID NO: 3165125 - RNA, 14 nt, Mycobacterium bovis subsp bovis AF2122/97
gggcagcgggccgc

SEQ ID NO: 3165126 - RNA, 16 nt, Mycobacterium bovis subsp bovis AF2122/97
gggcagcgggccgccc

SEQ ID NO: 3165127 - RNA, 18 nt, Mycobacterium bovis subsp bovis AF2122/97
gggcagcuccaccaggac

SEQ ID NO: 3165128 - RNA, 16 nt, Mycobacterium bovis subsp bovis AF2122/97
gggcagcugggcagga

SEQ ID NO: 3165129 - RNA, 20 nt, Mycobacterium bovis subsp bovis AF2122/97
gggcagcugguaggucaccg

SEQ ID NO: 3165130 - RNA, 16 nt, Mycobacterium bovis subsp bovis AF2122/97
gggcaggagcagcacg

SEQ ID NO: 3165131 - RNA, 22 nt, Mycobacterium bovis subsp bovis AF2122/97
gggcaggaucgaggcgucggca

SEQ ID NO: 3165132 - RNA, 23 nt, Mycobacterium bovis subsp bovis AF2122/97
gggcaggaucuccgggucgaugu

SEQ ID NO: 3165133 - RNA, 12 nt, Mycobacterium bovis subsp bovis AF2122/97
gggcaggcccca

SEQ ID NO: 3165134 - RNA, 13 nt, Mycobacterium bovis subsp bovis AF2122/97
gggcaggccccac

SEQ ID NO: 3165135 - RNA, 22 nt, Mycobacterium bovis subsp bovis AF2122/97
gggcaggccccacuggugcagc

SEQ ID NO: 3165136 - RNA, 24 nt, Mycobacterium bovis subsp bovis AF2122/97
gggcaggccgcugggccgaccgcc

SEQ ID NO: 3165137 - RNA, 14 nt, Mycobacterium bovis subsp bovis AF2122/97
gggcaggccgucga

SEQ ID NO: 3165138 - RNA, 17 nt, Mycobacterium bovis subsp bovis AF2122/97
gggcaggcggccagcga

SEQ ID NO: 3165139 - RNA, 15 nt, Mycobacterium bovis subsp bovis AF2122/97
gggcaggucgagcgc

SEQ ID NO: 3165140 - RNA, 14 nt, Mycobacterium bovis subsp bovis AF2122/97
gggcagucaacucc

SEQ ID NO: 3165141 - RNA, 14 nt, Mycobacterium bovis subsp bovis AF2122/97
gggcaguccaggca

SEQ ID NO: 3165142 - RNA, 16 nt, Mycobacterium bovis subsp bovis AF2122/97
gggcaguggcagcccg

SEQ ID NO: 3165143 - RNA, 13 nt, Mycobacterium bovis subsp bovis AF2122/97
gggcaucaccgcc

SEQ ID NO: 3165144 - RNA, 15 nt, Mycobacterium bovis subsp bovis AF2122/97
gggcaucaccgccgc

SEQ ID NO: 3165145 - RNA, 16 nt, Mycobacterium bovis subsp bovis AF2122/97
gggcaucaccgccgcg

SEQ ID NO: 3165146 - RNA, 23 nt, Mycobacterium bovis subsp bovis AF2122/97
gggcaucaccgccgcggccgccg

SEQ ID NO: 3165147 - RNA, 20 nt, Mycobacterium bovis subsp bovis AF2122/97
gggcaucagcagagccccgg

SEQ ID NO: 3165148 - RNA, 18 nt, Mycobacterium bovis subsp bovis AF2122/97
gggcaucaucagcggcgc

SEQ ID NO: 3165149 - RNA, 15 nt, Mycobacterium bovis subsp bovis AF2122/97
gggcaucaucgacgc

SEQ ID NO: 3165150 - RNA, 17 nt, Mycobacterium bovis subsp bovis AF2122/97
gggcaucaucgacgcgc

SEQ ID NO: 3165151 - RNA, 23 nt, Mycobacterium bovis subsp bovis AF2122/97
gggcaucgcgaauauagcggcgu

SEQ ID NO: 3165152 - RNA, 17 nt, Mycobacterium bovis subsp bovis AF2122/97
gggcaucgggccuagcc

SEQ ID NO: 3165153 - RNA, 12 nt, Mycobacterium bovis subsp bovis AF2122/97
gggcaucgucgc

SEQ ID NO: 3165154 - RNA, 20 nt, Mycobacterium bovis subsp bovis AF2122/97
gggcaucgucgucgcugccg

SEQ ID NO: 3165155 - RNA, 15 nt, Mycobacterium bovis subsp bovis AF2122/97
gggcaugauguugaa

SEQ ID NO: 3165156 - RNA, 21 nt, Mycobacterium bovis subsp bovis AF2122/97
gggcaugccggcgaagccggc

SEQ ID NO: 3165157 - RNA, 13 nt, Mycobacterium bovis subsp bovis AF2122/97
gggcauggcggcg

SEQ ID NO: 3165158 - RNA, 14 nt, Mycobacterium bovis subsp bovis AF2122/97
gggcauggucgccg

SEQ ID NO: 3165159 - RNA, 13 nt, Mycobacterium bovis subsp bovis AF2122/97
gggcaugucgccg

SEQ ID NO: 3165160 - RNA, 23 nt, Mycobacterium bovis subsp bovis AF2122/97
gggcaugucgccgaacgccacca

SEQ ID NO: 3165161 - RNA, 18 nt, Mycobacterium bovis subsp bovis AF2122/97
gggcauucccgcucgcag

SEQ ID NO: 3165162 - RNA, 15 nt, Mycobacterium bovis subsp bovis AF2122/97
gggcauucucgagcc

SEQ ID NO: 3165163 - RNA, 14 nt, Mycobacterium bovis subsp bovis AF2122/97
gggcauugcggcgc

SEQ ID NO: 3165164 - RNA, 14 nt, Mycobacterium bovis subsp bovis AF2122/97
gggccaaagccguc

SEQ ID NO: 3165165 - RNA, 17 nt, Mycobacterium bovis subsp bovis AF2122/97
gggccaaagccgucagc

SEQ ID NO: 3165166 - RNA, 18 nt, Mycobacterium bovis subsp bovis AF2122/97
gggccaaagcgcgggcgg

SEQ ID NO: 3165167 - RNA, 22 nt, Mycobacterium bovis subsp bovis AF2122/97
gggccaaccgggugugcgucga

SEQ ID NO: 3165168 - RNA, 20 nt, Mycobacterium bovis subsp bovis AF2122/97
gggccaaccggucgucuguc

SEQ ID NO: 3165169 - RNA, 13 nt, Mycobacterium bovis subsp bovis AF2122/97
gggccaacucauu

SEQ ID NO: 3165170 - RNA, 13 nt, Mycobacterium bovis subsp bovis AF2122/97
gggccaccaccac

SEQ ID NO: 3165171 - RNA, 16 nt, Mycobacterium bovis subsp bovis AF2122/97
gggccaccaccacggc

SEQ ID NO: 3165172 - RNA, 19 nt, Mycobacterium bovis subsp bovis AF2122/97
gggccaccaccacggccag

SEQ ID NO: 3165173 - RNA, 12 nt, Mycobacterium bovis subsp bovis AF2122/97
gggccaccaccu

SEQ ID NO: 3165174 - RNA, 12 nt, Mycobacterium bovis subsp bovis AF2122/97
gggccaccacgc

SEQ ID NO: 3165175 - RNA, 18 nt, Mycobacterium bovis subsp bovis AF2122/97
gggccaccacgcgccgca

SEQ ID NO: 3165176 - RNA, 21 nt, Mycobacterium bovis subsp bovis AF2122/97
gggccaccaguuguccggcua

SEQ ID NO: 3165177 - RNA, 13 nt, Mycobacterium bovis subsp bovis AF2122/97
gggccaccgccgc

SEQ ID NO: 3165178 - RNA, 15 nt, Mycobacterium bovis subsp bovis AF2122/97
gggccaccgccgccu

SEQ ID NO: 3165179 - RNA, 16 nt, Mycobacterium bovis subsp bovis AF2122/97
gggccaccgccgccug

SEQ ID NO: 3165180 - RNA, 22 nt, Mycobacterium bovis subsp bovis AF2122/97
gggccaccgccgccugcccggc

SEQ ID NO: 3165181 - RNA, 13 nt, Mycobacterium bovis subsp bovis AF2122/97
gggccaccgcgcc

SEQ ID NO: 3165182 - RNA, 24 nt, Mycobacterium bovis subsp bovis AF2122/97
gggccaccguaaacagcgcgccgg

SEQ ID NO: 3165183 - RNA, 23 nt, Mycobacterium bovis subsp bovis AF2122/97
gggccacugagccacagggaagc

SEQ ID NO: 3165184 - RNA, 15 nt, Mycobacterium bovis subsp bovis AF2122/97
gggccacuggccggu

SEQ ID NO: 3165185 - RNA, 17 nt, Mycobacterium bovis subsp bovis AF2122/97
gggccagaucgaagcgc

SEQ ID NO: 3165186 - RNA, 19 nt, Mycobacterium bovis subsp bovis AF2122/97
gggccagaucgaagcgcag

SEQ ID NO: 3165187 - RNA, 20 nt, Mycobacterium bovis subsp bovis AF2122/97
gggccagaucgaagcgcagc

SEQ ID NO: 3165188 - RNA, 16 nt, Mycobacterium bovis subsp bovis AF2122/97
gggccagaucgccggg

SEQ ID NO: 3165189 - RNA, 15 nt, Mycobacterium bovis subsp bovis AF2122/97
gggccagcacccgcu

SEQ ID NO: 3165190 - RNA, 15 nt, Mycobacterium bovis subsp bovis AF2122/97
gggccagcaccucga

SEQ ID NO: 3165191 - RNA, 13 nt, Mycobacterium bovis subsp bovis AF2122/97
gggccagcagccg

SEQ ID NO: 3165192 - RNA, 13 nt, Mycobacterium bovis subsp bovis AF2122/97
gggccagcgccuc

SEQ ID NO: 3165193 - RNA, 13 nt, Mycobacterium bovis subsp bovis AF2122/97
gggccagcggcag

SEQ ID NO: 3165194 - RNA, 14 nt, Mycobacterium bovis subsp bovis AF2122/97
gggccagcggcagc

SEQ ID NO: 3165195 - RNA, 16 nt, Mycobacterium bovis subsp bovis AF2122/97
gggccagcgucaccuc

SEQ ID NO: 3165196 - RNA, 22 nt, Mycobacterium bovis subsp bovis AF2122/97
gggccaggauccgaccccgcgc

SEQ ID NO: 3165197 - RNA, 15 nt, Mycobacterium bovis subsp bovis AF2122/97
gggccaggcccagcu

SEQ ID NO: 3165198 - RNA, 15 nt, Mycobacterium bovis subsp bovis AF2122/97
gggccaggccgaugc

SEQ ID NO: 3165199 - RNA, 17 nt, Mycobacterium bovis subsp bovis AF2122/97
gggccaggucagccgcg

SEQ ID NO: 3165200 - RNA, 13 nt, Mycobacterium bovis subsp bovis AF2122/97
gggccaggucggc

SEQ ID NO: 3165201 - RNA, 15 nt, Mycobacterium bovis subsp bovis AF2122/97
gggccaggucggcga

SEQ ID NO: 3165202 - RNA, 19 nt, Mycobacterium bovis subsp bovis AF2122/97
gggccagugaaaccaccgg

SEQ ID NO: 3165203 - RNA, 20 nt, Mycobacterium bovis subsp bovis AF2122/97
gggccgccgcugccgccugc

SEQ ID NO: 3165204 - RNA, 19 nt, Mycobacterium bovis subsp bovis AF2122/97
gggccgccucgaucgacuc

SEQ ID NO: 3165205 - RNA, 17 nt, Mycobacterium bovis subsp bovis AF2122/97
gggccgccucgcggaug

SEQ ID NO: 3165206 - RNA, 16 nt, Mycobacterium bovis subsp bovis AF2122/97
gggccgcgaaacccug

SEQ ID NO: 3165207 - RNA, 13 nt, Mycobacterium bovis subsp bovis AF2122/97
gggccgcgcggcg

SEQ ID NO: 3165208 - RNA, 15 nt, Mycobacterium bovis subsp bovis AF2122/97
gggccgcggcggcca

SEQ ID NO: 3165209 - RNA, 21 nt, Mycobacterium bovis subsp bovis AF2122/97
gggccggaccuuguuggccau

SEQ ID NO: 3165210 - RNA, 22 nt, Mycobacterium bovis subsp bovis AF2122/97
gggccggaugacgaucugguca

SEQ ID NO: 3165211 - RNA, 23 nt, Mycobacterium bovis subsp bovis AF2122/97
gggccggaugucgacgagcaccg

SEQ ID NO: 3165212 - RNA, 12 nt, Mycobacterium bovis subsp bovis AF2122/97
gggccggcaccg

SEQ ID NO: 3165213 - RNA, 16 nt, Mycobacterium bovis subsp bovis AF2122/97
gggccggcaccgcagc

SEQ ID NO: 3165214 - RNA, 12 nt, Mycobacterium bovis subsp bovis AF2122/97
gggccggccacg

SEQ ID NO: 3165215 - RNA, 13 nt, Mycobacterium bovis subsp bovis AF2122/97
gggccggccgagc

SEQ ID NO: 3165216 - RNA, 16 nt, Mycobacterium bovis subsp bovis AF2122/97
gggccggccgagcgca

SEQ ID NO: 3165217 - RNA, 13 nt, Mycobacterium bovis subsp bovis AF2122/97
gggccggccgccg

SEQ ID NO: 3165218 - RNA, 18 nt, Mycobacterium bovis subsp bovis AF2122/97
gggccggcgagcagacgc

SEQ ID NO: 3165219 - RNA, 15 nt, Mycobacterium bovis subsp bovis AF2122/97
gggccggcgccgcac

SEQ ID NO: 3165220 - RNA, 22 nt, Mycobacterium bovis subsp bovis AF2122/97
gggccggcgucgaugacgacgc

SEQ ID NO: 3165221 - RNA, 23 nt, Mycobacterium bovis subsp bovis AF2122/97
gggccggcuagggcagcagcccg

SEQ ID NO: 3165222 - RNA, 15 nt, Mycobacterium bovis subsp bovis AF2122/97
gggccgggcgaucgc

SEQ ID NO: 3165223 - RNA, 22 nt, Mycobacterium bovis subsp bovis AF2122/97
gggccgggcgaucgccugggcu

SEQ ID NO: 3165224 - RNA, 24 nt, Mycobacterium bovis subsp bovis AF2122/97
gggccgguccggggcaacgaucag

SEQ ID NO: 3165225 - RNA, 14 nt, Mycobacterium bovis subsp bovis AF2122/97
gggccggucgguga

SEQ ID NO: 3165226 - RNA, 15 nt, Mycobacterium bovis subsp bovis AF2122/97
gggccggucgugccg

SEQ ID NO: 3165227 - RNA, 14 nt, Mycobacterium bovis subsp bovis AF2122/97
gggccggugcagca

SEQ ID NO: 3165228 - RNA, 17 nt, Mycobacterium bovis subsp bovis AF2122/97
gggccggugcagcacgu

SEQ ID NO: 3165229 - RNA, 22 nt, Mycobacterium bovis subsp bovis AF2122/97
gggccggugcgcaccagagugg

SEQ ID NO: 3165230 - RNA, 23 nt, Mycobacterium bovis subsp bovis AF2122/97
gggccgguggaaaagccacggcu

SEQ ID NO: 3165231 - RNA, 18 nt, Mycobacterium bovis subsp bovis AF2122/97
gggccgguggacgugcac

SEQ ID NO: 3165232 - RNA, 20 nt, Mycobacterium bovis subsp bovis AF2122/97
gggccguacggcgcguacgg

SEQ ID NO: 3165233 - RNA, 21 nt, Mycobacterium bovis subsp bovis AF2122/97
gggccguagaucccgaagcga

SEQ ID NO: 3165234 - RNA, 21 nt, Mycobacterium bovis subsp bovis AF2122/97
gggccguccggcuuggcggcg

SEQ ID NO: 3165235 - RNA, 13 nt, Mycobacterium bovis subsp bovis AF2122/97
gggccguccuccc

SEQ ID NO: 3165236 - RNA, 21 nt, Mycobacterium bovis subsp bovis AF2122/97
gggccguccucccacagguag

SEQ ID NO: 3165237 - RNA, 15 nt, Mycobacterium bovis subsp bovis AF2122/97
gggccgucgccgucc

SEQ ID NO: 3165238 - RNA, 20 nt, Mycobacterium bovis subsp bovis AF2122/97
gggccgucggggaguucgcg

SEQ ID NO: 3165239 - RNA, 17 nt, Mycobacterium bovis subsp bovis AF2122/97
gggccgugacccucagc

SEQ ID NO: 3165240 - RNA, 17 nt, Mycobacterium bovis subsp bovis AF2122/97
gggccguguccgccgga

SEQ ID NO: 3165241 - RNA, 14 nt, Mycobacterium bovis subsp bovis AF2122/97
gggccguucaaccg

SEQ ID NO: 3165242 - RNA, 22 nt, Mycobacterium bovis subsp bovis AF2122/97
gggccguugugcgguugcgcgg

SEQ ID NO: 3165243 - RNA, 17 nt, Mycobacterium bovis subsp bovis AF2122/97
gggccucagacaacggg

SEQ ID NO: 3165244 - RNA, 18 nt, Mycobacterium bovis subsp bovis AF2122/97
gggccucaugcuaggcca

SEQ ID NO: 3165245 - RNA, 19 nt, Mycobacterium bovis subsp bovis AF2122/97
gggccuccacccgccacgg

SEQ ID NO: 3165246 - RNA, 18 nt, Mycobacterium bovis subsp bovis AF2122/97
gggccucggcgccgucgg

SEQ ID NO: 3165247 - RNA, 19 nt, Mycobacterium bovis subsp bovis AF2122/97
gggccucguugaccagaac

SEQ ID NO: 3165248 - RNA, 17 nt, Mycobacterium bovis subsp bovis AF2122/97
gggccugacgcgucagc

SEQ ID NO: 3165249 - RNA, 17 nt, Mycobacterium bovis subsp bovis AF2122/97
gggccugcaccacggcg

SEQ ID NO: 3165250 - RNA, 23 nt, Mycobacterium bovis subsp bovis AF2122/97
gggccugcaccacggcggccacc

SEQ ID NO: 3165251 - RNA, 14 nt, Mycobacterium bovis subsp bovis AF2122/97
gggccugcacgccg

SEQ ID NO: 3165252 - RNA, 15 nt, Mycobacterium bovis subsp bovis AF2122/97
gggccugcacgccgg

SEQ ID NO: 3165253 - RNA, 17 nt, Mycobacterium bovis subsp bovis AF2122/97
gggccugcacgccggcg

SEQ ID NO: 3165254 - RNA, 14 nt, Mycobacterium bovis subsp bovis AF2122/97
gggccugcccggcg

SEQ ID NO: 3165255 - RNA, 17 nt, Mycobacterium bovis subsp bovis AF2122/97
gggccugcguccgacgc

SEQ ID NO: 3165256 - RNA, 17 nt, Mycobacterium bovis subsp bovis AF2122/97
gggccuggaagacggug

SEQ ID NO: 3165257 - RNA, 16 nt, Mycobacterium bovis subsp bovis AF2122/97
gggccuggccacacuc

SEQ ID NO: 3165258 - RNA, 15 nt, Mycobacterium bovis subsp bovis AF2122/97
gggccuggcccacgc

SEQ ID NO: 3165259 - RNA, 20 nt, Mycobacterium bovis subsp bovis AF2122/97
gggccuggccugcccagcac

SEQ ID NO: 3165260 - RNA, 14 nt, Mycobacterium bovis subsp bovis AF2122/97
gggccugggccgca

SEQ ID NO: 3165261 - RNA, 15 nt, Mycobacterium bovis subsp bovis AF2122/97
gggccugggccgcac

SEQ ID NO: 3165262 - RNA, 21 nt, Mycobacterium bovis subsp bovis AF2122/97
gggccuuccugaggguuucca

SEQ ID NO: 3165263 - RNA, 15 nt, Mycobacterium bovis subsp bovis AF2122/97
gggccuuggcaggug

SEQ ID NO: 3165264 - RNA, 20 nt, Mycobacterium bovis subsp bovis AF2122/97
gggcgaacgcuucaccucgu

SEQ ID NO: 3165265 - RNA, 20 nt, Mycobacterium bovis subsp bovis AF2122/97
gggcgaacggcaccgcgccc

SEQ ID NO: 3165266 - RNA, 20 nt, Mycobacterium bovis subsp bovis AF2122/97
gggcgaaguggaucuggcgc

SEQ ID NO: 3165267 - RNA, 16 nt, Mycobacterium bovis subsp bovis AF2122/97
gggcgaauccggcggg

SEQ ID NO: 3165268 - RNA, 17 nt, Mycobacterium bovis subsp bovis AF2122/97
gggcgaauccggcgggu

SEQ ID NO: 3165269 - RNA, 15 nt, Mycobacterium bovis subsp bovis AF2122/97
gggcgacagcggcga

SEQ ID NO: 3165270 - RNA, 18 nt, Mycobacterium bovis subsp bovis AF2122/97
gggcgacaucgagaucgc

SEQ ID NO: 3165271 - RNA, 16 nt, Mycobacterium bovis subsp bovis AF2122/97
gggcgaccaccgcggc

SEQ ID NO: 3165272 - RNA, 12 nt, Mycobacterium bovis subsp bovis AF2122/97
gggcgaccuggu

SEQ ID NO: 3165273 - RNA, 12 nt, Mycobacterium bovis subsp bovis AF2122/97
gggcgacgacgu

SEQ ID NO: 3165274 - RNA, 15 nt, Mycobacterium bovis subsp bovis AF2122/97
gggcgacgcggcgcc

SEQ ID NO: 3165275 - RNA, 12 nt, Mycobacterium bovis subsp bovis AF2122/97
gggcgacggcga

SEQ ID NO: 3165276 - RNA, 12 nt, Mycobacterium bovis subsp bovis AF2122/97
gggcgacggcgg

SEQ ID NO: 3165277 - RNA, 20 nt, Mycobacterium bovis subsp bovis AF2122/97
gggcgacgucaucgccgacc

SEQ ID NO: 3165278 - RNA, 16 nt, Mycobacterium bovis subsp bovis AF2122/97
gggcgacuaccggcuc

SEQ ID NO: 3165279 - RNA, 16 nt, Mycobacterium bovis subsp bovis AF2122/97
gggcgagaacccacgc

SEQ ID NO: 3165280 - RNA, 14 nt, Mycobacterium bovis subsp bovis AF2122/97
gggcgagaccgcga

SEQ ID NO: 3165281 - RNA, 17 nt, Mycobacterium bovis subsp bovis AF2122/97
gggcgagaccgcgagca

SEQ ID NO: 3165282 - RNA, 21 nt, Mycobacterium bovis subsp bovis AF2122/97
gggcgagcaacucguccagca

SEQ ID NO: 3165283 - RNA, 20 nt, Mycobacterium bovis subsp bovis AF2122/97
gggcgagucgggggccgcgu

SEQ ID NO: 3165284 - RNA, 19 nt, Mycobacterium bovis subsp bovis AF2122/97
gggcgauauuggacgcgca

SEQ ID NO: 3165285 - RNA, 15 nt, Mycobacterium bovis subsp bovis AF2122/97
gggcgauccccagca

SEQ ID NO: 3165286 - RNA, 15 nt, Mycobacterium bovis subsp bovis AF2122/97
gggcgaucgccuggg

SEQ ID NO: 3165287 - RNA, 15 nt, Mycobacterium bovis subsp bovis AF2122/97
gggcgaucgcggcga

SEQ ID NO: 3165288 - RNA, 21 nt, Mycobacterium bovis subsp bovis AF2122/97
gggcgaucgcggcgagcacca

SEQ ID NO: 3165289 - RNA, 22 nt, Mycobacterium bovis subsp bovis AF2122/97
gggcgaucgcuucgcaagucau

SEQ ID NO: 3165290 - RNA, 15 nt, Mycobacterium bovis subsp bovis AF2122/97
gggcgguccgcgucu

SEQ ID NO: 3165291 - RNA, 18 nt, Mycobacterium bovis subsp bovis AF2122/97
gggcggucgcguugcaga

SEQ ID NO: 3165292 - RNA, 15 nt, Mycobacterium bovis subsp bovis AF2122/97
gggcggucggccggc

SEQ ID NO: 3165293 - RNA, 16 nt, Mycobacterium bovis subsp bovis AF2122/97
gggcggucggccggcu

SEQ ID NO: 3165294 - RNA, 17 nt, Mycobacterium bovis subsp bovis AF2122/97
gggcggugaaggccccg

SEQ ID NO: 3165295 - RNA, 16 nt, Mycobacterium bovis subsp bovis AF2122/97
gggcggugccgccgga

SEQ ID NO: 3165296 - RNA, 20 nt, Mycobacterium bovis subsp bovis AF2122/97
gggcggugcucuucggcacc

SEQ ID NO: 3165297 - RNA, 22 nt, Mycobacterium bovis subsp bovis AF2122/97
gggcgguggccacccggccgcg

SEQ ID NO: 3165298 - RNA, 20 nt, Mycobacterium bovis subsp bovis AF2122/97
gggcggugggcagcagcugg

SEQ ID NO: 3165299 - RNA, 22 nt, Mycobacterium bovis subsp bovis AF2122/97
gggcgguuacaacuggacgggg

SEQ ID NO: 3165300 - RNA, 21 nt, Mycobacterium bovis subsp bovis AF2122/97
gggcguaaaccguggccgcga

SEQ ID NO: 3165301 - RNA, 17 nt, Mycobacterium bovis subsp bovis AF2122/97
gggcguacucggcgcgc

SEQ ID NO: 3165302 - RNA, 17 nt, Mycobacterium bovis subsp bovis AF2122/97
gggcguccacgcugacc

SEQ ID NO: 3165303 - RNA, 15 nt, Mycobacterium bovis subsp bovis AF2122/97
gggcgucgaccacgc

SEQ ID NO: 3165304 - RNA, 16 nt, Mycobacterium bovis subsp bovis AF2122/97
gggcgucgaccgcggc

SEQ ID NO: 3165305 - RNA, 14 nt, Mycobacterium bovis subsp bovis AF2122/97
gggcgucgccgccg

SEQ ID NO: 3165306 - RNA, 15 nt, Mycobacterium bovis subsp bovis AF2122/97
gggcgucgcuggugg

SEQ ID NO: 3165307 - RNA, 14 nt, Mycobacterium bovis subsp bovis AF2122/97
gggcgucgucggug

SEQ ID NO: 3165308 - RNA, 13 nt, Mycobacterium bovis subsp bovis AF2122/97
gggcgucguucgc

SEQ ID NO: 3165309 - RNA, 14 nt, Mycobacterium bovis subsp bovis AF2122/97
gggcgucugcagcg

SEQ ID NO: 3165310 - RNA, 16 nt, Mycobacterium bovis subsp bovis AF2122/97
gggcgucugcagcggg

SEQ ID NO: 3165311 - RNA, 19 nt, Mycobacterium bovis subsp bovis AF2122/97
gggcgugacgggcaggagc

SEQ ID NO: 3165312 - RNA, 13 nt, Mycobacterium bovis subsp bovis AF2122/97
gggcgugccgacc

SEQ ID NO: 3165313 - RNA, 14 nt, Mycobacterium bovis subsp bovis AF2122/97
gggcgugccgacca

SEQ ID NO: 3165314 - RNA, 13 nt, Mycobacterium bovis subsp bovis AF2122/97
gggcgugccgccg

SEQ ID NO: 3165315 - RNA, 13 nt, Mycobacterium bovis subsp bovis AF2122/97
gggcgugcugccg

SEQ ID NO: 3165316 - RNA, 14 nt, Mycobacterium bovis subsp bovis AF2122/97
gggcgugcugccga

SEQ ID NO: 3165317 - RNA, 17 nt, Mycobacterium bovis subsp bovis AF2122/97
gggcgugggccgcuggg

SEQ ID NO: 3165318 - RNA, 13 nt, Mycobacterium bovis subsp bovis AF2122/97
gggcgugugcagu

SEQ ID NO: 3165319 - RNA, 15 nt, Mycobacterium bovis subsp bovis AF2122/97
gggcguucccccggc

SEQ ID NO: 3165320 - RNA, 23 nt, Mycobacterium bovis subsp bovis AF2122/97
gggcguucccccggcaccgccgg

SEQ ID NO: 3165321 - RNA, 21 nt, Mycobacterium bovis subsp bovis AF2122/97
gggcguugcugauggugccga

SEQ ID NO: 3165322 - RNA, 14 nt, Mycobacterium bovis subsp bovis AF2122/97
gggcguuggcgacg

SEQ ID NO: 3165323 - RNA, 15 nt, Mycobacterium bovis subsp bovis AF2122/97
gggcguuggcggcaa

SEQ ID NO: 3165324 - RNA, 19 nt, Mycobacterium bovis subsp bovis AF2122/97
gggcguuggcggcaagggu

SEQ ID NO: 3165325 - RNA, 20 nt, Mycobacterium bovis subsp bovis AF2122/97
gggcguuuggacgggcgugc

SEQ ID NO: 3165326 - RNA, 23 nt, Mycobacterium bovis subsp bovis AF2122/97
gggcuacuaggcccagcacgguc

SEQ ID NO: 3165327 - RNA, 21 nt, Mycobacterium bovis subsp bovis AF2122/97
gggcuaucguggcggcgucga

SEQ ID NO: 3165328 - RNA, 16 nt, Mycobacterium bovis subsp bovis AF2122/97
gggcuaugaccugcga

SEQ ID NO: 3165329 - RNA, 23 nt, Mycobacterium bovis subsp bovis AF2122/97
gggcucaacaccagccggucguc

SEQ ID NO: 3165330 - RNA, 14 nt, Mycobacterium bovis subsp bovis AF2122/97
gggcucagcggugg

SEQ ID NO: 3165331 - RNA, 21 nt, Mycobacterium bovis subsp bovis AF2122/97
gggcuccgugguugccgaagc

SEQ ID NO: 3165332 - RNA, 18 nt, Mycobacterium bovis subsp bovis AF2122/97
gggcuccucgugcacgca

SEQ ID NO: 3165333 - RNA, 18 nt, Mycobacterium bovis subsp bovis AF2122/97
gggcucgcccgcuacggc

SEQ ID NO: 3165334 - RNA, 23 nt, Mycobacterium bovis subsp bovis AF2122/97
gggcucgcgcucgauggcggcca

SEQ ID NO: 3165335 - RNA, 12 nt, Mycobacterium bovis subsp bovis AF2122/97
gggcucgcucgc

SEQ ID NO: 3165336 - RNA, 14 nt, Mycobacterium bovis subsp bovis AF2122/97
gggcucgcucgccg

SEQ ID NO: 3165337 - RNA, 18 nt, Mycobacterium bovis subsp bovis AF2122/97
gggcucgcucgccgagcu

SEQ ID NO: 3165338 - RNA, 20 nt, Mycobacterium bovis subsp bovis AF2122/97
gggcucgcuucaggcaccgg

SEQ ID NO: 3165339 - RNA, 20 nt, Mycobacterium bovis subsp bovis AF2122/97
gggcucggcgaaggccgcgc

SEQ ID NO: 3165340 - RNA, 11 nt, Mycobacterium bovis subsp bovis AF2122/97
gggcucggcgg

SEQ ID NO: 3165341 - RNA, 17 nt, Mycobacterium bovis subsp bovis AF2122/97
gggcucggcggcccggc

SEQ ID NO: 3165342 - RNA, 18 nt, Mycobacterium bovis subsp bovis AF2122/97
gggcucggcggcccggcc

SEQ ID NO: 3165343 - RNA, 20 nt, Mycobacterium bovis subsp bovis AF2122/97
gggcucggcggcccggccga

SEQ ID NO: 3165344 - RNA, 14 nt, Mycobacterium bovis subsp bovis AF2122/97
gggcucggcgucgc

SEQ ID NO: 3165345 - RNA, 21 nt, Mycobacterium bovis subsp bovis AF2122/97
gggcucggcgucgccgccauu

SEQ ID NO: 3165346 - RNA, 14 nt, Mycobacterium bovis subsp bovis AF2122/97
gggcucgguggcgg

SEQ ID NO: 3165347 - RNA, 18 nt, Mycobacterium bovis subsp bovis AF2122/97
gggcucguguccgccguc

SEQ ID NO: 3165348 - RNA, 13 nt, Mycobacterium bovis subsp bovis AF2122/97
gggcucucggcgu

SEQ ID NO: 3165349 - RNA, 17 nt, Mycobacterium bovis subsp bovis AF2122/97
gggcucugcugccagcc

SEQ ID NO: 3165350 - RNA, 14 nt, Mycobacterium bovis subsp bovis AF2122/97
gggcucuggccagu

SEQ ID NO: 3165351 - RNA, 18 nt, Mycobacterium bovis subsp bovis AF2122/97
gggcugaccgaagaagcc

SEQ ID NO: 3165352 - RNA, 14 nt, Mycobacterium bovis subsp bovis AF2122/97
gggcugaccgccac

SEQ ID NO: 3165353 - RNA, 18 nt, Mycobacterium bovis subsp bovis AF2122/97
gggcugaggaacgccggc

SEQ ID NO: 3165354 - RNA, 14 nt, Mycobacterium bovis subsp bovis AF2122/97
gggcugaggcggcg

SEQ ID NO: 3165355 - RNA, 22 nt, Mycobacterium bovis subsp bovis AF2122/97
gggcugaggguggaccggucga

SEQ ID NO: 3165356 - RNA, 21 nt, Mycobacterium bovis subsp bovis AF2122/97
gggcugccaaggccuucagcg

SEQ ID NO: 3165357 - RNA, 22 nt, Mycobacterium bovis subsp bovis AF2122/97
gggcugccccuccgggcgcacc

SEQ ID NO: 3165358 - RNA, 23 nt, Mycobacterium bovis subsp bovis AF2122/97
gggcugcccgcggacgugccggu

SEQ ID NO: 3165359 - RNA, 19 nt, Mycobacterium bovis subsp bovis AF2122/97
gggcugccggccagacggu

SEQ ID NO: 3165360 - RNA, 13 nt, Mycobacterium bovis subsp bovis AF2122/97
gggcugcggccgc

SEQ ID NO: 3165361 - RNA, 14 nt, Mycobacterium bovis subsp bovis AF2122/97
gggcugcggccgcg

SEQ ID NO: 3165362 - RNA, 12 nt, Mycobacterium bovis subsp bovis AF2122/97
gggcuggccagc

SEQ ID NO: 3165363 - RNA, 13 nt, Mycobacterium bovis subsp bovis AF2122/97
gggcuggccagca

SEQ ID NO: 3165364 - RNA, 14 nt, Mycobacterium bovis subsp bovis AF2122/97
gggcuggccagcac

SEQ ID NO: 3165365 - RNA, 16 nt, Mycobacterium bovis subsp bovis AF2122/97
gggcuggccgacucga

SEQ ID NO: 3165366 - RNA, 15 nt, Mycobacterium bovis subsp bovis AF2122/97
gggcugggauagcgc

SEQ ID NO: 3165367 - RNA, 22 nt, Mycobacterium bovis subsp bovis AF2122/97
gggcuggguaugcacccaggca

SEQ ID NO: 3165368 - RNA, 15 nt, Mycobacterium bovis subsp bovis AF2122/97
gggcugguaucgagc

SEQ ID NO: 3165369 - RNA, 21 nt, Mycobacterium bovis subsp bovis AF2122/97
gggcugguaucgagcaccccg

SEQ ID NO: 3165370 - RNA, 21 nt, Mycobacterium bovis subsp bovis AF2122/97
gggcuggucuacccgcggcgc

SEQ ID NO: 3165371 - RNA, 19 nt, Mycobacterium bovis subsp bovis AF2122/97
gggcugguguagaccucaa

SEQ ID NO: 3165372 - RNA, 18 nt, Mycobacterium bovis subsp bovis AF2122/97
gggcuguacucgcggcgc

SEQ ID NO: 3165373 - RNA, 18 nt, Mycobacterium bovis subsp bovis AF2122/97
gggcuguccgaccucgcc

SEQ ID NO: 3165374 - RNA, 19 nt, Mycobacterium bovis subsp bovis AF2122/97
gggcuguccgaccucgccg

SEQ ID NO: 3165375 - RNA, 23 nt, Mycobacterium bovis subsp bovis AF2122/97
gggcuguucggccauggcggcgc

SEQ ID NO: 3165376 - RNA, 17 nt, Mycobacterium bovis subsp bovis AF2122/97
gggcuuaggccgcggca

SEQ ID NO: 3165377 - RNA, 15 nt, Mycobacterium bovis subsp bovis AF2122/97
ggggcacgacgccgg

SEQ ID NO: 3165378 - RNA, 20 nt, Mycobacterium bovis subsp bovis AF2122/97
ggggcacgacgccggccugg

SEQ ID NO: 3165379 - RNA, 20 nt, Mycobacterium bovis subsp bovis AF2122/97
ggggcacuccgggcucggcg

SEQ ID NO: 3165380 - RNA, 23 nt, Mycobacterium bovis subsp bovis AF2122/97
ggggcagcacgucacgcaaccgg

SEQ ID NO: 3165381 - RNA, 21 nt, Mycobacterium bovis subsp bovis AF2122/97
ggggcagcgacggcagcucgg

SEQ ID NO: 3165382 - RNA, 12 nt, Mycobacterium bovis subsp bovis AF2122/97
ggggcagcgcga

SEQ ID NO: 3165383 - RNA, 12 nt, Mycobacterium bovis subsp bovis AF2122/97
ggggcagcgcgg

SEQ ID NO: 3165384 - RNA, 14 nt, Mycobacterium bovis subsp bovis AF2122/97
ggggcagcucaucg

SEQ ID NO: 3165385 - RNA, 15 nt, Mycobacterium bovis subsp bovis AF2122/97
ggggccaccagaacc

SEQ ID NO: 3165386 - RNA, 15 nt, Mycobacterium bovis subsp bovis AF2122/97
ggggccacccgcaga

SEQ ID NO: 3165387 - RNA, 18 nt, Mycobacterium bovis subsp bovis AF2122/97
ggggccccaugccgaccg

SEQ ID NO: 3165388 - RNA, 20 nt, Mycobacterium bovis subsp bovis AF2122/97
ggggccccgcgccggccgca

SEQ ID NO: 3165389 - RNA, 18 nt, Mycobacterium bovis subsp bovis AF2122/97
ggggccccgcggcgccgc

SEQ ID NO: 3165390 - RNA, 20 nt, Mycobacterium bovis subsp bovis AF2122/97
ggggccccgcggcgccgcca

SEQ ID NO: 3165391 - RNA, 22 nt, Mycobacterium bovis subsp bovis AF2122/97
ggggccgagccgacaucgaugu

SEQ ID NO: 3165392 - RNA, 14 nt, Mycobacterium bovis subsp bovis AF2122/97
ggggccgcaaccau

SEQ ID NO: 3165393 - RNA, 15 nt, Mycobacterium bovis subsp bovis AF2122/97
ggggccgccaccagc

SEQ ID NO: 3165394 - RNA, 17 nt, Mycobacterium bovis subsp bovis AF2122/97
ggggccgccgcggccgg

SEQ ID NO: 3165395 - RNA, 15 nt, Mycobacterium bovis subsp bovis AF2122/97
ggggccgcgccuugc

SEQ ID NO: 3165396 - RNA, 22 nt, Mycobacterium bovis subsp bovis AF2122/97
ggggccgcgucucggugcagca

SEQ ID NO: 3165397 - RNA, 21 nt, Mycobacterium bovis subsp bovis AF2122/97
ggggccgcucacaagccgugc

SEQ ID NO: 3165398 - RNA, 14 nt, Mycobacterium bovis subsp bovis AF2122/97
ggggccgcuggggc

SEQ ID NO: 3165399 - RNA, 15 nt, Mycobacterium bovis subsp bovis AF2122/97
ggggccgcuggggcg

SEQ ID NO: 3165400 - RNA, 13 nt, Mycobacterium bovis subsp bovis AF2122/97
ggggccggauguc

SEQ ID NO: 3165401 - RNA, 15 nt, Mycobacterium bovis subsp bovis AF2122/97
ggggccggccggcaa

SEQ ID NO: 3165402 - RNA, 18 nt, Mycobacterium bovis subsp bovis AF2122/97
ggggccggcggcucgggu

SEQ ID NO: 3165403 - RNA, 12 nt, Mycobacterium bovis subsp bovis AF2122/97
ggggccggcggu

SEQ ID NO: 3165404 - RNA, 14 nt, Mycobacterium bovis subsp bovis AF2122/97
ggggccggcgucga

SEQ ID NO: 3165405 - RNA, 11 nt, Mycobacterium bovis subsp bovis AF2122/97
ggggccgggcg

SEQ ID NO: 3165406 - RNA, 20 nt, Mycobacterium bovis subsp bovis AF2122/97
ggggccggggucggcccgcc

SEQ ID NO: 3165407 - RNA, 22 nt, Mycobacterium bovis subsp bovis AF2122/97
ggggccgucgucggucaccgac

SEQ ID NO: 3165408 - RNA, 16 nt, Mycobacterium bovis subsp bovis AF2122/97
ggggcgaacggcaccg

SEQ ID NO: 3165409 - RNA, 21 nt, Mycobacterium bovis subsp bovis AF2122/97
ggggcgaaguggaucuggcgc

SEQ ID NO: 3165410 - RNA, 23 nt, Mycobacterium bovis subsp bovis AF2122/97
ggggcgaugagccugcaggccgc

SEQ ID NO: 3165411 - RNA, 23 nt, Mycobacterium bovis subsp bovis AF2122/97
ggggcgcacgauggugugcagca

SEQ ID NO: 3165412 - RNA, 13 nt, Mycobacterium bovis subsp bovis AF2122/97
ggggcgccggcgc

SEQ ID NO: 3165413 - RNA, 22 nt, Mycobacterium bovis subsp bovis AF2122/97
ggggcgccuucaccuggugugc

SEQ ID NO: 3165414 - RNA, 13 nt, Mycobacterium bovis subsp bovis AF2122/97
ggggcgcgccggc

SEQ ID NO: 3165415 - RNA, 17 nt, Mycobacterium bovis subsp bovis AF2122/97
ggggcgcgugggcgugc

SEQ ID NO: 3165416 - RNA, 13 nt, Mycobacterium bovis subsp bovis AF2122/97
ggggcgcucgcgc

SEQ ID NO: 3165417 - RNA, 19 nt, Mycobacterium bovis subsp bovis AF2122/97
ggggcgcucgcgcgcuggg

SEQ ID NO: 3165418 - RNA, 20 nt, Mycobacterium bovis subsp bovis AF2122/97
ggggcgcuuccguggcccaa

SEQ ID NO: 3165419 - RNA, 14 nt, Mycobacterium bovis subsp bovis AF2122/97
ggggcggccggcgg

SEQ ID NO: 3165420 - RNA, 21 nt, Mycobacterium bovis subsp bovis AF2122/97
ggggcggccggcggccauggu

SEQ ID NO: 3165421 - RNA, 17 nt, Mycobacterium bovis subsp bovis AF2122/97
ggggcggcggugggcgc

SEQ ID NO: 3165422 - RNA, 21 nt, Mycobacterium bovis subsp bovis AF2122/97
ggggcggucggccggcucguc

SEQ ID NO: 3165423 - RNA, 10 nt, Mycobacterium bovis subsp bovis AF2122/97
ggggcgucgc

SEQ ID NO: 3165424 - RNA, 22 nt, Mycobacterium bovis subsp bovis AF2122/97
ggggcgucgcaacccggccugg

SEQ ID NO: 3165425 - RNA, 24 nt, Mycobacterium bovis subsp bovis AF2122/97
ggggcgucgcaacccggccuggag

SEQ ID NO: 3165426 - RNA, 13 nt, Mycobacterium bovis subsp bovis AF2122/97
ggggcgucguucg

SEQ ID NO: 3165427 - RNA, 19 nt, Mycobacterium bovis subsp bovis AF2122/97
ggggcgugacagggcggca

SEQ ID NO: 3165428 - RNA, 20 nt, Mycobacterium bovis subsp bovis AF2122/97
ggggcgugacagggcggcaa

SEQ ID NO: 3165429 - RNA, 16 nt, Mycobacterium bovis subsp bovis AF2122/97
ggggcuacaacugccg

SEQ ID NO: 3165430 - RNA, 20 nt, Mycobacterium bovis subsp bovis AF2122/97
ggggcuacaacugccgagca

SEQ ID NO: 3165431 - RNA, 19 nt, Mycobacterium bovis subsp bovis AF2122/97
ggggcuauggcgcagcugg

SEQ ID NO: 3165432 - RNA, 17 nt, Mycobacterium bovis subsp bovis AF2122/97
ggggcucaaccccgucc

SEQ ID NO: 3165433 - RNA, 19 nt, Mycobacterium bovis subsp bovis AF2122/97
ggggcucagcgguggcgug

SEQ ID NO: 3165434 - RNA, 20 nt, Mycobacterium bovis subsp bovis AF2122/97
ggggcucagcgguggcgugg

SEQ ID NO: 3165435 - RNA, 15 nt, Mycobacterium bovis subsp bovis AF2122/97
ggggcugaccgccac

SEQ ID NO: 3165436 - RNA, 13 nt, Mycobacterium bovis subsp bovis AF2122/97
ggggcugcacgcu

SEQ ID NO: 3165437 - RNA, 16 nt, Mycobacterium bovis subsp bovis AF2122/97
ggggcugccgccguug

SEQ ID NO: 3165438 - RNA, 14 nt, Mycobacterium bovis subsp bovis AF2122/97
ggggcuggucgccg

SEQ ID NO: 3165439 - RNA, 16 nt, Mycobacterium bovis subsp bovis AF2122/97
ggggcugugcaggcgg

SEQ ID NO: 3165440 - RNA, 19 nt, Mycobacterium bovis subsp bovis AF2122/97
ggggcuuaugcgucugcuc

SEQ ID NO: 3165441 - RNA, 20 nt, Mycobacterium bovis subsp bovis AF2122/97
ggggcuuaugcgucugcucg

SEQ ID NO: 3165442 - RNA, 23 nt, Mycobacterium bovis subsp bovis AF2122/97
ggggcuuaugcgucugcucgccg

SEQ ID NO: 3165443 - RNA, 20 nt, Mycobacterium bovis subsp bovis AF2122/97
ggggcuuauguguccgcucg

SEQ ID NO: 3165444 - RNA, 18 nt, Mycobacterium bovis subsp bovis AF2122/97
ggggcuucaucuggcgcc

SEQ ID NO: 3165445 - RNA, 22 nt, Mycobacterium bovis subsp bovis AF2122/97
ggggcuucaucuggcgccguua

SEQ ID NO: 3165446 - RNA, 19 nt, Mycobacterium bovis subsp bovis AF2122/97
ggggcuucugcgucugcuc

SEQ ID NO: 3165447 - RNA, 20 nt, Mycobacterium bovis subsp bovis AF2122/97
ggggcuuuuacgucugcucg

SEQ ID NO: 3165448 - RNA, 18 nt, Mycobacterium bovis subsp bovis AF2122/97
ggggcuuuugcgucugcu

SEQ ID NO: 3165449 - RNA, 22 nt, Mycobacterium bovis subsp bovis AF2122/97
ggggcuuuugcgucugcucgcc

SEQ ID NO: 3165450 - RNA, 23 nt, Mycobacterium bovis subsp bovis AF2122/97
ggggcuuuugcgucugcucgcca

SEQ ID NO: 3165451 - RNA, 19 nt, Mycobacterium bovis subsp bovis AF2122/97
ggggcuuuugcgucugcug

SEQ ID NO: 3165452 - RNA, 18 nt, Mycobacterium bovis subsp bovis AF2122/97
gggggaacccccucgcga

SEQ ID NO: 3165453 - RNA, 13 nt, Mycobacterium bovis subsp bovis AF2122/97
gggggagcgaacg

SEQ ID NO: 3165454 - RNA, 19 nt, Mycobacterium bovis subsp bovis AF2122/97
gggggauccagcaggccgg

SEQ ID NO: 3165455 - RNA, 23 nt, Mycobacterium bovis subsp bovis AF2122/97
gggggauccagcaggccgggaca

SEQ ID NO: 3165456 - RNA, 20 nt, Mycobacterium bovis subsp bovis AF2122/97
gggggaucucgagccgcggc

SEQ ID NO: 3165457 - RNA, 13 nt, Mycobacterium bovis subsp bovis AF2122/97
gggggaucucggu

SEQ ID NO: 3165458 - RNA, 16 nt, Mycobacterium bovis subsp bovis AF2122/97
gggggcaagcuccagu

SEQ ID NO: 3165459 - RNA, 12 nt, Mycobacterium bovis subsp bovis AF2122/97
gggggccgagcc

SEQ ID NO: 3165460 - RNA, 18 nt, Mycobacterium bovis subsp bovis AF2122/97
gggggccgagccgacauc

SEQ ID NO: 3165461 - RNA, 19 nt, Mycobacterium bovis subsp bovis AF2122/97
gggggccucguugaccaga

SEQ ID NO: 3165462 - RNA, 13 nt, Mycobacterium bovis subsp bovis AF2122/97
gggggcgcaccga

SEQ ID NO: 3165463 - RNA, 18 nt, Mycobacterium bovis subsp bovis AF2122/97
gggucgguuuccuccggc

SEQ ID NO: 3165464 - RNA, 15 nt, Mycobacterium bovis subsp bovis AF2122/97
gggucguacaacacg

SEQ ID NO: 3165465 - RNA, 17 nt, Mycobacterium bovis subsp bovis AF2122/97
gggucguacaacacggg

SEQ ID NO: 3165466 - RNA, 20 nt, Mycobacterium bovis subsp bovis AF2122/97
gggucgucauacagcgcccu

SEQ ID NO: 3165467 - RNA, 22 nt, Mycobacterium bovis subsp bovis AF2122/97
gggucgucguugugauccggug

SEQ ID NO: 3165468 - RNA, 13 nt, Mycobacterium bovis subsp bovis AF2122/97
gggucgugccagc

SEQ ID NO: 3165469 - RNA, 14 nt, Mycobacterium bovis subsp bovis AF2122/97
gggucgugccagca

SEQ ID NO: 3165470 - RNA, 20 nt, Mycobacterium bovis subsp bovis AF2122/97
gggucgugccccggcgcggu

SEQ ID NO: 3165471 - RNA, 22 nt, Mycobacterium bovis subsp bovis AF2122/97
gggucgugccccggcgcgguca

SEQ ID NO: 3165472 - RNA, 12 nt, Mycobacterium bovis subsp bovis AF2122/97
gggucgugcgac

SEQ ID NO: 3165473 - RNA, 14 nt, Mycobacterium bovis subsp bovis AF2122/97
gggucguucgccga

SEQ ID NO: 3165474 - RNA, 16 nt, Mycobacterium bovis subsp bovis AF2122/97
gggucguuggcggcgg

SEQ ID NO: 3165475 - RNA, 14 nt, Mycobacterium bovis subsp bovis AF2122/97
gggucucggugcgg

SEQ ID NO: 3165476 - RNA, 21 nt, Mycobacterium bovis subsp bovis AF2122/97
gggucugacaucggccaaggu

SEQ ID NO: 3165477 - RNA, 13 nt, Mycobacterium bovis subsp bovis AF2122/97
gggucugcgccgc

SEQ ID NO: 3165478 - RNA, 14 nt, Mycobacterium bovis subsp bovis AF2122/97
gggucugcgccgcc

SEQ ID NO: 3165479 - RNA, 15 nt, Mycobacterium bovis subsp bovis AF2122/97
gggucugcgccgccg

SEQ ID NO: 3165480 - RNA, 17 nt, Mycobacterium bovis subsp bovis AF2122/97
gggucugcgccgccggc

SEQ ID NO: 3165481 - RNA, 23 nt, Mycobacterium bovis subsp bovis AF2122/97
gggucugcggucaucgccucggc

SEQ ID NO: 3165482 - RNA, 18 nt, Mycobacterium bovis subsp bovis AF2122/97
gggucugcucagcgcggc

SEQ ID NO: 3165483 - RNA, 12 nt, Mycobacterium bovis subsp bovis AF2122/97
gggucugcucau

SEQ ID NO: 3165484 - RNA, 16 nt, Mycobacterium bovis subsp bovis AF2122/97
gggucuggcaggccag

SEQ ID NO: 3165485 - RNA, 18 nt, Mycobacterium bovis subsp bovis AF2122/97
gggucuggcaggccagca

SEQ ID NO: 3165486 - RNA, 15 nt, Mycobacterium bovis subsp bovis AF2122/97
gggucugggugguga

SEQ ID NO: 3165487 - RNA, 22 nt, Mycobacterium bovis subsp bovis AF2122/97
gggucugucgaacugguuucgc

SEQ ID NO: 3165488 - RNA, 14 nt, Mycobacterium bovis subsp bovis AF2122/97
gggucuuggcgauc

SEQ ID NO: 3165489 - RNA, 22 nt, Mycobacterium bovis subsp bovis AF2122/97
gggugaaacgauggcgaugagg

SEQ ID NO: 3165490 - RNA, 15 nt, Mycobacterium bovis subsp bovis AF2122/97
gggugaccaacaccc

SEQ ID NO: 3165491 - RNA, 18 nt, Mycobacterium bovis subsp bovis AF2122/97
gggugaccaacacccccc

SEQ ID NO: 3165492 - RNA, 17 nt, Mycobacterium bovis subsp bovis AF2122/97
gggugaccaggccgagc

SEQ ID NO: 3165493 - RNA, 12 nt, Mycobacterium bovis subsp bovis AF2122/97
gggugacccgcu

SEQ ID NO: 3165494 - RNA, 15 nt, Mycobacterium bovis subsp bovis AF2122/97
gggugaccucgucga

SEQ ID NO: 3165495 - RNA, 15 nt, Mycobacterium bovis subsp bovis AF2122/97
gggugacgggaaacu

SEQ ID NO: 3165496 - RNA, 19 nt, Mycobacterium bovis subsp bovis AF2122/97
gggugagcauggcuagggc

SEQ ID NO: 3165497 - RNA, 14 nt, Mycobacterium bovis subsp bovis AF2122/97
gggugagcccggga

SEQ ID NO: 3165498 - RNA, 17 nt, Mycobacterium bovis subsp bovis AF2122/97
gggugagcgaccugggu

SEQ ID NO: 3165499 - RNA, 20 nt, Mycobacterium bovis subsp bovis AF2122/97
gggugagcuacucacgguga

SEQ ID NO: 3165500 - RNA, 20 nt, Mycobacterium bovis subsp bovis AF2122/97
gggugaggcgggucgccgcc

SEQ ID NO: 3165501 - RNA, 17 nt, Mycobacterium bovis subsp bovis AF2122/97
gggugagugaccacgcu

SEQ ID NO: 3165502 - RNA, 22 nt, Mycobacterium bovis subsp bovis AF2122/97
gggugaucugggcggugaaggc

SEQ ID NO: 3165503 - RNA, 22 nt, Mycobacterium bovis subsp bovis AF2122/97
gggugaucuuggcgcccgccgg

SEQ ID NO: 3165504 - RNA, 17 nt, Mycobacterium bovis subsp bovis AF2122/97
gggugcagaucgcccca

SEQ ID NO: 3165505 - RNA, 13 nt, Mycobacterium bovis subsp bovis AF2122/97
gggugcagcacgg

SEQ ID NO: 3165506 - RNA, 17 nt, Mycobacterium bovis subsp bovis AF2122/97
gggugcagcacggcgcc

SEQ ID NO: 3165507 - RNA, 21 nt, Mycobacterium bovis subsp bovis AF2122/97
gggugcagcacggcgccgcca

SEQ ID NO: 3165508 - RNA, 20 nt, Mycobacterium bovis subsp bovis AF2122/97
gggugcagcacguccgcgga

SEQ ID NO: 3165509 - RNA, 23 nt, Mycobacterium bovis subsp bovis AF2122/97
gggugccagcccguugcaggacg

SEQ ID NO: 3165510 - RNA, 14 nt, Mycobacterium bovis subsp bovis AF2122/97
gggugccagccggu

SEQ ID NO: 3165511 - RNA, 15 nt, Mycobacterium bovis subsp bovis AF2122/97
gggugccagccgguc

SEQ ID NO: 3165512 - RNA, 19 nt, Mycobacterium bovis subsp bovis AF2122/97
gggugcccccggugccgcc

SEQ ID NO: 3165513 - RNA, 12 nt, Mycobacterium bovis subsp bovis AF2122/97
gggugcccgcgu

SEQ ID NO: 3165514 - RNA, 16 nt, Mycobacterium bovis subsp bovis AF2122/97
gggugcccggccgcca

SEQ ID NO: 3165515 - RNA, 23 nt, Mycobacterium bovis subsp bovis AF2122/97
gggugcccggccgccagcgcgcc

SEQ ID NO: 3165516 - RNA, 12 nt, Mycobacterium bovis subsp bovis AF2122/97
gggugccgcagc

SEQ ID NO: 3165517 - RNA, 14 nt, Mycobacterium bovis subsp bovis AF2122/97
gggugccggcagcg

SEQ ID NO: 3165518 - RNA, 18 nt, Mycobacterium bovis subsp bovis AF2122/97
gggugccggcagcggcgc

SEQ ID NO: 3165519 - RNA, 14 nt, Mycobacterium bovis subsp bovis AF2122/97
gggugccggcgccg

SEQ ID NO: 3165520 - RNA, 15 nt, Mycobacterium bovis subsp bovis AF2122/97
gggugccggcgccgc

SEQ ID NO: 3165521 - RNA, 13 nt, Mycobacterium bovis subsp bovis AF2122/97
gggugccggcggu

SEQ ID NO: 3165522 - RNA, 16 nt, Mycobacterium bovis subsp bovis AF2122/97
gggugccggcgucgcu

SEQ ID NO: 3165523 - RNA, 23 nt, Mycobacterium bovis subsp bovis AF2122/97
gggugccggcgucgcuggccagg

SEQ ID NO: 3165524 - RNA, 18 nt, Mycobacterium bovis subsp bovis AF2122/97
gggugccgguguugccgc

SEQ ID NO: 3165525 - RNA, 15 nt, Mycobacterium bovis subsp bovis AF2122/97
gggugccgucgggua

SEQ ID NO: 3165526 - RNA, 20 nt, Mycobacterium bovis subsp bovis AF2122/97
gggugccguugcgucugcuc

SEQ ID NO: 3165527 - RNA, 16 nt, Mycobacterium bovis subsp bovis AF2122/97
gggugcgacggcaggu

SEQ ID NO: 3165528 - RNA, 22 nt, Mycobacterium bovis subsp bovis AF2122/97
gggugcgcccggccaagccggc

SEQ ID NO: 3165529 - RNA, 15 nt, Mycobacterium bovis subsp bovis AF2122/97
gggugcgccgcagca

SEQ ID NO: 3165530 - RNA, 21 nt, Mycobacterium bovis subsp bovis AF2122/97
gggugcgccguugccgccguc

SEQ ID NO: 3165531 - RNA, 22 nt, Mycobacterium bovis subsp bovis AF2122/97
gggugcgcgcgaccauacccgc

SEQ ID NO: 3165532 - RNA, 15 nt, Mycobacterium bovis subsp bovis AF2122/97
gggugcgcugcagcg

SEQ ID NO: 3165533 - RNA, 16 nt, Mycobacterium bovis subsp bovis AF2122/97
gggugcgucugggcau

SEQ ID NO: 3165534 - RNA, 19 nt, Mycobacterium bovis subsp bovis AF2122/97
gggugcugaugggucaggc

SEQ ID NO: 3165535 - RNA, 20 nt, Mycobacterium bovis subsp bovis AF2122/97
gggugcugcgcgcggcggcc

SEQ ID NO: 3165536 - RNA, 11 nt, Mycobacterium bovis subsp bovis AF2122/97
gggugcuggca

SEQ ID NO: 3165537 - RNA, 17 nt, Mycobacterium bovis subsp bovis AF2122/97
gggugcuuccucgcgag

SEQ ID NO: 3165538 - RNA, 20 nt, Mycobacterium bovis subsp bovis AF2122/97
gggugcuuucgcgucugcuc

SEQ ID NO: 3165539 - RNA, 21 nt, Mycobacterium bovis subsp bovis AF2122/97
gggugcuuucgcgucugcucg

SEQ ID NO: 3165540 - RNA, 22 nt, Mycobacterium bovis subsp bovis AF2122/97
ggguggaaguacuucgcggcgg

SEQ ID NO: 3165541 - RNA, 13 nt, Mycobacterium bovis subsp bovis AF2122/97
ggguggacaccug

SEQ ID NO: 3165542 - RNA, 20 nt, Mycobacterium bovis subsp bovis AF2122/97
ggguggacaccugcugcacc

SEQ ID NO: 3165543 - RNA, 15 nt, Mycobacterium bovis subsp bovis AF2122/97
ggguggaccggucga

SEQ ID NO: 3165544 - RNA, 19 nt, Mycobacterium bovis subsp bovis AF2122/97
ggguggauugacgcgacga

SEQ ID NO: 3165545 - RNA, 17 nt, Mycobacterium bovis subsp bovis AF2122/97
ggguggccacgcccagg

SEQ ID NO: 3165546 - RNA, 18 nt, Mycobacterium bovis subsp bovis AF2122/97
ggguggccacgcccaggc

SEQ ID NO: 3165547 - RNA, 14 nt, Mycobacterium bovis subsp bovis AF2122/97
ggguggccagcagg

SEQ ID NO: 3165548 - RNA, 20 nt, Mycobacterium bovis subsp bovis AF2122/97
ggguggcccccgccggccac

SEQ ID NO: 3165549 - RNA, 16 nt, Mycobacterium bovis subsp bovis AF2122/97
ggguggcgaggcagca

SEQ ID NO: 3165550 - RNA, 13 nt, Mycobacterium bovis subsp bovis AF2122/97
gguaccaccggca

SEQ ID NO: 3165551 - RNA, 14 nt, Mycobacterium bovis subsp bovis AF2122/97
gguaccaucaccgc

SEQ ID NO: 3165552 - RNA, 18 nt, Mycobacterium bovis subsp bovis AF2122/97
gguacccccagcacccgg

SEQ ID NO: 3165553 - RNA, 21 nt, Mycobacterium bovis subsp bovis AF2122/97
gguaccccccagcgacggcaa

SEQ ID NO: 3165554 - RNA, 17 nt, Mycobacterium bovis subsp bovis AF2122/97
gguacccguagcaccac

SEQ ID NO: 3165555 - RNA, 12 nt, Mycobacterium bovis subsp bovis AF2122/97
gguaccgacggg

SEQ ID NO: 3165556 - RNA, 16 nt, Mycobacterium bovis subsp bovis AF2122/97
gguaccgccgcugccg

SEQ ID NO: 3165557 - RNA, 22 nt, Mycobacterium bovis subsp bovis AF2122/97
gguaccgccgcugccgguggcg

SEQ ID NO: 3165558 - RNA, 12 nt, Mycobacterium bovis subsp bovis AF2122/97
gguaccgccggc

SEQ ID NO: 3165559 - RNA, 14 nt, Mycobacterium bovis subsp bovis AF2122/97
gguaccgccggcuc

SEQ ID NO: 3165560 - RNA, 17 nt, Mycobacterium bovis subsp bovis AF2122/97
gguaccgccggcuccgc

SEQ ID NO: 3165561 - RNA, 17 nt, Mycobacterium bovis subsp bovis AF2122/97
gguaccgcgugcgccgg

SEQ ID NO: 3165562 - RNA, 14 nt, Mycobacterium bovis subsp bovis AF2122/97
gguaccggcgaucu

SEQ ID NO: 3165563 - RNA, 12 nt, Mycobacterium bovis subsp bovis AF2122/97
gguaccggcggc

SEQ ID NO: 3165564 - RNA, 13 nt, Mycobacterium bovis subsp bovis AF2122/97
gguaccggcggcg

SEQ ID NO: 3165565 - RNA, 14 nt, Mycobacterium bovis subsp bovis AF2122/97
gguaccggcggcgc

SEQ ID NO: 3165566 - RNA, 17 nt, Mycobacterium bovis subsp bovis AF2122/97
gguaccggcggcgccgg

SEQ ID NO: 3165567 - RNA, 20 nt, Mycobacterium bovis subsp bovis AF2122/97
gguaccggcggcgccggccu

SEQ ID NO: 3165568 - RNA, 21 nt, Mycobacterium bovis subsp bovis AF2122/97
gguaccggcggcgccggccuc

SEQ ID NO: 3165569 - RNA, 19 nt, Mycobacterium bovis subsp bovis AF2122/97
gguaccggcggcgccgggg

SEQ ID NO: 3165570 - RNA, 22 nt, Mycobacterium bovis subsp bovis AF2122/97
gguaccggcuucgucggccagc

SEQ ID NO: 3165571 - RNA, 13 nt, Mycobacterium bovis subsp bovis AF2122/97
gguaccgggacga

SEQ ID NO: 3165572 - RNA, 23 nt, Mycobacterium bovis subsp bovis AF2122/97
gguaccggugucaguccgacacc

SEQ ID NO: 3165573 - RNA, 19 nt, Mycobacterium bovis subsp bovis AF2122/97
gguaccucaacaccaggcc

SEQ ID NO: 3165574 - RNA, 20 nt, Mycobacterium bovis subsp bovis AF2122/97
gguaccucccgcgugcgggg

SEQ ID NO: 3165575 - RNA, 19 nt, Mycobacterium bovis subsp bovis AF2122/97
gguacgacaccgcagcggg

SEQ ID NO: 3165576 - RNA, 20 nt, Mycobacterium bovis subsp bovis AF2122/97
gguacgcaaccaaccgucgg

SEQ ID NO: 3165577 - RNA, 23 nt, Mycobacterium bovis subsp bovis AF2122/97
gguacgcaaccaaccgucgguga

SEQ ID NO: 3165578 - RNA, 15 nt, Mycobacterium bovis subsp bovis AF2122/97
gguacgccgccgcga

SEQ ID NO: 3165579 - RNA, 14 nt, Mycobacterium bovis subsp bovis AF2122/97
gguacgccgcgccg

SEQ ID NO: 3165580 - RNA, 15 nt, Mycobacterium bovis subsp bovis AF2122/97
gguacgcgaucagcg

SEQ ID NO: 3165581 - RNA, 16 nt, Mycobacterium bovis subsp bovis AF2122/97
gguacgcgaucagcgc

SEQ ID NO: 3165582 - RNA, 17 nt, Mycobacterium bovis subsp bovis AF2122/97
gguacgcgaucagcgcg

SEQ ID NO: 3165583 - RNA, 18 nt, Mycobacterium bovis subsp bovis AF2122/97
gguacgcgaucagcgcgc

SEQ ID NO: 3165584 - RNA, 18 nt, Mycobacterium bovis subsp bovis AF2122/97
gguacgggggugggccca

SEQ ID NO: 3165585 - RNA, 16 nt, Mycobacterium bovis subsp bovis AF2122/97
gguacggguaacgcac

SEQ ID NO: 3165586 - RNA, 17 nt, Mycobacterium bovis subsp bovis AF2122/97
gguacggucucacggcg

SEQ ID NO: 3165587 - RNA, 17 nt, Mycobacterium bovis subsp bovis AF2122/97
gguacguaaucgagcgc

SEQ ID NO: 3165588 - RNA, 16 nt, Mycobacterium bovis subsp bovis AF2122/97
gguacgucgaggguga

SEQ ID NO: 3165589 - RNA, 17 nt, Mycobacterium bovis subsp bovis AF2122/97
gguacgucgagggugac

SEQ ID NO: 3165590 - RNA, 20 nt, Mycobacterium bovis subsp bovis AF2122/97
gguacuccccguugccuucg

SEQ ID NO: 3165591 - RNA, 14 nt, Mycobacterium bovis subsp bovis AF2122/97
gguacucccgcgau

SEQ ID NO: 3165592 - RNA, 17 nt, Mycobacterium bovis subsp bovis AF2122/97
gguacucccgcgaucgc

SEQ ID NO: 3165593 - RNA, 22 nt, Mycobacterium bovis subsp bovis AF2122/97
gguacugcgaugugcgugaaca

SEQ ID NO: 3165594 - RNA, 16 nt, Mycobacterium bovis subsp bovis AF2122/97
gguacugcggcucgcu

SEQ ID NO: 3165595 - RNA, 21 nt, Mycobacterium bovis subsp bovis AF2122/97
gguagaacuccucgcugucga

SEQ ID NO: 3165596 - RNA, 19 nt, Mycobacterium bovis subsp bovis AF2122/97
gguagacaugggugaaucg

SEQ ID NO: 3165597 - RNA, 18 nt, Mycobacterium bovis subsp bovis AF2122/97
gguagaccaccugcaugu

SEQ ID NO: 3165598 - RNA, 13 nt, Mycobacterium bovis subsp bovis AF2122/97
gguagaccaugaa

SEQ ID NO: 3165599 - RNA, 16 nt, Mycobacterium bovis subsp bovis AF2122/97
gguagaccaugaagaa

SEQ ID NO: 3165600 - RNA, 14 nt, Mycobacterium bovis subsp bovis AF2122/97
gguagacgccgccg

SEQ ID NO: 3165601 - RNA, 18 nt, Mycobacterium bovis subsp bovis AF2122/97
gguagacguugccaacac

SEQ ID NO: 3165602 - RNA, 21 nt, Mycobacterium bovis subsp bovis AF2122/97
gguagaucagcaugccuucgg

SEQ ID NO: 3165603 - RNA, 17 nt, Mycobacterium bovis subsp bovis AF2122/97
gguagaucagcgccugg

SEQ ID NO: 3165604 - RNA, 12 nt, Mycobacterium bovis subsp bovis AF2122/97
gguagauggcga

SEQ ID NO: 3165605 - RNA, 19 nt, Mycobacterium bovis subsp bovis AF2122/97
gguagcacagcagcaacgc

SEQ ID NO: 3165606 - RNA, 15 nt, Mycobacterium bovis subsp bovis AF2122/97
gguagcacccacggc

SEQ ID NO: 3165607 - RNA, 23 nt, Mycobacterium bovis subsp bovis AF2122/97
gguagcaccgauuuuggcaagcu

SEQ ID NO: 3165608 - RNA, 14 nt, Mycobacterium bovis subsp bovis AF2122/97
gguagcacggucug

SEQ ID NO: 3165609 - RNA, 18 nt, Mycobacterium bovis subsp bovis AF2122/97
gguagcagcagcgggccg

SEQ ID NO: 3165610 - RNA, 17 nt, Mycobacterium bovis subsp bovis AF2122/97
gguagcauccagcgcgc

SEQ ID NO: 3165611 - RNA, 21 nt, Mycobacterium bovis subsp bovis AF2122/97
gguagccaaccugaagccagc

SEQ ID NO: 3165612 - RNA, 23 nt, Mycobacterium bovis subsp bovis AF2122/97
gguagccaaccugaagccagcgc

SEQ ID NO: 3165613 - RNA, 14 nt, Mycobacterium bovis subsp bovis AF2122/97
gguagccagcgcgc

SEQ ID NO: 3165614 - RNA, 15 nt, Mycobacterium bovis subsp bovis AF2122/97
gguagccaucggcua

SEQ ID NO: 3165615 - RNA, 18 nt, Mycobacterium bovis subsp bovis AF2122/97
gguagccauucggugugg

SEQ ID NO: 3165616 - RNA, 23 nt, Mycobacterium bovis subsp bovis AF2122/97
gguagccccgucgaccuccacca

SEQ ID NO: 3165617 - RNA, 14 nt, Mycobacterium bovis subsp bovis AF2122/97
gguagccgaccagc

SEQ ID NO: 3165618 - RNA, 15 nt, Mycobacterium bovis subsp bovis AF2122/97
gguagccgaccgacc

SEQ ID NO: 3165619 - RNA, 12 nt, Mycobacterium bovis subsp bovis AF2122/97
gguagccgacga

SEQ ID NO: 3165620 - RNA, 19 nt, Mycobacterium bovis subsp bovis AF2122/97
gguagccgacgauguucca

SEQ ID NO: 3165621 - RNA, 13 nt, Mycobacterium bovis subsp bovis AF2122/97
gguagccgcccag

SEQ ID NO: 3165622 - RNA, 15 nt, Mycobacterium bovis subsp bovis AF2122/97
gguagccgccggcgc

SEQ ID NO: 3165623 - RNA, 16 nt, Mycobacterium bovis subsp bovis AF2122/97
gguagccgccggcgcc

SEQ ID NO: 3165624 - RNA, 13 nt, Mycobacterium bovis subsp bovis AF2122/97
gguagccgcggcc

SEQ ID NO: 3165625 - RNA, 16 nt, Mycobacterium bovis subsp bovis AF2122/97
gguagccgcggccaca

SEQ ID NO: 3165626 - RNA, 12 nt, Mycobacterium bovis subsp bovis AF2122/97
gguagccggcga

SEQ ID NO: 3165627 - RNA, 13 nt, Mycobacterium bovis subsp bovis AF2122/97
gguagccggcgac

SEQ ID NO: 3165628 - RNA, 12 nt, Mycobacterium bovis subsp bovis AF2122/97
gguagccggcgu

SEQ ID NO: 3165629 - RNA, 22 nt, Mycobacterium bovis subsp bovis AF2122/97
gguagccgggaacgcugacgcc

SEQ ID NO: 3165630 - RNA, 13 nt, Mycobacterium bovis subsp bovis AF2122/97
gguagccgggcac

SEQ ID NO: 3165631 - RNA, 13 nt, Mycobacterium bovis subsp bovis AF2122/97
gguagccgucgau

SEQ ID NO: 3165632 - RNA, 14 nt, Mycobacterium bovis subsp bovis AF2122/97
gguagccugaccag

SEQ ID NO: 3165633 - RNA, 16 nt, Mycobacterium bovis subsp bovis AF2122/97
gguagcgaucgugcug

SEQ ID NO: 3165634 - RNA, 15 nt, Mycobacterium bovis subsp bovis AF2122/97
gguagcgcggguggc

SEQ ID NO: 3165635 - RNA, 21 nt, Mycobacterium bovis subsp bovis AF2122/97
gguagcgcggguggcucgggu

SEQ ID NO: 3165636 - RNA, 19 nt, Mycobacterium bovis subsp bovis AF2122/97
gguagcggaucaagcgcac

SEQ ID NO: 3165637 - RNA, 12 nt, Mycobacterium bovis subsp bovis AF2122/97
gguagcggcgcc

SEQ ID NO: 3165638 - RNA, 14 nt, Mycobacterium bovis subsp bovis AF2122/97
gguagcggcgccgc

SEQ ID NO: 3165639 - RNA, 12 nt, Mycobacterium bovis subsp bovis AF2122/97
gguagcggcggu

SEQ ID NO: 3165640 - RNA, 22 nt, Mycobacterium bovis subsp bovis AF2122/97
gguagcggcuccgaaggccgcc

SEQ ID NO: 3165641 - RNA, 21 nt, Mycobacterium bovis subsp bovis AF2122/97
gguagcguccaggucaugccg

SEQ ID NO: 3165642 - RNA, 21 nt, Mycobacterium bovis subsp bovis AF2122/97
gguagcugacgugucggcugc

SEQ ID NO: 3165643 - RNA, 14 nt, Mycobacterium bovis subsp bovis AF2122/97
gguagcugccgcgg

SEQ ID NO: 3165644 - RNA, 16 nt, Mycobacterium bovis subsp bovis AF2122/97
gguagcugccgcggcc

SEQ ID NO: 3165645 - RNA, 19 nt, Mycobacterium bovis subsp bovis AF2122/97
gguagcugccgcggccggc

SEQ ID NO: 3165646 - RNA, 23 nt, Mycobacterium bovis subsp bovis AF2122/97
gguagcugugguggugaugggca

SEQ ID NO: 3165647 - RNA, 21 nt, Mycobacterium bovis subsp bovis AF2122/97
gguaggacucacgcagcgcca

SEQ ID NO: 3165648 - RNA, 16 nt, Mycobacterium bovis subsp bovis AF2122/97
gguaggagcggguggc

SEQ ID NO: 3165649 - RNA, 19 nt, Mycobacterium bovis subsp bovis AF2122/97
gguaggcaauggcgugcgg

SEQ ID NO: 3165650 - RNA, 14 nt, Mycobacterium bovis subsp bovis AF2122/97
gguaggcaggccgg

SEQ ID NO: 3165651 - RNA, 15 nt, Mycobacterium bovis subsp bovis AF2122/97
gguaggcaggccggc

SEQ ID NO: 3165652 - RNA, 19 nt, Mycobacterium bovis subsp bovis AF2122/97
gguaggcaggccggcucgc

SEQ ID NO: 3165653 - RNA, 12 nt, Mycobacterium bovis subsp bovis AF2122/97
gguaggccggga

SEQ ID NO: 3165654 - RNA, 14 nt, Mycobacterium bovis subsp bovis AF2122/97
gguaggccggugcg

SEQ ID NO: 3165655 - RNA, 14 nt, Mycobacterium bovis subsp bovis AF2122/97
gguaggcggccagc

SEQ ID NO: 3165656 - RNA, 13 nt, Mycobacterium bovis subsp bovis AF2122/97
gguaggcgguguc

SEQ ID NO: 3165657 - RNA, 22 nt, Mycobacterium bovis subsp bovis AF2122/97
gguaggucgccgccgccacggc

SEQ ID NO: 3165658 - RNA, 14 nt, Mycobacterium bovis subsp bovis AF2122/97
gguaggugucgugg

SEQ ID NO: 3165659 - RNA, 13 nt, Mycobacterium bovis subsp bovis AF2122/97
gguagguucgacg

SEQ ID NO: 3165660 - RNA, 20 nt, Mycobacterium bovis subsp bovis AF2122/97
gguagguucgacggacaccc

SEQ ID NO: 3165661 - RNA, 20 nt, Mycobacterium bovis subsp bovis AF2122/97
gguaguccggcuuaccggcg

SEQ ID NO: 3165662 - RNA, 16 nt, Mycobacterium bovis subsp bovis AF2122/97
gguagucgaugcugac

SEQ ID NO: 3165663 - RNA, 16 nt, Mycobacterium bovis subsp bovis AF2122/97
gguagucggccuccuc

SEQ ID NO: 3165664 - RNA, 21 nt, Mycobacterium bovis subsp bovis AF2122/97
gguagucgggcaaggcggcgg

SEQ ID NO: 3165665 - RNA, 21 nt, Mycobacterium bovis subsp bovis AF2122/97
gguaguucuuggucaggcugg

SEQ ID NO: 3165666 - RNA, 14 nt, Mycobacterium bovis subsp bovis AF2122/97
gguaguugaggccg

SEQ ID NO: 3165667 - RNA, 18 nt, Mycobacterium bovis subsp bovis AF2122/97
gguaguugaggccgucga

SEQ ID NO: 3165668 - RNA, 17 nt, Mycobacterium bovis subsp bovis AF2122/97
gguaguugucccgccgc

SEQ ID NO: 3165669 - RNA, 14 nt, Mycobacterium bovis subsp bovis AF2122/97
gguauagccggcgc

SEQ ID NO: 3165670 - RNA, 13 nt, Mycobacterium bovis subsp bovis AF2122/97
gguauccaccgcg

SEQ ID NO: 3165671 - RNA, 15 nt, Mycobacterium bovis subsp bovis AF2122/97
gguauccaccgcgag

SEQ ID NO: 3165672 - RNA, 20 nt, Mycobacterium bovis subsp bovis AF2122/97
gguauccaccgcgagaccuu

SEQ ID NO: 3165673 - RNA, 22 nt, Mycobacterium bovis subsp bovis AF2122/97
gguauccguguguuaggcccgc

SEQ ID NO: 3165674 - RNA, 19 nt, Mycobacterium bovis subsp bovis AF2122/97
gguaucgagaugccaucgg

SEQ ID NO: 3165675 - RNA, 18 nt, Mycobacterium bovis subsp bovis AF2122/97
gguaucgagggcagccgc

SEQ ID NO: 3165676 - RNA, 17 nt, Mycobacterium bovis subsp bovis AF2122/97
gguaucgccaguggugc

SEQ ID NO: 3165677 - RNA, 21 nt, Mycobacterium bovis subsp bovis AF2122/97
gguaucgccaguggugcaccg

SEQ ID NO: 3165678 - RNA, 17 nt, Mycobacterium bovis subsp bovis AF2122/97
gguaucggcagaugguc

SEQ ID NO: 3165679 - RNA, 17 nt, Mycobacterium bovis subsp bovis AF2122/97
gguaucggcgaccagcu

SEQ ID NO: 3165680 - RNA, 14 nt, Mycobacterium bovis subsp bovis AF2122/97
gguaucggcgugcu

SEQ ID NO: 3165681 - RNA, 15 nt, Mycobacterium bovis subsp bovis AF2122/97
gguaucgucccggcg

SEQ ID NO: 3165682 - RNA, 17 nt, Mycobacterium bovis subsp bovis AF2122/97
gguaucgucccggcgac

SEQ ID NO: 3165683 - RNA, 19 nt, Mycobacterium bovis subsp bovis AF2122/97
gguaucgucccggcgaccg

SEQ ID NO: 3165684 - RNA, 20 nt, Mycobacterium bovis subsp bovis AF2122/97
gguaucgucccggcgaccgg

SEQ ID NO: 3165685 - RNA, 19 nt, Mycobacterium bovis subsp bovis AF2122/97
gguaugagcuuccgcgcgc

SEQ ID NO: 3165686 - RNA, 13 nt, Mycobacterium bovis subsp bovis AF2122/97
gguaugcucgcug

SEQ ID NO: 3165687 - RNA, 17 nt, Mycobacterium bovis subsp bovis AF2122/97
gguaugcucgcuggcgc

SEQ ID NO: 3165688 - RNA, 13 nt, Mycobacterium bovis subsp bovis AF2122/97
gguauggcggcga

SEQ ID NO: 3165689 - RNA, 19 nt, Mycobacterium bovis subsp bovis AF2122/97
gguauggcggcgacggccg

SEQ ID NO: 3165690 - RNA, 16 nt, Mycobacterium bovis subsp bovis AF2122/97
gguauugacguggccg

SEQ ID NO: 3165691 - RNA, 18 nt, Mycobacterium bovis subsp bovis AF2122/97
ggucaaaaucagggugcc

SEQ ID NO: 3165692 - RNA, 22 nt, Mycobacterium bovis subsp bovis AF2122/97
ggucaacaagacgaugcuggcg

SEQ ID NO: 3165693 - RNA, 13 nt, Mycobacterium bovis subsp bovis AF2122/97
ggucaaccggugu

SEQ ID NO: 3165694 - RNA, 12 nt, Mycobacterium bovis subsp bovis AF2122/97
ggucaacgacau

SEQ ID NO: 3165695 - RNA, 13 nt, Mycobacterium bovis subsp bovis AF2122/97
ggucaacgacauu

SEQ ID NO: 3165696 - RNA, 13 nt, Mycobacterium bovis subsp bovis AF2122/97
ggucaacggccga

SEQ ID NO: 3165697 - RNA, 20 nt, Mycobacterium bovis subsp bovis AF2122/97
ggucaacgggaugccggcga

SEQ ID NO: 3165698 - RNA, 21 nt, Mycobacterium bovis subsp bovis AF2122/97
ggucaacgggaugccggcgaa

SEQ ID NO: 3165699 - RNA, 14 nt, Mycobacterium bovis subsp bovis AF2122/97
ggucaagacccgca

SEQ ID NO: 3165700 - RNA, 18 nt, Mycobacterium bovis subsp bovis AF2122/97
ggucaagacccgcaucca

SEQ ID NO: 3165701 - RNA, 15 nt, Mycobacterium bovis subsp bovis AF2122/97
ggucaagccggcgcc

SEQ ID NO: 3165702 - RNA, 19 nt, Mycobacterium bovis subsp bovis AF2122/97
ggucaagccggcgcccgcc

SEQ ID NO: 3165703 - RNA, 18 nt, Mycobacterium bovis subsp bovis AF2122/97
ggucaaggugcgccgcca

SEQ ID NO: 3165704 - RNA, 19 nt, Mycobacterium bovis subsp bovis AF2122/97
ggucaaucccacgcccggc

SEQ ID NO: 3165705 - RNA, 22 nt, Mycobacterium bovis subsp bovis AF2122/97
ggucaaucggguucgucgucgu

SEQ ID NO: 3165706 - RNA, 15 nt, Mycobacterium bovis subsp bovis AF2122/97
ggucaaugccggccg

SEQ ID NO: 3165707 - RNA, 17 nt, Mycobacterium bovis subsp bovis AF2122/97
ggucaaugcgcuggcgc

SEQ ID NO: 3165708 - RNA, 22 nt, Mycobacterium bovis subsp bovis AF2122/97
ggucaaugcgcuggcgccgccg

SEQ ID NO: 3165709 - RNA, 14 nt, Mycobacterium bovis subsp bovis AF2122/97
ggucacaaacggca

SEQ ID NO: 3165710 - RNA, 20 nt, Mycobacterium bovis subsp bovis AF2122/97
ggucacacucccauccgccu

SEQ ID NO: 3165711 - RNA, 14 nt, Mycobacterium bovis subsp bovis AF2122/97
ggucacagcugcgc

SEQ ID NO: 3165712 - RNA, 19 nt, Mycobacterium bovis subsp bovis AF2122/97
ggucaccaagacaccggcc

SEQ ID NO: 3165713 - RNA, 22 nt, Mycobacterium bovis subsp bovis AF2122/97
ggucaccaagacaccggccugc

SEQ ID NO: 3165714 - RNA, 12 nt, Mycobacterium bovis subsp bovis AF2122/97
ggucaccaccau

SEQ ID NO: 3165715 - RNA, 16 nt, Mycobacterium bovis subsp bovis AF2122/97
ggucaccaccaucacg

SEQ ID NO: 3165716 - RNA, 13 nt, Mycobacterium bovis subsp bovis AF2122/97
ggucaccacgcgg

SEQ ID NO: 3165717 - RNA, 13 nt, Mycobacterium bovis subsp bovis AF2122/97
ggucaccacggcg

SEQ ID NO: 3165718 - RNA, 17 nt, Mycobacterium bovis subsp bovis AF2122/97
ggucaccagcgcaucgg

SEQ ID NO: 3165719 - RNA, 19 nt, Mycobacterium bovis subsp bovis AF2122/97
ggucaccauggcgccgcgc

SEQ ID NO: 3165720 - RNA, 22 nt, Mycobacterium bovis subsp bovis AF2122/97
ggucacccaauucacgacgccg

SEQ ID NO: 3165721 - RNA, 24 nt, Mycobacterium bovis subsp bovis AF2122/97
ggucacccacguugaugaugccgg

SEQ ID NO: 3165722 - RNA, 20 nt, Mycobacterium bovis subsp bovis AF2122/97
ggucacccccggccagcguc

SEQ ID NO: 3165723 - RNA, 21 nt, Mycobacterium bovis subsp bovis AF2122/97
ggucaccccggcucggccacc

SEQ ID NO: 3165724 - RNA, 18 nt, Mycobacterium bovis subsp bovis AF2122/97
ggucagguugucggcgau

SEQ ID NO: 3165725 - RNA, 21 nt, Mycobacterium bovis subsp bovis AF2122/97
ggucagguugucggcgaucaa

SEQ ID NO: 3165726 - RNA, 15 nt, Mycobacterium bovis subsp bovis AF2122/97
ggucaguccgacacc

SEQ ID NO: 3165727 - RNA, 17 nt, Mycobacterium bovis subsp bovis AF2122/97
ggucaguccgacaccgg

SEQ ID NO: 3165728 - RNA, 13 nt, Mycobacterium bovis subsp bovis AF2122/97
ggucagugcgaug

SEQ ID NO: 3165729 - RNA, 18 nt, Mycobacterium bovis subsp bovis AF2122/97
ggucagugggacgggcgc

SEQ ID NO: 3165730 - RNA, 20 nt, Mycobacterium bovis subsp bovis AF2122/97
ggucagugggacgggcgcgu

SEQ ID NO: 3165731 - RNA, 16 nt, Mycobacterium bovis subsp bovis AF2122/97
ggucaguucccagacc

SEQ ID NO: 3165732 - RNA, 14 nt, Mycobacterium bovis subsp bovis AF2122/97
ggucaguuccucua

SEQ ID NO: 3165733 - RNA, 15 nt, Mycobacterium bovis subsp bovis AF2122/97
ggucauauugcggug

SEQ ID NO: 3165734 - RNA, 23 nt, Mycobacterium bovis subsp bovis AF2122/97
ggucaucaacgccacgaugaccg

SEQ ID NO: 3165735 - RNA, 19 nt, Mycobacterium bovis subsp bovis AF2122/97
ggucaucccuuucgcgccg

SEQ ID NO: 3165736 - RNA, 20 nt, Mycobacterium bovis subsp bovis AF2122/97
ggucaucccuuucgcgccgc

SEQ ID NO: 3165737 - RNA, 22 nt, Mycobacterium bovis subsp bovis AF2122/97
ggucaucccuuucgcgccgcga

SEQ ID NO: 3165738 - RNA, 13 nt, Mycobacterium bovis subsp bovis AF2122/97
ggucauccggccg

SEQ ID NO: 3165739 - RNA, 18 nt, Mycobacterium bovis subsp bovis AF2122/97
ggucauccgggcgaccac

SEQ ID NO: 3165740 - RNA, 21 nt, Mycobacterium bovis subsp bovis AF2122/97
ggucauccgggcgaccaccac

SEQ ID NO: 3165741 - RNA, 12 nt, Mycobacterium bovis subsp bovis AF2122/97
ggucaucgccac

SEQ ID NO: 3165742 - RNA, 19 nt, Mycobacterium bovis subsp bovis AF2122/97
ggucaucgccacgccugcu

SEQ ID NO: 3165743 - RNA, 20 nt, Mycobacterium bovis subsp bovis AF2122/97
ggucaucgccagcggcaauc

SEQ ID NO: 3165744 - RNA, 21 nt, Mycobacterium bovis subsp bovis AF2122/97
ggucaucgguugaccggucga

SEQ ID NO: 3165745 - RNA, 15 nt, Mycobacterium bovis subsp bovis AF2122/97
ggucaugauccgaac

SEQ ID NO: 3165746 - RNA, 15 nt, Mycobacterium bovis subsp bovis AF2122/97
ggucaugucgaucag

SEQ ID NO: 3165747 - RNA, 17 nt, Mycobacterium bovis subsp bovis AF2122/97
ggucauguucggggcgc

SEQ ID NO: 3165748 - RNA, 17 nt, Mycobacterium bovis subsp bovis AF2122/97
ggucauugggguggcau

SEQ ID NO: 3165749 - RNA, 14 nt, Mycobacterium bovis subsp bovis AF2122/97
gguccaaagcacgu

SEQ ID NO: 3165750 - RNA, 14 nt, Mycobacterium bovis subsp bovis AF2122/97
gguccaacagcgcc

SEQ ID NO: 3165751 - RNA, 19 nt, Mycobacterium bovis subsp bovis AF2122/97
gguccaacagcgccaguag

SEQ ID NO: 3165752 - RNA, 15 nt, Mycobacterium bovis subsp bovis AF2122/97
gguccaaccagcacc

SEQ ID NO: 3165753 - RNA, 16 nt, Mycobacterium bovis subsp bovis AF2122/97
gguccaaccgggccgg

SEQ ID NO: 3165754 - RNA, 18 nt, Mycobacterium bovis subsp bovis AF2122/97
gguccaaccgggccggcu

SEQ ID NO: 3165755 - RNA, 20 nt, Mycobacterium bovis subsp bovis AF2122/97
gguccaaguccuccacggcg

SEQ ID NO: 3165756 - RNA, 22 nt, Mycobacterium bovis subsp bovis AF2122/97
gguccaagugcuuccggccauu

SEQ ID NO: 3165757 - RNA, 16 nt, Mycobacterium bovis subsp bovis AF2122/97
gguccaagugggccgg

SEQ ID NO: 3165758 - RNA, 17 nt, Mycobacterium bovis subsp bovis AF2122/97
gguccaagugggccggc

SEQ ID NO: 3165759 - RNA, 20 nt, Mycobacterium bovis subsp bovis AF2122/97
gguccaagugggccggcggu

SEQ ID NO: 3165760 - RNA, 15 nt, Mycobacterium bovis subsp bovis AF2122/97
gguccacagccggcg

SEQ ID NO: 3165761 - RNA, 17 nt, Mycobacterium bovis subsp bovis AF2122/97
gguccacagccggcggc

SEQ ID NO: 3165762 - RNA, 17 nt, Mycobacterium bovis subsp bovis AF2122/97
gguccacauccagggug

SEQ ID NO: 3165763 - RNA, 15 nt, Mycobacterium bovis subsp bovis AF2122/97
gguccaccccgccga

SEQ ID NO: 3165764 - RNA, 20 nt, Mycobacterium bovis subsp bovis AF2122/97
gguccaccccgccgaucacc

SEQ ID NO: 3165765 - RNA, 21 nt, Mycobacterium bovis subsp bovis AF2122/97
gguccaccgaccuaccgucga

SEQ ID NO: 3165766 - RNA, 19 nt, Mycobacterium bovis subsp bovis AF2122/97
gguccaccggcccucgcca

SEQ ID NO: 3165767 - RNA, 20 nt, Mycobacterium bovis subsp bovis AF2122/97
gguccacgccaggagcgugu

SEQ ID NO: 3165768 - RNA, 20 nt, Mycobacterium bovis subsp bovis AF2122/97
gguccacgcgcucggugccg

SEQ ID NO: 3165769 - RNA, 23 nt, Mycobacterium bovis subsp bovis AF2122/97
gguccagacaucagugcgccggc

SEQ ID NO: 3165770 - RNA, 16 nt, Mycobacterium bovis subsp bovis AF2122/97
gguccagacccagcuc

SEQ ID NO: 3165771 - RNA, 17 nt, Mycobacterium bovis subsp bovis AF2122/97
gguccagcacaucggcg

SEQ ID NO: 3165772 - RNA, 15 nt, Mycobacterium bovis subsp bovis AF2122/97
gguccagcagcucgg

SEQ ID NO: 3165773 - RNA, 22 nt, Mycobacterium bovis subsp bovis AF2122/97
gguccagcagcucggccgaggc

SEQ ID NO: 3165774 - RNA, 13 nt, Mycobacterium bovis subsp bovis AF2122/97
gguccagccaacg

SEQ ID NO: 3165775 - RNA, 18 nt, Mycobacterium bovis subsp bovis AF2122/97
gguccagccaacgggaac

SEQ ID NO: 3165776 - RNA, 15 nt, Mycobacterium bovis subsp bovis AF2122/97
gguccagccaccgac

SEQ ID NO: 3165777 - RNA, 21 nt, Mycobacterium bovis subsp bovis AF2122/97
gguccagccaccgaccccgga

SEQ ID NO: 3165778 - RNA, 13 nt, Mycobacterium bovis subsp bovis AF2122/97
gguccagcccagc

SEQ ID NO: 3165779 - RNA, 20 nt, Mycobacterium bovis subsp bovis AF2122/97
gguccagccgguagagcggg

SEQ ID NO: 3165780 - RNA, 12 nt, Mycobacterium bovis subsp bovis AF2122/97
gguccagcgagg

SEQ ID NO: 3165781 - RNA, 17 nt, Mycobacterium bovis subsp bovis AF2122/97
gguccagcggccgccgc

SEQ ID NO: 3165782 - RNA, 14 nt, Mycobacterium bovis subsp bovis AF2122/97
gguccaggccggca

SEQ ID NO: 3165783 - RNA, 22 nt, Mycobacterium bovis subsp bovis AF2122/97
gguccaggcguuggaucccagc

SEQ ID NO: 3165784 - RNA, 15 nt, Mycobacterium bovis subsp bovis AF2122/97
gguccaucagcacgg

SEQ ID NO: 3165785 - RNA, 18 nt, Mycobacterium bovis subsp bovis AF2122/97
gguccaucgcgcugcggc

SEQ ID NO: 3165786 - RNA, 18 nt, Mycobacterium bovis subsp bovis AF2122/97
gguccauggacggccagg

SEQ ID NO: 3165787 - RNA, 15 nt, Mycobacterium bovis subsp bovis AF2122/97
gguccauucguccgc

SEQ ID NO: 3165788 - RNA, 20 nt, Mycobacterium bovis subsp bovis AF2122/97
ggucccaaucgucggccagc

SEQ ID NO: 3165789 - RNA, 19 nt, Mycobacterium bovis subsp bovis AF2122/97
ggucccaccgcauugggcc

SEQ ID NO: 3165790 - RNA, 17 nt, Mycobacterium bovis subsp bovis AF2122/97
ggucccagccuggcaac

SEQ ID NO: 3165791 - RNA, 17 nt, Mycobacterium bovis subsp bovis AF2122/97
gguccccacauggcccg

SEQ ID NO: 3165792 - RNA, 19 nt, Mycobacterium bovis subsp bovis AF2122/97
gguccccacauggcccgga

SEQ ID NO: 3165793 - RNA, 20 nt, Mycobacterium bovis subsp bovis AF2122/97
ggucccccgaaguggugacc

SEQ ID NO: 3165794 - RNA, 17 nt, Mycobacterium bovis subsp bovis AF2122/97
gguccccgacaacggcg

SEQ ID NO: 3165795 - RNA, 20 nt, Mycobacterium bovis subsp bovis AF2122/97
gguccccgacaacggcggca

SEQ ID NO: 3165796 - RNA, 18 nt, Mycobacterium bovis subsp bovis AF2122/97
gguccccucccaccagcg

SEQ ID NO: 3165797 - RNA, 21 nt, Mycobacterium bovis subsp bovis AF2122/97
gguccccucggugccacugcc

SEQ ID NO: 3165798 - RNA, 15 nt, Mycobacterium bovis subsp bovis AF2122/97
ggucccgcauauccg

SEQ ID NO: 3165799 - RNA, 19 nt, Mycobacterium bovis subsp bovis AF2122/97
ggucccgccgaccgacacc

SEQ ID NO: 3165800 - RNA, 15 nt, Mycobacterium bovis subsp bovis AF2122/97
ggucccgccgccugg

SEQ ID NO: 3165801 - RNA, 21 nt, Mycobacterium bovis subsp bovis AF2122/97
ggucccgccgggugucggugg

SEQ ID NO: 3165802 - RNA, 15 nt, Mycobacterium bovis subsp bovis AF2122/97
ggucccgccgugccg

SEQ ID NO: 3165803 - RNA, 20 nt, Mycobacterium bovis subsp bovis AF2122/97
ggucccgccgugccgcggcg

SEQ ID NO: 3165804 - RNA, 21 nt, Mycobacterium bovis subsp bovis AF2122/97
ggucccgccgugccgcggcga

SEQ ID NO: 3165805 - RNA, 20 nt, Mycobacterium bovis subsp bovis AF2122/97
ggucccgcucuggucgucga

SEQ ID NO: 3165806 - RNA, 18 nt, Mycobacterium bovis subsp bovis AF2122/97
ggucccggugaugaccgg

SEQ ID NO: 3165807 - RNA, 13 nt, Mycobacterium bovis subsp bovis AF2122/97
ggucccguugccg

SEQ ID NO: 3165808 - RNA, 17 nt, Mycobacterium bovis subsp bovis AF2122/97
ggucccuccgacuaacg

SEQ ID NO: 3165809 - RNA, 19 nt, Mycobacterium bovis subsp bovis AF2122/97
ggucccugaagccagcgca

SEQ ID NO: 3165810 - RNA, 23 nt, Mycobacterium bovis subsp bovis AF2122/97
ggucgagauuggguccagcgagg

SEQ ID NO: 3165811 - RNA, 15 nt, Mycobacterium bovis subsp bovis AF2122/97
ggucgagcaccggcu

SEQ ID NO: 3165812 - RNA, 12 nt, Mycobacterium bovis subsp bovis AF2122/97
ggucgagcaggc

SEQ ID NO: 3165813 - RNA, 21 nt, Mycobacterium bovis subsp bovis AF2122/97
ggucgagcagugccucggcga

SEQ ID NO: 3165814 - RNA, 16 nt, Mycobacterium bovis subsp bovis AF2122/97
ggucgagccacccacc

SEQ ID NO: 3165815 - RNA, 20 nt, Mycobacterium bovis subsp bovis AF2122/97
ggucgagcgaacccuucgcg

SEQ ID NO: 3165816 - RNA, 15 nt, Mycobacterium bovis subsp bovis AF2122/97
ggucgagcgacccca

SEQ ID NO: 3165817 - RNA, 20 nt, Mycobacterium bovis subsp bovis AF2122/97
ggucgagcgcuucgucgccg

SEQ ID NO: 3165818 - RNA, 16 nt, Mycobacterium bovis subsp bovis AF2122/97
ggucgagcggucgcgg

SEQ ID NO: 3165819 - RNA, 18 nt, Mycobacterium bovis subsp bovis AF2122/97
ggucgagcggucgcggua

SEQ ID NO: 3165820 - RNA, 16 nt, Mycobacterium bovis subsp bovis AF2122/97
ggucgaggucggcgau

SEQ ID NO: 3165821 - RNA, 16 nt, Mycobacterium bovis subsp bovis AF2122/97
ggucgagguggggugg

SEQ ID NO: 3165822 - RNA, 21 nt, Mycobacterium bovis subsp bovis AF2122/97
ggucgaucaccgacaccgugu

SEQ ID NO: 3165823 - RNA, 21 nt, Mycobacterium bovis subsp bovis AF2122/97
ggucgaucaggggcccacccg

SEQ ID NO: 3165824 - RNA, 12 nt, Mycobacterium bovis subsp bovis AF2122/97
ggucgaucaguu

SEQ ID NO: 3165825 - RNA, 19 nt, Mycobacterium bovis subsp bovis AF2122/97
ggucgaucaugacgagccg

SEQ ID NO: 3165826 - RNA, 17 nt, Mycobacterium bovis subsp bovis AF2122/97
ggucgaucauggcggca

SEQ ID NO: 3165827 - RNA, 19 nt, Mycobacterium bovis subsp bovis AF2122/97
ggucgauccacucggcgau

SEQ ID NO: 3165828 - RNA, 23 nt, Mycobacterium bovis subsp bovis AF2122/97
ggucgaucgaauugcguucgccg

SEQ ID NO: 3165829 - RNA, 14 nt, Mycobacterium bovis subsp bovis AF2122/97
ggucgaugccgaug

SEQ ID NO: 3165830 - RNA, 20 nt, Mycobacterium bovis subsp bovis AF2122/97
ggucgaugcgggcgacgaag

SEQ ID NO: 3165831 - RNA, 14 nt, Mycobacterium bovis subsp bovis AF2122/97
ggucgaugcucagu

SEQ ID NO: 3165832 - RNA, 16 nt, Mycobacterium bovis subsp bovis AF2122/97
ggucgaugcugccagc

SEQ ID NO: 3165833 - RNA, 19 nt, Mycobacterium bovis subsp bovis AF2122/97
ggucgaugucagccaccau

SEQ ID NO: 3165834 - RNA, 19 nt, Mycobacterium bovis subsp bovis AF2122/97
ggucgauguccgcagcacc

SEQ ID NO: 3165835 - RNA, 15 nt, Mycobacterium bovis subsp bovis AF2122/97
ggucgaugucggcga

SEQ ID NO: 3165836 - RNA, 23 nt, Mycobacterium bovis subsp bovis AF2122/97
ggucgaugucggcgaaccacggc

SEQ ID NO: 3165837 - RNA, 20 nt, Mycobacterium bovis subsp bovis AF2122/97
ggucgcaccacagugccaau

SEQ ID NO: 3165838 - RNA, 20 nt, Mycobacterium bovis subsp bovis AF2122/97
ggucgcaccccggcggcguc

SEQ ID NO: 3165839 - RNA, 14 nt, Mycobacterium bovis subsp bovis AF2122/97
ggucgcaccgccgg

SEQ ID NO: 3165840 - RNA, 15 nt, Mycobacterium bovis subsp bovis AF2122/97
ggucgcagaccagac

SEQ ID NO: 3165841 - RNA, 16 nt, Mycobacterium bovis subsp bovis AF2122/97
ggucgcagcagaccac

SEQ ID NO: 3165842 - RNA, 22 nt, Mycobacterium bovis subsp bovis AF2122/97
ggucgcagcagaccacaacgcc

SEQ ID NO: 3165843 - RNA, 17 nt, Mycobacterium bovis subsp bovis AF2122/97
ggucgcagcucgucgug

SEQ ID NO: 3165844 - RNA, 23 nt, Mycobacterium bovis subsp bovis AF2122/97
ggucgcaguacuugguugcgacg

SEQ ID NO: 3165845 - RNA, 15 nt, Mycobacterium bovis subsp bovis AF2122/97
ggucgcagugcaccc

SEQ ID NO: 3165846 - RNA, 21 nt, Mycobacterium bovis subsp bovis AF2122/97
ggucgcagugcacccgggccg

SEQ ID NO: 3165847 - RNA, 17 nt, Mycobacterium bovis subsp bovis AF2122/97
ggucgccaacgccagca

SEQ ID NO: 3165848 - RNA, 18 nt, Mycobacterium bovis subsp bovis AF2122/97
ggucgccaacgccagcac

SEQ ID NO: 3165849 - RNA, 22 nt, Mycobacterium bovis subsp bovis AF2122/97
ggucgccaacgccagcaccagc

SEQ ID NO: 3165850 - RNA, 23 nt, Mycobacterium bovis subsp bovis AF2122/97
ggucgccaacgccagcaccagcg

SEQ ID NO: 3165851 - RNA, 13 nt, Mycobacterium bovis subsp bovis AF2122/97
ggucgccaagauc

SEQ ID NO: 3165852 - RNA, 17 nt, Mycobacterium bovis subsp bovis AF2122/97
ggucgccaagugcaggg

SEQ ID NO: 3165853 - RNA, 16 nt, Mycobacterium bovis subsp bovis AF2122/97
ggucgccaccgccggc

SEQ ID NO: 3165854 - RNA, 17 nt, Mycobacterium bovis subsp bovis AF2122/97
ggucgccaccgccggca

SEQ ID NO: 3165855 - RNA, 13 nt, Mycobacterium bovis subsp bovis AF2122/97
ggucgccagcucg

SEQ ID NO: 3165856 - RNA, 20 nt, Mycobacterium bovis subsp bovis AF2122/97
ggucgccaugucggccaggu

SEQ ID NO: 3165857 - RNA, 19 nt, Mycobacterium bovis subsp bovis AF2122/97
ggucgcccaacaccgcgcc

SEQ ID NO: 3165858 - RNA, 17 nt, Mycobacterium bovis subsp bovis AF2122/97
ggucgccccgaugaccg

SEQ ID NO: 3165859 - RNA, 14 nt, Mycobacterium bovis subsp bovis AF2122/97
ggucgcccgugucg

SEQ ID NO: 3165860 - RNA, 15 nt, Mycobacterium bovis subsp bovis AF2122/97
ggucgccgacggcga

SEQ ID NO: 3165861 - RNA, 14 nt, Mycobacterium bovis subsp bovis AF2122/97
ggucgccgaugacg

SEQ ID NO: 3165862 - RNA, 19 nt, Mycobacterium bovis subsp bovis AF2122/97
ggucgccgccaucagcccu

SEQ ID NO: 3165863 - RNA, 17 nt, Mycobacterium bovis subsp bovis AF2122/97
ggucgccgccgccacgg

SEQ ID NO: 3165864 - RNA, 14 nt, Mycobacterium bovis subsp bovis AF2122/97
ggucgccggcaccg

SEQ ID NO: 3165865 - RNA, 15 nt, Mycobacterium bovis subsp bovis AF2122/97
ggucgccggcgucga

SEQ ID NO: 3165866 - RNA, 19 nt, Mycobacterium bovis subsp bovis AF2122/97
ggucgccggcgucgagccg

SEQ ID NO: 3165867 - RNA, 21 nt, Mycobacterium bovis subsp bovis AF2122/97
ggucgccggcgucgagccgga

SEQ ID NO: 3165868 - RNA, 16 nt, Mycobacterium bovis subsp bovis AF2122/97
ggucgccggggccgcu

SEQ ID NO: 3165869 - RNA, 13 nt, Mycobacterium bovis subsp bovis AF2122/97
ggucgccuccucg

SEQ ID NO: 3165870 - RNA, 19 nt, Mycobacterium bovis subsp bovis AF2122/97
ggucgccuccugccgccgc

SEQ ID NO: 3165871 - RNA, 22 nt, Mycobacterium bovis subsp bovis AF2122/97
ggucgccugcgggaacgcggcg

SEQ ID NO: 3165872 - RNA, 19 nt, Mycobacterium bovis subsp bovis AF2122/97
ggucgcgacuaccaucgcc

SEQ ID NO: 3165873 - RNA, 14 nt, Mycobacterium bovis subsp bovis AF2122/97
ggucgcgauagccg

SEQ ID NO: 3165874 - RNA, 13 nt, Mycobacterium bovis subsp bovis AF2122/97
ggucgcgaugacg

SEQ ID NO: 3165875 - RNA, 22 nt, Mycobacterium bovis subsp bovis AF2122/97
ggucgcgcauuucguggcgcgc

SEQ ID NO: 3165876 - RNA, 19 nt, Mycobacterium bovis subsp bovis AF2122/97
ggucgcgcccucagccgcg

SEQ ID NO: 3165877 - RNA, 23 nt, Mycobacterium bovis subsp bovis AF2122/97
ggucgcgcgaauggucagcgucg

SEQ ID NO: 3165878 - RNA, 15 nt, Mycobacterium bovis subsp bovis AF2122/97
ggucgcgcgauggac

SEQ ID NO: 3165879 - RNA, 14 nt, Mycobacterium bovis subsp bovis AF2122/97
ggucgcgcggcacc

SEQ ID NO: 3165880 - RNA, 17 nt, Mycobacterium bovis subsp bovis AF2122/97
ggucgcgcggcaccgau

SEQ ID NO: 3165881 - RNA, 22 nt, Mycobacterium bovis subsp bovis AF2122/97
ggucgcgcggcaccgauggcgc

SEQ ID NO: 3165882 - RNA, 13 nt, Mycobacterium bovis subsp bovis AF2122/97
ggucgcggcgguc

SEQ ID NO: 3165883 - RNA, 20 nt, Mycobacterium bovis subsp bovis AF2122/97
ggucgcggcuauggcgccgc

SEQ ID NO: 3165884 - RNA, 13 nt, Mycobacterium bovis subsp bovis AF2122/97
ggucgcggggccg

SEQ ID NO: 3165885 - RNA, 21 nt, Mycobacterium bovis subsp bovis AF2122/97
ggucgcggggccggaugacga

SEQ ID NO: 3165886 - RNA, 19 nt, Mycobacterium bovis subsp bovis AF2122/97
ggucgcgggguaggcccag

SEQ ID NO: 3165887 - RNA, 21 nt, Mycobacterium bovis subsp bovis AF2122/97
ggucgcgggguaggcccagca

SEQ ID NO: 3165888 - RNA, 17 nt, Mycobacterium bovis subsp bovis AF2122/97
ggucgcgggugccgaag

SEQ ID NO: 3165889 - RNA, 22 nt, Mycobacterium bovis subsp bovis AF2122/97
ggucgcggucccacggccggcc

SEQ ID NO: 3165890 - RNA, 18 nt, Mycobacterium bovis subsp bovis AF2122/97
ggucgcgguggcggcggu

SEQ ID NO: 3165891 - RNA, 13 nt, Mycobacterium bovis subsp bovis AF2122/97
ggucgcguccacc

SEQ ID NO: 3165892 - RNA, 17 nt, Mycobacterium bovis subsp bovis AF2122/97
ggucgcguccacccacg

SEQ ID NO: 3165893 - RNA, 22 nt, Mycobacterium bovis subsp bovis AF2122/97
ggucgcguccacccacgaucag

SEQ ID NO: 3165894 - RNA, 23 nt, Mycobacterium bovis subsp bovis AF2122/97
ggucgcguugcagaccaccagug

SEQ ID NO: 3165895 - RNA, 18 nt, Mycobacterium bovis subsp bovis AF2122/97
ggucgcguuucgcagccg

SEQ ID NO: 3165896 - RNA, 17 nt, Mycobacterium bovis subsp bovis AF2122/97
ggucggugagccgugcc

SEQ ID NO: 3165897 - RNA, 20 nt, Mycobacterium bovis subsp bovis AF2122/97
ggucggugaggucgaugccg

SEQ ID NO: 3165898 - RNA, 20 nt, Mycobacterium bovis subsp bovis AF2122/97
ggucggugauggucagcugg

SEQ ID NO: 3165899 - RNA, 21 nt, Mycobacterium bovis subsp bovis AF2122/97
ggucggugauggucagcuggc

SEQ ID NO: 3165900 - RNA, 13 nt, Mycobacterium bovis subsp bovis AF2122/97
ggucggugcgguc

SEQ ID NO: 3165901 - RNA, 15 nt, Mycobacterium bovis subsp bovis AF2122/97
ggucggugggcggcg

SEQ ID NO: 3165902 - RNA, 23 nt, Mycobacterium bovis subsp bovis AF2122/97
ggucggugggcuugccgcgcacc

SEQ ID NO: 3165903 - RNA, 20 nt, Mycobacterium bovis subsp bovis AF2122/97
ggucggugugcaucgccggc

SEQ ID NO: 3165904 - RNA, 14 nt, Mycobacterium bovis subsp bovis AF2122/97
ggucgguuccggug

SEQ ID NO: 3165905 - RNA, 18 nt, Mycobacterium bovis subsp bovis AF2122/97
ggucgguuuccuccggca

SEQ ID NO: 3165906 - RNA, 20 nt, Mycobacterium bovis subsp bovis AF2122/97
ggucguacaacacgggcagc

SEQ ID NO: 3165907 - RNA, 21 nt, Mycobacterium bovis subsp bovis AF2122/97
ggucguacaacacgggcagcu

SEQ ID NO: 3165908 - RNA, 15 nt, Mycobacterium bovis subsp bovis AF2122/97
ggucguaggacacca

SEQ ID NO: 3165909 - RNA, 18 nt, Mycobacterium bovis subsp bovis AF2122/97
ggucguaggacaccaccg

SEQ ID NO: 3165910 - RNA, 20 nt, Mycobacterium bovis subsp bovis AF2122/97
ggucguaggacaccaccgug

SEQ ID NO: 3165911 - RNA, 18 nt, Mycobacterium bovis subsp bovis AF2122/97
ggucgucacggaccgcca

SEQ ID NO: 3165912 - RNA, 15 nt, Mycobacterium bovis subsp bovis AF2122/97
ggucgucaugccagu

SEQ ID NO: 3165913 - RNA, 21 nt, Mycobacterium bovis subsp bovis AF2122/97
ggucguccccgucgcuggccg

SEQ ID NO: 3165914 - RNA, 16 nt, Mycobacterium bovis subsp bovis AF2122/97
ggucgucccgauggcg

SEQ ID NO: 3165915 - RNA, 17 nt, Mycobacterium bovis subsp bovis AF2122/97
ggucgucccgauggcgg

SEQ ID NO: 3165916 - RNA, 16 nt, Mycobacterium bovis subsp bovis AF2122/97
ggucgucccgcccauc

SEQ ID NO: 3165917 - RNA, 23 nt, Mycobacterium bovis subsp bovis AF2122/97
ggucguccgccugcaccgccgcc

SEQ ID NO: 3165918 - RNA, 13 nt, Mycobacterium bovis subsp bovis AF2122/97
ggucgucgaacgg

SEQ ID NO: 3165919 - RNA, 15 nt, Mycobacterium bovis subsp bovis AF2122/97
ggucgucggcgucgc

SEQ ID NO: 3165920 - RNA, 19 nt, Mycobacterium bovis subsp bovis AF2122/97
ggucgucguugugauccgg

SEQ ID NO: 3165921 - RNA, 14 nt, Mycobacterium bovis subsp bovis AF2122/97
ggucgugcaggcga

SEQ ID NO: 3165922 - RNA, 18 nt, Mycobacterium bovis subsp bovis AF2122/97
ggucgugcaggcgacggc

SEQ ID NO: 3165923 - RNA, 20 nt, Mycobacterium bovis subsp bovis AF2122/97
ggucgugcaggcgacggcuc

SEQ ID NO: 3165924 - RNA, 14 nt, Mycobacterium bovis subsp bovis AF2122/97
ggucgugccagcag

SEQ ID NO: 3165925 - RNA, 15 nt, Mycobacterium bovis subsp bovis AF2122/97
ggucgugccagcagc

SEQ ID NO: 3165926 - RNA, 17 nt, Mycobacterium bovis subsp bovis AF2122/97
ggucgugccccggcgcg

SEQ ID NO: 3165927 - RNA, 17 nt, Mycobacterium bovis subsp bovis AF2122/97
ggucgugcccgggacca

SEQ ID NO: 3165928 - RNA, 22 nt, Mycobacterium bovis subsp bovis AF2122/97
ggucguggugcaacacgccggc

SEQ ID NO: 3165929 - RNA, 23 nt, Mycobacterium bovis subsp bovis AF2122/97
ggucguggugcaacacgccggcc

SEQ ID NO: 3165930 - RNA, 14 nt, Mycobacterium bovis subsp bovis AF2122/97
ggucguucaccgau

SEQ ID NO: 3165931 - RNA, 16 nt, Mycobacterium bovis subsp bovis AF2122/97
ggucguucaccgaucc

SEQ ID NO: 3165932 - RNA, 13 nt, Mycobacterium bovis subsp bovis AF2122/97
ggucguucgccga

SEQ ID NO: 3165933 - RNA, 14 nt, Mycobacterium bovis subsp bovis AF2122/97
ggucguugaggccg

SEQ ID NO: 3165934 - RNA, 15 nt, Mycobacterium bovis subsp bovis AF2122/97
ggucguugaggccgg

SEQ ID NO: 3165935 - RNA, 17 nt, Mycobacterium bovis subsp bovis AF2122/97
ggucguugccgcggucg

SEQ ID NO: 3165936 - RNA, 17 nt, Mycobacterium bovis subsp bovis AF2122/97
ggucguugccggacaac

SEQ ID NO: 3165937 - RNA, 17 nt, Mycobacterium bovis subsp bovis AF2122/97
ggucguuggcggcgguc

SEQ ID NO: 3165938 - RNA, 15 nt, Mycobacterium bovis subsp bovis AF2122/97
ggucguuggucgggg

SEQ ID NO: 3165939 - RNA, 21 nt, Mycobacterium bovis subsp bovis AF2122/97
ggucguuggugcagaccaccg

SEQ ID NO: 3165940 - RNA, 18 nt, Mycobacterium bovis subsp bovis AF2122/97
ggucguugucgggguugc

SEQ ID NO: 3165941 - RNA, 23 nt, Mycobacterium bovis subsp bovis AF2122/97
ggucguuucccuggccgccgccg

SEQ ID NO: 3165942 - RNA, 23 nt, Mycobacterium bovis subsp bovis AF2122/97
ggucuaccuuuuuggcacccacg

SEQ ID NO: 3165943 - RNA, 13 nt, Mycobacterium bovis subsp bovis AF2122/97
ggucuacgccacc

SEQ ID NO: 3165944 - RNA, 23 nt, Mycobacterium bovis subsp bovis AF2122/97
ggucuacgccaccgagaucggac

SEQ ID NO: 3165945 - RNA, 22 nt, Mycobacterium bovis subsp bovis AF2122/97
ggucucaacgcaucgguggcac

SEQ ID NO: 3165946 - RNA, 23 nt, Mycobacterium bovis subsp bovis AF2122/97
ggucucccagaggucgagcgccu

SEQ ID NO: 3165947 - RNA, 15 nt, Mycobacterium bovis subsp bovis AF2122/97
ggucucccggcugau

SEQ ID NO: 3165948 - RNA, 23 nt, Mycobacterium bovis subsp bovis AF2122/97
ggucuccgaacggguagacccac

SEQ ID NO: 3165949 - RNA, 17 nt, Mycobacterium bovis subsp bovis AF2122/97
ggucuccggaucgccga

SEQ ID NO: 3165950 - RNA, 15 nt, Mycobacterium bovis subsp bovis AF2122/97
ggucuccggcgcacc

SEQ ID NO: 3165951 - RNA, 17 nt, Mycobacterium bovis subsp bovis AF2122/97
ggucuccuugggcgacg

SEQ ID NO: 3165952 - RNA, 19 nt, Mycobacterium bovis subsp bovis AF2122/97
ggucucgaacuccaugccg

SEQ ID NO: 3165953 - RNA, 15 nt, Mycobacterium bovis subsp bovis AF2122/97
ggucucgaccuucgg

SEQ ID NO: 3165954 - RNA, 14 nt, Mycobacterium bovis subsp bovis AF2122/97
ggucucgacggcgg

SEQ ID NO: 3165955 - RNA, 14 nt, Mycobacterium bovis subsp bovis AF2122/97
ggucucgcaccagu

SEQ ID NO: 3165956 - RNA, 20 nt, Mycobacterium bovis subsp bovis AF2122/97
ggucucggaaacggaccucc

SEQ ID NO: 3165957 - RNA, 22 nt, Mycobacterium bovis subsp bovis AF2122/97
ggucugacagaccgggcaccag

SEQ ID NO: 3165958 - RNA, 23 nt, Mycobacterium bovis subsp bovis AF2122/97
ggucugcagaucguagugcgcgc

SEQ ID NO: 3165959 - RNA, 19 nt, Mycobacterium bovis subsp bovis AF2122/97
ggucugcgccgccggcggc

SEQ ID NO: 3165960 - RNA, 20 nt, Mycobacterium bovis subsp bovis AF2122/97
ggucugcgccgccggcggcg

SEQ ID NO: 3165961 - RNA, 21 nt, Mycobacterium bovis subsp bovis AF2122/97
ggucugcgccgccggcggcgg

SEQ ID NO: 3165962 - RNA, 22 nt, Mycobacterium bovis subsp bovis AF2122/97
ggucugcuauugguugaggagg

SEQ ID NO: 3165963 - RNA, 23 nt, Mycobacterium bovis subsp bovis AF2122/97
ggucugcuauugguugaggaggu

SEQ ID NO: 3165964 - RNA, 10 nt, Mycobacterium bovis subsp bovis AF2122/97
ggucugcuca

SEQ ID NO: 3165965 - RNA, 19 nt, Mycobacterium bovis subsp bovis AF2122/97
ggucuggacaucggccggc

SEQ ID NO: 3165966 - RNA, 14 nt, Mycobacterium bovis subsp bovis AF2122/97
ggucuggcccgcga

SEQ ID NO: 3165967 - RNA, 15 nt, Mycobacterium bovis subsp bovis AF2122/97
ggucuguuggugaca

SEQ ID NO: 3165968 - RNA, 20 nt, Mycobacterium bovis subsp bovis AF2122/97
ggucuucaggccgcgcaugg

SEQ ID NO: 3165969 - RNA, 20 nt, Mycobacterium bovis subsp bovis AF2122/97
ggucuuccggugcgccgauc

SEQ ID NO: 3165970 - RNA, 15 nt, Mycobacterium bovis subsp bovis AF2122/97
ggucuucgaccacgg

SEQ ID NO: 3165971 - RNA, 16 nt, Mycobacterium bovis subsp bovis AF2122/97
ggucuugcaucgccaa

SEQ ID NO: 3165972 - RNA, 14 nt, Mycobacterium bovis subsp bovis AF2122/97
ggucuugccgcagg

SEQ ID NO: 3165973 - RNA, 17 nt, Mycobacterium bovis subsp bovis AF2122/97
ggucuuggauccggccg

SEQ ID NO: 3165974 - RNA, 21 nt, Mycobacterium bovis subsp bovis AF2122/97
ggucuuggauccggccgccaa

SEQ ID NO: 3165975 - RNA, 13 nt, Mycobacterium bovis subsp bovis AF2122/97
ggucuuggcggug

SEQ ID NO: 3165976 - RNA, 20 nt, Mycobacterium bovis subsp bovis AF2122/97
ggucuugggcgcgggugcgc

SEQ ID NO: 3165977 - RNA, 20 nt, Mycobacterium bovis subsp bovis AF2122/97
ggucuuuaauccagcgccga

SEQ ID NO: 3165978 - RNA, 15 nt, Mycobacterium bovis subsp bovis AF2122/97
ggucuuugagccggu

SEQ ID NO: 3165979 - RNA, 14 nt, Mycobacterium bovis subsp bovis AF2122/97
ggucuuugcccgcc

SEQ ID NO: 3165980 - RNA, 18 nt, Mycobacterium bovis subsp bovis AF2122/97
ggucuuugcucucggucu

SEQ ID NO: 3165981 - RNA, 15 nt, Mycobacterium bovis subsp bovis AF2122/97
ggugaaaaucgccau

SEQ ID NO: 3165982 - RNA, 17 nt, Mycobacterium bovis subsp bovis AF2122/97
ggugacggaguuggccc

SEQ ID NO: 3165983 - RNA, 18 nt, Mycobacterium bovis subsp bovis AF2122/97
ggugacggccggcggucg

SEQ ID NO: 3165984 - RNA, 12 nt, Mycobacterium bovis subsp bovis AF2122/97
ggugacggcggc

SEQ ID NO: 3165985 - RNA, 14 nt, Mycobacterium bovis subsp bovis AF2122/97
ggugacggcggcaa

SEQ ID NO: 3165986 - RNA, 15 nt, Mycobacterium bovis subsp bovis AF2122/97
ggugacggcggcaac

SEQ ID NO: 3165987 - RNA, 13 nt, Mycobacterium bovis subsp bovis AF2122/97
ggugacggcggcu

SEQ ID NO: 3165988 - RNA, 12 nt, Mycobacterium bovis subsp bovis AF2122/97
ggugacggcggu

SEQ ID NO: 3165989 - RNA, 17 nt, Mycobacterium bovis subsp bovis AF2122/97
ggugacggcgguaccgc

SEQ ID NO: 3165990 - RNA, 19 nt, Mycobacterium bovis subsp bovis AF2122/97
ggugacggcgguaccgccg

SEQ ID NO: 3165991 - RNA, 16 nt, Mycobacterium bovis subsp bovis AF2122/97
ggugacggggcugacc

SEQ ID NO: 3165992 - RNA, 23 nt, Mycobacterium bovis subsp bovis AF2122/97
ggugacggucaaaugaaugguga

SEQ ID NO: 3165993 - RNA, 17 nt, Mycobacterium bovis subsp bovis AF2122/97
ggugacggugacaucgc

SEQ ID NO: 3165994 - RNA, 19 nt, Mycobacterium bovis subsp bovis AF2122/97
ggugacgguggccggcaac

SEQ ID NO: 3165995 - RNA, 16 nt, Mycobacterium bovis subsp bovis AF2122/97
ggugacgguguuggug

SEQ ID NO: 3165996 - RNA, 19 nt, Mycobacterium bovis subsp bovis AF2122/97
ggugacgguguuggugacc

SEQ ID NO: 3165997 - RNA, 21 nt, Mycobacterium bovis subsp bovis AF2122/97
ggugacgguguuggugaccgg

SEQ ID NO: 3165998 - RNA, 23 nt, Mycobacterium bovis subsp bovis AF2122/97
ggugacgguguugguggucgggu

SEQ ID NO: 3165999 - RNA, 14 nt, Mycobacterium bovis subsp bovis AF2122/97
ggugacgugguggg

SEQ ID NO: 3166000 - RNA, 19 nt, Mycobacterium bovis subsp bovis AF2122/97
ggugacguggugggcuugg

SEQ ID NO: 3166001 - RNA, 13 nt, Mycobacterium bovis subsp bovis AF2122/97
ggugacuccggcu

SEQ ID NO: 3166002 - RNA, 18 nt, Mycobacterium bovis subsp bovis AF2122/97
ggugacucggcaccugga

SEQ ID NO: 3166003 - RNA, 19 nt, Mycobacterium bovis subsp bovis AF2122/97
ggugacuucgcugcggugg

SEQ ID NO: 3166004 - RNA, 22 nt, Mycobacterium bovis subsp bovis AF2122/97
ggugagacaaaggugccgaccg

SEQ ID NO: 3166005 - RNA, 16 nt, Mycobacterium bovis subsp bovis AF2122/97
ggugagauugguggcc

SEQ ID NO: 3166006 - RNA, 22 nt, Mycobacterium bovis subsp bovis AF2122/97
ggugagcaacgcgaccaucucg

SEQ ID NO: 3166007 - RNA, 17 nt, Mycobacterium bovis subsp bovis AF2122/97
ggugagcaccugggcgc

SEQ ID NO: 3166008 - RNA, 22 nt, Mycobacterium bovis subsp bovis AF2122/97
ggugagcaccugggcgcgcugg

SEQ ID NO: 3166009 - RNA, 23 nt, Mycobacterium bovis subsp bovis AF2122/97
ggugagcaccugggcgcgcuggc

SEQ ID NO: 3166010 - RNA, 13 nt, Mycobacterium bovis subsp bovis AF2122/97
ggugagcagcucg

SEQ ID NO: 3166011 - RNA, 17 nt, Mycobacterium bovis subsp bovis AF2122/97
ggugagcagggcggcga

SEQ ID NO: 3166012 - RNA, 19 nt, Mycobacterium bovis subsp bovis AF2122/97
ggugagccaguuggccagu

SEQ ID NO: 3166013 - RNA, 19 nt, Mycobacterium bovis subsp bovis AF2122/97
ggugagcccgggauaccgc

SEQ ID NO: 3166014 - RNA, 20 nt, Mycobacterium bovis subsp bovis AF2122/97
ggugagccgguggcccgccg

SEQ ID NO: 3166015 - RNA, 19 nt, Mycobacterium bovis subsp bovis AF2122/97
ggugagccgugccgccagc

SEQ ID NO: 3166016 - RNA, 18 nt, Mycobacterium bovis subsp bovis AF2122/97
ggugagccucggcgagcc

SEQ ID NO: 3166017 - RNA, 21 nt, Mycobacterium bovis subsp bovis AF2122/97
ggugagccucuuggucaacgg

SEQ ID NO: 3166018 - RNA, 17 nt, Mycobacterium bovis subsp bovis AF2122/97
ggugagcgagcgcgcgu

SEQ ID NO: 3166019 - RNA, 12 nt, Mycobacterium bovis subsp bovis AF2122/97
ggugagcgcgcu

SEQ ID NO: 3166020 - RNA, 12 nt, Mycobacterium bovis subsp bovis AF2122/97
ggugagcucgcg

SEQ ID NO: 3166021 - RNA, 15 nt, Mycobacterium bovis subsp bovis AF2122/97
ggugaggaagcggcc

SEQ ID NO: 3166022 - RNA, 18 nt, Mycobacterium bovis subsp bovis AF2122/97
ggugaggcgggucgccgc

SEQ ID NO: 3166023 - RNA, 23 nt, Mycobacterium bovis subsp bovis AF2122/97
ggugagggaacccacaguggcuc

SEQ ID NO: 3166024 - RNA, 22 nt, Mycobacterium bovis subsp bovis AF2122/97
ggugagggguugcggucgacgu

SEQ ID NO: 3166025 - RNA, 19 nt, Mycobacterium bovis subsp bovis AF2122/97
ggugagguugacccccggg

SEQ ID NO: 3166026 - RNA, 19 nt, Mycobacterium bovis subsp bovis AF2122/97
ggugagguuggagcgccag

SEQ ID NO: 3166027 - RNA, 17 nt, Mycobacterium bovis subsp bovis AF2122/97
ggugaguccgcugagcg

SEQ ID NO: 3166028 - RNA, 20 nt, Mycobacterium bovis subsp bovis AF2122/97
ggugaguccgcugagcgggc

SEQ ID NO: 3166029 - RNA, 18 nt, Mycobacterium bovis subsp bovis AF2122/97
ggugagugcgucucggug

SEQ ID NO: 3166030 - RNA, 22 nt, Mycobacterium bovis subsp bovis AF2122/97
ggugagugcgucucgguggcug

SEQ ID NO: 3166031 - RNA, 23 nt, Mycobacterium bovis subsp bovis AF2122/97
ggugaguucgccggaggcaagca

SEQ ID NO: 3166032 - RNA, 21 nt, Mycobacterium bovis subsp bovis AF2122/97
ggugauagaggauaucgccga

SEQ ID NO: 3166033 - RNA, 16 nt, Mycobacterium bovis subsp bovis AF2122/97
ggugaucaaaccggcg

SEQ ID NO: 3166034 - RNA, 18 nt, Mycobacterium bovis subsp bovis AF2122/97
ggugaucaaaccggcggc

SEQ ID NO: 3166035 - RNA, 19 nt, Mycobacterium bovis subsp bovis AF2122/97
ggugaucaaaccggcggcg

SEQ ID NO: 3166036 - RNA, 14 nt, Mycobacterium bovis subsp bovis AF2122/97
ggugaucacgucgg

SEQ ID NO: 3166037 - RNA, 15 nt, Mycobacterium bovis subsp bovis AF2122/97
ggugaucacgucggc

SEQ ID NO: 3166038 - RNA, 14 nt, Mycobacterium bovis subsp bovis AF2122/97
ggugaucagcagca

SEQ ID NO: 3166039 - RNA, 15 nt, Mycobacterium bovis subsp bovis AF2122/97
ggugaucagcaggau

SEQ ID NO: 3166040 - RNA, 22 nt, Mycobacterium bovis subsp bovis AF2122/97
ggugaucagcaggaucggcagc

SEQ ID NO: 3166041 - RNA, 23 nt, Mycobacterium bovis subsp bovis AF2122/97
ggugaucagcaggaucggcagca

SEQ ID NO: 3166042 - RNA, 22 nt, Mycobacterium bovis subsp bovis AF2122/97
ggugaucagcucagugaugcgc

SEQ ID NO: 3166043 - RNA, 16 nt, Mycobacterium bovis subsp bovis AF2122/97
ggugauccacgcucgg

SEQ ID NO: 3166044 - RNA, 17 nt, Mycobacterium bovis subsp bovis AF2122/97
ggugauccacgcucggg

SEQ ID NO: 3166045 - RNA, 17 nt, Mycobacterium bovis subsp bovis AF2122/97
ggugauccagccgucgg

SEQ ID NO: 3166046 - RNA, 18 nt, Mycobacterium bovis subsp bovis AF2122/97
ggugauccagccgucggc

SEQ ID NO: 3166047 - RNA, 19 nt, Mycobacterium bovis subsp bovis AF2122/97
ggugaucccgauggucacu

SEQ ID NO: 3166048 - RNA, 18 nt, Mycobacterium bovis subsp bovis AF2122/97
ggugaucgagguugacgu

SEQ ID NO: 3166049 - RNA, 22 nt, Mycobacterium bovis subsp bovis AF2122/97
ggugaucgagguugacgucagg

SEQ ID NO: 3166050 - RNA, 14 nt, Mycobacterium bovis subsp bovis AF2122/97
ggugaucgccaccg

SEQ ID NO: 3166051 - RNA, 18 nt, Mycobacterium bovis subsp bovis AF2122/97
ggugaucgccggcuucgc

SEQ ID NO: 3166052 - RNA, 12 nt, Mycobacterium bovis subsp bovis AF2122/97
ggugaucggcgg

SEQ ID NO: 3166053 - RNA, 15 nt, Mycobacterium bovis subsp bovis AF2122/97
ggugaucgggcagca

SEQ ID NO: 3166054 - RNA, 17 nt, Mycobacterium bovis subsp bovis AF2122/97
ggugaucuccaccggcg

SEQ ID NO: 3166055 - RNA, 16 nt, Mycobacterium bovis subsp bovis AF2122/97
ggugaucuucuucagg

SEQ ID NO: 3166056 - RNA, 20 nt, Mycobacterium bovis subsp bovis AF2122/97
ggugaucuuggcgcccgccg

SEQ ID NO: 3166057 - RNA, 14 nt, Mycobacterium bovis subsp bovis AF2122/97
ggugaucuuguccg

SEQ ID NO: 3166058 - RNA, 18 nt, Mycobacterium bovis subsp bovis AF2122/97
ggugaugacgccgucggc

SEQ ID NO: 3166059 - RNA, 21 nt, Mycobacterium bovis subsp bovis AF2122/97
ggugaugagcgcuucgaggug

SEQ ID NO: 3166060 - RNA, 14 nt, Mycobacterium bovis subsp bovis AF2122/97
ggugaugagucagg

SEQ ID NO: 3166061 - RNA, 15 nt, Mycobacterium bovis subsp bovis AF2122/97
ggugaugagugcgga

SEQ ID NO: 3166062 - RNA, 17 nt, Mycobacterium bovis subsp bovis AF2122/97
ggugaugcaacgcggcg

SEQ ID NO: 3166063 - RNA, 18 nt, Mycobacterium bovis subsp bovis AF2122/97
ggugaugcaugcuaggca

SEQ ID NO: 3166064 - RNA, 16 nt, Mycobacterium bovis subsp bovis AF2122/97
ggugaugccaucaacg

SEQ ID NO: 3166065 - RNA, 16 nt, Mycobacterium bovis subsp bovis AF2122/97
ggugaugcccagcgcc

SEQ ID NO: 3166066 - RNA, 17 nt, Mycobacterium bovis subsp bovis AF2122/97
ggugaugcccagcgccg

SEQ ID NO: 3166067 - RNA, 15 nt, Mycobacterium bovis subsp bovis AF2122/97
ggugauggagccggu

SEQ ID NO: 3166068 - RNA, 14 nt, Mycobacterium bovis subsp bovis AF2122/97
ggugccgaacgagg

SEQ ID NO: 3166069 - RNA, 20 nt, Mycobacterium bovis subsp bovis AF2122/97
ggugccgaagaugaccgcuc

SEQ ID NO: 3166070 - RNA, 20 nt, Mycobacterium bovis subsp bovis AF2122/97
ggugccgaagcugcccaacc

SEQ ID NO: 3166071 - RNA, 16 nt, Mycobacterium bovis subsp bovis AF2122/97
ggugccgacccgccgc

SEQ ID NO: 3166072 - RNA, 17 nt, Mycobacterium bovis subsp bovis AF2122/97
ggugccgacccgccgcg

SEQ ID NO: 3166073 - RNA, 13 nt, Mycobacterium bovis subsp bovis AF2122/97
ggugccgaccgcg

SEQ ID NO: 3166074 - RNA, 16 nt, Mycobacterium bovis subsp bovis AF2122/97
ggugccgaccuguccg

SEQ ID NO: 3166075 - RNA, 16 nt, Mycobacterium bovis subsp bovis AF2122/97
ggugccgacggcgccg

SEQ ID NO: 3166076 - RNA, 16 nt, Mycobacterium bovis subsp bovis AF2122/97
ggugccgagcuggcga

SEQ ID NO: 3166077 - RNA, 17 nt, Mycobacterium bovis subsp bovis AF2122/97
ggugccgaucgaugcca

SEQ ID NO: 3166078 - RNA, 18 nt, Mycobacterium bovis subsp bovis AF2122/97
ggugccgcagcaggggac

SEQ ID NO: 3166079 - RNA, 16 nt, Mycobacterium bovis subsp bovis AF2122/97
ggugccgccaccaccg

SEQ ID NO: 3166080 - RNA, 19 nt, Mycobacterium bovis subsp bovis AF2122/97
ggugccgccaccaccggcg

SEQ ID NO: 3166081 - RNA, 21 nt, Mycobacterium bovis subsp bovis AF2122/97
ggugccgccaccaccggcgcc

SEQ ID NO: 3166082 - RNA, 16 nt, Mycobacterium bovis subsp bovis AF2122/97
ggugccgccaccggcg

SEQ ID NO: 3166083 - RNA, 17 nt, Mycobacterium bovis subsp bovis AF2122/97
ggugccgccaccggcgu

SEQ ID NO: 3166084 - RNA, 19 nt, Mycobacterium bovis subsp bovis AF2122/97
ggugccgccaucgccgccg

SEQ ID NO: 3166085 - RNA, 20 nt, Mycobacterium bovis subsp bovis AF2122/97
ggugccgccaucgccgccgg

SEQ ID NO: 3166086 - RNA, 19 nt, Mycobacterium bovis subsp bovis AF2122/97
ggugccgccauugacgccg

SEQ ID NO: 3166087 - RNA, 11 nt, Mycobacterium bovis subsp bovis AF2122/97
ggugccgcccg

SEQ ID NO: 3166088 - RNA, 12 nt, Mycobacterium bovis subsp bovis AF2122/97
ggugccgcccga

SEQ ID NO: 3166089 - RNA, 14 nt, Mycobacterium bovis subsp bovis AF2122/97
ggugccgcccgcgc

SEQ ID NO: 3166090 - RNA, 15 nt, Mycobacterium bovis subsp bovis AF2122/97
ggugccgcccgcgcc

SEQ ID NO: 3166091 - RNA, 16 nt, Mycobacterium bovis subsp bovis AF2122/97
ggugccgcccgcgccg

SEQ ID NO: 3166092 - RNA, 17 nt, Mycobacterium bovis subsp bovis AF2122/97
ggugccgcccgcgccgc

SEQ ID NO: 3166093 - RNA, 20 nt, Mycobacterium bovis subsp bovis AF2122/97
ggugccgcccgcgccgccgc

SEQ ID NO: 3166094 - RNA, 17 nt, Mycobacterium bovis subsp bovis AF2122/97
ggugccgccgauaccgc

SEQ ID NO: 3166095 - RNA, 14 nt, Mycobacterium bovis subsp bovis AF2122/97
ggugccgccgccgg

SEQ ID NO: 3166096 - RNA, 16 nt, Mycobacterium bovis subsp bovis AF2122/97
ggugccgccgccggcg

SEQ ID NO: 3166097 - RNA, 17 nt, Mycobacterium bovis subsp bovis AF2122/97
ggugccgccgccggcgc

SEQ ID NO: 3166098 - RNA, 12 nt, Mycobacterium bovis subsp bovis AF2122/97
ggugccgccgcg

SEQ ID NO: 3166099 - RNA, 13 nt, Mycobacterium bovis subsp bovis AF2122/97
ggugccgccgcgg

SEQ ID NO: 3166100 - RNA, 18 nt, Mycobacterium bovis subsp bovis AF2122/97
ggugccgccgcggccacc

SEQ ID NO: 3166101 - RNA, 12 nt, Mycobacterium bovis subsp bovis AF2122/97
ggugccgccggg

SEQ ID NO: 3166102 - RNA, 14 nt, Mycobacterium bovis subsp bovis AF2122/97
ggugccgccggugc

SEQ ID NO: 3166103 - RNA, 16 nt, Mycobacterium bovis subsp bovis AF2122/97
ggugccgccggugccg

SEQ ID NO: 3166104 - RNA, 14 nt, Mycobacterium bovis subsp bovis AF2122/97
ggugccgccgucgc

SEQ ID NO: 3166105 - RNA, 15 nt, Mycobacterium bovis subsp bovis AF2122/97
ggugccgccgucgcc

SEQ ID NO: 3166106 - RNA, 17 nt, Mycobacterium bovis subsp bovis AF2122/97
ggugccgccgucgccgc

SEQ ID NO: 3166107 - RNA, 15 nt, Mycobacterium bovis subsp bovis AF2122/97
ggugccgccguuccc

SEQ ID NO: 3166108 - RNA, 13 nt, Mycobacterium bovis subsp bovis AF2122/97
ggugccgccguug

SEQ ID NO: 3166109 - RNA, 16 nt, Mycobacterium bovis subsp bovis AF2122/97
ggugccgccuccgccu

SEQ ID NO: 3166110 - RNA, 16 nt, Mycobacterium bovis subsp bovis AF2122/97
ggugccgccugugcca

SEQ ID NO: 3166111 - RNA, 14 nt, Mycobacterium bovis subsp bovis AF2122/97
ggugccgcgcagcu

SEQ ID NO: 3166112 - RNA, 21 nt, Mycobacterium bovis subsp bovis AF2122/97
ggugccgcgcagcugccgcac

SEQ ID NO: 3166113 - RNA, 18 nt, Mycobacterium bovis subsp bovis AF2122/97
ggugccgcggccaccgcc

SEQ ID NO: 3166114 - RNA, 19 nt, Mycobacterium bovis subsp bovis AF2122/97
ggugccgcggccaccgccg

SEQ ID NO: 3166115 - RNA, 15 nt, Mycobacterium bovis subsp bovis AF2122/97
ggugccgcggcuagg

SEQ ID NO: 3166116 - RNA, 18 nt, Mycobacterium bovis subsp bovis AF2122/97
ggugccggaaacgccagg

SEQ ID NO: 3166117 - RNA, 21 nt, Mycobacterium bovis subsp bovis AF2122/97
ggugccggacuuggccugcgg

SEQ ID NO: 3166118 - RNA, 17 nt, Mycobacterium bovis subsp bovis AF2122/97
ggugccggcacccgagu

SEQ ID NO: 3166119 - RNA, 15 nt, Mycobacterium bovis subsp bovis AF2122/97
ggugccggcagcggc

SEQ ID NO: 3166120 - RNA, 17 nt, Mycobacterium bovis subsp bovis AF2122/97
ggugccggcagcggcgc

SEQ ID NO: 3166121 - RNA, 18 nt, Mycobacterium bovis subsp bovis AF2122/97
ggugccggcagcggcgcg

SEQ ID NO: 3166122 - RNA, 19 nt, Mycobacterium bovis subsp bovis AF2122/97
ggugccggcagcggcgcgc

SEQ ID NO: 3166123 - RNA, 24 nt, Mycobacterium bovis subsp bovis AF2122/97
ggugccggccagacucgcggucga

SEQ ID NO: 3166124 - RNA, 12 nt, Mycobacterium bovis subsp bovis AF2122/97
ggugccggcgac

SEQ ID NO: 3166125 - RNA, 14 nt, Mycobacterium bovis subsp bovis AF2122/97
ggugccggcgacgc

SEQ ID NO: 3166126 - RNA, 14 nt, Mycobacterium bovis subsp bovis AF2122/97
ggugccggcgccgc

SEQ ID NO: 3166127 - RNA, 16 nt, Mycobacterium bovis subsp bovis AF2122/97
ggugccggcgccgcca

SEQ ID NO: 3166128 - RNA, 21 nt, Mycobacterium bovis subsp bovis AF2122/97
ggugccggcgccgccagcacc

SEQ ID NO: 3166129 - RNA, 21 nt, Mycobacterium bovis subsp bovis AF2122/97
ggugccggcgccgcccuugcc

SEQ ID NO: 3166130 - RNA, 22 nt, Mycobacterium bovis subsp bovis AF2122/97
ggugccggcgccgcccuugccg

SEQ ID NO: 3166131 - RNA, 14 nt, Mycobacterium bovis subsp bovis AF2122/97
ggugccggcggaaa

SEQ ID NO: 3166132 - RNA, 23 nt, Mycobacterium bovis subsp bovis AF2122/97
ggugccggcggaaauggcgucgc

SEQ ID NO: 3166133 - RNA, 13 nt, Mycobacterium bovis subsp bovis AF2122/97
ggugccggcggcg

SEQ ID NO: 3166134 - RNA, 14 nt, Mycobacterium bovis subsp bovis AF2122/97
ggugccggcgguga

SEQ ID NO: 3166135 - RNA, 19 nt, Mycobacterium bovis subsp bovis AF2122/97
ggugccggcguugccgccg

SEQ ID NO: 3166136 - RNA, 20 nt, Mycobacterium bovis subsp bovis AF2122/97
ggugccggggccccaugccg

SEQ ID NO: 3166137 - RNA, 16 nt, Mycobacterium bovis subsp bovis AF2122/97
ggugccggggcugccg

SEQ ID NO: 3166138 - RNA, 17 nt, Mycobacterium bovis subsp bovis AF2122/97
ggugccggggcugccgc

SEQ ID NO: 3166139 - RNA, 18 nt, Mycobacterium bovis subsp bovis AF2122/97
ggugccggggcugccgcc

SEQ ID NO: 3166140 - RNA, 15 nt, Mycobacterium bovis subsp bovis AF2122/97
ggugccgggguggcg

SEQ ID NO: 3166141 - RNA, 18 nt, Mycobacterium bovis subsp bovis AF2122/97
ggugccgggguggcgcgc

SEQ ID NO: 3166142 - RNA, 14 nt, Mycobacterium bovis subsp bovis AF2122/97
ggugccggucacgu

SEQ ID NO: 3166143 - RNA, 14 nt, Mycobacterium bovis subsp bovis AF2122/97
ggugccggucgagu

SEQ ID NO: 3166144 - RNA, 14 nt, Mycobacterium bovis subsp bovis AF2122/97
ggugccggugcucc

SEQ ID NO: 3166145 - RNA, 18 nt, Mycobacterium bovis subsp bovis AF2122/97
ggugccggugcuccucgg

SEQ ID NO: 3166146 - RNA, 23 nt, Mycobacterium bovis subsp bovis AF2122/97
ggugccggugcuccucggcaggc

SEQ ID NO: 3166147 - RNA, 19 nt, Mycobacterium bovis subsp bovis AF2122/97
ggugccgguguugccgccg

SEQ ID NO: 3166148 - RNA, 20 nt, Mycobacterium bovis subsp bovis AF2122/97
ggugccgguguugccgccgg

SEQ ID NO: 3166149 - RNA, 18 nt, Mycobacterium bovis subsp bovis AF2122/97
ggugccgucagcggcggc

SEQ ID NO: 3166150 - RNA, 15 nt, Mycobacterium bovis subsp bovis AF2122/97
ggugccguccggcgc

SEQ ID NO: 3166151 - RNA, 13 nt, Mycobacterium bovis subsp bovis AF2122/97
ggugccgucgagu

SEQ ID NO: 3166152 - RNA, 11 nt, Mycobacterium bovis subsp bovis AF2122/97
ggugccgucgc

SEQ ID NO: 3166153 - RNA, 17 nt, Mycobacterium bovis subsp bovis AF2122/97
ggugccgucggugccgc

SEQ ID NO: 3166154 - RNA, 17 nt, Mycobacterium bovis subsp bovis AF2122/97
ggugccgucugcggggu

SEQ ID NO: 3166155 - RNA, 22 nt, Mycobacterium bovis subsp bovis AF2122/97
ggugcugacauuuccaccacgc

SEQ ID NO: 3166156 - RNA, 15 nt, Mycobacterium bovis subsp bovis AF2122/97
ggugcugaccgcgcc

SEQ ID NO: 3166157 - RNA, 17 nt, Mycobacterium bovis subsp bovis AF2122/97
ggugcugaccgcgccgg

SEQ ID NO: 3166158 - RNA, 16 nt, Mycobacterium bovis subsp bovis AF2122/97
ggugcugcaccuggcg

SEQ ID NO: 3166159 - RNA, 12 nt, Mycobacterium bovis subsp bovis AF2122/97
ggugcugcgcgg

SEQ ID NO: 3166160 - RNA, 18 nt, Mycobacterium bovis subsp bovis AF2122/97
ggugcugcgcgggugugg

SEQ ID NO: 3166161 - RNA, 15 nt, Mycobacterium bovis subsp bovis AF2122/97
ggugcugcggcgucc

SEQ ID NO: 3166162 - RNA, 13 nt, Mycobacterium bovis subsp bovis AF2122/97
ggugcuggcagga

SEQ ID NO: 3166163 - RNA, 20 nt, Mycobacterium bovis subsp bovis AF2122/97
ggugcugguauagccggcgc

SEQ ID NO: 3166164 - RNA, 23 nt, Mycobacterium bovis subsp bovis AF2122/97
ggugcuggucaacagcggcaaga

SEQ ID NO: 3166165 - RNA, 17 nt, Mycobacterium bovis subsp bovis AF2122/97
ggugcugguccagccgg

SEQ ID NO: 3166166 - RNA, 14 nt, Mycobacterium bovis subsp bovis AF2122/97
ggugcuggucgccg

SEQ ID NO: 3166167 - RNA, 16 nt, Mycobacterium bovis subsp bovis AF2122/97
ggugcuggucgccgcg

SEQ ID NO: 3166168 - RNA, 19 nt, Mycobacterium bovis subsp bovis AF2122/97
ggugcuggucgccgcggca

SEQ ID NO: 3166169 - RNA, 13 nt, Mycobacterium bovis subsp bovis AF2122/97
ggugcugguggcg

SEQ ID NO: 3166170 - RNA, 16 nt, Mycobacterium bovis subsp bovis AF2122/97
ggugcugguggcggca

SEQ ID NO: 3166171 - RNA, 17 nt, Mycobacterium bovis subsp bovis AF2122/97
ggugcugguggcggcac

SEQ ID NO: 3166172 - RNA, 19 nt, Mycobacterium bovis subsp bovis AF2122/97
ggugcugucgacgucggca

SEQ ID NO: 3166173 - RNA, 23 nt, Mycobacterium bovis subsp bovis AF2122/97
ggugcuguugcgcggucgcgcga

SEQ ID NO: 3166174 - RNA, 14 nt, Mycobacterium bovis subsp bovis AF2122/97
ggugcuuccacacg

SEQ ID NO: 3166175 - RNA, 16 nt, Mycobacterium bovis subsp bovis AF2122/97
ggugcuugucgccgcg

SEQ ID NO: 3166176 - RNA, 20 nt, Mycobacterium bovis subsp bovis AF2122/97
ggugcuuucgcgucugcucg

SEQ ID NO: 3166177 - RNA, 15 nt, Mycobacterium bovis subsp bovis AF2122/97
gguggaaaaagcccg

SEQ ID NO: 3166178 - RNA, 16 nt, Mycobacterium bovis subsp bovis AF2122/97
gguggaaaaagcccga

SEQ ID NO: 3166179 - RNA, 21 nt, Mycobacterium bovis subsp bovis AF2122/97
gguggaaacugaugucgccga

SEQ ID NO: 3166180 - RNA, 15 nt, Mycobacterium bovis subsp bovis AF2122/97
gguggacccggcggu

SEQ ID NO: 3166181 - RNA, 17 nt, Mycobacterium bovis subsp bovis AF2122/97
gguggacccggcggugc

SEQ ID NO: 3166182 - RNA, 15 nt, Mycobacterium bovis subsp bovis AF2122/97
gguggaccgccgauc

SEQ ID NO: 3166183 - RNA, 18 nt, Mycobacterium bovis subsp bovis AF2122/97
gguggaccgccgaucggc

SEQ ID NO: 3166184 - RNA, 14 nt, Mycobacterium bovis subsp bovis AF2122/97
gguggaccggccug

SEQ ID NO: 3166185 - RNA, 16 nt, Mycobacterium bovis subsp bovis AF2122/97
gguggacgaccgcgcg

SEQ ID NO: 3166186 - RNA, 18 nt, Mycobacterium bovis subsp bovis AF2122/97
gguggacgaggcggucga

SEQ ID NO: 3166187 - RNA, 16 nt, Mycobacterium bovis subsp bovis AF2122/97
gguggacggcaggcgg

SEQ ID NO: 3166188 - RNA, 22 nt, Mycobacterium bovis subsp bovis AF2122/97
gguggacggcaggcggccgccg

SEQ ID NO: 3166189 - RNA, 14 nt, Mycobacterium bovis subsp bovis AF2122/97
gguggagagccgac

SEQ ID NO: 3166190 - RNA, 21 nt, Mycobacterium bovis subsp bovis AF2122/97
gguggagagccgacgugcggc

SEQ ID NO: 3166191 - RNA, 16 nt, Mycobacterium bovis subsp bovis AF2122/97
gguggagcggcgcggg

SEQ ID NO: 3166192 - RNA, 23 nt, Mycobacterium bovis subsp bovis AF2122/97
gguggagcggcgcgggggugggc

SEQ ID NO: 3166193 - RNA, 17 nt, Mycobacterium bovis subsp bovis AF2122/97
gguggaguuggcugccg

SEQ ID NO: 3166194 - RNA, 20 nt, Mycobacterium bovis subsp bovis AF2122/97
gguggaguuuccgaagcccg

SEQ ID NO: 3166195 - RNA, 21 nt, Mycobacterium bovis subsp bovis AF2122/97
gguggaucagggucaucagcc

SEQ ID NO: 3166196 - RNA, 14 nt, Mycobacterium bovis subsp bovis AF2122/97
gguggaucuucacc

SEQ ID NO: 3166197 - RNA, 19 nt, Mycobacterium bovis subsp bovis AF2122/97
gguggauucgaucaggccu

SEQ ID NO: 3166198 - RNA, 22 nt, Mycobacterium bovis subsp bovis AF2122/97
gguggauuggugccggucaccu

SEQ ID NO: 3166199 - RNA, 22 nt, Mycobacterium bovis subsp bovis AF2122/97
gguggcaacggaggugccggcg

SEQ ID NO: 3166200 - RNA, 18 nt, Mycobacterium bovis subsp bovis AF2122/97
gguggcaccggcggcgac

SEQ ID NO: 3166201 - RNA, 15 nt, Mycobacterium bovis subsp bovis AF2122/97
gguggcacgcugagc

SEQ ID NO: 3166202 - RNA, 16 nt, Mycobacterium bovis subsp bovis AF2122/97
gguggcacggccccug

SEQ ID NO: 3166203 - RNA, 16 nt, Mycobacterium bovis subsp bovis AF2122/97
gguggcagagccgccg

SEQ ID NO: 3166204 - RNA, 22 nt, Mycobacterium bovis subsp bovis AF2122/97
gguggcagcgcacccggucggc

SEQ ID NO: 3166205 - RNA, 14 nt, Mycobacterium bovis subsp bovis AF2122/97
gguggcagcgcggc

SEQ ID NO: 3166206 - RNA, 12 nt, Mycobacterium bovis subsp bovis AF2122/97
gguggccaccaa

SEQ ID NO: 3166207 - RNA, 14 nt, Mycobacterium bovis subsp bovis AF2122/97
gguggccaccagcg

SEQ ID NO: 3166208 - RNA, 18 nt, Mycobacterium bovis subsp bovis AF2122/97
gguggccacccggccgcg

SEQ ID NO: 3166209 - RNA, 19 nt, Mycobacterium bovis subsp bovis AF2122/97
gguggccacccggccgcgc

SEQ ID NO: 3166210 - RNA, 21 nt, Mycobacterium bovis subsp bovis AF2122/97
gguggccagaucgaacgcagc

SEQ ID NO: 3166211 - RNA, 14 nt, Mycobacterium bovis subsp bovis AF2122/97
gguggccagcaggc

SEQ ID NO: 3166212 - RNA, 17 nt, Mycobacterium bovis subsp bovis AF2122/97
gguggccagcaggcggc

SEQ ID NO: 3166213 - RNA, 17 nt, Mycobacterium bovis subsp bovis AF2122/97
gguggccagccagcggg

SEQ ID NO: 3166214 - RNA, 15 nt, Mycobacterium bovis subsp bovis AF2122/97
gguggccagcgcggc

SEQ ID NO: 3166215 - RNA, 16 nt, Mycobacterium bovis subsp bovis AF2122/97
gguggccagcgcggcg

SEQ ID NO: 3166216 - RNA, 17 nt, Mycobacterium bovis subsp bovis AF2122/97
gguggccagcggagcgc

SEQ ID NO: 3166217 - RNA, 16 nt, Mycobacterium bovis subsp bovis AF2122/97
gguggccagcgucgcg

SEQ ID NO: 3166218 - RNA, 23 nt, Mycobacterium bovis subsp bovis AF2122/97
gguggccaggccguaguggccgg

SEQ ID NO: 3166219 - RNA, 13 nt, Mycobacterium bovis subsp bovis AF2122/97
gguggccaucgcg

SEQ ID NO: 3166220 - RNA, 15 nt, Mycobacterium bovis subsp bovis AF2122/97
gguggcccgaccggg

SEQ ID NO: 3166221 - RNA, 18 nt, Mycobacterium bovis subsp bovis AF2122/97
gguggcccgaccgggaac

SEQ ID NO: 3166222 - RNA, 24 nt, Mycobacterium bovis subsp bovis AF2122/97
gguggcccgaccgggaaccacggu

SEQ ID NO: 3166223 - RNA, 21 nt, Mycobacterium bovis subsp bovis AF2122/97
gguggcccgccggcagugagu

SEQ ID NO: 3166224 - RNA, 13 nt, Mycobacterium bovis subsp bovis AF2122/97
gguggcccggcug

SEQ ID NO: 3166225 - RNA, 16 nt, Mycobacterium bovis subsp bovis AF2122/97
gguggcccgggccacc

SEQ ID NO: 3166226 - RNA, 19 nt, Mycobacterium bovis subsp bovis AF2122/97
gguggcccgggccaccgga

SEQ ID NO: 3166227 - RNA, 13 nt, Mycobacterium bovis subsp bovis AF2122/97
gguggcccgggga

SEQ ID NO: 3166228 - RNA, 14 nt, Mycobacterium bovis subsp bovis AF2122/97
gguggcccguagcg

SEQ ID NO: 3166229 - RNA, 22 nt, Mycobacterium bovis subsp bovis AF2122/97
gguggccggcaacggcgcgccg

SEQ ID NO: 3166230 - RNA, 15 nt, Mycobacterium bovis subsp bovis AF2122/97
gguggccggggugcc

SEQ ID NO: 3166231 - RNA, 12 nt, Mycobacterium bovis subsp bovis AF2122/97
gguggccgucgc

SEQ ID NO: 3166232 - RNA, 14 nt, Mycobacterium bovis subsp bovis AF2122/97
gguggccgucgccg

SEQ ID NO: 3166233 - RNA, 15 nt, Mycobacterium bovis subsp bovis AF2122/97
gguggccucauccac

SEQ ID NO: 3166234 - RNA, 19 nt, Mycobacterium bovis subsp bovis AF2122/97
gguggccucauccaccgau

SEQ ID NO: 3166235 - RNA, 17 nt, Mycobacterium bovis subsp bovis AF2122/97
gguggccucccacggcg

SEQ ID NO: 3166236 - RNA, 18 nt, Mycobacterium bovis subsp bovis AF2122/97
gguggccucccacggcgc

SEQ ID NO: 3166237 - RNA, 17 nt, Mycobacterium bovis subsp bovis AF2122/97
gguggcgauccacaggc

SEQ ID NO: 3166238 - RNA, 14 nt, Mycobacterium bovis subsp bovis AF2122/97
gguggcgccaacgc

SEQ ID NO: 3166239 - RNA, 22 nt, Mycobacterium bovis subsp bovis AF2122/97
gguggcgccauccccgccggcg

SEQ ID NO: 3166240 - RNA, 23 nt, Mycobacterium bovis subsp bovis AF2122/97
gguggcgccauccccgccggcgc

SEQ ID NO: 3166241 - RNA, 22 nt, Mycobacterium bovis subsp bovis AF2122/97
gguggcgccaugaagccgggcg

SEQ ID NO: 3166242 - RNA, 18 nt, Mycobacterium bovis subsp bovis AF2122/97
gguggugccgcggccacc

SEQ ID NO: 3166243 - RNA, 17 nt, Mycobacterium bovis subsp bovis AF2122/97
gguggugccggcgccgc

SEQ ID NO: 3166244 - RNA, 21 nt, Mycobacterium bovis subsp bovis AF2122/97
gguggugcgcaaucgacacca

SEQ ID NO: 3166245 - RNA, 16 nt, Mycobacterium bovis subsp bovis AF2122/97
gguggugcgcucgcgg

SEQ ID NO: 3166246 - RNA, 13 nt, Mycobacterium bovis subsp bovis AF2122/97
gguggugcggaug

SEQ ID NO: 3166247 - RNA, 14 nt, Mycobacterium bovis subsp bovis AF2122/97
gguggugcucgucg

SEQ ID NO: 3166248 - RNA, 13 nt, Mycobacterium bovis subsp bovis AF2122/97
ggugguggccggg

SEQ ID NO: 3166249 - RNA, 15 nt, Mycobacterium bovis subsp bovis AF2122/97
ggugguggccggggu

SEQ ID NO: 3166250 - RNA, 21 nt, Mycobacterium bovis subsp bovis AF2122/97
ggugguggccggggugccggc

SEQ ID NO: 3166251 - RNA, 13 nt, Mycobacterium bovis subsp bovis AF2122/97
ggugguggcggug

SEQ ID NO: 3166252 - RNA, 22 nt, Mycobacterium bovis subsp bovis AF2122/97
ggugguggcgguguugcucccg

SEQ ID NO: 3166253 - RNA, 13 nt, Mycobacterium bovis subsp bovis AF2122/97
ggugguggcgucg

SEQ ID NO: 3166254 - RNA, 14 nt, Mycobacterium bovis subsp bovis AF2122/97
ggugguggcgucga

SEQ ID NO: 3166255 - RNA, 13 nt, Mycobacterium bovis subsp bovis AF2122/97
gguggugucgcuc

SEQ ID NO: 3166256 - RNA, 14 nt, Mycobacterium bovis subsp bovis AF2122/97
gguggugucgcucg

SEQ ID NO: 3166257 - RNA, 23 nt, Mycobacterium bovis subsp bovis AF2122/97
ggugguuagguggcuggcugugc

SEQ ID NO: 3166258 - RNA, 16 nt, Mycobacterium bovis subsp bovis AF2122/97
ggugguucaccucggc

SEQ ID NO: 3166259 - RNA, 18 nt, Mycobacterium bovis subsp bovis AF2122/97
ggugguucaccucggcga

SEQ ID NO: 3166260 - RNA, 16 nt, Mycobacterium bovis subsp bovis AF2122/97
ggugguucccgacauc

SEQ ID NO: 3166261 - RNA, 17 nt, Mycobacterium bovis subsp bovis AF2122/97
ggugguuccgcccggug

SEQ ID NO: 3166262 - RNA, 16 nt, Mycobacterium bovis subsp bovis AF2122/97
ggugguuccgcgcggc

SEQ ID NO: 3166263 - RNA, 18 nt, Mycobacterium bovis subsp bovis AF2122/97
ggugguuccggcuggugg

SEQ ID NO: 3166264 - RNA, 20 nt, Mycobacterium bovis subsp bovis AF2122/97
ggugguuucacuacgggucu

SEQ ID NO: 3166265 - RNA, 18 nt, Mycobacterium bovis subsp bovis AF2122/97
ggugguuuucccgucgcc

SEQ ID NO: 3166266 - RNA, 15 nt, Mycobacterium bovis subsp bovis AF2122/97
gguguaacggcggcu

SEQ ID NO: 3166267 - RNA, 17 nt, Mycobacterium bovis subsp bovis AF2122/97
gguguacagucgcgcgc

SEQ ID NO: 3166268 - RNA, 13 nt, Mycobacterium bovis subsp bovis AF2122/97
gguguacugcugc

SEQ ID NO: 3166269 - RNA, 22 nt, Mycobacterium bovis subsp bovis AF2122/97
gguguagaugaacuucccaccc

SEQ ID NO: 3166270 - RNA, 14 nt, Mycobacterium bovis subsp bovis AF2122/97
gguguagcccagcc

SEQ ID NO: 3166271 - RNA, 20 nt, Mycobacterium bovis subsp bovis AF2122/97
gguguagccgccggcagugg

SEQ ID NO: 3166272 - RNA, 19 nt, Mycobacterium bovis subsp bovis AF2122/97
gguguagccggcgccgccg

SEQ ID NO: 3166273 - RNA, 20 nt, Mycobacterium bovis subsp bovis AF2122/97
gguguaggccucggcagcaa

SEQ ID NO: 3166274 - RNA, 19 nt, Mycobacterium bovis subsp bovis AF2122/97
gguguaggccugcccccgg

SEQ ID NO: 3166275 - RNA, 19 nt, Mycobacterium bovis subsp bovis AF2122/97
gguguaggugccccacucg

SEQ ID NO: 3166276 - RNA, 23 nt, Mycobacterium bovis subsp bovis AF2122/97
gguguauccgacuggccccgcca

SEQ ID NO: 3166277 - RNA, 14 nt, Mycobacterium bovis subsp bovis AF2122/97
ggugucaacgcgcg

SEQ ID NO: 3166278 - RNA, 22 nt, Mycobacterium bovis subsp bovis AF2122/97
ggugucacgacccaagucgccg

SEQ ID NO: 3166279 - RNA, 17 nt, Mycobacterium bovis subsp bovis AF2122/97
ggugucagccaccggug

SEQ ID NO: 3166280 - RNA, 19 nt, Mycobacterium bovis subsp bovis AF2122/97
ggugucaugaacgaccgga

SEQ ID NO: 3166281 - RNA, 14 nt, Mycobacterium bovis subsp bovis AF2122/97
gguguccaccaccg

SEQ ID NO: 3166282 - RNA, 17 nt, Mycobacterium bovis subsp bovis AF2122/97
gguguccaccaccggca

SEQ ID NO: 3166283 - RNA, 23 nt, Mycobacterium bovis subsp bovis AF2122/97
gguguccagugcauucccgccuu

SEQ ID NO: 3166284 - RNA, 23 nt, Mycobacterium bovis subsp bovis AF2122/97
gguguccuccagcugcgcgggcg

SEQ ID NO: 3166285 - RNA, 14 nt, Mycobacterium bovis subsp bovis AF2122/97
gguguccucgucga

SEQ ID NO: 3166286 - RNA, 11 nt, Mycobacterium bovis subsp bovis AF2122/97
gguguccuugg

SEQ ID NO: 3166287 - RNA, 20 nt, Mycobacterium bovis subsp bovis AF2122/97
ggugucgacaaccgcugccg

SEQ ID NO: 3166288 - RNA, 16 nt, Mycobacterium bovis subsp bovis AF2122/97
ggugucgacgcgggcg

SEQ ID NO: 3166289 - RNA, 20 nt, Mycobacterium bovis subsp bovis AF2122/97
ggugucgaugcgcagcccgu

SEQ ID NO: 3166290 - RNA, 17 nt, Mycobacterium bovis subsp bovis AF2122/97
ggugucgauuggcucgc

SEQ ID NO: 3166291 - RNA, 18 nt, Mycobacterium bovis subsp bovis AF2122/97
ggugucgccgaacaccga

SEQ ID NO: 3166292 - RNA, 13 nt, Mycobacterium bovis subsp bovis AF2122/97
ggugucgcugcug

SEQ ID NO: 3166293 - RNA, 13 nt, Mycobacterium bovis subsp bovis AF2122/97
ggugucggcgugg

SEQ ID NO: 3166294 - RNA, 15 nt, Mycobacterium bovis subsp bovis AF2122/97
ggugucggcucgagu

SEQ ID NO: 3166295 - RNA, 16 nt, Mycobacterium bovis subsp bovis AF2122/97
ggugucggcuggucgc

SEQ ID NO: 3166296 - RNA, 22 nt, Mycobacterium bovis subsp bovis AF2122/97
ggugucggcuggucgcugcugc

SEQ ID NO: 3166297 - RNA, 15 nt, Mycobacterium bovis subsp bovis AF2122/97
ggugucgggcagcaa

SEQ ID NO: 3166298 - RNA, 14 nt, Mycobacterium bovis subsp bovis AF2122/97
ggugucgggcucgc

SEQ ID NO: 3166299 - RNA, 15 nt, Mycobacterium bovis subsp bovis AF2122/97
ggugucgggcucgca

SEQ ID NO: 3166300 - RNA, 18 nt, Mycobacterium bovis subsp bovis AF2122/97
ggugucggugcgcggcaa

SEQ ID NO: 3166301 - RNA, 19 nt, Mycobacterium bovis subsp bovis AF2122/97
ggugucgguggccgcggcg

SEQ ID NO: 3166302 - RNA, 17 nt, Mycobacterium bovis subsp bovis AF2122/97
ggugucggugucgacgu

SEQ ID NO: 3166303 - RNA, 17 nt, Mycobacterium bovis subsp bovis AF2122/97
ggugucgucaucggggc

SEQ ID NO: 3166304 - RNA, 16 nt, Mycobacterium bovis subsp bovis AF2122/97
ggugucucccuugccg

SEQ ID NO: 3166305 - RNA, 21 nt, Mycobacterium bovis subsp bovis AF2122/97
ggugucucccuugccgccauu

SEQ ID NO: 3166306 - RNA, 16 nt, Mycobacterium bovis subsp bovis AF2122/97
ggugucucuaccacgg

SEQ ID NO: 3166307 - RNA, 14 nt, Mycobacterium bovis subsp bovis AF2122/97
ggugugacgauccc

SEQ ID NO: 3166308 - RNA, 18 nt, Mycobacterium bovis subsp bovis AF2122/97
ggugugauacagcgccag

SEQ ID NO: 3166309 - RNA, 14 nt, Mycobacterium bovis subsp bovis AF2122/97
ggugugaucggcgg

SEQ ID NO: 3166310 - RNA, 12 nt, Mycobacterium bovis subsp bovis AF2122/97
ggugugcaggga

SEQ ID NO: 3166311 - RNA, 19 nt, Mycobacterium bovis subsp bovis AF2122/97
ggugugcaucgacucacgg

SEQ ID NO: 3166312 - RNA, 21 nt, Mycobacterium bovis subsp bovis AF2122/97
ggugugcgacgacggcgccgu

SEQ ID NO: 3166313 - RNA, 23 nt, Mycobacterium bovis subsp bovis AF2122/97
ggugugcgcaccccgcuugcgcg

SEQ ID NO: 3166314 - RNA, 19 nt, Mycobacterium bovis subsp bovis AF2122/97
ggugugcgcgccaggcucg

SEQ ID NO: 3166315 - RNA, 21 nt, Mycobacterium bovis subsp bovis AF2122/97
ggugugcgcgccaggcucgau

SEQ ID NO: 3166316 - RNA, 16 nt, Mycobacterium bovis subsp bovis AF2122/97
ggugugcgggcggugc

SEQ ID NO: 3166317 - RNA, 21 nt, Mycobacterium bovis subsp bovis AF2122/97
ggugugcgggguugggcggag

SEQ ID NO: 3166318 - RNA, 19 nt, Mycobacterium bovis subsp bovis AF2122/97
ggugugcgucuccagcugg

SEQ ID NO: 3166319 - RNA, 16 nt, Mycobacterium bovis subsp bovis AF2122/97
ggugugcucgccgacc

SEQ ID NO: 3166320 - RNA, 21 nt, Mycobacterium bovis subsp bovis AF2122/97
ggugugcucgccgaccagcuu

SEQ ID NO: 3166321 - RNA, 14 nt, Mycobacterium bovis subsp bovis AF2122/97
ggugugcugcacgg

SEQ ID NO: 3166322 - RNA, 14 nt, Mycobacterium bovis subsp bovis AF2122/97
ggugugcugccacc

SEQ ID NO: 3166323 - RNA, 15 nt, Mycobacterium bovis subsp bovis AF2122/97
ggugugcugccaccg

SEQ ID NO: 3166324 - RNA, 16 nt, Mycobacterium bovis subsp bovis AF2122/97
ggugugcugccaccgg

SEQ ID NO: 3166325 - RNA, 17 nt, Mycobacterium bovis subsp bovis AF2122/97
ggugugcugccaccggc

SEQ ID NO: 3166326 - RNA, 22 nt, Mycobacterium bovis subsp bovis AF2122/97
ggugugcugccaccggccggcg

SEQ ID NO: 3166327 - RNA, 22 nt, Mycobacterium bovis subsp bovis AF2122/97
ggugugcuugcucgggucgugc

SEQ ID NO: 3166328 - RNA, 13 nt, Mycobacterium bovis subsp bovis AF2122/97
gguguggccgugg

SEQ ID NO: 3166329 - RNA, 22 nt, Mycobacterium bovis subsp bovis AF2122/97
gguuuggugcagccgcggucgu

SEQ ID NO: 3166330 - RNA, 16 nt, Mycobacterium bovis subsp bovis AF2122/97
gguuuuguaguccgca

SEQ ID NO: 3166331 - RNA, 21 nt, Mycobacterium bovis subsp bovis AF2122/97
guaaaagccgaugacgguccc

SEQ ID NO: 3166332 - RNA, 19 nt, Mycobacterium bovis subsp bovis AF2122/97
guaaaccagguggccaggc

SEQ ID NO: 3166333 - RNA, 22 nt, Mycobacterium bovis subsp bovis AF2122/97
guaaacgaggucgccgcaacau

SEQ ID NO: 3166334 - RNA, 19 nt, Mycobacterium bovis subsp bovis AF2122/97
guaaacgucggucggggau

SEQ ID NO: 3166335 - RNA, 22 nt, Mycobacterium bovis subsp bovis AF2122/97
guaaacgucggucggggauccg

SEQ ID NO: 3166336 - RNA, 14 nt, Mycobacterium bovis subsp bovis AF2122/97
guaaagcucaccac

SEQ ID NO: 3166337 - RNA, 22 nt, Mycobacterium bovis subsp bovis AF2122/97
guaaagcucaccacaucggugu

SEQ ID NO: 3166338 - RNA, 15 nt, Mycobacterium bovis subsp bovis AF2122/97
guaaccacgacgacg

SEQ ID NO: 3166339 - RNA, 16 nt, Mycobacterium bovis subsp bovis AF2122/97
guaaccagcgccacga

SEQ ID NO: 3166340 - RNA, 23 nt, Mycobacterium bovis subsp bovis AF2122/97
guaacccagucccaacacggcga

SEQ ID NO: 3166341 - RNA, 16 nt, Mycobacterium bovis subsp bovis AF2122/97
guaaccgcgucgaccg

SEQ ID NO: 3166342 - RNA, 14 nt, Mycobacterium bovis subsp bovis AF2122/97
guaaccggcagcgg

SEQ ID NO: 3166343 - RNA, 14 nt, Mycobacterium bovis subsp bovis AF2122/97
guaaccguccgcgg

SEQ ID NO: 3166344 - RNA, 12 nt, Mycobacterium bovis subsp bovis AF2122/97
guaaccuccucg

SEQ ID NO: 3166345 - RNA, 13 nt, Mycobacterium bovis subsp bovis AF2122/97
guaaccuccucga

SEQ ID NO: 3166346 - RNA, 21 nt, Mycobacterium bovis subsp bovis AF2122/97
guaacgacgguuccgccaccg

SEQ ID NO: 3166347 - RNA, 14 nt, Mycobacterium bovis subsp bovis AF2122/97
guaacgcagcggca

SEQ ID NO: 3166348 - RNA, 22 nt, Mycobacterium bovis subsp bovis AF2122/97
guaacgccaacaccggcaucgc

SEQ ID NO: 3166349 - RNA, 14 nt, Mycobacterium bovis subsp bovis AF2122/97
guaacgccgcucau

SEQ ID NO: 3166350 - RNA, 20 nt, Mycobacterium bovis subsp bovis AF2122/97
guaacggcgaaacucgucga

SEQ ID NO: 3166351 - RNA, 14 nt, Mycobacterium bovis subsp bovis AF2122/97
guaacuucaccggc

SEQ ID NO: 3166352 - RNA, 23 nt, Mycobacterium bovis subsp bovis AF2122/97
guaagacgccgaacgcgagguuc

SEQ ID NO: 3166353 - RNA, 13 nt, Mycobacterium bovis subsp bovis AF2122/97
guaagcaccagcc

SEQ ID NO: 3166354 - RNA, 17 nt, Mycobacterium bovis subsp bovis AF2122/97
guaagcaccagccagcc

SEQ ID NO: 3166355 - RNA, 21 nt, Mycobacterium bovis subsp bovis AF2122/97
guaagcgccaaggcgaugguc

SEQ ID NO: 3166356 - RNA, 12 nt, Mycobacterium bovis subsp bovis AF2122/97
guaagcggaugu

SEQ ID NO: 3166357 - RNA, 13 nt, Mycobacterium bovis subsp bovis AF2122/97
guaagcggauguc

SEQ ID NO: 3166358 - RNA, 16 nt, Mycobacterium bovis subsp bovis AF2122/97
guaaggcacggguguu

SEQ ID NO: 3166359 - RNA, 20 nt, Mycobacterium bovis subsp bovis AF2122/97
guaagugccucgcgggaagu

SEQ ID NO: 3166360 - RNA, 15 nt, Mycobacterium bovis subsp bovis AF2122/97
guaaguuuucggccg

SEQ ID NO: 3166361 - RNA, 17 nt, Mycobacterium bovis subsp bovis AF2122/97
guaauccgagcgcggcg

SEQ ID NO: 3166362 - RNA, 15 nt, Mycobacterium bovis subsp bovis AF2122/97
guaaucgccaccgca

SEQ ID NO: 3166363 - RNA, 14 nt, Mycobacterium bovis subsp bovis AF2122/97
guaaugcgcugccg

SEQ ID NO: 3166364 - RNA, 17 nt, Mycobacterium bovis subsp bovis AF2122/97
guaaugcgcugccgccg

SEQ ID NO: 3166365 - RNA, 18 nt, Mycobacterium bovis subsp bovis AF2122/97
guaaugcgcugccgccgu

SEQ ID NO: 3166366 - RNA, 17 nt, Mycobacterium bovis subsp bovis AF2122/97
guaaugcugcugcagca

SEQ ID NO: 3166367 - RNA, 15 nt, Mycobacterium bovis subsp bovis AF2122/97
guaauggccgccggu

SEQ ID NO: 3166368 - RNA, 17 nt, Mycobacterium bovis subsp bovis AF2122/97
guaaugguggcguccag

SEQ ID NO: 3166369 - RNA, 12 nt, Mycobacterium bovis subsp bovis AF2122/97
guaauugcaggu

SEQ ID NO: 3166370 - RNA, 22 nt, Mycobacterium bovis subsp bovis AF2122/97
guacaacaugauucgcugcgcc

SEQ ID NO: 3166371 - RNA, 19 nt, Mycobacterium bovis subsp bovis AF2122/97
guacaagcauuggcgucga

SEQ ID NO: 3166372 - RNA, 23 nt, Mycobacterium bovis subsp bovis AF2122/97
guacaagucgaccaugagccggc

SEQ ID NO: 3166373 - RNA, 13 nt, Mycobacterium bovis subsp bovis AF2122/97
guacacacccgcc

SEQ ID NO: 3166374 - RNA, 13 nt, Mycobacterium bovis subsp bovis AF2122/97
guacacacgauga

SEQ ID NO: 3166375 - RNA, 17 nt, Mycobacterium bovis subsp bovis AF2122/97
guacacauaggugcggg

SEQ ID NO: 3166376 - RNA, 22 nt, Mycobacterium bovis subsp bovis AF2122/97
guacacauaggugcggggccgg

SEQ ID NO: 3166377 - RNA, 16 nt, Mycobacterium bovis subsp bovis AF2122/97
guacacaucgucacug

SEQ ID NO: 3166378 - RNA, 17 nt, Mycobacterium bovis subsp bovis AF2122/97
guacaccagggugccgg

SEQ ID NO: 3166379 - RNA, 16 nt, Mycobacterium bovis subsp bovis AF2122/97
guacaccccaucgaua

SEQ ID NO: 3166380 - RNA, 16 nt, Mycobacterium bovis subsp bovis AF2122/97
guacacccgcucgccc

SEQ ID NO: 3166381 - RNA, 18 nt, Mycobacterium bovis subsp bovis AF2122/97
guacacccgcucgcccgc

SEQ ID NO: 3166382 - RNA, 14 nt, Mycobacterium bovis subsp bovis AF2122/97
guacaccgcgcccg

SEQ ID NO: 3166383 - RNA, 18 nt, Mycobacterium bovis subsp bovis AF2122/97
guacaccgcgcccgccga

SEQ ID NO: 3166384 - RNA, 19 nt, Mycobacterium bovis subsp bovis AF2122/97
guacaccggcuggaaucug

SEQ ID NO: 3166385 - RNA, 13 nt, Mycobacterium bovis subsp bovis AF2122/97
guacaccgugcgc

SEQ ID NO: 3166386 - RNA, 17 nt, Mycobacterium bovis subsp bovis AF2122/97
guacaccgugcgccgaa

SEQ ID NO: 3166387 - RNA, 20 nt, Mycobacterium bovis subsp bovis AF2122/97
guacaccucgagcgcggcga

SEQ ID NO: 3166388 - RNA, 23 nt, Mycobacterium bovis subsp bovis AF2122/97
guacaccucgagcgcggcgaucg

SEQ ID NO: 3166389 - RNA, 12 nt, Mycobacterium bovis subsp bovis AF2122/97
guacacggcggc

SEQ ID NO: 3166390 - RNA, 21 nt, Mycobacterium bovis subsp bovis AF2122/97
guacagaucgagggggacgcu

SEQ ID NO: 3166391 - RNA, 11 nt, Mycobacterium bovis subsp bovis AF2122/97
guacagcgccu

SEQ ID NO: 3166392 - RNA, 14 nt, Mycobacterium bovis subsp bovis AF2122/97
guacagcggcggcg

SEQ ID NO: 3166393 - RNA, 17 nt, Mycobacterium bovis subsp bovis AF2122/97
guacagcggcggcgucg

SEQ ID NO: 3166394 - RNA, 13 nt, Mycobacterium bovis subsp bovis AF2122/97
guacaggcgcagc

SEQ ID NO: 3166395 - RNA, 15 nt, Mycobacterium bovis subsp bovis AF2122/97
guacaggcuguccag

SEQ ID NO: 3166396 - RNA, 16 nt, Mycobacterium bovis subsp bovis AF2122/97
guacaggcuguccagc

SEQ ID NO: 3166397 - RNA, 22 nt, Mycobacterium bovis subsp bovis AF2122/97
guacaggguggugaucggcgau

SEQ ID NO: 3166398 - RNA, 15 nt, Mycobacterium bovis subsp bovis AF2122/97
guacaggucggccca

SEQ ID NO: 3166399 - RNA, 14 nt, Mycobacterium bovis subsp bovis AF2122/97
guacaguccacgcg

SEQ ID NO: 3166400 - RNA, 16 nt, Mycobacterium bovis subsp bovis AF2122/97
guacagucgcgcgcuc

SEQ ID NO: 3166401 - RNA, 14 nt, Mycobacterium bovis subsp bovis AF2122/97
guacagugucugcc

SEQ ID NO: 3166402 - RNA, 22 nt, Mycobacterium bovis subsp bovis AF2122/97
guacauacucugcgacaccacg

SEQ ID NO: 3166403 - RNA, 13 nt, Mycobacterium bovis subsp bovis AF2122/97
guacaucagcgcg

SEQ ID NO: 3166404 - RNA, 14 nt, Mycobacterium bovis subsp bovis AF2122/97
guacaucagcgcga

SEQ ID NO: 3166405 - RNA, 17 nt, Mycobacterium bovis subsp bovis AF2122/97
guacaucagcgcgaacg

SEQ ID NO: 3166406 - RNA, 13 nt, Mycobacterium bovis subsp bovis AF2122/97
guacaucccggug

SEQ ID NO: 3166407 - RNA, 21 nt, Mycobacterium bovis subsp bovis AF2122/97
guacaucgaggccacgccagc

SEQ ID NO: 3166408 - RNA, 22 nt, Mycobacterium bovis subsp bovis AF2122/97
guaccaaccugcgcggcgaucg

SEQ ID NO: 3166409 - RNA, 16 nt, Mycobacterium bovis subsp bovis AF2122/97
guaccaauccaggcca

SEQ ID NO: 3166410 - RNA, 22 nt, Mycobacterium bovis subsp bovis AF2122/97
guaccaauccaggccaccccga

SEQ ID NO: 3166411 - RNA, 13 nt, Mycobacterium bovis subsp bovis AF2122/97
guaccaccggcac

SEQ ID NO: 3166412 - RNA, 17 nt, Mycobacterium bovis subsp bovis AF2122/97
guaccaccggcacggug

SEQ ID NO: 3166413 - RNA, 22 nt, Mycobacterium bovis subsp bovis AF2122/97
guaccacgcuggcgcguaucgc

SEQ ID NO: 3166414 - RNA, 17 nt, Mycobacterium bovis subsp bovis AF2122/97
guaccagcccaccggcg

SEQ ID NO: 3166415 - RNA, 23 nt, Mycobacterium bovis subsp bovis AF2122/97
guaccagccgaagaaccggucgc

SEQ ID NO: 3166416 - RNA, 18 nt, Mycobacterium bovis subsp bovis AF2122/97
guacuggaauggcucacg

SEQ ID NO: 3166417 - RNA, 22 nt, Mycobacterium bovis subsp bovis AF2122/97
guacuggcguugccaccggagc

SEQ ID NO: 3166418 - RNA, 15 nt, Mycobacterium bovis subsp bovis AF2122/97
guacugucgucgccc

SEQ ID NO: 3166419 - RNA, 23 nt, Mycobacterium bovis subsp bovis AF2122/97
guacuucauauaccgcucguaga

SEQ ID NO: 3166420 - RNA, 18 nt, Mycobacterium bovis subsp bovis AF2122/97
guacuucgacagcggcga

SEQ ID NO: 3166421 - RNA, 18 nt, Mycobacterium bovis subsp bovis AF2122/97
guacuucgcuggaaaccu

SEQ ID NO: 3166422 - RNA, 18 nt, Mycobacterium bovis subsp bovis AF2122/97
guacuugagggucuugaa

SEQ ID NO: 3166423 - RNA, 15 nt, Mycobacterium bovis subsp bovis AF2122/97
guagaacccaggccg

SEQ ID NO: 3166424 - RNA, 17 nt, Mycobacterium bovis subsp bovis AF2122/97
guagaacgcuagcgcca

SEQ ID NO: 3166425 - RNA, 18 nt, Mycobacterium bovis subsp bovis AF2122/97
guagaacgcuagcgccaa

SEQ ID NO: 3166426 - RNA, 22 nt, Mycobacterium bovis subsp bovis AF2122/97
guagaagauggcaccgcccccg

SEQ ID NO: 3166427 - RNA, 14 nt, Mycobacterium bovis subsp bovis AF2122/97
guagaagcgcucca

SEQ ID NO: 3166428 - RNA, 19 nt, Mycobacterium bovis subsp bovis AF2122/97
guagaagcgcuccagcuga

SEQ ID NO: 3166429 - RNA, 13 nt, Mycobacterium bovis subsp bovis AF2122/97
guagaagcgggcg

SEQ ID NO: 3166430 - RNA, 23 nt, Mycobacterium bovis subsp bovis AF2122/97
guagaaggaccgcucgucgccgg

SEQ ID NO: 3166431 - RNA, 16 nt, Mycobacterium bovis subsp bovis AF2122/97
guagacaagucggcgc

SEQ ID NO: 3166432 - RNA, 18 nt, Mycobacterium bovis subsp bovis AF2122/97
guagacaagucggcgcug

SEQ ID NO: 3166433 - RNA, 19 nt, Mycobacterium bovis subsp bovis AF2122/97
guagaccacgccggugacg

SEQ ID NO: 3166434 - RNA, 13 nt, Mycobacterium bovis subsp bovis AF2122/97
guagaccagcagg

SEQ ID NO: 3166435 - RNA, 16 nt, Mycobacterium bovis subsp bovis AF2122/97
guagaccagcaggccc

SEQ ID NO: 3166436 - RNA, 14 nt, Mycobacterium bovis subsp bovis AF2122/97
guagaccaggccca

SEQ ID NO: 3166437 - RNA, 15 nt, Mycobacterium bovis subsp bovis AF2122/97
guagaccaggcccag

SEQ ID NO: 3166438 - RNA, 19 nt, Mycobacterium bovis subsp bovis AF2122/97
guagacccacagucgccgg

SEQ ID NO: 3166439 - RNA, 19 nt, Mycobacterium bovis subsp bovis AF2122/97
guagacccacaucaggucg

SEQ ID NO: 3166440 - RNA, 18 nt, Mycobacterium bovis subsp bovis AF2122/97
guagaccccaaucgaccg

SEQ ID NO: 3166441 - RNA, 23 nt, Mycobacterium bovis subsp bovis AF2122/97
guagaccccaaucgaccgcccgc

SEQ ID NO: 3166442 - RNA, 21 nt, Mycobacterium bovis subsp bovis AF2122/97
guagaccgagcccgauggugg

SEQ ID NO: 3166443 - RNA, 20 nt, Mycobacterium bovis subsp bovis AF2122/97
guagaccggaaaccacagcg

SEQ ID NO: 3166444 - RNA, 22 nt, Mycobacterium bovis subsp bovis AF2122/97
guagaccuccagugcggccuug

SEQ ID NO: 3166445 - RNA, 16 nt, Mycobacterium bovis subsp bovis AF2122/97
guagaccucgagcuug

SEQ ID NO: 3166446 - RNA, 20 nt, Mycobacterium bovis subsp bovis AF2122/97
guagaccuggccgucgcugg

SEQ ID NO: 3166447 - RNA, 22 nt, Mycobacterium bovis subsp bovis AF2122/97
guagaccugguugaccucggug

SEQ ID NO: 3166448 - RNA, 23 nt, Mycobacterium bovis subsp bovis AF2122/97
guagacgacgucggccgcaucgc

SEQ ID NO: 3166449 - RNA, 16 nt, Mycobacterium bovis subsp bovis AF2122/97
guagacgccaugcacg

SEQ ID NO: 3166450 - RNA, 14 nt, Mycobacterium bovis subsp bovis AF2122/97
guagacggcacccc

SEQ ID NO: 3166451 - RNA, 16 nt, Mycobacterium bovis subsp bovis AF2122/97
guagacggcacccccg

SEQ ID NO: 3166452 - RNA, 22 nt, Mycobacterium bovis subsp bovis AF2122/97
guagacggcacccccgacgaga

SEQ ID NO: 3166453 - RNA, 13 nt, Mycobacterium bovis subsp bovis AF2122/97
guagacggggcga

SEQ ID NO: 3166454 - RNA, 12 nt, Mycobacterium bovis subsp bovis AF2122/97
guagacgguccg

SEQ ID NO: 3166455 - RNA, 17 nt, Mycobacterium bovis subsp bovis AF2122/97
guagacgguccggucgc

SEQ ID NO: 3166456 - RNA, 17 nt, Mycobacterium bovis subsp bovis AF2122/97
guagacgguuaccgcga

SEQ ID NO: 3166457 - RNA, 14 nt, Mycobacterium bovis subsp bovis AF2122/97
guagacguccgcgg

SEQ ID NO: 3166458 - RNA, 14 nt, Mycobacterium bovis subsp bovis AF2122/97
guagacgucgaccg

SEQ ID NO: 3166459 - RNA, 21 nt, Mycobacterium bovis subsp bovis AF2122/97
guagacgucgaccgugucacc

SEQ ID NO: 3166460 - RNA, 22 nt, Mycobacterium bovis subsp bovis AF2122/97
guagacgucguagacaccuucg

SEQ ID NO: 3166461 - RNA, 14 nt, Mycobacterium bovis subsp bovis AF2122/97
guagacgugcguca

SEQ ID NO: 3166462 - RNA, 20 nt, Mycobacterium bovis subsp bovis AF2122/97
guagacgugcgucaggugcg

SEQ ID NO: 3166463 - RNA, 18 nt, Mycobacterium bovis subsp bovis AF2122/97
guagacguugccaacacc

SEQ ID NO: 3166464 - RNA, 17 nt, Mycobacterium bovis subsp bovis AF2122/97
guagacuugcugcuccu

SEQ ID NO: 3166465 - RNA, 19 nt, Mycobacterium bovis subsp bovis AF2122/97
guagagcaugccgcccgcg

SEQ ID NO: 3166466 - RNA, 21 nt, Mycobacterium bovis subsp bovis AF2122/97
guagagcgggccaacucggcg

SEQ ID NO: 3166467 - RNA, 15 nt, Mycobacterium bovis subsp bovis AF2122/97
guagagggagcggcg

SEQ ID NO: 3166468 - RNA, 19 nt, Mycobacterium bovis subsp bovis AF2122/97
guagaucagcgccuggucc

SEQ ID NO: 3166469 - RNA, 19 nt, Mycobacterium bovis subsp bovis AF2122/97
guagaucaucuggcuggug

SEQ ID NO: 3166470 - RNA, 20 nt, Mycobacterium bovis subsp bovis AF2122/97
guagaugguggucaccacca

SEQ ID NO: 3166471 - RNA, 19 nt, Mycobacterium bovis subsp bovis AF2122/97
guagauguucacgccgccg

SEQ ID NO: 3166472 - RNA, 17 nt, Mycobacterium bovis subsp bovis AF2122/97
guagauguugccgcccg

SEQ ID NO: 3166473 - RNA, 17 nt, Mycobacterium bovis subsp bovis AF2122/97
guagauguugccgccug

SEQ ID NO: 3166474 - RNA, 14 nt, Mycobacterium bovis subsp bovis AF2122/97
guagcaacgguagc

SEQ ID NO: 3166475 - RNA, 15 nt, Mycobacterium bovis subsp bovis AF2122/97
guagcaccacaucgg

SEQ ID NO: 3166476 - RNA, 15 nt, Mycobacterium bovis subsp bovis AF2122/97
guagcacccacggcg

SEQ ID NO: 3166477 - RNA, 16 nt, Mycobacterium bovis subsp bovis AF2122/97
guagcagacgcagcca

SEQ ID NO: 3166478 - RNA, 16 nt, Mycobacterium bovis subsp bovis AF2122/97
guagcagcagcgggcc

SEQ ID NO: 3166479 - RNA, 13 nt, Mycobacterium bovis subsp bovis AF2122/97
guagcagcggcuc

SEQ ID NO: 3166480 - RNA, 17 nt, Mycobacterium bovis subsp bovis AF2122/97
guagcagcggcucggcg

SEQ ID NO: 3166481 - RNA, 16 nt, Mycobacterium bovis subsp bovis AF2122/97
guagcaggucgacggc

SEQ ID NO: 3166482 - RNA, 22 nt, Mycobacterium bovis subsp bovis AF2122/97
guagcaggucgacggccacggu

SEQ ID NO: 3166483 - RNA, 19 nt, Mycobacterium bovis subsp bovis AF2122/97
guagcaggucgugaaacca

SEQ ID NO: 3166484 - RNA, 15 nt, Mycobacterium bovis subsp bovis AF2122/97
guagcauccagcgcg

SEQ ID NO: 3166485 - RNA, 20 nt, Mycobacterium bovis subsp bovis AF2122/97
guagccaaccugaagccagc

SEQ ID NO: 3166486 - RNA, 22 nt, Mycobacterium bovis subsp bovis AF2122/97
guagccaaccugaagccagcgc

SEQ ID NO: 3166487 - RNA, 19 nt, Mycobacterium bovis subsp bovis AF2122/97
guagccaagcgagcggucg

SEQ ID NO: 3166488 - RNA, 22 nt, Mycobacterium bovis subsp bovis AF2122/97
guagccaagcgagcggucgacg

SEQ ID NO: 3166489 - RNA, 14 nt, Mycobacterium bovis subsp bovis AF2122/97
guagccacgcccac

SEQ ID NO: 3166490 - RNA, 14 nt, Mycobacterium bovis subsp bovis AF2122/97
guagccagcgcgcu

SEQ ID NO: 3166491 - RNA, 14 nt, Mycobacterium bovis subsp bovis AF2122/97
guagccagcggcug

SEQ ID NO: 3166492 - RNA, 16 nt, Mycobacterium bovis subsp bovis AF2122/97
guagccaggcgcgcua

SEQ ID NO: 3166493 - RNA, 20 nt, Mycobacterium bovis subsp bovis AF2122/97
guagcccaaaaacggcagca

SEQ ID NO: 3166494 - RNA, 16 nt, Mycobacterium bovis subsp bovis AF2122/97
guagcccggaccgccc

SEQ ID NO: 3166495 - RNA, 21 nt, Mycobacterium bovis subsp bovis AF2122/97
guagccgaaucccgcgaugcg

SEQ ID NO: 3166496 - RNA, 23 nt, Mycobacterium bovis subsp bovis AF2122/97
guagccgaccaggaccaccgcau

SEQ ID NO: 3166497 - RNA, 17 nt, Mycobacterium bovis subsp bovis AF2122/97
guagccgaccggcagcg

SEQ ID NO: 3166498 - RNA, 14 nt, Mycobacterium bovis subsp bovis AF2122/97
guagccgacgacac

SEQ ID NO: 3166499 - RNA, 14 nt, Mycobacterium bovis subsp bovis AF2122/97
guagccgagcucgu

SEQ ID NO: 3166500 - RNA, 13 nt, Mycobacterium bovis subsp bovis AF2122/97
guagccgaggucg

SEQ ID NO: 3166501 - RNA, 22 nt, Mycobacterium bovis subsp bovis AF2122/97
guagccgagguucaaagcagcg

SEQ ID NO: 3166502 - RNA, 14 nt, Mycobacterium bovis subsp bovis AF2122/97
guaguaggccuggc

SEQ ID NO: 3166503 - RNA, 14 nt, Mycobacterium bovis subsp bovis AF2122/97
guagucacggucgu

SEQ ID NO: 3166504 - RNA, 18 nt, Mycobacterium bovis subsp bovis AF2122/97
guagucacggucguggug

SEQ ID NO: 3166505 - RNA, 18 nt, Mycobacterium bovis subsp bovis AF2122/97
guaguccagcucgcugcg

SEQ ID NO: 3166506 - RNA, 22 nt, Mycobacterium bovis subsp bovis AF2122/97
guagucccacugccacuccuga

SEQ ID NO: 3166507 - RNA, 23 nt, Mycobacterium bovis subsp bovis AF2122/97
guagucccucaucaccucuccgu

SEQ ID NO: 3166508 - RNA, 19 nt, Mycobacterium bovis subsp bovis AF2122/97
guaguccgcauccgcgacg

SEQ ID NO: 3166509 - RNA, 12 nt, Mycobacterium bovis subsp bovis AF2122/97
guaguccgcugc

SEQ ID NO: 3166510 - RNA, 14 nt, Mycobacterium bovis subsp bovis AF2122/97
guaguccggccagu

SEQ ID NO: 3166511 - RNA, 14 nt, Mycobacterium bovis subsp bovis AF2122/97
guaguccucggugg

SEQ ID NO: 3166512 - RNA, 16 nt, Mycobacterium bovis subsp bovis AF2122/97
guaguccucgguggcc

SEQ ID NO: 3166513 - RNA, 17 nt, Mycobacterium bovis subsp bovis AF2122/97
guaguccugcgggccgu

SEQ ID NO: 3166514 - RNA, 16 nt, Mycobacterium bovis subsp bovis AF2122/97
guagucgaugcugacg

SEQ ID NO: 3166515 - RNA, 21 nt, Mycobacterium bovis subsp bovis AF2122/97
guagucgauuggcugcgccga

SEQ ID NO: 3166516 - RNA, 20 nt, Mycobacterium bovis subsp bovis AF2122/97
guagucgccggucaggcuca

SEQ ID NO: 3166517 - RNA, 19 nt, Mycobacterium bovis subsp bovis AF2122/97
guagucgcgaccgcgggcc

SEQ ID NO: 3166518 - RNA, 13 nt, Mycobacterium bovis subsp bovis AF2122/97
guagucggccagc

SEQ ID NO: 3166519 - RNA, 16 nt, Mycobacterium bovis subsp bovis AF2122/97
guagucggccagcucg

SEQ ID NO: 3166520 - RNA, 16 nt, Mycobacterium bovis subsp bovis AF2122/97
guagucggcgccgaga

SEQ ID NO: 3166521 - RNA, 19 nt, Mycobacterium bovis subsp bovis AF2122/97
guagucgggcaaggcggcg

SEQ ID NO: 3166522 - RNA, 19 nt, Mycobacterium bovis subsp bovis AF2122/97
guagugaucgaucgcggcg

SEQ ID NO: 3166523 - RNA, 14 nt, Mycobacterium bovis subsp bovis AF2122/97
guagugcucgccgg

SEQ ID NO: 3166524 - RNA, 15 nt, Mycobacterium bovis subsp bovis AF2122/97
guaguggccggcuuc

SEQ ID NO: 3166525 - RNA, 13 nt, Mycobacterium bovis subsp bovis AF2122/97
guagugucggcgu

SEQ ID NO: 3166526 - RNA, 16 nt, Mycobacterium bovis subsp bovis AF2122/97
guagugucguaggcga

SEQ ID NO: 3166527 - RNA, 22 nt, Mycobacterium bovis subsp bovis AF2122/97
guaguucaccaacgcgggaacg

SEQ ID NO: 3166528 - RNA, 13 nt, Mycobacterium bovis subsp bovis AF2122/97
guaguucaccgcg

SEQ ID NO: 3166529 - RNA, 14 nt, Mycobacterium bovis subsp bovis AF2122/97
guaguucgaugacu

SEQ ID NO: 3166530 - RNA, 21 nt, Mycobacterium bovis subsp bovis AF2122/97
guaguucgaugacugaaucga

SEQ ID NO: 3166531 - RNA, 15 nt, Mycobacterium bovis subsp bovis AF2122/97
guaguugccggcuuc

SEQ ID NO: 3166532 - RNA, 17 nt, Mycobacterium bovis subsp bovis AF2122/97
guaguugccggcuucgg

SEQ ID NO: 3166533 - RNA, 13 nt, Mycobacterium bovis subsp bovis AF2122/97
guaguugcgcggc

SEQ ID NO: 3166534 - RNA, 17 nt, Mycobacterium bovis subsp bovis AF2122/97
guaguuggcgaccugcg

SEQ ID NO: 3166535 - RNA, 17 nt, Mycobacterium bovis subsp bovis AF2122/97
guaguuggugaacaugu

SEQ ID NO: 3166536 - RNA, 15 nt, Mycobacterium bovis subsp bovis AF2122/97
guauaaacgcggcgc

SEQ ID NO: 3166537 - RNA, 21 nt, Mycobacterium bovis subsp bovis AF2122/97
guauaauucgagauaaccacc

SEQ ID NO: 3166538 - RNA, 22 nt, Mycobacterium bovis subsp bovis AF2122/97
guauagccgguugucgcagcgc

SEQ ID NO: 3166539 - RNA, 22 nt, Mycobacterium bovis subsp bovis AF2122/97
guauccaccgcgagaccuucgg

SEQ ID NO: 3166540 - RNA, 19 nt, Mycobacterium bovis subsp bovis AF2122/97
guauccacggucgaccagg

SEQ ID NO: 3166541 - RNA, 22 nt, Mycobacterium bovis subsp bovis AF2122/97
guauccaggcccauacgugccg

SEQ ID NO: 3166542 - RNA, 16 nt, Mycobacterium bovis subsp bovis AF2122/97
guaucccccagccgcg

SEQ ID NO: 3166543 - RNA, 15 nt, Mycobacterium bovis subsp bovis AF2122/97
guauccccgaccacu

SEQ ID NO: 3166544 - RNA, 15 nt, Mycobacterium bovis subsp bovis AF2122/97
guaucccggucucgg

SEQ ID NO: 3166545 - RNA, 14 nt, Mycobacterium bovis subsp bovis AF2122/97
guauccgacgucgg

SEQ ID NO: 3166546 - RNA, 19 nt, Mycobacterium bovis subsp bovis AF2122/97
guauccgacuggccccgcc

SEQ ID NO: 3166547 - RNA, 18 nt, Mycobacterium bovis subsp bovis AF2122/97
guauccgcgccgcaccau

SEQ ID NO: 3166548 - RNA, 20 nt, Mycobacterium bovis subsp bovis AF2122/97
guauccggcagaccggugcu

SEQ ID NO: 3166549 - RNA, 22 nt, Mycobacterium bovis subsp bovis AF2122/97
guaucgaaagccaacucgaccg

SEQ ID NO: 3166550 - RNA, 23 nt, Mycobacterium bovis subsp bovis AF2122/97
guaucgacccgaugacccacugc

SEQ ID NO: 3166551 - RNA, 21 nt, Mycobacterium bovis subsp bovis AF2122/97
guaucgacccuccagcacgcc

SEQ ID NO: 3166552 - RNA, 15 nt, Mycobacterium bovis subsp bovis AF2122/97
guaucgacggcggcc

SEQ ID NO: 3166553 - RNA, 15 nt, Mycobacterium bovis subsp bovis AF2122/97
guaucgagcggcaca

SEQ ID NO: 3166554 - RNA, 16 nt, Mycobacterium bovis subsp bovis AF2122/97
guaucgaggccgacga

SEQ ID NO: 3166555 - RNA, 16 nt, Mycobacterium bovis subsp bovis AF2122/97
guaucgagggcagccg

SEQ ID NO: 3166556 - RNA, 19 nt, Mycobacterium bovis subsp bovis AF2122/97
guaucgauugaugcguggu

SEQ ID NO: 3166557 - RNA, 19 nt, Mycobacterium bovis subsp bovis AF2122/97
guaucgcagcaucugcggg

SEQ ID NO: 3166558 - RNA, 19 nt, Mycobacterium bovis subsp bovis AF2122/97
guaucgccaaauccggugc

SEQ ID NO: 3166559 - RNA, 16 nt, Mycobacterium bovis subsp bovis AF2122/97
guaucgccggccgcgg

SEQ ID NO: 3166560 - RNA, 9 nt, Mycobacterium bovis subsp bovis AF2122/97
guaucggca

SEQ ID NO: 3166561 - RNA, 13 nt, Mycobacterium bovis subsp bovis AF2122/97
guaucggccggca

SEQ ID NO: 3166562 - RNA, 19 nt, Mycobacterium bovis subsp bovis AF2122/97
guaucggcgugucucgucg

SEQ ID NO: 3166563 - RNA, 15 nt, Mycobacterium bovis subsp bovis AF2122/97
guaucggucgacugg

SEQ ID NO: 3166564 - RNA, 13 nt, Mycobacterium bovis subsp bovis AF2122/97
guaucugcugccg

SEQ ID NO: 3166565 - RNA, 23 nt, Mycobacterium bovis subsp bovis AF2122/97
guaugaggucuacuucggcgccg

SEQ ID NO: 3166566 - RNA, 18 nt, Mycobacterium bovis subsp bovis AF2122/97
guaugauucacgcucggc

SEQ ID NO: 3166567 - RNA, 17 nt, Mycobacterium bovis subsp bovis AF2122/97
guaugcccggacgggga

SEQ ID NO: 3166568 - RNA, 13 nt, Mycobacterium bovis subsp bovis AF2122/97
guaugcggugacg

SEQ ID NO: 3166569 - RNA, 14 nt, Mycobacterium bovis subsp bovis AF2122/97
guaugcugcgcgcc

SEQ ID NO: 3166570 - RNA, 15 nt, Mycobacterium bovis subsp bovis AF2122/97
guaugcugcgcgccg

SEQ ID NO: 3166571 - RNA, 15 nt, Mycobacterium bovis subsp bovis AF2122/97
guauggccgccaccg

SEQ ID NO: 3166572 - RNA, 21 nt, Mycobacterium bovis subsp bovis AF2122/97
guauguaaguuguagacgucg

SEQ ID NO: 3166573 - RNA, 13 nt, Mycobacterium bovis subsp bovis AF2122/97
guauguucggcgg

SEQ ID NO: 3166574 - RNA, 16 nt, Mycobacterium bovis subsp bovis AF2122/97
guauguucggcggugu

SEQ ID NO: 3166575 - RNA, 16 nt, Mycobacterium bovis subsp bovis AF2122/97
guauuaccgccguggc

SEQ ID NO: 3166576 - RNA, 20 nt, Mycobacterium bovis subsp bovis AF2122/97
guauuagggccggcguuggc

SEQ ID NO: 3166577 - RNA, 21 nt, Mycobacterium bovis subsp bovis AF2122/97
guauuccgggguaucgacccu

SEQ ID NO: 3166578 - RNA, 17 nt, Mycobacterium bovis subsp bovis AF2122/97
guauucggcaucgccga

SEQ ID NO: 3166579 - RNA, 19 nt, Mycobacterium bovis subsp bovis AF2122/97
guauucguggucggccucg

SEQ ID NO: 3166580 - RNA, 22 nt, Mycobacterium bovis subsp bovis AF2122/97
guauucguggucggccucgaga

SEQ ID NO: 3166581 - RNA, 17 nt, Mycobacterium bovis subsp bovis AF2122/97
guauucguuggggcugc

SEQ ID NO: 3166582 - RNA, 16 nt, Mycobacterium bovis subsp bovis AF2122/97
guauugauacugcccg

SEQ ID NO: 3166583 - RNA, 19 nt, Mycobacterium bovis subsp bovis AF2122/97
guauugauacugcccgcgu

SEQ ID NO: 3166584 - RNA, 20 nt, Mycobacterium bovis subsp bovis AF2122/97
guauugaucgaauacaccug

SEQ ID NO: 3166585 - RNA, 22 nt, Mycobacterium bovis subsp bovis AF2122/97
guauugccaaagcccgacauga

SEQ ID NO: 3166586 - RNA, 12 nt, Mycobacterium bovis subsp bovis AF2122/97
guauuggggugg

SEQ ID NO: 3166587 - RNA, 13 nt, Mycobacterium bovis subsp bovis AF2122/97
guauugggguggc

SEQ ID NO: 3166588 - RNA, 15 nt, Mycobacterium bovis subsp bovis AF2122/97
guauuggucgguggg

SEQ ID NO: 3166589 - RNA, 12 nt, Mycobacterium bovis subsp bovis AF2122/97
gucacaggcgac

SEQ ID NO: 3166590 - RNA, 14 nt, Mycobacterium bovis subsp bovis AF2122/97
gucacaggcgacac

SEQ ID NO: 3166591 - RNA, 15 nt, Mycobacterium bovis subsp bovis AF2122/97
gucacauagcucaac

SEQ ID NO: 3166592 - RNA, 19 nt, Mycobacterium bovis subsp bovis AF2122/97
gucacauccgacagcagcc

SEQ ID NO: 3166593 - RNA, 16 nt, Mycobacterium bovis subsp bovis AF2122/97
gucaccaaacccgaug

SEQ ID NO: 3166594 - RNA, 18 nt, Mycobacterium bovis subsp bovis AF2122/97
gucaccaagacaccggcc

SEQ ID NO: 3166595 - RNA, 19 nt, Mycobacterium bovis subsp bovis AF2122/97
gucaccaccguggcgcccg

SEQ ID NO: 3166596 - RNA, 19 nt, Mycobacterium bovis subsp bovis AF2122/97
gucaccacgaucgcagugg

SEQ ID NO: 3166597 - RNA, 16 nt, Mycobacterium bovis subsp bovis AF2122/97
gucaccacgcggcggu

SEQ ID NO: 3166598 - RNA, 18 nt, Mycobacterium bovis subsp bovis AF2122/97
gucaccacgcggcggucg

SEQ ID NO: 3166599 - RNA, 15 nt, Mycobacterium bovis subsp bovis AF2122/97
gucaccacggcggcg

SEQ ID NO: 3166600 - RNA, 17 nt, Mycobacterium bovis subsp bovis AF2122/97
gucaccagcgcaucggc

SEQ ID NO: 3166601 - RNA, 18 nt, Mycobacterium bovis subsp bovis AF2122/97
gucaccagcgcaucggcc

SEQ ID NO: 3166602 - RNA, 19 nt, Mycobacterium bovis subsp bovis AF2122/97
gucaccagcgcaucggcca

SEQ ID NO: 3166603 - RNA, 18 nt, Mycobacterium bovis subsp bovis AF2122/97
gucaccaggccgaaaucc

SEQ ID NO: 3166604 - RNA, 21 nt, Mycobacterium bovis subsp bovis AF2122/97
gucaccaggccgaaauccaga

SEQ ID NO: 3166605 - RNA, 23 nt, Mycobacterium bovis subsp bovis AF2122/97
gucacccaauucacgacgccgag

SEQ ID NO: 3166606 - RNA, 20 nt, Mycobacterium bovis subsp bovis AF2122/97
gucacccaucucgaagguga

SEQ ID NO: 3166607 - RNA, 15 nt, Mycobacterium bovis subsp bovis AF2122/97
gucacccccgauacu

SEQ ID NO: 3166608 - RNA, 13 nt, Mycobacterium bovis subsp bovis AF2122/97
gucacccccggcc

SEQ ID NO: 3166609 - RNA, 19 nt, Mycobacterium bovis subsp bovis AF2122/97
gucaccccgauucgugucg

SEQ ID NO: 3166610 - RNA, 14 nt, Mycobacterium bovis subsp bovis AF2122/97
gucaccccgcccag

SEQ ID NO: 3166611 - RNA, 16 nt, Mycobacterium bovis subsp bovis AF2122/97
gucaccccgcccagcg

SEQ ID NO: 3166612 - RNA, 18 nt, Mycobacterium bovis subsp bovis AF2122/97
gucaccccugggcggaug

SEQ ID NO: 3166613 - RNA, 20 nt, Mycobacterium bovis subsp bovis AF2122/97
gucaccccuucgccagcgcc

SEQ ID NO: 3166614 - RNA, 14 nt, Mycobacterium bovis subsp bovis AF2122/97
gucacccgcccgag

SEQ ID NO: 3166615 - RNA, 22 nt, Mycobacterium bovis subsp bovis AF2122/97
gucacccggccguugggccacc

SEQ ID NO: 3166616 - RNA, 13 nt, Mycobacterium bovis subsp bovis AF2122/97
gucacccguaucg

SEQ ID NO: 3166617 - RNA, 15 nt, Mycobacterium bovis subsp bovis AF2122/97
gucacccugucgcgc

SEQ ID NO: 3166618 - RNA, 19 nt, Mycobacterium bovis subsp bovis AF2122/97
gucacccugucgcgcaccg

SEQ ID NO: 3166619 - RNA, 18 nt, Mycobacterium bovis subsp bovis AF2122/97
gucaccgauucggccagc

SEQ ID NO: 3166620 - RNA, 19 nt, Mycobacterium bovis subsp bovis AF2122/97
gucaccgauucggccagcg

SEQ ID NO: 3166621 - RNA, 20 nt, Mycobacterium bovis subsp bovis AF2122/97
gucaccgauucggccagcgc

SEQ ID NO: 3166622 - RNA, 16 nt, Mycobacterium bovis subsp bovis AF2122/97
gucaccgcccuugccg

SEQ ID NO: 3166623 - RNA, 20 nt, Mycobacterium bovis subsp bovis AF2122/97
gucaccgcccuugccgccgg

SEQ ID NO: 3166624 - RNA, 23 nt, Mycobacterium bovis subsp bovis AF2122/97
gucaccgcccuugccgccggccc

SEQ ID NO: 3166625 - RNA, 12 nt, Mycobacterium bovis subsp bovis AF2122/97
gucaccgccggg

SEQ ID NO: 3166626 - RNA, 13 nt, Mycobacterium bovis subsp bovis AF2122/97
gucaccgccggug

SEQ ID NO: 3166627 - RNA, 18 nt, Mycobacterium bovis subsp bovis AF2122/97
gucaccgccguugccgcc

SEQ ID NO: 3166628 - RNA, 13 nt, Mycobacterium bovis subsp bovis AF2122/97
gucaccgcgaccc

SEQ ID NO: 3166629 - RNA, 17 nt, Mycobacterium bovis subsp bovis AF2122/97
gucaccgcgacggaacc

SEQ ID NO: 3166630 - RNA, 17 nt, Mycobacterium bovis subsp bovis AF2122/97
gucaccgcgcuggucag

SEQ ID NO: 3166631 - RNA, 18 nt, Mycobacterium bovis subsp bovis AF2122/97
gucaccgcgcuggucagc

SEQ ID NO: 3166632 - RNA, 15 nt, Mycobacterium bovis subsp bovis AF2122/97
gucaccgcgucaccg

SEQ ID NO: 3166633 - RNA, 16 nt, Mycobacterium bovis subsp bovis AF2122/97
gucaccggaggccgcc

SEQ ID NO: 3166634 - RNA, 18 nt, Mycobacterium bovis subsp bovis AF2122/97
gucaccggaggccgccgc

SEQ ID NO: 3166635 - RNA, 22 nt, Mycobacterium bovis subsp bovis AF2122/97
gucaccggaggccgccgcgccg

SEQ ID NO: 3166636 - RNA, 12 nt, Mycobacterium bovis subsp bovis AF2122/97
gucaccggccgc

SEQ ID NO: 3166637 - RNA, 15 nt, Mycobacterium bovis subsp bovis AF2122/97
gucaccggccgccga

SEQ ID NO: 3166638 - RNA, 17 nt, Mycobacterium bovis subsp bovis AF2122/97
gucaccggccgccgaca

SEQ ID NO: 3166639 - RNA, 13 nt, Mycobacterium bovis subsp bovis AF2122/97
gucaccggcgacc

SEQ ID NO: 3166640 - RNA, 18 nt, Mycobacterium bovis subsp bovis AF2122/97
gucaccggcgaccggugc

SEQ ID NO: 3166641 - RNA, 14 nt, Mycobacterium bovis subsp bovis AF2122/97
gucaccggcgucgc

SEQ ID NO: 3166642 - RNA, 19 nt, Mycobacterium bovis subsp bovis AF2122/97
gucaccggcgucgcugccu

SEQ ID NO: 3166643 - RNA, 14 nt, Mycobacterium bovis subsp bovis AF2122/97
gucaccggcuucgg

SEQ ID NO: 3166644 - RNA, 22 nt, Mycobacterium bovis subsp bovis AF2122/97
gucaccggcuucggccagcagu

SEQ ID NO: 3166645 - RNA, 20 nt, Mycobacterium bovis subsp bovis AF2122/97
gucaccggcuucuccuccag

SEQ ID NO: 3166646 - RNA, 16 nt, Mycobacterium bovis subsp bovis AF2122/97
gucaccggguccaccg

SEQ ID NO: 3166647 - RNA, 18 nt, Mycobacterium bovis subsp bovis AF2122/97
gucaccggguccaccgca

SEQ ID NO: 3166648 - RNA, 14 nt, Mycobacterium bovis subsp bovis AF2122/97
gucaccgggugcac

SEQ ID NO: 3166649 - RNA, 15 nt, Mycobacterium bovis subsp bovis AF2122/97
gucaccgggugcacc

SEQ ID NO: 3166650 - RNA, 18 nt, Mycobacterium bovis subsp bovis AF2122/97
gucaccgggugcaccggc

SEQ ID NO: 3166651 - RNA, 15 nt, Mycobacterium bovis subsp bovis AF2122/97
gucaccggucaccgc

SEQ ID NO: 3166652 - RNA, 21 nt, Mycobacterium bovis subsp bovis AF2122/97
gucaccggucaccgcgcagcg

SEQ ID NO: 3166653 - RNA, 19 nt, Mycobacterium bovis subsp bovis AF2122/97
gucaccgucugcaccggca

SEQ ID NO: 3166654 - RNA, 22 nt, Mycobacterium bovis subsp bovis AF2122/97
gucaccgucugcaccggcaggc

SEQ ID NO: 3166655 - RNA, 16 nt, Mycobacterium bovis subsp bovis AF2122/97
gucaccguuggccgcg

SEQ ID NO: 3166656 - RNA, 13 nt, Mycobacterium bovis subsp bovis AF2122/97
gucaccucgaugc

SEQ ID NO: 3166657 - RNA, 16 nt, Mycobacterium bovis subsp bovis AF2122/97
gucaccucgccggcgg

SEQ ID NO: 3166658 - RNA, 17 nt, Mycobacterium bovis subsp bovis AF2122/97
gucaccucgccggcggg

SEQ ID NO: 3166659 - RNA, 23 nt, Mycobacterium bovis subsp bovis AF2122/97
gucaccugcaucgucgccaagcc

SEQ ID NO: 3166660 - RNA, 13 nt, Mycobacterium bovis subsp bovis AF2122/97
gucaccugcgggc

SEQ ID NO: 3166661 - RNA, 15 nt, Mycobacterium bovis subsp bovis AF2122/97
gucaccugcugcaac

SEQ ID NO: 3166662 - RNA, 16 nt, Mycobacterium bovis subsp bovis AF2122/97
gucaccuugaccgggu

SEQ ID NO: 3166663 - RNA, 15 nt, Mycobacterium bovis subsp bovis AF2122/97
gucaccuuggccggg

SEQ ID NO: 3166664 - RNA, 22 nt, Mycobacterium bovis subsp bovis AF2122/97
gucacgacccaagucgccgagg

SEQ ID NO: 3166665 - RNA, 14 nt, Mycobacterium bovis subsp bovis AF2122/97
gucacgacggcacg

SEQ ID NO: 3166666 - RNA, 14 nt, Mycobacterium bovis subsp bovis AF2122/97
gucacgacguccga

SEQ ID NO: 3166667 - RNA, 15 nt, Mycobacterium bovis subsp bovis AF2122/97
gucacgacguccgau

SEQ ID NO: 3166668 - RNA, 14 nt, Mycobacterium bovis subsp bovis AF2122/97
gucacgaucgugcc

SEQ ID NO: 3166669 - RNA, 16 nt, Mycobacterium bovis subsp bovis AF2122/97
gucacgaucgugccgg

SEQ ID NO: 3166670 - RNA, 16 nt, Mycobacterium bovis subsp bovis AF2122/97
gucacgcaaccggcgg

SEQ ID NO: 3166671 - RNA, 17 nt, Mycobacterium bovis subsp bovis AF2122/97
gucacgcaaccggcgga

SEQ ID NO: 3166672 - RNA, 16 nt, Mycobacterium bovis subsp bovis AF2122/97
gucacgcacccggcgc

SEQ ID NO: 3166673 - RNA, 12 nt, Mycobacterium bovis subsp bovis AF2122/97
gucacgcaccgc

SEQ ID NO: 3166674 - RNA, 17 nt, Mycobacterium bovis subsp bovis AF2122/97
gucacgcaccgcggugg

SEQ ID NO: 3166675 - RNA, 15 nt, Mycobacterium bovis subsp bovis AF2122/97
gucacgcagccgcgc

SEQ ID NO: 3166676 - RNA, 19 nt, Mycobacterium bovis subsp bovis AF2122/97
gucagcgggcacgccgccg

SEQ ID NO: 3166677 - RNA, 16 nt, Mycobacterium bovis subsp bovis AF2122/97
gucagcgggcagcagg

SEQ ID NO: 3166678 - RNA, 20 nt, Mycobacterium bovis subsp bovis AF2122/97
gucagcgggcagcaggcgau

SEQ ID NO: 3166679 - RNA, 19 nt, Mycobacterium bovis subsp bovis AF2122/97
gucagcgggucgaccccgg

SEQ ID NO: 3166680 - RNA, 14 nt, Mycobacterium bovis subsp bovis AF2122/97
gucagcgugcaggu

SEQ ID NO: 3166681 - RNA, 20 nt, Mycobacterium bovis subsp bovis AF2122/97
gucagcguggacgcccgccc

SEQ ID NO: 3166682 - RNA, 23 nt, Mycobacterium bovis subsp bovis AF2122/97
gucagcguugaccgcaucgucga

SEQ ID NO: 3166683 - RNA, 21 nt, Mycobacterium bovis subsp bovis AF2122/97
gucagcuaauaccugcggauu

SEQ ID NO: 3166684 - RNA, 16 nt, Mycobacterium bovis subsp bovis AF2122/97
gucagcucaccaccca

SEQ ID NO: 3166685 - RNA, 22 nt, Mycobacterium bovis subsp bovis AF2122/97
gucagcuccauccccuuggugg

SEQ ID NO: 3166686 - RNA, 16 nt, Mycobacterium bovis subsp bovis AF2122/97
gucagcuccgcgcagc

SEQ ID NO: 3166687 - RNA, 14 nt, Mycobacterium bovis subsp bovis AF2122/97
gucagcucgaccug

SEQ ID NO: 3166688 - RNA, 15 nt, Mycobacterium bovis subsp bovis AF2122/97
gucagcucgaccuga

SEQ ID NO: 3166689 - RNA, 12 nt, Mycobacterium bovis subsp bovis AF2122/97
gucagcucggca

SEQ ID NO: 3166690 - RNA, 19 nt, Mycobacterium bovis subsp bovis AF2122/97
gucagcucggcagcaucuc

SEQ ID NO: 3166691 - RNA, 15 nt, Mycobacterium bovis subsp bovis AF2122/97
gucagcucgucggcg

SEQ ID NO: 3166692 - RNA, 20 nt, Mycobacterium bovis subsp bovis AF2122/97
gucagcugggacccgagcag

SEQ ID NO: 3166693 - RNA, 18 nt, Mycobacterium bovis subsp bovis AF2122/97
gucagcuguuugccggcu

SEQ ID NO: 3166694 - RNA, 20 nt, Mycobacterium bovis subsp bovis AF2122/97
gucagcuuggacccugcgcc

SEQ ID NO: 3166695 - RNA, 17 nt, Mycobacterium bovis subsp bovis AF2122/97
gucagcuuuaucggccc

SEQ ID NO: 3166696 - RNA, 12 nt, Mycobacterium bovis subsp bovis AF2122/97
gucaggaaaccg

SEQ ID NO: 3166697 - RNA, 22 nt, Mycobacterium bovis subsp bovis AF2122/97
gucaggaacaaguagccgucgu

SEQ ID NO: 3166698 - RNA, 20 nt, Mycobacterium bovis subsp bovis AF2122/97
gucaggaaccacccaccggc

SEQ ID NO: 3166699 - RNA, 21 nt, Mycobacterium bovis subsp bovis AF2122/97
gucaggcagcuccgccgccga

SEQ ID NO: 3166700 - RNA, 16 nt, Mycobacterium bovis subsp bovis AF2122/97
gucaggccagagucgc

SEQ ID NO: 3166701 - RNA, 12 nt, Mycobacterium bovis subsp bovis AF2122/97
gucaggccagcg

SEQ ID NO: 3166702 - RNA, 19 nt, Mycobacterium bovis subsp bovis AF2122/97
gucaggcccauggcagccc

SEQ ID NO: 3166703 - RNA, 18 nt, Mycobacterium bovis subsp bovis AF2122/97
gucaggcccucggguguc

SEQ ID NO: 3166704 - RNA, 13 nt, Mycobacterium bovis subsp bovis AF2122/97
gucaggccgccgc

SEQ ID NO: 3166705 - RNA, 18 nt, Mycobacterium bovis subsp bovis AF2122/97
gucaggccuagcgcggcg

SEQ ID NO: 3166706 - RNA, 21 nt, Mycobacterium bovis subsp bovis AF2122/97
gucaggccuagcgcggcgacg

SEQ ID NO: 3166707 - RNA, 16 nt, Mycobacterium bovis subsp bovis AF2122/97
gucaggcgaaccuggu

SEQ ID NO: 3166708 - RNA, 12 nt, Mycobacterium bovis subsp bovis AF2122/97
gucaggcggccg

SEQ ID NO: 3166709 - RNA, 15 nt, Mycobacterium bovis subsp bovis AF2122/97
gucaggcggccgucg

SEQ ID NO: 3166710 - RNA, 20 nt, Mycobacterium bovis subsp bovis AF2122/97
gucaggcggccgucgucggc

SEQ ID NO: 3166711 - RNA, 14 nt, Mycobacterium bovis subsp bovis AF2122/97
gucaggcggcggac

SEQ ID NO: 3166712 - RNA, 14 nt, Mycobacterium bovis subsp bovis AF2122/97
gucaggcggcuggc

SEQ ID NO: 3166713 - RNA, 15 nt, Mycobacterium bovis subsp bovis AF2122/97
gucaggcucauccgc

SEQ ID NO: 3166714 - RNA, 20 nt, Mycobacterium bovis subsp bovis AF2122/97
gucaggcucauccgccgggc

SEQ ID NO: 3166715 - RNA, 17 nt, Mycobacterium bovis subsp bovis AF2122/97
gucaggcuggaggugaa

SEQ ID NO: 3166716 - RNA, 16 nt, Mycobacterium bovis subsp bovis AF2122/97
gucagggucaccugcg

SEQ ID NO: 3166717 - RNA, 17 nt, Mycobacterium bovis subsp bovis AF2122/97
gucagggucagcuggga

SEQ ID NO: 3166718 - RNA, 21 nt, Mycobacterium bovis subsp bovis AF2122/97
gucaggguguugcggcugacc

SEQ ID NO: 3166719 - RNA, 17 nt, Mycobacterium bovis subsp bovis AF2122/97
gucagguaauucgucca

SEQ ID NO: 3166720 - RNA, 18 nt, Mycobacterium bovis subsp bovis AF2122/97
gucagguaauucguccac

SEQ ID NO: 3166721 - RNA, 14 nt, Mycobacterium bovis subsp bovis AF2122/97
gucagguacauccc

SEQ ID NO: 3166722 - RNA, 20 nt, Mycobacterium bovis subsp bovis AF2122/97
gucaggucugacagaccggg

SEQ ID NO: 3166723 - RNA, 20 nt, Mycobacterium bovis subsp bovis AF2122/97
gucaggugauucgcgcagcg

SEQ ID NO: 3166724 - RNA, 16 nt, Mycobacterium bovis subsp bovis AF2122/97
gucaggugcgcgacca

SEQ ID NO: 3166725 - RNA, 19 nt, Mycobacterium bovis subsp bovis AF2122/97
gucagguucuaccaaaucg

SEQ ID NO: 3166726 - RNA, 17 nt, Mycobacterium bovis subsp bovis AF2122/97
gucagguugucggcgau

SEQ ID NO: 3166727 - RNA, 18 nt, Mycobacterium bovis subsp bovis AF2122/97
gucaguaauucggccauc

SEQ ID NO: 3166728 - RNA, 13 nt, Mycobacterium bovis subsp bovis AF2122/97
gucaguagccacg

SEQ ID NO: 3166729 - RNA, 14 nt, Mycobacterium bovis subsp bovis AF2122/97
gucaguaggcggau

SEQ ID NO: 3166730 - RNA, 22 nt, Mycobacterium bovis subsp bovis AF2122/97
gucaguaggcggaucuuggugu

SEQ ID NO: 3166731 - RNA, 14 nt, Mycobacterium bovis subsp bovis AF2122/97
gucagucaccaacc

SEQ ID NO: 3166732 - RNA, 21 nt, Mycobacterium bovis subsp bovis AF2122/97
gucaguccgacaccacggacc

SEQ ID NO: 3166733 - RNA, 15 nt, Mycobacterium bovis subsp bovis AF2122/97
gucaguccgucggcc

SEQ ID NO: 3166734 - RNA, 22 nt, Mycobacterium bovis subsp bovis AF2122/97
gucaguccucaucgagcgcgcg

SEQ ID NO: 3166735 - RNA, 15 nt, Mycobacterium bovis subsp bovis AF2122/97
gucagugaucaccaa

SEQ ID NO: 3166736 - RNA, 17 nt, Mycobacterium bovis subsp bovis AF2122/97
gucagugccccgcccgg

SEQ ID NO: 3166737 - RNA, 22 nt, Mycobacterium bovis subsp bovis AF2122/97
gucaguuacgcaucgucagcga

SEQ ID NO: 3166738 - RNA, 15 nt, Mycobacterium bovis subsp bovis AF2122/97
gucaguucccagacc

SEQ ID NO: 3166739 - RNA, 23 nt, Mycobacterium bovis subsp bovis AF2122/97
gucaguucccagaccaccgugac

SEQ ID NO: 3166740 - RNA, 14 nt, Mycobacterium bovis subsp bovis AF2122/97
gucauacccagcuc

SEQ ID NO: 3166741 - RNA, 19 nt, Mycobacterium bovis subsp bovis AF2122/97
gucauacccagcucgucgc

SEQ ID NO: 3166742 - RNA, 22 nt, Mycobacterium bovis subsp bovis AF2122/97
gucauacccagcucgucgcuga

SEQ ID NO: 3166743 - RNA, 15 nt, Mycobacterium bovis subsp bovis AF2122/97
gucauaucucgagcc

SEQ ID NO: 3166744 - RNA, 20 nt, Mycobacterium bovis subsp bovis AF2122/97
gucauauugugggugcgacg

SEQ ID NO: 3166745 - RNA, 15 nt, Mycobacterium bovis subsp bovis AF2122/97
gucaucaacguucaa

SEQ ID NO: 3166746 - RNA, 16 nt, Mycobacterium bovis subsp bovis AF2122/97
gucauccaaccguggu

SEQ ID NO: 3166747 - RNA, 23 nt, Mycobacterium bovis subsp bovis AF2122/97
gucauccauccgggccgcggcca

SEQ ID NO: 3166748 - RNA, 16 nt, Mycobacterium bovis subsp bovis AF2122/97
gucauccccggccagc

SEQ ID NO: 3166749 - RNA, 15 nt, Mycobacterium bovis subsp bovis AF2122/97
gucaucccgagcucu

SEQ ID NO: 3166750 - RNA, 14 nt, Mycobacterium bovis subsp bovis AF2122/97
gucauccggccguc

SEQ ID NO: 3166751 - RNA, 15 nt, Mycobacterium bovis subsp bovis AF2122/97
gucauccggccgucg

SEQ ID NO: 3166752 - RNA, 15 nt, Mycobacterium bovis subsp bovis AF2122/97
gucauccuugagguc

SEQ ID NO: 3166753 - RNA, 14 nt, Mycobacterium bovis subsp bovis AF2122/97
gucaucgacgagcg

SEQ ID NO: 3166754 - RNA, 22 nt, Mycobacterium bovis subsp bovis AF2122/97
gucaucgacuugccgccgcaca

SEQ ID NO: 3166755 - RNA, 22 nt, Mycobacterium bovis subsp bovis AF2122/97
gucaucgagcgggaucgggccc

SEQ ID NO: 3166756 - RNA, 13 nt, Mycobacterium bovis subsp bovis AF2122/97
gucaucgccagcg

SEQ ID NO: 3166757 - RNA, 19 nt, Mycobacterium bovis subsp bovis AF2122/97
gucaucgccggguagcugu

SEQ ID NO: 3166758 - RNA, 16 nt, Mycobacterium bovis subsp bovis AF2122/97
gucaucgccucggcgu

SEQ ID NO: 3166759 - RNA, 16 nt, Mycobacterium bovis subsp bovis AF2122/97
gucaucgcgggugauc

SEQ ID NO: 3166760 - RNA, 23 nt, Mycobacterium bovis subsp bovis AF2122/97
gucaucgcgggugaucuccaccg

SEQ ID NO: 3166761 - RNA, 18 nt, Mycobacterium bovis subsp bovis AF2122/97
gucaucgcggugugccgg

SEQ ID NO: 3166762 - RNA, 15 nt, Mycobacterium bovis subsp bovis AF2122/97
gucaucgcguaguga

SEQ ID NO: 3166763 - RNA, 22 nt, Mycobacterium bovis subsp bovis AF2122/97
guccagcagcucggccgaggcg

SEQ ID NO: 3166764 - RNA, 22 nt, Mycobacterium bovis subsp bovis AF2122/97
guccagccaacgggaacaacgg

SEQ ID NO: 3166765 - RNA, 24 nt, Mycobacterium bovis subsp bovis AF2122/97
guccagccaacgggaacaacggcg

SEQ ID NO: 3166766 - RNA, 13 nt, Mycobacterium bovis subsp bovis AF2122/97
guccagccaccga

SEQ ID NO: 3166767 - RNA, 13 nt, Mycobacterium bovis subsp bovis AF2122/97
guccagccaccgc

SEQ ID NO: 3166768 - RNA, 12 nt, Mycobacterium bovis subsp bovis AF2122/97
guccagcccaga

SEQ ID NO: 3166769 - RNA, 17 nt, Mycobacterium bovis subsp bovis AF2122/97
guccagccggcgcgccg

SEQ ID NO: 3166770 - RNA, 14 nt, Mycobacterium bovis subsp bovis AF2122/97
guccagccggucca

SEQ ID NO: 3166771 - RNA, 18 nt, Mycobacterium bovis subsp bovis AF2122/97
guccagccgguccagacc

SEQ ID NO: 3166772 - RNA, 15 nt, Mycobacterium bovis subsp bovis AF2122/97
guccagccggugacg

SEQ ID NO: 3166773 - RNA, 21 nt, Mycobacterium bovis subsp bovis AF2122/97
guccagccggugacguggugg

SEQ ID NO: 3166774 - RNA, 18 nt, Mycobacterium bovis subsp bovis AF2122/97
guccagccguggcggcgg

SEQ ID NO: 3166775 - RNA, 20 nt, Mycobacterium bovis subsp bovis AF2122/97
guccagccguggcggcgggc

SEQ ID NO: 3166776 - RNA, 18 nt, Mycobacterium bovis subsp bovis AF2122/97
guccagcgaucccgguga

SEQ ID NO: 3166777 - RNA, 15 nt, Mycobacterium bovis subsp bovis AF2122/97
guccagcgccgcggc

SEQ ID NO: 3166778 - RNA, 16 nt, Mycobacterium bovis subsp bovis AF2122/97
guccagcgccgcggcc

SEQ ID NO: 3166779 - RNA, 22 nt, Mycobacterium bovis subsp bovis AF2122/97
guccagcgccgcggcccgcucg

SEQ ID NO: 3166780 - RNA, 15 nt, Mycobacterium bovis subsp bovis AF2122/97
guccagcgcgacguc

SEQ ID NO: 3166781 - RNA, 20 nt, Mycobacterium bovis subsp bovis AF2122/97
guccagcgcgccacccagca

SEQ ID NO: 3166782 - RNA, 15 nt, Mycobacterium bovis subsp bovis AF2122/97
guccagcgcggccuu

SEQ ID NO: 3166783 - RNA, 15 nt, Mycobacterium bovis subsp bovis AF2122/97
guccagcggccgccg

SEQ ID NO: 3166784 - RNA, 18 nt, Mycobacterium bovis subsp bovis AF2122/97
guccagcggccgccgcgg

SEQ ID NO: 3166785 - RNA, 13 nt, Mycobacterium bovis subsp bovis AF2122/97
guccagcgggcau

SEQ ID NO: 3166786 - RNA, 23 nt, Mycobacterium bovis subsp bovis AF2122/97
guccagcgggcauaacccgcacc

SEQ ID NO: 3166787 - RNA, 17 nt, Mycobacterium bovis subsp bovis AF2122/97
guccagcguccuggcgu

SEQ ID NO: 3166788 - RNA, 14 nt, Mycobacterium bovis subsp bovis AF2122/97
guccagcgucgccg

SEQ ID NO: 3166789 - RNA, 13 nt, Mycobacterium bovis subsp bovis AF2122/97
guccagcuggccg

SEQ ID NO: 3166790 - RNA, 22 nt, Mycobacterium bovis subsp bovis AF2122/97
guccagcuggccgggugcgugc

SEQ ID NO: 3166791 - RNA, 23 nt, Mycobacterium bovis subsp bovis AF2122/97
guccaggaacuugugccgggcga

SEQ ID NO: 3166792 - RNA, 15 nt, Mycobacterium bovis subsp bovis AF2122/97
guccaggagugcggg

SEQ ID NO: 3166793 - RNA, 21 nt, Mycobacterium bovis subsp bovis AF2122/97
guccaggaucgcguggcgcac

SEQ ID NO: 3166794 - RNA, 19 nt, Mycobacterium bovis subsp bovis AF2122/97
guccaggcacuccagcggc

SEQ ID NO: 3166795 - RNA, 15 nt, Mycobacterium bovis subsp bovis AF2122/97
guccaggccggcacc

SEQ ID NO: 3166796 - RNA, 16 nt, Mycobacterium bovis subsp bovis AF2122/97
guccaggccggcaccc

SEQ ID NO: 3166797 - RNA, 16 nt, Mycobacterium bovis subsp bovis AF2122/97
guccaggcgcgcacca

SEQ ID NO: 3166798 - RNA, 19 nt, Mycobacterium bovis subsp bovis AF2122/97
guccaggcgcgcaccaccg

SEQ ID NO: 3166799 - RNA, 15 nt, Mycobacterium bovis subsp bovis AF2122/97
guccaggcgcugcag

SEQ ID NO: 3166800 - RNA, 13 nt, Mycobacterium bovis subsp bovis AF2122/97
guccagggccugu

SEQ ID NO: 3166801 - RNA, 22 nt, Mycobacterium bovis subsp bovis AF2122/97
guccaggguggucaguccgucg

SEQ ID NO: 3166802 - RNA, 21 nt, Mycobacterium bovis subsp bovis AF2122/97
guccaggugcgccguggcauc

SEQ ID NO: 3166803 - RNA, 22 nt, Mycobacterium bovis subsp bovis AF2122/97
guccagguucuucuccaccacc

SEQ ID NO: 3166804 - RNA, 23 nt, Mycobacterium bovis subsp bovis AF2122/97
guccagguucuucuccaccaccg

SEQ ID NO: 3166805 - RNA, 15 nt, Mycobacterium bovis subsp bovis AF2122/97
guccaguccguccag

SEQ ID NO: 3166806 - RNA, 21 nt, Mycobacterium bovis subsp bovis AF2122/97
guccagugcauucccgccuuc

SEQ ID NO: 3166807 - RNA, 19 nt, Mycobacterium bovis subsp bovis AF2122/97
guccauauagaucacugcu

SEQ ID NO: 3166808 - RNA, 18 nt, Mycobacterium bovis subsp bovis AF2122/97
guccaucaagagcgcgcc

SEQ ID NO: 3166809 - RNA, 17 nt, Mycobacterium bovis subsp bovis AF2122/97
guccaucaccggcggcc

SEQ ID NO: 3166810 - RNA, 20 nt, Mycobacterium bovis subsp bovis AF2122/97
guccaucaccggcggcccca

SEQ ID NO: 3166811 - RNA, 19 nt, Mycobacterium bovis subsp bovis AF2122/97
guccaucccggcgccgcgg

SEQ ID NO: 3166812 - RNA, 16 nt, Mycobacterium bovis subsp bovis AF2122/97
guccaucgccaccgcg

SEQ ID NO: 3166813 - RNA, 18 nt, Mycobacterium bovis subsp bovis AF2122/97
guccaucgccaccgcguc

SEQ ID NO: 3166814 - RNA, 16 nt, Mycobacterium bovis subsp bovis AF2122/97
guccaucgcgcgccga

SEQ ID NO: 3166815 - RNA, 19 nt, Mycobacterium bovis subsp bovis AF2122/97
guccaucgcgcggcugugc

SEQ ID NO: 3166816 - RNA, 23 nt, Mycobacterium bovis subsp bovis AF2122/97
guccaucgcgcugcggcccacac

SEQ ID NO: 3166817 - RNA, 17 nt, Mycobacterium bovis subsp bovis AF2122/97
guccauggacggccagg

SEQ ID NO: 3166818 - RNA, 16 nt, Mycobacterium bovis subsp bovis AF2122/97
guccaugugcccaggu

SEQ ID NO: 3166819 - RNA, 21 nt, Mycobacterium bovis subsp bovis AF2122/97
guccauguggggucagugcgg

SEQ ID NO: 3166820 - RNA, 22 nt, Mycobacterium bovis subsp bovis AF2122/97
guccauguggggucagugcggg

SEQ ID NO: 3166821 - RNA, 21 nt, Mycobacterium bovis subsp bovis AF2122/97
guccauguuuugcugcaugcc

SEQ ID NO: 3166822 - RNA, 15 nt, Mycobacterium bovis subsp bovis AF2122/97
gucccaacacggcga

SEQ ID NO: 3166823 - RNA, 17 nt, Mycobacterium bovis subsp bovis AF2122/97
gucccaacacggcgaca

SEQ ID NO: 3166824 - RNA, 22 nt, Mycobacterium bovis subsp bovis AF2122/97
gucccaacgccacugcgccgug

SEQ ID NO: 3166825 - RNA, 16 nt, Mycobacterium bovis subsp bovis AF2122/97
gucccaaucgucggcc

SEQ ID NO: 3166826 - RNA, 20 nt, Mycobacterium bovis subsp bovis AF2122/97
gucccaaucgucggccagca

SEQ ID NO: 3166827 - RNA, 19 nt, Mycobacterium bovis subsp bovis AF2122/97
gucccacaccuccucgagc

SEQ ID NO: 3166828 - RNA, 17 nt, Mycobacterium bovis subsp bovis AF2122/97
gucccacauccaucgcc

SEQ ID NO: 3166829 - RNA, 21 nt, Mycobacterium bovis subsp bovis AF2122/97
gucccacauccaucgccagug

SEQ ID NO: 3166830 - RNA, 14 nt, Mycobacterium bovis subsp bovis AF2122/97
gucccacgccagcg

SEQ ID NO: 3166831 - RNA, 15 nt, Mycobacterium bovis subsp bovis AF2122/97
gucccacgugugcgg

SEQ ID NO: 3166832 - RNA, 14 nt, Mycobacterium bovis subsp bovis AF2122/97
gucccacugcgcgu

SEQ ID NO: 3166833 - RNA, 20 nt, Mycobacterium bovis subsp bovis AF2122/97
gucccacugcgcgucgagcg

SEQ ID NO: 3166834 - RNA, 15 nt, Mycobacterium bovis subsp bovis AF2122/97
gucccagagaaucag

SEQ ID NO: 3166835 - RNA, 15 nt, Mycobacterium bovis subsp bovis AF2122/97
gucccagcacacccc

SEQ ID NO: 3166836 - RNA, 18 nt, Mycobacterium bovis subsp bovis AF2122/97
gucccagccgaucacggg

SEQ ID NO: 3166837 - RNA, 17 nt, Mycobacterium bovis subsp bovis AF2122/97
gucccagcgccgcagug

SEQ ID NO: 3166838 - RNA, 20 nt, Mycobacterium bovis subsp bovis AF2122/97
gucccagcgguagccgagcu

SEQ ID NO: 3166839 - RNA, 16 nt, Mycobacterium bovis subsp bovis AF2122/97
gucccagcugaccagc

SEQ ID NO: 3166840 - RNA, 19 nt, Mycobacterium bovis subsp bovis AF2122/97
gucccagcugaccagcguc

SEQ ID NO: 3166841 - RNA, 22 nt, Mycobacterium bovis subsp bovis AF2122/97
gucccaggacuccggccgcacg

SEQ ID NO: 3166842 - RNA, 16 nt, Mycobacterium bovis subsp bovis AF2122/97
gucccagggcugccgg

SEQ ID NO: 3166843 - RNA, 16 nt, Mycobacterium bovis subsp bovis AF2122/97
gucccaggugcuggua

SEQ ID NO: 3166844 - RNA, 16 nt, Mycobacterium bovis subsp bovis AF2122/97
gucccaguacgaucgu

SEQ ID NO: 3166845 - RNA, 16 nt, Mycobacterium bovis subsp bovis AF2122/97
gucccagucccgcguc

SEQ ID NO: 3166846 - RNA, 22 nt, Mycobacterium bovis subsp bovis AF2122/97
gucccaguucguugguguugga

SEQ ID NO: 3166847 - RNA, 23 nt, Mycobacterium bovis subsp bovis AF2122/97
gucccaugcacggccgagcaggu

SEQ ID NO: 3166848 - RNA, 20 nt, Mycobacterium bovis subsp bovis AF2122/97
gucccauggaauuccgccug

SEQ ID NO: 3166849 - RNA, 22 nt, Mycobacterium bovis subsp bovis AF2122/97
guccgcagacgacaaccgagcu

SEQ ID NO: 3166850 - RNA, 13 nt, Mycobacterium bovis subsp bovis AF2122/97
guccgcagcgucc

SEQ ID NO: 3166851 - RNA, 19 nt, Mycobacterium bovis subsp bovis AF2122/97
guccgcagcguccagcgcc

SEQ ID NO: 3166852 - RNA, 17 nt, Mycobacterium bovis subsp bovis AF2122/97
guccgcaguucggucgu

SEQ ID NO: 3166853 - RNA, 18 nt, Mycobacterium bovis subsp bovis AF2122/97
guccgcaguucggucguc

SEQ ID NO: 3166854 - RNA, 20 nt, Mycobacterium bovis subsp bovis AF2122/97
guccgcauccgcgacggcgc

SEQ ID NO: 3166855 - RNA, 21 nt, Mycobacterium bovis subsp bovis AF2122/97
guccgcauccgcgacggcgcc

SEQ ID NO: 3166856 - RNA, 20 nt, Mycobacterium bovis subsp bovis AF2122/97
guccgccaaguacugggcca

SEQ ID NO: 3166857 - RNA, 17 nt, Mycobacterium bovis subsp bovis AF2122/97
guccgccacggcgggcg

SEQ ID NO: 3166858 - RNA, 16 nt, Mycobacterium bovis subsp bovis AF2122/97
guccgccagcgcgaac

SEQ ID NO: 3166859 - RNA, 17 nt, Mycobacterium bovis subsp bovis AF2122/97
guccgccauuggcgccg

SEQ ID NO: 3166860 - RNA, 22 nt, Mycobacterium bovis subsp bovis AF2122/97
guccgccauuggcgccgucacc

SEQ ID NO: 3166861 - RNA, 22 nt, Mycobacterium bovis subsp bovis AF2122/97
guccgccauugucgaucuggua

SEQ ID NO: 3166862 - RNA, 14 nt, Mycobacterium bovis subsp bovis AF2122/97
guccgcccagcacc

SEQ ID NO: 3166863 - RNA, 18 nt, Mycobacterium bovis subsp bovis AF2122/97
guccgcccagccgcagca

SEQ ID NO: 3166864 - RNA, 22 nt, Mycobacterium bovis subsp bovis AF2122/97
guccgccccguugugucaccgg

SEQ ID NO: 3166865 - RNA, 17 nt, Mycobacterium bovis subsp bovis AF2122/97
guccgccgcagaccugc

SEQ ID NO: 3166866 - RNA, 21 nt, Mycobacterium bovis subsp bovis AF2122/97
guccgccggauagcaccggca

SEQ ID NO: 3166867 - RNA, 15 nt, Mycobacterium bovis subsp bovis AF2122/97
guccgccguaugccg

SEQ ID NO: 3166868 - RNA, 21 nt, Mycobacterium bovis subsp bovis AF2122/97
guccgccguaugccgccaacc

SEQ ID NO: 3166869 - RNA, 16 nt, Mycobacterium bovis subsp bovis AF2122/97
guccgccgucgaccac

SEQ ID NO: 3166870 - RNA, 20 nt, Mycobacterium bovis subsp bovis AF2122/97
guccgccguugccgaucccc

SEQ ID NO: 3166871 - RNA, 14 nt, Mycobacterium bovis subsp bovis AF2122/97
guccgccugcaccg

SEQ ID NO: 3166872 - RNA, 19 nt, Mycobacterium bovis subsp bovis AF2122/97
guccgccugcaccgccgcc

SEQ ID NO: 3166873 - RNA, 21 nt, Mycobacterium bovis subsp bovis AF2122/97
guccgcgaacgauuucggccc

SEQ ID NO: 3166874 - RNA, 22 nt, Mycobacterium bovis subsp bovis AF2122/97
guccgcgaacgauuucggccca

SEQ ID NO: 3166875 - RNA, 22 nt, Mycobacterium bovis subsp bovis AF2122/97
guccgcgaagugcuugggccgc

SEQ ID NO: 3166876 - RNA, 23 nt, Mycobacterium bovis subsp bovis AF2122/97
guccgcgaagugcuugggccgcu

SEQ ID NO: 3166877 - RNA, 13 nt, Mycobacterium bovis subsp bovis AF2122/97
guccgcgacggcc

SEQ ID NO: 3166878 - RNA, 15 nt, Mycobacterium bovis subsp bovis AF2122/97
guccgcgauggccgc

SEQ ID NO: 3166879 - RNA, 16 nt, Mycobacterium bovis subsp bovis AF2122/97
guccgcgauggccgcg

SEQ ID NO: 3166880 - RNA, 14 nt, Mycobacterium bovis subsp bovis AF2122/97
guccgcgcaccgca

SEQ ID NO: 3166881 - RNA, 16 nt, Mycobacterium bovis subsp bovis AF2122/97
guccgcgcaccgcagg

SEQ ID NO: 3166882 - RNA, 15 nt, Mycobacterium bovis subsp bovis AF2122/97
guccgcgcccgagcc

SEQ ID NO: 3166883 - RNA, 22 nt, Mycobacterium bovis subsp bovis AF2122/97
guccgcgccgacggccagcagg

SEQ ID NO: 3166884 - RNA, 19 nt, Mycobacterium bovis subsp bovis AF2122/97
guccgcgcguugcuggucg

SEQ ID NO: 3166885 - RNA, 17 nt, Mycobacterium bovis subsp bovis AF2122/97
guccgcgcucagcuccg

SEQ ID NO: 3166886 - RNA, 18 nt, Mycobacterium bovis subsp bovis AF2122/97
guccgcgcucagcuccgg

SEQ ID NO: 3166887 - RNA, 22 nt, Mycobacterium bovis subsp bovis AF2122/97
guccgcgcucagcuccggcgac

SEQ ID NO: 3166888 - RNA, 22 nt, Mycobacterium bovis subsp bovis AF2122/97
guccgcggagaacaucccccgg

SEQ ID NO: 3166889 - RNA, 12 nt, Mycobacterium bovis subsp bovis AF2122/97
guccgcggccac

SEQ ID NO: 3166890 - RNA, 14 nt, Mycobacterium bovis subsp bovis AF2122/97
guccgcgggccgcg

SEQ ID NO: 3166891 - RNA, 15 nt, Mycobacterium bovis subsp bovis AF2122/97
guccgcgggccgcgc

SEQ ID NO: 3166892 - RNA, 17 nt, Mycobacterium bovis subsp bovis AF2122/97
guccgcgggggaccgcc

SEQ ID NO: 3166893 - RNA, 12 nt, Mycobacterium bovis subsp bovis AF2122/97
guccgcggucgc

SEQ ID NO: 3166894 - RNA, 20 nt, Mycobacterium bovis subsp bovis AF2122/97
guccgcggucgcagcagacc

SEQ ID NO: 3166895 - RNA, 22 nt, Mycobacterium bovis subsp bovis AF2122/97
guccgcggucgcagcagaccac

SEQ ID NO: 3166896 - RNA, 21 nt, Mycobacterium bovis subsp bovis AF2122/97
guccgcucaccuuuggccgcg

SEQ ID NO: 3166897 - RNA, 12 nt, Mycobacterium bovis subsp bovis AF2122/97
guccgcucgccg

SEQ ID NO: 3166898 - RNA, 18 nt, Mycobacterium bovis subsp bovis AF2122/97
guccgcugagcgggcaac

SEQ ID NO: 3166899 - RNA, 18 nt, Mycobacterium bovis subsp bovis AF2122/97
guccgcugguggucagca

SEQ ID NO: 3166900 - RNA, 19 nt, Mycobacterium bovis subsp bovis AF2122/97
guccggaaauuccggcgcg

SEQ ID NO: 3166901 - RNA, 20 nt, Mycobacterium bovis subsp bovis AF2122/97
guccggaaauuccggcgcgg

SEQ ID NO: 3166902 - RNA, 21 nt, Mycobacterium bovis subsp bovis AF2122/97
guccggaaauuccggcgcggc

SEQ ID NO: 3166903 - RNA, 17 nt, Mycobacterium bovis subsp bovis AF2122/97
guccggaagcggcguuc

SEQ ID NO: 3166904 - RNA, 14 nt, Mycobacterium bovis subsp bovis AF2122/97
guccggacggcagc

SEQ ID NO: 3166905 - RNA, 15 nt, Mycobacterium bovis subsp bovis AF2122/97
guccggacggcagcc

SEQ ID NO: 3166906 - RNA, 17 nt, Mycobacterium bovis subsp bovis AF2122/97
guccggaugcgcaaccg

SEQ ID NO: 3166907 - RNA, 21 nt, Mycobacterium bovis subsp bovis AF2122/97
guccggcaacaugagcgucgc

SEQ ID NO: 3166908 - RNA, 19 nt, Mycobacterium bovis subsp bovis AF2122/97
guccggcacgcgucuggaa

SEQ ID NO: 3166909 - RNA, 18 nt, Mycobacterium bovis subsp bovis AF2122/97
guccggcacugcggccag

SEQ ID NO: 3166910 - RNA, 19 nt, Mycobacterium bovis subsp bovis AF2122/97
guccggcaucgagacgcac

SEQ ID NO: 3166911 - RNA, 17 nt, Mycobacterium bovis subsp bovis AF2122/97
guccggcaucggugauc

SEQ ID NO: 3166912 - RNA, 17 nt, Mycobacterium bovis subsp bovis AF2122/97
guccggccacgguccgg

SEQ ID NO: 3166913 - RNA, 16 nt, Mycobacterium bovis subsp bovis AF2122/97
guccggcccaccagcg

SEQ ID NO: 3166914 - RNA, 16 nt, Mycobacterium bovis subsp bovis AF2122/97
guccggcccguagcug

SEQ ID NO: 3166915 - RNA, 17 nt, Mycobacterium bovis subsp bovis AF2122/97
guccggcccguagcugc

SEQ ID NO: 3166916 - RNA, 19 nt, Mycobacterium bovis subsp bovis AF2122/97
guccggcccuacgcagcgc

SEQ ID NO: 3166917 - RNA, 16 nt, Mycobacterium bovis subsp bovis AF2122/97
guccggccgacccgga

SEQ ID NO: 3166918 - RNA, 18 nt, Mycobacterium bovis subsp bovis AF2122/97
guccggcgaacugcgauc

SEQ ID NO: 3166919 - RNA, 23 nt, Mycobacterium bovis subsp bovis AF2122/97
guccggcgaacugcgaucggccg

SEQ ID NO: 3166920 - RNA, 20 nt, Mycobacterium bovis subsp bovis AF2122/97
guccggcggacccucgccga

SEQ ID NO: 3166921 - RNA, 16 nt, Mycobacterium bovis subsp bovis AF2122/97
guccggcggccgccau

SEQ ID NO: 3166922 - RNA, 19 nt, Mycobacterium bovis subsp bovis AF2122/97
guccggcguacgccguacc

SEQ ID NO: 3166923 - RNA, 23 nt, Mycobacterium bovis subsp bovis AF2122/97
guccggcguacucggugaucgcg

SEQ ID NO: 3166924 - RNA, 16 nt, Mycobacterium bovis subsp bovis AF2122/97
guccggcgugggcacc

SEQ ID NO: 3166925 - RNA, 17 nt, Mycobacterium bovis subsp bovis AF2122/97
guccggcuuaccggcgg

SEQ ID NO: 3166926 - RNA, 19 nt, Mycobacterium bovis subsp bovis AF2122/97
guccggcuuaccggcgggc

SEQ ID NO: 3166927 - RNA, 17 nt, Mycobacterium bovis subsp bovis AF2122/97
guccggcuuggcggcga

SEQ ID NO: 3166928 - RNA, 18 nt, Mycobacterium bovis subsp bovis AF2122/97
guccggcuuggcggcgau

SEQ ID NO: 3166929 - RNA, 15 nt, Mycobacterium bovis subsp bovis AF2122/97
guccgggcagccgcg

SEQ ID NO: 3166930 - RNA, 19 nt, Mycobacterium bovis subsp bovis AF2122/97
guccgggccccacggcggg

SEQ ID NO: 3166931 - RNA, 20 nt, Mycobacterium bovis subsp bovis AF2122/97
guccgggcggccucccgggc

SEQ ID NO: 3166932 - RNA, 13 nt, Mycobacterium bovis subsp bovis AF2122/97
guccggggccgcg

SEQ ID NO: 3166933 - RNA, 17 nt, Mycobacterium bovis subsp bovis AF2122/97
guccggggccgcggccc

SEQ ID NO: 3166934 - RNA, 14 nt, Mycobacterium bovis subsp bovis AF2122/97
guccggggcgcagg

SEQ ID NO: 3166935 - RNA, 20 nt, Mycobacterium bovis subsp bovis AF2122/97
guccuuguugaacguucugc

SEQ ID NO: 3166936 - RNA, 14 nt, Mycobacterium bovis subsp bovis AF2122/97
guccuuugccaccu

SEQ ID NO: 3166937 - RNA, 22 nt, Mycobacterium bovis subsp bovis AF2122/97
gucgaaaagccgugcaccagcg

SEQ ID NO: 3166938 - RNA, 18 nt, Mycobacterium bovis subsp bovis AF2122/97
gucgaaacccacguacgc

SEQ ID NO: 3166939 - RNA, 20 nt, Mycobacterium bovis subsp bovis AF2122/97
gucgaaacgguacgccgccg

SEQ ID NO: 3166940 - RNA, 23 nt, Mycobacterium bovis subsp bovis AF2122/97
gucgaaacgguacgccgccgcga

SEQ ID NO: 3166941 - RNA, 21 nt, Mycobacterium bovis subsp bovis AF2122/97
gucgaaaucggugcacaacgc

SEQ ID NO: 3166942 - RNA, 19 nt, Mycobacterium bovis subsp bovis AF2122/97
gucgaaauggauugcggca

SEQ ID NO: 3166943 - RNA, 14 nt, Mycobacterium bovis subsp bovis AF2122/97
gucgaacacgucgg

SEQ ID NO: 3166944 - RNA, 22 nt, Mycobacterium bovis subsp bovis AF2122/97
gucgaacagcaccgccggcgac

SEQ ID NO: 3166945 - RNA, 19 nt, Mycobacterium bovis subsp bovis AF2122/97
gucgaacaggaucagcgac

SEQ ID NO: 3166946 - RNA, 15 nt, Mycobacterium bovis subsp bovis AF2122/97
gucgaacaggccggc

SEQ ID NO: 3166947 - RNA, 17 nt, Mycobacterium bovis subsp bovis AF2122/97
gucgaacaggccggccg

SEQ ID NO: 3166948 - RNA, 22 nt, Mycobacterium bovis subsp bovis AF2122/97
gucgaacaggccggccgcgauc

SEQ ID NO: 3166949 - RNA, 14 nt, Mycobacterium bovis subsp bovis AF2122/97
gucgaacaugaucc

SEQ ID NO: 3166950 - RNA, 16 nt, Mycobacterium bovis subsp bovis AF2122/97
gucgaacaugauccgc

SEQ ID NO: 3166951 - RNA, 19 nt, Mycobacterium bovis subsp bovis AF2122/97
gucgaacaugauccgccgg

SEQ ID NO: 3166952 - RNA, 17 nt, Mycobacterium bovis subsp bovis AF2122/97
gucgaaccaguccucgg

SEQ ID NO: 3166953 - RNA, 13 nt, Mycobacterium bovis subsp bovis AF2122/97
gucgaaccgccgg

SEQ ID NO: 3166954 - RNA, 18 nt, Mycobacterium bovis subsp bovis AF2122/97
gucgaaccgccggcugcg

SEQ ID NO: 3166955 - RNA, 19 nt, Mycobacterium bovis subsp bovis AF2122/97
gucgaaccgccggcugcgc

SEQ ID NO: 3166956 - RNA, 17 nt, Mycobacterium bovis subsp bovis AF2122/97
gucgaaccuaccgugua

SEQ ID NO: 3166957 - RNA, 21 nt, Mycobacterium bovis subsp bovis AF2122/97
gucgaaccugucgaucacggc

SEQ ID NO: 3166958 - RNA, 20 nt, Mycobacterium bovis subsp bovis AF2122/97
gucgaacgcaugcucgaucg

SEQ ID NO: 3166959 - RNA, 12 nt, Mycobacterium bovis subsp bovis AF2122/97
gucgaacgcccc

SEQ ID NO: 3166960 - RNA, 13 nt, Mycobacterium bovis subsp bovis AF2122/97
gucgaacgccccc

SEQ ID NO: 3166961 - RNA, 19 nt, Mycobacterium bovis subsp bovis AF2122/97
gucgaacgccccccacggc

SEQ ID NO: 3166962 - RNA, 13 nt, Mycobacterium bovis subsp bovis AF2122/97
gucgaacgguagc

SEQ ID NO: 3166963 - RNA, 20 nt, Mycobacterium bovis subsp bovis AF2122/97
gucgaacgguagcacggucu

SEQ ID NO: 3166964 - RNA, 14 nt, Mycobacterium bovis subsp bovis AF2122/97
gucgaacugccgga

SEQ ID NO: 3166965 - RNA, 13 nt, Mycobacterium bovis subsp bovis AF2122/97
gucgaacugggcg

SEQ ID NO: 3166966 - RNA, 21 nt, Mycobacterium bovis subsp bovis AF2122/97
gucgaacuuugucgcgcugcu

SEQ ID NO: 3166967 - RNA, 16 nt, Mycobacterium bovis subsp bovis AF2122/97
gucgaagaaccggccg

SEQ ID NO: 3166968 - RNA, 19 nt, Mycobacterium bovis subsp bovis AF2122/97
gucgaagaaccggccgacg

SEQ ID NO: 3166969 - RNA, 20 nt, Mycobacterium bovis subsp bovis AF2122/97
gucgaagaaccggccgacga

SEQ ID NO: 3166970 - RNA, 22 nt, Mycobacterium bovis subsp bovis AF2122/97
gucgaagaaccggccgacgaac

SEQ ID NO: 3166971 - RNA, 22 nt, Mycobacterium bovis subsp bovis AF2122/97
gucgaagaauaugccgaugacc

SEQ ID NO: 3166972 - RNA, 22 nt, Mycobacterium bovis subsp bovis AF2122/97
gucgaagacguuggcgcgguug

SEQ ID NO: 3166973 - RNA, 13 nt, Mycobacterium bovis subsp bovis AF2122/97
gucgaagagcagg

SEQ ID NO: 3166974 - RNA, 16 nt, Mycobacterium bovis subsp bovis AF2122/97
gucgaagauccagcgc

SEQ ID NO: 3166975 - RNA, 15 nt, Mycobacterium bovis subsp bovis AF2122/97
gucgaagaucgagcc

SEQ ID NO: 3166976 - RNA, 17 nt, Mycobacterium bovis subsp bovis AF2122/97
gucgaagaucgccuggg

SEQ ID NO: 3166977 - RNA, 18 nt, Mycobacterium bovis subsp bovis AF2122/97
gucgaagaugaccugauc

SEQ ID NO: 3166978 - RNA, 20 nt, Mycobacterium bovis subsp bovis AF2122/97
gucgaagccccucaccucgg

SEQ ID NO: 3166979 - RNA, 17 nt, Mycobacterium bovis subsp bovis AF2122/97
gucgaagcggaccagcg

SEQ ID NO: 3166980 - RNA, 23 nt, Mycobacterium bovis subsp bovis AF2122/97
gucgaagugggugaaccggaccu

SEQ ID NO: 3166981 - RNA, 12 nt, Mycobacterium bovis subsp bovis AF2122/97
gucgaaguggua

SEQ ID NO: 3166982 - RNA, 20 nt, Mycobacterium bovis subsp bovis AF2122/97
gucgaagugguaguccaggg

SEQ ID NO: 3166983 - RNA, 23 nt, Mycobacterium bovis subsp bovis AF2122/97
gucgaaguuggcgaagcccgaca

SEQ ID NO: 3166984 - RNA, 19 nt, Mycobacterium bovis subsp bovis AF2122/97
gucgaauaguugaccaggc

SEQ ID NO: 3166985 - RNA, 22 nt, Mycobacterium bovis subsp bovis AF2122/97
gucgaauaguugaccaggccga

SEQ ID NO: 3166986 - RNA, 14 nt, Mycobacterium bovis subsp bovis AF2122/97
gucgaaucgcugcc

SEQ ID NO: 3166987 - RNA, 18 nt, Mycobacterium bovis subsp bovis AF2122/97
gucgaaucgcugccgccg

SEQ ID NO: 3166988 - RNA, 13 nt, Mycobacterium bovis subsp bovis AF2122/97
gucgaaucguguc

SEQ ID NO: 3166989 - RNA, 21 nt, Mycobacterium bovis subsp bovis AF2122/97
gucgaaucuucugagacugcc

SEQ ID NO: 3166990 - RNA, 23 nt, Mycobacterium bovis subsp bovis AF2122/97
gucgaaugggggcuggucgccgu

SEQ ID NO: 3166991 - RNA, 22 nt, Mycobacterium bovis subsp bovis AF2122/97
gucgaaugucccgguguccagc

SEQ ID NO: 3166992 - RNA, 23 nt, Mycobacterium bovis subsp bovis AF2122/97
gucgacaacaaacccggccucgg

SEQ ID NO: 3166993 - RNA, 20 nt, Mycobacterium bovis subsp bovis AF2122/97
gucgacaacgaucgcgcgag

SEQ ID NO: 3166994 - RNA, 17 nt, Mycobacterium bovis subsp bovis AF2122/97
gucgacaccgaggaccu

SEQ ID NO: 3166995 - RNA, 19 nt, Mycobacterium bovis subsp bovis AF2122/97
gucgacaccgaggaccucg

SEQ ID NO: 3166996 - RNA, 23 nt, Mycobacterium bovis subsp bovis AF2122/97
gucgacaccgaggaccucgucac

SEQ ID NO: 3166997 - RNA, 17 nt, Mycobacterium bovis subsp bovis AF2122/97
gucgacaccgcggugcc

SEQ ID NO: 3166998 - RNA, 15 nt, Mycobacterium bovis subsp bovis AF2122/97
gucgacacggugauc

SEQ ID NO: 3166999 - RNA, 16 nt, Mycobacterium bovis subsp bovis AF2122/97
gucgacagcgaaggcg

SEQ ID NO: 3167000 - RNA, 22 nt, Mycobacterium bovis subsp bovis AF2122/97
gucgacagcgaaggcgccgaac

SEQ ID NO: 3167001 - RNA, 22 nt, Mycobacterium bovis subsp bovis AF2122/97
gucgacagucaacagggccagg

SEQ ID NO: 3167002 - RNA, 17 nt, Mycobacterium bovis subsp bovis AF2122/97
gucgacaguucaacggg

SEQ ID NO: 3167003 - RNA, 23 nt, Mycobacterium bovis subsp bovis AF2122/97
gucgacaguucaacgggccuucg

SEQ ID NO: 3167004 - RNA, 20 nt, Mycobacterium bovis subsp bovis AF2122/97
gucgacaguuuucaccgcga

SEQ ID NO: 3167005 - RNA, 15 nt, Mycobacterium bovis subsp bovis AF2122/97
gucgacaucggugac

SEQ ID NO: 3167006 - RNA, 20 nt, Mycobacterium bovis subsp bovis AF2122/97
gucgaccaagguguccagca

SEQ ID NO: 3167007 - RNA, 20 nt, Mycobacterium bovis subsp bovis AF2122/97
gucgaccaauaccaguccgu

SEQ ID NO: 3167008 - RNA, 11 nt, Mycobacterium bovis subsp bovis AF2122/97
gucgaccaccc

SEQ ID NO: 3167009 - RNA, 15 nt, Mycobacterium bovis subsp bovis AF2122/97
gucgaccacccgcag

SEQ ID NO: 3167010 - RNA, 16 nt, Mycobacterium bovis subsp bovis AF2122/97
gucgaccacccgcagg

SEQ ID NO: 3167011 - RNA, 16 nt, Mycobacterium bovis subsp bovis AF2122/97
gucgaccacgaauggg

SEQ ID NO: 3167012 - RNA, 14 nt, Mycobacterium bovis subsp bovis AF2122/97
gucgaccaggccac

SEQ ID NO: 3167013 - RNA, 15 nt, Mycobacterium bovis subsp bovis AF2122/97
gucgaccaggccacu

SEQ ID NO: 3167014 - RNA, 22 nt, Mycobacterium bovis subsp bovis AF2122/97
gucgaccauauuggcgcggccg

SEQ ID NO: 3167015 - RNA, 18 nt, Mycobacterium bovis subsp bovis AF2122/97
gucgaccaugagccggcg

SEQ ID NO: 3167016 - RNA, 21 nt, Mycobacterium bovis subsp bovis AF2122/97
gucgaccaugagccggcgccg

SEQ ID NO: 3167017 - RNA, 23 nt, Mycobacterium bovis subsp bovis AF2122/97
gucgaccaugcgaccggcaacgc

SEQ ID NO: 3167018 - RNA, 13 nt, Mycobacterium bovis subsp bovis AF2122/97
gucgacccaacgc

SEQ ID NO: 3167019 - RNA, 18 nt, Mycobacterium bovis subsp bovis AF2122/97
gucgacccaacgcagauc

SEQ ID NO: 3167020 - RNA, 19 nt, Mycobacterium bovis subsp bovis AF2122/97
gucgacccccugccacagc

SEQ ID NO: 3167021 - RNA, 16 nt, Mycobacterium bovis subsp bovis AF2122/97
gucgacuugcaggcgu

SEQ ID NO: 3167022 - RNA, 18 nt, Mycobacterium bovis subsp bovis AF2122/97
gucgacuugugacggucg

SEQ ID NO: 3167023 - RNA, 23 nt, Mycobacterium bovis subsp bovis AF2122/97
gucgagagaguuagugacguaga

SEQ ID NO: 3167024 - RNA, 19 nt, Mycobacterium bovis subsp bovis AF2122/97
gucgagagguucgccgucg

SEQ ID NO: 3167025 - RNA, 20 nt, Mycobacterium bovis subsp bovis AF2122/97
gucgagagguucgccgucgg

SEQ ID NO: 3167026 - RNA, 17 nt, Mycobacterium bovis subsp bovis AF2122/97
gucgagauagccgacgu

SEQ ID NO: 3167027 - RNA, 21 nt, Mycobacterium bovis subsp bovis AF2122/97
gucgagauagucggccggcgg

SEQ ID NO: 3167028 - RNA, 16 nt, Mycobacterium bovis subsp bovis AF2122/97
gucgagauccucgucg

SEQ ID NO: 3167029 - RNA, 17 nt, Mycobacterium bovis subsp bovis AF2122/97
gucgagauccucgucga

SEQ ID NO: 3167030 - RNA, 21 nt, Mycobacterium bovis subsp bovis AF2122/97
gucgagauccucgucgagguc

SEQ ID NO: 3167031 - RNA, 21 nt, Mycobacterium bovis subsp bovis AF2122/97
gucgagaucucacgugcccgc

SEQ ID NO: 3167032 - RNA, 19 nt, Mycobacterium bovis subsp bovis AF2122/97
gucgagauuggguccagcg

SEQ ID NO: 3167033 - RNA, 22 nt, Mycobacterium bovis subsp bovis AF2122/97
gucgagauuggguccagcgagg

SEQ ID NO: 3167034 - RNA, 20 nt, Mycobacterium bovis subsp bovis AF2122/97
gucgagcacaccgaggucgc

SEQ ID NO: 3167035 - RNA, 19 nt, Mycobacterium bovis subsp bovis AF2122/97
gucgagcacaccgucgucg

SEQ ID NO: 3167036 - RNA, 22 nt, Mycobacterium bovis subsp bovis AF2122/97
gucgagcaccacccgggccucg

SEQ ID NO: 3167037 - RNA, 17 nt, Mycobacterium bovis subsp bovis AF2122/97
gucgagcaccggcugcg

SEQ ID NO: 3167038 - RNA, 22 nt, Mycobacterium bovis subsp bovis AF2122/97
gucgagcaccggcugcggggcg

SEQ ID NO: 3167039 - RNA, 14 nt, Mycobacterium bovis subsp bovis AF2122/97
gucgagcaccucga

SEQ ID NO: 3167040 - RNA, 19 nt, Mycobacterium bovis subsp bovis AF2122/97
gucgagcacgaugucgaug

SEQ ID NO: 3167041 - RNA, 16 nt, Mycobacterium bovis subsp bovis AF2122/97
gucgagcacgcugcug

SEQ ID NO: 3167042 - RNA, 17 nt, Mycobacterium bovis subsp bovis AF2122/97
gucgagcacggugagcc

SEQ ID NO: 3167043 - RNA, 15 nt, Mycobacterium bovis subsp bovis AF2122/97
gucgagcagcaccac

SEQ ID NO: 3167044 - RNA, 13 nt, Mycobacterium bovis subsp bovis AF2122/97
gucgagcagccga

SEQ ID NO: 3167045 - RNA, 13 nt, Mycobacterium bovis subsp bovis AF2122/97
gucgagcagccgc

SEQ ID NO: 3167046 - RNA, 17 nt, Mycobacterium bovis subsp bovis AF2122/97
gucgagcagccgcgaca

SEQ ID NO: 3167047 - RNA, 14 nt, Mycobacterium bovis subsp bovis AF2122/97
gucgagcagcgcca

SEQ ID NO: 3167048 - RNA, 18 nt, Mycobacterium bovis subsp bovis AF2122/97
gucgagcagcucgcacuc

SEQ ID NO: 3167049 - RNA, 13 nt, Mycobacterium bovis subsp bovis AF2122/97
gucgagcaggccc

SEQ ID NO: 3167050 - RNA, 14 nt, Mycobacterium bovis subsp bovis AF2122/97
gucgagcaugcgau

SEQ ID NO: 3167051 - RNA, 18 nt, Mycobacterium bovis subsp bovis AF2122/97
gucgagccacagcgucga

SEQ ID NO: 3167052 - RNA, 20 nt, Mycobacterium bovis subsp bovis AF2122/97
gucgagccacccaccgacau

SEQ ID NO: 3167053 - RNA, 13 nt, Mycobacterium bovis subsp bovis AF2122/97
gucgagccggauu

SEQ ID NO: 3167054 - RNA, 14 nt, Mycobacterium bovis subsp bovis AF2122/97
gucgagccggugcc

SEQ ID NO: 3167055 - RNA, 18 nt, Mycobacterium bovis subsp bovis AF2122/97
gucgagccggugccgcgg

SEQ ID NO: 3167056 - RNA, 19 nt, Mycobacterium bovis subsp bovis AF2122/97
gucgagcgaccccacacgc

SEQ ID NO: 3167057 - RNA, 22 nt, Mycobacterium bovis subsp bovis AF2122/97
gucgagcgaccccacacgccga

SEQ ID NO: 3167058 - RNA, 15 nt, Mycobacterium bovis subsp bovis AF2122/97
gucgagcgcccacug

SEQ ID NO: 3167059 - RNA, 16 nt, Mycobacterium bovis subsp bovis AF2122/97
gucgagcgcccacugg

SEQ ID NO: 3167060 - RNA, 13 nt, Mycobacterium bovis subsp bovis AF2122/97
gucgagcgccgcg

SEQ ID NO: 3167061 - RNA, 13 nt, Mycobacterium bovis subsp bovis AF2122/97
gucgagcgccggc

SEQ ID NO: 3167062 - RNA, 17 nt, Mycobacterium bovis subsp bovis AF2122/97
gucgagcgccggccgcg

SEQ ID NO: 3167063 - RNA, 13 nt, Mycobacterium bovis subsp bovis AF2122/97
gucgagcgcgucg

SEQ ID NO: 3167064 - RNA, 20 nt, Mycobacterium bovis subsp bovis AF2122/97
gucgagcgucugcgaucccg

SEQ ID NO: 3167065 - RNA, 16 nt, Mycobacterium bovis subsp bovis AF2122/97
gucgagcugaccacgg

SEQ ID NO: 3167066 - RNA, 18 nt, Mycobacterium bovis subsp bovis AF2122/97
gucgagcugauccaagua

SEQ ID NO: 3167067 - RNA, 23 nt, Mycobacterium bovis subsp bovis AF2122/97
gucgaggcaggccucggcgccgc

SEQ ID NO: 3167068 - RNA, 17 nt, Mycobacterium bovis subsp bovis AF2122/97
gucgaggcgcaggucaa

SEQ ID NO: 3167069 - RNA, 16 nt, Mycobacterium bovis subsp bovis AF2122/97
gucgaggcggcagucg

SEQ ID NO: 3167070 - RNA, 16 nt, Mycobacterium bovis subsp bovis AF2122/97
gucgagggagcgccgc

SEQ ID NO: 3167071 - RNA, 19 nt, Mycobacterium bovis subsp bovis AF2122/97
gucgagggagcgccgcagg

SEQ ID NO: 3167072 - RNA, 20 nt, Mycobacterium bovis subsp bovis AF2122/97
gucgagggagcgccgcaggg

SEQ ID NO: 3167073 - RNA, 18 nt, Mycobacterium bovis subsp bovis AF2122/97
gucgagguacacgccgag

SEQ ID NO: 3167074 - RNA, 19 nt, Mycobacterium bovis subsp bovis AF2122/97
gucgagguacacgccgagg

SEQ ID NO: 3167075 - RNA, 22 nt, Mycobacterium bovis subsp bovis AF2122/97
gucgagguacacgccgaggucu

SEQ ID NO: 3167076 - RNA, 13 nt, Mycobacterium bovis subsp bovis AF2122/97
gucgagguagugg

SEQ ID NO: 3167077 - RNA, 19 nt, Mycobacterium bovis subsp bovis AF2122/97
gucgaggucacgcgaggcg

SEQ ID NO: 3167078 - RNA, 17 nt, Mycobacterium bovis subsp bovis AF2122/97
gucgaggucagugggcg

SEQ ID NO: 3167079 - RNA, 15 nt, Mycobacterium bovis subsp bovis AF2122/97
gucgagguccaccac

SEQ ID NO: 3167080 - RNA, 18 nt, Mycobacterium bovis subsp bovis AF2122/97
gucgagguccucgagguc

SEQ ID NO: 3167081 - RNA, 20 nt, Mycobacterium bovis subsp bovis AF2122/97
gucgagguccucgagguccu

SEQ ID NO: 3167082 - RNA, 12 nt, Mycobacterium bovis subsp bovis AF2122/97
gucgaggucggc

SEQ ID NO: 3167083 - RNA, 15 nt, Mycobacterium bovis subsp bovis AF2122/97
gucgaggucggcgau

SEQ ID NO: 3167084 - RNA, 23 nt, Mycobacterium bovis subsp bovis AF2122/97
gucgaggucuuucgaugaugggc

SEQ ID NO: 3167085 - RNA, 14 nt, Mycobacterium bovis subsp bovis AF2122/97
gucgaggugacuug

SEQ ID NO: 3167086 - RNA, 15 nt, Mycobacterium bovis subsp bovis AF2122/97
gucgagguggcgggc

SEQ ID NO: 3167087 - RNA, 18 nt, Mycobacterium bovis subsp bovis AF2122/97
gucgagguucucccgcgc

SEQ ID NO: 3167088 - RNA, 20 nt, Mycobacterium bovis subsp bovis AF2122/97
gucgagguuuuucgaugggu

SEQ ID NO: 3167089 - RNA, 16 nt, Mycobacterium bovis subsp bovis AF2122/97
gucgaguagccguagc

SEQ ID NO: 3167090 - RNA, 21 nt, Mycobacterium bovis subsp bovis AF2122/97
gucgaguagccguagccgccg

SEQ ID NO: 3167091 - RNA, 22 nt, Mycobacterium bovis subsp bovis AF2122/97
gucgaguagccguagccgccgu

SEQ ID NO: 3167092 - RNA, 17 nt, Mycobacterium bovis subsp bovis AF2122/97
gucgaguauugcaggaa

SEQ ID NO: 3167093 - RNA, 15 nt, Mycobacterium bovis subsp bovis AF2122/97
gucgaguccacagcg

SEQ ID NO: 3167094 - RNA, 17 nt, Mycobacterium bovis subsp bovis AF2122/97
gucgaguccacagcgca

SEQ ID NO: 3167095 - RNA, 18 nt, Mycobacterium bovis subsp bovis AF2122/97
gucgaguccaggccggca

SEQ ID NO: 3167096 - RNA, 13 nt, Mycobacterium bovis subsp bovis AF2122/97
gucgagucgccga

SEQ ID NO: 3167097 - RNA, 22 nt, Mycobacterium bovis subsp bovis AF2122/97
gucgagucgccgaggacgccgg

SEQ ID NO: 3167098 - RNA, 18 nt, Mycobacterium bovis subsp bovis AF2122/97
gucgagucgguccugcca

SEQ ID NO: 3167099 - RNA, 20 nt, Mycobacterium bovis subsp bovis AF2122/97
gucgagugccucgaccugga

SEQ ID NO: 3167100 - RNA, 19 nt, Mycobacterium bovis subsp bovis AF2122/97
gucgaguucgcagucgaug

SEQ ID NO: 3167101 - RNA, 14 nt, Mycobacterium bovis subsp bovis AF2122/97
gucgauaaccuggc

SEQ ID NO: 3167102 - RNA, 22 nt, Mycobacterium bovis subsp bovis AF2122/97
gucgauaagggcuugugguguc

SEQ ID NO: 3167103 - RNA, 22 nt, Mycobacterium bovis subsp bovis AF2122/97
gucgauaaugaucucggcaagg

SEQ ID NO: 3167104 - RNA, 12 nt, Mycobacterium bovis subsp bovis AF2122/97
gucgaucaacaa

SEQ ID NO: 3167105 - RNA, 23 nt, Mycobacterium bovis subsp bovis AF2122/97
gucgaucaacaacagccgcagcc

SEQ ID NO: 3167106 - RNA, 17 nt, Mycobacterium bovis subsp bovis AF2122/97
gucgaucaacaccaacg

SEQ ID NO: 3167107 - RNA, 20 nt, Mycobacterium bovis subsp bovis AF2122/97
gucgcagcagaccacaacgc

SEQ ID NO: 3167108 - RNA, 14 nt, Mycobacterium bovis subsp bovis AF2122/97
gucgcagcucgucg

SEQ ID NO: 3167109 - RNA, 22 nt, Mycobacterium bovis subsp bovis AF2122/97
gucgcaggauucccagucgcgg

SEQ ID NO: 3167110 - RNA, 15 nt, Mycobacterium bovis subsp bovis AF2122/97
gucgcaggccagggu

SEQ ID NO: 3167111 - RNA, 14 nt, Mycobacterium bovis subsp bovis AF2122/97
gucgcaucaccagg

SEQ ID NO: 3167112 - RNA, 16 nt, Mycobacterium bovis subsp bovis AF2122/97
gucgcaucaccagggu

SEQ ID NO: 3167113 - RNA, 17 nt, Mycobacterium bovis subsp bovis AF2122/97
gucgcauggcggcuggu

SEQ ID NO: 3167114 - RNA, 15 nt, Mycobacterium bovis subsp bovis AF2122/97
gucgccaacgccagc

SEQ ID NO: 3167115 - RNA, 21 nt, Mycobacterium bovis subsp bovis AF2122/97
gucgccaacgccagcaccagc

SEQ ID NO: 3167116 - RNA, 17 nt, Mycobacterium bovis subsp bovis AF2122/97
gucgccaagaucgggug

SEQ ID NO: 3167117 - RNA, 15 nt, Mycobacterium bovis subsp bovis AF2122/97
gucgccaagcccagg

SEQ ID NO: 3167118 - RNA, 16 nt, Mycobacterium bovis subsp bovis AF2122/97
gucgccaagugcaggg

SEQ ID NO: 3167119 - RNA, 17 nt, Mycobacterium bovis subsp bovis AF2122/97
gucgccaaucgaguagc

SEQ ID NO: 3167120 - RNA, 15 nt, Mycobacterium bovis subsp bovis AF2122/97
gucgccacacccgcg

SEQ ID NO: 3167121 - RNA, 20 nt, Mycobacterium bovis subsp bovis AF2122/97
gucgccacaccggggcggcc

SEQ ID NO: 3167122 - RNA, 22 nt, Mycobacterium bovis subsp bovis AF2122/97
gucgccacaccggggcggccga

SEQ ID NO: 3167123 - RNA, 13 nt, Mycobacterium bovis subsp bovis AF2122/97
gucgccaccaucg

SEQ ID NO: 3167124 - RNA, 13 nt, Mycobacterium bovis subsp bovis AF2122/97
gucgccaccgaug

SEQ ID NO: 3167125 - RNA, 16 nt, Mycobacterium bovis subsp bovis AF2122/97
gucgccaccgauggcg

SEQ ID NO: 3167126 - RNA, 19 nt, Mycobacterium bovis subsp bovis AF2122/97
gucgccaccgauggcggug

SEQ ID NO: 3167127 - RNA, 20 nt, Mycobacterium bovis subsp bovis AF2122/97
gucgccaccgauggcggugg

SEQ ID NO: 3167128 - RNA, 13 nt, Mycobacterium bovis subsp bovis AF2122/97
gucgccaccggua

SEQ ID NO: 3167129 - RNA, 15 nt, Mycobacterium bovis subsp bovis AF2122/97
gucgccaccgguacc

SEQ ID NO: 3167130 - RNA, 17 nt, Mycobacterium bovis subsp bovis AF2122/97
gucgccacgcccagcgc

SEQ ID NO: 3167131 - RNA, 13 nt, Mycobacterium bovis subsp bovis AF2122/97
gucgccagaccgc

SEQ ID NO: 3167132 - RNA, 18 nt, Mycobacterium bovis subsp bovis AF2122/97
gucgccagcucggcaccc

SEQ ID NO: 3167133 - RNA, 22 nt, Mycobacterium bovis subsp bovis AF2122/97
gucgccagcucggcacccgccg

SEQ ID NO: 3167134 - RNA, 16 nt, Mycobacterium bovis subsp bovis AF2122/97
gucgccaggcccccuc

SEQ ID NO: 3167135 - RNA, 15 nt, Mycobacterium bovis subsp bovis AF2122/97
gucgccaggucaucg

SEQ ID NO: 3167136 - RNA, 18 nt, Mycobacterium bovis subsp bovis AF2122/97
gucgccauccucgagcug

SEQ ID NO: 3167137 - RNA, 20 nt, Mycobacterium bovis subsp bovis AF2122/97
gucgccaugcugcccuuguu

SEQ ID NO: 3167138 - RNA, 16 nt, Mycobacterium bovis subsp bovis AF2122/97
gucgccaugucggcca

SEQ ID NO: 3167139 - RNA, 18 nt, Mycobacterium bovis subsp bovis AF2122/97
gucgccaugucggccagg

SEQ ID NO: 3167140 - RNA, 22 nt, Mycobacterium bovis subsp bovis AF2122/97
gucgccauuccaucgcgcaccg

SEQ ID NO: 3167141 - RNA, 16 nt, Mycobacterium bovis subsp bovis AF2122/97
gucgcccaaccgaacc

SEQ ID NO: 3167142 - RNA, 20 nt, Mycobacterium bovis subsp bovis AF2122/97
gucgcccagccacugacggc

SEQ ID NO: 3167143 - RNA, 19 nt, Mycobacterium bovis subsp bovis AF2122/97
gucgcccaggcgugucguc

SEQ ID NO: 3167144 - RNA, 21 nt, Mycobacterium bovis subsp bovis AF2122/97
gucgcccagucccaggugcug

SEQ ID NO: 3167145 - RNA, 12 nt, Mycobacterium bovis subsp bovis AF2122/97
gucgccccaagc

SEQ ID NO: 3167146 - RNA, 14 nt, Mycobacterium bovis subsp bovis AF2122/97
gucgccccaagcgc

SEQ ID NO: 3167147 - RNA, 17 nt, Mycobacterium bovis subsp bovis AF2122/97
gucgccccaagcgccug

SEQ ID NO: 3167148 - RNA, 14 nt, Mycobacterium bovis subsp bovis AF2122/97
gucgccccaugcgg

SEQ ID NO: 3167149 - RNA, 15 nt, Mycobacterium bovis subsp bovis AF2122/97
gucgcccccggccau

SEQ ID NO: 3167150 - RNA, 16 nt, Mycobacterium bovis subsp bovis AF2122/97
gucgccccgaugaccg

SEQ ID NO: 3167151 - RNA, 20 nt, Mycobacterium bovis subsp bovis AF2122/97
gucgccccguucacgcucgu

SEQ ID NO: 3167152 - RNA, 13 nt, Mycobacterium bovis subsp bovis AF2122/97
gucgcccgagucg

SEQ ID NO: 3167153 - RNA, 15 nt, Mycobacterium bovis subsp bovis AF2122/97
gucgcccgaucggcg

SEQ ID NO: 3167154 - RNA, 15 nt, Mycobacterium bovis subsp bovis AF2122/97
gucgcccgcacacag

SEQ ID NO: 3167155 - RNA, 17 nt, Mycobacterium bovis subsp bovis AF2122/97
gucgcccuguucggccc

SEQ ID NO: 3167156 - RNA, 18 nt, Mycobacterium bovis subsp bovis AF2122/97
gucgccgaacaccgagug

SEQ ID NO: 3167157 - RNA, 17 nt, Mycobacterium bovis subsp bovis AF2122/97
gucgccgaacagcgacg

SEQ ID NO: 3167158 - RNA, 23 nt, Mycobacterium bovis subsp bovis AF2122/97
gucgccgaacagugcggucccga

SEQ ID NO: 3167159 - RNA, 16 nt, Mycobacterium bovis subsp bovis AF2122/97
gucgccgaacgccacc

SEQ ID NO: 3167160 - RNA, 17 nt, Mycobacterium bovis subsp bovis AF2122/97
gucgccgaacgccacca

SEQ ID NO: 3167161 - RNA, 18 nt, Mycobacterium bovis subsp bovis AF2122/97
gucgccgaacgccaccac

SEQ ID NO: 3167162 - RNA, 19 nt, Mycobacterium bovis subsp bovis AF2122/97
gucgccgaacgccaccacc

SEQ ID NO: 3167163 - RNA, 20 nt, Mycobacterium bovis subsp bovis AF2122/97
gucgccgaacgccaccaccu

SEQ ID NO: 3167164 - RNA, 21 nt, Mycobacterium bovis subsp bovis AF2122/97
gucgccgaacgccaccaccuc

SEQ ID NO: 3167165 - RNA, 19 nt, Mycobacterium bovis subsp bovis AF2122/97
gucgccgaccacucgagcg

SEQ ID NO: 3167166 - RNA, 20 nt, Mycobacterium bovis subsp bovis AF2122/97
gucgccgacggcgaccaccg

SEQ ID NO: 3167167 - RNA, 15 nt, Mycobacterium bovis subsp bovis AF2122/97
gucgccgagaccggc

SEQ ID NO: 3167168 - RNA, 12 nt, Mycobacterium bovis subsp bovis AF2122/97
gucgccgaggua

SEQ ID NO: 3167169 - RNA, 20 nt, Mycobacterium bovis subsp bovis AF2122/97
gucgccgagguagauggcga

SEQ ID NO: 3167170 - RNA, 20 nt, Mycobacterium bovis subsp bovis AF2122/97
gucgccgaggucgaaccgcc

SEQ ID NO: 3167171 - RNA, 20 nt, Mycobacterium bovis subsp bovis AF2122/97
gucgccgaguaccggccagc

SEQ ID NO: 3167172 - RNA, 23 nt, Mycobacterium bovis subsp bovis AF2122/97
gucgccgaguaccggccagccgc

SEQ ID NO: 3167173 - RNA, 17 nt, Mycobacterium bovis subsp bovis AF2122/97
gucgccgauaucgguga

SEQ ID NO: 3167174 - RNA, 20 nt, Mycobacterium bovis subsp bovis AF2122/97
gucgccgaucaacagcaccg

SEQ ID NO: 3167175 - RNA, 22 nt, Mycobacterium bovis subsp bovis AF2122/97
gucgccgaucaugaccaucugc

SEQ ID NO: 3167176 - RNA, 22 nt, Mycobacterium bovis subsp bovis AF2122/97
gucgccgcauugcagaaccgcc

SEQ ID NO: 3167177 - RNA, 14 nt, Mycobacterium bovis subsp bovis AF2122/97
gucgccgccaaagc

SEQ ID NO: 3167178 - RNA, 14 nt, Mycobacterium bovis subsp bovis AF2122/97
gucgccgccaccag

SEQ ID NO: 3167179 - RNA, 15 nt, Mycobacterium bovis subsp bovis AF2122/97
gucgccgccaccagg

SEQ ID NO: 3167180 - RNA, 17 nt, Mycobacterium bovis subsp bovis AF2122/97
gucgccgccagguugcc

SEQ ID NO: 3167181 - RNA, 12 nt, Mycobacterium bovis subsp bovis AF2122/97
gucgccgcccgu

SEQ ID NO: 3167182 - RNA, 13 nt, Mycobacterium bovis subsp bovis AF2122/97
gucgccgcccgug

SEQ ID NO: 3167183 - RNA, 16 nt, Mycobacterium bovis subsp bovis AF2122/97
gucgccgccgcgggcg

SEQ ID NO: 3167184 - RNA, 15 nt, Mycobacterium bovis subsp bovis AF2122/97
gucgccgccgcuacc

SEQ ID NO: 3167185 - RNA, 18 nt, Mycobacterium bovis subsp bovis AF2122/97
gucgccgccgcuaccgcc

SEQ ID NO: 3167186 - RNA, 20 nt, Mycobacterium bovis subsp bovis AF2122/97
gucgccgccgcuaccgccgg

SEQ ID NO: 3167187 - RNA, 13 nt, Mycobacterium bovis subsp bovis AF2122/97
gucgccgccgggc

SEQ ID NO: 3167188 - RNA, 19 nt, Mycobacterium bovis subsp bovis AF2122/97
gucgccgccuuacgcaccg

SEQ ID NO: 3167189 - RNA, 21 nt, Mycobacterium bovis subsp bovis AF2122/97
gucgccgccuuacgcaccgau

SEQ ID NO: 3167190 - RNA, 14 nt, Mycobacterium bovis subsp bovis AF2122/97
gucgccgccuucuu

SEQ ID NO: 3167191 - RNA, 21 nt, Mycobacterium bovis subsp bovis AF2122/97
gucgccgcgcguuccagcaca

SEQ ID NO: 3167192 - RNA, 12 nt, Mycobacterium bovis subsp bovis AF2122/97
gucgccgcggca

SEQ ID NO: 3167193 - RNA, 12 nt, Mycobacterium bovis subsp bovis AF2122/97
gucgccgcggcg

SEQ ID NO: 3167194 - RNA, 17 nt, Mycobacterium bovis subsp bovis AF2122/97
gucgccgcggcggcagc

SEQ ID NO: 3167195 - RNA, 21 nt, Mycobacterium bovis subsp bovis AF2122/97
gucgccgcggcggcagcggcg

SEQ ID NO: 3167196 - RNA, 23 nt, Mycobacterium bovis subsp bovis AF2122/97
gucgccgcggcggcagcggcgau

SEQ ID NO: 3167197 - RNA, 13 nt, Mycobacterium bovis subsp bovis AF2122/97
gucgccgcgguag

SEQ ID NO: 3167198 - RNA, 22 nt, Mycobacterium bovis subsp bovis AF2122/97
gucgccgcguccucgcccuggc

SEQ ID NO: 3167199 - RNA, 15 nt, Mycobacterium bovis subsp bovis AF2122/97
gucgccgcuuucuug

SEQ ID NO: 3167200 - RNA, 22 nt, Mycobacterium bovis subsp bovis AF2122/97
gucgccgcuuucuuggcgggcg

SEQ ID NO: 3167201 - RNA, 18 nt, Mycobacterium bovis subsp bovis AF2122/97
gucgccggaccagagcca

SEQ ID NO: 3167202 - RNA, 19 nt, Mycobacterium bovis subsp bovis AF2122/97
gucgccggacugcggcccg

SEQ ID NO: 3167203 - RNA, 18 nt, Mycobacterium bovis subsp bovis AF2122/97
gucgccggagucgaucag

SEQ ID NO: 3167204 - RNA, 18 nt, Mycobacterium bovis subsp bovis AF2122/97
gucgccggaguucugcga

SEQ ID NO: 3167205 - RNA, 16 nt, Mycobacterium bovis subsp bovis AF2122/97
gucgccggauagcgca

SEQ ID NO: 3167206 - RNA, 22 nt, Mycobacterium bovis subsp bovis AF2122/97
gucgccggauagcgcagcucgc

SEQ ID NO: 3167207 - RNA, 15 nt, Mycobacterium bovis subsp bovis AF2122/97
gucgccggcauacac

SEQ ID NO: 3167208 - RNA, 18 nt, Mycobacterium bovis subsp bovis AF2122/97
gucgccggcauacaccgu

SEQ ID NO: 3167209 - RNA, 12 nt, Mycobacterium bovis subsp bovis AF2122/97
gucgccggccac

SEQ ID NO: 3167210 - RNA, 14 nt, Mycobacterium bovis subsp bovis AF2122/97
gucgccggccuuga

SEQ ID NO: 3167211 - RNA, 13 nt, Mycobacterium bovis subsp bovis AF2122/97
gucgccggcggcg

SEQ ID NO: 3167212 - RNA, 18 nt, Mycobacterium bovis subsp bovis AF2122/97
gucgccggcgucgagccg

SEQ ID NO: 3167213 - RNA, 14 nt, Mycobacterium bovis subsp bovis AF2122/97
gucgccggcugggg

SEQ ID NO: 3167214 - RNA, 22 nt, Mycobacterium bovis subsp bovis AF2122/97
gucgccgggcaguuuggcggca

SEQ ID NO: 3167215 - RNA, 19 nt, Mycobacterium bovis subsp bovis AF2122/97
gucgccggucaggccgccg

SEQ ID NO: 3167216 - RNA, 20 nt, Mycobacterium bovis subsp bovis AF2122/97
gucgccggucaggccgccgc

SEQ ID NO: 3167217 - RNA, 23 nt, Mycobacterium bovis subsp bovis AF2122/97
gucgccggucaggccgccgcggc

SEQ ID NO: 3167218 - RNA, 16 nt, Mycobacterium bovis subsp bovis AF2122/97
gucgccggucaucgcc

SEQ ID NO: 3167219 - RNA, 13 nt, Mycobacterium bovis subsp bovis AF2122/97
gucgccggugacg

SEQ ID NO: 3167220 - RNA, 20 nt, Mycobacterium bovis subsp bovis AF2122/97
gucgccggugacgaugaccg

SEQ ID NO: 3167221 - RNA, 12 nt, Mycobacterium bovis subsp bovis AF2122/97
gucgccggugcc

SEQ ID NO: 3167222 - RNA, 17 nt, Mycobacterium bovis subsp bovis AF2122/97
gucgccgguggcacccg

SEQ ID NO: 3167223 - RNA, 19 nt, Mycobacterium bovis subsp bovis AF2122/97
gucgccgguggcacccgcg

SEQ ID NO: 3167224 - RNA, 17 nt, Mycobacterium bovis subsp bovis AF2122/97
gucgccguacaaccacc

SEQ ID NO: 3167225 - RNA, 18 nt, Mycobacterium bovis subsp bovis AF2122/97
gucgccguacaaccaccc

SEQ ID NO: 3167226 - RNA, 15 nt, Mycobacterium bovis subsp bovis AF2122/97
gucgccguacagcgc

SEQ ID NO: 3167227 - RNA, 16 nt, Mycobacterium bovis subsp bovis AF2122/97
gucgccgucgaaccag

SEQ ID NO: 3167228 - RNA, 12 nt, Mycobacterium bovis subsp bovis AF2122/97
gucgccgucgcg

SEQ ID NO: 3167229 - RNA, 17 nt, Mycobacterium bovis subsp bovis AF2122/97
gucgccgucgcggcacg

SEQ ID NO: 3167230 - RNA, 19 nt, Mycobacterium bovis subsp bovis AF2122/97
gucgccgucggugccgccg

SEQ ID NO: 3167231 - RNA, 18 nt, Mycobacterium bovis subsp bovis AF2122/97
gucgccgucgugccaccg

SEQ ID NO: 3167232 - RNA, 19 nt, Mycobacterium bovis subsp bovis AF2122/97
gucgccgucgugccaccgu

SEQ ID NO: 3167233 - RNA, 15 nt, Mycobacterium bovis subsp bovis AF2122/97
gucgccucgaugcca

SEQ ID NO: 3167234 - RNA, 22 nt, Mycobacterium bovis subsp bovis AF2122/97
gucgccucgcuaacuccccaga

SEQ ID NO: 3167235 - RNA, 22 nt, Mycobacterium bovis subsp bovis AF2122/97
gucgccugcccccgcgcgcacg

SEQ ID NO: 3167236 - RNA, 15 nt, Mycobacterium bovis subsp bovis AF2122/97
gucgccugccgacga

SEQ ID NO: 3167237 - RNA, 14 nt, Mycobacterium bovis subsp bovis AF2122/97
gucgccugcgggaa

SEQ ID NO: 3167238 - RNA, 17 nt, Mycobacterium bovis subsp bovis AF2122/97
gucgccugcgggaacgc

SEQ ID NO: 3167239 - RNA, 19 nt, Mycobacterium bovis subsp bovis AF2122/97
gucgccuucguaaccacga

SEQ ID NO: 3167240 - RNA, 19 nt, Mycobacterium bovis subsp bovis AF2122/97
gucgccuucuucgcggcgg

SEQ ID NO: 3167241 - RNA, 20 nt, Mycobacterium bovis subsp bovis AF2122/97
gucgccuucuuggcaggugc

SEQ ID NO: 3167242 - RNA, 22 nt, Mycobacterium bovis subsp bovis AF2122/97
gucgcgaaacaccagacacugg

SEQ ID NO: 3167243 - RNA, 18 nt, Mycobacterium bovis subsp bovis AF2122/97
gucgcgaaauagcugcgg

SEQ ID NO: 3167244 - RNA, 19 nt, Mycobacterium bovis subsp bovis AF2122/97
gucgcgaaauagcugcgga

SEQ ID NO: 3167245 - RNA, 21 nt, Mycobacterium bovis subsp bovis AF2122/97
gucgcgaaauagcugcggagg

SEQ ID NO: 3167246 - RNA, 22 nt, Mycobacterium bovis subsp bovis AF2122/97
gucgcgaaauagcugcggaggg

SEQ ID NO: 3167247 - RNA, 22 nt, Mycobacterium bovis subsp bovis AF2122/97
gucgcgaccuugcccgcuagcg

SEQ ID NO: 3167248 - RNA, 20 nt, Mycobacterium bovis subsp bovis AF2122/97
gucgcgacgacguagauggu

SEQ ID NO: 3167249 - RNA, 14 nt, Mycobacterium bovis subsp bovis AF2122/97
gucgcgacgucggc

SEQ ID NO: 3167250 - RNA, 16 nt, Mycobacterium bovis subsp bovis AF2122/97
gucgcgagguccagca

SEQ ID NO: 3167251 - RNA, 15 nt, Mycobacterium bovis subsp bovis AF2122/97
gucgcgaugcuuccc

SEQ ID NO: 3167252 - RNA, 22 nt, Mycobacterium bovis subsp bovis AF2122/97
gucgcgcaccggaucgccgucg

SEQ ID NO: 3167253 - RNA, 18 nt, Mycobacterium bovis subsp bovis AF2122/97
gucgcgcacggcccgagc

SEQ ID NO: 3167254 - RNA, 17 nt, Mycobacterium bovis subsp bovis AF2122/97
gucgcgcagcuccaccg

SEQ ID NO: 3167255 - RNA, 16 nt, Mycobacterium bovis subsp bovis AF2122/97
gucgcgcagguagcgc

SEQ ID NO: 3167256 - RNA, 22 nt, Mycobacterium bovis subsp bovis AF2122/97
gucgcgccaggcgcgaucgcgc

SEQ ID NO: 3167257 - RNA, 18 nt, Mycobacterium bovis subsp bovis AF2122/97
gucgcgccaggcuugcgg

SEQ ID NO: 3167258 - RNA, 20 nt, Mycobacterium bovis subsp bovis AF2122/97
gucgcgccaggcuugcggca

SEQ ID NO: 3167259 - RNA, 22 nt, Mycobacterium bovis subsp bovis AF2122/97
gucgcgccaggcuugcggcacc

SEQ ID NO: 3167260 - RNA, 16 nt, Mycobacterium bovis subsp bovis AF2122/97
gucgcgcccucagccg

SEQ ID NO: 3167261 - RNA, 20 nt, Mycobacterium bovis subsp bovis AF2122/97
gucgcgcccucagccgcggc

SEQ ID NO: 3167262 - RNA, 15 nt, Mycobacterium bovis subsp bovis AF2122/97
gucgcgccugcccgg

SEQ ID NO: 3167263 - RNA, 13 nt, Mycobacterium bovis subsp bovis AF2122/97
gucgcgcgcggca

SEQ ID NO: 3167264 - RNA, 19 nt, Mycobacterium bovis subsp bovis AF2122/97
gucgcgcgcuaggugcaac

SEQ ID NO: 3167265 - RNA, 14 nt, Mycobacterium bovis subsp bovis AF2122/97
gucgcgcgcucgcg

SEQ ID NO: 3167266 - RNA, 15 nt, Mycobacterium bovis subsp bovis AF2122/97
gucgcgcucgcacca

SEQ ID NO: 3167267 - RNA, 21 nt, Mycobacterium bovis subsp bovis AF2122/97
gucgcgcucgcaccaccacgu

SEQ ID NO: 3167268 - RNA, 15 nt, Mycobacterium bovis subsp bovis AF2122/97
gucgcgcugccggcc

SEQ ID NO: 3167269 - RNA, 21 nt, Mycobacterium bovis subsp bovis AF2122/97
gucgcgcuggcgccggccagc

SEQ ID NO: 3167270 - RNA, 14 nt, Mycobacterium bovis subsp bovis AF2122/97
gucgcggacccgcg

SEQ ID NO: 3167271 - RNA, 13 nt, Mycobacterium bovis subsp bovis AF2122/97
gucgcggacgucg

SEQ ID NO: 3167272 - RNA, 20 nt, Mycobacterium bovis subsp bovis AF2122/97
gucgcggaguagccgcagcu

SEQ ID NO: 3167273 - RNA, 17 nt, Mycobacterium bovis subsp bovis AF2122/97
gucgcggaucagcccgc

SEQ ID NO: 3167274 - RNA, 23 nt, Mycobacterium bovis subsp bovis AF2122/97
gucgcggauugccgcgcgcaagc

SEQ ID NO: 3167275 - RNA, 16 nt, Mycobacterium bovis subsp bovis AF2122/97
gucgcggccacgguca

SEQ ID NO: 3167276 - RNA, 18 nt, Mycobacterium bovis subsp bovis AF2122/97
gucgcggccacggucagc

SEQ ID NO: 3167277 - RNA, 15 nt, Mycobacterium bovis subsp bovis AF2122/97
gucgcggcccgcgaa

SEQ ID NO: 3167278 - RNA, 12 nt, Mycobacterium bovis subsp bovis AF2122/97
gucgcggccgcg

SEQ ID NO: 3167279 - RNA, 13 nt, Mycobacterium bovis subsp bovis AF2122/97
gucgcggccggcg

SEQ ID NO: 3167280 - RNA, 14 nt, Mycobacterium bovis subsp bovis AF2122/97
gucggaccuuccgg

SEQ ID NO: 3167281 - RNA, 15 nt, Mycobacterium bovis subsp bovis AF2122/97
gucggacggccaucg

SEQ ID NO: 3167282 - RNA, 21 nt, Mycobacterium bovis subsp bovis AF2122/97
gucggacggccaucgccagcc

SEQ ID NO: 3167283 - RNA, 16 nt, Mycobacterium bovis subsp bovis AF2122/97
gucggacucguccuuc

SEQ ID NO: 3167284 - RNA, 15 nt, Mycobacterium bovis subsp bovis AF2122/97
gucggagaacgcccg

SEQ ID NO: 3167285 - RNA, 14 nt, Mycobacterium bovis subsp bovis AF2122/97
gucggagaccagcu

SEQ ID NO: 3167286 - RNA, 15 nt, Mycobacterium bovis subsp bovis AF2122/97
gucggagaccagcuc

SEQ ID NO: 3167287 - RNA, 12 nt, Mycobacterium bovis subsp bovis AF2122/97
gucggagccggc

SEQ ID NO: 3167288 - RNA, 16 nt, Mycobacterium bovis subsp bovis AF2122/97
gucggagccggccacc

SEQ ID NO: 3167289 - RNA, 13 nt, Mycobacterium bovis subsp bovis AF2122/97
gucggagcgggug

SEQ ID NO: 3167290 - RNA, 17 nt, Mycobacterium bovis subsp bovis AF2122/97
gucggagcgggugcggg

SEQ ID NO: 3167291 - RNA, 22 nt, Mycobacterium bovis subsp bovis AF2122/97
gucggagcuagacccgucaccg

SEQ ID NO: 3167292 - RNA, 23 nt, Mycobacterium bovis subsp bovis AF2122/97
gucggaggugaaccccgccggca

SEQ ID NO: 3167293 - RNA, 22 nt, Mycobacterium bovis subsp bovis AF2122/97
gucggagucgacggucacggug

SEQ ID NO: 3167294 - RNA, 21 nt, Mycobacterium bovis subsp bovis AF2122/97
gucggauagccucggcggcgc

SEQ ID NO: 3167295 - RNA, 17 nt, Mycobacterium bovis subsp bovis AF2122/97
gucggauggaaggcggc

SEQ ID NO: 3167296 - RNA, 20 nt, Mycobacterium bovis subsp bovis AF2122/97
gucggcaaagaaggcgaccc

SEQ ID NO: 3167297 - RNA, 15 nt, Mycobacterium bovis subsp bovis AF2122/97
gucggcaaccaaccg

SEQ ID NO: 3167298 - RNA, 19 nt, Mycobacterium bovis subsp bovis AF2122/97
gucggcaaccaaccgcgcg

SEQ ID NO: 3167299 - RNA, 22 nt, Mycobacterium bovis subsp bovis AF2122/97
gucggcaaccaaccgcgcgagc

SEQ ID NO: 3167300 - RNA, 23 nt, Mycobacterium bovis subsp bovis AF2122/97
gucggcaaccaaccgcgcgagcc

SEQ ID NO: 3167301 - RNA, 22 nt, Mycobacterium bovis subsp bovis AF2122/97
gucggcaacccacacgcccucg

SEQ ID NO: 3167302 - RNA, 15 nt, Mycobacterium bovis subsp bovis AF2122/97
gucggcaacgacccg

SEQ ID NO: 3167303 - RNA, 17 nt, Mycobacterium bovis subsp bovis AF2122/97
gucggcaacgacccgcc

SEQ ID NO: 3167304 - RNA, 22 nt, Mycobacterium bovis subsp bovis AF2122/97
gucggcaaugacguacgggguc

SEQ ID NO: 3167305 - RNA, 23 nt, Mycobacterium bovis subsp bovis AF2122/97
gucggcaaugucuucgauaccga

SEQ ID NO: 3167306 - RNA, 15 nt, Mycobacterium bovis subsp bovis AF2122/97
gucggcaccaccacg

SEQ ID NO: 3167307 - RNA, 17 nt, Mycobacterium bovis subsp bovis AF2122/97
gucggcaccaccacgcc

SEQ ID NO: 3167308 - RNA, 18 nt, Mycobacterium bovis subsp bovis AF2122/97
gucggcaccaccacgccg

SEQ ID NO: 3167309 - RNA, 20 nt, Mycobacterium bovis subsp bovis AF2122/97
gucggcaccaccacgccgac

SEQ ID NO: 3167310 - RNA, 22 nt, Mycobacterium bovis subsp bovis AF2122/97
gucggcaccaccacgccgaccg

SEQ ID NO: 3167311 - RNA, 15 nt, Mycobacterium bovis subsp bovis AF2122/97
gucggcaccagcagc

SEQ ID NO: 3167312 - RNA, 19 nt, Mycobacterium bovis subsp bovis AF2122/97
gucggcaccagcagccagc

SEQ ID NO: 3167313 - RNA, 20 nt, Mycobacterium bovis subsp bovis AF2122/97
gucggcaccauagcuggagu

SEQ ID NO: 3167314 - RNA, 13 nt, Mycobacterium bovis subsp bovis AF2122/97
gucggcacccucg

SEQ ID NO: 3167315 - RNA, 13 nt, Mycobacterium bovis subsp bovis AF2122/97
gucggcaccgauc

SEQ ID NO: 3167316 - RNA, 13 nt, Mycobacterium bovis subsp bovis AF2122/97
gucggcaccgguu

SEQ ID NO: 3167317 - RNA, 14 nt, Mycobacterium bovis subsp bovis AF2122/97
gucggcaccgguuu

SEQ ID NO: 3167318 - RNA, 14 nt, Mycobacterium bovis subsp bovis AF2122/97
gucggcacgacccg

SEQ ID NO: 3167319 - RNA, 22 nt, Mycobacterium bovis subsp bovis AF2122/97
gucggcacgggaaucgcucgcg

SEQ ID NO: 3167320 - RNA, 18 nt, Mycobacterium bovis subsp bovis AF2122/97
gucggcagaccgaccucg

SEQ ID NO: 3167321 - RNA, 14 nt, Mycobacterium bovis subsp bovis AF2122/97
gucggcagcagcgg

SEQ ID NO: 3167322 - RNA, 20 nt, Mycobacterium bovis subsp bovis AF2122/97
gucggcagcagcggugcagc

SEQ ID NO: 3167323 - RNA, 14 nt, Mycobacterium bovis subsp bovis AF2122/97
gucggcagcgacgc

SEQ ID NO: 3167324 - RNA, 17 nt, Mycobacterium bovis subsp bovis AF2122/97
gucggcagcgacgccgg

SEQ ID NO: 3167325 - RNA, 16 nt, Mycobacterium bovis subsp bovis AF2122/97
gucggcagcuccagca

SEQ ID NO: 3167326 - RNA, 17 nt, Mycobacterium bovis subsp bovis AF2122/97
gucggcagcuccagcaa

SEQ ID NO: 3167327 - RNA, 21 nt, Mycobacterium bovis subsp bovis AF2122/97
gucggcagcuucucgccgacg

SEQ ID NO: 3167328 - RNA, 23 nt, Mycobacterium bovis subsp bovis AF2122/97
gucggcauccucugaaccagcug

SEQ ID NO: 3167329 - RNA, 17 nt, Mycobacterium bovis subsp bovis AF2122/97
gucggcaucgcgagcug

SEQ ID NO: 3167330 - RNA, 13 nt, Mycobacterium bovis subsp bovis AF2122/97
gucggcaugaucu

SEQ ID NO: 3167331 - RNA, 17 nt, Mycobacterium bovis subsp bovis AF2122/97
gucggcaugggccggcg

SEQ ID NO: 3167332 - RNA, 15 nt, Mycobacterium bovis subsp bovis AF2122/97
gucggcauugaucgg

SEQ ID NO: 3167333 - RNA, 19 nt, Mycobacterium bovis subsp bovis AF2122/97
gucggcauugaucggugcc

SEQ ID NO: 3167334 - RNA, 17 nt, Mycobacterium bovis subsp bovis AF2122/97
gucggccaaagacccgg

SEQ ID NO: 3167335 - RNA, 23 nt, Mycobacterium bovis subsp bovis AF2122/97
gucggccaccaacucggcgaccu

SEQ ID NO: 3167336 - RNA, 15 nt, Mycobacterium bovis subsp bovis AF2122/97
gucggccaccggcgu

SEQ ID NO: 3167337 - RNA, 13 nt, Mycobacterium bovis subsp bovis AF2122/97
gucggccacgcgc

SEQ ID NO: 3167338 - RNA, 22 nt, Mycobacterium bovis subsp bovis AF2122/97
gucggccagcagaucagguccu

SEQ ID NO: 3167339 - RNA, 12 nt, Mycobacterium bovis subsp bovis AF2122/97
gucggccaggcc

SEQ ID NO: 3167340 - RNA, 14 nt, Mycobacterium bovis subsp bovis AF2122/97
gucggccaggccac

SEQ ID NO: 3167341 - RNA, 14 nt, Mycobacterium bovis subsp bovis AF2122/97
gucggccaggccgu

SEQ ID NO: 3167342 - RNA, 16 nt, Mycobacterium bovis subsp bovis AF2122/97
gucggccaggccgucg

SEQ ID NO: 3167343 - RNA, 12 nt, Mycobacterium bovis subsp bovis AF2122/97
gucggccaggcu

SEQ ID NO: 3167344 - RNA, 19 nt, Mycobacterium bovis subsp bovis AF2122/97
gucggccaggcugccuccg

SEQ ID NO: 3167345 - RNA, 21 nt, Mycobacterium bovis subsp bovis AF2122/97
gucggccauccaccgcagauc

SEQ ID NO: 3167346 - RNA, 19 nt, Mycobacterium bovis subsp bovis AF2122/97
gucggccaucgaguccacc

SEQ ID NO: 3167347 - RNA, 20 nt, Mycobacterium bovis subsp bovis AF2122/97
gucggccaugguguucggca

SEQ ID NO: 3167348 - RNA, 16 nt, Mycobacterium bovis subsp bovis AF2122/97
gucggccccggccgcg

SEQ ID NO: 3167349 - RNA, 16 nt, Mycobacterium bovis subsp bovis AF2122/97
gucggcccgcggucgc

SEQ ID NO: 3167350 - RNA, 14 nt, Mycobacterium bovis subsp bovis AF2122/97
gucggcccuccacc

SEQ ID NO: 3167351 - RNA, 23 nt, Mycobacterium bovis subsp bovis AF2122/97
gucggcccuccaccgguguuggu

SEQ ID NO: 3167352 - RNA, 15 nt, Mycobacterium bovis subsp bovis AF2122/97
gucggccgacaccgc

SEQ ID NO: 3167353 - RNA, 23 nt, Mycobacterium bovis subsp bovis AF2122/97
gucggccgagucgauugccaccg

SEQ ID NO: 3167354 - RNA, 16 nt, Mycobacterium bovis subsp bovis AF2122/97
gucggccgcaucgccc

SEQ ID NO: 3167355 - RNA, 23 nt, Mycobacterium bovis subsp bovis AF2122/97
gucggccgccuucuccggcguca

SEQ ID NO: 3167356 - RNA, 22 nt, Mycobacterium bovis subsp bovis AF2122/97
gucggccgcgggucccggccgg

SEQ ID NO: 3167357 - RNA, 21 nt, Mycobacterium bovis subsp bovis AF2122/97
gucggccggaugagcgaacgc

SEQ ID NO: 3167358 - RNA, 14 nt, Mycobacterium bovis subsp bovis AF2122/97
gucggccggcaccc

SEQ ID NO: 3167359 - RNA, 12 nt, Mycobacterium bovis subsp bovis AF2122/97
gucggccggcgg

SEQ ID NO: 3167360 - RNA, 15 nt, Mycobacterium bovis subsp bovis AF2122/97
gucggccggcggucg

SEQ ID NO: 3167361 - RNA, 13 nt, Mycobacterium bovis subsp bovis AF2122/97
gucggccggcucg

SEQ ID NO: 3167362 - RNA, 17 nt, Mycobacterium bovis subsp bovis AF2122/97
gucggccggggccaccc

SEQ ID NO: 3167363 - RNA, 17 nt, Mycobacterium bovis subsp bovis AF2122/97
gucggccugaccgguca

SEQ ID NO: 3167364 - RNA, 19 nt, Mycobacterium bovis subsp bovis AF2122/97
gucggccugaccggucacc

SEQ ID NO: 3167365 - RNA, 20 nt, Mycobacterium bovis subsp bovis AF2122/97
gucggccugcgacacaacgg

SEQ ID NO: 3167366 - RNA, 18 nt, Mycobacterium bovis subsp bovis AF2122/97
gucggccugcgccggcgc

SEQ ID NO: 3167367 - RNA, 16 nt, Mycobacterium bovis subsp bovis AF2122/97
gucgggacgcugccgg

SEQ ID NO: 3167368 - RNA, 15 nt, Mycobacterium bovis subsp bovis AF2122/97
gucgggacggccaac

SEQ ID NO: 3167369 - RNA, 20 nt, Mycobacterium bovis subsp bovis AF2122/97
gucgggcaaccugccgggcc

SEQ ID NO: 3167370 - RNA, 17 nt, Mycobacterium bovis subsp bovis AF2122/97
gucgggcaaggcggcgg

SEQ ID NO: 3167371 - RNA, 15 nt, Mycobacterium bovis subsp bovis AF2122/97
gucgggcacaccgac

SEQ ID NO: 3167372 - RNA, 17 nt, Mycobacterium bovis subsp bovis AF2122/97
gucgggcacaccgacgc

SEQ ID NO: 3167373 - RNA, 20 nt, Mycobacterium bovis subsp bovis AF2122/97
gucgggcacaccgacgccgc

SEQ ID NO: 3167374 - RNA, 20 nt, Mycobacterium bovis subsp bovis AF2122/97
gucgggcagauaugacggca

SEQ ID NO: 3167375 - RNA, 21 nt, Mycobacterium bovis subsp bovis AF2122/97
gucgggcagauucuucaccca

SEQ ID NO: 3167376 - RNA, 14 nt, Mycobacterium bovis subsp bovis AF2122/97
gucgggcaugacga

SEQ ID NO: 3167377 - RNA, 17 nt, Mycobacterium bovis subsp bovis AF2122/97
gucgggcaugcucuggc

SEQ ID NO: 3167378 - RNA, 15 nt, Mycobacterium bovis subsp bovis AF2122/97
gucgggcauggcggc

SEQ ID NO: 3167379 - RNA, 17 nt, Mycobacterium bovis subsp bovis AF2122/97
gucgggcauggcggcgu

SEQ ID NO: 3167380 - RNA, 21 nt, Mycobacterium bovis subsp bovis AF2122/97
gucgggcccagccggaccgcg

SEQ ID NO: 3167381 - RNA, 18 nt, Mycobacterium bovis subsp bovis AF2122/97
gucgggcccccggcagca

SEQ ID NO: 3167382 - RNA, 12 nt, Mycobacterium bovis subsp bovis AF2122/97
gucgggccgucg

SEQ ID NO: 3167383 - RNA, 18 nt, Mycobacterium bovis subsp bovis AF2122/97
gucgggccgucgggugug

SEQ ID NO: 3167384 - RNA, 15 nt, Mycobacterium bovis subsp bovis AF2122/97
gucgggcgcgcugcc

SEQ ID NO: 3167385 - RNA, 14 nt, Mycobacterium bovis subsp bovis AF2122/97
gucgggcggcgucg

SEQ ID NO: 3167386 - RNA, 17 nt, Mycobacterium bovis subsp bovis AF2122/97
gucgggcggcgucgaac

SEQ ID NO: 3167387 - RNA, 12 nt, Mycobacterium bovis subsp bovis AF2122/97
gucgggcgguaa

SEQ ID NO: 3167388 - RNA, 15 nt, Mycobacterium bovis subsp bovis AF2122/97
gucgggcgugucggg

SEQ ID NO: 3167389 - RNA, 16 nt, Mycobacterium bovis subsp bovis AF2122/97
gucgggcgugucggga

SEQ ID NO: 3167390 - RNA, 23 nt, Mycobacterium bovis subsp bovis AF2122/97
gucgggcuaauccagcagcaccg

SEQ ID NO: 3167391 - RNA, 20 nt, Mycobacterium bovis subsp bovis AF2122/97
gucgggcucgcauucggcga

SEQ ID NO: 3167392 - RNA, 22 nt, Mycobacterium bovis subsp bovis AF2122/97
gucgggcucgcauucggcgagc

SEQ ID NO: 3167393 - RNA, 17 nt, Mycobacterium bovis subsp bovis AF2122/97
gucgggcugaguggcga

SEQ ID NO: 3167394 - RNA, 19 nt, Mycobacterium bovis subsp bovis AF2122/97
gucgggcuggguggccaac

SEQ ID NO: 3167395 - RNA, 23 nt, Mycobacterium bovis subsp bovis AF2122/97
gucgggcuugacccuugggcacc

SEQ ID NO: 3167396 - RNA, 16 nt, Mycobacterium bovis subsp bovis AF2122/97
gucggggaacgcggcg

SEQ ID NO: 3167397 - RNA, 20 nt, Mycobacterium bovis subsp bovis AF2122/97
gucggggaagacgaccgugc

SEQ ID NO: 3167398 - RNA, 22 nt, Mycobacterium bovis subsp bovis AF2122/97
gucggggaagacgaccgugcug

SEQ ID NO: 3167399 - RNA, 17 nt, Mycobacterium bovis subsp bovis AF2122/97
gucggggaugccgaacc

SEQ ID NO: 3167400 - RNA, 17 nt, Mycobacterium bovis subsp bovis AF2122/97
gucggggcccccgccgg

SEQ ID NO: 3167401 - RNA, 22 nt, Mycobacterium bovis subsp bovis AF2122/97
gucggggccgucgucggucacc

SEQ ID NO: 3167402 - RNA, 14 nt, Mycobacterium bovis subsp bovis AF2122/97
gucgggggcagcgc

SEQ ID NO: 3167403 - RNA, 19 nt, Mycobacterium bovis subsp bovis AF2122/97
gucgggguacaggcugcug

SEQ ID NO: 3167404 - RNA, 19 nt, Mycobacterium bovis subsp bovis AF2122/97
gucggggucaacaggccgu

SEQ ID NO: 3167405 - RNA, 24 nt, Mycobacterium bovis subsp bovis AF2122/97
gucggggucaacaggccguggcgg

SEQ ID NO: 3167406 - RNA, 21 nt, Mycobacterium bovis subsp bovis AF2122/97
gucggggucguugaggccggu

SEQ ID NO: 3167407 - RNA, 24 nt, Mycobacterium bovis subsp bovis AF2122/97
gucggggucguugaggccggugaa

SEQ ID NO: 3167408 - RNA, 22 nt, Mycobacterium bovis subsp bovis AF2122/97
gucgggguguucgaugggugca

SEQ ID NO: 3167409 - RNA, 23 nt, Mycobacterium bovis subsp bovis AF2122/97
gucgggguugacuggccgcccgg

SEQ ID NO: 3167410 - RNA, 22 nt, Mycobacterium bovis subsp bovis AF2122/97
gucgggguuguccucggcgauc

SEQ ID NO: 3167411 - RNA, 19 nt, Mycobacterium bovis subsp bovis AF2122/97
gucgggguuucaggcggca

SEQ ID NO: 3167412 - RNA, 20 nt, Mycobacterium bovis subsp bovis AF2122/97
gucgggguuucaggcggcag

SEQ ID NO: 3167413 - RNA, 21 nt, Mycobacterium bovis subsp bovis AF2122/97
gucgggguuucaggcggcagg

SEQ ID NO: 3167414 - RNA, 22 nt, Mycobacterium bovis subsp bovis AF2122/97
gucggguaaauauugcgcccgg

SEQ ID NO: 3167415 - RNA, 18 nt, Mycobacterium bovis subsp bovis AF2122/97
gucggguaccacgcuggc

SEQ ID NO: 3167416 - RNA, 15 nt, Mycobacterium bovis subsp bovis AF2122/97
gucggguaggccgcc

SEQ ID NO: 3167417 - RNA, 23 nt, Mycobacterium bovis subsp bovis AF2122/97
gucggguagggcaucgucgccga

SEQ ID NO: 3167418 - RNA, 17 nt, Mycobacterium bovis subsp bovis AF2122/97
gucgggucgaucaccga

SEQ ID NO: 3167419 - RNA, 13 nt, Mycobacterium bovis subsp bovis AF2122/97
gucgggucgcacc

SEQ ID NO: 3167420 - RNA, 14 nt, Mycobacterium bovis subsp bovis AF2122/97
gucgggucgcaccc

SEQ ID NO: 3167421 - RNA, 23 nt, Mycobacterium bovis subsp bovis AF2122/97
gucgggucgcaccccggcggcgu

SEQ ID NO: 3167422 - RNA, 22 nt, Mycobacterium bovis subsp bovis AF2122/97
gucgggugcagcacggcgccgc

SEQ ID NO: 3167423 - RNA, 12 nt, Mycobacterium bovis subsp bovis AF2122/97
gucgggugcuga

SEQ ID NO: 3167424 - RNA, 15 nt, Mycobacterium bovis subsp bovis AF2122/97
gucggguggcugcug

SEQ ID NO: 3167425 - RNA, 18 nt, Mycobacterium bovis subsp bovis AF2122/97
gucgggugugcaggccgc

SEQ ID NO: 3167426 - RNA, 16 nt, Mycobacterium bovis subsp bovis AF2122/97
gucgggugugcgcaga

SEQ ID NO: 3167427 - RNA, 17 nt, Mycobacterium bovis subsp bovis AF2122/97
gucggguugcgacgaac

SEQ ID NO: 3167428 - RNA, 18 nt, Mycobacterium bovis subsp bovis AF2122/97
gucggguugguuggcucg

SEQ ID NO: 3167429 - RNA, 19 nt, Mycobacterium bovis subsp bovis AF2122/97
gucggguugguuggcucgc

SEQ ID NO: 3167430 - RNA, 15 nt, Mycobacterium bovis subsp bovis AF2122/97
gucggguuuggccga

SEQ ID NO: 3167431 - RNA, 23 nt, Mycobacterium bovis subsp bovis AF2122/97
gucgguaaagggcucgauggugu

SEQ ID NO: 3167432 - RNA, 17 nt, Mycobacterium bovis subsp bovis AF2122/97
gucgguaacggcggugc

SEQ ID NO: 3167433 - RNA, 16 nt, Mycobacterium bovis subsp bovis AF2122/97
gucgguaccccagcgc

SEQ ID NO: 3167434 - RNA, 22 nt, Mycobacterium bovis subsp bovis AF2122/97
gucgguaccgcccaguugggcc

SEQ ID NO: 3167435 - RNA, 14 nt, Mycobacterium bovis subsp bovis AF2122/97
gucgguaccguccu

SEQ ID NO: 3167436 - RNA, 23 nt, Mycobacterium bovis subsp bovis AF2122/97
gucggucaauucggugcgcuggc

SEQ ID NO: 3167437 - RNA, 15 nt, Mycobacterium bovis subsp bovis AF2122/97
gucggucaccauggc

SEQ ID NO: 3167438 - RNA, 18 nt, Mycobacterium bovis subsp bovis AF2122/97
gucggucaccauggcgcc

SEQ ID NO: 3167439 - RNA, 19 nt, Mycobacterium bovis subsp bovis AF2122/97
gucggucaccauggcgccg

SEQ ID NO: 3167440 - RNA, 20 nt, Mycobacterium bovis subsp bovis AF2122/97
gucggucaccauggcgccgc

SEQ ID NO: 3167441 - RNA, 22 nt, Mycobacterium bovis subsp bovis AF2122/97
gucggucagcugugcgacccgc

SEQ ID NO: 3167442 - RNA, 19 nt, Mycobacterium bovis subsp bovis AF2122/97
gucggucaggucgaggucc

SEQ ID NO: 3167443 - RNA, 18 nt, Mycobacterium bovis subsp bovis AF2122/97
gucggucaucgguugacc

SEQ ID NO: 3167444 - RNA, 12 nt, Mycobacterium bovis subsp bovis AF2122/97
gucgguccacuu

SEQ ID NO: 3167445 - RNA, 23 nt, Mycobacterium bovis subsp bovis AF2122/97
gucgguccacuucagaucggcga

SEQ ID NO: 3167446 - RNA, 12 nt, Mycobacterium bovis subsp bovis AF2122/97
gucggucccagg

SEQ ID NO: 3167447 - RNA, 21 nt, Mycobacterium bovis subsp bovis AF2122/97
gucggucccagguuggagccc

SEQ ID NO: 3167448 - RNA, 23 nt, Mycobacterium bovis subsp bovis AF2122/97
gucgguccugccaaugcugcagg

SEQ ID NO: 3167449 - RNA, 21 nt, Mycobacterium bovis subsp bovis AF2122/97
gucggucggaucggcgccgca

SEQ ID NO: 3167450 - RNA, 23 nt, Mycobacterium bovis subsp bovis AF2122/97
gucggucggguggaucuucaccu

SEQ ID NO: 3167451 - RNA, 14 nt, Mycobacterium bovis subsp bovis AF2122/97
gucggucucggcga

SEQ ID NO: 3167452 - RNA, 21 nt, Mycobacterium bovis subsp bovis AF2122/97
gucggucuuuggcauugccgc

SEQ ID NO: 3167453 - RNA, 23 nt, Mycobacterium bovis subsp bovis AF2122/97
gucguccagacgccacugccagc

SEQ ID NO: 3167454 - RNA, 13 nt, Mycobacterium bovis subsp bovis AF2122/97
gucguccagcacc

SEQ ID NO: 3167455 - RNA, 16 nt, Mycobacterium bovis subsp bovis AF2122/97
gucguccagggcgacg

SEQ ID NO: 3167456 - RNA, 18 nt, Mycobacterium bovis subsp bovis AF2122/97
gucgucccagggcugccg

SEQ ID NO: 3167457 - RNA, 15 nt, Mycobacterium bovis subsp bovis AF2122/97
gucguccccgucgcu

SEQ ID NO: 3167458 - RNA, 16 nt, Mycobacterium bovis subsp bovis AF2122/97
gucgucccgauggcgg

SEQ ID NO: 3167459 - RNA, 18 nt, Mycobacterium bovis subsp bovis AF2122/97
gucguccgcgccaguggc

SEQ ID NO: 3167460 - RNA, 19 nt, Mycobacterium bovis subsp bovis AF2122/97
gucguccggaucggucggc

SEQ ID NO: 3167461 - RNA, 20 nt, Mycobacterium bovis subsp bovis AF2122/97
gucguccggaucggucggca

SEQ ID NO: 3167462 - RNA, 14 nt, Mycobacterium bovis subsp bovis AF2122/97
gucguccggccacg

SEQ ID NO: 3167463 - RNA, 18 nt, Mycobacterium bovis subsp bovis AF2122/97
gucgucgacaaacagcgc

SEQ ID NO: 3167464 - RNA, 14 nt, Mycobacterium bovis subsp bovis AF2122/97
gucgucgaccacga

SEQ ID NO: 3167465 - RNA, 20 nt, Mycobacterium bovis subsp bovis AF2122/97
gucgucgaccaggccacugc

SEQ ID NO: 3167466 - RNA, 13 nt, Mycobacterium bovis subsp bovis AF2122/97
gucgucgagcuga

SEQ ID NO: 3167467 - RNA, 13 nt, Mycobacterium bovis subsp bovis AF2122/97
gucgucgagguca

SEQ ID NO: 3167468 - RNA, 15 nt, Mycobacterium bovis subsp bovis AF2122/97
gucgucgaguuggcc

SEQ ID NO: 3167469 - RNA, 16 nt, Mycobacterium bovis subsp bovis AF2122/97
gucgucgaguuggcca

SEQ ID NO: 3167470 - RNA, 13 nt, Mycobacterium bovis subsp bovis AF2122/97
gucgucgaucgac

SEQ ID NO: 3167471 - RNA, 15 nt, Mycobacterium bovis subsp bovis AF2122/97
gucgucgaucgcgga

SEQ ID NO: 3167472 - RNA, 22 nt, Mycobacterium bovis subsp bovis AF2122/97
gucgucgaugaugccggacagc

SEQ ID NO: 3167473 - RNA, 13 nt, Mycobacterium bovis subsp bovis AF2122/97
gucgucgccccgg

SEQ ID NO: 3167474 - RNA, 12 nt, Mycobacterium bovis subsp bovis AF2122/97
gucgucgccgcc

SEQ ID NO: 3167475 - RNA, 13 nt, Mycobacterium bovis subsp bovis AF2122/97
gucgucgccgccg

SEQ ID NO: 3167476 - RNA, 14 nt, Mycobacterium bovis subsp bovis AF2122/97
gucgucgccgccga

SEQ ID NO: 3167477 - RNA, 15 nt, Mycobacterium bovis subsp bovis AF2122/97
gucgucgccgccgaa

SEQ ID NO: 3167478 - RNA, 14 nt, Mycobacterium bovis subsp bovis AF2122/97
gucgucgccggcgg

SEQ ID NO: 3167479 - RNA, 22 nt, Mycobacterium bovis subsp bovis AF2122/97
gucgucgccggcggcggugcgc

SEQ ID NO: 3167480 - RNA, 13 nt, Mycobacterium bovis subsp bovis AF2122/97
gucgucgcggccg

SEQ ID NO: 3167481 - RNA, 16 nt, Mycobacterium bovis subsp bovis AF2122/97
gucgucgcggccgcuc

SEQ ID NO: 3167482 - RNA, 14 nt, Mycobacterium bovis subsp bovis AF2122/97
gucgucgcugagca

SEQ ID NO: 3167483 - RNA, 19 nt, Mycobacterium bovis subsp bovis AF2122/97
gucgucggaguaccgcgcg

SEQ ID NO: 3167484 - RNA, 17 nt, Mycobacterium bovis subsp bovis AF2122/97
gucgucggcaaccaacc

SEQ ID NO: 3167485 - RNA, 16 nt, Mycobacterium bovis subsp bovis AF2122/97
gucgucggcaggcagc

SEQ ID NO: 3167486 - RNA, 16 nt, Mycobacterium bovis subsp bovis AF2122/97
gucgucggcaugggcc

SEQ ID NO: 3167487 - RNA, 13 nt, Mycobacterium bovis subsp bovis AF2122/97
gucgucggccauc

SEQ ID NO: 3167488 - RNA, 18 nt, Mycobacterium bovis subsp bovis AF2122/97
gucgucggccugcgccgg

SEQ ID NO: 3167489 - RNA, 13 nt, Mycobacterium bovis subsp bovis AF2122/97
gucgucggcgucg

SEQ ID NO: 3167490 - RNA, 17 nt, Mycobacterium bovis subsp bovis AF2122/97
gucgucgggaacgccga

SEQ ID NO: 3167491 - RNA, 18 nt, Mycobacterium bovis subsp bovis AF2122/97
gucgucgggaacgccgaa

SEQ ID NO: 3167492 - RNA, 18 nt, Mycobacterium bovis subsp bovis AF2122/97
gucgucgguaaugccggg

SEQ ID NO: 3167493 - RNA, 21 nt, Mycobacterium bovis subsp bovis AF2122/97
gucgucggucaugucggccac

SEQ ID NO: 3167494 - RNA, 21 nt, Mycobacterium bovis subsp bovis AF2122/97
gucgucggugaucaccgcggc

SEQ ID NO: 3167495 - RNA, 22 nt, Mycobacterium bovis subsp bovis AF2122/97
gucgucggugaucaccgcggcg

SEQ ID NO: 3167496 - RNA, 16 nt, Mycobacterium bovis subsp bovis AF2122/97
gucgucgguguuccgc

SEQ ID NO: 3167497 - RNA, 19 nt, Mycobacterium bovis subsp bovis AF2122/97
gucgucguagcuggcgauc

SEQ ID NO: 3167498 - RNA, 22 nt, Mycobacterium bovis subsp bovis AF2122/97
gucgucgucccagggcugccgg

SEQ ID NO: 3167499 - RNA, 19 nt, Mycobacterium bovis subsp bovis AF2122/97
gucgucguugugugccagc

SEQ ID NO: 3167500 - RNA, 17 nt, Mycobacterium bovis subsp bovis AF2122/97
gucgucuugguugugga

SEQ ID NO: 3167501 - RNA, 15 nt, Mycobacterium bovis subsp bovis AF2122/97
gucgugaaaccacac

SEQ ID NO: 3167502 - RNA, 14 nt, Mycobacterium bovis subsp bovis AF2122/97
gucgugaccggcgg

SEQ ID NO: 3167503 - RNA, 22 nt, Mycobacterium bovis subsp bovis AF2122/97
gucgugagucacccggccguug

SEQ ID NO: 3167504 - RNA, 16 nt, Mycobacterium bovis subsp bovis AF2122/97
gucgugaucagcagga

SEQ ID NO: 3167505 - RNA, 15 nt, Mycobacterium bovis subsp bovis AF2122/97
gucgugaucgcguuu

SEQ ID NO: 3167506 - RNA, 14 nt, Mycobacterium bovis subsp bovis AF2122/97
gucgugaucggcga

SEQ ID NO: 3167507 - RNA, 14 nt, Mycobacterium bovis subsp bovis AF2122/97
gucgugaucggcgu

SEQ ID NO: 3167508 - RNA, 18 nt, Mycobacterium bovis subsp bovis AF2122/97
gucgugaucggcgucagg

SEQ ID NO: 3167509 - RNA, 14 nt, Mycobacterium bovis subsp bovis AF2122/97
gucgugcaccucgu

SEQ ID NO: 3167510 - RNA, 16 nt, Mycobacterium bovis subsp bovis AF2122/97
gucgugcacggcggcc

SEQ ID NO: 3167511 - RNA, 16 nt, Mycobacterium bovis subsp bovis AF2122/97
gucgugcaggcgacgg

SEQ ID NO: 3167512 - RNA, 19 nt, Mycobacterium bovis subsp bovis AF2122/97
gucgugccacuuccacggc

SEQ ID NO: 3167513 - RNA, 13 nt, Mycobacterium bovis subsp bovis AF2122/97
gucgugccccggc

SEQ ID NO: 3167514 - RNA, 16 nt, Mycobacterium bovis subsp bovis AF2122/97
gucgugccggggcugc

SEQ ID NO: 3167515 - RNA, 22 nt, Mycobacterium bovis subsp bovis AF2122/97
gucgugcgauucacacucgggc

SEQ ID NO: 3167516 - RNA, 20 nt, Mycobacterium bovis subsp bovis AF2122/97
gucgugcguugccgucgaga

SEQ ID NO: 3167517 - RNA, 14 nt, Mycobacterium bovis subsp bovis AF2122/97
gucgugcucucggc

SEQ ID NO: 3167518 - RNA, 16 nt, Mycobacterium bovis subsp bovis AF2122/97
gucgugcucucggcga

SEQ ID NO: 3167519 - RNA, 21 nt, Mycobacterium bovis subsp bovis AF2122/97
gucguggacuuuauggcuagu

SEQ ID NO: 3167520 - RNA, 17 nt, Mycobacterium bovis subsp bovis AF2122/97
gucguggcgcucggcga

SEQ ID NO: 3167521 - RNA, 18 nt, Mycobacterium bovis subsp bovis AF2122/97
gucguggcgcucggcgag

SEQ ID NO: 3167522 - RNA, 15 nt, Mycobacterium bovis subsp bovis AF2122/97
gucguggcgguggcc

SEQ ID NO: 3167523 - RNA, 19 nt, Mycobacterium bovis subsp bovis AF2122/97
gucguggcgguggccgucg

SEQ ID NO: 3167524 - RNA, 20 nt, Mycobacterium bovis subsp bovis AF2122/97
gucguggcgguggccgucgg

SEQ ID NO: 3167525 - RNA, 16 nt, Mycobacterium bovis subsp bovis AF2122/97
gucguggggaccggca

SEQ ID NO: 3167526 - RNA, 22 nt, Mycobacterium bovis subsp bovis AF2122/97
gucguggggaccggcaggccgg

SEQ ID NO: 3167527 - RNA, 16 nt, Mycobacterium bovis subsp bovis AF2122/97
gucguggucgugggug

SEQ ID NO: 3167528 - RNA, 21 nt, Mycobacterium bovis subsp bovis AF2122/97
gucguggugcaacacgccggc

SEQ ID NO: 3167529 - RNA, 15 nt, Mycobacterium bovis subsp bovis AF2122/97
gucgugguggccacg

SEQ ID NO: 3167530 - RNA, 14 nt, Mycobacterium bovis subsp bovis AF2122/97
gucguguaggaccu

SEQ ID NO: 3167531 - RNA, 13 nt, Mycobacterium bovis subsp bovis AF2122/97
gucgugucgccgc

SEQ ID NO: 3167532 - RNA, 16 nt, Mycobacterium bovis subsp bovis AF2122/97
gucguguucgcugacg

SEQ ID NO: 3167533 - RNA, 19 nt, Mycobacterium bovis subsp bovis AF2122/97
gucguuaagacggcgacga

SEQ ID NO: 3167534 - RNA, 21 nt, Mycobacterium bovis subsp bovis AF2122/97
gucguucgcgucacaccagcg

SEQ ID NO: 3167535 - RNA, 16 nt, Mycobacterium bovis subsp bovis AF2122/97
gucguugccagggcgg

SEQ ID NO: 3167536 - RNA, 22 nt, Mycobacterium bovis subsp bovis AF2122/97
gucguugccagggcgggcgucg

SEQ ID NO: 3167537 - RNA, 22 nt, Mycobacterium bovis subsp bovis AF2122/97
gucguugccgggucaaccggug

SEQ ID NO: 3167538 - RNA, 22 nt, Mycobacterium bovis subsp bovis AF2122/97
gucguugcgugcauaggccgcg

SEQ ID NO: 3167539 - RNA, 14 nt, Mycobacterium bovis subsp bovis AF2122/97
gucguuggacggca

SEQ ID NO: 3167540 - RNA, 14 nt, Mycobacterium bovis subsp bovis AF2122/97
gucugcucgccgag

SEQ ID NO: 3167541 - RNA, 15 nt, Mycobacterium bovis subsp bovis AF2122/97
gucugcucgccgagg

SEQ ID NO: 3167542 - RNA, 19 nt, Mycobacterium bovis subsp bovis AF2122/97
gucugcucgccgggcagcu

SEQ ID NO: 3167543 - RNA, 23 nt, Mycobacterium bovis subsp bovis AF2122/97
gucugcucgcgccggugaggcga

SEQ ID NO: 3167544 - RNA, 13 nt, Mycobacterium bovis subsp bovis AF2122/97
gucugcucggcgc

SEQ ID NO: 3167545 - RNA, 19 nt, Mycobacterium bovis subsp bovis AF2122/97
gucugcucggcgcgguggg

SEQ ID NO: 3167546 - RNA, 20 nt, Mycobacterium bovis subsp bovis AF2122/97
gucugcucggcggagaaaag

SEQ ID NO: 3167547 - RNA, 15 nt, Mycobacterium bovis subsp bovis AF2122/97
gucugcugaccggag

SEQ ID NO: 3167548 - RNA, 19 nt, Mycobacterium bovis subsp bovis AF2122/97
gucuggacaucggccggcg

SEQ ID NO: 3167549 - RNA, 16 nt, Mycobacterium bovis subsp bovis AF2122/97
gucuggacugcagccc

SEQ ID NO: 3167550 - RNA, 14 nt, Mycobacterium bovis subsp bovis AF2122/97
gucuggcaggccag

SEQ ID NO: 3167551 - RNA, 21 nt, Mycobacterium bovis subsp bovis AF2122/97
gucuggccccaggggaggcga

SEQ ID NO: 3167552 - RNA, 12 nt, Mycobacterium bovis subsp bovis AF2122/97
gucuggccgucg

SEQ ID NO: 3167553 - RNA, 17 nt, Mycobacterium bovis subsp bovis AF2122/97
gucuggcgaacagugac

SEQ ID NO: 3167554 - RNA, 15 nt, Mycobacterium bovis subsp bovis AF2122/97
gucuggcgaugacga

SEQ ID NO: 3167555 - RNA, 16 nt, Mycobacterium bovis subsp bovis AF2122/97
gucugggcaucaucga

SEQ ID NO: 3167556 - RNA, 19 nt, Mycobacterium bovis subsp bovis AF2122/97
gucugggcaucaucgacgc

SEQ ID NO: 3167557 - RNA, 13 nt, Mycobacterium bovis subsp bovis AF2122/97
gucugggcgaucg

SEQ ID NO: 3167558 - RNA, 22 nt, Mycobacterium bovis subsp bovis AF2122/97
gucugggucaggcgaaccuggu

SEQ ID NO: 3167559 - RNA, 18 nt, Mycobacterium bovis subsp bovis AF2122/97
gucugggugagcaccugg

SEQ ID NO: 3167560 - RNA, 14 nt, Mycobacterium bovis subsp bovis AF2122/97
gucugggugcaggu

SEQ ID NO: 3167561 - RNA, 17 nt, Mycobacterium bovis subsp bovis AF2122/97
gucugggugcagguucu

SEQ ID NO: 3167562 - RNA, 16 nt, Mycobacterium bovis subsp bovis AF2122/97
gucuggucauggccga

SEQ ID NO: 3167563 - RNA, 23 nt, Mycobacterium bovis subsp bovis AF2122/97
gucuggucggcuacggccagugc

SEQ ID NO: 3167564 - RNA, 15 nt, Mycobacterium bovis subsp bovis AF2122/97
gucugguggcagcgc

SEQ ID NO: 3167565 - RNA, 22 nt, Mycobacterium bovis subsp bovis AF2122/97
gucugguggucggcgacgucgc

SEQ ID NO: 3167566 - RNA, 19 nt, Mycobacterium bovis subsp bovis AF2122/97
gucuguacaacgacacgcc

SEQ ID NO: 3167567 - RNA, 21 nt, Mycobacterium bovis subsp bovis AF2122/97
gucuguacaacgacacgccgc

SEQ ID NO: 3167568 - RNA, 17 nt, Mycobacterium bovis subsp bovis AF2122/97
gucugucuggccccagg

SEQ ID NO: 3167569 - RNA, 13 nt, Mycobacterium bovis subsp bovis AF2122/97
gucugugcucacg

SEQ ID NO: 3167570 - RNA, 16 nt, Mycobacterium bovis subsp bovis AF2122/97
gucuguucgccgacgc

SEQ ID NO: 3167571 - RNA, 17 nt, Mycobacterium bovis subsp bovis AF2122/97
gucuguucgccgacgcg

SEQ ID NO: 3167572 - RNA, 16 nt, Mycobacterium bovis subsp bovis AF2122/97
gucuuaucggcgucgu

SEQ ID NO: 3167573 - RNA, 16 nt, Mycobacterium bovis subsp bovis AF2122/97
gucuuccggugcgccg

SEQ ID NO: 3167574 - RNA, 21 nt, Mycobacterium bovis subsp bovis AF2122/97
gucuuccucggccacccgcag

SEQ ID NO: 3167575 - RNA, 21 nt, Mycobacterium bovis subsp bovis AF2122/97
gucuucgauaccgaccgaaag

SEQ ID NO: 3167576 - RNA, 23 nt, Mycobacterium bovis subsp bovis AF2122/97
gucuucgccgccaccggcgacgc

SEQ ID NO: 3167577 - RNA, 13 nt, Mycobacterium bovis subsp bovis AF2122/97
gucuucggcgaca

SEQ ID NO: 3167578 - RNA, 19 nt, Mycobacterium bovis subsp bovis AF2122/97
gucuucgggcucguccagc

SEQ ID NO: 3167579 - RNA, 15 nt, Mycobacterium bovis subsp bovis AF2122/97
gucuucggucgcggc

SEQ ID NO: 3167580 - RNA, 19 nt, Mycobacterium bovis subsp bovis AF2122/97
gucuucgucggagucuucg

SEQ ID NO: 3167581 - RNA, 18 nt, Mycobacterium bovis subsp bovis AF2122/97
gucuugacggcgccaggc

SEQ ID NO: 3167582 - RNA, 18 nt, Mycobacterium bovis subsp bovis AF2122/97
gucuugcaguaacuucac

SEQ ID NO: 3167583 - RNA, 16 nt, Mycobacterium bovis subsp bovis AF2122/97
gucuugccgcaggccu

SEQ ID NO: 3167584 - RNA, 17 nt, Mycobacterium bovis subsp bovis AF2122/97
gucuuggacagcagcag

SEQ ID NO: 3167585 - RNA, 16 nt, Mycobacterium bovis subsp bovis AF2122/97
gucuuggaucacgcga

SEQ ID NO: 3167586 - RNA, 21 nt, Mycobacterium bovis subsp bovis AF2122/97
gucuuggauccggccgccaac

SEQ ID NO: 3167587 - RNA, 14 nt, Mycobacterium bovis subsp bovis AF2122/97
gucuuggcccggcg

SEQ ID NO: 3167588 - RNA, 16 nt, Mycobacterium bovis subsp bovis AF2122/97
gucuuggcccggcggu

SEQ ID NO: 3167589 - RNA, 13 nt, Mycobacterium bovis subsp bovis AF2122/97
gucuuggcggcgg

SEQ ID NO: 3167590 - RNA, 18 nt, Mycobacterium bovis subsp bovis AF2122/97
gucuuggcggcggugcag

SEQ ID NO: 3167591 - RNA, 12 nt, Mycobacterium bovis subsp bovis AF2122/97
gucuugggcgcg

SEQ ID NO: 3167592 - RNA, 16 nt, Mycobacterium bovis subsp bovis AF2122/97
gucuugguuguggagg

SEQ ID NO: 3167593 - RNA, 15 nt, Mycobacterium bovis subsp bovis AF2122/97
gucuugucgccgagu

SEQ ID NO: 3167594 - RNA, 21 nt, Mycobacterium bovis subsp bovis AF2122/97
gucuuucacguagcgaccgcg

SEQ ID NO: 3167595 - RNA, 14 nt, Mycobacterium bovis subsp bovis AF2122/97
gugaaaaucgccau

SEQ ID NO: 3167596 - RNA, 15 nt, Mycobacterium bovis subsp bovis AF2122/97
gugaaaccggccuuc

SEQ ID NO: 3167597 - RNA, 16 nt, Mycobacterium bovis subsp bovis AF2122/97
gugaaaccggccuucu

SEQ ID NO: 3167598 - RNA, 19 nt, Mycobacterium bovis subsp bovis AF2122/97
gugaaagacaacccgcucg

SEQ ID NO: 3167599 - RNA, 20 nt, Mycobacterium bovis subsp bovis AF2122/97
gugaaagacaacccgcucgg

SEQ ID NO: 3167600 - RNA, 12 nt, Mycobacterium bovis subsp bovis AF2122/97
gugaaaguucau

SEQ ID NO: 3167601 - RNA, 14 nt, Mycobacterium bovis subsp bovis AF2122/97
gugaaaugccgaga

SEQ ID NO: 3167602 - RNA, 15 nt, Mycobacterium bovis subsp bovis AF2122/97
gugaaauugccgccg

SEQ ID NO: 3167603 - RNA, 16 nt, Mycobacterium bovis subsp bovis AF2122/97
gugaaauugccgccgc

SEQ ID NO: 3167604 - RNA, 19 nt, Mycobacterium bovis subsp bovis AF2122/97
gugaacaaaugccggugca

SEQ ID NO: 3167605 - RNA, 12 nt, Mycobacterium bovis subsp bovis AF2122/97
gugaacaacuca

SEQ ID NO: 3167606 - RNA, 12 nt, Mycobacterium bovis subsp bovis AF2122/97
gugaacaccccu

SEQ ID NO: 3167607 - RNA, 22 nt, Mycobacterium bovis subsp bovis AF2122/97
gugaacagcagguuggcgagcu

SEQ ID NO: 3167608 - RNA, 20 nt, Mycobacterium bovis subsp bovis AF2122/97
gugaacaggccgaggcgagu

SEQ ID NO: 3167609 - RNA, 13 nt, Mycobacterium bovis subsp bovis AF2122/97
gugaacccgccgg

SEQ ID NO: 3167610 - RNA, 19 nt, Mycobacterium bovis subsp bovis AF2122/97
gugaaccgcgcggcgaucg

SEQ ID NO: 3167611 - RNA, 17 nt, Mycobacterium bovis subsp bovis AF2122/97
gugaaccgggcaccacu

SEQ ID NO: 3167612 - RNA, 19 nt, Mycobacterium bovis subsp bovis AF2122/97
gugaaccuggcgacgcgac

SEQ ID NO: 3167613 - RNA, 23 nt, Mycobacterium bovis subsp bovis AF2122/97
gugaacgacaugggcaggccgcg

SEQ ID NO: 3167614 - RNA, 15 nt, Mycobacterium bovis subsp bovis AF2122/97
gugaacgccggugcg

SEQ ID NO: 3167615 - RNA, 20 nt, Mycobacterium bovis subsp bovis AF2122/97
gugaacgcgcgugcagccau

SEQ ID NO: 3167616 - RNA, 19 nt, Mycobacterium bovis subsp bovis AF2122/97
gugaacgcggacaccgcgg

SEQ ID NO: 3167617 - RNA, 20 nt, Mycobacterium bovis subsp bovis AF2122/97
gugaacgcggacaccgcggc

SEQ ID NO: 3167618 - RNA, 22 nt, Mycobacterium bovis subsp bovis AF2122/97
gugaacgcgucguugucgucgc

SEQ ID NO: 3167619 - RNA, 15 nt, Mycobacterium bovis subsp bovis AF2122/97
gugaacggcagcacg

SEQ ID NO: 3167620 - RNA, 20 nt, Mycobacterium bovis subsp bovis AF2122/97
gugaacggcgcgggccacca

SEQ ID NO: 3167621 - RNA, 22 nt, Mycobacterium bovis subsp bovis AF2122/97
gugaacggcgcgggccaccacg

SEQ ID NO: 3167622 - RNA, 12 nt, Mycobacterium bovis subsp bovis AF2122/97
gugaacggugcc

SEQ ID NO: 3167623 - RNA, 23 nt, Mycobacterium bovis subsp bovis AF2122/97
gugaacggugccucgcagccaac

SEQ ID NO: 3167624 - RNA, 18 nt, Mycobacterium bovis subsp bovis AF2122/97
gugaacguuuccagcuga

SEQ ID NO: 3167625 - RNA, 19 nt, Mycobacterium bovis subsp bovis AF2122/97
gugaacugcuggccgaugu

SEQ ID NO: 3167626 - RNA, 18 nt, Mycobacterium bovis subsp bovis AF2122/97
gugaacuucuccaccagc

SEQ ID NO: 3167627 - RNA, 23 nt, Mycobacterium bovis subsp bovis AF2122/97
gugacgaucaggucgccgagacc

SEQ ID NO: 3167628 - RNA, 16 nt, Mycobacterium bovis subsp bovis AF2122/97
gugacgaucgacagcc

SEQ ID NO: 3167629 - RNA, 17 nt, Mycobacterium bovis subsp bovis AF2122/97
gugacgaugaccgcgcg

SEQ ID NO: 3167630 - RNA, 13 nt, Mycobacterium bovis subsp bovis AF2122/97
gugacgauugcca

SEQ ID NO: 3167631 - RNA, 13 nt, Mycobacterium bovis subsp bovis AF2122/97
gugacgcacagca

SEQ ID NO: 3167632 - RNA, 14 nt, Mycobacterium bovis subsp bovis AF2122/97
gugacgcacagcag

SEQ ID NO: 3167633 - RNA, 16 nt, Mycobacterium bovis subsp bovis AF2122/97
gugacgcacagcagca

SEQ ID NO: 3167634 - RNA, 18 nt, Mycobacterium bovis subsp bovis AF2122/97
gugacgcccgcuccgcgg

SEQ ID NO: 3167635 - RNA, 12 nt, Mycobacterium bovis subsp bovis AF2122/97
gugacgccgcca

SEQ ID NO: 3167636 - RNA, 13 nt, Mycobacterium bovis subsp bovis AF2122/97
gugacgccgccag

SEQ ID NO: 3167637 - RNA, 16 nt, Mycobacterium bovis subsp bovis AF2122/97
gugacgccgccagcac

SEQ ID NO: 3167638 - RNA, 23 nt, Mycobacterium bovis subsp bovis AF2122/97
gugacgcgccguaacagccggcc

SEQ ID NO: 3167639 - RNA, 18 nt, Mycobacterium bovis subsp bovis AF2122/97
gugacggccggcggucgg

SEQ ID NO: 3167640 - RNA, 14 nt, Mycobacterium bovis subsp bovis AF2122/97
gugacggcggcugu

SEQ ID NO: 3167641 - RNA, 22 nt, Mycobacterium bovis subsp bovis AF2122/97
gugacggggcugaccgccaccc

SEQ ID NO: 3167642 - RNA, 19 nt, Mycobacterium bovis subsp bovis AF2122/97
gugacgggguugaccgcca

SEQ ID NO: 3167643 - RNA, 22 nt, Mycobacterium bovis subsp bovis AF2122/97
gugacgggguugaccgccaccc

SEQ ID NO: 3167644 - RNA, 19 nt, Mycobacterium bovis subsp bovis AF2122/97
gugacggugaauucacgau

SEQ ID NO: 3167645 - RNA, 18 nt, Mycobacterium bovis subsp bovis AF2122/97
gugacgguggccggcaac

SEQ ID NO: 3167646 - RNA, 15 nt, Mycobacterium bovis subsp bovis AF2122/97
gugacgguguuggug

SEQ ID NO: 3167647 - RNA, 18 nt, Mycobacterium bovis subsp bovis AF2122/97
gugacgguguuggugacc

SEQ ID NO: 3167648 - RNA, 23 nt, Mycobacterium bovis subsp bovis AF2122/97
gugacguagaccacgccggugac

SEQ ID NO: 3167649 - RNA, 12 nt, Mycobacterium bovis subsp bovis AF2122/97
gugacguagaug

SEQ ID NO: 3167650 - RNA, 19 nt, Mycobacterium bovis subsp bovis AF2122/97
gugacguagggcagcgcca

SEQ ID NO: 3167651 - RNA, 21 nt, Mycobacterium bovis subsp bovis AF2122/97
gugacguagggcagcgccagg

SEQ ID NO: 3167652 - RNA, 13 nt, Mycobacterium bovis subsp bovis AF2122/97
gugacgugguggg

SEQ ID NO: 3167653 - RNA, 17 nt, Mycobacterium bovis subsp bovis AF2122/97
gugacguggugggcuug

SEQ ID NO: 3167654 - RNA, 20 nt, Mycobacterium bovis subsp bovis AF2122/97
gugacucggccuccgccgag

SEQ ID NO: 3167655 - RNA, 19 nt, Mycobacterium bovis subsp bovis AF2122/97
gugacuuggagugcgggug

SEQ ID NO: 3167656 - RNA, 21 nt, Mycobacterium bovis subsp bovis AF2122/97
gugacuuggagugcggguggu

SEQ ID NO: 3167657 - RNA, 18 nt, Mycobacterium bovis subsp bovis AF2122/97
gugacuuugacccguucc

SEQ ID NO: 3167658 - RNA, 22 nt, Mycobacterium bovis subsp bovis AF2122/97
gugagaauagugaaagugguug

SEQ ID NO: 3167659 - RNA, 22 nt, Mycobacterium bovis subsp bovis AF2122/97
gugagaccagguucucggucgg

SEQ ID NO: 3167660 - RNA, 23 nt, Mycobacterium bovis subsp bovis AF2122/97
gugagacgaaaagccgcgucgcg

SEQ ID NO: 3167661 - RNA, 23 nt, Mycobacterium bovis subsp bovis AF2122/97
gugagauaccgacgcgcucggcg

SEQ ID NO: 3167662 - RNA, 21 nt, Mycobacterium bovis subsp bovis AF2122/97
gugagaucguagggacgccga

SEQ ID NO: 3167663 - RNA, 15 nt, Mycobacterium bovis subsp bovis AF2122/97
gugagauggcgguga

SEQ ID NO: 3167664 - RNA, 17 nt, Mycobacterium bovis subsp bovis AF2122/97
gugagauggcggugagc

SEQ ID NO: 3167665 - RNA, 17 nt, Mycobacterium bovis subsp bovis AF2122/97
gugagauugguggcccg

SEQ ID NO: 3167666 - RNA, 20 nt, Mycobacterium bovis subsp bovis AF2122/97
gugagcacaccgacagcacc

SEQ ID NO: 3167667 - RNA, 15 nt, Mycobacterium bovis subsp bovis AF2122/97
gugagcaccagcagc

SEQ ID NO: 3167668 - RNA, 16 nt, Mycobacterium bovis subsp bovis AF2122/97
gugagcaccagcagca

SEQ ID NO: 3167669 - RNA, 19 nt, Mycobacterium bovis subsp bovis AF2122/97
gugagcaccagcagcacca

SEQ ID NO: 3167670 - RNA, 20 nt, Mycobacterium bovis subsp bovis AF2122/97
gugagcaccggauacagcca

SEQ ID NO: 3167671 - RNA, 12 nt, Mycobacterium bovis subsp bovis AF2122/97
gugagcaccugg

SEQ ID NO: 3167672 - RNA, 22 nt, Mycobacterium bovis subsp bovis AF2122/97
gugagcagcgggacauccagug

SEQ ID NO: 3167673 - RNA, 22 nt, Mycobacterium bovis subsp bovis AF2122/97
gugagcagcucggugacaagcg

SEQ ID NO: 3167674 - RNA, 14 nt, Mycobacterium bovis subsp bovis AF2122/97
gugagcaugcgacg

SEQ ID NO: 3167675 - RNA, 17 nt, Mycobacterium bovis subsp bovis AF2122/97
gugagcauggcuagggc

SEQ ID NO: 3167676 - RNA, 16 nt, Mycobacterium bovis subsp bovis AF2122/97
gugagccaugccgcuc

SEQ ID NO: 3167677 - RNA, 20 nt, Mycobacterium bovis subsp bovis AF2122/97
gugagccccagcgacgucgc

SEQ ID NO: 3167678 - RNA, 18 nt, Mycobacterium bovis subsp bovis AF2122/97
gugagcccgggauaccgc

SEQ ID NO: 3167679 - RNA, 15 nt, Mycobacterium bovis subsp bovis AF2122/97
gugagcccguugacc

SEQ ID NO: 3167680 - RNA, 19 nt, Mycobacterium bovis subsp bovis AF2122/97
gugagcccguugaccugcg

SEQ ID NO: 3167681 - RNA, 16 nt, Mycobacterium bovis subsp bovis AF2122/97
gugagccgguggcccg

SEQ ID NO: 3167682 - RNA, 17 nt, Mycobacterium bovis subsp bovis AF2122/97
gugagccgguggcccgc

SEQ ID NO: 3167683 - RNA, 20 nt, Mycobacterium bovis subsp bovis AF2122/97
gugagccgguggcccgccgg

SEQ ID NO: 3167684 - RNA, 18 nt, Mycobacterium bovis subsp bovis AF2122/97
gugagccgugccgccagc

SEQ ID NO: 3167685 - RNA, 13 nt, Mycobacterium bovis subsp bovis AF2122/97
gugagccuuucgu

SEQ ID NO: 3167686 - RNA, 21 nt, Mycobacterium bovis subsp bovis AF2122/97
gugagccuuucgugcaccgcg

SEQ ID NO: 3167687 - RNA, 13 nt, Mycobacterium bovis subsp bovis AF2122/97
gugagcgccgcgg

SEQ ID NO: 3167688 - RNA, 14 nt, Mycobacterium bovis subsp bovis AF2122/97
gugagcgccgcggc

SEQ ID NO: 3167689 - RNA, 15 nt, Mycobacterium bovis subsp bovis AF2122/97
gugagcgccgcggcg

SEQ ID NO: 3167690 - RNA, 20 nt, Mycobacterium bovis subsp bovis AF2122/97
gugagcgcgcucaggucauc

SEQ ID NO: 3167691 - RNA, 12 nt, Mycobacterium bovis subsp bovis AF2122/97
gugagcgcgucg

SEQ ID NO: 3167692 - RNA, 15 nt, Mycobacterium bovis subsp bovis AF2122/97
gugagcucggcugcu

SEQ ID NO: 3167693 - RNA, 14 nt, Mycobacterium bovis subsp bovis AF2122/97
gugagcuuagcgca

SEQ ID NO: 3167694 - RNA, 18 nt, Mycobacterium bovis subsp bovis AF2122/97
gugaggaaccccggucgg

SEQ ID NO: 3167695 - RNA, 17 nt, Mycobacterium bovis subsp bovis AF2122/97
gugaggcccgaguuuga

SEQ ID NO: 3167696 - RNA, 16 nt, Mycobacterium bovis subsp bovis AF2122/97
gugaggccgaccagca

SEQ ID NO: 3167697 - RNA, 17 nt, Mycobacterium bovis subsp bovis AF2122/97
gugaggccgaccagcac

SEQ ID NO: 3167698 - RNA, 16 nt, Mycobacterium bovis subsp bovis AF2122/97
gugaggccuucgccga

SEQ ID NO: 3167699 - RNA, 14 nt, Mycobacterium bovis subsp bovis AF2122/97
gugaggcgaccgga

SEQ ID NO: 3167700 - RNA, 19 nt, Mycobacterium bovis subsp bovis AF2122/97
gugaggcguugaacugugc

SEQ ID NO: 3167701 - RNA, 14 nt, Mycobacterium bovis subsp bovis AF2122/97
gugagggccgggug

SEQ ID NO: 3167702 - RNA, 21 nt, Mycobacterium bovis subsp bovis AF2122/97
gugaggucauagccguugcgg

SEQ ID NO: 3167703 - RNA, 14 nt, Mycobacterium bovis subsp bovis AF2122/97
gugagguggucagc

SEQ ID NO: 3167704 - RNA, 20 nt, Mycobacterium bovis subsp bovis AF2122/97
gugaguaccaauccaggcca

SEQ ID NO: 3167705 - RNA, 22 nt, Mycobacterium bovis subsp bovis AF2122/97
gugaguacggugugcgugcggu

SEQ ID NO: 3167706 - RNA, 17 nt, Mycobacterium bovis subsp bovis AF2122/97
gugaguccagccggcgc

SEQ ID NO: 3167707 - RNA, 14 nt, Mycobacterium bovis subsp bovis AF2122/97
gugagucccacgcc

SEQ ID NO: 3167708 - RNA, 18 nt, Mycobacterium bovis subsp bovis AF2122/97
gugagucccacgccagcg

SEQ ID NO: 3167709 - RNA, 13 nt, Mycobacterium bovis subsp bovis AF2122/97
gugagugaccacg

SEQ ID NO: 3167710 - RNA, 12 nt, Mycobacterium bovis subsp bovis AF2122/97
gugaguucggcg

SEQ ID NO: 3167711 - RNA, 23 nt, Mycobacterium bovis subsp bovis AF2122/97
gugauacagcgccaggggugugc

SEQ ID NO: 3167712 - RNA, 17 nt, Mycobacterium bovis subsp bovis AF2122/97
gugauacagcucggugc

SEQ ID NO: 3167713 - RNA, 20 nt, Mycobacterium bovis subsp bovis AF2122/97
gugauagcgcgugugcgucg

SEQ ID NO: 3167714 - RNA, 19 nt, Mycobacterium bovis subsp bovis AF2122/97
gugcacccgguugugcgcg

SEQ ID NO: 3167715 - RNA, 19 nt, Mycobacterium bovis subsp bovis AF2122/97
gugcaccgaagauggccag

SEQ ID NO: 3167716 - RNA, 12 nt, Mycobacterium bovis subsp bovis AF2122/97
gugcaccgcgac

SEQ ID NO: 3167717 - RNA, 20 nt, Mycobacterium bovis subsp bovis AF2122/97
gugcaccgcgaccgcgcacg

SEQ ID NO: 3167718 - RNA, 20 nt, Mycobacterium bovis subsp bovis AF2122/97
gugcacgacgacaucgagcc

SEQ ID NO: 3167719 - RNA, 21 nt, Mycobacterium bovis subsp bovis AF2122/97
gugcacgacgacaucgagcca

SEQ ID NO: 3167720 - RNA, 18 nt, Mycobacterium bovis subsp bovis AF2122/97
gugcacgagcggacaggg

SEQ ID NO: 3167721 - RNA, 16 nt, Mycobacterium bovis subsp bovis AF2122/97
gugcacgaucgcggug

SEQ ID NO: 3167722 - RNA, 12 nt, Mycobacterium bovis subsp bovis AF2122/97
gugcacggcggc

SEQ ID NO: 3167723 - RNA, 19 nt, Mycobacterium bovis subsp bovis AF2122/97
gugcacggcuucggcgagc

SEQ ID NO: 3167724 - RNA, 19 nt, Mycobacterium bovis subsp bovis AF2122/97
gugcacggcuuuucgacgc

SEQ ID NO: 3167725 - RNA, 13 nt, Mycobacterium bovis subsp bovis AF2122/97
gugcacugccggg

SEQ ID NO: 3167726 - RNA, 16 nt, Mycobacterium bovis subsp bovis AF2122/97
gugcagaaaccaggac

SEQ ID NO: 3167727 - RNA, 22 nt, Mycobacterium bovis subsp bovis AF2122/97
gugcagaagacaagugguggua

SEQ ID NO: 3167728 - RNA, 13 nt, Mycobacterium bovis subsp bovis AF2122/97
gugcagacaggcg

SEQ ID NO: 3167729 - RNA, 15 nt, Mycobacterium bovis subsp bovis AF2122/97
gugcagacaggcggc

SEQ ID NO: 3167730 - RNA, 17 nt, Mycobacterium bovis subsp bovis AF2122/97
gugcagacaggcggcgg

SEQ ID NO: 3167731 - RNA, 22 nt, Mycobacterium bovis subsp bovis AF2122/97
gugcagacaggcggcggccugg

SEQ ID NO: 3167732 - RNA, 14 nt, Mycobacterium bovis subsp bovis AF2122/97
gugcagaccaccgc

SEQ ID NO: 3167733 - RNA, 17 nt, Mycobacterium bovis subsp bovis AF2122/97
gugcagaccaucuugcc

SEQ ID NO: 3167734 - RNA, 21 nt, Mycobacterium bovis subsp bovis AF2122/97
gugcagagccaacucccgcgg

SEQ ID NO: 3167735 - RNA, 20 nt, Mycobacterium bovis subsp bovis AF2122/97
gugcagaucgucgccgauca

SEQ ID NO: 3167736 - RNA, 22 nt, Mycobacterium bovis subsp bovis AF2122/97
gugcagcaacaucuugccgucg

SEQ ID NO: 3167737 - RNA, 17 nt, Mycobacterium bovis subsp bovis AF2122/97
gugcagcaccagccacg

SEQ ID NO: 3167738 - RNA, 14 nt, Mycobacterium bovis subsp bovis AF2122/97
gugcagcacggcgc

SEQ ID NO: 3167739 - RNA, 17 nt, Mycobacterium bovis subsp bovis AF2122/97
gugcagcacguccgcgg

SEQ ID NO: 3167740 - RNA, 18 nt, Mycobacterium bovis subsp bovis AF2122/97
gugcagcacgugugcggg

SEQ ID NO: 3167741 - RNA, 21 nt, Mycobacterium bovis subsp bovis AF2122/97
gugcagcacuuccaagccgac

SEQ ID NO: 3167742 - RNA, 14 nt, Mycobacterium bovis subsp bovis AF2122/97
gugcagcagcgcgc

SEQ ID NO: 3167743 - RNA, 18 nt, Mycobacterium bovis subsp bovis AF2122/97
gugcagccaaaucagaug

SEQ ID NO: 3167744 - RNA, 17 nt, Mycobacterium bovis subsp bovis AF2122/97
gugcagcccgccgcuga

SEQ ID NO: 3167745 - RNA, 23 nt, Mycobacterium bovis subsp bovis AF2122/97
gugcagccgcaggugggcguugg

SEQ ID NO: 3167746 - RNA, 21 nt, Mycobacterium bovis subsp bovis AF2122/97
gugcagcgacuccguaccggg

SEQ ID NO: 3167747 - RNA, 13 nt, Mycobacterium bovis subsp bovis AF2122/97
gugcagcgcagga

SEQ ID NO: 3167748 - RNA, 17 nt, Mycobacterium bovis subsp bovis AF2122/97
gugcagcggcgccgcca

SEQ ID NO: 3167749 - RNA, 14 nt, Mycobacterium bovis subsp bovis AF2122/97
gugcagcgugcagc

SEQ ID NO: 3167750 - RNA, 21 nt, Mycobacterium bovis subsp bovis AF2122/97
gugcagcugcaaugacuggac

SEQ ID NO: 3167751 - RNA, 14 nt, Mycobacterium bovis subsp bovis AF2122/97
gugcaggaccagaa

SEQ ID NO: 3167752 - RNA, 15 nt, Mycobacterium bovis subsp bovis AF2122/97
gugcaggaccagcac

SEQ ID NO: 3167753 - RNA, 16 nt, Mycobacterium bovis subsp bovis AF2122/97
gugcaggaucacgccg

SEQ ID NO: 3167754 - RNA, 15 nt, Mycobacterium bovis subsp bovis AF2122/97
gugcaggaucggcuu

SEQ ID NO: 3167755 - RNA, 19 nt, Mycobacterium bovis subsp bovis AF2122/97
gugcaggauucggcggucg

SEQ ID NO: 3167756 - RNA, 19 nt, Mycobacterium bovis subsp bovis AF2122/97
gugcaggccgcggagaagg

SEQ ID NO: 3167757 - RNA, 15 nt, Mycobacterium bovis subsp bovis AF2122/97
gugcaggcgacggcu

SEQ ID NO: 3167758 - RNA, 22 nt, Mycobacterium bovis subsp bovis AF2122/97
gugcaggcgaguuaggccgcca

SEQ ID NO: 3167759 - RNA, 15 nt, Mycobacterium bovis subsp bovis AF2122/97
gugcaggcugucaau

SEQ ID NO: 3167760 - RNA, 22 nt, Mycobacterium bovis subsp bovis AF2122/97
gugcagggacccggcgccgucg

SEQ ID NO: 3167761 - RNA, 23 nt, Mycobacterium bovis subsp bovis AF2122/97
gugcagggacccggcgccgucga

SEQ ID NO: 3167762 - RNA, 15 nt, Mycobacterium bovis subsp bovis AF2122/97
gugcaggucguccau

SEQ ID NO: 3167763 - RNA, 17 nt, Mycobacterium bovis subsp bovis AF2122/97
gugcaggucguccaucg

SEQ ID NO: 3167764 - RNA, 15 nt, Mycobacterium bovis subsp bovis AF2122/97
gugcaggucgugcuc

SEQ ID NO: 3167765 - RNA, 16 nt, Mycobacterium bovis subsp bovis AF2122/97
gugcaggugaugcaug

SEQ ID NO: 3167766 - RNA, 13 nt, Mycobacterium bovis subsp bovis AF2122/97
gugcaggugcggg

SEQ ID NO: 3167767 - RNA, 19 nt, Mycobacterium bovis subsp bovis AF2122/97
gugcagguggccgucgccg

SEQ ID NO: 3167768 - RNA, 18 nt, Mycobacterium bovis subsp bovis AF2122/97
gugcagguuggccugcuu

SEQ ID NO: 3167769 - RNA, 17 nt, Mycobacterium bovis subsp bovis AF2122/97
gugcagugccucggcgg

SEQ ID NO: 3167770 - RNA, 22 nt, Mycobacterium bovis subsp bovis AF2122/97
gugcaguggcuacgcgaucagc

SEQ ID NO: 3167771 - RNA, 15 nt, Mycobacterium bovis subsp bovis AF2122/97
gugcaguuccgcggg

SEQ ID NO: 3167772 - RNA, 17 nt, Mycobacterium bovis subsp bovis AF2122/97
gugcauaagcccgcgag

SEQ ID NO: 3167773 - RNA, 21 nt, Mycobacterium bovis subsp bovis AF2122/97
gugcauaucaaccccggugca

SEQ ID NO: 3167774 - RNA, 18 nt, Mycobacterium bovis subsp bovis AF2122/97
gugcaucgacucacggau

SEQ ID NO: 3167775 - RNA, 18 nt, Mycobacterium bovis subsp bovis AF2122/97
gugcaucgaucaccgcuu

SEQ ID NO: 3167776 - RNA, 16 nt, Mycobacterium bovis subsp bovis AF2122/97
gugcaucgccaccacc

SEQ ID NO: 3167777 - RNA, 21 nt, Mycobacterium bovis subsp bovis AF2122/97
gugcaucgccaccaccggaac

SEQ ID NO: 3167778 - RNA, 16 nt, Mycobacterium bovis subsp bovis AF2122/97
gugcaucgccggcacg

SEQ ID NO: 3167779 - RNA, 18 nt, Mycobacterium bovis subsp bovis AF2122/97
gugcaucgccugcgccuu

SEQ ID NO: 3167780 - RNA, 14 nt, Mycobacterium bovis subsp bovis AF2122/97
gugcaucggcgacc

SEQ ID NO: 3167781 - RNA, 15 nt, Mycobacterium bovis subsp bovis AF2122/97
gugcaugcaugccgg

SEQ ID NO: 3167782 - RNA, 21 nt, Mycobacterium bovis subsp bovis AF2122/97
gugccaaagcggcaugcagau

SEQ ID NO: 3167783 - RNA, 20 nt, Mycobacterium bovis subsp bovis AF2122/97
gugccaaaggacgacaccgc

SEQ ID NO: 3167784 - RNA, 22 nt, Mycobacterium bovis subsp bovis AF2122/97
gugccaaaggacgacaccgcga

SEQ ID NO: 3167785 - RNA, 17 nt, Mycobacterium bovis subsp bovis AF2122/97
gugccaacugcgccguu

SEQ ID NO: 3167786 - RNA, 17 nt, Mycobacterium bovis subsp bovis AF2122/97
gugccaauuccagcccc

SEQ ID NO: 3167787 - RNA, 18 nt, Mycobacterium bovis subsp bovis AF2122/97
gugccaauuccagccccc

SEQ ID NO: 3167788 - RNA, 19 nt, Mycobacterium bovis subsp bovis AF2122/97
gugccaauuccagcccccc

SEQ ID NO: 3167789 - RNA, 23 nt, Mycobacterium bovis subsp bovis AF2122/97
gugccaauuccagccccccggcg

SEQ ID NO: 3167790 - RNA, 16 nt, Mycobacterium bovis subsp bovis AF2122/97
gugccacagcucgccg

SEQ ID NO: 3167791 - RNA, 19 nt, Mycobacterium bovis subsp bovis AF2122/97
gugccacagcucgccguga

SEQ ID NO: 3167792 - RNA, 19 nt, Mycobacterium bovis subsp bovis AF2122/97
gugccacccuugccgccgg

SEQ ID NO: 3167793 - RNA, 20 nt, Mycobacterium bovis subsp bovis AF2122/97
gugccacccuugccgccggu

SEQ ID NO: 3167794 - RNA, 22 nt, Mycobacterium bovis subsp bovis AF2122/97
gugccaccgcuggaucgacuuc

SEQ ID NO: 3167795 - RNA, 13 nt, Mycobacterium bovis subsp bovis AF2122/97
gugccaccguugg

SEQ ID NO: 3167796 - RNA, 17 nt, Mycobacterium bovis subsp bovis AF2122/97
gugccaccugggcgggc

SEQ ID NO: 3167797 - RNA, 15 nt, Mycobacterium bovis subsp bovis AF2122/97
gugccacgccugagc

SEQ ID NO: 3167798 - RNA, 15 nt, Mycobacterium bovis subsp bovis AF2122/97
gugccacggugaccc

SEQ ID NO: 3167799 - RNA, 17 nt, Mycobacterium bovis subsp bovis AF2122/97
gugccacguucgcgggc

SEQ ID NO: 3167800 - RNA, 14 nt, Mycobacterium bovis subsp bovis AF2122/97
gugccgcagcggcg

SEQ ID NO: 3167801 - RNA, 16 nt, Mycobacterium bovis subsp bovis AF2122/97
gugccgcagcggcggc

SEQ ID NO: 3167802 - RNA, 15 nt, Mycobacterium bovis subsp bovis AF2122/97
gugccgcaucacccg

SEQ ID NO: 3167803 - RNA, 12 nt, Mycobacterium bovis subsp bovis AF2122/97
gugccgccacca

SEQ ID NO: 3167804 - RNA, 15 nt, Mycobacterium bovis subsp bovis AF2122/97
gugccgccaccaccg

SEQ ID NO: 3167805 - RNA, 18 nt, Mycobacterium bovis subsp bovis AF2122/97
gugccgccaccaccggcg

SEQ ID NO: 3167806 - RNA, 20 nt, Mycobacterium bovis subsp bovis AF2122/97
gugccgccaccaccggcgcc

SEQ ID NO: 3167807 - RNA, 12 nt, Mycobacterium bovis subsp bovis AF2122/97
gugccgccaccg

SEQ ID NO: 3167808 - RNA, 14 nt, Mycobacterium bovis subsp bovis AF2122/97
gugccgccaccggc

SEQ ID NO: 3167809 - RNA, 13 nt, Mycobacterium bovis subsp bovis AF2122/97
gugccgccagcaa

SEQ ID NO: 3167810 - RNA, 14 nt, Mycobacterium bovis subsp bovis AF2122/97
gugccgccagcaac

SEQ ID NO: 3167811 - RNA, 15 nt, Mycobacterium bovis subsp bovis AF2122/97
gugccgccaucgccg

SEQ ID NO: 3167812 - RNA, 17 nt, Mycobacterium bovis subsp bovis AF2122/97
gugccgccaucgccgcc

SEQ ID NO: 3167813 - RNA, 18 nt, Mycobacterium bovis subsp bovis AF2122/97
gugccgccaucgccgccg

SEQ ID NO: 3167814 - RNA, 19 nt, Mycobacterium bovis subsp bovis AF2122/97
gugccgccaucgccgccgg

SEQ ID NO: 3167815 - RNA, 20 nt, Mycobacterium bovis subsp bovis AF2122/97
gugccgccaucgccgccggu

SEQ ID NO: 3167816 - RNA, 22 nt, Mycobacterium bovis subsp bovis AF2122/97
gugccgccaucgccgccggugc

SEQ ID NO: 3167817 - RNA, 23 nt, Mycobacterium bovis subsp bovis AF2122/97
gugccgccaucgccgccggugcc

SEQ ID NO: 3167818 - RNA, 19 nt, Mycobacterium bovis subsp bovis AF2122/97
gugccgcccaccacacagc

SEQ ID NO: 3167819 - RNA, 11 nt, Mycobacterium bovis subsp bovis AF2122/97
gugccgcccag

SEQ ID NO: 3167820 - RNA, 16 nt, Mycobacterium bovis subsp bovis AF2122/97
gugccgcccccggcac

SEQ ID NO: 3167821 - RNA, 18 nt, Mycobacterium bovis subsp bovis AF2122/97
gugccgcccccggcacag

SEQ ID NO: 3167822 - RNA, 11 nt, Mycobacterium bovis subsp bovis AF2122/97
gugccgcccgc

SEQ ID NO: 3167823 - RNA, 20 nt, Mycobacterium bovis subsp bovis AF2122/97
gugccgcccgccucugucuu

SEQ ID NO: 3167824 - RNA, 18 nt, Mycobacterium bovis subsp bovis AF2122/97
gugccgcccgcgccgccc

SEQ ID NO: 3167825 - RNA, 15 nt, Mycobacterium bovis subsp bovis AF2122/97
gugccgcccggucgg

SEQ ID NO: 3167826 - RNA, 18 nt, Mycobacterium bovis subsp bovis AF2122/97
gugccgcccuggacgucg

SEQ ID NO: 3167827 - RNA, 14 nt, Mycobacterium bovis subsp bovis AF2122/97
gugccgccgacacc

SEQ ID NO: 3167828 - RNA, 20 nt, Mycobacterium bovis subsp bovis AF2122/97
gugccgccgauaccgccggc

SEQ ID NO: 3167829 - RNA, 13 nt, Mycobacterium bovis subsp bovis AF2122/97
gugccgccgaugu

SEQ ID NO: 3167830 - RNA, 13 nt, Mycobacterium bovis subsp bovis AF2122/97
gugccgccgccgg

SEQ ID NO: 3167831 - RNA, 14 nt, Mycobacterium bovis subsp bovis AF2122/97
gugccgccgccggc

SEQ ID NO: 3167832 - RNA, 20 nt, Mycobacterium bovis subsp bovis AF2122/97
gugccgccgccggcgccgga

SEQ ID NO: 3167833 - RNA, 16 nt, Mycobacterium bovis subsp bovis AF2122/97
gugccgccgcggccac

SEQ ID NO: 3167834 - RNA, 22 nt, Mycobacterium bovis subsp bovis AF2122/97
gugccgccgcggccaccaccgc

SEQ ID NO: 3167835 - RNA, 15 nt, Mycobacterium bovis subsp bovis AF2122/97
gugccgccggccagu

SEQ ID NO: 3167836 - RNA, 15 nt, Mycobacterium bovis subsp bovis AF2122/97
gugccgccggcgcca

SEQ ID NO: 3167837 - RNA, 12 nt, Mycobacterium bovis subsp bovis AF2122/97
gugccgccgggu

SEQ ID NO: 3167838 - RNA, 22 nt, Mycobacterium bovis subsp bovis AF2122/97
gugccgccguucccaccaccac

SEQ ID NO: 3167839 - RNA, 17 nt, Mycobacterium bovis subsp bovis AF2122/97
gugccgccugcgccgcc

SEQ ID NO: 3167840 - RNA, 22 nt, Mycobacterium bovis subsp bovis AF2122/97
gugccgccugcgccgccagcgc

SEQ ID NO: 3167841 - RNA, 23 nt, Mycobacterium bovis subsp bovis AF2122/97
gugccgccugcgccgccagcgcc

SEQ ID NO: 3167842 - RNA, 14 nt, Mycobacterium bovis subsp bovis AF2122/97
gugccgcgcagcug

SEQ ID NO: 3167843 - RNA, 14 nt, Mycobacterium bovis subsp bovis AF2122/97
gugccgcggccacc

SEQ ID NO: 3167844 - RNA, 15 nt, Mycobacterium bovis subsp bovis AF2122/97
gugccgcggccaccg

SEQ ID NO: 3167845 - RNA, 17 nt, Mycobacterium bovis subsp bovis AF2122/97
gugccgcggccaccgcc

SEQ ID NO: 3167846 - RNA, 19 nt, Mycobacterium bovis subsp bovis AF2122/97
gugccgcgucaaccgaucg

SEQ ID NO: 3167847 - RNA, 16 nt, Mycobacterium bovis subsp bovis AF2122/97
gugccgcuagcggauu

SEQ ID NO: 3167848 - RNA, 18 nt, Mycobacterium bovis subsp bovis AF2122/97
gugccgcugcauccgcag

SEQ ID NO: 3167849 - RNA, 20 nt, Mycobacterium bovis subsp bovis AF2122/97
gugccggacuuggccugcgg

SEQ ID NO: 3167850 - RNA, 18 nt, Mycobacterium bovis subsp bovis AF2122/97
gugccggcauagaucggg

SEQ ID NO: 3167851 - RNA, 21 nt, Mycobacterium bovis subsp bovis AF2122/97
gugccggccagacucgcgguc

SEQ ID NO: 3167852 - RNA, 19 nt, Mycobacterium bovis subsp bovis AF2122/97
gugccggcccugcucggcc

SEQ ID NO: 3167853 - RNA, 20 nt, Mycobacterium bovis subsp bovis AF2122/97
gugccggcccugcucggcca

SEQ ID NO: 3167854 - RNA, 21 nt, Mycobacterium bovis subsp bovis AF2122/97
gugccggcccugcucggccaa

SEQ ID NO: 3167855 - RNA, 20 nt, Mycobacterium bovis subsp bovis AF2122/97
gugccggccgcacaugagcu

SEQ ID NO: 3167856 - RNA, 19 nt, Mycobacterium bovis subsp bovis AF2122/97
gugccggcgaaccccagcg

SEQ ID NO: 3167857 - RNA, 13 nt, Mycobacterium bovis subsp bovis AF2122/97
gugccggcgacgc

SEQ ID NO: 3167858 - RNA, 15 nt, Mycobacterium bovis subsp bovis AF2122/97
gugccggcgacgcua

SEQ ID NO: 3167859 - RNA, 20 nt, Mycobacterium bovis subsp bovis AF2122/97
gugccggcgacgcuaccgcc

SEQ ID NO: 3167860 - RNA, 23 nt, Mycobacterium bovis subsp bovis AF2122/97
gugccggcgacgcuaccgccgga

SEQ ID NO: 3167861 - RNA, 14 nt, Mycobacterium bovis subsp bovis AF2122/97
gugccggcgccgcc

SEQ ID NO: 3167862 - RNA, 21 nt, Mycobacterium bovis subsp bovis AF2122/97
gugccggcgccgccagcacca

SEQ ID NO: 3167863 - RNA, 15 nt, Mycobacterium bovis subsp bovis AF2122/97
gugccggcgccgccc

SEQ ID NO: 3167864 - RNA, 16 nt, Mycobacterium bovis subsp bovis AF2122/97
gugccggcgccgcccu

SEQ ID NO: 3167865 - RNA, 17 nt, Mycobacterium bovis subsp bovis AF2122/97
gugccggcgccgcccuu

SEQ ID NO: 3167866 - RNA, 12 nt, Mycobacterium bovis subsp bovis AF2122/97
gugccggcggcg

SEQ ID NO: 3167867 - RNA, 14 nt, Mycobacterium bovis subsp bovis AF2122/97
gugccggcggugac

SEQ ID NO: 3167868 - RNA, 20 nt, Mycobacterium bovis subsp bovis AF2122/97
gugccggcggugacggcggc

SEQ ID NO: 3167869 - RNA, 22 nt, Mycobacterium bovis subsp bovis AF2122/97
gugccggcguaggcaggaucgc

SEQ ID NO: 3167870 - RNA, 14 nt, Mycobacterium bovis subsp bovis AF2122/97
gugccggcgugcgc

SEQ ID NO: 3167871 - RNA, 16 nt, Mycobacterium bovis subsp bovis AF2122/97
gugccggcgugcgcga

SEQ ID NO: 3167872 - RNA, 15 nt, Mycobacterium bovis subsp bovis AF2122/97
gugccggcguugccg

SEQ ID NO: 3167873 - RNA, 20 nt, Mycobacterium bovis subsp bovis AF2122/97
gugccggcguugccgccguu

SEQ ID NO: 3167874 - RNA, 13 nt, Mycobacterium bovis subsp bovis AF2122/97
gugccgggaucgc

SEQ ID NO: 3167875 - RNA, 21 nt, Mycobacterium bovis subsp bovis AF2122/97
gugccgggaugccgccgcuga

SEQ ID NO: 3167876 - RNA, 15 nt, Mycobacterium bovis subsp bovis AF2122/97
gugccgggcaccacc

SEQ ID NO: 3167877 - RNA, 20 nt, Mycobacterium bovis subsp bovis AF2122/97
gugccgggcaccaccacacc

SEQ ID NO: 3167878 - RNA, 19 nt, Mycobacterium bovis subsp bovis AF2122/97
gugccgggcgaugcugggc

SEQ ID NO: 3167879 - RNA, 19 nt, Mycobacterium bovis subsp bovis AF2122/97
gugccggggcugccgccgu

SEQ ID NO: 3167880 - RNA, 20 nt, Mycobacterium bovis subsp bovis AF2122/97
gugccggggcugccgccguu

SEQ ID NO: 3167881 - RNA, 19 nt, Mycobacterium bovis subsp bovis AF2122/97
gugccgggguggcgcgcca

SEQ ID NO: 3167882 - RNA, 14 nt, Mycobacterium bovis subsp bovis AF2122/97
gugccgggucaccg

SEQ ID NO: 3167883 - RNA, 15 nt, Mycobacterium bovis subsp bovis AF2122/97
gugccgggucaccga

SEQ ID NO: 3167884 - RNA, 14 nt, Mycobacterium bovis subsp bovis AF2122/97
gugccggucgauga

SEQ ID NO: 3167885 - RNA, 21 nt, Mycobacterium bovis subsp bovis AF2122/97
gugccggucgaugaccuccaa

SEQ ID NO: 3167886 - RNA, 20 nt, Mycobacterium bovis subsp bovis AF2122/97
gugccggugauggccgacca

SEQ ID NO: 3167887 - RNA, 21 nt, Mycobacterium bovis subsp bovis AF2122/97
gugcucaccuccacggucggg

SEQ ID NO: 3167888 - RNA, 13 nt, Mycobacterium bovis subsp bovis AF2122/97
gugcucacggcgg

SEQ ID NO: 3167889 - RNA, 20 nt, Mycobacterium bovis subsp bovis AF2122/97
gugcucagcgcgcgccgcug

SEQ ID NO: 3167890 - RNA, 20 nt, Mycobacterium bovis subsp bovis AF2122/97
gugcucagcuucgcgucggg

SEQ ID NO: 3167891 - RNA, 23 nt, Mycobacterium bovis subsp bovis AF2122/97
gugcucaucgacaaucgcacgcu

SEQ ID NO: 3167892 - RNA, 20 nt, Mycobacterium bovis subsp bovis AF2122/97
gugcucccgauaauccuuug

SEQ ID NO: 3167893 - RNA, 19 nt, Mycobacterium bovis subsp bovis AF2122/97
gugcucgaugcgaucgacg

SEQ ID NO: 3167894 - RNA, 21 nt, Mycobacterium bovis subsp bovis AF2122/97
gugcucgcaaucguuggccau

SEQ ID NO: 3167895 - RNA, 20 nt, Mycobacterium bovis subsp bovis AF2122/97
gugcucgccggaucuugccg

SEQ ID NO: 3167896 - RNA, 13 nt, Mycobacterium bovis subsp bovis AF2122/97
gugcucgccgggu

SEQ ID NO: 3167897 - RNA, 22 nt, Mycobacterium bovis subsp bovis AF2122/97
gugcucgccguaagcaccagcc

SEQ ID NO: 3167898 - RNA, 21 nt, Mycobacterium bovis subsp bovis AF2122/97
gugcucggaggcgaucaggau

SEQ ID NO: 3167899 - RNA, 22 nt, Mycobacterium bovis subsp bovis AF2122/97
gugcucggucgaugcucagugc

SEQ ID NO: 3167900 - RNA, 21 nt, Mycobacterium bovis subsp bovis AF2122/97
gugcucguagacuugcugcuc

SEQ ID NO: 3167901 - RNA, 17 nt, Mycobacterium bovis subsp bovis AF2122/97
gugcucgucguacaugg

SEQ ID NO: 3167902 - RNA, 20 nt, Mycobacterium bovis subsp bovis AF2122/97
gugcucucguggauggccgc

SEQ ID NO: 3167903 - RNA, 22 nt, Mycobacterium bovis subsp bovis AF2122/97
gugcucucguggauggccgcca

SEQ ID NO: 3167904 - RNA, 15 nt, Mycobacterium bovis subsp bovis AF2122/97
gugcugaccccgccg

SEQ ID NO: 3167905 - RNA, 22 nt, Mycobacterium bovis subsp bovis AF2122/97
gugcugaccccgccggcugcgg

SEQ ID NO: 3167906 - RNA, 14 nt, Mycobacterium bovis subsp bovis AF2122/97
gugcugaccgcgcc

SEQ ID NO: 3167907 - RNA, 17 nt, Mycobacterium bovis subsp bovis AF2122/97
gugcugaccgcgccgga

SEQ ID NO: 3167908 - RNA, 21 nt, Mycobacterium bovis subsp bovis AF2122/97
gugcugagucgguucagccac

SEQ ID NO: 3167909 - RNA, 17 nt, Mycobacterium bovis subsp bovis AF2122/97
gugcugaugggucaggc

SEQ ID NO: 3167910 - RNA, 18 nt, Mycobacterium bovis subsp bovis AF2122/97
gugcugcaccgauucggg

SEQ ID NO: 3167911 - RNA, 17 nt, Mycobacterium bovis subsp bovis AF2122/97
gugcugcagaucggccg

SEQ ID NO: 3167912 - RNA, 13 nt, Mycobacterium bovis subsp bovis AF2122/97
gugcugccaccgg

SEQ ID NO: 3167913 - RNA, 20 nt, Mycobacterium bovis subsp bovis AF2122/97
gugcugccaccggccggcgc

SEQ ID NO: 3167914 - RNA, 23 nt, Mycobacterium bovis subsp bovis AF2122/97
gugcugccaccggccggcgcagu

SEQ ID NO: 3167915 - RNA, 17 nt, Mycobacterium bovis subsp bovis AF2122/97
gugcugccauugccgca

SEQ ID NO: 3167916 - RNA, 15 nt, Mycobacterium bovis subsp bovis AF2122/97
gugcugcccaucccg

SEQ ID NO: 3167917 - RNA, 21 nt, Mycobacterium bovis subsp bovis AF2122/97
gugcugcccaucccggccgag

SEQ ID NO: 3167918 - RNA, 13 nt, Mycobacterium bovis subsp bovis AF2122/97
gugcugccgcaca

SEQ ID NO: 3167919 - RNA, 20 nt, Mycobacterium bovis subsp bovis AF2122/97
gugcugccuugggaccgcgc

SEQ ID NO: 3167920 - RNA, 17 nt, Mycobacterium bovis subsp bovis AF2122/97
gugcugcgcgcggcggc

SEQ ID NO: 3167921 - RNA, 13 nt, Mycobacterium bovis subsp bovis AF2122/97
gugcugcucgaca

SEQ ID NO: 3167922 - RNA, 15 nt, Mycobacterium bovis subsp bovis AF2122/97
gugcuggcaccagca

SEQ ID NO: 3167923 - RNA, 11 nt, Mycobacterium bovis subsp bovis AF2122/97
gugcuggcagg

SEQ ID NO: 3167924 - RNA, 15 nt, Mycobacterium bovis subsp bovis AF2122/97
gugcuggcgcaacca

SEQ ID NO: 3167925 - RNA, 22 nt, Mycobacterium bovis subsp bovis AF2122/97
gugcuggcuuugaucgcccggu

SEQ ID NO: 3167926 - RNA, 19 nt, Mycobacterium bovis subsp bovis AF2122/97
gugcugggcaucaccgacg

SEQ ID NO: 3167927 - RNA, 22 nt, Mycobacterium bovis subsp bovis AF2122/97
gugcuggggaugcgauggcccg

SEQ ID NO: 3167928 - RNA, 20 nt, Mycobacterium bovis subsp bovis AF2122/97
gugcuggggguaccucccgc

SEQ ID NO: 3167929 - RNA, 18 nt, Mycobacterium bovis subsp bovis AF2122/97
gugcuggucaacagcggc

SEQ ID NO: 3167930 - RNA, 14 nt, Mycobacterium bovis subsp bovis AF2122/97
gugcuggucgccgc

SEQ ID NO: 3167931 - RNA, 16 nt, Mycobacterium bovis subsp bovis AF2122/97
gugcuggucgccgcgg

SEQ ID NO: 3167932 - RNA, 18 nt, Mycobacterium bovis subsp bovis AF2122/97
gugcuggugaucugcugg

SEQ ID NO: 3167933 - RNA, 21 nt, Mycobacterium bovis subsp bovis AF2122/97
gugcuggugggccggaccuug

SEQ ID NO: 3167934 - RNA, 18 nt, Mycobacterium bovis subsp bovis AF2122/97
gugcuggugguaucggcg

SEQ ID NO: 3167935 - RNA, 23 nt, Mycobacterium bovis subsp bovis AF2122/97
gugcugucgucuuggcgaucggg

SEQ ID NO: 3167936 - RNA, 20 nt, Mycobacterium bovis subsp bovis AF2122/97
gugcuguggaugccgacggc

SEQ ID NO: 3167937 - RNA, 22 nt, Mycobacterium bovis subsp bovis AF2122/97
gugcuguugcgcggucgcgcga

SEQ ID NO: 3167938 - RNA, 13 nt, Mycobacterium bovis subsp bovis AF2122/97
gugcuuggcagcg

SEQ ID NO: 3167939 - RNA, 16 nt, Mycobacterium bovis subsp bovis AF2122/97
gugcuugucgccgcgu

SEQ ID NO: 3167940 - RNA, 19 nt, Mycobacterium bovis subsp bovis AF2122/97
gugcuuuggguccgggcgg

SEQ ID NO: 3167941 - RNA, 15 nt, Mycobacterium bovis subsp bovis AF2122/97
guggaaacccgccga

SEQ ID NO: 3167942 - RNA, 21 nt, Mycobacterium bovis subsp bovis AF2122/97
guggaaaccggugguagcgac

SEQ ID NO: 3167943 - RNA, 22 nt, Mycobacterium bovis subsp bovis AF2122/97
guggaaacugaugucgccgauu

SEQ ID NO: 3167944 - RNA, 17 nt, Mycobacterium bovis subsp bovis AF2122/97
guggaacaccgcggcaa

SEQ ID NO: 3167945 - RNA, 16 nt, Mycobacterium bovis subsp bovis AF2122/97
guggaacagucgaggu

SEQ ID NO: 3167946 - RNA, 11 nt, Mycobacterium bovis subsp bovis AF2122/97
guggaacaugu

SEQ ID NO: 3167947 - RNA, 15 nt, Mycobacterium bovis subsp bovis AF2122/97
guggaaccacggcgc

SEQ ID NO: 3167948 - RNA, 18 nt, Mycobacterium bovis subsp bovis AF2122/97
guggaacuccguccgccg

SEQ ID NO: 3167949 - RNA, 14 nt, Mycobacterium bovis subsp bovis AF2122/97
guggaagacgucga

SEQ ID NO: 3167950 - RNA, 22 nt, Mycobacterium bovis subsp bovis AF2122/97
guggaagauguugccgccgguc

SEQ ID NO: 3167951 - RNA, 17 nt, Mycobacterium bovis subsp bovis AF2122/97
guggaagcccgucgcgg

SEQ ID NO: 3167952 - RNA, 18 nt, Mycobacterium bovis subsp bovis AF2122/97
guggaagcccgucgcggc

SEQ ID NO: 3167953 - RNA, 19 nt, Mycobacterium bovis subsp bovis AF2122/97
guggaagcccgucgcggcc

SEQ ID NO: 3167954 - RNA, 14 nt, Mycobacterium bovis subsp bovis AF2122/97
guggaagccgacca

SEQ ID NO: 3167955 - RNA, 21 nt, Mycobacterium bovis subsp bovis AF2122/97
guggaagccgaccaccgccgg

SEQ ID NO: 3167956 - RNA, 22 nt, Mycobacterium bovis subsp bovis AF2122/97
guggaagccgacgaccagcaga

SEQ ID NO: 3167957 - RNA, 15 nt, Mycobacterium bovis subsp bovis AF2122/97
guggaagguguuggu

SEQ ID NO: 3167958 - RNA, 16 nt, Mycobacterium bovis subsp bovis AF2122/97
guggaagguguuggug

SEQ ID NO: 3167959 - RNA, 19 nt, Mycobacterium bovis subsp bovis AF2122/97
guggaagguguuggugcgg

SEQ ID NO: 3167960 - RNA, 23 nt, Mycobacterium bovis subsp bovis AF2122/97
guggaaguacuucgcggcgguga

SEQ ID NO: 3167961 - RNA, 13 nt, Mycobacterium bovis subsp bovis AF2122/97
guggaauacgcug

SEQ ID NO: 3167962 - RNA, 15 nt, Mycobacterium bovis subsp bovis AF2122/97
guggaauacgcugcu

SEQ ID NO: 3167963 - RNA, 20 nt, Mycobacterium bovis subsp bovis AF2122/97
guggaauacgcugcuggucu

SEQ ID NO: 3167964 - RNA, 16 nt, Mycobacterium bovis subsp bovis AF2122/97
guggaauccaccagcc

SEQ ID NO: 3167965 - RNA, 21 nt, Mycobacterium bovis subsp bovis AF2122/97
guggaauggaccagcgccccg

SEQ ID NO: 3167966 - RNA, 13 nt, Mycobacterium bovis subsp bovis AF2122/97
guggaauggcgcc

SEQ ID NO: 3167967 - RNA, 18 nt, Mycobacterium bovis subsp bovis AF2122/97
guggaauggcgccggccg

SEQ ID NO: 3167968 - RNA, 23 nt, Mycobacterium bovis subsp bovis AF2122/97
guggacaaaucgaugaccgucgc

SEQ ID NO: 3167969 - RNA, 15 nt, Mycobacterium bovis subsp bovis AF2122/97
guggacacggcgcug

SEQ ID NO: 3167970 - RNA, 22 nt, Mycobacterium bovis subsp bovis AF2122/97
guggacacggcgcugcccacgc

SEQ ID NO: 3167971 - RNA, 19 nt, Mycobacterium bovis subsp bovis AF2122/97
guggacagaaucgaccgcc

SEQ ID NO: 3167972 - RNA, 22 nt, Mycobacterium bovis subsp bovis AF2122/97
guggacaucgggcggcaccgcu

SEQ ID NO: 3167973 - RNA, 21 nt, Mycobacterium bovis subsp bovis AF2122/97
guggccgaaagccaggcggca

SEQ ID NO: 3167974 - RNA, 13 nt, Mycobacterium bovis subsp bovis AF2122/97
guggccgacagcg

SEQ ID NO: 3167975 - RNA, 13 nt, Mycobacterium bovis subsp bovis AF2122/97
guggccgagccgc

SEQ ID NO: 3167976 - RNA, 15 nt, Mycobacterium bovis subsp bovis AF2122/97
guggccgcaucgacg

SEQ ID NO: 3167977 - RNA, 16 nt, Mycobacterium bovis subsp bovis AF2122/97
guggccgcaucgccuc

SEQ ID NO: 3167978 - RNA, 12 nt, Mycobacterium bovis subsp bovis AF2122/97
guggccgccacc

SEQ ID NO: 3167979 - RNA, 17 nt, Mycobacterium bovis subsp bovis AF2122/97
guggccgccaccuccca

SEQ ID NO: 3167980 - RNA, 18 nt, Mycobacterium bovis subsp bovis AF2122/97
guggccgccaccucccag

SEQ ID NO: 3167981 - RNA, 14 nt, Mycobacterium bovis subsp bovis AF2122/97
guggccgccgucga

SEQ ID NO: 3167982 - RNA, 15 nt, Mycobacterium bovis subsp bovis AF2122/97
guggccgcgaucccg

SEQ ID NO: 3167983 - RNA, 17 nt, Mycobacterium bovis subsp bovis AF2122/97
guggccgcgaucccggc

SEQ ID NO: 3167984 - RNA, 14 nt, Mycobacterium bovis subsp bovis AF2122/97
guggccgcgcaggg

SEQ ID NO: 3167985 - RNA, 20 nt, Mycobacterium bovis subsp bovis AF2122/97
guggccgcggcggucugggu

SEQ ID NO: 3167986 - RNA, 16 nt, Mycobacterium bovis subsp bovis AF2122/97
guggccgcugccagcc

SEQ ID NO: 3167987 - RNA, 18 nt, Mycobacterium bovis subsp bovis AF2122/97
guggccgcugccagccgu

SEQ ID NO: 3167988 - RNA, 20 nt, Mycobacterium bovis subsp bovis AF2122/97
guggccgggcgguaggcuug

SEQ ID NO: 3167989 - RNA, 16 nt, Mycobacterium bovis subsp bovis AF2122/97
guggccggggugccgg

SEQ ID NO: 3167990 - RNA, 19 nt, Mycobacterium bovis subsp bovis AF2122/97
guggccggggugccggcga

SEQ ID NO: 3167991 - RNA, 22 nt, Mycobacterium bovis subsp bovis AF2122/97
guggccgggucgaucaccgaca

SEQ ID NO: 3167992 - RNA, 13 nt, Mycobacterium bovis subsp bovis AF2122/97
guggccggucguu

SEQ ID NO: 3167993 - RNA, 16 nt, Mycobacterium bovis subsp bovis AF2122/97
guggccggugggccgc

SEQ ID NO: 3167994 - RNA, 22 nt, Mycobacterium bovis subsp bovis AF2122/97
guggccgucgggugcagcacgg

SEQ ID NO: 3167995 - RNA, 22 nt, Mycobacterium bovis subsp bovis AF2122/97
guggccgugaagggauccggaa

SEQ ID NO: 3167996 - RNA, 17 nt, Mycobacterium bovis subsp bovis AF2122/97
guggccguguaucgggu

SEQ ID NO: 3167997 - RNA, 20 nt, Mycobacterium bovis subsp bovis AF2122/97
guggccguuggccggaucga

SEQ ID NO: 3167998 - RNA, 19 nt, Mycobacterium bovis subsp bovis AF2122/97
guggccucguccagcucgg

SEQ ID NO: 3167999 - RNA, 20 nt, Mycobacterium bovis subsp bovis AF2122/97
guggccugaaacggcugcag

SEQ ID NO: 3168000 - RNA, 17 nt, Mycobacterium bovis subsp bovis AF2122/97
guggccuugcgucaucg

SEQ ID NO: 3168001 - RNA, 15 nt, Mycobacterium bovis subsp bovis AF2122/97
guggcgaaaucgucg

SEQ ID NO: 3168002 - RNA, 18 nt, Mycobacterium bovis subsp bovis AF2122/97
guggcgaaaucgucgaac

SEQ ID NO: 3168003 - RNA, 20 nt, Mycobacterium bovis subsp bovis AF2122/97
guggcgaaaucgucgaaccg

SEQ ID NO: 3168004 - RNA, 19 nt, Mycobacterium bovis subsp bovis AF2122/97
guggcgaaccaggggucgc

SEQ ID NO: 3168005 - RNA, 16 nt, Mycobacterium bovis subsp bovis AF2122/97
guggcgaaugacggcc

SEQ ID NO: 3168006 - RNA, 17 nt, Mycobacterium bovis subsp bovis AF2122/97
guggcgaccggcgaccg

SEQ ID NO: 3168007 - RNA, 19 nt, Mycobacterium bovis subsp bovis AF2122/97
guggcgacggcgucgauga

SEQ ID NO: 3168008 - RNA, 16 nt, Mycobacterium bovis subsp bovis AF2122/97
guggcgaggcagcacc

SEQ ID NO: 3168009 - RNA, 13 nt, Mycobacterium bovis subsp bovis AF2122/97
guggcgaucaucg

SEQ ID NO: 3168010 - RNA, 22 nt, Mycobacterium bovis subsp bovis AF2122/97
guggcgaugaccacgccgacga

SEQ ID NO: 3168011 - RNA, 13 nt, Mycobacterium bovis subsp bovis AF2122/97
guggcgcacaucg

SEQ ID NO: 3168012 - RNA, 13 nt, Mycobacterium bovis subsp bovis AF2122/97
guggcgcaccacc

SEQ ID NO: 3168013 - RNA, 14 nt, Mycobacterium bovis subsp bovis AF2122/97
guggcgccacggca

SEQ ID NO: 3168014 - RNA, 20 nt, Mycobacterium bovis subsp bovis AF2122/97
guggcgccacggcagcgccc

SEQ ID NO: 3168015 - RNA, 15 nt, Mycobacterium bovis subsp bovis AF2122/97
guggcgccagggccu

SEQ ID NO: 3168016 - RNA, 18 nt, Mycobacterium bovis subsp bovis AF2122/97
guggcgccauccccgccg

SEQ ID NO: 3168017 - RNA, 13 nt, Mycobacterium bovis subsp bovis AF2122/97
guggcgccaugaa

SEQ ID NO: 3168018 - RNA, 11 nt, Mycobacterium bovis subsp bovis AF2122/97
guggcgcccau

SEQ ID NO: 3168019 - RNA, 18 nt, Mycobacterium bovis subsp bovis AF2122/97
guggcgcccauggccacc

SEQ ID NO: 3168020 - RNA, 21 nt, Mycobacterium bovis subsp bovis AF2122/97
guggcgcccgcguucagggca

SEQ ID NO: 3168021 - RNA, 20 nt, Mycobacterium bovis subsp bovis AF2122/97
guggcgccgaacgcaacgcc

SEQ ID NO: 3168022 - RNA, 20 nt, Mycobacterium bovis subsp bovis AF2122/97
guggcgccgaacgccagcag

SEQ ID NO: 3168023 - RNA, 16 nt, Mycobacterium bovis subsp bovis AF2122/97
guggcgccgaccugga

SEQ ID NO: 3168024 - RNA, 12 nt, Mycobacterium bovis subsp bovis AF2122/97
guggcgccgccg

SEQ ID NO: 3168025 - RNA, 13 nt, Mycobacterium bovis subsp bovis AF2122/97
guggcgccgccgg

SEQ ID NO: 3168026 - RNA, 21 nt, Mycobacterium bovis subsp bovis AF2122/97
guggcgccgccggcaccgccg

SEQ ID NO: 3168027 - RNA, 22 nt, Mycobacterium bovis subsp bovis AF2122/97
guggcgccgccggcaccgccgg

SEQ ID NO: 3168028 - RNA, 13 nt, Mycobacterium bovis subsp bovis AF2122/97
guggcgccggccg

SEQ ID NO: 3168029 - RNA, 19 nt, Mycobacterium bovis subsp bovis AF2122/97
guggcgccggggccgccga

SEQ ID NO: 3168030 - RNA, 12 nt, Mycobacterium bovis subsp bovis AF2122/97
guggcgccguug

SEQ ID NO: 3168031 - RNA, 22 nt, Mycobacterium bovis subsp bovis AF2122/97
guggcgccguugucggcgguga

SEQ ID NO: 3168032 - RNA, 20 nt, Mycobacterium bovis subsp bovis AF2122/97
guggcgcgccgcaucggcga

SEQ ID NO: 3168033 - RNA, 17 nt, Mycobacterium bovis subsp bovis AF2122/97
guggcgcgcggcgccgc

SEQ ID NO: 3168034 - RNA, 12 nt, Mycobacterium bovis subsp bovis AF2122/97
guggcgcgggcc

SEQ ID NO: 3168035 - RNA, 22 nt, Mycobacterium bovis subsp bovis AF2122/97
guggcgcucggcgagcaacacg

SEQ ID NO: 3168036 - RNA, 14 nt, Mycobacterium bovis subsp bovis AF2122/97
guggcgcugaucgg

SEQ ID NO: 3168037 - RNA, 20 nt, Mycobacterium bovis subsp bovis AF2122/97
guggcgcugggguccgcguc

SEQ ID NO: 3168038 - RNA, 13 nt, Mycobacterium bovis subsp bovis AF2122/97
guggcggacggcg

SEQ ID NO: 3168039 - RNA, 15 nt, Mycobacterium bovis subsp bovis AF2122/97
guggcggacggcguc

SEQ ID NO: 3168040 - RNA, 16 nt, Mycobacterium bovis subsp bovis AF2122/97
guggcggacggcgucg

SEQ ID NO: 3168041 - RNA, 14 nt, Mycobacterium bovis subsp bovis AF2122/97
guggcggaucgcga

SEQ ID NO: 3168042 - RNA, 21 nt, Mycobacterium bovis subsp bovis AF2122/97
guggcggaucgcgagcgccgc

SEQ ID NO: 3168043 - RNA, 14 nt, Mycobacterium bovis subsp bovis AF2122/97
guggcggcaggugu

SEQ ID NO: 3168044 - RNA, 12 nt, Mycobacterium bovis subsp bovis AF2122/97
guggcggccagu

SEQ ID NO: 3168045 - RNA, 19 nt, Mycobacterium bovis subsp bovis AF2122/97
guggcggccaguucggcgg

SEQ ID NO: 3168046 - RNA, 12 nt, Mycobacterium bovis subsp bovis AF2122/97
guggcggccucc

SEQ ID NO: 3168047 - RNA, 23 nt, Mycobacterium bovis subsp bovis AF2122/97
guggcggcggcggcaacggcggc

SEQ ID NO: 3168048 - RNA, 13 nt, Mycobacterium bovis subsp bovis AF2122/97
guggcggcgggcc

SEQ ID NO: 3168049 - RNA, 16 nt, Mycobacterium bovis subsp bovis AF2122/97
guggcggcgggccucg

SEQ ID NO: 3168050 - RNA, 17 nt, Mycobacterium bovis subsp bovis AF2122/97
guggcggcgggccucgg

SEQ ID NO: 3168051 - RNA, 20 nt, Mycobacterium bovis subsp bovis AF2122/97
guggcggcgggccucggcga

SEQ ID NO: 3168052 - RNA, 13 nt, Mycobacterium bovis subsp bovis AF2122/97
guggcggcgucga

SEQ ID NO: 3168053 - RNA, 19 nt, Mycobacterium bovis subsp bovis AF2122/97
guggcgggccggaugacgc

SEQ ID NO: 3168054 - RNA, 21 nt, Mycobacterium bovis subsp bovis AF2122/97
guggcgggcgaugcgggccgc

SEQ ID NO: 3168055 - RNA, 21 nt, Mycobacterium bovis subsp bovis AF2122/97
guggcgggcugcagccgacag

SEQ ID NO: 3168056 - RNA, 20 nt, Mycobacterium bovis subsp bovis AF2122/97
guggcgggguugaucaccga

SEQ ID NO: 3168057 - RNA, 16 nt, Mycobacterium bovis subsp bovis AF2122/97
guggcgggucagccuu

SEQ ID NO: 3168058 - RNA, 14 nt, Mycobacterium bovis subsp bovis AF2122/97
guggcgggucagcg

SEQ ID NO: 3168059 - RNA, 16 nt, Mycobacterium bovis subsp bovis AF2122/97
guggcgggucagcgcg

SEQ ID NO: 3168060 - RNA, 14 nt, Mycobacterium bovis subsp bovis AF2122/97
gugggucgauccgg

SEQ ID NO: 3168061 - RNA, 22 nt, Mycobacterium bovis subsp bovis AF2122/97
guggguguuuuugcgggugguc

SEQ ID NO: 3168062 - RNA, 21 nt, Mycobacterium bovis subsp bovis AF2122/97
guggguuuacgcugccgcagc

SEQ ID NO: 3168063 - RNA, 16 nt, Mycobacterium bovis subsp bovis AF2122/97
gugguaacaccggcga

SEQ ID NO: 3168064 - RNA, 18 nt, Mycobacterium bovis subsp bovis AF2122/97
gugguaaccauauggccc

SEQ ID NO: 3168065 - RNA, 16 nt, Mycobacterium bovis subsp bovis AF2122/97
gugguaacggcggcca

SEQ ID NO: 3168066 - RNA, 15 nt, Mycobacterium bovis subsp bovis AF2122/97
gugguaagacgccga

SEQ ID NO: 3168067 - RNA, 14 nt, Mycobacterium bovis subsp bovis AF2122/97
gugguaccggcgcc

SEQ ID NO: 3168068 - RNA, 15 nt, Mycobacterium bovis subsp bovis AF2122/97
gugguaccggcgcca

SEQ ID NO: 3168069 - RNA, 18 nt, Mycobacterium bovis subsp bovis AF2122/97
gugguaccggcggcgccg

SEQ ID NO: 3168070 - RNA, 21 nt, Mycobacterium bovis subsp bovis AF2122/97
gugguagcgacgauguuggug

SEQ ID NO: 3168071 - RNA, 19 nt, Mycobacterium bovis subsp bovis AF2122/97
gugguagcugacgcugcuc

SEQ ID NO: 3168072 - RNA, 12 nt, Mycobacterium bovis subsp bovis AF2122/97
gugguaggccgg

SEQ ID NO: 3168073 - RNA, 19 nt, Mycobacterium bovis subsp bovis AF2122/97
gugguaggccggggcgucg

SEQ ID NO: 3168074 - RNA, 16 nt, Mycobacterium bovis subsp bovis AF2122/97
gugguaggccggugcg

SEQ ID NO: 3168075 - RNA, 23 nt, Mycobacterium bovis subsp bovis AF2122/97
gugguaucgauugaugcgugguu

SEQ ID NO: 3168076 - RNA, 14 nt, Mycobacterium bovis subsp bovis AF2122/97
gugguaucggcgug

SEQ ID NO: 3168077 - RNA, 15 nt, Mycobacterium bovis subsp bovis AF2122/97
guggucaacggccga

SEQ ID NO: 3168078 - RNA, 15 nt, Mycobacterium bovis subsp bovis AF2122/97
guggucaccaccauc

SEQ ID NO: 3168079 - RNA, 20 nt, Mycobacterium bovis subsp bovis AF2122/97
guggucaccccuucgccagc

SEQ ID NO: 3168080 - RNA, 21 nt, Mycobacterium bovis subsp bovis AF2122/97
guggucacgcagucgggcagc

SEQ ID NO: 3168081 - RNA, 14 nt, Mycobacterium bovis subsp bovis AF2122/97
guggucagcaccca

SEQ ID NO: 3168082 - RNA, 14 nt, Mycobacterium bovis subsp bovis AF2122/97
guggucaguccgac

SEQ ID NO: 3168083 - RNA, 18 nt, Mycobacterium bovis subsp bovis AF2122/97
guggucaguccgacaccg

SEQ ID NO: 3168084 - RNA, 14 nt, Mycobacterium bovis subsp bovis AF2122/97
guggucaucgccac

SEQ ID NO: 3168085 - RNA, 21 nt, Mycobacterium bovis subsp bovis AF2122/97
guggucaucgccacgccugcu

SEQ ID NO: 3168086 - RNA, 19 nt, Mycobacterium bovis subsp bovis AF2122/97
guggucauugggguggcau

SEQ ID NO: 3168087 - RNA, 18 nt, Mycobacterium bovis subsp bovis AF2122/97
guggucccccgcagccag

SEQ ID NO: 3168088 - RNA, 20 nt, Mycobacterium bovis subsp bovis AF2122/97
gugguccuuguuguggugga

SEQ ID NO: 3168089 - RNA, 15 nt, Mycobacterium bovis subsp bovis AF2122/97
guggucgacccggcc

SEQ ID NO: 3168090 - RNA, 19 nt, Mycobacterium bovis subsp bovis AF2122/97
guggucgacccggccagga

SEQ ID NO: 3168091 - RNA, 16 nt, Mycobacterium bovis subsp bovis AF2122/97
guggucgagcggucgc

SEQ ID NO: 3168092 - RNA, 17 nt, Mycobacterium bovis subsp bovis AF2122/97
guggucgagggcggcgu

SEQ ID NO: 3168093 - RNA, 17 nt, Mycobacterium bovis subsp bovis AF2122/97
guggucgagguggggug

SEQ ID NO: 3168094 - RNA, 17 nt, Mycobacterium bovis subsp bovis AF2122/97
guggucgcgcggcaccg

SEQ ID NO: 3168095 - RNA, 22 nt, Mycobacterium bovis subsp bovis AF2122/97
guggucgcugcugccgcaccgg

SEQ ID NO: 3168096 - RNA, 13 nt, Mycobacterium bovis subsp bovis AF2122/97
guggucggcuccg

SEQ ID NO: 3168097 - RNA, 16 nt, Mycobacterium bovis subsp bovis AF2122/97
guggucggcuccgcga

SEQ ID NO: 3168098 - RNA, 16 nt, Mycobacterium bovis subsp bovis AF2122/97
guggucggugccagca

SEQ ID NO: 3168099 - RNA, 17 nt, Mycobacterium bovis subsp bovis AF2122/97
guggucgguggcgggga

SEQ ID NO: 3168100 - RNA, 23 nt, Mycobacterium bovis subsp bovis AF2122/97
guggucgucccgauggcgguggg

SEQ ID NO: 3168101 - RNA, 22 nt, Mycobacterium bovis subsp bovis AF2122/97
guggucgucccgcccaucccgg

SEQ ID NO: 3168102 - RNA, 16 nt, Mycobacterium bovis subsp bovis AF2122/97
guggucuccggcaccg

SEQ ID NO: 3168103 - RNA, 18 nt, Mycobacterium bovis subsp bovis AF2122/97
guggucucgacggcgccg

SEQ ID NO: 3168104 - RNA, 20 nt, Mycobacterium bovis subsp bovis AF2122/97
guggucucgacggcgccgcc

SEQ ID NO: 3168105 - RNA, 19 nt, Mycobacterium bovis subsp bovis AF2122/97
guggucucgguaggcggug

SEQ ID NO: 3168106 - RNA, 16 nt, Mycobacterium bovis subsp bovis AF2122/97
guggucucggucagcc

SEQ ID NO: 3168107 - RNA, 18 nt, Mycobacterium bovis subsp bovis AF2122/97
guggucugccaaaagggc

SEQ ID NO: 3168108 - RNA, 18 nt, Mycobacterium bovis subsp bovis AF2122/97
guggucugccagcacccu

SEQ ID NO: 3168109 - RNA, 14 nt, Mycobacterium bovis subsp bovis AF2122/97
guggucugcgcggu

SEQ ID NO: 3168110 - RNA, 15 nt, Mycobacterium bovis subsp bovis AF2122/97
guggucugcgcggug

SEQ ID NO: 3168111 - RNA, 16 nt, Mycobacterium bovis subsp bovis AF2122/97
guggucuuggcccggc

SEQ ID NO: 3168112 - RNA, 15 nt, Mycobacterium bovis subsp bovis AF2122/97
guggucuuggccggu

SEQ ID NO: 3168113 - RNA, 17 nt, Mycobacterium bovis subsp bovis AF2122/97
guggucuuggcgguggc

SEQ ID NO: 3168114 - RNA, 21 nt, Mycobacterium bovis subsp bovis AF2122/97
guggugaaaccccagccccga

SEQ ID NO: 3168115 - RNA, 17 nt, Mycobacterium bovis subsp bovis AF2122/97
guggugaaaugccgaga

SEQ ID NO: 3168116 - RNA, 22 nt, Mycobacterium bovis subsp bovis AF2122/97
guggugaaguagucggcgccga

SEQ ID NO: 3168117 - RNA, 13 nt, Mycobacterium bovis subsp bovis AF2122/97
guggugaagucgg

SEQ ID NO: 3168118 - RNA, 21 nt, Mycobacterium bovis subsp bovis AF2122/97
guggugaccaaguagucgggu

SEQ ID NO: 3168119 - RNA, 16 nt, Mycobacterium bovis subsp bovis AF2122/97
guggugaccgacgcgg

SEQ ID NO: 3168120 - RNA, 20 nt, Mycobacterium bovis subsp bovis AF2122/97
guggugaccgacgcggacag

SEQ ID NO: 3168121 - RNA, 13 nt, Mycobacterium bovis subsp bovis AF2122/97
guggugaguacca

SEQ ID NO: 3168122 - RNA, 19 nt, Mycobacterium bovis subsp bovis AF2122/97
guggugauccagccgucgg

SEQ ID NO: 3168123 - RNA, 22 nt, Mycobacterium bovis subsp bovis AF2122/97
guggugauccagccgucggcgc

SEQ ID NO: 3168124 - RNA, 15 nt, Mycobacterium bovis subsp bovis AF2122/97
guggugccaaccugg

SEQ ID NO: 3168125 - RNA, 16 nt, Mycobacterium bovis subsp bovis AF2122/97
guggugccaaccuggg

SEQ ID NO: 3168126 - RNA, 14 nt, Mycobacterium bovis subsp bovis AF2122/97
guggugccggcgcc

SEQ ID NO: 3168127 - RNA, 14 nt, Mycobacterium bovis subsp bovis AF2122/97
guggugcggcgcga

SEQ ID NO: 3168128 - RNA, 18 nt, Mycobacterium bovis subsp bovis AF2122/97
guggugcuagcgccgcca

SEQ ID NO: 3168129 - RNA, 15 nt, Mycobacterium bovis subsp bovis AF2122/97
guggugcugaccgcg

SEQ ID NO: 3168130 - RNA, 16 nt, Mycobacterium bovis subsp bovis AF2122/97
gugguggacgaccgcg

SEQ ID NO: 3168131 - RNA, 15 nt, Mycobacterium bovis subsp bovis AF2122/97
gugguggagcggcgc

SEQ ID NO: 3168132 - RNA, 20 nt, Mycobacterium bovis subsp bovis AF2122/97
gugguggcccggcuggcuag

SEQ ID NO: 3168133 - RNA, 22 nt, Mycobacterium bovis subsp bovis AF2122/97
gugguggccggggugccggcga

SEQ ID NO: 3168134 - RNA, 14 nt, Mycobacterium bovis subsp bovis AF2122/97
gugguggcgguguu

SEQ ID NO: 3168135 - RNA, 12 nt, Mycobacterium bovis subsp bovis AF2122/97
gugguggcguug

SEQ ID NO: 3168136 - RNA, 13 nt, Mycobacterium bovis subsp bovis AF2122/97
guggugggccgug

SEQ ID NO: 3168137 - RNA, 23 nt, Mycobacterium bovis subsp bovis AF2122/97
guggugggcgugacugguggcgc

SEQ ID NO: 3168138 - RNA, 15 nt, Mycobacterium bovis subsp bovis AF2122/97
guggugggcuuggcu

SEQ ID NO: 3168139 - RNA, 19 nt, Mycobacterium bovis subsp bovis AF2122/97
guggugggcuuggcugugg

SEQ ID NO: 3168140 - RNA, 14 nt, Mycobacterium bovis subsp bovis AF2122/97
gugguggggccgug

SEQ ID NO: 3168141 - RNA, 14 nt, Mycobacterium bovis subsp bovis AF2122/97
guggugguagccau

SEQ ID NO: 3168142 - RNA, 16 nt, Mycobacterium bovis subsp bovis AF2122/97
gugguggugaugggca

SEQ ID NO: 3168143 - RNA, 18 nt, Mycobacterium bovis subsp bovis AF2122/97
guggugguugaucagcca

SEQ ID NO: 3168144 - RNA, 20 nt, Mycobacterium bovis subsp bovis AF2122/97
gugguguaucgacggcggcc

SEQ ID NO: 3168145 - RNA, 13 nt, Mycobacterium bovis subsp bovis AF2122/97
guggugucgcggc

SEQ ID NO: 3168146 - RNA, 13 nt, Mycobacterium bovis subsp bovis AF2122/97
guggugucggcga

SEQ ID NO: 3168147 - RNA, 16 nt, Mycobacterium bovis subsp bovis AF2122/97
guggugugucaccgga

SEQ ID NO: 3168148 - RNA, 14 nt, Mycobacterium bovis subsp bovis AF2122/97
gugguguuccaggu

SEQ ID NO: 3168149 - RNA, 17 nt, Mycobacterium bovis subsp bovis AF2122/97
gugguguuccaggucau

SEQ ID NO: 3168150 - RNA, 19 nt, Mycobacterium bovis subsp bovis AF2122/97
gugguucaccucggcgacg

SEQ ID NO: 3168151 - RNA, 12 nt, Mycobacterium bovis subsp bovis AF2122/97
gugguucccggc

SEQ ID NO: 3168152 - RNA, 14 nt, Mycobacterium bovis subsp bovis AF2122/97
gugguugaucagcc

SEQ ID NO: 3168153 - RNA, 17 nt, Mycobacterium bovis subsp bovis AF2122/97
gugguugccgaagccgg

SEQ ID NO: 3168154 - RNA, 16 nt, Mycobacterium bovis subsp bovis AF2122/97
gugguuguccacggcg

SEQ ID NO: 3168155 - RNA, 21 nt, Mycobacterium bovis subsp bovis AF2122/97
gugguuguccacggcguuacg

SEQ ID NO: 3168156 - RNA, 19 nt, Mycobacterium bovis subsp bovis AF2122/97
gugguuuggaccgcugaug

SEQ ID NO: 3168157 - RNA, 18 nt, Mycobacterium bovis subsp bovis AF2122/97
gugguuuucccgucgccg

SEQ ID NO: 3168158 - RNA, 19 nt, Mycobacterium bovis subsp bovis AF2122/97
gugguuuucccgucgccgc

SEQ ID NO: 3168159 - RNA, 21 nt, Mycobacterium bovis subsp bovis AF2122/97
gugguuuucccgucgccgccc

SEQ ID NO: 3168160 - RNA, 22 nt, Mycobacterium bovis subsp bovis AF2122/97
gugguuuucccgucgccgcccg

SEQ ID NO: 3168161 - RNA, 15 nt, Mycobacterium bovis subsp bovis AF2122/97
guguaacccuggcgg

SEQ ID NO: 3168162 - RNA, 20 nt, Mycobacterium bovis subsp bovis AF2122/97
guguacaccgcgcccgccga

SEQ ID NO: 3168163 - RNA, 19 nt, Mycobacterium bovis subsp bovis AF2122/97
guguacagucgcgcgcucg

SEQ ID NO: 3168164 - RNA, 12 nt, Mycobacterium bovis subsp bovis AF2122/97
guguacccgccu

SEQ ID NO: 3168165 - RNA, 12 nt, Mycobacterium bovis subsp bovis AF2122/97
guguaccgcgac

SEQ ID NO: 3168166 - RNA, 13 nt, Mycobacterium bovis subsp bovis AF2122/97
guguacuggucug

SEQ ID NO: 3168167 - RNA, 20 nt, Mycobacterium bovis subsp bovis AF2122/97
guguagacaggaccgguggg

SEQ ID NO: 3168168 - RNA, 17 nt, Mycobacterium bovis subsp bovis AF2122/97
guguagaucagcaacgg

SEQ ID NO: 3168169 - RNA, 17 nt, Mycobacterium bovis subsp bovis AF2122/97
guguagcaagucgccga

SEQ ID NO: 3168170 - RNA, 19 nt, Mycobacterium bovis subsp bovis AF2122/97
guguagcaagucgccgagg

SEQ ID NO: 3168171 - RNA, 13 nt, Mycobacterium bovis subsp bovis AF2122/97
guguagccgccgg

SEQ ID NO: 3168172 - RNA, 14 nt, Mycobacterium bovis subsp bovis AF2122/97
guguagccgccggc

SEQ ID NO: 3168173 - RNA, 22 nt, Mycobacterium bovis subsp bovis AF2122/97
guguaggcaaccuuuggccgcu

SEQ ID NO: 3168174 - RNA, 18 nt, Mycobacterium bovis subsp bovis AF2122/97
guguaggccucggcagca

SEQ ID NO: 3168175 - RNA, 23 nt, Mycobacterium bovis subsp bovis AF2122/97
guguaggccugcccccggcgcgg

SEQ ID NO: 3168176 - RNA, 23 nt, Mycobacterium bovis subsp bovis AF2122/97
guguagggcggcguugagcuggc

SEQ ID NO: 3168177 - RNA, 20 nt, Mycobacterium bovis subsp bovis AF2122/97
guguaguggaagaccucgac

SEQ ID NO: 3168178 - RNA, 22 nt, Mycobacterium bovis subsp bovis AF2122/97
guguaugcauccacugcggcgc

SEQ ID NO: 3168179 - RNA, 13 nt, Mycobacterium bovis subsp bovis AF2122/97
guguauuggggug

SEQ ID NO: 3168180 - RNA, 15 nt, Mycobacterium bovis subsp bovis AF2122/97
gugucaacgcgcggc

SEQ ID NO: 3168181 - RNA, 19 nt, Mycobacterium bovis subsp bovis AF2122/97
gugucaacgcgcggcucga

SEQ ID NO: 3168182 - RNA, 19 nt, Mycobacterium bovis subsp bovis AF2122/97
gugucaaugugguucgucg

SEQ ID NO: 3168183 - RNA, 16 nt, Mycobacterium bovis subsp bovis AF2122/97
gugucacagugguggg

SEQ ID NO: 3168184 - RNA, 21 nt, Mycobacterium bovis subsp bovis AF2122/97
gugucacccaauggagccgcg

SEQ ID NO: 3168185 - RNA, 13 nt, Mycobacterium bovis subsp bovis AF2122/97
gugucacccucgg

SEQ ID NO: 3168186 - RNA, 12 nt, Mycobacterium bovis subsp bovis AF2122/97
gugucaccggcg

SEQ ID NO: 3168187 - RNA, 13 nt, Mycobacterium bovis subsp bovis AF2122/97
gugucaccggcgu

SEQ ID NO: 3168188 - RNA, 16 nt, Mycobacterium bovis subsp bovis AF2122/97
gugucaccggcgucgc

SEQ ID NO: 3168189 - RNA, 18 nt, Mycobacterium bovis subsp bovis AF2122/97
gugucagcaagaucggca

SEQ ID NO: 3168190 - RNA, 21 nt, Mycobacterium bovis subsp bovis AF2122/97
gugucagcagaugggcgucgg

SEQ ID NO: 3168191 - RNA, 16 nt, Mycobacterium bovis subsp bovis AF2122/97
gugucagcgccacaua

SEQ ID NO: 3168192 - RNA, 20 nt, Mycobacterium bovis subsp bovis AF2122/97
gugucagguaauucguccac

SEQ ID NO: 3168193 - RNA, 19 nt, Mycobacterium bovis subsp bovis AF2122/97
guguccaccaccggcaccc

SEQ ID NO: 3168194 - RNA, 21 nt, Mycobacterium bovis subsp bovis AF2122/97
guguccaccggaccgaccacc

SEQ ID NO: 3168195 - RNA, 17 nt, Mycobacterium bovis subsp bovis AF2122/97
guguccagaacgguggc

SEQ ID NO: 3168196 - RNA, 20 nt, Mycobacterium bovis subsp bovis AF2122/97
guguccccggcugccagcgc

SEQ ID NO: 3168197 - RNA, 23 nt, Mycobacterium bovis subsp bovis AF2122/97
guguccgagcggcccuucaccag

SEQ ID NO: 3168198 - RNA, 12 nt, Mycobacterium bovis subsp bovis AF2122/97
guguccgccgaa

SEQ ID NO: 3168199 - RNA, 21 nt, Mycobacterium bovis subsp bovis AF2122/97
guguccgccggauagcaccgg

SEQ ID NO: 3168200 - RNA, 23 nt, Mycobacterium bovis subsp bovis AF2122/97
guguccgccggauagcaccggca

SEQ ID NO: 3168201 - RNA, 13 nt, Mycobacterium bovis subsp bovis AF2122/97
guguccucgucga

SEQ ID NO: 3168202 - RNA, 16 nt, Mycobacterium bovis subsp bovis AF2122/97
guguccuuggccgcca

SEQ ID NO: 3168203 - RNA, 18 nt, Mycobacterium bovis subsp bovis AF2122/97
gugucgaaaucgauuccg

SEQ ID NO: 3168204 - RNA, 14 nt, Mycobacterium bovis subsp bovis AF2122/97
gugucgacgguguc

SEQ ID NO: 3168205 - RNA, 19 nt, Mycobacterium bovis subsp bovis AF2122/97
gugucgacuccgaucgggc

SEQ ID NO: 3168206 - RNA, 15 nt, Mycobacterium bovis subsp bovis AF2122/97
gugucgaucagcucc

SEQ ID NO: 3168207 - RNA, 19 nt, Mycobacterium bovis subsp bovis AF2122/97
gugucgaugcgcagcccgu

SEQ ID NO: 3168208 - RNA, 14 nt, Mycobacterium bovis subsp bovis AF2122/97
gugucgaugcgcgc

SEQ ID NO: 3168209 - RNA, 15 nt, Mycobacterium bovis subsp bovis AF2122/97
gugucgccacccgcg

SEQ ID NO: 3168210 - RNA, 21 nt, Mycobacterium bovis subsp bovis AF2122/97
gugucgcccuguucggcccga

SEQ ID NO: 3168211 - RNA, 19 nt, Mycobacterium bovis subsp bovis AF2122/97
gugucgccgaucaccgcau

SEQ ID NO: 3168212 - RNA, 20 nt, Mycobacterium bovis subsp bovis AF2122/97
gugucgccgaucaccgcauc

SEQ ID NO: 3168213 - RNA, 14 nt, Mycobacterium bovis subsp bovis AF2122/97
gugucgccgccguu

SEQ ID NO: 3168214 - RNA, 20 nt, Mycobacterium bovis subsp bovis AF2122/97
gugucgccgcucgguccccg

SEQ ID NO: 3168215 - RNA, 23 nt, Mycobacterium bovis subsp bovis AF2122/97
gugucgcugcaaccgccggugcc

SEQ ID NO: 3168216 - RNA, 22 nt, Mycobacterium bovis subsp bovis AF2122/97
gugucgcugcggcgcuggccag

SEQ ID NO: 3168217 - RNA, 13 nt, Mycobacterium bovis subsp bovis AF2122/97
gugucgcugcuga

SEQ ID NO: 3168218 - RNA, 20 nt, Mycobacterium bovis subsp bovis AF2122/97
gugucggaaugggcgccaca

SEQ ID NO: 3168219 - RNA, 13 nt, Mycobacterium bovis subsp bovis AF2122/97
gugucggcgccga

SEQ ID NO: 3168220 - RNA, 14 nt, Mycobacterium bovis subsp bovis AF2122/97
gugucggcgccgaa

SEQ ID NO: 3168221 - RNA, 21 nt, Mycobacterium bovis subsp bovis AF2122/97
gugucggcuggucgcugcugc

SEQ ID NO: 3168222 - RNA, 22 nt, Mycobacterium bovis subsp bovis AF2122/97
gugucgggaacgaguacgggca

SEQ ID NO: 3168223 - RNA, 20 nt, Mycobacterium bovis subsp bovis AF2122/97
gugucggggcccccgccgga

SEQ ID NO: 3168224 - RNA, 23 nt, Mycobacterium bovis subsp bovis AF2122/97
gugucggggcccccgccggacac

SEQ ID NO: 3168225 - RNA, 19 nt, Mycobacterium bovis subsp bovis AF2122/97
gugucgguggccgcggcgg

SEQ ID NO: 3168226 - RNA, 18 nt, Mycobacterium bovis subsp bovis AF2122/97
gugucggugguaccggcg

SEQ ID NO: 3168227 - RNA, 20 nt, Mycobacterium bovis subsp bovis AF2122/97
gugucggugguaccggcggc

SEQ ID NO: 3168228 - RNA, 17 nt, Mycobacterium bovis subsp bovis AF2122/97
gugucguaacugcccgc

SEQ ID NO: 3168229 - RNA, 22 nt, Mycobacterium bovis subsp bovis AF2122/97
gugucguaggcgaugagcgugc

SEQ ID NO: 3168230 - RNA, 12 nt, Mycobacterium bovis subsp bovis AF2122/97
gugucgucgagg

SEQ ID NO: 3168231 - RNA, 18 nt, Mycobacterium bovis subsp bovis AF2122/97
gugucgucgaucgcggac

SEQ ID NO: 3168232 - RNA, 18 nt, Mycobacterium bovis subsp bovis AF2122/97
gugucgucggaccucgcc

SEQ ID NO: 3168233 - RNA, 16 nt, Mycobacterium bovis subsp bovis AF2122/97
guguuguugaagcccg

SEQ ID NO: 3168234 - RNA, 22 nt, Mycobacterium bovis subsp bovis AF2122/97
guguuguugaagggggcgucgu

SEQ ID NO: 3168235 - RNA, 18 nt, Mycobacterium bovis subsp bovis AF2122/97
guguuucgugccaugguu

SEQ ID NO: 3168236 - RNA, 20 nt, Mycobacterium bovis subsp bovis AF2122/97
guguuuuuguauguucggcg

SEQ ID NO: 3168237 - RNA, 18 nt, Mycobacterium bovis subsp bovis AF2122/97
guuaaugacgccauuguu

SEQ ID NO: 3168238 - RNA, 22 nt, Mycobacterium bovis subsp bovis AF2122/97
guuacaccaucaaggacucgga

SEQ ID NO: 3168239 - RNA, 22 nt, Mycobacterium bovis subsp bovis AF2122/97
guuacagaugaaggugacgacg

SEQ ID NO: 3168240 - RNA, 23 nt, Mycobacterium bovis subsp bovis AF2122/97
guuacagaugaaggugacgacga

SEQ ID NO: 3168241 - RNA, 16 nt, Mycobacterium bovis subsp bovis AF2122/97
guuaccaccgucaccg

SEQ ID NO: 3168242 - RNA, 13 nt, Mycobacterium bovis subsp bovis AF2122/97
guuacccaucgcc

SEQ ID NO: 3168243 - RNA, 22 nt, Mycobacterium bovis subsp bovis AF2122/97
guuacccaucgccacacccaaa

SEQ ID NO: 3168244 - RNA, 16 nt, Mycobacterium bovis subsp bovis AF2122/97
guuaccgaaggucauc

SEQ ID NO: 3168245 - RNA, 16 nt, Mycobacterium bovis subsp bovis AF2122/97
guuaccgacgccggug

SEQ ID NO: 3168246 - RNA, 21 nt, Mycobacterium bovis subsp bovis AF2122/97
guuaccgccaaacgcugcgcc

SEQ ID NO: 3168247 - RNA, 14 nt, Mycobacterium bovis subsp bovis AF2122/97
guuaccgccggcgc

SEQ ID NO: 3168248 - RNA, 21 nt, Mycobacterium bovis subsp bovis AF2122/97
guuaccgccggcgccggugcc

SEQ ID NO: 3168249 - RNA, 14 nt, Mycobacterium bovis subsp bovis AF2122/97
guuaccgccgucgc

SEQ ID NO: 3168250 - RNA, 16 nt, Mycobacterium bovis subsp bovis AF2122/97
guuaccgccguugccg

SEQ ID NO: 3168251 - RNA, 15 nt, Mycobacterium bovis subsp bovis AF2122/97
guuacgcucgcgggc

SEQ ID NO: 3168252 - RNA, 13 nt, Mycobacterium bovis subsp bovis AF2122/97
guuacgcucggcg

SEQ ID NO: 3168253 - RNA, 13 nt, Mycobacterium bovis subsp bovis AF2122/97
guuacggagggca

SEQ ID NO: 3168254 - RNA, 20 nt, Mycobacterium bovis subsp bovis AF2122/97
guuacguuguacucgugcgg

SEQ ID NO: 3168255 - RNA, 16 nt, Mycobacterium bovis subsp bovis AF2122/97
guuacucgcagcgccg

SEQ ID NO: 3168256 - RNA, 20 nt, Mycobacterium bovis subsp bovis AF2122/97
guuagaggauggucagcagc

SEQ ID NO: 3168257 - RNA, 19 nt, Mycobacterium bovis subsp bovis AF2122/97
guuagaucacccgcagccg

SEQ ID NO: 3168258 - RNA, 22 nt, Mycobacterium bovis subsp bovis AF2122/97
guuagaucacccgcagccgcgc

SEQ ID NO: 3168259 - RNA, 14 nt, Mycobacterium bovis subsp bovis AF2122/97
guuagcaccaguuc

SEQ ID NO: 3168260 - RNA, 19 nt, Mycobacterium bovis subsp bovis AF2122/97
guuagccaggucgauaccg

SEQ ID NO: 3168261 - RNA, 18 nt, Mycobacterium bovis subsp bovis AF2122/97
guuagccgcggcccgcgu

SEQ ID NO: 3168262 - RNA, 14 nt, Mycobacterium bovis subsp bovis AF2122/97
guuaggguccaggu

SEQ ID NO: 3168263 - RNA, 21 nt, Mycobacterium bovis subsp bovis AF2122/97
guuagguggcuggcugugccg

SEQ ID NO: 3168264 - RNA, 14 nt, Mycobacterium bovis subsp bovis AF2122/97
guuagucggccuga

SEQ ID NO: 3168265 - RNA, 16 nt, Mycobacterium bovis subsp bovis AF2122/97
guuaucagccgcgcgc

SEQ ID NO: 3168266 - RNA, 20 nt, Mycobacterium bovis subsp bovis AF2122/97
guuaucgccgagauccgcgc

SEQ ID NO: 3168267 - RNA, 20 nt, Mycobacterium bovis subsp bovis AF2122/97
guuaugaccucgacgucggg

SEQ ID NO: 3168268 - RNA, 20 nt, Mycobacterium bovis subsp bovis AF2122/97
guuauguauccgcgccgcac

SEQ ID NO: 3168269 - RNA, 14 nt, Mycobacterium bovis subsp bovis AF2122/97
guuauugaugcccg

SEQ ID NO: 3168270 - RNA, 21 nt, Mycobacterium bovis subsp bovis AF2122/97
guucaaccggacgcccucacg

SEQ ID NO: 3168271 - RNA, 14 nt, Mycobacterium bovis subsp bovis AF2122/97
guucaacgaggccg

SEQ ID NO: 3168272 - RNA, 18 nt, Mycobacterium bovis subsp bovis AF2122/97
guucaacgaggccgacga

SEQ ID NO: 3168273 - RNA, 20 nt, Mycobacterium bovis subsp bovis AF2122/97
guucaacgcgcgcacgccac

SEQ ID NO: 3168274 - RNA, 17 nt, Mycobacterium bovis subsp bovis AF2122/97
guucaacuccggcaccg

SEQ ID NO: 3168275 - RNA, 20 nt, Mycobacterium bovis subsp bovis AF2122/97
guucaacuccggcaccggca

SEQ ID NO: 3168276 - RNA, 23 nt, Mycobacterium bovis subsp bovis AF2122/97
guucaacuccggcaccggcaaca

SEQ ID NO: 3168277 - RNA, 18 nt, Mycobacterium bovis subsp bovis AF2122/97
guucaacucgggcagcuu

SEQ ID NO: 3168278 - RNA, 15 nt, Mycobacterium bovis subsp bovis AF2122/97
guucaacuugggguc

SEQ ID NO: 3168279 - RNA, 19 nt, Mycobacterium bovis subsp bovis AF2122/97
guucacaaacggaacagcc

SEQ ID NO: 3168280 - RNA, 22 nt, Mycobacterium bovis subsp bovis AF2122/97
guucacccugccagagaucagc

SEQ ID NO: 3168281 - RNA, 17 nt, Mycobacterium bovis subsp bovis AF2122/97
guucaccgacgcgaacg

SEQ ID NO: 3168282 - RNA, 15 nt, Mycobacterium bovis subsp bovis AF2122/97
guucaccgaggugcc

SEQ ID NO: 3168283 - RNA, 20 nt, Mycobacterium bovis subsp bovis AF2122/97
guucaccgaggugccgcgca

SEQ ID NO: 3168284 - RNA, 21 nt, Mycobacterium bovis subsp bovis AF2122/97
guucaccgaggugccgcgcag

SEQ ID NO: 3168285 - RNA, 19 nt, Mycobacterium bovis subsp bovis AF2122/97
guucaccgcgcgcucgccc

SEQ ID NO: 3168286 - RNA, 16 nt, Mycobacterium bovis subsp bovis AF2122/97
guucaccucggcgacg

SEQ ID NO: 3168287 - RNA, 21 nt, Mycobacterium bovis subsp bovis AF2122/97
guucaccucggcgacgaugau

SEQ ID NO: 3168288 - RNA, 17 nt, Mycobacterium bovis subsp bovis AF2122/97
guucacggggaccagau

SEQ ID NO: 3168289 - RNA, 12 nt, Mycobacterium bovis subsp bovis AF2122/97
guucacgguuga

SEQ ID NO: 3168290 - RNA, 22 nt, Mycobacterium bovis subsp bovis AF2122/97
guucacguucggcgacgcgccg

SEQ ID NO: 3168291 - RNA, 20 nt, Mycobacterium bovis subsp bovis AF2122/97
guucacguucggcgcugcca

SEQ ID NO: 3168292 - RNA, 16 nt, Mycobacterium bovis subsp bovis AF2122/97
guucagcccgaacucg

SEQ ID NO: 3168293 - RNA, 14 nt, Mycobacterium bovis subsp bovis AF2122/97
guucagccugagca

SEQ ID NO: 3168294 - RNA, 22 nt, Mycobacterium bovis subsp bovis AF2122/97
guucagcgccacguccaucacc

SEQ ID NO: 3168295 - RNA, 14 nt, Mycobacterium bovis subsp bovis AF2122/97
guucagcgcuggca

SEQ ID NO: 3168296 - RNA, 17 nt, Mycobacterium bovis subsp bovis AF2122/97
guucagcgcuggcaggc

SEQ ID NO: 3168297 - RNA, 16 nt, Mycobacterium bovis subsp bovis AF2122/97
guucagcuuccgaauc

SEQ ID NO: 3168298 - RNA, 17 nt, Mycobacterium bovis subsp bovis AF2122/97
guucaucacgccgccgg

SEQ ID NO: 3168299 - RNA, 14 nt, Mycobacterium bovis subsp bovis AF2122/97
guucauccacuccg

SEQ ID NO: 3168300 - RNA, 16 nt, Mycobacterium bovis subsp bovis AF2122/97
guucaucgccggcgcg

SEQ ID NO: 3168301 - RNA, 20 nt, Mycobacterium bovis subsp bovis AF2122/97
guucaucgcuauggaugggg

SEQ ID NO: 3168302 - RNA, 20 nt, Mycobacterium bovis subsp bovis AF2122/97
guucaugcaaaagccgcgau

SEQ ID NO: 3168303 - RNA, 22 nt, Mycobacterium bovis subsp bovis AF2122/97
guucaugcggcggcgcucgucg

SEQ ID NO: 3168304 - RNA, 14 nt, Mycobacterium bovis subsp bovis AF2122/97
guuccaacuccugc

SEQ ID NO: 3168305 - RNA, 17 nt, Mycobacterium bovis subsp bovis AF2122/97
guuccaacuccugcagc

SEQ ID NO: 3168306 - RNA, 15 nt, Mycobacterium bovis subsp bovis AF2122/97
guuccacaccaggcc

SEQ ID NO: 3168307 - RNA, 17 nt, Mycobacterium bovis subsp bovis AF2122/97
guuccacccggugccgc

SEQ ID NO: 3168308 - RNA, 18 nt, Mycobacterium bovis subsp bovis AF2122/97
guuccacccggugccgca

SEQ ID NO: 3168309 - RNA, 15 nt, Mycobacterium bovis subsp bovis AF2122/97
guuccacccgguggc

SEQ ID NO: 3168310 - RNA, 18 nt, Mycobacterium bovis subsp bovis AF2122/97
guuccaccgcgcaggugc

SEQ ID NO: 3168311 - RNA, 19 nt, Mycobacterium bovis subsp bovis AF2122/97
guuccaccgcgcaggugcc

SEQ ID NO: 3168312 - RNA, 15 nt, Mycobacterium bovis subsp bovis AF2122/97
guuccaccgggcguc

SEQ ID NO: 3168313 - RNA, 16 nt, Mycobacterium bovis subsp bovis AF2122/97
guuccacgacaaccgu

SEQ ID NO: 3168314 - RNA, 19 nt, Mycobacterium bovis subsp bovis AF2122/97
guuccacgacaaccguagg

SEQ ID NO: 3168315 - RNA, 15 nt, Mycobacterium bovis subsp bovis AF2122/97
guuccacgagucguc

SEQ ID NO: 3168316 - RNA, 21 nt, Mycobacterium bovis subsp bovis AF2122/97
guuccacgagucgucguccga

SEQ ID NO: 3168317 - RNA, 15 nt, Mycobacterium bovis subsp bovis AF2122/97
guuccacgaucaccc

SEQ ID NO: 3168318 - RNA, 23 nt, Mycobacterium bovis subsp bovis AF2122/97
guuccacgccggcaucgucgacg

SEQ ID NO: 3168319 - RNA, 14 nt, Mycobacterium bovis subsp bovis AF2122/97
guucgcugacggcc

SEQ ID NO: 3168320 - RNA, 13 nt, Mycobacterium bovis subsp bovis AF2122/97
guucggagcuggg

SEQ ID NO: 3168321 - RNA, 14 nt, Mycobacterium bovis subsp bovis AF2122/97
guucggagcugggc

SEQ ID NO: 3168322 - RNA, 20 nt, Mycobacterium bovis subsp bovis AF2122/97
guucggaugucucggcacca

SEQ ID NO: 3168323 - RNA, 20 nt, Mycobacterium bovis subsp bovis AF2122/97
guucggcaaugacggccugc

SEQ ID NO: 3168324 - RNA, 17 nt, Mycobacterium bovis subsp bovis AF2122/97
guucggcacaaccaacg

SEQ ID NO: 3168325 - RNA, 19 nt, Mycobacterium bovis subsp bovis AF2122/97
guucggcacaaccaacgac

SEQ ID NO: 3168326 - RNA, 18 nt, Mycobacterium bovis subsp bovis AF2122/97
guucggccaucguccagc

SEQ ID NO: 3168327 - RNA, 21 nt, Mycobacterium bovis subsp bovis AF2122/97
guucggccaucguccagcagg

SEQ ID NO: 3168328 - RNA, 14 nt, Mycobacterium bovis subsp bovis AF2122/97
guucggccauggcg

SEQ ID NO: 3168329 - RNA, 16 nt, Mycobacterium bovis subsp bovis AF2122/97
guucggccauggcggc

SEQ ID NO: 3168330 - RNA, 20 nt, Mycobacterium bovis subsp bovis AF2122/97
guucggccauggcggcgccg

SEQ ID NO: 3168331 - RNA, 17 nt, Mycobacterium bovis subsp bovis AF2122/97
guucggcccgcaaacag

SEQ ID NO: 3168332 - RNA, 17 nt, Mycobacterium bovis subsp bovis AF2122/97
guucggccggagccgcc

SEQ ID NO: 3168333 - RNA, 20 nt, Mycobacterium bovis subsp bovis AF2122/97
guucggccgucauggcccga

SEQ ID NO: 3168334 - RNA, 14 nt, Mycobacterium bovis subsp bovis AF2122/97
guucggcgaugcgc

SEQ ID NO: 3168335 - RNA, 21 nt, Mycobacterium bovis subsp bovis AF2122/97
guucggcguacaaaccgucgg

SEQ ID NO: 3168336 - RNA, 13 nt, Mycobacterium bovis subsp bovis AF2122/97
guucggcgucgac

SEQ ID NO: 3168337 - RNA, 17 nt, Mycobacterium bovis subsp bovis AF2122/97
guucggcgucguugccg

SEQ ID NO: 3168338 - RNA, 19 nt, Mycobacterium bovis subsp bovis AF2122/97
guucggcgucguugccggg

SEQ ID NO: 3168339 - RNA, 15 nt, Mycobacterium bovis subsp bovis AF2122/97
guucggcgugucggg

SEQ ID NO: 3168340 - RNA, 22 nt, Mycobacterium bovis subsp bovis AF2122/97
guucggcuaagccuucgguguc

SEQ ID NO: 3168341 - RNA, 21 nt, Mycobacterium bovis subsp bovis AF2122/97
guucggcugccgcgcgcugcc

SEQ ID NO: 3168342 - RNA, 23 nt, Mycobacterium bovis subsp bovis AF2122/97
guucgggacgaaaaaaucgugcg

SEQ ID NO: 3168343 - RNA, 20 nt, Mycobacterium bovis subsp bovis AF2122/97
guucgggagcugaucacgca

SEQ ID NO: 3168344 - RNA, 14 nt, Mycobacterium bovis subsp bovis AF2122/97
guucgggcaacggc

SEQ ID NO: 3168345 - RNA, 17 nt, Mycobacterium bovis subsp bovis AF2122/97
guucgggcaacggcagc

SEQ ID NO: 3168346 - RNA, 14 nt, Mycobacterium bovis subsp bovis AF2122/97
guucgggcagcacc

SEQ ID NO: 3168347 - RNA, 18 nt, Mycobacterium bovis subsp bovis AF2122/97
guucggggcgcaccacga

SEQ ID NO: 3168348 - RNA, 17 nt, Mycobacterium bovis subsp bovis AF2122/97
guucggggugcgcccag

SEQ ID NO: 3168349 - RNA, 14 nt, Mycobacterium bovis subsp bovis AF2122/97
guucgggguggugg

SEQ ID NO: 3168350 - RNA, 15 nt, Mycobacterium bovis subsp bovis AF2122/97
guucgggguggugga

SEQ ID NO: 3168351 - RNA, 19 nt, Mycobacterium bovis subsp bovis AF2122/97
guucgggucgagccggacc

SEQ ID NO: 3168352 - RNA, 16 nt, Mycobacterium bovis subsp bovis AF2122/97
guucgggucgaucacc

SEQ ID NO: 3168353 - RNA, 20 nt, Mycobacterium bovis subsp bovis AF2122/97
guucgggugguuguucggcc

SEQ ID NO: 3168354 - RNA, 22 nt, Mycobacterium bovis subsp bovis AF2122/97
guucggguuggagaagauuuuc

SEQ ID NO: 3168355 - RNA, 14 nt, Mycobacterium bovis subsp bovis AF2122/97
guucggucagcgcc

SEQ ID NO: 3168356 - RNA, 22 nt, Mycobacterium bovis subsp bovis AF2122/97
guucggucggggagcugcggcg

SEQ ID NO: 3168357 - RNA, 14 nt, Mycobacterium bovis subsp bovis AF2122/97
guucggugagccgg

SEQ ID NO: 3168358 - RNA, 18 nt, Mycobacterium bovis subsp bovis AF2122/97
guucggugagccgggcgg

SEQ ID NO: 3168359 - RNA, 14 nt, Mycobacterium bovis subsp bovis AF2122/97
guucgucgacaccc

SEQ ID NO: 3168360 - RNA, 19 nt, Mycobacterium bovis subsp bovis AF2122/97
guucgucgacgucggcgag

SEQ ID NO: 3168361 - RNA, 20 nt, Mycobacterium bovis subsp bovis AF2122/97
guucgucgacgucggcgagc

SEQ ID NO: 3168362 - RNA, 18 nt, Mycobacterium bovis subsp bovis AF2122/97
guucgucgggacgccgcc

SEQ ID NO: 3168363 - RNA, 17 nt, Mycobacterium bovis subsp bovis AF2122/97
guucgucgguugccacg

SEQ ID NO: 3168364 - RNA, 23 nt, Mycobacterium bovis subsp bovis AF2122/97
guucgucguaguccaggccguag

SEQ ID NO: 3168365 - RNA, 13 nt, Mycobacterium bovis subsp bovis AF2122/97
guucgucgucguc

SEQ ID NO: 3168366 - RNA, 16 nt, Mycobacterium bovis subsp bovis AF2122/97
guucgugagcggccag

SEQ ID NO: 3168367 - RNA, 17 nt, Mycobacterium bovis subsp bovis AF2122/97
guucgugagcggccagg

SEQ ID NO: 3168368 - RNA, 14 nt, Mycobacterium bovis subsp bovis AF2122/97
guucgugcacggcg

SEQ ID NO: 3168369 - RNA, 15 nt, Mycobacterium bovis subsp bovis AF2122/97
guucgugcacggcga

SEQ ID NO: 3168370 - RNA, 23 nt, Mycobacterium bovis subsp bovis AF2122/97
guucgugccggcguugccgaaac

SEQ ID NO: 3168371 - RNA, 19 nt, Mycobacterium bovis subsp bovis AF2122/97
guucguggcuggcaugccg

SEQ ID NO: 3168372 - RNA, 20 nt, Mycobacterium bovis subsp bovis AF2122/97
guucuauuccaugucgucga

SEQ ID NO: 3168373 - RNA, 22 nt, Mycobacterium bovis subsp bovis AF2122/97
guucucaccaccagagacgauc

SEQ ID NO: 3168374 - RNA, 16 nt, Mycobacterium bovis subsp bovis AF2122/97
guucuccccgcuagcc

SEQ ID NO: 3168375 - RNA, 19 nt, Mycobacterium bovis subsp bovis AF2122/97
guucuccugcucguccacc

SEQ ID NO: 3168376 - RNA, 14 nt, Mycobacterium bovis subsp bovis AF2122/97
guucucgagcucgg

SEQ ID NO: 3168377 - RNA, 20 nt, Mycobacterium bovis subsp bovis AF2122/97
guucucgagcucggcgaacg

SEQ ID NO: 3168378 - RNA, 16 nt, Mycobacterium bovis subsp bovis AF2122/97
guucucgcccacccgc

SEQ ID NO: 3168379 - RNA, 22 nt, Mycobacterium bovis subsp bovis AF2122/97
guucucgcuguugaagccgccc

SEQ ID NO: 3168380 - RNA, 13 nt, Mycobacterium bovis subsp bovis AF2122/97
guucucggugcgc

SEQ ID NO: 3168381 - RNA, 17 nt, Mycobacterium bovis subsp bovis AF2122/97
guucugcgcccacccgc

SEQ ID NO: 3168382 - RNA, 17 nt, Mycobacterium bovis subsp bovis AF2122/97
guucugcgcccguccgc

SEQ ID NO: 3168383 - RNA, 23 nt, Mycobacterium bovis subsp bovis AF2122/97
guucugcgcucccguacgccggc

SEQ ID NO: 3168384 - RNA, 22 nt, Mycobacterium bovis subsp bovis AF2122/97
guucugcggccgcgugccgccc

SEQ ID NO: 3168385 - RNA, 22 nt, Mycobacterium bovis subsp bovis AF2122/97
guucugcuggauguaguuggcg

SEQ ID NO: 3168386 - RNA, 16 nt, Mycobacterium bovis subsp bovis AF2122/97
guucugcuggcugugg

SEQ ID NO: 3168387 - RNA, 23 nt, Mycobacterium bovis subsp bovis AF2122/97
guucugggaccgauaaguucggc

SEQ ID NO: 3168388 - RNA, 16 nt, Mycobacterium bovis subsp bovis AF2122/97
guucuucuccaccacc

SEQ ID NO: 3168389 - RNA, 17 nt, Mycobacterium bovis subsp bovis AF2122/97
guucuucuccaccaccg

SEQ ID NO: 3168390 - RNA, 22 nt, Mycobacterium bovis subsp bovis AF2122/97
guucuucuccaccaccgucgag

SEQ ID NO: 3168391 - RNA, 22 nt, Mycobacterium bovis subsp bovis AF2122/97
guucuucugcgccacgucgacg

SEQ ID NO: 3168392 - RNA, 14 nt, Mycobacterium bovis subsp bovis AF2122/97
guucuuggcgaccu

SEQ ID NO: 3168393 - RNA, 21 nt, Mycobacterium bovis subsp bovis AF2122/97
guucuuuugcgucugcuggcg

SEQ ID NO: 3168394 - RNA, 20 nt, Mycobacterium bovis subsp bovis AF2122/97
guugaaaacgcccggcacac

SEQ ID NO: 3168395 - RNA, 16 nt, Mycobacterium bovis subsp bovis AF2122/97
guugaaaaggcgcugg

SEQ ID NO: 3168396 - RNA, 23 nt, Mycobacterium bovis subsp bovis AF2122/97
guugaaauugaugaucugcagcu

SEQ ID NO: 3168397 - RNA, 21 nt, Mycobacterium bovis subsp bovis AF2122/97
guugaacaauccgguguugag

SEQ ID NO: 3168398 - RNA, 21 nt, Mycobacterium bovis subsp bovis AF2122/97
guugaacccuuccccgucggg

SEQ ID NO: 3168399 - RNA, 18 nt, Mycobacterium bovis subsp bovis AF2122/97
guugaacgccgccagcag

SEQ ID NO: 3168400 - RNA, 17 nt, Mycobacterium bovis subsp bovis AF2122/97
guugaacggcaccagcg

SEQ ID NO: 3168401 - RNA, 16 nt, Mycobacterium bovis subsp bovis AF2122/97
guugaacucgaccacc

SEQ ID NO: 3168402 - RNA, 16 nt, Mycobacterium bovis subsp bovis AF2122/97
guugaagaaagcggcc

SEQ ID NO: 3168403 - RNA, 14 nt, Mycobacterium bovis subsp bovis AF2122/97
guugaagaagcccg

SEQ ID NO: 3168404 - RNA, 22 nt, Mycobacterium bovis subsp bovis AF2122/97
guugaagaagcccgaguuguuc

SEQ ID NO: 3168405 - RNA, 14 nt, Mycobacterium bovis subsp bovis AF2122/97
guugccccgaagcg

SEQ ID NO: 3168406 - RNA, 15 nt, Mycobacterium bovis subsp bovis AF2122/97
guugccccggcgacc

SEQ ID NO: 3168407 - RNA, 15 nt, Mycobacterium bovis subsp bovis AF2122/97
guugccccggucggc

SEQ ID NO: 3168408 - RNA, 18 nt, Mycobacterium bovis subsp bovis AF2122/97
guugccccggucggcgac

SEQ ID NO: 3168409 - RNA, 19 nt, Mycobacterium bovis subsp bovis AF2122/97
guugccccggucggcgacg

SEQ ID NO: 3168410 - RNA, 20 nt, Mycobacterium bovis subsp bovis AF2122/97
guugccccggucggcgacgu

SEQ ID NO: 3168411 - RNA, 16 nt, Mycobacterium bovis subsp bovis AF2122/97
guugcccgacccgccg

SEQ ID NO: 3168412 - RNA, 17 nt, Mycobacterium bovis subsp bovis AF2122/97
guugcccgacccgccga

SEQ ID NO: 3168413 - RNA, 22 nt, Mycobacterium bovis subsp bovis AF2122/97
guugcccgacccgccgacgccg

SEQ ID NO: 3168414 - RNA, 18 nt, Mycobacterium bovis subsp bovis AF2122/97
guugcccgacgccgguca

SEQ ID NO: 3168415 - RNA, 17 nt, Mycobacterium bovis subsp bovis AF2122/97
guugccgaagcccgagc

SEQ ID NO: 3168416 - RNA, 23 nt, Mycobacterium bovis subsp bovis AF2122/97
guugccgacgaucgacgccgcca

SEQ ID NO: 3168417 - RNA, 21 nt, Mycobacterium bovis subsp bovis AF2122/97
guugccgacgcucacgcugcu

SEQ ID NO: 3168418 - RNA, 18 nt, Mycobacterium bovis subsp bovis AF2122/97
guugccgaucaacccccc

SEQ ID NO: 3168419 - RNA, 16 nt, Mycobacterium bovis subsp bovis AF2122/97
guugccgaucaccacg

SEQ ID NO: 3168420 - RNA, 14 nt, Mycobacterium bovis subsp bovis AF2122/97
guugccgaucagcc

SEQ ID NO: 3168421 - RNA, 22 nt, Mycobacterium bovis subsp bovis AF2122/97
guugccgauccccaggccgcuu

SEQ ID NO: 3168422 - RNA, 16 nt, Mycobacterium bovis subsp bovis AF2122/97
guugccgaucccggcg

SEQ ID NO: 3168423 - RNA, 18 nt, Mycobacterium bovis subsp bovis AF2122/97
guugccgaucccggcgag

SEQ ID NO: 3168424 - RNA, 19 nt, Mycobacterium bovis subsp bovis AF2122/97
guugccgaucccggcgagc

SEQ ID NO: 3168425 - RNA, 17 nt, Mycobacterium bovis subsp bovis AF2122/97
guugccgcaccagucgc

SEQ ID NO: 3168426 - RNA, 15 nt, Mycobacterium bovis subsp bovis AF2122/97
guugccgccaucacc

SEQ ID NO: 3168427 - RNA, 19 nt, Mycobacterium bovis subsp bovis AF2122/97
guugccgccaucaccgccg

SEQ ID NO: 3168428 - RNA, 16 nt, Mycobacterium bovis subsp bovis AF2122/97
guugccgccgaagccg

SEQ ID NO: 3168429 - RNA, 13 nt, Mycobacterium bovis subsp bovis AF2122/97
guugccgccgacu

SEQ ID NO: 3168430 - RNA, 23 nt, Mycobacterium bovis subsp bovis AF2122/97
guugccgccgccuccgccgaggc

SEQ ID NO: 3168431 - RNA, 22 nt, Mycobacterium bovis subsp bovis AF2122/97
guugccgccgcggcgcccggcg

SEQ ID NO: 3168432 - RNA, 17 nt, Mycobacterium bovis subsp bovis AF2122/97
guugccgccggcgccgc

SEQ ID NO: 3168433 - RNA, 19 nt, Mycobacterium bovis subsp bovis AF2122/97
guugccgccggcgccgccg

SEQ ID NO: 3168434 - RNA, 13 nt, Mycobacterium bovis subsp bovis AF2122/97
guugccgccggug

SEQ ID NO: 3168435 - RNA, 15 nt, Mycobacterium bovis subsp bovis AF2122/97
guugccgccggugcc

SEQ ID NO: 3168436 - RNA, 14 nt, Mycobacterium bovis subsp bovis AF2122/97
guugccgccgucgc

SEQ ID NO: 3168437 - RNA, 19 nt, Mycobacterium bovis subsp bovis AF2122/97
guugccgccgucgccgccg

SEQ ID NO: 3168438 - RNA, 14 nt, Mycobacterium bovis subsp bovis AF2122/97
guugccgccgucgu

SEQ ID NO: 3168439 - RNA, 21 nt, Mycobacterium bovis subsp bovis AF2122/97
guugccgccguugccgccauu

SEQ ID NO: 3168440 - RNA, 19 nt, Mycobacterium bovis subsp bovis AF2122/97
guugccgcggucggcgacg

SEQ ID NO: 3168441 - RNA, 20 nt, Mycobacterium bovis subsp bovis AF2122/97
guugccgcugaauuggcgcc

SEQ ID NO: 3168442 - RNA, 16 nt, Mycobacterium bovis subsp bovis AF2122/97
guugccggacaaccug

SEQ ID NO: 3168443 - RNA, 18 nt, Mycobacterium bovis subsp bovis AF2122/97
guugccggacaaccuggg

SEQ ID NO: 3168444 - RNA, 19 nt, Mycobacterium bovis subsp bovis AF2122/97
guugccggaguugucgacg

SEQ ID NO: 3168445 - RNA, 13 nt, Mycobacterium bovis subsp bovis AF2122/97
guugccggcggcg

SEQ ID NO: 3168446 - RNA, 16 nt, Mycobacterium bovis subsp bovis AF2122/97
guugccggcggcgacg

SEQ ID NO: 3168447 - RNA, 22 nt, Mycobacterium bovis subsp bovis AF2122/97
guugccggcguugccgccgucc

SEQ ID NO: 3168448 - RNA, 21 nt, Mycobacterium bovis subsp bovis AF2122/97
guugccgggguuggucgucgc

SEQ ID NO: 3168449 - RNA, 23 nt, Mycobacterium bovis subsp bovis AF2122/97
guugccggucaggcaguccaccg

SEQ ID NO: 3168450 - RNA, 16 nt, Mycobacterium bovis subsp bovis AF2122/97
guugccguccaccgau

SEQ ID NO: 3168451 - RNA, 18 nt, Mycobacterium bovis subsp bovis AF2122/97
guugccgucggcguacag

SEQ ID NO: 3168452 - RNA, 16 nt, Mycobacterium bovis subsp bovis AF2122/97
guugccgucgucgccg

SEQ ID NO: 3168453 - RNA, 16 nt, Mycobacterium bovis subsp bovis AF2122/97
guugccguuggugccg

SEQ ID NO: 3168454 - RNA, 18 nt, Mycobacterium bovis subsp bovis AF2122/97
guugccuuguucgcccac

SEQ ID NO: 3168455 - RNA, 19 nt, Mycobacterium bovis subsp bovis AF2122/97
guugcgaagaagaaggcga

SEQ ID NO: 3168456 - RNA, 17 nt, Mycobacterium bovis subsp bovis AF2122/97
guugcgaccauccgagu

SEQ ID NO: 3168457 - RNA, 20 nt, Mycobacterium bovis subsp bovis AF2122/97
guugcgaucugcggcgcccg

SEQ ID NO: 3168458 - RNA, 16 nt, Mycobacterium bovis subsp bovis AF2122/97
guugcgcaagcuggua

SEQ ID NO: 3168459 - RNA, 20 nt, Mycobacterium bovis subsp bovis AF2122/97
guugcgcauaggcgaucguc

SEQ ID NO: 3168460 - RNA, 19 nt, Mycobacterium bovis subsp bovis AF2122/97
guugcgccgaccggccacg

SEQ ID NO: 3168461 - RNA, 17 nt, Mycobacterium bovis subsp bovis AF2122/97
guugcgcgaugggagcc

SEQ ID NO: 3168462 - RNA, 13 nt, Mycobacterium bovis subsp bovis AF2122/97
guugcgcgguagc

SEQ ID NO: 3168463 - RNA, 20 nt, Mycobacterium bovis subsp bovis AF2122/97
guugcgcgguagcucgucga

SEQ ID NO: 3168464 - RNA, 16 nt, Mycobacterium bovis subsp bovis AF2122/97
guugcgcucacccggu

SEQ ID NO: 3168465 - RNA, 23 nt, Mycobacterium bovis subsp bovis AF2122/97
guugcgcuccaacaacuccagca

SEQ ID NO: 3168466 - RNA, 20 nt, Mycobacterium bovis subsp bovis AF2122/97
guugcggaaucagcacccca

SEQ ID NO: 3168467 - RNA, 21 nt, Mycobacterium bovis subsp bovis AF2122/97
guugcggaaucagcaccccau

SEQ ID NO: 3168468 - RNA, 14 nt, Mycobacterium bovis subsp bovis AF2122/97
guugcggcagcugg

SEQ ID NO: 3168469 - RNA, 14 nt, Mycobacterium bovis subsp bovis AF2122/97
guugcggccgucga

SEQ ID NO: 3168470 - RNA, 15 nt, Mycobacterium bovis subsp bovis AF2122/97
guugcggccgucgau

SEQ ID NO: 3168471 - RNA, 21 nt, Mycobacterium bovis subsp bovis AF2122/97
guugcggcugcguuggcuggu

SEQ ID NO: 3168472 - RNA, 13 nt, Mycobacterium bovis subsp bovis AF2122/97
guugcgggccagg

SEQ ID NO: 3168473 - RNA, 14 nt, Mycobacterium bovis subsp bovis AF2122/97
guugcgggccaggc

SEQ ID NO: 3168474 - RNA, 15 nt, Mycobacterium bovis subsp bovis AF2122/97
guugcgggccaggcc

SEQ ID NO: 3168475 - RNA, 23 nt, Mycobacterium bovis subsp bovis AF2122/97
guugcgggccaggcccucgacgg

SEQ ID NO: 3168476 - RNA, 14 nt, Mycobacterium bovis subsp bovis AF2122/97
guugcgggcgugga

SEQ ID NO: 3168477 - RNA, 13 nt, Mycobacterium bovis subsp bovis AF2122/97
guugcggucaccg

SEQ ID NO: 3168478 - RNA, 17 nt, Mycobacterium bovis subsp bovis AF2122/97
guugcggucaucggcgc

SEQ ID NO: 3168479 - RNA, 14 nt, Mycobacterium bovis subsp bovis AF2122/97
guugcggugugccg

SEQ ID NO: 3168480 - RNA, 17 nt, Mycobacterium bovis subsp bovis AF2122/97
guugcggugugccgaga

SEQ ID NO: 3168481 - RNA, 22 nt, Mycobacterium bovis subsp bovis AF2122/97
guugcguucggucagugggacg

SEQ ID NO: 3168482 - RNA, 16 nt, Mycobacterium bovis subsp bovis AF2122/97
guugcguuggcgccac

SEQ ID NO: 3168483 - RNA, 16 nt, Mycobacterium bovis subsp bovis AF2122/97
guugcguuguccacca

SEQ ID NO: 3168484 - RNA, 18 nt, Mycobacterium bovis subsp bovis AF2122/97
guugcguuguccaccauc

SEQ ID NO: 3168485 - RNA, 19 nt, Mycobacterium bovis subsp bovis AF2122/97
guugcucccacggcaccca

SEQ ID NO: 3168486 - RNA, 21 nt, Mycobacterium bovis subsp bovis AF2122/97
guugcucgagcgguggcgucg

SEQ ID NO: 3168487 - RNA, 18 nt, Mycobacterium bovis subsp bovis AF2122/97
guugcucggccgaugcgc

SEQ ID NO: 3168488 - RNA, 13 nt, Mycobacterium bovis subsp bovis AF2122/97
guugcucggucuc

SEQ ID NO: 3168489 - RNA, 19 nt, Mycobacterium bovis subsp bovis AF2122/97
guugcucguccaagccggc

SEQ ID NO: 3168490 - RNA, 19 nt, Mycobacterium bovis subsp bovis AF2122/97
guugcugaacugguuggug

SEQ ID NO: 3168491 - RNA, 17 nt, Mycobacterium bovis subsp bovis AF2122/97
guuguagauucccgaga

SEQ ID NO: 3168492 - RNA, 23 nt, Mycobacterium bovis subsp bovis AF2122/97
guuguagcccaaaaacggcagca

SEQ ID NO: 3168493 - RNA, 18 nt, Mycobacterium bovis subsp bovis AF2122/97
guuguaguccgcgccgac

SEQ ID NO: 3168494 - RNA, 20 nt, Mycobacterium bovis subsp bovis AF2122/97
guuguaguccgcgccgacgg

SEQ ID NO: 3168495 - RNA, 20 nt, Mycobacterium bovis subsp bovis AF2122/97
guugucagcgaacggccagg

SEQ ID NO: 3168496 - RNA, 21 nt, Mycobacterium bovis subsp bovis AF2122/97
guuguccaccgccaccacggu

SEQ ID NO: 3168497 - RNA, 22 nt, Mycobacterium bovis subsp bovis AF2122/97
guuguccagaacggcgaucacc

SEQ ID NO: 3168498 - RNA, 16 nt, Mycobacterium bovis subsp bovis AF2122/97
guuguccagcgcgacg

SEQ ID NO: 3168499 - RNA, 22 nt, Mycobacterium bovis subsp bovis AF2122/97
guuguccagcgcgacguccacc

SEQ ID NO: 3168500 - RNA, 22 nt, Mycobacterium bovis subsp bovis AF2122/97
guuguccagcgucucgaucacc

SEQ ID NO: 3168501 - RNA, 23 nt, Mycobacterium bovis subsp bovis AF2122/97
guuguccaggaauuccccaccgu

SEQ ID NO: 3168502 - RNA, 23 nt, Mycobacterium bovis subsp bovis AF2122/97
guuguccgcggccaacguacauc

SEQ ID NO: 3168503 - RNA, 15 nt, Mycobacterium bovis subsp bovis AF2122/97
guuguccucggcgau

SEQ ID NO: 3168504 - RNA, 23 nt, Mycobacterium bovis subsp bovis AF2122/97
guuguccuucagccaguccagcg

SEQ ID NO: 3168505 - RNA, 19 nt, Mycobacterium bovis subsp bovis AF2122/97
guugucgacgaagguggcg

SEQ ID NO: 3168506 - RNA, 16 nt, Mycobacterium bovis subsp bovis AF2122/97
guugucgacggucggc

SEQ ID NO: 3168507 - RNA, 22 nt, Mycobacterium bovis subsp bovis AF2122/97
guugucgaucagaaucugccuc

SEQ ID NO: 3168508 - RNA, 20 nt, Mycobacterium bovis subsp bovis AF2122/97
guugucgggggcguggccgu

SEQ ID NO: 3168509 - RNA, 13 nt, Mycobacterium bovis subsp bovis AF2122/97
guugucguccaac

SEQ ID NO: 3168510 - RNA, 16 nt, Mycobacterium bovis subsp bovis AF2122/97
guugucgucgccgccg

SEQ ID NO: 3168511 - RNA, 18 nt, Mycobacterium bovis subsp bovis AF2122/97
guugucuuucacaugcgc

SEQ ID NO: 3168512 - RNA, 14 nt, Mycobacterium bovis subsp bovis AF2122/97
guugugauccggug

SEQ ID NO: 3168513 - RNA, 21 nt, Mycobacterium bovis subsp bovis AF2122/97
guugugcagaucgucgccgau

SEQ ID NO: 3168514 - RNA, 16 nt, Mycobacterium bovis subsp bovis AF2122/97
guugugccgcaagccu

SEQ ID NO: 3168515 - RNA, 13 nt, Mycobacterium bovis subsp bovis AF2122/97
guugugcggcguu

SEQ ID NO: 3168516 - RNA, 13 nt, Mycobacterium bovis subsp bovis AF2122/97
guugugcguccuc

SEQ ID NO: 3168517 - RNA, 14 nt, Mycobacterium bovis subsp bovis AF2122/97
guugugcucgguga

SEQ ID NO: 3168518 - RNA, 18 nt, Mycobacterium bovis subsp bovis AF2122/97
guuguggaaccacggcgc

SEQ ID NO: 3168519 - RNA, 14 nt, Mycobacterium bovis subsp bovis AF2122/97
guuguucaccgacg

SEQ ID NO: 3168520 - RNA, 20 nt, Mycobacterium bovis subsp bovis AF2122/97
guuguucaccgacgcgaacg

SEQ ID NO: 3168521 - RNA, 20 nt, Mycobacterium bovis subsp bovis AF2122/97
guuguucgacugcagaaaca

SEQ ID NO: 3168522 - RNA, 19 nt, Mycobacterium bovis subsp bovis AF2122/97
guuguugaagggggcgucg

SEQ ID NO: 3168523 - RNA, 20 nt, Mycobacterium bovis subsp bovis AF2122/97
guuguugacagacacagcac

SEQ ID NO: 3168524 - RNA, 14 nt, Mycobacterium bovis subsp bovis AF2122/97
guuguuggccagac

SEQ ID NO: 3168525 - RNA, 15 nt, Mycobacterium bovis subsp bovis AF2122/97
guuguugucgguguc

SEQ ID NO: 3168526 - RNA, 20 nt, Mycobacterium bovis subsp bovis AF2122/97
guuuacccgcauggacgcga

SEQ ID NO: 3168527 - RNA, 14 nt, Mycobacterium bovis subsp bovis AF2122/97
guuuacggcccggc

SEQ ID NO: 3168528 - RNA, 22 nt, Mycobacterium bovis subsp bovis AF2122/97
guuuagcaacuacucauccaga

SEQ ID NO: 3168529 - RNA, 18 nt, Mycobacterium bovis subsp bovis AF2122/97
guuuaggcgauucugcgu

SEQ ID NO: 3168530 - RNA, 16 nt, Mycobacterium bovis subsp bovis AF2122/97
guuucacauuuuuguu

SEQ ID NO: 3168531 - RNA, 17 nt, Mycobacterium bovis subsp bovis AF2122/97
guuucacauuuuuguug

SEQ ID NO: 3168532 - RNA, 19 nt, Mycobacterium bovis subsp bovis AF2122/97
guuucaccacucggucguu

SEQ ID NO: 3168533 - RNA, 16 nt, Mycobacterium bovis subsp bovis AF2122/97
guuucauuccugguua

SEQ ID NO: 3168534 - RNA, 20 nt, Mycobacterium bovis subsp bovis AF2122/97
guuuccaagucggagcgggg

SEQ ID NO: 3168535 - RNA, 20 nt, Mycobacterium bovis subsp bovis AF2122/97
guuuccgaaacccgccgcga

SEQ ID NO: 3168536 - RNA, 14 nt, Mycobacterium bovis subsp bovis AF2122/97
guuuccgccgccgc

SEQ ID NO: 3168537 - RNA, 19 nt, Mycobacterium bovis subsp bovis AF2122/97
guuuccgccgccgccgcca

SEQ ID NO: 3168538 - RNA, 21 nt, Mycobacterium bovis subsp bovis AF2122/97
guuuccgccgccgccgccauc

SEQ ID NO: 3168539 - RNA, 19 nt, Mycobacterium bovis subsp bovis AF2122/97
guuuccggccugcacggcg

SEQ ID NO: 3168540 - RNA, 15 nt, Mycobacterium bovis subsp bovis AF2122/97
guuuccucagcugcu

SEQ ID NO: 3168541 - RNA, 19 nt, Mycobacterium bovis subsp bovis AF2122/97
guuuccuccggcagcagca

SEQ ID NO: 3168542 - RNA, 18 nt, Mycobacterium bovis subsp bovis AF2122/97
guuucgcucgcaccgccc

SEQ ID NO: 3168543 - RNA, 20 nt, Mycobacterium bovis subsp bovis AF2122/97
guuucggcgcaugugaaaga

SEQ ID NO: 3168544 - RNA, 19 nt, Mycobacterium bovis subsp bovis AF2122/97
guuucggugguaacggggc

SEQ ID NO: 3168545 - RNA, 14 nt, Mycobacterium bovis subsp bovis AF2122/97
guuucguccccaga

SEQ ID NO: 3168546 - RNA, 17 nt, Mycobacterium bovis subsp bovis AF2122/97
guuucguccccagaccg

SEQ ID NO: 3168547 - RNA, 20 nt, Mycobacterium bovis subsp bovis AF2122/97
guuucguccccagaccggcg

SEQ ID NO: 3168548 - RNA, 20 nt, Mycobacterium bovis subsp bovis AF2122/97
guuucugagcgcgcuggcca

SEQ ID NO: 3168549 - RNA, 18 nt, Mycobacterium bovis subsp bovis AF2122/97
guuugaacuucgccgucc

SEQ ID NO: 3168550 - RNA, 15 nt, Mycobacterium bovis subsp bovis AF2122/97
guuugaccaccuggu

SEQ ID NO: 3168551 - RNA, 15 nt, Mycobacterium bovis subsp bovis AF2122/97
guuugacgccgauga

SEQ ID NO: 3168552 - RNA, 16 nt, Mycobacterium bovis subsp bovis AF2122/97
guuugacgcgcucgcg

SEQ ID NO: 3168553 - RNA, 17 nt, Mycobacterium bovis subsp bovis AF2122/97
guuugacgcgcucgcgc

SEQ ID NO: 3168554 - RNA, 19 nt, Mycobacterium bovis subsp bovis AF2122/97
guuugacguccagggccac

SEQ ID NO: 3168555 - RNA, 19 nt, Mycobacterium bovis subsp bovis AF2122/97
guuugaggcagcguagugc

SEQ ID NO: 3168556 - RNA, 20 nt, Mycobacterium bovis subsp bovis AF2122/97
guuugaucaccgugguggcg

SEQ ID NO: 3168557 - RNA, 14 nt, Mycobacterium bovis subsp bovis AF2122/97
guuugaucgcaacg

SEQ ID NO: 3168558 - RNA, 17 nt, Mycobacterium bovis subsp bovis AF2122/97
guuugaugcgggcggca

SEQ ID NO: 3168559 - RNA, 19 nt, Mycobacterium bovis subsp bovis AF2122/97
guuugaugcgggcggcaag

SEQ ID NO: 3168560 - RNA, 16 nt, Mycobacterium bovis subsp bovis AF2122/97
guuugcacgcaccaca

SEQ ID NO: 3168561 - RNA, 20 nt, Mycobacterium bovis subsp bovis AF2122/97
guuugcacgcaccacaaucc

SEQ ID NO: 3168562 - RNA, 17 nt, Mycobacterium bovis subsp bovis AF2122/97
guuugcacuguucgcgg

SEQ ID NO: 3168563 - RNA, 20 nt, Mycobacterium bovis subsp bovis AF2122/97
guuugcacuguucgcgguga

SEQ ID NO: 3168564 - RNA, 16 nt, Mycobacterium bovis subsp bovis AF2122/97
guuugcagcgggauca

SEQ ID NO: 3168565 - RNA, 23 nt, Mycobacterium bovis subsp bovis AF2122/97
guuugccaucgggaccggggacg

SEQ ID NO: 3168566 - RNA, 22 nt, Mycobacterium bovis subsp bovis AF2122/97
guuugccgauggaugggcugcg

SEQ ID NO: 3168567 - RNA, 16 nt, Mycobacterium bovis subsp bovis AF2122/97
guuugccggcgguggc

SEQ ID NO: 3168568 - RNA, 13 nt, Mycobacterium bovis subsp bovis AF2122/97
guuugccggugcg

SEQ ID NO: 3168569 - RNA, 18 nt, Mycobacterium bovis subsp bovis AF2122/97
guuugccggugcgguggu

SEQ ID NO: 3168570 - RNA, 14 nt, Mycobacterium bovis subsp bovis AF2122/97
guuugcgaagccca

SEQ ID NO: 3168571 - RNA, 13 nt, Mycobacterium bovis subsp bovis AF2122/97
guuugcgacgacg

SEQ ID NO: 3168572 - RNA, 14 nt, Mycobacterium bovis subsp bovis AF2122/97
guuugcguccuggu

SEQ ID NO: 3168573 - RNA, 11 nt, Mycobacterium bovis subsp bovis AF2122/97
guuuggccagu

SEQ ID NO: 3168574 - RNA, 20 nt, Mycobacterium bovis subsp bovis AF2122/97
guuuggccgacagccaccgc

SEQ ID NO: 3168575 - RNA, 12 nt, Mycobacterium bovis subsp bovis AF2122/97
guuuggccgccg

SEQ ID NO: 3168576 - RNA, 17 nt, Mycobacterium bovis subsp bovis AF2122/97
guuuggcgugccgucgc

SEQ ID NO: 3168577 - RNA, 13 nt, Mycobacterium bovis subsp bovis AF2122/97
uaaucguuccgca

SEQ ID NO: 3168578 - RNA, 19 nt, Mycobacterium bovis subsp bovis AF2122/97
uaauggcgccaccggccgc

SEQ ID NO: 3168579 - RNA, 23 nt, Mycobacterium bovis subsp bovis AF2122/97
uaauucaacagcaccgcgacgac

SEQ ID NO: 3168580 - RNA, 13 nt, Mycobacterium bovis subsp bovis AF2122/97
uaauugccgaccg

SEQ ID NO: 3168581 - RNA, 15 nt, Mycobacterium bovis subsp bovis AF2122/97
uaauuggcaacacag

SEQ ID NO: 3168582 - RNA, 21 nt, Mycobacterium bovis subsp bovis AF2122/97
uacaacacagaacucaccgac

SEQ ID NO: 3168583 - RNA, 22 nt, Mycobacterium bovis subsp bovis AF2122/97
uacaacacagaacucaccgacg

SEQ ID NO: 3168584 - RNA, 19 nt, Mycobacterium bovis subsp bovis AF2122/97
uacaacagcgucuggccgu

SEQ ID NO: 3168585 - RNA, 21 nt, Mycobacterium bovis subsp bovis AF2122/97
uacaaccacccacccgcacca

SEQ ID NO: 3168586 - RNA, 15 nt, Mycobacterium bovis subsp bovis AF2122/97
uacaaccugaugcuc

SEQ ID NO: 3168587 - RNA, 24 nt, Mycobacterium bovis subsp bovis AF2122/97
uacaacgccgucgucguagaacug

SEQ ID NO: 3168588 - RNA, 20 nt, Mycobacterium bovis subsp bovis AF2122/97
uacacagcaugguuagcggu

SEQ ID NO: 3168589 - RNA, 23 nt, Mycobacterium bovis subsp bovis AF2122/97
uacacaggaagcguugucgccca

SEQ ID NO: 3168590 - RNA, 21 nt, Mycobacterium bovis subsp bovis AF2122/97
uacacaucgucacugccaccu

SEQ ID NO: 3168591 - RNA, 14 nt, Mycobacterium bovis subsp bovis AF2122/97
uacacccaacucau

SEQ ID NO: 3168592 - RNA, 22 nt, Mycobacterium bovis subsp bovis AF2122/97
uacaccgacgggauauccgguc

SEQ ID NO: 3168593 - RNA, 12 nt, Mycobacterium bovis subsp bovis AF2122/97
uacaccgcccgg

SEQ ID NO: 3168594 - RNA, 15 nt, Mycobacterium bovis subsp bovis AF2122/97
uacaccgcccggccc

SEQ ID NO: 3168595 - RNA, 13 nt, Mycobacterium bovis subsp bovis AF2122/97
uacaccggcugga

SEQ ID NO: 3168596 - RNA, 16 nt, Mycobacterium bovis subsp bovis AF2122/97
uacaccgugcgccgaa

SEQ ID NO: 3168597 - RNA, 15 nt, Mycobacterium bovis subsp bovis AF2122/97
uacagcaauccgcaa

SEQ ID NO: 3168598 - RNA, 16 nt, Mycobacterium bovis subsp bovis AF2122/97
uacagcacauccagcc

SEQ ID NO: 3168599 - RNA, 18 nt, Mycobacterium bovis subsp bovis AF2122/97
uacagcaccccgccgggg

SEQ ID NO: 3168600 - RNA, 23 nt, Mycobacterium bovis subsp bovis AF2122/97
uacagcgcaaagcccuccucgau

SEQ ID NO: 3168601 - RNA, 13 nt, Mycobacterium bovis subsp bovis AF2122/97
uacagcgccaggg

SEQ ID NO: 3168602 - RNA, 22 nt, Mycobacterium bovis subsp bovis AF2122/97
uacagcgcccggauguccgccg

SEQ ID NO: 3168603 - RNA, 16 nt, Mycobacterium bovis subsp bovis AF2122/97
uacagcgcguuggcga

SEQ ID NO: 3168604 - RNA, 14 nt, Mycobacterium bovis subsp bovis AF2122/97
uacagcgggauccc

SEQ ID NO: 3168605 - RNA, 18 nt, Mycobacterium bovis subsp bovis AF2122/97
uacagcgggaucccgauc

SEQ ID NO: 3168606 - RNA, 22 nt, Mycobacterium bovis subsp bovis AF2122/97
uacagcgggaucccgaucguga

SEQ ID NO: 3168607 - RNA, 19 nt, Mycobacterium bovis subsp bovis AF2122/97
uacagcucggugcacggcg

SEQ ID NO: 3168608 - RNA, 17 nt, Mycobacterium bovis subsp bovis AF2122/97
uacagcuugaucgccga

SEQ ID NO: 3168609 - RNA, 21 nt, Mycobacterium bovis subsp bovis AF2122/97
uacagcuugaucgccgaggcc

SEQ ID NO: 3168610 - RNA, 19 nt, Mycobacterium bovis subsp bovis AF2122/97
uacaggaagucgcggacgu

SEQ ID NO: 3168611 - RNA, 22 nt, Mycobacterium bovis subsp bovis AF2122/97
uacaggcccgccagcagggcca

SEQ ID NO: 3168612 - RNA, 23 nt, Mycobacterium bovis subsp bovis AF2122/97
uacaggcccgccagcagggccag

SEQ ID NO: 3168613 - RNA, 16 nt, Mycobacterium bovis subsp bovis AF2122/97
uacaggcccggcaccg

SEQ ID NO: 3168614 - RNA, 15 nt, Mycobacterium bovis subsp bovis AF2122/97
uacaggucgccgggg

SEQ ID NO: 3168615 - RNA, 21 nt, Mycobacterium bovis subsp bovis AF2122/97
uacagucgaccggacacuccu

SEQ ID NO: 3168616 - RNA, 23 nt, Mycobacterium bovis subsp bovis AF2122/97
uacagugcgcggaucaacaggcc

SEQ ID NO: 3168617 - RNA, 15 nt, Mycobacterium bovis subsp bovis AF2122/97
uacaucgccuugccc

SEQ ID NO: 3168618 - RNA, 19 nt, Mycobacterium bovis subsp bovis AF2122/97
uacaucgccuugcccagcg

SEQ ID NO: 3168619 - RNA, 20 nt, Mycobacterium bovis subsp bovis AF2122/97
uacaucggcggcgucgacgu

SEQ ID NO: 3168620 - RNA, 15 nt, Mycobacterium bovis subsp bovis AF2122/97
uacauuucccaguca

SEQ ID NO: 3168621 - RNA, 14 nt, Mycobacterium bovis subsp bovis AF2122/97
uaccaacaccgccc

SEQ ID NO: 3168622 - RNA, 20 nt, Mycobacterium bovis subsp bovis AF2122/97
uaccaacaggauggugcggc

SEQ ID NO: 3168623 - RNA, 19 nt, Mycobacterium bovis subsp bovis AF2122/97
uaccaaccugcgcggcgau

SEQ ID NO: 3168624 - RNA, 23 nt, Mycobacterium bovis subsp bovis AF2122/97
uaccaacguuuugggcgccggag

SEQ ID NO: 3168625 - RNA, 15 nt, Mycobacterium bovis subsp bovis AF2122/97
uaccacauaccccga

SEQ ID NO: 3168626 - RNA, 12 nt, Mycobacterium bovis subsp bovis AF2122/97
uaccaccggcac

SEQ ID NO: 3168627 - RNA, 16 nt, Mycobacterium bovis subsp bovis AF2122/97
uaccaccggcacggug

SEQ ID NO: 3168628 - RNA, 14 nt, Mycobacterium bovis subsp bovis AF2122/97
uaccaccgucaccg

SEQ ID NO: 3168629 - RNA, 18 nt, Mycobacterium bovis subsp bovis AF2122/97
uaccaccgucuccggcgc

SEQ ID NO: 3168630 - RNA, 20 nt, Mycobacterium bovis subsp bovis AF2122/97
uaccaccgucuccggcgcca

SEQ ID NO: 3168631 - RNA, 11 nt, Mycobacterium bovis subsp bovis AF2122/97
uaccacgggcu

SEQ ID NO: 3168632 - RNA, 22 nt, Mycobacterium bovis subsp bovis AF2122/97
uaccacuuugcguucccauccc

SEQ ID NO: 3168633 - RNA, 15 nt, Mycobacterium bovis subsp bovis AF2122/97
uaccagaccggccga

SEQ ID NO: 3168634 - RNA, 20 nt, Mycobacterium bovis subsp bovis AF2122/97
uaccagaccggccgacguga

SEQ ID NO: 3168635 - RNA, 11 nt, Mycobacterium bovis subsp bovis AF2122/97
uaccagcaccg

SEQ ID NO: 3168636 - RNA, 22 nt, Mycobacterium bovis subsp bovis AF2122/97
uaccagcaccgggaugugcggc

SEQ ID NO: 3168637 - RNA, 22 nt, Mycobacterium bovis subsp bovis AF2122/97
uaccagccaugcucgucuuggg

SEQ ID NO: 3168638 - RNA, 22 nt, Mycobacterium bovis subsp bovis AF2122/97
uaccagccgaagaaccggucgc

SEQ ID NO: 3168639 - RNA, 14 nt, Mycobacterium bovis subsp bovis AF2122/97
uaccagcggcaccg

SEQ ID NO: 3168640 - RNA, 17 nt, Mycobacterium bovis subsp bovis AF2122/97
uaccagcucacggcgga

SEQ ID NO: 3168641 - RNA, 22 nt, Mycobacterium bovis subsp bovis AF2122/97
uaccagcuggccacuuucagau

SEQ ID NO: 3168642 - RNA, 15 nt, Mycobacterium bovis subsp bovis AF2122/97
uaccaggcgcggccc

SEQ ID NO: 3168643 - RNA, 21 nt, Mycobacterium bovis subsp bovis AF2122/97
uacccacaguuaucagccgcg

SEQ ID NO: 3168644 - RNA, 13 nt, Mycobacterium bovis subsp bovis AF2122/97
uacccaccagggu

SEQ ID NO: 3168645 - RNA, 21 nt, Mycobacterium bovis subsp bovis AF2122/97
uacccaccguuugggcgccgg

SEQ ID NO: 3168646 - RNA, 12 nt, Mycobacterium bovis subsp bovis AF2122/97
uacccaccuccc

SEQ ID NO: 3168647 - RNA, 19 nt, Mycobacterium bovis subsp bovis AF2122/97
uacccaccucccgcagccg

SEQ ID NO: 3168648 - RNA, 16 nt, Mycobacterium bovis subsp bovis AF2122/97
uacccacgacgggccg

SEQ ID NO: 3168649 - RNA, 12 nt, Mycobacterium bovis subsp bovis AF2122/97
uacccagcgccc

SEQ ID NO: 3168650 - RNA, 20 nt, Mycobacterium bovis subsp bovis AF2122/97
uacccaucaacaucggcccg

SEQ ID NO: 3168651 - RNA, 16 nt, Mycobacterium bovis subsp bovis AF2122/97
uacccaucgccacacc

SEQ ID NO: 3168652 - RNA, 15 nt, Mycobacterium bovis subsp bovis AF2122/97
uacccaucgucgagc

SEQ ID NO: 3168653 - RNA, 16 nt, Mycobacterium bovis subsp bovis AF2122/97
uacccauucggcggcg

SEQ ID NO: 3168654 - RNA, 18 nt, Mycobacterium bovis subsp bovis AF2122/97
uaccccagaccgccacac

SEQ ID NO: 3168655 - RNA, 23 nt, Mycobacterium bovis subsp bovis AF2122/97
uaccccagcaucuuuggcggccg

SEQ ID NO: 3168656 - RNA, 20 nt, Mycobacterium bovis subsp bovis AF2122/97
uaccccagccggcagcagcg

SEQ ID NO: 3168657 - RNA, 14 nt, Mycobacterium bovis subsp bovis AF2122/97
uacccccagcaccc

SEQ ID NO: 3168658 - RNA, 15 nt, Mycobacterium bovis subsp bovis AF2122/97
uacccccgauggcgu

SEQ ID NO: 3168659 - RNA, 16 nt, Mycobacterium bovis subsp bovis AF2122/97
uaccccgacggcgacc

SEQ ID NO: 3168660 - RNA, 19 nt, Mycobacterium bovis subsp bovis AF2122/97
uaccccuccgaucacgcug

SEQ ID NO: 3168661 - RNA, 23 nt, Mycobacterium bovis subsp bovis AF2122/97
uaccccuccgaucacgcuguucc

SEQ ID NO: 3168662 - RNA, 14 nt, Mycobacterium bovis subsp bovis AF2122/97
uacccgcagcgugc

SEQ ID NO: 3168663 - RNA, 13 nt, Mycobacterium bovis subsp bovis AF2122/97
uacgcaucgccgu

SEQ ID NO: 3168664 - RNA, 17 nt, Mycobacterium bovis subsp bovis AF2122/97
uacgccaaccgcuucca

SEQ ID NO: 3168665 - RNA, 17 nt, Mycobacterium bovis subsp bovis AF2122/97
uacgcccacuccagcag

SEQ ID NO: 3168666 - RNA, 19 nt, Mycobacterium bovis subsp bovis AF2122/97
uacgcccacuccagcagcu

SEQ ID NO: 3168667 - RNA, 13 nt, Mycobacterium bovis subsp bovis AF2122/97
uacgccgcgccga

SEQ ID NO: 3168668 - RNA, 13 nt, Mycobacterium bovis subsp bovis AF2122/97
uacgccggccgcg

SEQ ID NO: 3168669 - RNA, 14 nt, Mycobacterium bovis subsp bovis AF2122/97
uacgccggccgcgc

SEQ ID NO: 3168670 - RNA, 15 nt, Mycobacterium bovis subsp bovis AF2122/97
uacgccggucggugc

SEQ ID NO: 3168671 - RNA, 14 nt, Mycobacterium bovis subsp bovis AF2122/97
uacgccuccuucgu

SEQ ID NO: 3168672 - RNA, 14 nt, Mycobacterium bovis subsp bovis AF2122/97
uacgcgaccgcgau

SEQ ID NO: 3168673 - RNA, 18 nt, Mycobacterium bovis subsp bovis AF2122/97
uacgcgacgccgucaugc

SEQ ID NO: 3168674 - RNA, 20 nt, Mycobacterium bovis subsp bovis AF2122/97
uacgcgccgccggcucgccg

SEQ ID NO: 3168675 - RNA, 14 nt, Mycobacterium bovis subsp bovis AF2122/97
uacgcgcgcccgau

SEQ ID NO: 3168676 - RNA, 16 nt, Mycobacterium bovis subsp bovis AF2122/97
uacgcgcgcccgaucc

SEQ ID NO: 3168677 - RNA, 20 nt, Mycobacterium bovis subsp bovis AF2122/97
uacgcgcgcucgcucaccgg

SEQ ID NO: 3168678 - RNA, 12 nt, Mycobacterium bovis subsp bovis AF2122/97
uacgcggccgag

SEQ ID NO: 3168679 - RNA, 15 nt, Mycobacterium bovis subsp bovis AF2122/97
uacgcggcugcgucg

SEQ ID NO: 3168680 - RNA, 22 nt, Mycobacterium bovis subsp bovis AF2122/97
uacgcuggcacacuguuacucc

SEQ ID NO: 3168681 - RNA, 18 nt, Mycobacterium bovis subsp bovis AF2122/97
uacggccaccaggugccg

SEQ ID NO: 3168682 - RNA, 16 nt, Mycobacterium bovis subsp bovis AF2122/97
uacggcgacacgccag

SEQ ID NO: 3168683 - RNA, 24 nt, Mycobacterium bovis subsp bovis AF2122/97
uacgggaacguccagccguggcgg

SEQ ID NO: 3168684 - RNA, 18 nt, Mycobacterium bovis subsp bovis AF2122/97
uacgggcugacgaucucc

SEQ ID NO: 3168685 - RNA, 22 nt, Mycobacterium bovis subsp bovis AF2122/97
uacgggucgccggacugcggcc

SEQ ID NO: 3168686 - RNA, 13 nt, Mycobacterium bovis subsp bovis AF2122/97
uacgggugucggg

SEQ ID NO: 3168687 - RNA, 18 nt, Mycobacterium bovis subsp bovis AF2122/97
uacgguccggcguacucg

SEQ ID NO: 3168688 - RNA, 15 nt, Mycobacterium bovis subsp bovis AF2122/97
uacggugaucgccgg

SEQ ID NO: 3168689 - RNA, 18 nt, Mycobacterium bovis subsp bovis AF2122/97
uacggugccaagggccgg

SEQ ID NO: 3168690 - RNA, 13 nt, Mycobacterium bovis subsp bovis AF2122/97
uacguacagggug

SEQ ID NO: 3168691 - RNA, 18 nt, Mycobacterium bovis subsp bovis AF2122/97
uacguacaggguggugau

SEQ ID NO: 3168692 - RNA, 18 nt, Mycobacterium bovis subsp bovis AF2122/97
uacgucaagccgugcugc

SEQ ID NO: 3168693 - RNA, 21 nt, Mycobacterium bovis subsp bovis AF2122/97
uacgucgagggugaccaacgu

SEQ ID NO: 3168694 - RNA, 20 nt, Mycobacterium bovis subsp bovis AF2122/97
uacgucgaucaggucgucac

SEQ ID NO: 3168695 - RNA, 16 nt, Mycobacterium bovis subsp bovis AF2122/97
uacgucggggccgcac

SEQ ID NO: 3168696 - RNA, 15 nt, Mycobacterium bovis subsp bovis AF2122/97
uacgucgguccaccc

SEQ ID NO: 3168697 - RNA, 16 nt, Mycobacterium bovis subsp bovis AF2122/97
uacgucguccagcacc

SEQ ID NO: 3168698 - RNA, 21 nt, Mycobacterium bovis subsp bovis AF2122/97
uacguuacgccgagaugcugc

SEQ ID NO: 3168699 - RNA, 20 nt, Mycobacterium bovis subsp bovis AF2122/97
uacguucaccaccgcacauc

SEQ ID NO: 3168700 - RNA, 12 nt, Mycobacterium bovis subsp bovis AF2122/97
uacguuccuagc

SEQ ID NO: 3168701 - RNA, 15 nt, Mycobacterium bovis subsp bovis AF2122/97
uacucagguggaagu

SEQ ID NO: 3168702 - RNA, 15 nt, Mycobacterium bovis subsp bovis AF2122/97
uacuccacccaggcc

SEQ ID NO: 3168703 - RNA, 16 nt, Mycobacterium bovis subsp bovis AF2122/97
uacuccgacggcccgg

SEQ ID NO: 3168704 - RNA, 21 nt, Mycobacterium bovis subsp bovis AF2122/97
uacuccgacggcccggugagc

SEQ ID NO: 3168705 - RNA, 23 nt, Mycobacterium bovis subsp bovis AF2122/97
uacucggcauccaggcugucgcg

SEQ ID NO: 3168706 - RNA, 13 nt, Mycobacterium bovis subsp bovis AF2122/97
uacucggcgcgca

SEQ ID NO: 3168707 - RNA, 13 nt, Mycobacterium bovis subsp bovis AF2122/97
uacucucgcgaca

SEQ ID NO: 3168708 - RNA, 13 nt, Mycobacterium bovis subsp bovis AF2122/97
uacugcgaucgcg

SEQ ID NO: 3168709 - RNA, 16 nt, Mycobacterium bovis subsp bovis AF2122/97
uacugcguugacguca

SEQ ID NO: 3168710 - RNA, 16 nt, Mycobacterium bovis subsp bovis AF2122/97
uacuggccgccgcgca

SEQ ID NO: 3168711 - RNA, 19 nt, Mycobacterium bovis subsp bovis AF2122/97
uacuggcguugccaccgga

SEQ ID NO: 3168712 - RNA, 16 nt, Mycobacterium bovis subsp bovis AF2122/97
uacuggcuauccaccu

SEQ ID NO: 3168713 - RNA, 21 nt, Mycobacterium bovis subsp bovis AF2122/97
uacuguucugcuggcuguggc

SEQ ID NO: 3168714 - RNA, 16 nt, Mycobacterium bovis subsp bovis AF2122/97
uacuucgcuggaaacc

SEQ ID NO: 3168715 - RNA, 10 nt, Mycobacterium bovis subsp bovis AF2122/97
uacuugaccg

SEQ ID NO: 3168716 - RNA, 14 nt, Mycobacterium bovis subsp bovis AF2122/97
uacuugagggucuu

SEQ ID NO: 3168717 - RNA, 15 nt, Mycobacterium bovis subsp bovis AF2122/97
uagaacguagcgccc

SEQ ID NO: 3168718 - RNA, 17 nt, Mycobacterium bovis subsp bovis AF2122/97
uagaacgucuggguugc

SEQ ID NO: 3168719 - RNA, 20 nt, Mycobacterium bovis subsp bovis AF2122/97
uagaagccgacguugaagcc

SEQ ID NO: 3168720 - RNA, 13 nt, Mycobacterium bovis subsp bovis AF2122/97
uagacaaggccaa

SEQ ID NO: 3168721 - RNA, 22 nt, Mycobacterium bovis subsp bovis AF2122/97
uagacaaggccaagcgccaaca

SEQ ID NO: 3168722 - RNA, 18 nt, Mycobacterium bovis subsp bovis AF2122/97
uagacauuggcuccgaac

SEQ ID NO: 3168723 - RNA, 17 nt, Mycobacterium bovis subsp bovis AF2122/97
uagaccacgccggugac

SEQ ID NO: 3168724 - RNA, 16 nt, Mycobacterium bovis subsp bovis AF2122/97
uagaccagugaccgca

SEQ ID NO: 3168725 - RNA, 15 nt, Mycobacterium bovis subsp bovis AF2122/97
uagaccaugaagaac

SEQ ID NO: 3168726 - RNA, 18 nt, Mycobacterium bovis subsp bovis AF2122/97
uagacccgucaccgccga

SEQ ID NO: 3168727 - RNA, 17 nt, Mycobacterium bovis subsp bovis AF2122/97
uagaccgaaauggucgu

SEQ ID NO: 3168728 - RNA, 15 nt, Mycobacterium bovis subsp bovis AF2122/97
uagaccgagcccgau

SEQ ID NO: 3168729 - RNA, 18 nt, Mycobacterium bovis subsp bovis AF2122/97
uagaccgcagucgcuggg

SEQ ID NO: 3168730 - RNA, 17 nt, Mycobacterium bovis subsp bovis AF2122/97
uagaccucgccggugac

SEQ ID NO: 3168731 - RNA, 13 nt, Mycobacterium bovis subsp bovis AF2122/97
uagaccuggccgu

SEQ ID NO: 3168732 - RNA, 21 nt, Mycobacterium bovis subsp bovis AF2122/97
uagaccuuggugcccagcagg

SEQ ID NO: 3168733 - RNA, 21 nt, Mycobacterium bovis subsp bovis AF2122/97
uagacgaaggauucgaagccg

SEQ ID NO: 3168734 - RNA, 23 nt, Mycobacterium bovis subsp bovis AF2122/97
uagacgacaucgucaucagcgcg

SEQ ID NO: 3168735 - RNA, 21 nt, Mycobacterium bovis subsp bovis AF2122/97
uagacggcgaaaaucccgcuc

SEQ ID NO: 3168736 - RNA, 12 nt, Mycobacterium bovis subsp bovis AF2122/97
uagacggcgacg

SEQ ID NO: 3168737 - RNA, 20 nt, Mycobacterium bovis subsp bovis AF2122/97
uagacggggcgagcaugccg

SEQ ID NO: 3168738 - RNA, 23 nt, Mycobacterium bovis subsp bovis AF2122/97
uagacgguuaccgcgaagcugcg

SEQ ID NO: 3168739 - RNA, 20 nt, Mycobacterium bovis subsp bovis AF2122/97
uagacguagaaugcgccguc

SEQ ID NO: 3168740 - RNA, 13 nt, Mycobacterium bovis subsp bovis AF2122/97
uagacgucgaccg

SEQ ID NO: 3168741 - RNA, 13 nt, Mycobacterium bovis subsp bovis AF2122/97
uagacgugcacca

SEQ ID NO: 3168742 - RNA, 20 nt, Mycobacterium bovis subsp bovis AF2122/97
uagacuagccgauccagcag

SEQ ID NO: 3168743 - RNA, 15 nt, Mycobacterium bovis subsp bovis AF2122/97
uagacuugcugcucc

SEQ ID NO: 3168744 - RNA, 13 nt, Mycobacterium bovis subsp bovis AF2122/97
uagagcagcagcg

SEQ ID NO: 3168745 - RNA, 22 nt, Mycobacterium bovis subsp bovis AF2122/97
uagagcaugccgcccgcgccgc

SEQ ID NO: 3168746 - RNA, 13 nt, Mycobacterium bovis subsp bovis AF2122/97
uagagcgcaccgc

SEQ ID NO: 3168747 - RNA, 18 nt, Mycobacterium bovis subsp bovis AF2122/97
uagaggacugcggucugg

SEQ ID NO: 3168748 - RNA, 16 nt, Mycobacterium bovis subsp bovis AF2122/97
uagaggauaucgccga

SEQ ID NO: 3168749 - RNA, 16 nt, Mycobacterium bovis subsp bovis AF2122/97
uagaggauggucagca

SEQ ID NO: 3168750 - RNA, 14 nt, Mycobacterium bovis subsp bovis AF2122/97
uagcgacagcagcg

SEQ ID NO: 3168751 - RNA, 17 nt, Mycobacterium bovis subsp bovis AF2122/97
uagcgacgccaucugcu

SEQ ID NO: 3168752 - RNA, 20 nt, Mycobacterium bovis subsp bovis AF2122/97
uagcgacggcgcucggcgag

SEQ ID NO: 3168753 - RNA, 21 nt, Mycobacterium bovis subsp bovis AF2122/97
uagcgacgguuuagcgccggu

SEQ ID NO: 3168754 - RNA, 17 nt, Mycobacterium bovis subsp bovis AF2122/97
uagcgagcgcacaccgg

SEQ ID NO: 3168755 - RNA, 15 nt, Mycobacterium bovis subsp bovis AF2122/97
uagcgcaccaccguc

SEQ ID NO: 3168756 - RNA, 22 nt, Mycobacterium bovis subsp bovis AF2122/97
uagcgcaccaccgucucgccgc

SEQ ID NO: 3168757 - RNA, 13 nt, Mycobacterium bovis subsp bovis AF2122/97
uagcgcacugccg

SEQ ID NO: 3168758 - RNA, 16 nt, Mycobacterium bovis subsp bovis AF2122/97
uagcgcacugccgggu

SEQ ID NO: 3168759 - RNA, 23 nt, Mycobacterium bovis subsp bovis AF2122/97
uagcgcauccaauaucgcuuucg

SEQ ID NO: 3168760 - RNA, 15 nt, Mycobacterium bovis subsp bovis AF2122/97
uagcgcaucgccaau

SEQ ID NO: 3168761 - RNA, 23 nt, Mycobacterium bovis subsp bovis AF2122/97
uagcgcaugucgauccggcgcca

SEQ ID NO: 3168762 - RNA, 20 nt, Mycobacterium bovis subsp bovis AF2122/97
uagcgcccaccguagacgac

SEQ ID NO: 3168763 - RNA, 16 nt, Mycobacterium bovis subsp bovis AF2122/97
uagcgccgccagucgu

SEQ ID NO: 3168764 - RNA, 19 nt, Mycobacterium bovis subsp bovis AF2122/97
uagcgcgaaagcgccgaaa

SEQ ID NO: 3168765 - RNA, 16 nt, Mycobacterium bovis subsp bovis AF2122/97
uagcgcggcaccagca

SEQ ID NO: 3168766 - RNA, 14 nt, Mycobacterium bovis subsp bovis AF2122/97
uagcgcggccagca

SEQ ID NO: 3168767 - RNA, 14 nt, Mycobacterium bovis subsp bovis AF2122/97
uagcgcgugcugca

SEQ ID NO: 3168768 - RNA, 21 nt, Mycobacterium bovis subsp bovis AF2122/97
uagcgcuugccgcugagcccu

SEQ ID NO: 3168769 - RNA, 22 nt, Mycobacterium bovis subsp bovis AF2122/97
uagcggaccgaugacgaucggc

SEQ ID NO: 3168770 - RNA, 15 nt, Mycobacterium bovis subsp bovis AF2122/97
uagcggcaaagccgg

SEQ ID NO: 3168771 - RNA, 21 nt, Mycobacterium bovis subsp bovis AF2122/97
uagcggcccaucgggcgccca

SEQ ID NO: 3168772 - RNA, 16 nt, Mycobacterium bovis subsp bovis AF2122/97
uagcggcccgaucacc

SEQ ID NO: 3168773 - RNA, 18 nt, Mycobacterium bovis subsp bovis AF2122/97
uagcggcccuucgacgag

SEQ ID NO: 3168774 - RNA, 23 nt, Mycobacterium bovis subsp bovis AF2122/97
uagcggcgcagcgugagugcagc

SEQ ID NO: 3168775 - RNA, 19 nt, Mycobacterium bovis subsp bovis AF2122/97
uagcggcgcccgccaccgg

SEQ ID NO: 3168776 - RNA, 14 nt, Mycobacterium bovis subsp bovis AF2122/97
uagcggcggcggca

SEQ ID NO: 3168777 - RNA, 17 nt, Mycobacterium bovis subsp bovis AF2122/97
uagcggcucaccgcgca

SEQ ID NO: 3168778 - RNA, 13 nt, Mycobacterium bovis subsp bovis AF2122/97
uagcggcuuggcc

SEQ ID NO: 3168779 - RNA, 18 nt, Mycobacterium bovis subsp bovis AF2122/97
uagcgggcaagaugaucg

SEQ ID NO: 3168780 - RNA, 13 nt, Mycobacterium bovis subsp bovis AF2122/97
uagcgggcgguag

SEQ ID NO: 3168781 - RNA, 20 nt, Mycobacterium bovis subsp bovis AF2122/97
uagcgggcgguagccauccg

SEQ ID NO: 3168782 - RNA, 16 nt, Mycobacterium bovis subsp bovis AF2122/97
uagcgggugccagccc

SEQ ID NO: 3168783 - RNA, 18 nt, Mycobacterium bovis subsp bovis AF2122/97
uagcgguccagcgucgcc

SEQ ID NO: 3168784 - RNA, 16 nt, Mycobacterium bovis subsp bovis AF2122/97
uagcggucccgcggac

SEQ ID NO: 3168785 - RNA, 20 nt, Mycobacterium bovis subsp bovis AF2122/97
uagcggucugugcugcgcug

SEQ ID NO: 3168786 - RNA, 14 nt, Mycobacterium bovis subsp bovis AF2122/97
uagcggugucaugc

SEQ ID NO: 3168787 - RNA, 17 nt, Mycobacterium bovis subsp bovis AF2122/97
uagcggugugggaugag

SEQ ID NO: 3168788 - RNA, 20 nt, Mycobacterium bovis subsp bovis AF2122/97
uagcgguucaucaccgucag

SEQ ID NO: 3168789 - RNA, 19 nt, Mycobacterium bovis subsp bovis AF2122/97
uagcgguuuagccgcuugg

SEQ ID NO: 3168790 - RNA, 15 nt, Mycobacterium bovis subsp bovis AF2122/97
uagcguagcccgagu

SEQ ID NO: 3168791 - RNA, 20 nt, Mycobacterium bovis subsp bovis AF2122/97
uagcguccgagcguaaugcu

SEQ ID NO: 3168792 - RNA, 19 nt, Mycobacterium bovis subsp bovis AF2122/97
uagcgucgucccagcgcgg

SEQ ID NO: 3168793 - RNA, 17 nt, Mycobacterium bovis subsp bovis AF2122/97
uagcgucugcuggaucg

SEQ ID NO: 3168794 - RNA, 22 nt, Mycobacterium bovis subsp bovis AF2122/97
uagcgugguacuuucacgcucg

SEQ ID NO: 3168795 - RNA, 22 nt, Mycobacterium bovis subsp bovis AF2122/97
uagcucaggguguucacguuca

SEQ ID NO: 3168796 - RNA, 19 nt, Mycobacterium bovis subsp bovis AF2122/97
uagcucgcugaccuuguug

SEQ ID NO: 3168797 - RNA, 18 nt, Mycobacterium bovis subsp bovis AF2122/97
uagcucgguaggccggca

SEQ ID NO: 3168798 - RNA, 14 nt, Mycobacterium bovis subsp bovis AF2122/97
uagcucgucgagga

SEQ ID NO: 3168799 - RNA, 21 nt, Mycobacterium bovis subsp bovis AF2122/97
uagcugacaccgaaccgccgc

SEQ ID NO: 3168800 - RNA, 19 nt, Mycobacterium bovis subsp bovis AF2122/97
uagcugaccgagcugaucc

SEQ ID NO: 3168801 - RNA, 13 nt, Mycobacterium bovis subsp bovis AF2122/97
uagcugacguguc

SEQ ID NO: 3168802 - RNA, 13 nt, Mycobacterium bovis subsp bovis AF2122/97
uagcugccggccc

SEQ ID NO: 3168803 - RNA, 15 nt, Mycobacterium bovis subsp bovis AF2122/97
uagcugccgucggug

SEQ ID NO: 3168804 - RNA, 16 nt, Mycobacterium bovis subsp bovis AF2122/97
uagcugccgucggugc

SEQ ID NO: 3168805 - RNA, 20 nt, Mycobacterium bovis subsp bovis AF2122/97
uagcugcgggucucgccgac

SEQ ID NO: 3168806 - RNA, 16 nt, Mycobacterium bovis subsp bovis AF2122/97
uagcugcucaucgcgc

SEQ ID NO: 3168807 - RNA, 21 nt, Mycobacterium bovis subsp bovis AF2122/97
uagcuggccagguugccgucg

SEQ ID NO: 3168808 - RNA, 17 nt, Mycobacterium bovis subsp bovis AF2122/97
uagcuggcggggguccg

SEQ ID NO: 3168809 - RNA, 22 nt, Mycobacterium bovis subsp bovis AF2122/97
uagcuguugaccguguggccgu

SEQ ID NO: 3168810 - RNA, 14 nt, Mycobacterium bovis subsp bovis AF2122/97
uagcuguuggccag

SEQ ID NO: 3168811 - RNA, 22 nt, Mycobacterium bovis subsp bovis AF2122/97
uagcuguuggccagccgacaac

SEQ ID NO: 3168812 - RNA, 13 nt, Mycobacterium bovis subsp bovis AF2122/97
uaggaccaccagc

SEQ ID NO: 3168813 - RNA, 14 nt, Mycobacterium bovis subsp bovis AF2122/97
uaggaccaccagcg

SEQ ID NO: 3168814 - RNA, 21 nt, Mycobacterium bovis subsp bovis AF2122/97
uaggacucuucggucagggug

SEQ ID NO: 3168815 - RNA, 22 nt, Mycobacterium bovis subsp bovis AF2122/97
uaggaggagugguugcccgcac

SEQ ID NO: 3168816 - RNA, 15 nt, Mycobacterium bovis subsp bovis AF2122/97
uaggaguggccgggc

SEQ ID NO: 3168817 - RNA, 17 nt, Mycobacterium bovis subsp bovis AF2122/97
uaggaguggccgggcgg

SEQ ID NO: 3168818 - RNA, 22 nt, Mycobacterium bovis subsp bovis AF2122/97
uaggcaaccuuuggccgcugug

SEQ ID NO: 3168819 - RNA, 20 nt, Mycobacterium bovis subsp bovis AF2122/97
uaggcaaggucaacccgcac

SEQ ID NO: 3168820 - RNA, 14 nt, Mycobacterium bovis subsp bovis AF2122/97
uaggcacucccgga

SEQ ID NO: 3168821 - RNA, 16 nt, Mycobacterium bovis subsp bovis AF2122/97
uaggcaggaucgccug

SEQ ID NO: 3168822 - RNA, 14 nt, Mycobacterium bovis subsp bovis AF2122/97
uaggcaggccggcu

SEQ ID NO: 3168823 - RNA, 15 nt, Mycobacterium bovis subsp bovis AF2122/97
uaggccaccacugcg

SEQ ID NO: 3168824 - RNA, 22 nt, Mycobacterium bovis subsp bovis AF2122/97
uaggcccacggcagcgccgguc

SEQ ID NO: 3168825 - RNA, 11 nt, Mycobacterium bovis subsp bovis AF2122/97
uaggcccagca

SEQ ID NO: 3168826 - RNA, 19 nt, Mycobacterium bovis subsp bovis AF2122/97
uaggcccagcaaccgcucg

SEQ ID NO: 3168827 - RNA, 17 nt, Mycobacterium bovis subsp bovis AF2122/97
uaggccccaccauucgc

SEQ ID NO: 3168828 - RNA, 20 nt, Mycobacterium bovis subsp bovis AF2122/97
uaggccccgccagcgccggu

SEQ ID NO: 3168829 - RNA, 22 nt, Mycobacterium bovis subsp bovis AF2122/97
uaggccgccggacccgucgagc

SEQ ID NO: 3168830 - RNA, 20 nt, Mycobacterium bovis subsp bovis AF2122/97
uaggccgcgcggcggcgccg

SEQ ID NO: 3168831 - RNA, 22 nt, Mycobacterium bovis subsp bovis AF2122/97
uaggccgcgcggcggcgccggc

SEQ ID NO: 3168832 - RNA, 21 nt, Mycobacterium bovis subsp bovis AF2122/97
uaggccgcggcaccuggcuug

SEQ ID NO: 3168833 - RNA, 15 nt, Mycobacterium bovis subsp bovis AF2122/97
uaggccgcgucgauc

SEQ ID NO: 3168834 - RNA, 14 nt, Mycobacterium bovis subsp bovis AF2122/97
uaggccucggcagc

SEQ ID NO: 3168835 - RNA, 15 nt, Mycobacterium bovis subsp bovis AF2122/97
uaggccucggcagca

SEQ ID NO: 3168836 - RNA, 17 nt, Mycobacterium bovis subsp bovis AF2122/97
uaucgcagcaucugcgg

SEQ ID NO: 3168837 - RNA, 14 nt, Mycobacterium bovis subsp bovis AF2122/97
uaucgccggccgcg

SEQ ID NO: 3168838 - RNA, 20 nt, Mycobacterium bovis subsp bovis AF2122/97
uaucggcaaucaggucgucg

SEQ ID NO: 3168839 - RNA, 19 nt, Mycobacterium bovis subsp bovis AF2122/97
uaucggcacggucacacgc

SEQ ID NO: 3168840 - RNA, 19 nt, Mycobacterium bovis subsp bovis AF2122/97
uaucggcauacccaucaac

SEQ ID NO: 3168841 - RNA, 18 nt, Mycobacterium bovis subsp bovis AF2122/97
uaucggccgaaucuccgc

SEQ ID NO: 3168842 - RNA, 23 nt, Mycobacterium bovis subsp bovis AF2122/97
uaucggccgugaauucgccgaac

SEQ ID NO: 3168843 - RNA, 18 nt, Mycobacterium bovis subsp bovis AF2122/97
uaucggcuucgucaucug

SEQ ID NO: 3168844 - RNA, 13 nt, Mycobacterium bovis subsp bovis AF2122/97
uaucgggaagccg

SEQ ID NO: 3168845 - RNA, 21 nt, Mycobacterium bovis subsp bovis AF2122/97
uaucgggcucagcggcgaccg

SEQ ID NO: 3168846 - RNA, 22 nt, Mycobacterium bovis subsp bovis AF2122/97
uaucggugccggagacaccgca

SEQ ID NO: 3168847 - RNA, 19 nt, Mycobacterium bovis subsp bovis AF2122/97
uaucggugcuggucgccgc

SEQ ID NO: 3168848 - RNA, 17 nt, Mycobacterium bovis subsp bovis AF2122/97
uaucgucccggcgaccg

SEQ ID NO: 3168849 - RNA, 12 nt, Mycobacterium bovis subsp bovis AF2122/97
uaucgucgacgc

SEQ ID NO: 3168850 - RNA, 18 nt, Mycobacterium bovis subsp bovis AF2122/97
uaucgucgacgccgaucg

SEQ ID NO: 3168851 - RNA, 24 nt, Mycobacterium bovis subsp bovis AF2122/97
uaucuauggaugaccgaaccuggu

SEQ ID NO: 3168852 - RNA, 13 nt, Mycobacterium bovis subsp bovis AF2122/97
uaucucggugacg

SEQ ID NO: 3168853 - RNA, 15 nt, Mycobacterium bovis subsp bovis AF2122/97
uaucugccacguuga

SEQ ID NO: 3168854 - RNA, 15 nt, Mycobacterium bovis subsp bovis AF2122/97
uaugaccucgacguc

SEQ ID NO: 3168855 - RNA, 16 nt, Mycobacterium bovis subsp bovis AF2122/97
uaugacgcccaccgac

SEQ ID NO: 3168856 - RNA, 21 nt, Mycobacterium bovis subsp bovis AF2122/97
uaugacuugcgcgcggcaaca

SEQ ID NO: 3168857 - RNA, 15 nt, Mycobacterium bovis subsp bovis AF2122/97
uaugcaacaccgcac

SEQ ID NO: 3168858 - RNA, 18 nt, Mycobacterium bovis subsp bovis AF2122/97
uaugccaggacuggcacc

SEQ ID NO: 3168859 - RNA, 23 nt, Mycobacterium bovis subsp bovis AF2122/97
uaugcccacgaaccgugcugggc

SEQ ID NO: 3168860 - RNA, 13 nt, Mycobacterium bovis subsp bovis AF2122/97
uaugcccggcaaa

SEQ ID NO: 3168861 - RNA, 14 nt, Mycobacterium bovis subsp bovis AF2122/97
uaugcgcacucuag

SEQ ID NO: 3168862 - RNA, 22 nt, Mycobacterium bovis subsp bovis AF2122/97
uaugcgggacugacccugaucg

SEQ ID NO: 3168863 - RNA, 15 nt, Mycobacterium bovis subsp bovis AF2122/97
uaugcucgcuggcgc

SEQ ID NO: 3168864 - RNA, 13 nt, Mycobacterium bovis subsp bovis AF2122/97
uauggaccgccgc

SEQ ID NO: 3168865 - RNA, 15 nt, Mycobacterium bovis subsp bovis AF2122/97
uauggaccgccgccg

SEQ ID NO: 3168866 - RNA, 18 nt, Mycobacterium bovis subsp bovis AF2122/97
uauggaccgccgccgaca

SEQ ID NO: 3168867 - RNA, 20 nt, Mycobacterium bovis subsp bovis AF2122/97
uauggcauucgauaccgcac

SEQ ID NO: 3168868 - RNA, 15 nt, Mycobacterium bovis subsp bovis AF2122/97
uauggcccgggccga

SEQ ID NO: 3168869 - RNA, 22 nt, Mycobacterium bovis subsp bovis AF2122/97
uauggcccgggccgaagcgcgc

SEQ ID NO: 3168870 - RNA, 15 nt, Mycobacterium bovis subsp bovis AF2122/97
uauggccggagcgca

SEQ ID NO: 3168871 - RNA, 14 nt, Mycobacterium bovis subsp bovis AF2122/97
uaugggaccggcaa

SEQ ID NO: 3168872 - RNA, 19 nt, Mycobacterium bovis subsp bovis AF2122/97
uauguucggcgguguccua

SEQ ID NO: 3168873 - RNA, 21 nt, Mycobacterium bovis subsp bovis AF2122/97
uauucgaagggguacccgccc

SEQ ID NO: 3168874 - RNA, 19 nt, Mycobacterium bovis subsp bovis AF2122/97
uauucgccagcgccggaug

SEQ ID NO: 3168875 - RNA, 14 nt, Mycobacterium bovis subsp bovis AF2122/97
uauucguuggcgaa

SEQ ID NO: 3168876 - RNA, 18 nt, Mycobacterium bovis subsp bovis AF2122/97
uauugaacccguguucug

SEQ ID NO: 3168877 - RNA, 22 nt, Mycobacterium bovis subsp bovis AF2122/97
uauugaccuucucgucggccag

SEQ ID NO: 3168878 - RNA, 17 nt, Mycobacterium bovis subsp bovis AF2122/97
uauugccuaucgacaac

SEQ ID NO: 3168879 - RNA, 16 nt, Mycobacterium bovis subsp bovis AF2122/97
uauugcgcccggccau

SEQ ID NO: 3168880 - RNA, 13 nt, Mycobacterium bovis subsp bovis AF2122/97
uauugcggcgccg

SEQ ID NO: 3168881 - RNA, 13 nt, Mycobacterium bovis subsp bovis AF2122/97
uauuggacugcag

SEQ ID NO: 3168882 - RNA, 16 nt, Mycobacterium bovis subsp bovis AF2122/97
uauugggguggcagcu

SEQ ID NO: 3168883 - RNA, 16 nt, Mycobacterium bovis subsp bovis AF2122/97
uauuucucccagccca

SEQ ID NO: 3168884 - RNA, 13 nt, Mycobacterium bovis subsp bovis AF2122/97
ucaaaaagcucgg

SEQ ID NO: 3168885 - RNA, 18 nt, Mycobacterium bovis subsp bovis AF2122/97
ucaaaaucagggugccgu

SEQ ID NO: 3168886 - RNA, 22 nt, Mycobacterium bovis subsp bovis AF2122/97
ucaaacccagcgacgcggccag

SEQ ID NO: 3168887 - RNA, 21 nt, Mycobacterium bovis subsp bovis AF2122/97
ucaaacccgaaaacccaacac

SEQ ID NO: 3168888 - RNA, 23 nt, Mycobacterium bovis subsp bovis AF2122/97
ucaaaccuauccguucaauuucg

SEQ ID NO: 3168889 - RNA, 16 nt, Mycobacterium bovis subsp bovis AF2122/97
ucaaacgcgcgcgcca

SEQ ID NO: 3168890 - RNA, 15 nt, Mycobacterium bovis subsp bovis AF2122/97
ucaaacuaccgaaca

SEQ ID NO: 3168891 - RNA, 19 nt, Mycobacterium bovis subsp bovis AF2122/97
ucaaacuaccgaacagugg

SEQ ID NO: 3168892 - RNA, 19 nt, Mycobacterium bovis subsp bovis AF2122/97
ucaaagacccgacgccacg

SEQ ID NO: 3168893 - RNA, 13 nt, Mycobacterium bovis subsp bovis AF2122/97
ucaaagcagcgca

SEQ ID NO: 3168894 - RNA, 12 nt, Mycobacterium bovis subsp bovis AF2122/97
ucaaagcggccu

SEQ ID NO: 3168895 - RNA, 20 nt, Mycobacterium bovis subsp bovis AF2122/97
ucaaauccuuugcugcccag

SEQ ID NO: 3168896 - RNA, 22 nt, Mycobacterium bovis subsp bovis AF2122/97
ucaacaacagccgcagccaggu

SEQ ID NO: 3168897 - RNA, 22 nt, Mycobacterium bovis subsp bovis AF2122/97
ucaacaagacgaugcuggcggc

SEQ ID NO: 3168898 - RNA, 16 nt, Mycobacterium bovis subsp bovis AF2122/97
ucaacaaggggcagca

SEQ ID NO: 3168899 - RNA, 16 nt, Mycobacterium bovis subsp bovis AF2122/97
ucaacaaucggugguc

SEQ ID NO: 3168900 - RNA, 19 nt, Mycobacterium bovis subsp bovis AF2122/97
ucaacaccaacgacagcga

SEQ ID NO: 3168901 - RNA, 16 nt, Mycobacterium bovis subsp bovis AF2122/97
ucaacaccagcaagug

SEQ ID NO: 3168902 - RNA, 20 nt, Mycobacterium bovis subsp bovis AF2122/97
ucaacaccgccgaccuaguc

SEQ ID NO: 3168903 - RNA, 15 nt, Mycobacterium bovis subsp bovis AF2122/97
ucaacaccggcaucg

SEQ ID NO: 3168904 - RNA, 20 nt, Mycobacterium bovis subsp bovis AF2122/97
ucaacagaccuagcaccgcg

SEQ ID NO: 3168905 - RNA, 17 nt, Mycobacterium bovis subsp bovis AF2122/97
ucaacaggccggcucgc

SEQ ID NO: 3168906 - RNA, 14 nt, Mycobacterium bovis subsp bovis AF2122/97
ucaacagggccaga

SEQ ID NO: 3168907 - RNA, 14 nt, Mycobacterium bovis subsp bovis AF2122/97
ucaacagggccagg

SEQ ID NO: 3168908 - RNA, 18 nt, Mycobacterium bovis subsp bovis AF2122/97
ucaacaguacccaggcgu

SEQ ID NO: 3168909 - RNA, 13 nt, Mycobacterium bovis subsp bovis AF2122/97
ucaacauuucuga

SEQ ID NO: 3168910 - RNA, 15 nt, Mycobacterium bovis subsp bovis AF2122/97
ucaaccaagcgugcc

SEQ ID NO: 3168911 - RNA, 21 nt, Mycobacterium bovis subsp bovis AF2122/97
ucaaccaagugaccggccugc

SEQ ID NO: 3168912 - RNA, 14 nt, Mycobacterium bovis subsp bovis AF2122/97
ucaaccagggugcc

SEQ ID NO: 3168913 - RNA, 17 nt, Mycobacterium bovis subsp bovis AF2122/97
ucaaccagggugccggc

SEQ ID NO: 3168914 - RNA, 20 nt, Mycobacterium bovis subsp bovis AF2122/97
ucaacccgcaccccggccgc

SEQ ID NO: 3168915 - RNA, 14 nt, Mycobacterium bovis subsp bovis AF2122/97
ucaacccggccuuc

SEQ ID NO: 3168916 - RNA, 15 nt, Mycobacterium bovis subsp bovis AF2122/97
ucaacccucgccacg

SEQ ID NO: 3168917 - RNA, 14 nt, Mycobacterium bovis subsp bovis AF2122/97
ucaaccgggucagc

SEQ ID NO: 3168918 - RNA, 15 nt, Mycobacterium bovis subsp bovis AF2122/97
ucaaccugaaccggc

SEQ ID NO: 3168919 - RNA, 19 nt, Mycobacterium bovis subsp bovis AF2122/97
ucaaccugaaccggccgcg

SEQ ID NO: 3168920 - RNA, 20 nt, Mycobacterium bovis subsp bovis AF2122/97
ucaaccugaaccggccgcga

SEQ ID NO: 3168921 - RNA, 16 nt, Mycobacterium bovis subsp bovis AF2122/97
ucaaccugcgcaucac

SEQ ID NO: 3168922 - RNA, 20 nt, Mycobacterium bovis subsp bovis AF2122/97
ucaacgaaaauuugacgacg

SEQ ID NO: 3168923 - RNA, 17 nt, Mycobacterium bovis subsp bovis AF2122/97
ucacaggccgccugggg

SEQ ID NO: 3168924 - RNA, 18 nt, Mycobacterium bovis subsp bovis AF2122/97
ucacaggccgccuggggg

SEQ ID NO: 3168925 - RNA, 21 nt, Mycobacterium bovis subsp bovis AF2122/97
ucacaggcgacacauugguau

SEQ ID NO: 3168926 - RNA, 15 nt, Mycobacterium bovis subsp bovis AF2122/97
ucacauccacgcacu

SEQ ID NO: 3168927 - RNA, 19 nt, Mycobacterium bovis subsp bovis AF2122/97
ucacauccgacagcagccg

SEQ ID NO: 3168928 - RNA, 21 nt, Mycobacterium bovis subsp bovis AF2122/97
ucacaucggccucugaccagc

SEQ ID NO: 3168929 - RNA, 13 nt, Mycobacterium bovis subsp bovis AF2122/97
ucacaucguuguc

SEQ ID NO: 3168930 - RNA, 16 nt, Mycobacterium bovis subsp bovis AF2122/97
ucacaugcccgcaccg

SEQ ID NO: 3168931 - RNA, 15 nt, Mycobacterium bovis subsp bovis AF2122/97
ucacaugcgccgaaa

SEQ ID NO: 3168932 - RNA, 15 nt, Mycobacterium bovis subsp bovis AF2122/97
ucacauucaacagau

SEQ ID NO: 3168933 - RNA, 14 nt, Mycobacterium bovis subsp bovis AF2122/97
ucacauucagcacg

SEQ ID NO: 3168934 - RNA, 23 nt, Mycobacterium bovis subsp bovis AF2122/97
ucaccaaaaacccggugaccagc

SEQ ID NO: 3168935 - RNA, 15 nt, Mycobacterium bovis subsp bovis AF2122/97
ucaccaacgcgggaa

SEQ ID NO: 3168936 - RNA, 17 nt, Mycobacterium bovis subsp bovis AF2122/97
ucaccaacgcgggaacg

SEQ ID NO: 3168937 - RNA, 23 nt, Mycobacterium bovis subsp bovis AF2122/97
ucaccaacgcgggaacgaugccg

SEQ ID NO: 3168938 - RNA, 16 nt, Mycobacterium bovis subsp bovis AF2122/97
ucaccaagacaccggc

SEQ ID NO: 3168939 - RNA, 17 nt, Mycobacterium bovis subsp bovis AF2122/97
ucaccaaguucagcacg

SEQ ID NO: 3168940 - RNA, 20 nt, Mycobacterium bovis subsp bovis AF2122/97
ucaccaaguucagcacgugg

SEQ ID NO: 3168941 - RNA, 15 nt, Mycobacterium bovis subsp bovis AF2122/97
ucaccaaucugcggg

SEQ ID NO: 3168942 - RNA, 22 nt, Mycobacterium bovis subsp bovis AF2122/97
ucaccaaucugcgggccgguga

SEQ ID NO: 3168943 - RNA, 14 nt, Mycobacterium bovis subsp bovis AF2122/97
ucaccacaccggca

SEQ ID NO: 3168944 - RNA, 15 nt, Mycobacterium bovis subsp bovis AF2122/97
ucaccacaccggcag

SEQ ID NO: 3168945 - RNA, 16 nt, Mycobacterium bovis subsp bovis AF2122/97
ucaccacaugggagcc

SEQ ID NO: 3168946 - RNA, 15 nt, Mycobacterium bovis subsp bovis AF2122/97
ucaccacccgaccgc

SEQ ID NO: 3168947 - RNA, 16 nt, Mycobacterium bovis subsp bovis AF2122/97
ucaccacccgaccgcc

SEQ ID NO: 3168948 - RNA, 18 nt, Mycobacterium bovis subsp bovis AF2122/97
ucaccacccgaccgccau

SEQ ID NO: 3168949 - RNA, 14 nt, Mycobacterium bovis subsp bovis AF2122/97
ucaccacccgcacu

SEQ ID NO: 3168950 - RNA, 18 nt, Mycobacterium bovis subsp bovis AF2122/97
ucaccacccgucggcccg

SEQ ID NO: 3168951 - RNA, 22 nt, Mycobacterium bovis subsp bovis AF2122/97
ucaccacccgucggcccgcuca

SEQ ID NO: 3168952 - RNA, 13 nt, Mycobacterium bovis subsp bovis AF2122/97
ucaccaccgaccc

SEQ ID NO: 3168953 - RNA, 12 nt, Mycobacterium bovis subsp bovis AF2122/97
ucaccaccggca

SEQ ID NO: 3168954 - RNA, 13 nt, Mycobacterium bovis subsp bovis AF2122/97
ucaccaccggcac

SEQ ID NO: 3168955 - RNA, 15 nt, Mycobacterium bovis subsp bovis AF2122/97
ucaccaccggcaccg

SEQ ID NO: 3168956 - RNA, 14 nt, Mycobacterium bovis subsp bovis AF2122/97
ucaccaccguggcg

SEQ ID NO: 3168957 - RNA, 22 nt, Mycobacterium bovis subsp bovis AF2122/97
ucaccacgccggucgaggugac

SEQ ID NO: 3168958 - RNA, 14 nt, Mycobacterium bovis subsp bovis AF2122/97
ucaccacggcggcg

SEQ ID NO: 3168959 - RNA, 13 nt, Mycobacterium bovis subsp bovis AF2122/97
ucaccacgucguc

SEQ ID NO: 3168960 - RNA, 17 nt, Mycobacterium bovis subsp bovis AF2122/97
ucaccagcaacagcccg

SEQ ID NO: 3168961 - RNA, 12 nt, Mycobacterium bovis subsp bovis AF2122/97
ucaccagcaccc

SEQ ID NO: 3168962 - RNA, 18 nt, Mycobacterium bovis subsp bovis AF2122/97
ucaccagccaccccugcg

SEQ ID NO: 3168963 - RNA, 18 nt, Mycobacterium bovis subsp bovis AF2122/97
ucaccagcgcaucggcca

SEQ ID NO: 3168964 - RNA, 21 nt, Mycobacterium bovis subsp bovis AF2122/97
ucaccagcgcaucggccagca

SEQ ID NO: 3168965 - RNA, 16 nt, Mycobacterium bovis subsp bovis AF2122/97
ucaccagcggucagcc

SEQ ID NO: 3168966 - RNA, 13 nt, Mycobacterium bovis subsp bovis AF2122/97
ucaccagcuccuc

SEQ ID NO: 3168967 - RNA, 13 nt, Mycobacterium bovis subsp bovis AF2122/97
ucaccagcugcga

SEQ ID NO: 3168968 - RNA, 21 nt, Mycobacterium bovis subsp bovis AF2122/97
ucaccaggguguauggccacc

SEQ ID NO: 3168969 - RNA, 17 nt, Mycobacterium bovis subsp bovis AF2122/97
ucaccaggguuggcacc

SEQ ID NO: 3168970 - RNA, 19 nt, Mycobacterium bovis subsp bovis AF2122/97
ucaccauccagcccauccc

SEQ ID NO: 3168971 - RNA, 16 nt, Mycobacterium bovis subsp bovis AF2122/97
ucaccauggcgccgcg

SEQ ID NO: 3168972 - RNA, 20 nt, Mycobacterium bovis subsp bovis AF2122/97
ucaccauggcgccgcgccga

SEQ ID NO: 3168973 - RNA, 21 nt, Mycobacterium bovis subsp bovis AF2122/97
ucacccaaccccgccggccgg

SEQ ID NO: 3168974 - RNA, 19 nt, Mycobacterium bovis subsp bovis AF2122/97
ucacccaauucacgacgcc

SEQ ID NO: 3168975 - RNA, 17 nt, Mycobacterium bovis subsp bovis AF2122/97
ucacccacauggugauc

SEQ ID NO: 3168976 - RNA, 20 nt, Mycobacterium bovis subsp bovis AF2122/97
ucacccacauggugauccac

SEQ ID NO: 3168977 - RNA, 13 nt, Mycobacterium bovis subsp bovis AF2122/97
ucacccacccgca

SEQ ID NO: 3168978 - RNA, 19 nt, Mycobacterium bovis subsp bovis AF2122/97
ucacccacuccgccgauag

SEQ ID NO: 3168979 - RNA, 17 nt, Mycobacterium bovis subsp bovis AF2122/97
ucacccagcgccgaccc

SEQ ID NO: 3168980 - RNA, 16 nt, Mycobacterium bovis subsp bovis AF2122/97
ucacccagcucgcgca

SEQ ID NO: 3168981 - RNA, 19 nt, Mycobacterium bovis subsp bovis AF2122/97
ucacccagcucgcgcaccc

SEQ ID NO: 3168982 - RNA, 20 nt, Mycobacterium bovis subsp bovis AF2122/97
ucacccagcucgcgcaccca

SEQ ID NO: 3168983 - RNA, 22 nt, Mycobacterium bovis subsp bovis AF2122/97
ucacccagcucgcgcacccagc

SEQ ID NO: 3168984 - RNA, 21 nt, Mycobacterium bovis subsp bovis AF2122/97
ucacccagcugggucccgcug

SEQ ID NO: 3168985 - RNA, 17 nt, Mycobacterium bovis subsp bovis AF2122/97
ucacccaggcgccgaug

SEQ ID NO: 3168986 - RNA, 20 nt, Mycobacterium bovis subsp bovis AF2122/97
ucacccccgauagcgaccgc

SEQ ID NO: 3168987 - RNA, 21 nt, Mycobacterium bovis subsp bovis AF2122/97
ucacccccgauagcgaccgcg

SEQ ID NO: 3168988 - RNA, 19 nt, Mycobacterium bovis subsp bovis AF2122/97
ucacccccuggacuucggg

SEQ ID NO: 3168989 - RNA, 14 nt, Mycobacterium bovis subsp bovis AF2122/97
ucaccccggcggcc

SEQ ID NO: 3168990 - RNA, 16 nt, Mycobacterium bovis subsp bovis AF2122/97
ucacccgagccaucac

SEQ ID NO: 3168991 - RNA, 15 nt, Mycobacterium bovis subsp bovis AF2122/97
ucacccgcagccgcg

SEQ ID NO: 3168992 - RNA, 13 nt, Mycobacterium bovis subsp bovis AF2122/97
ucacccgcaucgg

SEQ ID NO: 3168993 - RNA, 12 nt, Mycobacterium bovis subsp bovis AF2122/97
ucacccgcccga

SEQ ID NO: 3168994 - RNA, 22 nt, Mycobacterium bovis subsp bovis AF2122/97
ucacccgccgcgguuaucgccg

SEQ ID NO: 3168995 - RNA, 18 nt, Mycobacterium bovis subsp bovis AF2122/97
ucacccgggcagccugcu

SEQ ID NO: 3168996 - RNA, 20 nt, Mycobacterium bovis subsp bovis AF2122/97
ucacccggucaacgugaacu

SEQ ID NO: 3168997 - RNA, 21 nt, Mycobacterium bovis subsp bovis AF2122/97
ucacccgguguccagugcauu

SEQ ID NO: 3168998 - RNA, 21 nt, Mycobacterium bovis subsp bovis AF2122/97
ucacccguguucgccacaccc

SEQ ID NO: 3168999 - RNA, 13 nt, Mycobacterium bovis subsp bovis AF2122/97
ucacccucccgca

SEQ ID NO: 3169000 - RNA, 16 nt, Mycobacterium bovis subsp bovis AF2122/97
ucacccugccagagau

SEQ ID NO: 3169001 - RNA, 18 nt, Mycobacterium bovis subsp bovis AF2122/97
ucacccugucgcgcaccg

SEQ ID NO: 3169002 - RNA, 20 nt, Mycobacterium bovis subsp bovis AF2122/97
ucacccuguuugcccaacag

SEQ ID NO: 3169003 - RNA, 21 nt, Mycobacterium bovis subsp bovis AF2122/97
ucacccuguuugcccaacaga

SEQ ID NO: 3169004 - RNA, 20 nt, Mycobacterium bovis subsp bovis AF2122/97
ucaccgaaacgaugcggccu

SEQ ID NO: 3169005 - RNA, 16 nt, Mycobacterium bovis subsp bovis AF2122/97
ucaccgaauaccgccg

SEQ ID NO: 3169006 - RNA, 17 nt, Mycobacterium bovis subsp bovis AF2122/97
ucaccgaauaccgccgc

SEQ ID NO: 3169007 - RNA, 17 nt, Mycobacterium bovis subsp bovis AF2122/97
ucaccgaaugcacgacg

SEQ ID NO: 3169008 - RNA, 13 nt, Mycobacterium bovis subsp bovis AF2122/97
ucaccgacaccgu

SEQ ID NO: 3169009 - RNA, 17 nt, Mycobacterium bovis subsp bovis AF2122/97
ucaccgacaccgugccg

SEQ ID NO: 3169010 - RNA, 15 nt, Mycobacterium bovis subsp bovis AF2122/97
ucaccuugcgcacca

SEQ ID NO: 3169011 - RNA, 21 nt, Mycobacterium bovis subsp bovis AF2122/97
ucaccuuuggccgcgaccggc

SEQ ID NO: 3169012 - RNA, 22 nt, Mycobacterium bovis subsp bovis AF2122/97
ucacgaagaccaggccggugac

SEQ ID NO: 3169013 - RNA, 20 nt, Mycobacterium bovis subsp bovis AF2122/97
ucacgacccaagucgccgag

SEQ ID NO: 3169014 - RNA, 21 nt, Mycobacterium bovis subsp bovis AF2122/97
ucacgaccggccaacgccgcc

SEQ ID NO: 3169015 - RNA, 17 nt, Mycobacterium bovis subsp bovis AF2122/97
ucacgaccugcucaucc

SEQ ID NO: 3169016 - RNA, 13 nt, Mycobacterium bovis subsp bovis AF2122/97
ucacgacgccgag

SEQ ID NO: 3169017 - RNA, 21 nt, Mycobacterium bovis subsp bovis AF2122/97
ucacgacguccgaucgguguc

SEQ ID NO: 3169018 - RNA, 20 nt, Mycobacterium bovis subsp bovis AF2122/97
ucacgacguugccucgcgac

SEQ ID NO: 3169019 - RNA, 15 nt, Mycobacterium bovis subsp bovis AF2122/97
ucacgagcaaaccag

SEQ ID NO: 3169020 - RNA, 13 nt, Mycobacterium bovis subsp bovis AF2122/97
ucacgagccaggg

SEQ ID NO: 3169021 - RNA, 17 nt, Mycobacterium bovis subsp bovis AF2122/97
ucacgaucgugccggga

SEQ ID NO: 3169022 - RNA, 16 nt, Mycobacterium bovis subsp bovis AF2122/97
ucacgaugcucgccgu

SEQ ID NO: 3169023 - RNA, 19 nt, Mycobacterium bovis subsp bovis AF2122/97
ucacgauguccucgaugcg

SEQ ID NO: 3169024 - RNA, 16 nt, Mycobacterium bovis subsp bovis AF2122/97
ucacgaugucguugua

SEQ ID NO: 3169025 - RNA, 19 nt, Mycobacterium bovis subsp bovis AF2122/97
ucacgcacccggcgcaaca

SEQ ID NO: 3169026 - RNA, 11 nt, Mycobacterium bovis subsp bovis AF2122/97
ucacgcaccgc

SEQ ID NO: 3169027 - RNA, 13 nt, Mycobacterium bovis subsp bovis AF2122/97
ucacgcaccgcgg

SEQ ID NO: 3169028 - RNA, 15 nt, Mycobacterium bovis subsp bovis AF2122/97
ucacgcacgccgcgu

SEQ ID NO: 3169029 - RNA, 23 nt, Mycobacterium bovis subsp bovis AF2122/97
ucacgcacugaugucacccgccc

SEQ ID NO: 3169030 - RNA, 22 nt, Mycobacterium bovis subsp bovis AF2122/97
ucacgcagcacccugcgggccg

SEQ ID NO: 3169031 - RNA, 16 nt, Mycobacterium bovis subsp bovis AF2122/97
ucacgcagccgcgcgg

SEQ ID NO: 3169032 - RNA, 13 nt, Mycobacterium bovis subsp bovis AF2122/97
ucacgcagucggg

SEQ ID NO: 3169033 - RNA, 15 nt, Mycobacterium bovis subsp bovis AF2122/97
ucacgcagucgggca

SEQ ID NO: 3169034 - RNA, 19 nt, Mycobacterium bovis subsp bovis AF2122/97
ucacgccaccgcaacucgc

SEQ ID NO: 3169035 - RNA, 13 nt, Mycobacterium bovis subsp bovis AF2122/97
ucacgcccaccac

SEQ ID NO: 3169036 - RNA, 20 nt, Mycobacterium bovis subsp bovis AF2122/97
ucacgcccaugaccggccgc

SEQ ID NO: 3169037 - RNA, 15 nt, Mycobacterium bovis subsp bovis AF2122/97
ucacgccccucacgu

SEQ ID NO: 3169038 - RNA, 19 nt, Mycobacterium bovis subsp bovis AF2122/97
ucacgccgccccugcgcgg

SEQ ID NO: 3169039 - RNA, 22 nt, Mycobacterium bovis subsp bovis AF2122/97
ucacgccgccccugcgcggcca

SEQ ID NO: 3169040 - RNA, 16 nt, Mycobacterium bovis subsp bovis AF2122/97
ucacgccgccggcgaa

SEQ ID NO: 3169041 - RNA, 23 nt, Mycobacterium bovis subsp bovis AF2122/97
ucacgccggccucgccgaagcgg

SEQ ID NO: 3169042 - RNA, 13 nt, Mycobacterium bovis subsp bovis AF2122/97
ucacgccugccac

SEQ ID NO: 3169043 - RNA, 15 nt, Mycobacterium bovis subsp bovis AF2122/97
ucacgcgaccaccgc

SEQ ID NO: 3169044 - RNA, 18 nt, Mycobacterium bovis subsp bovis AF2122/97
ucacgcgaggcgaagcgg

SEQ ID NO: 3169045 - RNA, 21 nt, Mycobacterium bovis subsp bovis AF2122/97
ucacgcgcggaucggcggccg

SEQ ID NO: 3169046 - RNA, 22 nt, Mycobacterium bovis subsp bovis AF2122/97
ucacgcgcggaucggcggccgc

SEQ ID NO: 3169047 - RNA, 17 nt, Mycobacterium bovis subsp bovis AF2122/97
ucacgcgcucaccgacg

SEQ ID NO: 3169048 - RNA, 20 nt, Mycobacterium bovis subsp bovis AF2122/97
ucacgcgcucaccgacgcug

SEQ ID NO: 3169049 - RNA, 16 nt, Mycobacterium bovis subsp bovis AF2122/97
ucacgcguacgucggu

SEQ ID NO: 3169050 - RNA, 23 nt, Mycobacterium bovis subsp bovis AF2122/97
ucacgcguacgucgguccaccca

SEQ ID NO: 3169051 - RNA, 16 nt, Mycobacterium bovis subsp bovis AF2122/97
ucacgcguuccauggc

SEQ ID NO: 3169052 - RNA, 19 nt, Mycobacterium bovis subsp bovis AF2122/97
ucacgcguuccauggcccg

SEQ ID NO: 3169053 - RNA, 22 nt, Mycobacterium bovis subsp bovis AF2122/97
ucacgcguuccauggcccgcuc

SEQ ID NO: 3169054 - RNA, 18 nt, Mycobacterium bovis subsp bovis AF2122/97
ucacgcucggcguccgcc

SEQ ID NO: 3169055 - RNA, 23 nt, Mycobacterium bovis subsp bovis AF2122/97
ucacgcucggcguccgcccagca

SEQ ID NO: 3169056 - RNA, 14 nt, Mycobacterium bovis subsp bovis AF2122/97
ucacgcugccccgc

SEQ ID NO: 3169057 - RNA, 20 nt, Mycobacterium bovis subsp bovis AF2122/97
ucacgcugccccgccgccau

SEQ ID NO: 3169058 - RNA, 21 nt, Mycobacterium bovis subsp bovis AF2122/97
ucacgcuggccuccagcuugg

SEQ ID NO: 3169059 - RNA, 13 nt, Mycobacterium bovis subsp bovis AF2122/97
ucacgcugugcgg

SEQ ID NO: 3169060 - RNA, 15 nt, Mycobacterium bovis subsp bovis AF2122/97
ucacggaccgccacc

SEQ ID NO: 3169061 - RNA, 16 nt, Mycobacterium bovis subsp bovis AF2122/97
ucacggagguccggug

SEQ ID NO: 3169062 - RNA, 20 nt, Mycobacterium bovis subsp bovis AF2122/97
ucacggaucugagcuagccg

SEQ ID NO: 3169063 - RNA, 14 nt, Mycobacterium bovis subsp bovis AF2122/97
ucacggcaggcggu

SEQ ID NO: 3169064 - RNA, 21 nt, Mycobacterium bovis subsp bovis AF2122/97
ucacggcaggcggugaacacc

SEQ ID NO: 3169065 - RNA, 16 nt, Mycobacterium bovis subsp bovis AF2122/97
ucacggcgcgagccug

SEQ ID NO: 3169066 - RNA, 19 nt, Mycobacterium bovis subsp bovis AF2122/97
ucacggcggccccggcauu

SEQ ID NO: 3169067 - RNA, 13 nt, Mycobacterium bovis subsp bovis AF2122/97
ucacggcggggau

SEQ ID NO: 3169068 - RNA, 23 nt, Mycobacterium bovis subsp bovis AF2122/97
ucacggcggggaucgcuggccgc

SEQ ID NO: 3169069 - RNA, 18 nt, Mycobacterium bovis subsp bovis AF2122/97
ucacggcgucgacuggcc

SEQ ID NO: 3169070 - RNA, 19 nt, Mycobacterium bovis subsp bovis AF2122/97
ucacggcgucgacuggccg

SEQ ID NO: 3169071 - RNA, 14 nt, Mycobacterium bovis subsp bovis AF2122/97
ucacgggacgacgg

SEQ ID NO: 3169072 - RNA, 17 nt, Mycobacterium bovis subsp bovis AF2122/97
ucacgggcuaccggcag

SEQ ID NO: 3169073 - RNA, 13 nt, Mycobacterium bovis subsp bovis AF2122/97
ucacgggucagca

SEQ ID NO: 3169074 - RNA, 15 nt, Mycobacterium bovis subsp bovis AF2122/97
ucacgggugcuggca

SEQ ID NO: 3169075 - RNA, 18 nt, Mycobacterium bovis subsp bovis AF2122/97
ucacgguagcguucgucg

SEQ ID NO: 3169076 - RNA, 14 nt, Mycobacterium bovis subsp bovis AF2122/97
ucacggucgacgau

SEQ ID NO: 3169077 - RNA, 14 nt, Mycobacterium bovis subsp bovis AF2122/97
ucacggucgcggau

SEQ ID NO: 3169078 - RNA, 20 nt, Mycobacterium bovis subsp bovis AF2122/97
ucacggucggaucgauuccg

SEQ ID NO: 3169079 - RNA, 13 nt, Mycobacterium bovis subsp bovis AF2122/97
ucacgguggccgc

SEQ ID NO: 3169080 - RNA, 15 nt, Mycobacterium bovis subsp bovis AF2122/97
ucacggugggcgccg

SEQ ID NO: 3169081 - RNA, 21 nt, Mycobacterium bovis subsp bovis AF2122/97
ucacggugggcgccgacaccg

SEQ ID NO: 3169082 - RNA, 22 nt, Mycobacterium bovis subsp bovis AF2122/97
ucacgguucgcccgucgccaau

SEQ ID NO: 3169083 - RNA, 17 nt, Mycobacterium bovis subsp bovis AF2122/97
ucacguacgccgccgau

SEQ ID NO: 3169084 - RNA, 21 nt, Mycobacterium bovis subsp bovis AF2122/97
ucacguagcgaccgcggucgc

SEQ ID NO: 3169085 - RNA, 20 nt, Mycobacterium bovis subsp bovis AF2122/97
ucacgucagcguugaccgca

SEQ ID NO: 3169086 - RNA, 14 nt, Mycobacterium bovis subsp bovis AF2122/97
ucacguccgcgggg

SEQ ID NO: 3169087 - RNA, 21 nt, Mycobacterium bovis subsp bovis AF2122/97
ucacguccgcgggggaccgcc

SEQ ID NO: 3169088 - RNA, 16 nt, Mycobacterium bovis subsp bovis AF2122/97
ucacgucgacggcggc

SEQ ID NO: 3169089 - RNA, 12 nt, Mycobacterium bovis subsp bovis AF2122/97
ucacgucgaugu

SEQ ID NO: 3169090 - RNA, 14 nt, Mycobacterium bovis subsp bovis AF2122/97
ucacgugcccgcgc

SEQ ID NO: 3169091 - RNA, 14 nt, Mycobacterium bovis subsp bovis AF2122/97
ucacgugcgacgaa

SEQ ID NO: 3169092 - RNA, 14 nt, Mycobacterium bovis subsp bovis AF2122/97
ucacguggaccacg

SEQ ID NO: 3169093 - RNA, 22 nt, Mycobacterium bovis subsp bovis AF2122/97
ucacguucagcccaugcccggc

SEQ ID NO: 3169094 - RNA, 19 nt, Mycobacterium bovis subsp bovis AF2122/97
ucacguucaguuccgcggc

SEQ ID NO: 3169095 - RNA, 14 nt, Mycobacterium bovis subsp bovis AF2122/97
ucacguucggcgac

SEQ ID NO: 3169096 - RNA, 23 nt, Mycobacterium bovis subsp bovis AF2122/97
ucacuacgggucuggccaacgcc

SEQ ID NO: 3169097 - RNA, 22 nt, Mycobacterium bovis subsp bovis AF2122/97
ucagccagggucccgccgccug

SEQ ID NO: 3169098 - RNA, 16 nt, Mycobacterium bovis subsp bovis AF2122/97
ucagccaguccagcgc

SEQ ID NO: 3169099 - RNA, 12 nt, Mycobacterium bovis subsp bovis AF2122/97
ucagcccaggug

SEQ ID NO: 3169100 - RNA, 16 nt, Mycobacterium bovis subsp bovis AF2122/97
ucagcccaucuaccag

SEQ ID NO: 3169101 - RNA, 16 nt, Mycobacterium bovis subsp bovis AF2122/97
ucagccccaugaucug

SEQ ID NO: 3169102 - RNA, 21 nt, Mycobacterium bovis subsp bovis AF2122/97
ucagcccgaacucguuggcga

SEQ ID NO: 3169103 - RNA, 22 nt, Mycobacterium bovis subsp bovis AF2122/97
ucagcccgacaccguccagcag

SEQ ID NO: 3169104 - RNA, 16 nt, Mycobacterium bovis subsp bovis AF2122/97
ucagcccgccggaccc

SEQ ID NO: 3169105 - RNA, 13 nt, Mycobacterium bovis subsp bovis AF2122/97
ucagcccgcgcag

SEQ ID NO: 3169106 - RNA, 15 nt, Mycobacterium bovis subsp bovis AF2122/97
ucagcccggccagcc

SEQ ID NO: 3169107 - RNA, 18 nt, Mycobacterium bovis subsp bovis AF2122/97
ucagcccggccagccgca

SEQ ID NO: 3169108 - RNA, 20 nt, Mycobacterium bovis subsp bovis AF2122/97
ucagcccggccuugccgccg

SEQ ID NO: 3169109 - RNA, 17 nt, Mycobacterium bovis subsp bovis AF2122/97
ucagcccggcgcgaucc

SEQ ID NO: 3169110 - RNA, 15 nt, Mycobacterium bovis subsp bovis AF2122/97
ucagcccggcgcgcc

SEQ ID NO: 3169111 - RNA, 15 nt, Mycobacterium bovis subsp bovis AF2122/97
ucagccgacaagguc

SEQ ID NO: 3169112 - RNA, 19 nt, Mycobacterium bovis subsp bovis AF2122/97
ucagccgcaccccgcccga

SEQ ID NO: 3169113 - RNA, 14 nt, Mycobacterium bovis subsp bovis AF2122/97
ucagccgccgccug

SEQ ID NO: 3169114 - RNA, 14 nt, Mycobacterium bovis subsp bovis AF2122/97
ucagccgcgccggg

SEQ ID NO: 3169115 - RNA, 22 nt, Mycobacterium bovis subsp bovis AF2122/97
ucagccgcgccggguccgcgga

SEQ ID NO: 3169116 - RNA, 22 nt, Mycobacterium bovis subsp bovis AF2122/97
ucagccgcgcgggucacgaccu

SEQ ID NO: 3169117 - RNA, 15 nt, Mycobacterium bovis subsp bovis AF2122/97
ucagccgcggccaca

SEQ ID NO: 3169118 - RNA, 12 nt, Mycobacterium bovis subsp bovis AF2122/97
ucagccgcggcg

SEQ ID NO: 3169119 - RNA, 20 nt, Mycobacterium bovis subsp bovis AF2122/97
ucagccggccauacgcgcgc

SEQ ID NO: 3169120 - RNA, 22 nt, Mycobacterium bovis subsp bovis AF2122/97
ucagccggugacaaguggugcc

SEQ ID NO: 3169121 - RNA, 17 nt, Mycobacterium bovis subsp bovis AF2122/97
ucagccgguggucugcg

SEQ ID NO: 3169122 - RNA, 20 nt, Mycobacterium bovis subsp bovis AF2122/97
ucagccgguggucugcgcgg

SEQ ID NO: 3169123 - RNA, 16 nt, Mycobacterium bovis subsp bovis AF2122/97
ucagccguacgccgua

SEQ ID NO: 3169124 - RNA, 14 nt, Mycobacterium bovis subsp bovis AF2122/97
ucagccguccgggc

SEQ ID NO: 3169125 - RNA, 19 nt, Mycobacterium bovis subsp bovis AF2122/97
ucagccguccgggcggccu

SEQ ID NO: 3169126 - RNA, 16 nt, Mycobacterium bovis subsp bovis AF2122/97
ucagccgugcgggccg

SEQ ID NO: 3169127 - RNA, 12 nt, Mycobacterium bovis subsp bovis AF2122/97
ucagccguggca

SEQ ID NO: 3169128 - RNA, 21 nt, Mycobacterium bovis subsp bovis AF2122/97
ucagccugauauccgcggauc

SEQ ID NO: 3169129 - RNA, 22 nt, Mycobacterium bovis subsp bovis AF2122/97
ucagcgaaccaccggcgccgcc

SEQ ID NO: 3169130 - RNA, 22 nt, Mycobacterium bovis subsp bovis AF2122/97
ucagcgaagccgggucucggug

SEQ ID NO: 3169131 - RNA, 15 nt, Mycobacterium bovis subsp bovis AF2122/97
ucagcgaccucacga

SEQ ID NO: 3169132 - RNA, 22 nt, Mycobacterium bovis subsp bovis AF2122/97
ucagcgaccucacugcggcgcc

SEQ ID NO: 3169133 - RNA, 17 nt, Mycobacterium bovis subsp bovis AF2122/97
ucagcgacgcauaaccg

SEQ ID NO: 3169134 - RNA, 20 nt, Mycobacterium bovis subsp bovis AF2122/97
ucagcgacggccgccagcag

SEQ ID NO: 3169135 - RNA, 22 nt, Mycobacterium bovis subsp bovis AF2122/97
ucagcgacggccgccagcagcu

SEQ ID NO: 3169136 - RNA, 18 nt, Mycobacterium bovis subsp bovis AF2122/97
ucagcgacuugcggugcu

SEQ ID NO: 3169137 - RNA, 18 nt, Mycobacterium bovis subsp bovis AF2122/97
ucagcgaguagccgcuag

SEQ ID NO: 3169138 - RNA, 14 nt, Mycobacterium bovis subsp bovis AF2122/97
ucagcgaguggucc

SEQ ID NO: 3169139 - RNA, 18 nt, Mycobacterium bovis subsp bovis AF2122/97
ucagcgaguuucugcucg

SEQ ID NO: 3169140 - RNA, 16 nt, Mycobacterium bovis subsp bovis AF2122/97
ucagcgaugcggcccu

SEQ ID NO: 3169141 - RNA, 19 nt, Mycobacterium bovis subsp bovis AF2122/97
ucagcgcacuggccgcuau

SEQ ID NO: 3169142 - RNA, 21 nt, Mycobacterium bovis subsp bovis AF2122/97
ucagcgcacuggccgcuaucc

SEQ ID NO: 3169143 - RNA, 20 nt, Mycobacterium bovis subsp bovis AF2122/97
ucagcgcagcaacugggcgg

SEQ ID NO: 3169144 - RNA, 20 nt, Mycobacterium bovis subsp bovis AF2122/97
ucagcgcaucgccgcuggcc

SEQ ID NO: 3169145 - RNA, 22 nt, Mycobacterium bovis subsp bovis AF2122/97
ucagcgcaucgccgcuggccag

SEQ ID NO: 3169146 - RNA, 23 nt, Mycobacterium bovis subsp bovis AF2122/97
ucagcgcaucgccgcuggccagc

SEQ ID NO: 3169147 - RNA, 19 nt, Mycobacterium bovis subsp bovis AF2122/97
ucagcgccacguccaucac

SEQ ID NO: 3169148 - RNA, 13 nt, Mycobacterium bovis subsp bovis AF2122/97
ucagcgccagcga

SEQ ID NO: 3169149 - RNA, 22 nt, Mycobacterium bovis subsp bovis AF2122/97
ucagcgccgagagcaccgcucg

SEQ ID NO: 3169150 - RNA, 19 nt, Mycobacterium bovis subsp bovis AF2122/97
ucagcgccgcauucgcgac

SEQ ID NO: 3169151 - RNA, 21 nt, Mycobacterium bovis subsp bovis AF2122/97
ucagcgccgcgccccagacgc

SEQ ID NO: 3169152 - RNA, 14 nt, Mycobacterium bovis subsp bovis AF2122/97
ucagcgcgaccgaa

SEQ ID NO: 3169153 - RNA, 20 nt, Mycobacterium bovis subsp bovis AF2122/97
ucagcgcgaccgucaggguc

SEQ ID NO: 3169154 - RNA, 19 nt, Mycobacterium bovis subsp bovis AF2122/97
ucagcgcgcgccgcugggu

SEQ ID NO: 3169155 - RNA, 21 nt, Mycobacterium bovis subsp bovis AF2122/97
ucagcgcgcgguuuucggcug

SEQ ID NO: 3169156 - RNA, 17 nt, Mycobacterium bovis subsp bovis AF2122/97
ucagcgcggccacgccg

SEQ ID NO: 3169157 - RNA, 15 nt, Mycobacterium bovis subsp bovis AF2122/97
ucagcgcggcgaccu

SEQ ID NO: 3169158 - RNA, 15 nt, Mycobacterium bovis subsp bovis AF2122/97
ucagcgcgguccauc

SEQ ID NO: 3169159 - RNA, 16 nt, Mycobacterium bovis subsp bovis AF2122/97
ucagcgcguagccaau

SEQ ID NO: 3169160 - RNA, 15 nt, Mycobacterium bovis subsp bovis AF2122/97
ucagcgcuggcaggc

SEQ ID NO: 3169161 - RNA, 17 nt, Mycobacterium bovis subsp bovis AF2122/97
ucagcgcuggcaggccg

SEQ ID NO: 3169162 - RNA, 18 nt, Mycobacterium bovis subsp bovis AF2122/97
ucagcggauccagaaacu

SEQ ID NO: 3169163 - RNA, 18 nt, Mycobacterium bovis subsp bovis AF2122/97
ucagcggcagcaccgcac

SEQ ID NO: 3169164 - RNA, 14 nt, Mycobacterium bovis subsp bovis AF2122/97
ucagcggccaaccc

SEQ ID NO: 3169165 - RNA, 17 nt, Mycobacterium bovis subsp bovis AF2122/97
ucagcggccagcagugc

SEQ ID NO: 3169166 - RNA, 22 nt, Mycobacterium bovis subsp bovis AF2122/97
ucagcggccgguacacguccag

SEQ ID NO: 3169167 - RNA, 16 nt, Mycobacterium bovis subsp bovis AF2122/97
ucagcggcgaccgcau

SEQ ID NO: 3169168 - RNA, 22 nt, Mycobacterium bovis subsp bovis AF2122/97
ucagcggcgccaguauggccgc

SEQ ID NO: 3169169 - RNA, 12 nt, Mycobacterium bovis subsp bovis AF2122/97
ucagcggcggcc

SEQ ID NO: 3169170 - RNA, 15 nt, Mycobacterium bovis subsp bovis AF2122/97
ucagcggcugggcgg

SEQ ID NO: 3169171 - RNA, 17 nt, Mycobacterium bovis subsp bovis AF2122/97
ucagcgggcacgccgcc

SEQ ID NO: 3169172 - RNA, 18 nt, Mycobacterium bovis subsp bovis AF2122/97
ucagcgggcacgccgccg

SEQ ID NO: 3169173 - RNA, 19 nt, Mycobacterium bovis subsp bovis AF2122/97
ucagcgggcacgccgccga

SEQ ID NO: 3169174 - RNA, 13 nt, Mycobacterium bovis subsp bovis AF2122/97
ucagcgggcagca

SEQ ID NO: 3169175 - RNA, 20 nt, Mycobacterium bovis subsp bovis AF2122/97
ucagcgggcagcaggcgaug

SEQ ID NO: 3169176 - RNA, 23 nt, Mycobacterium bovis subsp bovis AF2122/97
ucagcgggcagcaggcgaugcgc

SEQ ID NO: 3169177 - RNA, 16 nt, Mycobacterium bovis subsp bovis AF2122/97
ucagcgggucgacccc

SEQ ID NO: 3169178 - RNA, 14 nt, Mycobacterium bovis subsp bovis AF2122/97
ucagcgguugggcg

SEQ ID NO: 3169179 - RNA, 20 nt, Mycobacterium bovis subsp bovis AF2122/97
ucagcguauuggacgcugcc

SEQ ID NO: 3169180 - RNA, 23 nt, Mycobacterium bovis subsp bovis AF2122/97
ucagcguauuggacgcugccgca

SEQ ID NO: 3169181 - RNA, 22 nt, Mycobacterium bovis subsp bovis AF2122/97
ucagcgucaggccuccaaaauc

SEQ ID NO: 3169182 - RNA, 13 nt, Mycobacterium bovis subsp bovis AF2122/97
ucagcgucgacgu

SEQ ID NO: 3169183 - RNA, 16 nt, Mycobacterium bovis subsp bovis AF2122/97
ucagguuggcggcugc

SEQ ID NO: 3169184 - RNA, 19 nt, Mycobacterium bovis subsp bovis AF2122/97
ucaguaauucggccaucgc

SEQ ID NO: 3169185 - RNA, 14 nt, Mycobacterium bovis subsp bovis AF2122/97
ucaguaccgcacgc

SEQ ID NO: 3169186 - RNA, 15 nt, Mycobacterium bovis subsp bovis AF2122/97
ucaguacgcugcggc

SEQ ID NO: 3169187 - RNA, 22 nt, Mycobacterium bovis subsp bovis AF2122/97
ucaguagccacgcccacagggg

SEQ ID NO: 3169188 - RNA, 14 nt, Mycobacterium bovis subsp bovis AF2122/97
ucaguauggcgacg

SEQ ID NO: 3169189 - RNA, 20 nt, Mycobacterium bovis subsp bovis AF2122/97
ucaguauucguaguccgguc

SEQ ID NO: 3169190 - RNA, 23 nt, Mycobacterium bovis subsp bovis AF2122/97
ucaguccggcccccgacuccggc

SEQ ID NO: 3169191 - RNA, 20 nt, Mycobacterium bovis subsp bovis AF2122/97
ucagugcaagaccgcaucgg

SEQ ID NO: 3169192 - RNA, 16 nt, Mycobacterium bovis subsp bovis AF2122/97
ucagugccaaagcggc

SEQ ID NO: 3169193 - RNA, 16 nt, Mycobacterium bovis subsp bovis AF2122/97
ucagugccccgcccgg

SEQ ID NO: 3169194 - RNA, 13 nt, Mycobacterium bovis subsp bovis AF2122/97
ucagugcgggcgg

SEQ ID NO: 3169195 - RNA, 23 nt, Mycobacterium bovis subsp bovis AF2122/97
ucagugcgugauggcggcgcacc

SEQ ID NO: 3169196 - RNA, 21 nt, Mycobacterium bovis subsp bovis AF2122/97
ucaguguacaccgcgcccgcc

SEQ ID NO: 3169197 - RNA, 20 nt, Mycobacterium bovis subsp bovis AF2122/97
ucaguucccgaaccccgacc

SEQ ID NO: 3169198 - RNA, 19 nt, Mycobacterium bovis subsp bovis AF2122/97
ucaguucgacggugccguc

SEQ ID NO: 3169199 - RNA, 22 nt, Mycobacterium bovis subsp bovis AF2122/97
ucaguucggccgucauggcccg

SEQ ID NO: 3169200 - RNA, 17 nt, Mycobacterium bovis subsp bovis AF2122/97
ucaguugauagcuguug

SEQ ID NO: 3169201 - RNA, 15 nt, Mycobacterium bovis subsp bovis AF2122/97
ucaguugcacaccga

SEQ ID NO: 3169202 - RNA, 22 nt, Mycobacterium bovis subsp bovis AF2122/97
ucaguugguagagcaccagguu

SEQ ID NO: 3169203 - RNA, 13 nt, Mycobacterium bovis subsp bovis AF2122/97
ucaguugugcguu

SEQ ID NO: 3169204 - RNA, 22 nt, Mycobacterium bovis subsp bovis AF2122/97
ucaguuuagggaaaaucacaau

SEQ ID NO: 3169205 - RNA, 20 nt, Mycobacterium bovis subsp bovis AF2122/97
ucauaaagguccaaccaccg

SEQ ID NO: 3169206 - RNA, 15 nt, Mycobacterium bovis subsp bovis AF2122/97
ucauacucgacaccg

SEQ ID NO: 3169207 - RNA, 17 nt, Mycobacterium bovis subsp bovis AF2122/97
ucauagacagggccgcu

SEQ ID NO: 3169208 - RNA, 22 nt, Mycobacterium bovis subsp bovis AF2122/97
ucauagccguugcgggccaggc

SEQ ID NO: 3169209 - RNA, 13 nt, Mycobacterium bovis subsp bovis AF2122/97
ucauaggccugca

SEQ ID NO: 3169210 - RNA, 19 nt, Mycobacterium bovis subsp bovis AF2122/97
ucauauccgccccagcugc

SEQ ID NO: 3169211 - RNA, 15 nt, Mycobacterium bovis subsp bovis AF2122/97
ucaucaagguguugc

SEQ ID NO: 3169212 - RNA, 18 nt, Mycobacterium bovis subsp bovis AF2122/97
ucaucacccagcgccgac

SEQ ID NO: 3169213 - RNA, 21 nt, Mycobacterium bovis subsp bovis AF2122/97
ucaucacccagcgccgaccca

SEQ ID NO: 3169214 - RNA, 13 nt, Mycobacterium bovis subsp bovis AF2122/97
ucaucaccggcau

SEQ ID NO: 3169215 - RNA, 14 nt, Mycobacterium bovis subsp bovis AF2122/97
ucaucaccggcgca

SEQ ID NO: 3169216 - RNA, 17 nt, Mycobacterium bovis subsp bovis AF2122/97
ucaucaccggcgcaccg

SEQ ID NO: 3169217 - RNA, 16 nt, Mycobacterium bovis subsp bovis AF2122/97
ucaucaccucucgcuu

SEQ ID NO: 3169218 - RNA, 17 nt, Mycobacterium bovis subsp bovis AF2122/97
ucaucagagcgcugguu

SEQ ID NO: 3169219 - RNA, 14 nt, Mycobacterium bovis subsp bovis AF2122/97
ucaucagcggcgcc

SEQ ID NO: 3169220 - RNA, 16 nt, Mycobacterium bovis subsp bovis AF2122/97
ucaucaggucgucguc

SEQ ID NO: 3169221 - RNA, 19 nt, Mycobacterium bovis subsp bovis AF2122/97
ucaucauauccgccccagc

SEQ ID NO: 3169222 - RNA, 15 nt, Mycobacterium bovis subsp bovis AF2122/97
ucaucauccacaccg

SEQ ID NO: 3169223 - RNA, 15 nt, Mycobacterium bovis subsp bovis AF2122/97
ucauccacaccggau

SEQ ID NO: 3169224 - RNA, 15 nt, Mycobacterium bovis subsp bovis AF2122/97
ucauccaccccugag

SEQ ID NO: 3169225 - RNA, 20 nt, Mycobacterium bovis subsp bovis AF2122/97
ucauccacuccgccaacauc

SEQ ID NO: 3169226 - RNA, 17 nt, Mycobacterium bovis subsp bovis AF2122/97
ucauccauucggcggcg

SEQ ID NO: 3169227 - RNA, 21 nt, Mycobacterium bovis subsp bovis AF2122/97
ucaucccaagcguccgcugca

SEQ ID NO: 3169228 - RNA, 13 nt, Mycobacterium bovis subsp bovis AF2122/97
ucauccccgacug

SEQ ID NO: 3169229 - RNA, 20 nt, Mycobacterium bovis subsp bovis AF2122/97
ucaucccgauguaccccagc

SEQ ID NO: 3169230 - RNA, 18 nt, Mycobacterium bovis subsp bovis AF2122/97
ucaucccuuucgcgccgc

SEQ ID NO: 3169231 - RNA, 17 nt, Mycobacterium bovis subsp bovis AF2122/97
ucauccgacaagcuguc

SEQ ID NO: 3169232 - RNA, 16 nt, Mycobacterium bovis subsp bovis AF2122/97
ucauccgagcgguggu

SEQ ID NO: 3169233 - RNA, 17 nt, Mycobacterium bovis subsp bovis AF2122/97
ucauccgagcgguggug

SEQ ID NO: 3169234 - RNA, 17 nt, Mycobacterium bovis subsp bovis AF2122/97
ucauccgggcgaccacc

SEQ ID NO: 3169235 - RNA, 18 nt, Mycobacterium bovis subsp bovis AF2122/97
ucauccgggcgaccacca

SEQ ID NO: 3169236 - RNA, 19 nt, Mycobacterium bovis subsp bovis AF2122/97
ucauccgggcgaccaccac

SEQ ID NO: 3169237 - RNA, 19 nt, Mycobacterium bovis subsp bovis AF2122/97
ucauccuccugcgccgcag

SEQ ID NO: 3169238 - RNA, 19 nt, Mycobacterium bovis subsp bovis AF2122/97
ucauccuucgccggcgcca

SEQ ID NO: 3169239 - RNA, 15 nt, Mycobacterium bovis subsp bovis AF2122/97
ucaucgacggugauc

SEQ ID NO: 3169240 - RNA, 17 nt, Mycobacterium bovis subsp bovis AF2122/97
ucaucgacguuccagca

SEQ ID NO: 3169241 - RNA, 20 nt, Mycobacterium bovis subsp bovis AF2122/97
ucaucgacuugccgccgcac

SEQ ID NO: 3169242 - RNA, 21 nt, Mycobacterium bovis subsp bovis AF2122/97
ucaucgagcgggaucgggccc

SEQ ID NO: 3169243 - RNA, 20 nt, Mycobacterium bovis subsp bovis AF2122/97
ucaucgagucgaagaaccug

SEQ ID NO: 3169244 - RNA, 18 nt, Mycobacterium bovis subsp bovis AF2122/97
ucaucgaucacacguccg

SEQ ID NO: 3169245 - RNA, 18 nt, Mycobacterium bovis subsp bovis AF2122/97
ucaucgauccucgcccgc

SEQ ID NO: 3169246 - RNA, 12 nt, Mycobacterium bovis subsp bovis AF2122/97
ucaucgaugcga

SEQ ID NO: 3169247 - RNA, 18 nt, Mycobacterium bovis subsp bovis AF2122/97
ucaucgcagucaugucca

SEQ ID NO: 3169248 - RNA, 22 nt, Mycobacterium bovis subsp bovis AF2122/97
ucaucgccaaaaguacuggcgu

SEQ ID NO: 3169249 - RNA, 15 nt, Mycobacterium bovis subsp bovis AF2122/97
ucaucgccagcggca

SEQ ID NO: 3169250 - RNA, 19 nt, Mycobacterium bovis subsp bovis AF2122/97
ucaucgcccaccgcaacgc

SEQ ID NO: 3169251 - RNA, 19 nt, Mycobacterium bovis subsp bovis AF2122/97
ucaucgcccugggcgccgg

SEQ ID NO: 3169252 - RNA, 16 nt, Mycobacterium bovis subsp bovis AF2122/97
ucaucgccucgaggac

SEQ ID NO: 3169253 - RNA, 16 nt, Mycobacterium bovis subsp bovis AF2122/97
ucaucgcgcacgcccu

SEQ ID NO: 3169254 - RNA, 14 nt, Mycobacterium bovis subsp bovis AF2122/97
ucaucgcgcccgcc

SEQ ID NO: 3169255 - RNA, 22 nt, Mycobacterium bovis subsp bovis AF2122/97
ucaucgcggcgaacaucaccgu

SEQ ID NO: 3169256 - RNA, 19 nt, Mycobacterium bovis subsp bovis AF2122/97
ucaucgcggucgccaccgu

SEQ ID NO: 3169257 - RNA, 19 nt, Mycobacterium bovis subsp bovis AF2122/97
ucaucggcaaacuccugca

SEQ ID NO: 3169258 - RNA, 17 nt, Mycobacterium bovis subsp bovis AF2122/97
ucaucggcacaggcggc

SEQ ID NO: 3169259 - RNA, 14 nt, Mycobacterium bovis subsp bovis AF2122/97
ucaucggcaucgac

SEQ ID NO: 3169260 - RNA, 15 nt, Mycobacterium bovis subsp bovis AF2122/97
ucaucggcuggccgc

SEQ ID NO: 3169261 - RNA, 16 nt, Mycobacterium bovis subsp bovis AF2122/97
ucaucgggagccgcac

SEQ ID NO: 3169262 - RNA, 13 nt, Mycobacterium bovis subsp bovis AF2122/97
ucaucgggccaca

SEQ ID NO: 3169263 - RNA, 23 nt, Mycobacterium bovis subsp bovis AF2122/97
ucaucgguugaccggucgaccaa

SEQ ID NO: 3169264 - RNA, 13 nt, Mycobacterium bovis subsp bovis AF2122/97
ucaucguggggau

SEQ ID NO: 3169265 - RNA, 16 nt, Mycobacterium bovis subsp bovis AF2122/97
ucaucgugguaaccau

SEQ ID NO: 3169266 - RNA, 20 nt, Mycobacterium bovis subsp bovis AF2122/97
ucaucucggugguggccaug

SEQ ID NO: 3169267 - RNA, 12 nt, Mycobacterium bovis subsp bovis AF2122/97
ucaucucgucgu

SEQ ID NO: 3169268 - RNA, 19 nt, Mycobacterium bovis subsp bovis AF2122/97
ucaucuguaaccuccucga

SEQ ID NO: 3169269 - RNA, 22 nt, Mycobacterium bovis subsp bovis AF2122/97
uccaccccugagcucccgccgg

SEQ ID NO: 3169270 - RNA, 14 nt, Mycobacterium bovis subsp bovis AF2122/97
uccacccgacgacg

SEQ ID NO: 3169271 - RNA, 20 nt, Mycobacterium bovis subsp bovis AF2122/97
uccacccgauauucggccau

SEQ ID NO: 3169272 - RNA, 14 nt, Mycobacterium bovis subsp bovis AF2122/97
uccacccgccggcc

SEQ ID NO: 3169273 - RNA, 19 nt, Mycobacterium bovis subsp bovis AF2122/97
uccacccuugccgcuggug

SEQ ID NO: 3169274 - RNA, 22 nt, Mycobacterium bovis subsp bovis AF2122/97
uccaccgaaaaguccgccgccu

SEQ ID NO: 3169275 - RNA, 21 nt, Mycobacterium bovis subsp bovis AF2122/97
uccaccgacguggccagcccg

SEQ ID NO: 3169276 - RNA, 18 nt, Mycobacterium bovis subsp bovis AF2122/97
uccaccgauucggcgacg

SEQ ID NO: 3169277 - RNA, 23 nt, Mycobacterium bovis subsp bovis AF2122/97
uccaccgcacggaugucgcccaa

SEQ ID NO: 3169278 - RNA, 18 nt, Mycobacterium bovis subsp bovis AF2122/97
uccaccgcagauccccgc

SEQ ID NO: 3169279 - RNA, 21 nt, Mycobacterium bovis subsp bovis AF2122/97
uccaccgcagauccccgccac

SEQ ID NO: 3169280 - RNA, 23 nt, Mycobacterium bovis subsp bovis AF2122/97
uccaccgcagauccccgccaccg

SEQ ID NO: 3169281 - RNA, 23 nt, Mycobacterium bovis subsp bovis AF2122/97
uccaccgccgagaugcuggucgg

SEQ ID NO: 3169282 - RNA, 15 nt, Mycobacterium bovis subsp bovis AF2122/97
uccaccgcgccggcg

SEQ ID NO: 3169283 - RNA, 23 nt, Mycobacterium bovis subsp bovis AF2122/97
uccaccgcugccggcagcguccg

SEQ ID NO: 3169284 - RNA, 17 nt, Mycobacterium bovis subsp bovis AF2122/97
uccaccggaccgaccac

SEQ ID NO: 3169285 - RNA, 20 nt, Mycobacterium bovis subsp bovis AF2122/97
uccaccggacggguuacucg

SEQ ID NO: 3169286 - RNA, 16 nt, Mycobacterium bovis subsp bovis AF2122/97
uccaccgggcccgccg

SEQ ID NO: 3169287 - RNA, 19 nt, Mycobacterium bovis subsp bovis AF2122/97
uccaccgggcccgccggcc

SEQ ID NO: 3169288 - RNA, 20 nt, Mycobacterium bovis subsp bovis AF2122/97
uccaccgggcccgccggccc

SEQ ID NO: 3169289 - RNA, 16 nt, Mycobacterium bovis subsp bovis AF2122/97
uccaccgggcgucguc

SEQ ID NO: 3169290 - RNA, 16 nt, Mycobacterium bovis subsp bovis AF2122/97
uccaccgucacggucg

SEQ ID NO: 3169291 - RNA, 17 nt, Mycobacterium bovis subsp bovis AF2122/97
uccaccguuagccaggu

SEQ ID NO: 3169292 - RNA, 18 nt, Mycobacterium bovis subsp bovis AF2122/97
uccaccguuagccagguc

SEQ ID NO: 3169293 - RNA, 15 nt, Mycobacterium bovis subsp bovis AF2122/97
uccaccucgauggcg

SEQ ID NO: 3169294 - RNA, 23 nt, Mycobacterium bovis subsp bovis AF2122/97
uccaccuuggccagacccaccac

SEQ ID NO: 3169295 - RNA, 13 nt, Mycobacterium bovis subsp bovis AF2122/97
uccacgacgucga

SEQ ID NO: 3169296 - RNA, 21 nt, Mycobacterium bovis subsp bovis AF2122/97
uccacgauaucgaugcggcga

SEQ ID NO: 3169297 - RNA, 16 nt, Mycobacterium bovis subsp bovis AF2122/97
uccacgaucacccgga

SEQ ID NO: 3169298 - RNA, 14 nt, Mycobacterium bovis subsp bovis AF2122/97
uccacgaucggccc

SEQ ID NO: 3169299 - RNA, 18 nt, Mycobacterium bovis subsp bovis AF2122/97
uccacgaucggcccagcc

SEQ ID NO: 3169300 - RNA, 15 nt, Mycobacterium bovis subsp bovis AF2122/97
uccacgcaaacgggg

SEQ ID NO: 3169301 - RNA, 13 nt, Mycobacterium bovis subsp bovis AF2122/97
uccacgcaccacg

SEQ ID NO: 3169302 - RNA, 21 nt, Mycobacterium bovis subsp bovis AF2122/97
uccacgcaccacgagcagccg

SEQ ID NO: 3169303 - RNA, 16 nt, Mycobacterium bovis subsp bovis AF2122/97
uccacgcacucgucgg

SEQ ID NO: 3169304 - RNA, 23 nt, Mycobacterium bovis subsp bovis AF2122/97
uccacgcacucgucgggguugau

SEQ ID NO: 3169305 - RNA, 18 nt, Mycobacterium bovis subsp bovis AF2122/97
uccacgcagcccgucggc

SEQ ID NO: 3169306 - RNA, 15 nt, Mycobacterium bovis subsp bovis AF2122/97
uccacgccgaccauc

SEQ ID NO: 3169307 - RNA, 19 nt, Mycobacterium bovis subsp bovis AF2122/97
uccacgccggcaucgucga

SEQ ID NO: 3169308 - RNA, 14 nt, Mycobacterium bovis subsp bovis AF2122/97
uccacgcguugacg

SEQ ID NO: 3169309 - RNA, 15 nt, Mycobacterium bovis subsp bovis AF2122/97
uccacgcugaccaac

SEQ ID NO: 3169310 - RNA, 16 nt, Mycobacterium bovis subsp bovis AF2122/97
uccacggagaccggcc

SEQ ID NO: 3169311 - RNA, 20 nt, Mycobacterium bovis subsp bovis AF2122/97
uccacggcgaugcagccaca

SEQ ID NO: 3169312 - RNA, 14 nt, Mycobacterium bovis subsp bovis AF2122/97
uccacggucgacca

SEQ ID NO: 3169313 - RNA, 19 nt, Mycobacterium bovis subsp bovis AF2122/97
uccacgguugccggcggcg

SEQ ID NO: 3169314 - RNA, 20 nt, Mycobacterium bovis subsp bovis AF2122/97
uccacgguugccggcggcga

SEQ ID NO: 3169315 - RNA, 22 nt, Mycobacterium bovis subsp bovis AF2122/97
uccacgguugccggcggcgacg

SEQ ID NO: 3169316 - RNA, 17 nt, Mycobacterium bovis subsp bovis AF2122/97
uccacgucaucuggcgc

SEQ ID NO: 3169317 - RNA, 15 nt, Mycobacterium bovis subsp bovis AF2122/97
uccacuccccagccc

SEQ ID NO: 3169318 - RNA, 20 nt, Mycobacterium bovis subsp bovis AF2122/97
uccacuccccagccccaccc

SEQ ID NO: 3169319 - RNA, 16 nt, Mycobacterium bovis subsp bovis AF2122/97
uccacucgaccugaug

SEQ ID NO: 3169320 - RNA, 19 nt, Mycobacterium bovis subsp bovis AF2122/97
uccacugacgucucaucaa

SEQ ID NO: 3169321 - RNA, 20 nt, Mycobacterium bovis subsp bovis AF2122/97
uccacugggccugccagucc

SEQ ID NO: 3169322 - RNA, 13 nt, Mycobacterium bovis subsp bovis AF2122/97
uccacuucacgug

SEQ ID NO: 3169323 - RNA, 19 nt, Mycobacterium bovis subsp bovis AF2122/97
uccacuucagaucggcgaa

SEQ ID NO: 3169324 - RNA, 18 nt, Mycobacterium bovis subsp bovis AF2122/97
uccacuuggggcgccagg

SEQ ID NO: 3169325 - RNA, 16 nt, Mycobacterium bovis subsp bovis AF2122/97
uccacuuuuccgccgg

SEQ ID NO: 3169326 - RNA, 22 nt, Mycobacterium bovis subsp bovis AF2122/97
uccagaaccgaagccucggcau

SEQ ID NO: 3169327 - RNA, 17 nt, Mycobacterium bovis subsp bovis AF2122/97
uccagaacgguggcgcg

SEQ ID NO: 3169328 - RNA, 19 nt, Mycobacterium bovis subsp bovis AF2122/97
uccagaaggccgcaccgcc

SEQ ID NO: 3169329 - RNA, 20 nt, Mycobacterium bovis subsp bovis AF2122/97
uccagaaguaggcgaccgcc

SEQ ID NO: 3169330 - RNA, 22 nt, Mycobacterium bovis subsp bovis AF2122/97
uccagaaugucgcggguggcuu

SEQ ID NO: 3169331 - RNA, 19 nt, Mycobacterium bovis subsp bovis AF2122/97
uccagacaugucaggccgu

SEQ ID NO: 3169332 - RNA, 21 nt, Mycobacterium bovis subsp bovis AF2122/97
uccagaccguagcggccggga

SEQ ID NO: 3169333 - RNA, 16 nt, Mycobacterium bovis subsp bovis AF2122/97
uccagauaccaccgcc

SEQ ID NO: 3169334 - RNA, 15 nt, Mycobacterium bovis subsp bovis AF2122/97
uccagaucaacgcgu

SEQ ID NO: 3169335 - RNA, 16 nt, Mycobacterium bovis subsp bovis AF2122/97
uccagauccacgccga

SEQ ID NO: 3169336 - RNA, 15 nt, Mycobacterium bovis subsp bovis AF2122/97
uccagaugcccagca

SEQ ID NO: 3169337 - RNA, 18 nt, Mycobacterium bovis subsp bovis AF2122/97
uccagcaacagcgagcgg

SEQ ID NO: 3169338 - RNA, 24 nt, Mycobacterium bovis subsp bovis AF2122/97
uccagcaccacggcgcgcgcgccg

SEQ ID NO: 3169339 - RNA, 13 nt, Mycobacterium bovis subsp bovis AF2122/97
uccagcacccgcu

SEQ ID NO: 3169340 - RNA, 16 nt, Mycobacterium bovis subsp bovis AF2122/97
uccagcacccgcugca

SEQ ID NO: 3169341 - RNA, 23 nt, Mycobacterium bovis subsp bovis AF2122/97
uccagcaccgggaagucgggguc

SEQ ID NO: 3169342 - RNA, 18 nt, Mycobacterium bovis subsp bovis AF2122/97
uccagcacgccguccagg

SEQ ID NO: 3169343 - RNA, 22 nt, Mycobacterium bovis subsp bovis AF2122/97
uccagcagcccgguggugcugu

SEQ ID NO: 3169344 - RNA, 16 nt, Mycobacterium bovis subsp bovis AF2122/97
uccagcagcgacgcug

SEQ ID NO: 3169345 - RNA, 18 nt, Mycobacterium bovis subsp bovis AF2122/97
uccagcagcgacgcugcc

SEQ ID NO: 3169346 - RNA, 19 nt, Mycobacterium bovis subsp bovis AF2122/97
uccagcagcgacgcugccg

SEQ ID NO: 3169347 - RNA, 21 nt, Mycobacterium bovis subsp bovis AF2122/97
uccagcagcgacgcugccgcc

SEQ ID NO: 3169348 - RNA, 22 nt, Mycobacterium bovis subsp bovis AF2122/97
uccagcagcgacgcugccgcca

SEQ ID NO: 3169349 - RNA, 19 nt, Mycobacterium bovis subsp bovis AF2122/97
uccagcagcucgccggcac

SEQ ID NO: 3169350 - RNA, 23 nt, Mycobacterium bovis subsp bovis AF2122/97
uccagcaggccgggacagcgccg

SEQ ID NO: 3169351 - RNA, 21 nt, Mycobacterium bovis subsp bovis AF2122/97
uccagcagguccgcggccgcg

SEQ ID NO: 3169352 - RNA, 20 nt, Mycobacterium bovis subsp bovis AF2122/97
uccagcaguacaccgcccgg

SEQ ID NO: 3169353 - RNA, 15 nt, Mycobacterium bovis subsp bovis AF2122/97
uccagcaugcccgcc

SEQ ID NO: 3169354 - RNA, 12 nt, Mycobacterium bovis subsp bovis AF2122/97
uccagccaggcg

SEQ ID NO: 3169355 - RNA, 16 nt, Mycobacterium bovis subsp bovis AF2122/97
uccaugauggccguca

SEQ ID NO: 3169356 - RNA, 20 nt, Mycobacterium bovis subsp bovis AF2122/97
uccaugcggguaaaccaggu

SEQ ID NO: 3169357 - RNA, 12 nt, Mycobacterium bovis subsp bovis AF2122/97
uccauggcgugc

SEQ ID NO: 3169358 - RNA, 12 nt, Mycobacterium bovis subsp bovis AF2122/97
uccaugucgucg

SEQ ID NO: 3169359 - RNA, 14 nt, Mycobacterium bovis subsp bovis AF2122/97
uccaugugcccagg

SEQ ID NO: 3169360 - RNA, 19 nt, Mycobacterium bovis subsp bovis AF2122/97
uccauguuuugcugcaugc

SEQ ID NO: 3169361 - RNA, 17 nt, Mycobacterium bovis subsp bovis AF2122/97
uccauucauggccgcga

SEQ ID NO: 3169362 - RNA, 18 nt, Mycobacterium bovis subsp bovis AF2122/97
uccauucggcggcggcgu

SEQ ID NO: 3169363 - RNA, 18 nt, Mycobacterium bovis subsp bovis AF2122/97
uccauuggaaccugaucc

SEQ ID NO: 3169364 - RNA, 17 nt, Mycobacterium bovis subsp bovis AF2122/97
uccauugugggacgcga

SEQ ID NO: 3169365 - RNA, 14 nt, Mycobacterium bovis subsp bovis AF2122/97
ucccaaaugucgua

SEQ ID NO: 3169366 - RNA, 16 nt, Mycobacterium bovis subsp bovis AF2122/97
ucccaacacagccguc

SEQ ID NO: 3169367 - RNA, 15 nt, Mycobacterium bovis subsp bovis AF2122/97
ucccaacacggcgac

SEQ ID NO: 3169368 - RNA, 17 nt, Mycobacterium bovis subsp bovis AF2122/97
ucccaacccaugaugug

SEQ ID NO: 3169369 - RNA, 14 nt, Mycobacterium bovis subsp bovis AF2122/97
ucccaaccgcccgu

SEQ ID NO: 3169370 - RNA, 15 nt, Mycobacterium bovis subsp bovis AF2122/97
ucccaaccgcccgug

SEQ ID NO: 3169371 - RNA, 15 nt, Mycobacterium bovis subsp bovis AF2122/97
ucccaacgccacugc

SEQ ID NO: 3169372 - RNA, 14 nt, Mycobacterium bovis subsp bovis AF2122/97
ucccaacgcccggg

SEQ ID NO: 3169373 - RNA, 22 nt, Mycobacterium bovis subsp bovis AF2122/97
ucccaaucgggaucgcugccag

SEQ ID NO: 3169374 - RNA, 18 nt, Mycobacterium bovis subsp bovis AF2122/97
ucccaaucgucggccagc

SEQ ID NO: 3169375 - RNA, 14 nt, Mycobacterium bovis subsp bovis AF2122/97
ucccacaacucggc

SEQ ID NO: 3169376 - RNA, 21 nt, Mycobacterium bovis subsp bovis AF2122/97
ucccacaacucggcauucacc

SEQ ID NO: 3169377 - RNA, 14 nt, Mycobacterium bovis subsp bovis AF2122/97
ucccaccaccaccg

SEQ ID NO: 3169378 - RNA, 19 nt, Mycobacterium bovis subsp bovis AF2122/97
ucccaccaccgcucgucgu

SEQ ID NO: 3169379 - RNA, 21 nt, Mycobacterium bovis subsp bovis AF2122/97
ucccaccaccgcucgucgucc

SEQ ID NO: 3169380 - RNA, 22 nt, Mycobacterium bovis subsp bovis AF2122/97
ucccaccaccgcucgucguccg

SEQ ID NO: 3169381 - RNA, 14 nt, Mycobacterium bovis subsp bovis AF2122/97
ucccaccaccggug

SEQ ID NO: 3169382 - RNA, 17 nt, Mycobacterium bovis subsp bovis AF2122/97
ucccaccagcggcggcc

SEQ ID NO: 3169383 - RNA, 20 nt, Mycobacterium bovis subsp bovis AF2122/97
ucccaccagcggcggcccuu

SEQ ID NO: 3169384 - RNA, 13 nt, Mycobacterium bovis subsp bovis AF2122/97
ucccaccaucgau

SEQ ID NO: 3169385 - RNA, 19 nt, Mycobacterium bovis subsp bovis AF2122/97
ucccacccucggguccaac

SEQ ID NO: 3169386 - RNA, 18 nt, Mycobacterium bovis subsp bovis AF2122/97
ucccaccgcuuccagguu

SEQ ID NO: 3169387 - RNA, 14 nt, Mycobacterium bovis subsp bovis AF2122/97
ucccacgaguuggc

SEQ ID NO: 3169388 - RNA, 17 nt, Mycobacterium bovis subsp bovis AF2122/97
ucccacgaguuggccaa

SEQ ID NO: 3169389 - RNA, 14 nt, Mycobacterium bovis subsp bovis AF2122/97
ucccacgcccggcc

SEQ ID NO: 3169390 - RNA, 12 nt, Mycobacterium bovis subsp bovis AF2122/97
ucccacggccgg

SEQ ID NO: 3169391 - RNA, 21 nt, Mycobacterium bovis subsp bovis AF2122/97
ucccacggccggccgcugcca

SEQ ID NO: 3169392 - RNA, 22 nt, Mycobacterium bovis subsp bovis AF2122/97
ucccacggccggccgcugccac

SEQ ID NO: 3169393 - RNA, 12 nt, Mycobacterium bovis subsp bovis AF2122/97
ucccacggcgcg

SEQ ID NO: 3169394 - RNA, 23 nt, Mycobacterium bovis subsp bovis AF2122/97
ucccacggcgguugccccgaccg

SEQ ID NO: 3169395 - RNA, 14 nt, Mycobacterium bovis subsp bovis AF2122/97
ucccacucacccag

SEQ ID NO: 3169396 - RNA, 14 nt, Mycobacterium bovis subsp bovis AF2122/97
ucccacucgucguc

SEQ ID NO: 3169397 - RNA, 18 nt, Mycobacterium bovis subsp bovis AF2122/97
ucccacucgucgucgguc

SEQ ID NO: 3169398 - RNA, 14 nt, Mycobacterium bovis subsp bovis AF2122/97
ucccacuggagguc

SEQ ID NO: 3169399 - RNA, 19 nt, Mycobacterium bovis subsp bovis AF2122/97
ucccagagaaucagcgugg

SEQ ID NO: 3169400 - RNA, 16 nt, Mycobacterium bovis subsp bovis AF2122/97
ucccagaggcccgcgg

SEQ ID NO: 3169401 - RNA, 16 nt, Mycobacterium bovis subsp bovis AF2122/97
ucccagauaugcagga

SEQ ID NO: 3169402 - RNA, 19 nt, Mycobacterium bovis subsp bovis AF2122/97
ucccaggacuccggccgca

SEQ ID NO: 3169403 - RNA, 20 nt, Mycobacterium bovis subsp bovis AF2122/97
ucccagggcucggcggcccg

SEQ ID NO: 3169404 - RNA, 16 nt, Mycobacterium bovis subsp bovis AF2122/97
ucccagucgcggcgcg

SEQ ID NO: 3169405 - RNA, 21 nt, Mycobacterium bovis subsp bovis AF2122/97
ucccagucgcggcgcgaggag

SEQ ID NO: 3169406 - RNA, 13 nt, Mycobacterium bovis subsp bovis AF2122/97
ucccauacgccgg

SEQ ID NO: 3169407 - RNA, 15 nt, Mycobacterium bovis subsp bovis AF2122/97
ucccaucccaugucg

SEQ ID NO: 3169408 - RNA, 17 nt, Mycobacterium bovis subsp bovis AF2122/97
ucccaugcacggccgag

SEQ ID NO: 3169409 - RNA, 16 nt, Mycobacterium bovis subsp bovis AF2122/97
ucccaugcugcgcaac

SEQ ID NO: 3169410 - RNA, 17 nt, Mycobacterium bovis subsp bovis AF2122/97
ucccauucccaacacag

SEQ ID NO: 3169411 - RNA, 15 nt, Mycobacterium bovis subsp bovis AF2122/97
ucccauucguagucg

SEQ ID NO: 3169412 - RNA, 20 nt, Mycobacterium bovis subsp bovis AF2122/97
ucccauuugccuugagccgc

SEQ ID NO: 3169413 - RNA, 14 nt, Mycobacterium bovis subsp bovis AF2122/97
uccccaagucgacg

SEQ ID NO: 3169414 - RNA, 19 nt, Mycobacterium bovis subsp bovis AF2122/97
uccccaagucgacgguggc

SEQ ID NO: 3169415 - RNA, 18 nt, Mycobacterium bovis subsp bovis AF2122/97
uccccagaccggcggcua

SEQ ID NO: 3169416 - RNA, 14 nt, Mycobacterium bovis subsp bovis AF2122/97
uccccagcgccacc

SEQ ID NO: 3169417 - RNA, 16 nt, Mycobacterium bovis subsp bovis AF2122/97
uccccaggugggcagc

SEQ ID NO: 3169418 - RNA, 23 nt, Mycobacterium bovis subsp bovis AF2122/97
uccccaugcagcgcgucgccgaa

SEQ ID NO: 3169419 - RNA, 13 nt, Mycobacterium bovis subsp bovis AF2122/97
uccccauugcgcc

SEQ ID NO: 3169420 - RNA, 14 nt, Mycobacterium bovis subsp bovis AF2122/97
uccccauugcgccc

SEQ ID NO: 3169421 - RNA, 12 nt, Mycobacterium bovis subsp bovis AF2122/97
ucccccgcgaag

SEQ ID NO: 3169422 - RNA, 20 nt, Mycobacterium bovis subsp bovis AF2122/97
ucccccgcuacgcgcgcucg

SEQ ID NO: 3169423 - RNA, 13 nt, Mycobacterium bovis subsp bovis AF2122/97
ucccccggcaccg

SEQ ID NO: 3169424 - RNA, 15 nt, Mycobacterium bovis subsp bovis AF2122/97
ucccccggcaccgcc

SEQ ID NO: 3169425 - RNA, 17 nt, Mycobacterium bovis subsp bovis AF2122/97
uccccgacaacgaaacc

SEQ ID NO: 3169426 - RNA, 21 nt, Mycobacterium bovis subsp bovis AF2122/97
uccccgacaacgaaaccgacc

SEQ ID NO: 3169427 - RNA, 22 nt, Mycobacterium bovis subsp bovis AF2122/97
uccccgacaacgaaaccgaccu

SEQ ID NO: 3169428 - RNA, 15 nt, Mycobacterium bovis subsp bovis AF2122/97
uccccgaccgaaccg

SEQ ID NO: 3169429 - RNA, 16 nt, Mycobacterium bovis subsp bovis AF2122/97
uccccgaccgcgcccg

SEQ ID NO: 3169430 - RNA, 13 nt, Mycobacterium bovis subsp bovis AF2122/97
uccccgaccugca

SEQ ID NO: 3169431 - RNA, 15 nt, Mycobacterium bovis subsp bovis AF2122/97
uccccgaccugcaag

SEQ ID NO: 3169432 - RNA, 21 nt, Mycobacterium bovis subsp bovis AF2122/97
uccccgacggacuccggccgg

SEQ ID NO: 3169433 - RNA, 14 nt, Mycobacterium bovis subsp bovis AF2122/97
uccccgcagcgccu

SEQ ID NO: 3169434 - RNA, 19 nt, Mycobacterium bovis subsp bovis AF2122/97
uccccgcccuugccgccag

SEQ ID NO: 3169435 - RNA, 22 nt, Mycobacterium bovis subsp bovis AF2122/97
uccccgcccuugccgccagccc

SEQ ID NO: 3169436 - RNA, 14 nt, Mycobacterium bovis subsp bovis AF2122/97
uccccgccgacgcc

SEQ ID NO: 3169437 - RNA, 16 nt, Mycobacterium bovis subsp bovis AF2122/97
uccccgccgacgccga

SEQ ID NO: 3169438 - RNA, 12 nt, Mycobacterium bovis subsp bovis AF2122/97
uccccgccggaa

SEQ ID NO: 3169439 - RNA, 13 nt, Mycobacterium bovis subsp bovis AF2122/97
uccccgccggcgg

SEQ ID NO: 3169440 - RNA, 11 nt, Mycobacterium bovis subsp bovis AF2122/97
uccccgccguc

SEQ ID NO: 3169441 - RNA, 16 nt, Mycobacterium bovis subsp bovis AF2122/97
uccccgccgucgccac

SEQ ID NO: 3169442 - RNA, 15 nt, Mycobacterium bovis subsp bovis AF2122/97
uccgaccagcggccg

SEQ ID NO: 3169443 - RNA, 14 nt, Mycobacterium bovis subsp bovis AF2122/97
uccgacccaacgac

SEQ ID NO: 3169444 - RNA, 21 nt, Mycobacterium bovis subsp bovis AF2122/97
uccgacccaacgaccaccacc

SEQ ID NO: 3169445 - RNA, 18 nt, Mycobacterium bovis subsp bovis AF2122/97
uccgaccucgccgcgcgu

SEQ ID NO: 3169446 - RNA, 15 nt, Mycobacterium bovis subsp bovis AF2122/97
uccgacgaccucgac

SEQ ID NO: 3169447 - RNA, 13 nt, Mycobacterium bovis subsp bovis AF2122/97
uccgacgccuggg

SEQ ID NO: 3169448 - RNA, 21 nt, Mycobacterium bovis subsp bovis AF2122/97
uccgacgccugggcacggccg

SEQ ID NO: 3169449 - RNA, 21 nt, Mycobacterium bovis subsp bovis AF2122/97
uccgacgcgugucugggaccc

SEQ ID NO: 3169450 - RNA, 21 nt, Mycobacterium bovis subsp bovis AF2122/97
uccgacggcggauaaccggca

SEQ ID NO: 3169451 - RNA, 16 nt, Mycobacterium bovis subsp bovis AF2122/97
uccgacgggggucggg

SEQ ID NO: 3169452 - RNA, 11 nt, Mycobacterium bovis subsp bovis AF2122/97
uccgacggugu

SEQ ID NO: 3169453 - RNA, 19 nt, Mycobacterium bovis subsp bovis AF2122/97
uccgacgguguagccgccg

SEQ ID NO: 3169454 - RNA, 22 nt, Mycobacterium bovis subsp bovis AF2122/97
uccgacgguguagccgccggca

SEQ ID NO: 3169455 - RNA, 23 nt, Mycobacterium bovis subsp bovis AF2122/97
uccgacgguguagccgccggcag

SEQ ID NO: 3169456 - RNA, 14 nt, Mycobacterium bovis subsp bovis AF2122/97
uccgacgucgacga

SEQ ID NO: 3169457 - RNA, 15 nt, Mycobacterium bovis subsp bovis AF2122/97
uccgacgucgacgag

SEQ ID NO: 3169458 - RNA, 14 nt, Mycobacterium bovis subsp bovis AF2122/97
uccgacuggccccg

SEQ ID NO: 3169459 - RNA, 17 nt, Mycobacterium bovis subsp bovis AF2122/97
uccgacuggccccgcca

SEQ ID NO: 3169460 - RNA, 20 nt, Mycobacterium bovis subsp bovis AF2122/97
uccgacuggccccgccagcg

SEQ ID NO: 3169461 - RNA, 24 nt, Mycobacterium bovis subsp bovis AF2122/97
uccgacuggccccgccagcggcag

SEQ ID NO: 3169462 - RNA, 13 nt, Mycobacterium bovis subsp bovis AF2122/97
uccgagccgcgau

SEQ ID NO: 3169463 - RNA, 17 nt, Mycobacterium bovis subsp bovis AF2122/97
uccgagcgcggcggcgg

SEQ ID NO: 3169464 - RNA, 22 nt, Mycobacterium bovis subsp bovis AF2122/97
uccgagcgcggcggcggaggcu

SEQ ID NO: 3169465 - RNA, 22 nt, Mycobacterium bovis subsp bovis AF2122/97
uccgagcggcccuucaccagcc

SEQ ID NO: 3169466 - RNA, 13 nt, Mycobacterium bovis subsp bovis AF2122/97
uccgagcuuggcc

SEQ ID NO: 3169467 - RNA, 17 nt, Mycobacterium bovis subsp bovis AF2122/97
uccgagcuuggccgccg

SEQ ID NO: 3169468 - RNA, 18 nt, Mycobacterium bovis subsp bovis AF2122/97
uccgagcuuggccgccgc

SEQ ID NO: 3169469 - RNA, 18 nt, Mycobacterium bovis subsp bovis AF2122/97
uccgaggaauacagcuug

SEQ ID NO: 3169470 - RNA, 19 nt, Mycobacterium bovis subsp bovis AF2122/97
uccgaggaauacagcuuga

SEQ ID NO: 3169471 - RNA, 22 nt, Mycobacterium bovis subsp bovis AF2122/97
uccgaggagggccgcgaucgac

SEQ ID NO: 3169472 - RNA, 20 nt, Mycobacterium bovis subsp bovis AF2122/97
uccgaggauguugugccgau

SEQ ID NO: 3169473 - RNA, 15 nt, Mycobacterium bovis subsp bovis AF2122/97
uccgaggccgccauc

SEQ ID NO: 3169474 - RNA, 19 nt, Mycobacterium bovis subsp bovis AF2122/97
uccgagggaacggugcaca

SEQ ID NO: 3169475 - RNA, 21 nt, Mycobacterium bovis subsp bovis AF2122/97
uccgagggcgucgccgccguu

SEQ ID NO: 3169476 - RNA, 17 nt, Mycobacterium bovis subsp bovis AF2122/97
uccgagggcugcguggc

SEQ ID NO: 3169477 - RNA, 15 nt, Mycobacterium bovis subsp bovis AF2122/97
uccgagggugcguug

SEQ ID NO: 3169478 - RNA, 18 nt, Mycobacterium bovis subsp bovis AF2122/97
uccgaguugucgccggag

SEQ ID NO: 3169479 - RNA, 16 nt, Mycobacterium bovis subsp bovis AF2122/97
uccgauaaauggccga

SEQ ID NO: 3169480 - RNA, 17 nt, Mycobacterium bovis subsp bovis AF2122/97
uccgauaaauggccgau

SEQ ID NO: 3169481 - RNA, 14 nt, Mycobacterium bovis subsp bovis AF2122/97
uccgaucacccgca

SEQ ID NO: 3169482 - RNA, 12 nt, Mycobacterium bovis subsp bovis AF2122/97
uccgaucaccuc

SEQ ID NO: 3169483 - RNA, 18 nt, Mycobacterium bovis subsp bovis AF2122/97
uccgaucaccucggcgac

SEQ ID NO: 3169484 - RNA, 12 nt, Mycobacterium bovis subsp bovis AF2122/97
uccgauccggug

SEQ ID NO: 3169485 - RNA, 13 nt, Mycobacterium bovis subsp bovis AF2122/97
uccgaucgccgag

SEQ ID NO: 3169486 - RNA, 15 nt, Mycobacterium bovis subsp bovis AF2122/97
uccgaucgccgcgaa

SEQ ID NO: 3169487 - RNA, 18 nt, Mycobacterium bovis subsp bovis AF2122/97
uccgaucggcgcgccgau

SEQ ID NO: 3169488 - RNA, 21 nt, Mycobacterium bovis subsp bovis AF2122/97
uccgaugaacaucuggcgacg

SEQ ID NO: 3169489 - RNA, 21 nt, Mycobacterium bovis subsp bovis AF2122/97
uccgaugaccagggucugcuc

SEQ ID NO: 3169490 - RNA, 20 nt, Mycobacterium bovis subsp bovis AF2122/97
uccgaugcaucggugcagcc

SEQ ID NO: 3169491 - RNA, 22 nt, Mycobacterium bovis subsp bovis AF2122/97
uccgauggcccggcucacagca

SEQ ID NO: 3169492 - RNA, 18 nt, Mycobacterium bovis subsp bovis AF2122/97
uccgaugguaugcccgcc

SEQ ID NO: 3169493 - RNA, 17 nt, Mycobacterium bovis subsp bovis AF2122/97
uccgauuggugucggug

SEQ ID NO: 3169494 - RNA, 22 nt, Mycobacterium bovis subsp bovis AF2122/97
uccgauuuugugagccaggcgg

SEQ ID NO: 3169495 - RNA, 22 nt, Mycobacterium bovis subsp bovis AF2122/97
uccgcaaaacgagcuuccacgc

SEQ ID NO: 3169496 - RNA, 17 nt, Mycobacterium bovis subsp bovis AF2122/97
uccgcaacaacgccgcg

SEQ ID NO: 3169497 - RNA, 12 nt, Mycobacterium bovis subsp bovis AF2122/97
uccgcacaacga

SEQ ID NO: 3169498 - RNA, 16 nt, Mycobacterium bovis subsp bovis AF2122/97
uccgcacagcgacgag

SEQ ID NO: 3169499 - RNA, 14 nt, Mycobacterium bovis subsp bovis AF2122/97
uccgcacagguccg

SEQ ID NO: 3169500 - RNA, 20 nt, Mycobacterium bovis subsp bovis AF2122/97
uccgcaccccauacucggcg

SEQ ID NO: 3169501 - RNA, 21 nt, Mycobacterium bovis subsp bovis AF2122/97
uccgcacccggccgcgcaccc

SEQ ID NO: 3169502 - RNA, 13 nt, Mycobacterium bovis subsp bovis AF2122/97
uccgcaccgaaac

SEQ ID NO: 3169503 - RNA, 14 nt, Mycobacterium bovis subsp bovis AF2122/97
uccgcacgaucgcc

SEQ ID NO: 3169504 - RNA, 23 nt, Mycobacterium bovis subsp bovis AF2122/97
uccgcacgaucggggaagccugc

SEQ ID NO: 3169505 - RNA, 22 nt, Mycobacterium bovis subsp bovis AF2122/97
uccgcacucugaugucgggaag

SEQ ID NO: 3169506 - RNA, 15 nt, Mycobacterium bovis subsp bovis AF2122/97
uccgcagcgccaccc

SEQ ID NO: 3169507 - RNA, 15 nt, Mycobacterium bovis subsp bovis AF2122/97
uccgcagcggugcgc

SEQ ID NO: 3169508 - RNA, 13 nt, Mycobacterium bovis subsp bovis AF2122/97
uccgcaggcccgc

SEQ ID NO: 3169509 - RNA, 15 nt, Mycobacterium bovis subsp bovis AF2122/97
uccgcaguccggggc

SEQ ID NO: 3169510 - RNA, 21 nt, Mycobacterium bovis subsp bovis AF2122/97
uccgcagugagcaaugccaac

SEQ ID NO: 3169511 - RNA, 17 nt, Mycobacterium bovis subsp bovis AF2122/97
uccgcaguucggucguc

SEQ ID NO: 3169512 - RNA, 18 nt, Mycobacterium bovis subsp bovis AF2122/97
uccgcaucaugucgaaga

SEQ ID NO: 3169513 - RNA, 22 nt, Mycobacterium bovis subsp bovis AF2122/97
uccgccaauccaccggugccgc

SEQ ID NO: 3169514 - RNA, 19 nt, Mycobacterium bovis subsp bovis AF2122/97
uccgccacccgccaacgcc

SEQ ID NO: 3169515 - RNA, 21 nt, Mycobacterium bovis subsp bovis AF2122/97
uccgccagaauugccggcgau

SEQ ID NO: 3169516 - RNA, 16 nt, Mycobacterium bovis subsp bovis AF2122/97
uccgccagaucucgcg

SEQ ID NO: 3169517 - RNA, 19 nt, Mycobacterium bovis subsp bovis AF2122/97
uccgccauuucucguaccc

SEQ ID NO: 3169518 - RNA, 14 nt, Mycobacterium bovis subsp bovis AF2122/97
uccgcccagcaccc

SEQ ID NO: 3169519 - RNA, 15 nt, Mycobacterium bovis subsp bovis AF2122/97
uccgcccagccgcag

SEQ ID NO: 3169520 - RNA, 20 nt, Mycobacterium bovis subsp bovis AF2122/97
uccgcccauucccagaggcc

SEQ ID NO: 3169521 - RNA, 23 nt, Mycobacterium bovis subsp bovis AF2122/97
uccgcccauucccagaggcccgc

SEQ ID NO: 3169522 - RNA, 14 nt, Mycobacterium bovis subsp bovis AF2122/97
uccgccccgcccgc

SEQ ID NO: 3169523 - RNA, 12 nt, Mycobacterium bovis subsp bovis AF2122/97
uccgcccggugc

SEQ ID NO: 3169524 - RNA, 15 nt, Mycobacterium bovis subsp bovis AF2122/97
uccgcccuugccgcc

SEQ ID NO: 3169525 - RNA, 13 nt, Mycobacterium bovis subsp bovis AF2122/97
uccgccgaacacc

SEQ ID NO: 3169526 - RNA, 13 nt, Mycobacterium bovis subsp bovis AF2122/97
uccgccgagcaga

SEQ ID NO: 3169527 - RNA, 14 nt, Mycobacterium bovis subsp bovis AF2122/97
uccgccgaggccgc

SEQ ID NO: 3169528 - RNA, 18 nt, Mycobacterium bovis subsp bovis AF2122/97
uccgccgaggccgccguu

SEQ ID NO: 3169529 - RNA, 22 nt, Mycobacterium bovis subsp bovis AF2122/97
uccggaagcggcguucgaugcc

SEQ ID NO: 3169530 - RNA, 16 nt, Mycobacterium bovis subsp bovis AF2122/97
uccggaaucgcccggg

SEQ ID NO: 3169531 - RNA, 20 nt, Mycobacterium bovis subsp bovis AF2122/97
uccggacccacccgcaccgc

SEQ ID NO: 3169532 - RNA, 22 nt, Mycobacterium bovis subsp bovis AF2122/97
uccggacccacccgcaccgccg

SEQ ID NO: 3169533 - RNA, 15 nt, Mycobacterium bovis subsp bovis AF2122/97
uccggacggcagccg

SEQ ID NO: 3169534 - RNA, 14 nt, Mycobacterium bovis subsp bovis AF2122/97
uccggagccccugu

SEQ ID NO: 3169535 - RNA, 18 nt, Mycobacterium bovis subsp bovis AF2122/97
uccggaguuuaagacgcc

SEQ ID NO: 3169536 - RNA, 21 nt, Mycobacterium bovis subsp bovis AF2122/97
uccggaguuuaagacgcccga

SEQ ID NO: 3169537 - RNA, 16 nt, Mycobacterium bovis subsp bovis AF2122/97
uccggaucccaccacc

SEQ ID NO: 3169538 - RNA, 20 nt, Mycobacterium bovis subsp bovis AF2122/97
uccggaucccaccaccgcuc

SEQ ID NO: 3169539 - RNA, 12 nt, Mycobacterium bovis subsp bovis AF2122/97
uccggauccgau

SEQ ID NO: 3169540 - RNA, 14 nt, Mycobacterium bovis subsp bovis AF2122/97
uccggaucgccgaa

SEQ ID NO: 3169541 - RNA, 15 nt, Mycobacterium bovis subsp bovis AF2122/97
uccggaugcgcaacc

SEQ ID NO: 3169542 - RNA, 22 nt, Mycobacterium bovis subsp bovis AF2122/97
uccggauggaacuggacaccgu

SEQ ID NO: 3169543 - RNA, 14 nt, Mycobacterium bovis subsp bovis AF2122/97
uccggauggccccg

SEQ ID NO: 3169544 - RNA, 19 nt, Mycobacterium bovis subsp bovis AF2122/97
uccggauucggacucgccg

SEQ ID NO: 3169545 - RNA, 18 nt, Mycobacterium bovis subsp bovis AF2122/97
uccggauugaagucgucg

SEQ ID NO: 3169546 - RNA, 22 nt, Mycobacterium bovis subsp bovis AF2122/97
uccggauugaagucgucggcca

SEQ ID NO: 3169547 - RNA, 17 nt, Mycobacterium bovis subsp bovis AF2122/97
uccggcaacagcaccag

SEQ ID NO: 3169548 - RNA, 18 nt, Mycobacterium bovis subsp bovis AF2122/97
uccggcaaccaccggccg

SEQ ID NO: 3169549 - RNA, 16 nt, Mycobacterium bovis subsp bovis AF2122/97
uccggcaagcacaccg

SEQ ID NO: 3169550 - RNA, 19 nt, Mycobacterium bovis subsp bovis AF2122/97
uccggcaagcacaccgcca

SEQ ID NO: 3169551 - RNA, 20 nt, Mycobacterium bovis subsp bovis AF2122/97
uccggcaagcacaccgccag

SEQ ID NO: 3169552 - RNA, 22 nt, Mycobacterium bovis subsp bovis AF2122/97
uccggcaagcacaccgccagcg

SEQ ID NO: 3169553 - RNA, 16 nt, Mycobacterium bovis subsp bovis AF2122/97
uccggcaagucgaugg

SEQ ID NO: 3169554 - RNA, 21 nt, Mycobacterium bovis subsp bovis AF2122/97
uccggcaauugugcugcgcgu

SEQ ID NO: 3169555 - RNA, 14 nt, Mycobacterium bovis subsp bovis AF2122/97
uccggcaccaacgc

SEQ ID NO: 3169556 - RNA, 14 nt, Mycobacterium bovis subsp bovis AF2122/97
uccggcaccggcaa

SEQ ID NO: 3169557 - RNA, 22 nt, Mycobacterium bovis subsp bovis AF2122/97
uccggcaccggucuuggugcuc

SEQ ID NO: 3169558 - RNA, 14 nt, Mycobacterium bovis subsp bovis AF2122/97
uccggcaccuccag

SEQ ID NO: 3169559 - RNA, 17 nt, Mycobacterium bovis subsp bovis AF2122/97
uccggcaccuccagcac

SEQ ID NO: 3169560 - RNA, 13 nt, Mycobacterium bovis subsp bovis AF2122/97
uccggcacgcguc

SEQ ID NO: 3169561 - RNA, 21 nt, Mycobacterium bovis subsp bovis AF2122/97
uccggcacugcggccagucag

SEQ ID NO: 3169562 - RNA, 22 nt, Mycobacterium bovis subsp bovis AF2122/97
uccggcagaccggugcugucga

SEQ ID NO: 3169563 - RNA, 21 nt, Mycobacterium bovis subsp bovis AF2122/97
uccggcauaccgaacagcacc

SEQ ID NO: 3169564 - RNA, 22 nt, Mycobacterium bovis subsp bovis AF2122/97
uccggcauaccgaacagcaccu

SEQ ID NO: 3169565 - RNA, 16 nt, Mycobacterium bovis subsp bovis AF2122/97
uccggcauugccgccg

SEQ ID NO: 3169566 - RNA, 13 nt, Mycobacterium bovis subsp bovis AF2122/97
uccggccacacuc

SEQ ID NO: 3169567 - RNA, 18 nt, Mycobacterium bovis subsp bovis AF2122/97
uccggccacacucgccag

SEQ ID NO: 3169568 - RNA, 13 nt, Mycobacterium bovis subsp bovis AF2122/97
uccggccagaccc

SEQ ID NO: 3169569 - RNA, 23 nt, Mycobacterium bovis subsp bovis AF2122/97
uccggccagacccuggccguccc

SEQ ID NO: 3169570 - RNA, 15 nt, Mycobacterium bovis subsp bovis AF2122/97
uccggccaguccaag

SEQ ID NO: 3169571 - RNA, 18 nt, Mycobacterium bovis subsp bovis AF2122/97
uccggcccaccagcgcag

SEQ ID NO: 3169572 - RNA, 15 nt, Mycobacterium bovis subsp bovis AF2122/97
uccggcccaccgguc

SEQ ID NO: 3169573 - RNA, 16 nt, Mycobacterium bovis subsp bovis AF2122/97
uccggcccacucacac

SEQ ID NO: 3169574 - RNA, 19 nt, Mycobacterium bovis subsp bovis AF2122/97
uccggcccacuucccagga

SEQ ID NO: 3169575 - RNA, 19 nt, Mycobacterium bovis subsp bovis AF2122/97
uccggcccguagcugcgca

SEQ ID NO: 3169576 - RNA, 23 nt, Mycobacterium bovis subsp bovis AF2122/97
uccggcccguagcugcgcagcgc

SEQ ID NO: 3169577 - RNA, 18 nt, Mycobacterium bovis subsp bovis AF2122/97
uccggcccuacgcagcgc

SEQ ID NO: 3169578 - RNA, 23 nt, Mycobacterium bovis subsp bovis AF2122/97
uccggcccuacgcagcgcggcug

SEQ ID NO: 3169579 - RNA, 15 nt, Mycobacterium bovis subsp bovis AF2122/97
uccggcccugccgcc

SEQ ID NO: 3169580 - RNA, 16 nt, Mycobacterium bovis subsp bovis AF2122/97
uccggcccugccgccg

SEQ ID NO: 3169581 - RNA, 17 nt, Mycobacterium bovis subsp bovis AF2122/97
uccggcccugccgccgg

SEQ ID NO: 3169582 - RNA, 22 nt, Mycobacterium bovis subsp bovis AF2122/97
uccggccgacacgccgaugccg

SEQ ID NO: 3169583 - RNA, 14 nt, Mycobacterium bovis subsp bovis AF2122/97
uccggccgacccgg

SEQ ID NO: 3169584 - RNA, 17 nt, Mycobacterium bovis subsp bovis AF2122/97
uccggccgaugcgaccc

SEQ ID NO: 3169585 - RNA, 20 nt, Mycobacterium bovis subsp bovis AF2122/97
uccggccggccagcacccga

SEQ ID NO: 3169586 - RNA, 17 nt, Mycobacterium bovis subsp bovis AF2122/97
uccggccgggcccucca

SEQ ID NO: 3169587 - RNA, 17 nt, Mycobacterium bovis subsp bovis AF2122/97
uccggccgguccgggaa

SEQ ID NO: 3169588 - RNA, 14 nt, Mycobacterium bovis subsp bovis AF2122/97
uccggccgguuggc

SEQ ID NO: 3169589 - RNA, 22 nt, Mycobacterium bovis subsp bovis AF2122/97
uccggccgguuggccagccaca

SEQ ID NO: 3169590 - RNA, 20 nt, Mycobacterium bovis subsp bovis AF2122/97
uccggccgucggcgggcaug

SEQ ID NO: 3169591 - RNA, 15 nt, Mycobacterium bovis subsp bovis AF2122/97
uccggccgucgggca

SEQ ID NO: 3169592 - RNA, 18 nt, Mycobacterium bovis subsp bovis AF2122/97
uccggccgucgggcagca

SEQ ID NO: 3169593 - RNA, 22 nt, Mycobacterium bovis subsp bovis AF2122/97
uccggcgacgaucucgccgcca

SEQ ID NO: 3169594 - RNA, 20 nt, Mycobacterium bovis subsp bovis AF2122/97
uccggcgcacgaaaccgcag

SEQ ID NO: 3169595 - RNA, 23 nt, Mycobacterium bovis subsp bovis AF2122/97
uccggcgcacgaaaccgcagcgc

SEQ ID NO: 3169596 - RNA, 13 nt, Mycobacterium bovis subsp bovis AF2122/97
uccggcgcagcga

SEQ ID NO: 3169597 - RNA, 17 nt, Mycobacterium bovis subsp bovis AF2122/97
uccggcgcagcgaccgg

SEQ ID NO: 3169598 - RNA, 23 nt, Mycobacterium bovis subsp bovis AF2122/97
uccggcgcagguucucggugccg

SEQ ID NO: 3169599 - RNA, 13 nt, Mycobacterium bovis subsp bovis AF2122/97
uccggcgccaccg

SEQ ID NO: 3169600 - RNA, 15 nt, Mycobacterium bovis subsp bovis AF2122/97
uccggcgccaccgcc

SEQ ID NO: 3169601 - RNA, 18 nt, Mycobacterium bovis subsp bovis AF2122/97
uccggcgcggccggccgc

SEQ ID NO: 3169602 - RNA, 22 nt, Mycobacterium bovis subsp bovis AF2122/97
uccggcgcuccacugaccaggu

SEQ ID NO: 3169603 - RNA, 20 nt, Mycobacterium bovis subsp bovis AF2122/97
uccggcggaaacaugugggu

SEQ ID NO: 3169604 - RNA, 15 nt, Mycobacterium bovis subsp bovis AF2122/97
uccggcggaucuggg

SEQ ID NO: 3169605 - RNA, 14 nt, Mycobacterium bovis subsp bovis AF2122/97
uccggcggcagcgg

SEQ ID NO: 3169606 - RNA, 22 nt, Mycobacterium bovis subsp bovis AF2122/97
uccggcggcagcggcgccgccu

SEQ ID NO: 3169607 - RNA, 15 nt, Mycobacterium bovis subsp bovis AF2122/97
uccggcggcagguag

SEQ ID NO: 3169608 - RNA, 19 nt, Mycobacterium bovis subsp bovis AF2122/97
uccggcggccacgccggcg

SEQ ID NO: 3169609 - RNA, 20 nt, Mycobacterium bovis subsp bovis AF2122/97
uccggcggccacgccggcgu

SEQ ID NO: 3169610 - RNA, 13 nt, Mycobacterium bovis subsp bovis AF2122/97
uccggcggccgcc

SEQ ID NO: 3169611 - RNA, 13 nt, Mycobacterium bovis subsp bovis AF2122/97
uccggcggcgacg

SEQ ID NO: 3169612 - RNA, 18 nt, Mycobacterium bovis subsp bovis AF2122/97
uccggcggcuucgccgac

SEQ ID NO: 3169613 - RNA, 23 nt, Mycobacterium bovis subsp bovis AF2122/97
uccggcgggugccgagcuggcga

SEQ ID NO: 3169614 - RNA, 18 nt, Mycobacterium bovis subsp bovis AF2122/97
uccggcggugccgucgcc

SEQ ID NO: 3169615 - RNA, 18 nt, Mycobacterium bovis subsp bovis AF2122/97
uccguagaaggcgauuug

SEQ ID NO: 3169616 - RNA, 16 nt, Mycobacterium bovis subsp bovis AF2122/97
uccguaggccacagcc

SEQ ID NO: 3169617 - RNA, 17 nt, Mycobacterium bovis subsp bovis AF2122/97
uccguaggccacagccc

SEQ ID NO: 3169618 - RNA, 20 nt, Mycobacterium bovis subsp bovis AF2122/97
uccguaggccacagcccggc

SEQ ID NO: 3169619 - RNA, 18 nt, Mycobacterium bovis subsp bovis AF2122/97
uccgucagcgccgcgcgc

SEQ ID NO: 3169620 - RNA, 13 nt, Mycobacterium bovis subsp bovis AF2122/97
uccguccucgucc

SEQ ID NO: 3169621 - RNA, 19 nt, Mycobacterium bovis subsp bovis AF2122/97
uccgucgaaccuaccgugu

SEQ ID NO: 3169622 - RNA, 18 nt, Mycobacterium bovis subsp bovis AF2122/97
uccgucgagucgccgagg

SEQ ID NO: 3169623 - RNA, 22 nt, Mycobacterium bovis subsp bovis AF2122/97
uccgucgauggaccgcacugac

SEQ ID NO: 3169624 - RNA, 13 nt, Mycobacterium bovis subsp bovis AF2122/97
uccgucgccgaac

SEQ ID NO: 3169625 - RNA, 13 nt, Mycobacterium bovis subsp bovis AF2122/97
uccgucgcggccg

SEQ ID NO: 3169626 - RNA, 22 nt, Mycobacterium bovis subsp bovis AF2122/97
uccgucggccuggaucgugccg

SEQ ID NO: 3169627 - RNA, 12 nt, Mycobacterium bovis subsp bovis AF2122/97
uccgucggcgga

SEQ ID NO: 3169628 - RNA, 17 nt, Mycobacterium bovis subsp bovis AF2122/97
uccgucugacccaccgc

SEQ ID NO: 3169629 - RNA, 20 nt, Mycobacterium bovis subsp bovis AF2122/97
uccgucugacccaccgcccc

SEQ ID NO: 3169630 - RNA, 21 nt, Mycobacterium bovis subsp bovis AF2122/97
uccgugaaucgagcaccgcaa

SEQ ID NO: 3169631 - RNA, 13 nt, Mycobacterium bovis subsp bovis AF2122/97
uccgugacaccgg

SEQ ID NO: 3169632 - RNA, 12 nt, Mycobacterium bovis subsp bovis AF2122/97
uccgugagcagu

SEQ ID NO: 3169633 - RNA, 15 nt, Mycobacterium bovis subsp bovis AF2122/97
uccgugccagcugcc

SEQ ID NO: 3169634 - RNA, 17 nt, Mycobacterium bovis subsp bovis AF2122/97
uccgugccagcugccga

SEQ ID NO: 3169635 - RNA, 14 nt, Mycobacterium bovis subsp bovis AF2122/97
uccgugccgaugcc

SEQ ID NO: 3169636 - RNA, 15 nt, Mycobacterium bovis subsp bovis AF2122/97
uccgugccgaugccg

SEQ ID NO: 3169637 - RNA, 22 nt, Mycobacterium bovis subsp bovis AF2122/97
uccgugcuuccauucgcggucc

SEQ ID NO: 3169638 - RNA, 19 nt, Mycobacterium bovis subsp bovis AF2122/97
uccguguuucgaacaccgu

SEQ ID NO: 3169639 - RNA, 16 nt, Mycobacterium bovis subsp bovis AF2122/97
uccguugaugccgccg

SEQ ID NO: 3169640 - RNA, 18 nt, Mycobacterium bovis subsp bovis AF2122/97
uccguugaugccgccgga

SEQ ID NO: 3169641 - RNA, 22 nt, Mycobacterium bovis subsp bovis AF2122/97
uccguugcccccauugccgccg

SEQ ID NO: 3169642 - RNA, 23 nt, Mycobacterium bovis subsp bovis AF2122/97
uccguugcccccauugccgccgu

SEQ ID NO: 3169643 - RNA, 14 nt, Mycobacterium bovis subsp bovis AF2122/97
uccguuuuaccucg

SEQ ID NO: 3169644 - RNA, 14 nt, Mycobacterium bovis subsp bovis AF2122/97
uccuacggugcagu

SEQ ID NO: 3169645 - RNA, 17 nt, Mycobacterium bovis subsp bovis AF2122/97
uccuaucagugagccgc

SEQ ID NO: 3169646 - RNA, 19 nt, Mycobacterium bovis subsp bovis AF2122/97
uccucaaggucggccaggc

SEQ ID NO: 3169647 - RNA, 21 nt, Mycobacterium bovis subsp bovis AF2122/97
uccucagccaccgcggucagc

SEQ ID NO: 3169648 - RNA, 17 nt, Mycobacterium bovis subsp bovis AF2122/97
uccucagccggugcgcu

SEQ ID NO: 3169649 - RNA, 22 nt, Mycobacterium bovis subsp bovis AF2122/97
uccuccaaggcggucaccaccg

SEQ ID NO: 3169650 - RNA, 23 nt, Mycobacterium bovis subsp bovis AF2122/97
uccuccaccagugccccgccgag

SEQ ID NO: 3169651 - RNA, 20 nt, Mycobacterium bovis subsp bovis AF2122/97
uccuccagagacagcgccau

SEQ ID NO: 3169652 - RNA, 16 nt, Mycobacterium bovis subsp bovis AF2122/97
uccucccaucccaugu

SEQ ID NO: 3169653 - RNA, 21 nt, Mycobacterium bovis subsp bovis AF2122/97
uccuccggaaagcucucggca

SEQ ID NO: 3169654 - RNA, 16 nt, Mycobacterium bovis subsp bovis AF2122/97
uccuccgggcagucga

SEQ ID NO: 3169655 - RNA, 18 nt, Mycobacterium bovis subsp bovis AF2122/97
uccuccggguuggcgacg

SEQ ID NO: 3169656 - RNA, 21 nt, Mycobacterium bovis subsp bovis AF2122/97
uccuccggguuggcgacgauc

SEQ ID NO: 3169657 - RNA, 19 nt, Mycobacterium bovis subsp bovis AF2122/97
uccuccgguaucggcgacc

SEQ ID NO: 3169658 - RNA, 14 nt, Mycobacterium bovis subsp bovis AF2122/97
uccuccucgacccc

SEQ ID NO: 3169659 - RNA, 13 nt, Mycobacterium bovis subsp bovis AF2122/97
uccuccucgucga

SEQ ID NO: 3169660 - RNA, 16 nt, Mycobacterium bovis subsp bovis AF2122/97
uccuccugcgccgcag

SEQ ID NO: 3169661 - RNA, 23 nt, Mycobacterium bovis subsp bovis AF2122/97
uccuccuggaugaaguguuuggc

SEQ ID NO: 3169662 - RNA, 22 nt, Mycobacterium bovis subsp bovis AF2122/97
uccucgaaguccgcuugggcgg

SEQ ID NO: 3169663 - RNA, 14 nt, Mycobacterium bovis subsp bovis AF2122/97
uccucgacacccau

SEQ ID NO: 3169664 - RNA, 15 nt, Mycobacterium bovis subsp bovis AF2122/97
uccucgaccgcggcc

SEQ ID NO: 3169665 - RNA, 12 nt, Mycobacterium bovis subsp bovis AF2122/97
uccucgaccguc

SEQ ID NO: 3169666 - RNA, 15 nt, Mycobacterium bovis subsp bovis AF2122/97
uccucgacgagcauc

SEQ ID NO: 3169667 - RNA, 16 nt, Mycobacterium bovis subsp bovis AF2122/97
uccucgacgaggagcc

SEQ ID NO: 3169668 - RNA, 21 nt, Mycobacterium bovis subsp bovis AF2122/97
uccucgacgaggagccucgac

SEQ ID NO: 3169669 - RNA, 23 nt, Mycobacterium bovis subsp bovis AF2122/97
uccucgacgaggagccucgaccg

SEQ ID NO: 3169670 - RNA, 19 nt, Mycobacterium bovis subsp bovis AF2122/97
uccucgacgucggcgagca

SEQ ID NO: 3169671 - RNA, 18 nt, Mycobacterium bovis subsp bovis AF2122/97
uccucgagugccgccguc

SEQ ID NO: 3169672 - RNA, 14 nt, Mycobacterium bovis subsp bovis AF2122/97
uccucgaucagacg

SEQ ID NO: 3169673 - RNA, 14 nt, Mycobacterium bovis subsp bovis AF2122/97
uccucgaucgucga

SEQ ID NO: 3169674 - RNA, 15 nt, Mycobacterium bovis subsp bovis AF2122/97
uccucgaucgucgac

SEQ ID NO: 3169675 - RNA, 16 nt, Mycobacterium bovis subsp bovis AF2122/97
uccucgaugaggcgca

SEQ ID NO: 3169676 - RNA, 20 nt, Mycobacterium bovis subsp bovis AF2122/97
uccucgaugaggcgcagcgc

SEQ ID NO: 3169677 - RNA, 17 nt, Mycobacterium bovis subsp bovis AF2122/97
uccucgaugcgggcgcc

SEQ ID NO: 3169678 - RNA, 20 nt, Mycobacterium bovis subsp bovis AF2122/97
uccucgaugcgggcgcccca

SEQ ID NO: 3169679 - RNA, 21 nt, Mycobacterium bovis subsp bovis AF2122/97
uccucgaugcgggcgccccac

SEQ ID NO: 3169680 - RNA, 18 nt, Mycobacterium bovis subsp bovis AF2122/97
uccucgcccgcaccagcu

SEQ ID NO: 3169681 - RNA, 14 nt, Mycobacterium bovis subsp bovis AF2122/97
uccucgcccuugac

SEQ ID NO: 3169682 - RNA, 15 nt, Mycobacterium bovis subsp bovis AF2122/97
uccucgcgagcuccc

SEQ ID NO: 3169683 - RNA, 22 nt, Mycobacterium bovis subsp bovis AF2122/97
uccucgcgguaguugucccgcc

SEQ ID NO: 3169684 - RNA, 20 nt, Mycobacterium bovis subsp bovis AF2122/97
uccucggacugaagagcaau

SEQ ID NO: 3169685 - RNA, 16 nt, Mycobacterium bovis subsp bovis AF2122/97
uccucggauugcagcg

SEQ ID NO: 3169686 - RNA, 19 nt, Mycobacterium bovis subsp bovis AF2122/97
uccucggcaaaccaagcgc

SEQ ID NO: 3169687 - RNA, 15 nt, Mycobacterium bovis subsp bovis AF2122/97
uccucggcaggaagg

SEQ ID NO: 3169688 - RNA, 14 nt, Mycobacterium bovis subsp bovis AF2122/97
uccucggccacccg

SEQ ID NO: 3169689 - RNA, 13 nt, Mycobacterium bovis subsp bovis AF2122/97
uccucggccagcg

SEQ ID NO: 3169690 - RNA, 19 nt, Mycobacterium bovis subsp bovis AF2122/97
uccucggcgguaaaugccu

SEQ ID NO: 3169691 - RNA, 20 nt, Mycobacterium bovis subsp bovis AF2122/97
uccucgggcaggcggccagc

SEQ ID NO: 3169692 - RNA, 21 nt, Mycobacterium bovis subsp bovis AF2122/97
uccucgggcaggcggccagcg

SEQ ID NO: 3169693 - RNA, 16 nt, Mycobacterium bovis subsp bovis AF2122/97
uccucggggaggucga

SEQ ID NO: 3169694 - RNA, 16 nt, Mycobacterium bovis subsp bovis AF2122/97
uccucggggcucucga

SEQ ID NO: 3169695 - RNA, 15 nt, Mycobacterium bovis subsp bovis AF2122/97
uccucggguucguca

SEQ ID NO: 3169696 - RNA, 13 nt, Mycobacterium bovis subsp bovis AF2122/97
uccucggucacga

SEQ ID NO: 3169697 - RNA, 23 nt, Mycobacterium bovis subsp bovis AF2122/97
uccucggugacuucacucguuga

SEQ ID NO: 3169698 - RNA, 16 nt, Mycobacterium bovis subsp bovis AF2122/97
uccucgguguccucga

SEQ ID NO: 3169699 - RNA, 19 nt, Mycobacterium bovis subsp bovis AF2122/97
uccucggugugcucgccga

SEQ ID NO: 3169700 - RNA, 15 nt, Mycobacterium bovis subsp bovis AF2122/97
uccucgucaccgcga

SEQ ID NO: 3169701 - RNA, 13 nt, Mycobacterium bovis subsp bovis AF2122/97
uccucgucgacgu

SEQ ID NO: 3169702 - RNA, 18 nt, Mycobacterium bovis subsp bovis AF2122/97
ucgaacugggggccggca

SEQ ID NO: 3169703 - RNA, 21 nt, Mycobacterium bovis subsp bovis AF2122/97
ucgaacugguuucgcaccgug

SEQ ID NO: 3169704 - RNA, 21 nt, Mycobacterium bovis subsp bovis AF2122/97
ucgaacuucgauucuggccgg

SEQ ID NO: 3169705 - RNA, 12 nt, Mycobacterium bovis subsp bovis AF2122/97
ucgaagaauaug

SEQ ID NO: 3169706 - RNA, 21 nt, Mycobacterium bovis subsp bovis AF2122/97
ucgaagaccgccuccaccgcc

SEQ ID NO: 3169707 - RNA, 21 nt, Mycobacterium bovis subsp bovis AF2122/97
ucgaagacguuggcgcgguug

SEQ ID NO: 3169708 - RNA, 16 nt, Mycobacterium bovis subsp bovis AF2122/97
ucgaagaucgagccga

SEQ ID NO: 3169709 - RNA, 16 nt, Mycobacterium bovis subsp bovis AF2122/97
ucgaagccccucaccu

SEQ ID NO: 3169710 - RNA, 20 nt, Mycobacterium bovis subsp bovis AF2122/97
ucgaagccccucaccucggc

SEQ ID NO: 3169711 - RNA, 12 nt, Mycobacterium bovis subsp bovis AF2122/97
ucgaagcccgga

SEQ ID NO: 3169712 - RNA, 16 nt, Mycobacterium bovis subsp bovis AF2122/97
ucgaagcccggcggca

SEQ ID NO: 3169713 - RNA, 13 nt, Mycobacterium bovis subsp bovis AF2122/97
ucgaagcgauccg

SEQ ID NO: 3169714 - RNA, 13 nt, Mycobacterium bovis subsp bovis AF2122/97
ucgaagcgaucgc

SEQ ID NO: 3169715 - RNA, 18 nt, Mycobacterium bovis subsp bovis AF2122/97
ucgaagcggaccagcgaa

SEQ ID NO: 3169716 - RNA, 20 nt, Mycobacterium bovis subsp bovis AF2122/97
ucgaagcggcugcugcgcgg

SEQ ID NO: 3169717 - RNA, 12 nt, Mycobacterium bovis subsp bovis AF2122/97
ucgaagcgggcu

SEQ ID NO: 3169718 - RNA, 17 nt, Mycobacterium bovis subsp bovis AF2122/97
ucgaagcucgcgcugug

SEQ ID NO: 3169719 - RNA, 16 nt, Mycobacterium bovis subsp bovis AF2122/97
ucgaagcuucggccuu

SEQ ID NO: 3169720 - RNA, 15 nt, Mycobacterium bovis subsp bovis AF2122/97
ucgaaggcacugcga

SEQ ID NO: 3169721 - RNA, 16 nt, Mycobacterium bovis subsp bovis AF2122/97
ucgaaggccacccgcg

SEQ ID NO: 3169722 - RNA, 18 nt, Mycobacterium bovis subsp bovis AF2122/97
ucgaaggcgugggugucg

SEQ ID NO: 3169723 - RNA, 18 nt, Mycobacterium bovis subsp bovis AF2122/97
ucgaaggcuucgcuggcu

SEQ ID NO: 3169724 - RNA, 19 nt, Mycobacterium bovis subsp bovis AF2122/97
ucgaagggcuugucgccgg

SEQ ID NO: 3169725 - RNA, 16 nt, Mycobacterium bovis subsp bovis AF2122/97
ucgaaggugaaucgac

SEQ ID NO: 3169726 - RNA, 13 nt, Mycobacterium bovis subsp bovis AF2122/97
ucgaaguccacau

SEQ ID NO: 3169727 - RNA, 20 nt, Mycobacterium bovis subsp bovis AF2122/97
ucgaaguccgcuugggcggu

SEQ ID NO: 3169728 - RNA, 15 nt, Mycobacterium bovis subsp bovis AF2122/97
ucgaagucgcccagu

SEQ ID NO: 3169729 - RNA, 14 nt, Mycobacterium bovis subsp bovis AF2122/97
ucgaauacaccugc

SEQ ID NO: 3169730 - RNA, 17 nt, Mycobacterium bovis subsp bovis AF2122/97
ucgaauagguguguggc

SEQ ID NO: 3169731 - RNA, 18 nt, Mycobacterium bovis subsp bovis AF2122/97
ucgaauaguugaccaggc

SEQ ID NO: 3169732 - RNA, 15 nt, Mycobacterium bovis subsp bovis AF2122/97
ucgaaucaggcucca

SEQ ID NO: 3169733 - RNA, 14 nt, Mycobacterium bovis subsp bovis AF2122/97
ucgaauccugccgc

SEQ ID NO: 3169734 - RNA, 17 nt, Mycobacterium bovis subsp bovis AF2122/97
ucgaauccugccgcacg

SEQ ID NO: 3169735 - RNA, 14 nt, Mycobacterium bovis subsp bovis AF2122/97
ucgacaaacagcgc

SEQ ID NO: 3169736 - RNA, 17 nt, Mycobacterium bovis subsp bovis AF2122/97
ucgacaacaaacccggc

SEQ ID NO: 3169737 - RNA, 23 nt, Mycobacterium bovis subsp bovis AF2122/97
ucgacaacaaacccggccucggu

SEQ ID NO: 3169738 - RNA, 15 nt, Mycobacterium bovis subsp bovis AF2122/97
ucgacaaccgcugcc

SEQ ID NO: 3169739 - RNA, 22 nt, Mycobacterium bovis subsp bovis AF2122/97
ucgacaaccgcugccgcaucgg

SEQ ID NO: 3169740 - RNA, 22 nt, Mycobacterium bovis subsp bovis AF2122/97
ucgacaacgcggcaccuucggc

SEQ ID NO: 3169741 - RNA, 19 nt, Mycobacterium bovis subsp bovis AF2122/97
ucgacacacccaccggacc

SEQ ID NO: 3169742 - RNA, 20 nt, Mycobacterium bovis subsp bovis AF2122/97
ucgacacacccaccggacca

SEQ ID NO: 3169743 - RNA, 20 nt, Mycobacterium bovis subsp bovis AF2122/97
ucgacacccgcacgaagccg

SEQ ID NO: 3169744 - RNA, 16 nt, Mycobacterium bovis subsp bovis AF2122/97
ucgacacccgcucggc

SEQ ID NO: 3169745 - RNA, 14 nt, Mycobacterium bovis subsp bovis AF2122/97
ucgacacccguuga

SEQ ID NO: 3169746 - RNA, 12 nt, Mycobacterium bovis subsp bovis AF2122/97
ucgacaccgacg

SEQ ID NO: 3169747 - RNA, 18 nt, Mycobacterium bovis subsp bovis AF2122/97
ucgacaccgagccacgac

SEQ ID NO: 3169748 - RNA, 20 nt, Mycobacterium bovis subsp bovis AF2122/97
ucgacaccgaggaccucguc

SEQ ID NO: 3169749 - RNA, 14 nt, Mycobacterium bovis subsp bovis AF2122/97
ucgacaccgcccga

SEQ ID NO: 3169750 - RNA, 16 nt, Mycobacterium bovis subsp bovis AF2122/97
ucgacaccgcggugcc

SEQ ID NO: 3169751 - RNA, 20 nt, Mycobacterium bovis subsp bovis AF2122/97
ucgacaccgugaccgccgcg

SEQ ID NO: 3169752 - RNA, 22 nt, Mycobacterium bovis subsp bovis AF2122/97
ucgacaccgugaccgccgcgcc

SEQ ID NO: 3169753 - RNA, 16 nt, Mycobacterium bovis subsp bovis AF2122/97
ucgacacggugaucuu

SEQ ID NO: 3169754 - RNA, 23 nt, Mycobacterium bovis subsp bovis AF2122/97
ucgacacuggacgcuccgggaau

SEQ ID NO: 3169755 - RNA, 15 nt, Mycobacterium bovis subsp bovis AF2122/97
ucgacagcagcgcga

SEQ ID NO: 3169756 - RNA, 12 nt, Mycobacterium bovis subsp bovis AF2122/97
ucgacagcauca

SEQ ID NO: 3169757 - RNA, 16 nt, Mycobacterium bovis subsp bovis AF2122/97
ucgacagcaucacgcc

SEQ ID NO: 3169758 - RNA, 20 nt, Mycobacterium bovis subsp bovis AF2122/97
ucgacagcaucacgcccacg

SEQ ID NO: 3169759 - RNA, 21 nt, Mycobacterium bovis subsp bovis AF2122/97
ucgacagccccgcggccagca

SEQ ID NO: 3169760 - RNA, 17 nt, Mycobacterium bovis subsp bovis AF2122/97
ucgacaggccaccgcag

SEQ ID NO: 3169761 - RNA, 17 nt, Mycobacterium bovis subsp bovis AF2122/97
ucgacaggugccagacc

SEQ ID NO: 3169762 - RNA, 19 nt, Mycobacterium bovis subsp bovis AF2122/97
ucgacaguugcgccagcgu

SEQ ID NO: 3169763 - RNA, 15 nt, Mycobacterium bovis subsp bovis AF2122/97
ucgacaucaccaccg

SEQ ID NO: 3169764 - RNA, 19 nt, Mycobacterium bovis subsp bovis AF2122/97
ucgacaucaccaccgccgg

SEQ ID NO: 3169765 - RNA, 14 nt, Mycobacterium bovis subsp bovis AF2122/97
ucgacaucggccag

SEQ ID NO: 3169766 - RNA, 20 nt, Mycobacterium bovis subsp bovis AF2122/97
ucgacaucguuggccgggca

SEQ ID NO: 3169767 - RNA, 17 nt, Mycobacterium bovis subsp bovis AF2122/97
ucgacaugggucggcug

SEQ ID NO: 3169768 - RNA, 20 nt, Mycobacterium bovis subsp bovis AF2122/97
ucgaccaagguguccagcac

SEQ ID NO: 3169769 - RNA, 18 nt, Mycobacterium bovis subsp bovis AF2122/97
ucgaccaauucgaccgcg

SEQ ID NO: 3169770 - RNA, 17 nt, Mycobacterium bovis subsp bovis AF2122/97
ucgaccaccacccggaa

SEQ ID NO: 3169771 - RNA, 11 nt, Mycobacterium bovis subsp bovis AF2122/97
ucgaccacgaa

SEQ ID NO: 3169772 - RNA, 15 nt, Mycobacterium bovis subsp bovis AF2122/97
ucgaccacgaccguc

SEQ ID NO: 3169773 - RNA, 14 nt, Mycobacterium bovis subsp bovis AF2122/97
ucgaccacgacgug

SEQ ID NO: 3169774 - RNA, 19 nt, Mycobacterium bovis subsp bovis AF2122/97
ucgaccagagccgcgagca

SEQ ID NO: 3169775 - RNA, 15 nt, Mycobacterium bovis subsp bovis AF2122/97
ucgaccagcgccgau

SEQ ID NO: 3169776 - RNA, 15 nt, Mycobacterium bovis subsp bovis AF2122/97
ucgaccaucaccacg

SEQ ID NO: 3169777 - RNA, 20 nt, Mycobacterium bovis subsp bovis AF2122/97
ucgaccaucaccacggccgc

SEQ ID NO: 3169778 - RNA, 21 nt, Mycobacterium bovis subsp bovis AF2122/97
ucgaccaucaccacggccgcc

SEQ ID NO: 3169779 - RNA, 17 nt, Mycobacterium bovis subsp bovis AF2122/97
ucgaccaugagccggcg

SEQ ID NO: 3169780 - RNA, 21 nt, Mycobacterium bovis subsp bovis AF2122/97
ucgacccccgcaucggcgcca

SEQ ID NO: 3169781 - RNA, 17 nt, Mycobacterium bovis subsp bovis AF2122/97
ucgacccccugccacag

SEQ ID NO: 3169782 - RNA, 21 nt, Mycobacterium bovis subsp bovis AF2122/97
ucgacccgaugacccacugca

SEQ ID NO: 3169783 - RNA, 21 nt, Mycobacterium bovis subsp bovis AF2122/97
ucgacccgcccauucccauau

SEQ ID NO: 3169784 - RNA, 10 nt, Mycobacterium bovis subsp bovis AF2122/97
ucgacccgcg

SEQ ID NO: 3169785 - RNA, 20 nt, Mycobacterium bovis subsp bovis AF2122/97
ucgacccggccaagggugcu

SEQ ID NO: 3169786 - RNA, 16 nt, Mycobacterium bovis subsp bovis AF2122/97
ucgaccgaacccgacg

SEQ ID NO: 3169787 - RNA, 12 nt, Mycobacterium bovis subsp bovis AF2122/97
ucgaccgagcuu

SEQ ID NO: 3169788 - RNA, 16 nt, Mycobacterium bovis subsp bovis AF2122/97
ucgaccgccagccgcg

SEQ ID NO: 3169789 - RNA, 22 nt, Mycobacterium bovis subsp bovis AF2122/97
ucgacggcgucgacugcgugcc

SEQ ID NO: 3169790 - RNA, 19 nt, Mycobacterium bovis subsp bovis AF2122/97
ucgacgggagcgacgucgg

SEQ ID NO: 3169791 - RNA, 17 nt, Mycobacterium bovis subsp bovis AF2122/97
ucgacgggcacgcggcg

SEQ ID NO: 3169792 - RNA, 22 nt, Mycobacterium bovis subsp bovis AF2122/97
ucgacgggccggaccaucagcg

SEQ ID NO: 3169793 - RNA, 23 nt, Mycobacterium bovis subsp bovis AF2122/97
ucgacggggaacguccgcgccga

SEQ ID NO: 3169794 - RNA, 16 nt, Mycobacterium bovis subsp bovis AF2122/97
ucgacgggucggcgcc

SEQ ID NO: 3169795 - RNA, 19 nt, Mycobacterium bovis subsp bovis AF2122/97
ucgacgggucggcgccgag

SEQ ID NO: 3169796 - RNA, 21 nt, Mycobacterium bovis subsp bovis AF2122/97
ucgacgggucggcgccgagca

SEQ ID NO: 3169797 - RNA, 14 nt, Mycobacterium bovis subsp bovis AF2122/97
ucgacggucaccgg

SEQ ID NO: 3169798 - RNA, 15 nt, Mycobacterium bovis subsp bovis AF2122/97
ucgacggucacggug

SEQ ID NO: 3169799 - RNA, 14 nt, Mycobacterium bovis subsp bovis AF2122/97
ucgacggucauccc

SEQ ID NO: 3169800 - RNA, 17 nt, Mycobacterium bovis subsp bovis AF2122/97
ucgacggucguuggucg

SEQ ID NO: 3169801 - RNA, 20 nt, Mycobacterium bovis subsp bovis AF2122/97
ucgacggugacgaccacguc

SEQ ID NO: 3169802 - RNA, 16 nt, Mycobacterium bovis subsp bovis AF2122/97
ucgacggugaucaggu

SEQ ID NO: 3169803 - RNA, 17 nt, Mycobacterium bovis subsp bovis AF2122/97
ucgacgguggcgccguc

SEQ ID NO: 3169804 - RNA, 22 nt, Mycobacterium bovis subsp bovis AF2122/97
ucgacgguggcgccgucggccg

SEQ ID NO: 3169805 - RNA, 13 nt, Mycobacterium bovis subsp bovis AF2122/97
ucgacggugucau

SEQ ID NO: 3169806 - RNA, 20 nt, Mycobacterium bovis subsp bovis AF2122/97
ucgacggugucuugggcguc

SEQ ID NO: 3169807 - RNA, 16 nt, Mycobacterium bovis subsp bovis AF2122/97
ucgacguaagugugcc

SEQ ID NO: 3169808 - RNA, 21 nt, Mycobacterium bovis subsp bovis AF2122/97
ucgacguaaugcgcugccgcc

SEQ ID NO: 3169809 - RNA, 18 nt, Mycobacterium bovis subsp bovis AF2122/97
ucgacguaggacugccag

SEQ ID NO: 3169810 - RNA, 14 nt, Mycobacterium bovis subsp bovis AF2122/97
ucgacguagucgcg

SEQ ID NO: 3169811 - RNA, 16 nt, Mycobacterium bovis subsp bovis AF2122/97
ucgacgucaugcaggg

SEQ ID NO: 3169812 - RNA, 18 nt, Mycobacterium bovis subsp bovis AF2122/97
ucgacgucgauuucggcg

SEQ ID NO: 3169813 - RNA, 21 nt, Mycobacterium bovis subsp bovis AF2122/97
ucgacgucgauuucggcgacc

SEQ ID NO: 3169814 - RNA, 20 nt, Mycobacterium bovis subsp bovis AF2122/97
ucgacgucggcaucggcggc

SEQ ID NO: 3169815 - RNA, 15 nt, Mycobacterium bovis subsp bovis AF2122/97
ucgacgucggcgacc

SEQ ID NO: 3169816 - RNA, 20 nt, Mycobacterium bovis subsp bovis AF2122/97
ucgacgucgggcauggcggc

SEQ ID NO: 3169817 - RNA, 20 nt, Mycobacterium bovis subsp bovis AF2122/97
ucgacgucgguaagcgccaa

SEQ ID NO: 3169818 - RNA, 11 nt, Mycobacterium bovis subsp bovis AF2122/97
ucgacguucgg

SEQ ID NO: 3169819 - RNA, 20 nt, Mycobacterium bovis subsp bovis AF2122/97
ucgacguucgggucgagccg

SEQ ID NO: 3169820 - RNA, 16 nt, Mycobacterium bovis subsp bovis AF2122/97
ucgacguucgguggcg

SEQ ID NO: 3169821 - RNA, 16 nt, Mycobacterium bovis subsp bovis AF2122/97
ucgacguugaucgcca

SEQ ID NO: 3169822 - RNA, 12 nt, Mycobacterium bovis subsp bovis AF2122/97
ucgacguuggcg

SEQ ID NO: 3169823 - RNA, 22 nt, Mycobacterium bovis subsp bovis AF2122/97
ucgacguuggcgugcaccgcau

SEQ ID NO: 3169824 - RNA, 13 nt, Mycobacterium bovis subsp bovis AF2122/97
ucgacucacacac

SEQ ID NO: 3169825 - RNA, 14 nt, Mycobacterium bovis subsp bovis AF2122/97
ucgacucacacacc

SEQ ID NO: 3169826 - RNA, 16 nt, Mycobacterium bovis subsp bovis AF2122/97
ucgacuccagcaccag

SEQ ID NO: 3169827 - RNA, 17 nt, Mycobacterium bovis subsp bovis AF2122/97
ucgacucgaccgcgacg

SEQ ID NO: 3169828 - RNA, 17 nt, Mycobacterium bovis subsp bovis AF2122/97
ucgacucggcggcgcgg

SEQ ID NO: 3169829 - RNA, 23 nt, Mycobacterium bovis subsp bovis AF2122/97
ucgacugacuuugggucggcgau

SEQ ID NO: 3169830 - RNA, 12 nt, Mycobacterium bovis subsp bovis AF2122/97
ucgacugaucga

SEQ ID NO: 3169831 - RNA, 20 nt, Mycobacterium bovis subsp bovis AF2122/97
ucgacugaucgccacccggu

SEQ ID NO: 3169832 - RNA, 14 nt, Mycobacterium bovis subsp bovis AF2122/97
ucgacugccagcgc

SEQ ID NO: 3169833 - RNA, 12 nt, Mycobacterium bovis subsp bovis AF2122/97
ucgacugggacg

SEQ ID NO: 3169834 - RNA, 16 nt, Mycobacterium bovis subsp bovis AF2122/97
ucgacugggacgacgc

SEQ ID NO: 3169835 - RNA, 12 nt, Mycobacterium bovis subsp bovis AF2122/97
ucgagaaucggc

SEQ ID NO: 3169836 - RNA, 16 nt, Mycobacterium bovis subsp bovis AF2122/97
ucgagaaucggcauuc

SEQ ID NO: 3169837 - RNA, 17 nt, Mycobacterium bovis subsp bovis AF2122/97
ucgagacgcuuuccgcc

SEQ ID NO: 3169838 - RNA, 24 nt, Mycobacterium bovis subsp bovis AF2122/97
ucgagagaacguaggguggccggu

SEQ ID NO: 3169839 - RNA, 16 nt, Mycobacterium bovis subsp bovis AF2122/97
ucgagagguucgccgu

SEQ ID NO: 3169840 - RNA, 17 nt, Mycobacterium bovis subsp bovis AF2122/97
ucgagauaaccaccauc

SEQ ID NO: 3169841 - RNA, 17 nt, Mycobacterium bovis subsp bovis AF2122/97
ucgagauauugcgcgcc

SEQ ID NO: 3169842 - RNA, 18 nt, Mycobacterium bovis subsp bovis AF2122/97
ucgagaucagucugggcg

SEQ ID NO: 3169843 - RNA, 16 nt, Mycobacterium bovis subsp bovis AF2122/97
ucgagauccucgucga

SEQ ID NO: 3169844 - RNA, 14 nt, Mycobacterium bovis subsp bovis AF2122/97
ucgagaucucacgu

SEQ ID NO: 3169845 - RNA, 20 nt, Mycobacterium bovis subsp bovis AF2122/97
ucgagcaacugcucgacgag

SEQ ID NO: 3169846 - RNA, 12 nt, Mycobacterium bovis subsp bovis AF2122/97
ucgagcacaccg

SEQ ID NO: 3169847 - RNA, 15 nt, Mycobacterium bovis subsp bovis AF2122/97
ucgagcaccacccgg

SEQ ID NO: 3169848 - RNA, 16 nt, Mycobacterium bovis subsp bovis AF2122/97
ucgagcaccgacaccg

SEQ ID NO: 3169849 - RNA, 19 nt, Mycobacterium bovis subsp bovis AF2122/97
ucgagcaccgacaccggcc

SEQ ID NO: 3169850 - RNA, 22 nt, Mycobacterium bovis subsp bovis AF2122/97
ucgagcaccgacaccggccgcg

SEQ ID NO: 3169851 - RNA, 15 nt, Mycobacterium bovis subsp bovis AF2122/97
ucgagcaccgcgaac

SEQ ID NO: 3169852 - RNA, 15 nt, Mycobacterium bovis subsp bovis AF2122/97
ucgagcaccggcugc

SEQ ID NO: 3169853 - RNA, 14 nt, Mycobacterium bovis subsp bovis AF2122/97
ucgagcaccucggc

SEQ ID NO: 3169854 - RNA, 17 nt, Mycobacterium bovis subsp bovis AF2122/97
ucgagcaccucggccuc

SEQ ID NO: 3169855 - RNA, 16 nt, Mycobacterium bovis subsp bovis AF2122/97
ucgagcaccugccgau

SEQ ID NO: 3169856 - RNA, 19 nt, Mycobacterium bovis subsp bovis AF2122/97
ucgagcacgaugucgaugc

SEQ ID NO: 3169857 - RNA, 21 nt, Mycobacterium bovis subsp bovis AF2122/97
ucgagcacgaugucgaugccg

SEQ ID NO: 3169858 - RNA, 15 nt, Mycobacterium bovis subsp bovis AF2122/97
ucgagcacgucgggg

SEQ ID NO: 3169859 - RNA, 15 nt, Mycobacterium bovis subsp bovis AF2122/97
ucgagcagcaccacc

SEQ ID NO: 3169860 - RNA, 14 nt, Mycobacterium bovis subsp bovis AF2122/97
ucgagcagcauguc

SEQ ID NO: 3169861 - RNA, 13 nt, Mycobacterium bovis subsp bovis AF2122/97
ucgagcagcgcgc

SEQ ID NO: 3169862 - RNA, 14 nt, Mycobacterium bovis subsp bovis AF2122/97
ucgagcagcgcgcc

SEQ ID NO: 3169863 - RNA, 15 nt, Mycobacterium bovis subsp bovis AF2122/97
ucgagcaggcgcacc

SEQ ID NO: 3169864 - RNA, 18 nt, Mycobacterium bovis subsp bovis AF2122/97
ucgagcaggcgcaccagg

SEQ ID NO: 3169865 - RNA, 20 nt, Mycobacterium bovis subsp bovis AF2122/97
ucgagcagugccucggcgau

SEQ ID NO: 3169866 - RNA, 22 nt, Mycobacterium bovis subsp bovis AF2122/97
ucgagcagugccucggcgaugg

SEQ ID NO: 3169867 - RNA, 19 nt, Mycobacterium bovis subsp bovis AF2122/97
ucgagcaguuccagcucgc

SEQ ID NO: 3169868 - RNA, 14 nt, Mycobacterium bovis subsp bovis AF2122/97
ucgagccacaugac

SEQ ID NO: 3169869 - RNA, 12 nt, Mycobacterium bovis subsp bovis AF2122/97
ucgagccagcgg

SEQ ID NO: 3169870 - RNA, 19 nt, Mycobacterium bovis subsp bovis AF2122/97
ucgagcccaaggggcagcg

SEQ ID NO: 3169871 - RNA, 16 nt, Mycobacterium bovis subsp bovis AF2122/97
ucgagcccucguuauc

SEQ ID NO: 3169872 - RNA, 24 nt, Mycobacterium bovis subsp bovis AF2122/97
ucgagccgcggcaacaccaccucg

SEQ ID NO: 3169873 - RNA, 14 nt, Mycobacterium bovis subsp bovis AF2122/97
ucgagccgcguucg

SEQ ID NO: 3169874 - RNA, 19 nt, Mycobacterium bovis subsp bovis AF2122/97
ucgagccggacccggugca

SEQ ID NO: 3169875 - RNA, 20 nt, Mycobacterium bovis subsp bovis AF2122/97
ucgagccggauucggcugcc

SEQ ID NO: 3169876 - RNA, 16 nt, Mycobacterium bovis subsp bovis AF2122/97
ucgaucacguggucca

SEQ ID NO: 3169877 - RNA, 17 nt, Mycobacterium bovis subsp bovis AF2122/97
ucgaucacguggugcgg

SEQ ID NO: 3169878 - RNA, 19 nt, Mycobacterium bovis subsp bovis AF2122/97
ucgaucagaaucugccucu

SEQ ID NO: 3169879 - RNA, 18 nt, Mycobacterium bovis subsp bovis AF2122/97
ucgaucagaugcggcccg

SEQ ID NO: 3169880 - RNA, 19 nt, Mycobacterium bovis subsp bovis AF2122/97
ucgaucagcaacucggcca

SEQ ID NO: 3169881 - RNA, 15 nt, Mycobacterium bovis subsp bovis AF2122/97
ucgaucagcgccgga

SEQ ID NO: 3169882 - RNA, 13 nt, Mycobacterium bovis subsp bovis AF2122/97
ucgaucagcuccu

SEQ ID NO: 3169883 - RNA, 23 nt, Mycobacterium bovis subsp bovis AF2122/97
ucgaucagcuugggcagcagcgc

SEQ ID NO: 3169884 - RNA, 17 nt, Mycobacterium bovis subsp bovis AF2122/97
ucgaucaggggcccacc

SEQ ID NO: 3169885 - RNA, 18 nt, Mycobacterium bovis subsp bovis AF2122/97
ucgaucaggggcccaccc

SEQ ID NO: 3169886 - RNA, 15 nt, Mycobacterium bovis subsp bovis AF2122/97
ucgaucaggucguca

SEQ ID NO: 3169887 - RNA, 17 nt, Mycobacterium bovis subsp bovis AF2122/97
ucgaucaguucguggcu

SEQ ID NO: 3169888 - RNA, 15 nt, Mycobacterium bovis subsp bovis AF2122/97
ucgaucaucgaccug

SEQ ID NO: 3169889 - RNA, 19 nt, Mycobacterium bovis subsp bovis AF2122/97
ucgaucaucgaccuggcca

SEQ ID NO: 3169890 - RNA, 14 nt, Mycobacterium bovis subsp bovis AF2122/97
ucgaucauggcggc

SEQ ID NO: 3169891 - RNA, 18 nt, Mycobacterium bovis subsp bovis AF2122/97
ucgauccucgcccgcacc

SEQ ID NO: 3169892 - RNA, 22 nt, Mycobacterium bovis subsp bovis AF2122/97
ucgauccucgcccgcaccagcu

SEQ ID NO: 3169893 - RNA, 22 nt, Mycobacterium bovis subsp bovis AF2122/97
ucgaucgagcaggccgcccagc

SEQ ID NO: 3169894 - RNA, 23 nt, Mycobacterium bovis subsp bovis AF2122/97
ucgaucgccgcgauggcggucca

SEQ ID NO: 3169895 - RNA, 22 nt, Mycobacterium bovis subsp bovis AF2122/97
ucgaucgcuugccccgccgagc

SEQ ID NO: 3169896 - RNA, 18 nt, Mycobacterium bovis subsp bovis AF2122/97
ucgaucggcagccagggc

SEQ ID NO: 3169897 - RNA, 14 nt, Mycobacterium bovis subsp bovis AF2122/97
ucgaucgucgacgc

SEQ ID NO: 3169898 - RNA, 14 nt, Mycobacterium bovis subsp bovis AF2122/97
ucgaucuccaggcc

SEQ ID NO: 3169899 - RNA, 15 nt, Mycobacterium bovis subsp bovis AF2122/97
ucgaucucgcgaacc

SEQ ID NO: 3169900 - RNA, 14 nt, Mycobacterium bovis subsp bovis AF2122/97
ucgaucucggccag

SEQ ID NO: 3169901 - RNA, 18 nt, Mycobacterium bovis subsp bovis AF2122/97
ucgaucugcacgagugcg

SEQ ID NO: 3169902 - RNA, 23 nt, Mycobacterium bovis subsp bovis AF2122/97
ucgaucugcccccgccggccguc

SEQ ID NO: 3169903 - RNA, 20 nt, Mycobacterium bovis subsp bovis AF2122/97
ucgaucugcccggugaucca

SEQ ID NO: 3169904 - RNA, 15 nt, Mycobacterium bovis subsp bovis AF2122/97
ucgaucugcgggcgg

SEQ ID NO: 3169905 - RNA, 13 nt, Mycobacterium bovis subsp bovis AF2122/97
ucgaucuggcgga

SEQ ID NO: 3169906 - RNA, 22 nt, Mycobacterium bovis subsp bovis AF2122/97
ucgaucuggcuacgggccgcgg

SEQ ID NO: 3169907 - RNA, 17 nt, Mycobacterium bovis subsp bovis AF2122/97
ucgaucugucgcgccgg

SEQ ID NO: 3169908 - RNA, 15 nt, Mycobacterium bovis subsp bovis AF2122/97
ucgaucuucuccucg

SEQ ID NO: 3169909 - RNA, 21 nt, Mycobacterium bovis subsp bovis AF2122/97
ucgaugaagcgucguugcucg

SEQ ID NO: 3169910 - RNA, 19 nt, Mycobacterium bovis subsp bovis AF2122/97
ucgaugaccagcacaccgc

SEQ ID NO: 3169911 - RNA, 21 nt, Mycobacterium bovis subsp bovis AF2122/97
ucgaugaccagcacaccgccc

SEQ ID NO: 3169912 - RNA, 21 nt, Mycobacterium bovis subsp bovis AF2122/97
ucgaugacccauacgaacuca

SEQ ID NO: 3169913 - RNA, 15 nt, Mycobacterium bovis subsp bovis AF2122/97
ucgaugacgacgccg

SEQ ID NO: 3169914 - RNA, 21 nt, Mycobacterium bovis subsp bovis AF2122/97
ucgaugaggcgcagcgccagc

SEQ ID NO: 3169915 - RNA, 23 nt, Mycobacterium bovis subsp bovis AF2122/97
ucgaugaggcgcagcgccagcgg

SEQ ID NO: 3169916 - RNA, 22 nt, Mycobacterium bovis subsp bovis AF2122/97
ucgaugagugacgguccguucg

SEQ ID NO: 3169917 - RNA, 19 nt, Mycobacterium bovis subsp bovis AF2122/97
ucgaugaucucgccccagu

SEQ ID NO: 3169918 - RNA, 16 nt, Mycobacterium bovis subsp bovis AF2122/97
ucgaugaugccggaca

SEQ ID NO: 3169919 - RNA, 21 nt, Mycobacterium bovis subsp bovis AF2122/97
ucgaugaugccggacagcucg

SEQ ID NO: 3169920 - RNA, 21 nt, Mycobacterium bovis subsp bovis AF2122/97
ucgaugauggcuccggccgcg

SEQ ID NO: 3169921 - RNA, 21 nt, Mycobacterium bovis subsp bovis AF2122/97
ucgaugcauggcuugcucugc

SEQ ID NO: 3169922 - RNA, 22 nt, Mycobacterium bovis subsp bovis AF2122/97
ucgaugccacaucccacggugg

SEQ ID NO: 3169923 - RNA, 15 nt, Mycobacterium bovis subsp bovis AF2122/97
ucgaugccgcgcagc

SEQ ID NO: 3169924 - RNA, 18 nt, Mycobacterium bovis subsp bovis AF2122/97
ucgaugccgcguagcugg

SEQ ID NO: 3169925 - RNA, 17 nt, Mycobacterium bovis subsp bovis AF2122/97
ucgaugccggcuggcgg

SEQ ID NO: 3169926 - RNA, 22 nt, Mycobacterium bovis subsp bovis AF2122/97
ucgaugccuucguagcggccgc

SEQ ID NO: 3169927 - RNA, 13 nt, Mycobacterium bovis subsp bovis AF2122/97
ucgaugcgacgaa

SEQ ID NO: 3169928 - RNA, 21 nt, Mycobacterium bovis subsp bovis AF2122/97
ucgaugcgcagcccgucggug

SEQ ID NO: 3169929 - RNA, 16 nt, Mycobacterium bovis subsp bovis AF2122/97
ucgaugcugccagcca

SEQ ID NO: 3169930 - RNA, 23 nt, Mycobacterium bovis subsp bovis AF2122/97
ucgaugcuuucguauucggccgc

SEQ ID NO: 3169931 - RNA, 21 nt, Mycobacterium bovis subsp bovis AF2122/97
ucgauggaaaacgccaugccg

SEQ ID NO: 3169932 - RNA, 16 nt, Mycobacterium bovis subsp bovis AF2122/97
ucgauggcaugggcua

SEQ ID NO: 3169933 - RNA, 20 nt, Mycobacterium bovis subsp bovis AF2122/97
ucgauggccacccgguggcg

SEQ ID NO: 3169934 - RNA, 22 nt, Mycobacterium bovis subsp bovis AF2122/97
ucgauggcgcacugguugggcg

SEQ ID NO: 3169935 - RNA, 19 nt, Mycobacterium bovis subsp bovis AF2122/97
ucgauggcggccaccagcg

SEQ ID NO: 3169936 - RNA, 18 nt, Mycobacterium bovis subsp bovis AF2122/97
ucgauggcguacagcacc

SEQ ID NO: 3169937 - RNA, 19 nt, Mycobacterium bovis subsp bovis AF2122/97
ucgaugggugacgguggcc

SEQ ID NO: 3169938 - RNA, 13 nt, Mycobacterium bovis subsp bovis AF2122/97
ucgauggugugcc

SEQ ID NO: 3169939 - RNA, 15 nt, Mycobacterium bovis subsp bovis AF2122/97
ucgauguacaccgug

SEQ ID NO: 3169940 - RNA, 16 nt, Mycobacterium bovis subsp bovis AF2122/97
ucgauguauccgaugc

SEQ ID NO: 3169941 - RNA, 18 nt, Mycobacterium bovis subsp bovis AF2122/97
ucgauguccaaugcaccg

SEQ ID NO: 3169942 - RNA, 17 nt, Mycobacterium bovis subsp bovis AF2122/97
ucgauguccccggcggc

SEQ ID NO: 3169943 - RNA, 18 nt, Mycobacterium bovis subsp bovis AF2122/97
ucgauguccucgacaccc

SEQ ID NO: 3169944 - RNA, 20 nt, Mycobacterium bovis subsp bovis AF2122/97
ucgaugucgagguagugguc

SEQ ID NO: 3169945 - RNA, 14 nt, Mycobacterium bovis subsp bovis AF2122/97
ucgaugucgccgcu

SEQ ID NO: 3169946 - RNA, 22 nt, Mycobacterium bovis subsp bovis AF2122/97
ucgauguucgccgcgcggaaca

SEQ ID NO: 3169947 - RNA, 18 nt, Mycobacterium bovis subsp bovis AF2122/97
ucgauuaucgcgcgcaac

SEQ ID NO: 3169948 - RNA, 20 nt, Mycobacterium bovis subsp bovis AF2122/97
ucgauuaucgcgcgcaaccg

SEQ ID NO: 3169949 - RNA, 18 nt, Mycobacterium bovis subsp bovis AF2122/97
ucgauuccgggugcgauc

SEQ ID NO: 3169950 - RNA, 20 nt, Mycobacterium bovis subsp bovis AF2122/97
ucgauuggcucgccgaacca

SEQ ID NO: 3169951 - RNA, 14 nt, Mycobacterium bovis subsp bovis AF2122/97
ucgauugucgccgc

SEQ ID NO: 3169952 - RNA, 15 nt, Mycobacterium bovis subsp bovis AF2122/97
ucgauuguggccagc

SEQ ID NO: 3169953 - RNA, 19 nt, Mycobacterium bovis subsp bovis AF2122/97
ucgcaaacaagaucagacc

SEQ ID NO: 3169954 - RNA, 22 nt, Mycobacterium bovis subsp bovis AF2122/97
ucgcaaacagauucggugccag

SEQ ID NO: 3169955 - RNA, 16 nt, Mycobacterium bovis subsp bovis AF2122/97
ucgcaaaggccccggu

SEQ ID NO: 3169956 - RNA, 13 nt, Mycobacterium bovis subsp bovis AF2122/97
ucgcaaccgccgc

SEQ ID NO: 3169957 - RNA, 14 nt, Mycobacterium bovis subsp bovis AF2122/97
ucgcaacgcaucga

SEQ ID NO: 3169958 - RNA, 15 nt, Mycobacterium bovis subsp bovis AF2122/97
ucgcaagcgcggcga

SEQ ID NO: 3169959 - RNA, 15 nt, Mycobacterium bovis subsp bovis AF2122/97
ucgcaagcugggcgu

SEQ ID NO: 3169960 - RNA, 18 nt, Mycobacterium bovis subsp bovis AF2122/97
ucgcaauauccggccgag

SEQ ID NO: 3169961 - RNA, 19 nt, Mycobacterium bovis subsp bovis AF2122/97
ucgcaauaugccacagacc

SEQ ID NO: 3169962 - RNA, 22 nt, Mycobacterium bovis subsp bovis AF2122/97
ucgccacgacaggucgcccggu

SEQ ID NO: 3169963 - RNA, 21 nt, Mycobacterium bovis subsp bovis AF2122/97
ucgccacucagcccgacaccg

SEQ ID NO: 3169964 - RNA, 20 nt, Mycobacterium bovis subsp bovis AF2122/97
ucgccacuguugaagaagcc

SEQ ID NO: 3169965 - RNA, 21 nt, Mycobacterium bovis subsp bovis AF2122/97
ucgccacuguugaagaagccc

SEQ ID NO: 3169966 - RNA, 22 nt, Mycobacterium bovis subsp bovis AF2122/97
ucgccacuguugaagaagcccg

SEQ ID NO: 3169967 - RNA, 15 nt, Mycobacterium bovis subsp bovis AF2122/97
ucgccagaccgcacc

SEQ ID NO: 3169968 - RNA, 19 nt, Mycobacterium bovis subsp bovis AF2122/97
ucgccagcaucagcccggc

SEQ ID NO: 3169969 - RNA, 16 nt, Mycobacterium bovis subsp bovis AF2122/97
ucgccagccggccgcg

SEQ ID NO: 3169970 - RNA, 17 nt, Mycobacterium bovis subsp bovis AF2122/97
ucgccagccugugcugc

SEQ ID NO: 3169971 - RNA, 21 nt, Mycobacterium bovis subsp bovis AF2122/97
ucgccagccugugcugccaac

SEQ ID NO: 3169972 - RNA, 14 nt, Mycobacterium bovis subsp bovis AF2122/97
ucgccagcgccgga

SEQ ID NO: 3169973 - RNA, 12 nt, Mycobacterium bovis subsp bovis AF2122/97
ucgccagcggca

SEQ ID NO: 3169974 - RNA, 12 nt, Mycobacterium bovis subsp bovis AF2122/97
ucgccagcggcg

SEQ ID NO: 3169975 - RNA, 14 nt, Mycobacterium bovis subsp bovis AF2122/97
ucgccagcggcgcg

SEQ ID NO: 3169976 - RNA, 21 nt, Mycobacterium bovis subsp bovis AF2122/97
ucgccagcugacacccgcagc

SEQ ID NO: 3169977 - RNA, 14 nt, Mycobacterium bovis subsp bovis AF2122/97
ucgccaggccgucg

SEQ ID NO: 3169978 - RNA, 15 nt, Mycobacterium bovis subsp bovis AF2122/97
ucgccaggccguggc

SEQ ID NO: 3169979 - RNA, 20 nt, Mycobacterium bovis subsp bovis AF2122/97
ucgccagggccaucuggcug

SEQ ID NO: 3169980 - RNA, 16 nt, Mycobacterium bovis subsp bovis AF2122/97
ucgccagggccuuggc

SEQ ID NO: 3169981 - RNA, 22 nt, Mycobacterium bovis subsp bovis AF2122/97
ucgccagugcuccaaaucggca

SEQ ID NO: 3169982 - RNA, 13 nt, Mycobacterium bovis subsp bovis AF2122/97
ucgccaucguuuc

SEQ ID NO: 3169983 - RNA, 23 nt, Mycobacterium bovis subsp bovis AF2122/97
ucgccaucguuucacccgggcug

SEQ ID NO: 3169984 - RNA, 22 nt, Mycobacterium bovis subsp bovis AF2122/97
ucgccaugauggacagcugcgg

SEQ ID NO: 3169985 - RNA, 23 nt, Mycobacterium bovis subsp bovis AF2122/97
ucgccaugauggacagcugcggg

SEQ ID NO: 3169986 - RNA, 18 nt, Mycobacterium bovis subsp bovis AF2122/97
ucgcccaacaccgcgccg

SEQ ID NO: 3169987 - RNA, 21 nt, Mycobacterium bovis subsp bovis AF2122/97
ucgcccaacaccgcgccgacg

SEQ ID NO: 3169988 - RNA, 17 nt, Mycobacterium bovis subsp bovis AF2122/97
ucgcccaauucggcacg

SEQ ID NO: 3169989 - RNA, 13 nt, Mycobacterium bovis subsp bovis AF2122/97
ucgcccaauuucg

SEQ ID NO: 3169990 - RNA, 19 nt, Mycobacterium bovis subsp bovis AF2122/97
ucgcccaauuucgucucga

SEQ ID NO: 3169991 - RNA, 22 nt, Mycobacterium bovis subsp bovis AF2122/97
ucgcccaccacgaacacguucg

SEQ ID NO: 3169992 - RNA, 12 nt, Mycobacterium bovis subsp bovis AF2122/97
ucgcccaccgca

SEQ ID NO: 3169993 - RNA, 15 nt, Mycobacterium bovis subsp bovis AF2122/97
ucgcccagagccgcu

SEQ ID NO: 3169994 - RNA, 12 nt, Mycobacterium bovis subsp bovis AF2122/97
ucgcccagcaag

SEQ ID NO: 3169995 - RNA, 15 nt, Mycobacterium bovis subsp bovis AF2122/97
ucgcccagcaaggcc

SEQ ID NO: 3169996 - RNA, 18 nt, Mycobacterium bovis subsp bovis AF2122/97
ucgcccagcaaggcccga

SEQ ID NO: 3169997 - RNA, 21 nt, Mycobacterium bovis subsp bovis AF2122/97
ucgcccagcaggcccuuggcg

SEQ ID NO: 3169998 - RNA, 20 nt, Mycobacterium bovis subsp bovis AF2122/97
ucgcccagccgagcguggcg

SEQ ID NO: 3169999 - RNA, 17 nt, Mycobacterium bovis subsp bovis AF2122/97
ucgcccagcgugaacug

SEQ ID NO: 3170000 - RNA, 15 nt, Mycobacterium bovis subsp bovis AF2122/97
ucgcccaggaagccg

SEQ ID NO: 3170001 - RNA, 16 nt, Mycobacterium bovis subsp bovis AF2122/97
ucgcccaggaagccga

SEQ ID NO: 3170002 - RNA, 17 nt, Mycobacterium bovis subsp bovis AF2122/97
ucgcccaggaagccgag

SEQ ID NO: 3170003 - RNA, 18 nt, Mycobacterium bovis subsp bovis AF2122/97
ucgcccaggccaaggugg

SEQ ID NO: 3170004 - RNA, 21 nt, Mycobacterium bovis subsp bovis AF2122/97
ucgcccaggccaagguggcca

SEQ ID NO: 3170005 - RNA, 23 nt, Mycobacterium bovis subsp bovis AF2122/97
ucgcccaggccaagguggccacc

SEQ ID NO: 3170006 - RNA, 11 nt, Mycobacterium bovis subsp bovis AF2122/97
ucgcccaggcg

SEQ ID NO: 3170007 - RNA, 12 nt, Mycobacterium bovis subsp bovis AF2122/97
ucgcccaggcgc

SEQ ID NO: 3170008 - RNA, 13 nt, Mycobacterium bovis subsp bovis AF2122/97
ucgcccaggcgcg

SEQ ID NO: 3170009 - RNA, 18 nt, Mycobacterium bovis subsp bovis AF2122/97
ucgcccaggcgugucguc

SEQ ID NO: 3170010 - RNA, 13 nt, Mycobacterium bovis subsp bovis AF2122/97
ucgcccagggugg

SEQ ID NO: 3170011 - RNA, 14 nt, Mycobacterium bovis subsp bovis AF2122/97
ucgcccagucccag

SEQ ID NO: 3170012 - RNA, 16 nt, Mycobacterium bovis subsp bovis AF2122/97
ucgcccagucgccgcg

SEQ ID NO: 3170013 - RNA, 19 nt, Mycobacterium bovis subsp bovis AF2122/97
ucgcccagugugcgccgug

SEQ ID NO: 3170014 - RNA, 21 nt, Mycobacterium bovis subsp bovis AF2122/97
ucgcccaucgcaagcugggcg

SEQ ID NO: 3170015 - RNA, 17 nt, Mycobacterium bovis subsp bovis AF2122/97
ucgcccauuggccaggu

SEQ ID NO: 3170016 - RNA, 19 nt, Mycobacterium bovis subsp bovis AF2122/97
ucgccccagugcucaucga

SEQ ID NO: 3170017 - RNA, 21 nt, Mycobacterium bovis subsp bovis AF2122/97
ucgcccccuggauggcgcccu

SEQ ID NO: 3170018 - RNA, 22 nt, Mycobacterium bovis subsp bovis AF2122/97
ucgccccugcacagcaggcucg

SEQ ID NO: 3170019 - RNA, 18 nt, Mycobacterium bovis subsp bovis AF2122/97
ucgcccgagucgaaaccg

SEQ ID NO: 3170020 - RNA, 20 nt, Mycobacterium bovis subsp bovis AF2122/97
ucgcccgaguugaagaagcc

SEQ ID NO: 3170021 - RNA, 14 nt, Mycobacterium bovis subsp bovis AF2122/97
ucgcccgaucggcg

SEQ ID NO: 3170022 - RNA, 12 nt, Mycobacterium bovis subsp bovis AF2122/97
ucgcccgaugcg

SEQ ID NO: 3170023 - RNA, 19 nt, Mycobacterium bovis subsp bovis AF2122/97
ucgcccgccgccaccagcu

SEQ ID NO: 3170024 - RNA, 16 nt, Mycobacterium bovis subsp bovis AF2122/97
ucgcccgcuacggcag

SEQ ID NO: 3170025 - RNA, 14 nt, Mycobacterium bovis subsp bovis AF2122/97
ucgcccggaugauc

SEQ ID NO: 3170026 - RNA, 14 nt, Mycobacterium bovis subsp bovis AF2122/97
ucgcccgggccgcg

SEQ ID NO: 3170027 - RNA, 21 nt, Mycobacterium bovis subsp bovis AF2122/97
ucgcccgggcgggauccaccc

SEQ ID NO: 3170028 - RNA, 21 nt, Mycobacterium bovis subsp bovis AF2122/97
ucgcccggguggcgucgaucu

SEQ ID NO: 3170029 - RNA, 13 nt, Mycobacterium bovis subsp bovis AF2122/97
ucgcccucccggg

SEQ ID NO: 3170030 - RNA, 16 nt, Mycobacterium bovis subsp bovis AF2122/97
ucgcccucccgggccc

SEQ ID NO: 3170031 - RNA, 23 nt, Mycobacterium bovis subsp bovis AF2122/97
ucgcccucccgggcccgcugggc

SEQ ID NO: 3170032 - RNA, 13 nt, Mycobacterium bovis subsp bovis AF2122/97
ucgcccugacacc

SEQ ID NO: 3170033 - RNA, 15 nt, Mycobacterium bovis subsp bovis AF2122/97
ucgcccugacaccca

SEQ ID NO: 3170034 - RNA, 18 nt, Mycobacterium bovis subsp bovis AF2122/97
ucgcccugacccggagcc

SEQ ID NO: 3170035 - RNA, 14 nt, Mycobacterium bovis subsp bovis AF2122/97
ucgcccugcagacg

SEQ ID NO: 3170036 - RNA, 16 nt, Mycobacterium bovis subsp bovis AF2122/97
ucgcccugggcgccgg

SEQ ID NO: 3170037 - RNA, 17 nt, Mycobacterium bovis subsp bovis AF2122/97
ucgcccuuagggucgcc

SEQ ID NO: 3170038 - RNA, 15 nt, Mycobacterium bovis subsp bovis AF2122/97
ucgcccuugccgcag

SEQ ID NO: 3170039 - RNA, 16 nt, Mycobacterium bovis subsp bovis AF2122/97
ucgccgaaaucggcca

SEQ ID NO: 3170040 - RNA, 16 nt, Mycobacterium bovis subsp bovis AF2122/97
ucgccgaagcgccgcu

SEQ ID NO: 3170041 - RNA, 19 nt, Mycobacterium bovis subsp bovis AF2122/97
ucgccgaagcgggcccgca

SEQ ID NO: 3170042 - RNA, 21 nt, Mycobacterium bovis subsp bovis AF2122/97
ucgccgaaguuccagccgacg

SEQ ID NO: 3170043 - RNA, 16 nt, Mycobacterium bovis subsp bovis AF2122/97
ucgccgaaucgcugac

SEQ ID NO: 3170044 - RNA, 20 nt, Mycobacterium bovis subsp bovis AF2122/97
ucgccgaaucgcugaccgcg

SEQ ID NO: 3170045 - RNA, 17 nt, Mycobacterium bovis subsp bovis AF2122/97
ucgccgaaucucaccgu

SEQ ID NO: 3170046 - RNA, 18 nt, Mycobacterium bovis subsp bovis AF2122/97
ucgccgaaucucaccguc

SEQ ID NO: 3170047 - RNA, 17 nt, Mycobacterium bovis subsp bovis AF2122/97
ucgccgacacccucggg

SEQ ID NO: 3170048 - RNA, 15 nt, Mycobacterium bovis subsp bovis AF2122/97
ucgccgacagcgccu

SEQ ID NO: 3170049 - RNA, 21 nt, Mycobacterium bovis subsp bovis AF2122/97
ucgccgcuaacgcaccugcgc

SEQ ID NO: 3170050 - RNA, 21 nt, Mycobacterium bovis subsp bovis AF2122/97
ucgccgcucauuagcccccgc

SEQ ID NO: 3170051 - RNA, 19 nt, Mycobacterium bovis subsp bovis AF2122/97
ucgccgcuugacgcagcuc

SEQ ID NO: 3170052 - RNA, 17 nt, Mycobacterium bovis subsp bovis AF2122/97
ucgccgcuuggcccggc

SEQ ID NO: 3170053 - RNA, 18 nt, Mycobacterium bovis subsp bovis AF2122/97
ucgccgcuuggcccggca

SEQ ID NO: 3170054 - RNA, 17 nt, Mycobacterium bovis subsp bovis AF2122/97
ucgccgcuuucuuggcg

SEQ ID NO: 3170055 - RNA, 18 nt, Mycobacterium bovis subsp bovis AF2122/97
ucgccgcuuucuuggcgg

SEQ ID NO: 3170056 - RNA, 16 nt, Mycobacterium bovis subsp bovis AF2122/97
ucgccggaaagcccgu

SEQ ID NO: 3170057 - RNA, 20 nt, Mycobacterium bovis subsp bovis AF2122/97
ucgccggaaagcccgucguc

SEQ ID NO: 3170058 - RNA, 19 nt, Mycobacterium bovis subsp bovis AF2122/97
ucgccggaauacaccagcg

SEQ ID NO: 3170059 - RNA, 23 nt, Mycobacterium bovis subsp bovis AF2122/97
ucgccggaauacaccagcgacgc

SEQ ID NO: 3170060 - RNA, 16 nt, Mycobacterium bovis subsp bovis AF2122/97
ucgccggaccagagcc

SEQ ID NO: 3170061 - RNA, 21 nt, Mycobacterium bovis subsp bovis AF2122/97
ucgccggacgacaacaggccg

SEQ ID NO: 3170062 - RNA, 16 nt, Mycobacterium bovis subsp bovis AF2122/97
ucgccggacugcggcc

SEQ ID NO: 3170063 - RNA, 16 nt, Mycobacterium bovis subsp bovis AF2122/97
ucgccggagacccggg

SEQ ID NO: 3170064 - RNA, 21 nt, Mycobacterium bovis subsp bovis AF2122/97
ucgccggagucgacccugccc

SEQ ID NO: 3170065 - RNA, 14 nt, Mycobacterium bovis subsp bovis AF2122/97
ucgccggagucgau

SEQ ID NO: 3170066 - RNA, 15 nt, Mycobacterium bovis subsp bovis AF2122/97
ucgccggagucgauc

SEQ ID NO: 3170067 - RNA, 22 nt, Mycobacterium bovis subsp bovis AF2122/97
ucgccggagucgaucagcuugg

SEQ ID NO: 3170068 - RNA, 16 nt, Mycobacterium bovis subsp bovis AF2122/97
ucgccggauagcgcag

SEQ ID NO: 3170069 - RNA, 18 nt, Mycobacterium bovis subsp bovis AF2122/97
ucgccggaucuugccgcu

SEQ ID NO: 3170070 - RNA, 20 nt, Mycobacterium bovis subsp bovis AF2122/97
ucgccggaucuugccgcugg

SEQ ID NO: 3170071 - RNA, 17 nt, Mycobacterium bovis subsp bovis AF2122/97
ucgccggauucgaugac

SEQ ID NO: 3170072 - RNA, 14 nt, Mycobacterium bovis subsp bovis AF2122/97
ucgccggcaccggc

SEQ ID NO: 3170073 - RNA, 23 nt, Mycobacterium bovis subsp bovis AF2122/97
ucgccggcacgcagccaaugccg

SEQ ID NO: 3170074 - RNA, 15 nt, Mycobacterium bovis subsp bovis AF2122/97
ucgccggcacgguga

SEQ ID NO: 3170075 - RNA, 18 nt, Mycobacterium bovis subsp bovis AF2122/97
ucgccggcauacaccgug

SEQ ID NO: 3170076 - RNA, 17 nt, Mycobacterium bovis subsp bovis AF2122/97
ucgccggccaacugggc

SEQ ID NO: 3170077 - RNA, 14 nt, Mycobacterium bovis subsp bovis AF2122/97
ucgccggccaccag

SEQ ID NO: 3170078 - RNA, 17 nt, Mycobacterium bovis subsp bovis AF2122/97
ucgccggccaccagccg

SEQ ID NO: 3170079 - RNA, 19 nt, Mycobacterium bovis subsp bovis AF2122/97
ucgccggccaccagccggu

SEQ ID NO: 3170080 - RNA, 15 nt, Mycobacterium bovis subsp bovis AF2122/97
ucgccggccacccgc

SEQ ID NO: 3170081 - RNA, 16 nt, Mycobacterium bovis subsp bovis AF2122/97
ucgccggccacgaccu

SEQ ID NO: 3170082 - RNA, 15 nt, Mycobacterium bovis subsp bovis AF2122/97
ucgccggccccgccg

SEQ ID NO: 3170083 - RNA, 17 nt, Mycobacterium bovis subsp bovis AF2122/97
ucgccggccccgccggc

SEQ ID NO: 3170084 - RNA, 14 nt, Mycobacterium bovis subsp bovis AF2122/97
ucgccggccggccc

SEQ ID NO: 3170085 - RNA, 13 nt, Mycobacterium bovis subsp bovis AF2122/97
ucgccggccguca

SEQ ID NO: 3170086 - RNA, 15 nt, Mycobacterium bovis subsp bovis AF2122/97
ucgccggccugcucg

SEQ ID NO: 3170087 - RNA, 17 nt, Mycobacterium bovis subsp bovis AF2122/97
ucgccggcgaacugauc

SEQ ID NO: 3170088 - RNA, 23 nt, Mycobacterium bovis subsp bovis AF2122/97
ucgccggcgaacugaucguuggc

SEQ ID NO: 3170089 - RNA, 18 nt, Mycobacterium bovis subsp bovis AF2122/97
ucgccggcgaagaccgcc

SEQ ID NO: 3170090 - RNA, 19 nt, Mycobacterium bovis subsp bovis AF2122/97
ucgccggcgaagaccgccg

SEQ ID NO: 3170091 - RNA, 12 nt, Mycobacterium bovis subsp bovis AF2122/97
ucgccggcgacc

SEQ ID NO: 3170092 - RNA, 14 nt, Mycobacterium bovis subsp bovis AF2122/97
ucgccggcgccaag

SEQ ID NO: 3170093 - RNA, 17 nt, Mycobacterium bovis subsp bovis AF2122/97
ucgccggcgcgcagccg

SEQ ID NO: 3170094 - RNA, 16 nt, Mycobacterium bovis subsp bovis AF2122/97
ucgccggcgcgccgau

SEQ ID NO: 3170095 - RNA, 15 nt, Mycobacterium bovis subsp bovis AF2122/97
ucgccggcggcccgc

SEQ ID NO: 3170096 - RNA, 18 nt, Mycobacterium bovis subsp bovis AF2122/97
ucgccggcggcccgcucg

SEQ ID NO: 3170097 - RNA, 15 nt, Mycobacterium bovis subsp bovis AF2122/97
ucgccggcuaccgcc

SEQ ID NO: 3170098 - RNA, 16 nt, Mycobacterium bovis subsp bovis AF2122/97
ucgccggcuccgcagc

SEQ ID NO: 3170099 - RNA, 18 nt, Mycobacterium bovis subsp bovis AF2122/97
ucgccgggcaacgcgaac

SEQ ID NO: 3170100 - RNA, 19 nt, Mycobacterium bovis subsp bovis AF2122/97
ucgccgggcuuaggccgcg

SEQ ID NO: 3170101 - RNA, 16 nt, Mycobacterium bovis subsp bovis AF2122/97
ucgccgggcuuggccg

SEQ ID NO: 3170102 - RNA, 18 nt, Mycobacterium bovis subsp bovis AF2122/97
ucgccgggcuuggccgcg

SEQ ID NO: 3170103 - RNA, 21 nt, Mycobacterium bovis subsp bovis AF2122/97
ucgccgggcuuggccgcgccg

SEQ ID NO: 3170104 - RNA, 23 nt, Mycobacterium bovis subsp bovis AF2122/97
ucgccgggcuuggccgcgccggu

SEQ ID NO: 3170105 - RNA, 17 nt, Mycobacterium bovis subsp bovis AF2122/97
ucgccggggacgccgcg

SEQ ID NO: 3170106 - RNA, 20 nt, Mycobacterium bovis subsp bovis AF2122/97
ucgccggggccgcuggcggu

SEQ ID NO: 3170107 - RNA, 15 nt, Mycobacterium bovis subsp bovis AF2122/97
ucgccgggucagccc

SEQ ID NO: 3170108 - RNA, 18 nt, Mycobacterium bovis subsp bovis AF2122/97
ucgccgggucagcccggc

SEQ ID NO: 3170109 - RNA, 21 nt, Mycobacterium bovis subsp bovis AF2122/97
ucgccgggucagcccggcgcg

SEQ ID NO: 3170110 - RNA, 20 nt, Mycobacterium bovis subsp bovis AF2122/97
ucgccgguaggcggccagcg

SEQ ID NO: 3170111 - RNA, 21 nt, Mycobacterium bovis subsp bovis AF2122/97
ucgccgguaggcggccagcgc

SEQ ID NO: 3170112 - RNA, 23 nt, Mycobacterium bovis subsp bovis AF2122/97
ucgccgguaggcggccagcgcgc

SEQ ID NO: 3170113 - RNA, 20 nt, Mycobacterium bovis subsp bovis AF2122/97
ucgccggucagcgugcaggu

SEQ ID NO: 3170114 - RNA, 19 nt, Mycobacterium bovis subsp bovis AF2122/97
ucgccggucaggccgccgc

SEQ ID NO: 3170115 - RNA, 20 nt, Mycobacterium bovis subsp bovis AF2122/97
ucgccggucaggccgccgcg

SEQ ID NO: 3170116 - RNA, 15 nt, Mycobacterium bovis subsp bovis AF2122/97
ucgccggucaggcuc

SEQ ID NO: 3170117 - RNA, 11 nt, Mycobacterium bovis subsp bovis AF2122/97
ucgccggugac

SEQ ID NO: 3170118 - RNA, 17 nt, Mycobacterium bovis subsp bovis AF2122/97
ucgccggugacgacguc

SEQ ID NO: 3170119 - RNA, 19 nt, Mycobacterium bovis subsp bovis AF2122/97
ucgccggugacgaugaccg

SEQ ID NO: 3170120 - RNA, 15 nt, Mycobacterium bovis subsp bovis AF2122/97
ucgccggugagccgg

SEQ ID NO: 3170121 - RNA, 17 nt, Mycobacterium bovis subsp bovis AF2122/97
ucgccgguguccuuggc

SEQ ID NO: 3170122 - RNA, 16 nt, Mycobacterium bovis subsp bovis AF2122/97
ucgccguaagcaccag

SEQ ID NO: 3170123 - RNA, 23 nt, Mycobacterium bovis subsp bovis AF2122/97
ucgccguaagcaccagccagccu

SEQ ID NO: 3170124 - RNA, 20 nt, Mycobacterium bovis subsp bovis AF2122/97
ucgccguagagcuggugcgg

SEQ ID NO: 3170125 - RNA, 16 nt, Mycobacterium bovis subsp bovis AF2122/97
ucgccgucacgcacgc

SEQ ID NO: 3170126 - RNA, 15 nt, Mycobacterium bovis subsp bovis AF2122/97
ucgccguccagcaau

SEQ ID NO: 3170127 - RNA, 22 nt, Mycobacterium bovis subsp bovis AF2122/97
ucgccgucccgauacggccggc

SEQ ID NO: 3170128 - RNA, 13 nt, Mycobacterium bovis subsp bovis AF2122/97
ucgccgucgaagc

SEQ ID NO: 3170129 - RNA, 15 nt, Mycobacterium bovis subsp bovis AF2122/97
ucgccgucgcgaccg

SEQ ID NO: 3170130 - RNA, 14 nt, Mycobacterium bovis subsp bovis AF2122/97
ucgccgucggcgac

SEQ ID NO: 3170131 - RNA, 15 nt, Mycobacterium bovis subsp bovis AF2122/97
ucgccgucggcgacu

SEQ ID NO: 3170132 - RNA, 17 nt, Mycobacterium bovis subsp bovis AF2122/97
ucgccgucggcggugag

SEQ ID NO: 3170133 - RNA, 15 nt, Mycobacterium bovis subsp bovis AF2122/97
ucgccgucggugccg

SEQ ID NO: 3170134 - RNA, 18 nt, Mycobacterium bovis subsp bovis AF2122/97
ucgccgucggugccgccg

SEQ ID NO: 3170135 - RNA, 16 nt, Mycobacterium bovis subsp bovis AF2122/97
ucgcgccauacuggcg

SEQ ID NO: 3170136 - RNA, 17 nt, Mycobacterium bovis subsp bovis AF2122/97
ucgcgccauacuggcgg

SEQ ID NO: 3170137 - RNA, 15 nt, Mycobacterium bovis subsp bovis AF2122/97
ucgcgccaucgucgc

SEQ ID NO: 3170138 - RNA, 23 nt, Mycobacterium bovis subsp bovis AF2122/97
ucgcgcccgccaucagcccggcg

SEQ ID NO: 3170139 - RNA, 21 nt, Mycobacterium bovis subsp bovis AF2122/97
ucgcgcccgcuaacuggcccg

SEQ ID NO: 3170140 - RNA, 19 nt, Mycobacterium bovis subsp bovis AF2122/97
ucgcgcccgcugagccagc

SEQ ID NO: 3170141 - RNA, 15 nt, Mycobacterium bovis subsp bovis AF2122/97
ucgcgcccucagccg

SEQ ID NO: 3170142 - RNA, 20 nt, Mycobacterium bovis subsp bovis AF2122/97
ucgcgccgcgugguuccggc

SEQ ID NO: 3170143 - RNA, 12 nt, Mycobacterium bovis subsp bovis AF2122/97
ucgcgccgguga

SEQ ID NO: 3170144 - RNA, 16 nt, Mycobacterium bovis subsp bovis AF2122/97
ucgcgccgucgucgac

SEQ ID NO: 3170145 - RNA, 18 nt, Mycobacterium bovis subsp bovis AF2122/97
ucgcgccguggcgucggu

SEQ ID NO: 3170146 - RNA, 18 nt, Mycobacterium bovis subsp bovis AF2122/97
ucgcgccugcccggguga

SEQ ID NO: 3170147 - RNA, 21 nt, Mycobacterium bovis subsp bovis AF2122/97
ucgcgccugugcgcaaggccg

SEQ ID NO: 3170148 - RNA, 20 nt, Mycobacterium bovis subsp bovis AF2122/97
ucgcgccuuugagcccgcga

SEQ ID NO: 3170149 - RNA, 13 nt, Mycobacterium bovis subsp bovis AF2122/97
ucgcgcgccgcga

SEQ ID NO: 3170150 - RNA, 13 nt, Mycobacterium bovis subsp bovis AF2122/97
ucgcgcgcgaaac

SEQ ID NO: 3170151 - RNA, 20 nt, Mycobacterium bovis subsp bovis AF2122/97
ucgcgcgcgaacacccgaag

SEQ ID NO: 3170152 - RNA, 13 nt, Mycobacterium bovis subsp bovis AF2122/97
ucgcgcgcggcga

SEQ ID NO: 3170153 - RNA, 13 nt, Mycobacterium bovis subsp bovis AF2122/97
ucgcgcgcucaac

SEQ ID NO: 3170154 - RNA, 13 nt, Mycobacterium bovis subsp bovis AF2122/97
ucgcgcgcugggc

SEQ ID NO: 3170155 - RNA, 16 nt, Mycobacterium bovis subsp bovis AF2122/97
ucgcgcggcugugccc

SEQ ID NO: 3170156 - RNA, 18 nt, Mycobacterium bovis subsp bovis AF2122/97
ucgcgcgguagucgucgc

SEQ ID NO: 3170157 - RNA, 21 nt, Mycobacterium bovis subsp bovis AF2122/97
ucgcgcgucgucgcgcugaac

SEQ ID NO: 3170158 - RNA, 22 nt, Mycobacterium bovis subsp bovis AF2122/97
ucgcgcgucgucgcgcugaacg

SEQ ID NO: 3170159 - RNA, 22 nt, Mycobacterium bovis subsp bovis AF2122/97
ucgcgcucauguucucgaccgc

SEQ ID NO: 3170160 - RNA, 16 nt, Mycobacterium bovis subsp bovis AF2122/97
ucgcgcucgcaccacc

SEQ ID NO: 3170161 - RNA, 23 nt, Mycobacterium bovis subsp bovis AF2122/97
ucgcgcucgccgguguccuuggc

SEQ ID NO: 3170162 - RNA, 12 nt, Mycobacterium bovis subsp bovis AF2122/97
ucgcgcugauca

SEQ ID NO: 3170163 - RNA, 15 nt, Mycobacterium bovis subsp bovis AF2122/97
ucgcgcugccggccg

SEQ ID NO: 3170164 - RNA, 16 nt, Mycobacterium bovis subsp bovis AF2122/97
ucgcgcugccggccgc

SEQ ID NO: 3170165 - RNA, 17 nt, Mycobacterium bovis subsp bovis AF2122/97
ucgcgcugccggccgcg

SEQ ID NO: 3170166 - RNA, 12 nt, Mycobacterium bovis subsp bovis AF2122/97
ucgcgcugcggc

SEQ ID NO: 3170167 - RNA, 19 nt, Mycobacterium bovis subsp bovis AF2122/97
ucgcgcugcggcccacacc

SEQ ID NO: 3170168 - RNA, 24 nt, Mycobacterium bovis subsp bovis AF2122/97
ucgcgcugcggcccacaccagcgc

SEQ ID NO: 3170169 - RNA, 15 nt, Mycobacterium bovis subsp bovis AF2122/97
ucgcgcugcgggaac

SEQ ID NO: 3170170 - RNA, 20 nt, Mycobacterium bovis subsp bovis AF2122/97
ucgcgcugcugucgauuucg

SEQ ID NO: 3170171 - RNA, 21 nt, Mycobacterium bovis subsp bovis AF2122/97
ucgcgcuggcgccggccagcc

SEQ ID NO: 3170172 - RNA, 22 nt, Mycobacterium bovis subsp bovis AF2122/97
ucgcgcuggcgccggccagcca

SEQ ID NO: 3170173 - RNA, 14 nt, Mycobacterium bovis subsp bovis AF2122/97
ucgcgcuugaaacu

SEQ ID NO: 3170174 - RNA, 14 nt, Mycobacterium bovis subsp bovis AF2122/97
ucgcgcuugcgccg

SEQ ID NO: 3170175 - RNA, 15 nt, Mycobacterium bovis subsp bovis AF2122/97
ucgcgcuugcgccgc

SEQ ID NO: 3170176 - RNA, 22 nt, Mycobacterium bovis subsp bovis AF2122/97
ucgcgcuugcgccgcccaugcc

SEQ ID NO: 3170177 - RNA, 20 nt, Mycobacterium bovis subsp bovis AF2122/97
ucgcggaaccguacgccaga

SEQ ID NO: 3170178 - RNA, 14 nt, Mycobacterium bovis subsp bovis AF2122/97
ucgcggaacucguc

SEQ ID NO: 3170179 - RNA, 19 nt, Mycobacterium bovis subsp bovis AF2122/97
ucgcggaacucgucgcugc

SEQ ID NO: 3170180 - RNA, 20 nt, Mycobacterium bovis subsp bovis AF2122/97
ucgcggaacucgucgcugcc

SEQ ID NO: 3170181 - RNA, 20 nt, Mycobacterium bovis subsp bovis AF2122/97
ucgcggaagcgggcgaugcc

SEQ ID NO: 3170182 - RNA, 12 nt, Mycobacterium bovis subsp bovis AF2122/97
ucgcggacccgc

SEQ ID NO: 3170183 - RNA, 13 nt, Mycobacterium bovis subsp bovis AF2122/97
ucgcggacccgcg

SEQ ID NO: 3170184 - RNA, 19 nt, Mycobacterium bovis subsp bovis AF2122/97
ucgcggacccgcgcgucgc

SEQ ID NO: 3170185 - RNA, 19 nt, Mycobacterium bovis subsp bovis AF2122/97
ucgcggacccgucggcgug

SEQ ID NO: 3170186 - RNA, 13 nt, Mycobacterium bovis subsp bovis AF2122/97
ucgcggacgucgc

SEQ ID NO: 3170187 - RNA, 22 nt, Mycobacterium bovis subsp bovis AF2122/97
ucgcggacucguagcaccgguc

SEQ ID NO: 3170188 - RNA, 21 nt, Mycobacterium bovis subsp bovis AF2122/97
ucgcggagccaggacgacgcc

SEQ ID NO: 3170189 - RNA, 19 nt, Mycobacterium bovis subsp bovis AF2122/97
ucgcggagccgucgcauca

SEQ ID NO: 3170190 - RNA, 22 nt, Mycobacterium bovis subsp bovis AF2122/97
ucgcggagcgugagccaugccg

SEQ ID NO: 3170191 - RNA, 20 nt, Mycobacterium bovis subsp bovis AF2122/97
ucgcggagucugcugaucga

SEQ ID NO: 3170192 - RNA, 15 nt, Mycobacterium bovis subsp bovis AF2122/97
ucgcggaucagcccg

SEQ ID NO: 3170193 - RNA, 22 nt, Mycobacterium bovis subsp bovis AF2122/97
ucgcggauccgggcguggugga

SEQ ID NO: 3170194 - RNA, 17 nt, Mycobacterium bovis subsp bovis AF2122/97
ucgcggaucucaucggg

SEQ ID NO: 3170195 - RNA, 20 nt, Mycobacterium bovis subsp bovis AF2122/97
ucgcggaucucaucgggcca

SEQ ID NO: 3170196 - RNA, 17 nt, Mycobacterium bovis subsp bovis AF2122/97
ucgcggaucugggcggc

SEQ ID NO: 3170197 - RNA, 15 nt, Mycobacterium bovis subsp bovis AF2122/97
ucgcggauugccgcg

SEQ ID NO: 3170198 - RNA, 16 nt, Mycobacterium bovis subsp bovis AF2122/97
ucgcggauugccgcgc

SEQ ID NO: 3170199 - RNA, 19 nt, Mycobacterium bovis subsp bovis AF2122/97
ucgcggauugccgcgcgca

SEQ ID NO: 3170200 - RNA, 21 nt, Mycobacterium bovis subsp bovis AF2122/97
ucgcggauuucucgcccugag

SEQ ID NO: 3170201 - RNA, 22 nt, Mycobacterium bovis subsp bovis AF2122/97
ucgcggcaaugaggccgucugc

SEQ ID NO: 3170202 - RNA, 21 nt, Mycobacterium bovis subsp bovis AF2122/97
ucgcggcacgaucaaccgggu

SEQ ID NO: 3170203 - RNA, 23 nt, Mycobacterium bovis subsp bovis AF2122/97
ucgcggcacgaucaaccggguca

SEQ ID NO: 3170204 - RNA, 16 nt, Mycobacterium bovis subsp bovis AF2122/97
ucgcggcacgcccaca

SEQ ID NO: 3170205 - RNA, 17 nt, Mycobacterium bovis subsp bovis AF2122/97
ucgcggcaucgacgcgg

SEQ ID NO: 3170206 - RNA, 16 nt, Mycobacterium bovis subsp bovis AF2122/97
ucgcggcccgcagcgu

SEQ ID NO: 3170207 - RNA, 20 nt, Mycobacterium bovis subsp bovis AF2122/97
ucgcggcccggcccuccggg

SEQ ID NO: 3170208 - RNA, 23 nt, Mycobacterium bovis subsp bovis AF2122/97
ucgcggccgaaacuucgcccggg

SEQ ID NO: 3170209 - RNA, 21 nt, Mycobacterium bovis subsp bovis AF2122/97
ucgcggccgcggccucccgca

SEQ ID NO: 3170210 - RNA, 14 nt, Mycobacterium bovis subsp bovis AF2122/97
ucgcggccgcucac

SEQ ID NO: 3170211 - RNA, 14 nt, Mycobacterium bovis subsp bovis AF2122/97
ucgcggccggcggc

SEQ ID NO: 3170212 - RNA, 15 nt, Mycobacterium bovis subsp bovis AF2122/97
ucgcggccggcgucg

SEQ ID NO: 3170213 - RNA, 20 nt, Mycobacterium bovis subsp bovis AF2122/97
ucgcggccguggaugucgcg

SEQ ID NO: 3170214 - RNA, 19 nt, Mycobacterium bovis subsp bovis AF2122/97
ucgcggcgcaggucgcgca

SEQ ID NO: 3170215 - RNA, 14 nt, Mycobacterium bovis subsp bovis AF2122/97
ucgcggcgccgucg

SEQ ID NO: 3170216 - RNA, 16 nt, Mycobacterium bovis subsp bovis AF2122/97
ucgcggcgccgucguc

SEQ ID NO: 3170217 - RNA, 20 nt, Mycobacterium bovis subsp bovis AF2122/97
ucgcggcgcuggcugcggua

SEQ ID NO: 3170218 - RNA, 21 nt, Mycobacterium bovis subsp bovis AF2122/97
ucgcggcggcacuacgcagcc

SEQ ID NO: 3170219 - RNA, 16 nt, Mycobacterium bovis subsp bovis AF2122/97
ucgcggcggcgcuggc

SEQ ID NO: 3170220 - RNA, 21 nt, Mycobacterium bovis subsp bovis AF2122/97
ucgcggcggcgcuggcgggca

SEQ ID NO: 3170221 - RNA, 20 nt, Mycobacterium bovis subsp bovis AF2122/97
ucgcuccggcccugccgccg

SEQ ID NO: 3170222 - RNA, 16 nt, Mycobacterium bovis subsp bovis AF2122/97
ucgcucgcgccagguc

SEQ ID NO: 3170223 - RNA, 14 nt, Mycobacterium bovis subsp bovis AF2122/97
ucgcucgcugaugc

SEQ ID NO: 3170224 - RNA, 16 nt, Mycobacterium bovis subsp bovis AF2122/97
ucgcucugugucgccg

SEQ ID NO: 3170225 - RNA, 18 nt, Mycobacterium bovis subsp bovis AF2122/97
ucgcucugugucgccgau

SEQ ID NO: 3170226 - RNA, 12 nt, Mycobacterium bovis subsp bovis AF2122/97
ucgcugaccgcg

SEQ ID NO: 3170227 - RNA, 19 nt, Mycobacterium bovis subsp bovis AF2122/97
ucgcugaccgcguagacca

SEQ ID NO: 3170228 - RNA, 20 nt, Mycobacterium bovis subsp bovis AF2122/97
ucgcugaccuuguugaccac

SEQ ID NO: 3170229 - RNA, 18 nt, Mycobacterium bovis subsp bovis AF2122/97
ucgcugacggcaaacgac

SEQ ID NO: 3170230 - RNA, 15 nt, Mycobacterium bovis subsp bovis AF2122/97
ucgcugagcacggcg

SEQ ID NO: 3170231 - RNA, 19 nt, Mycobacterium bovis subsp bovis AF2122/97
ucgcugagcacggcgcggc

SEQ ID NO: 3170232 - RNA, 22 nt, Mycobacterium bovis subsp bovis AF2122/97
ucgcugagcacggcgcggcgga

SEQ ID NO: 3170233 - RNA, 19 nt, Mycobacterium bovis subsp bovis AF2122/97
ucgcugaucuggggcacca

SEQ ID NO: 3170234 - RNA, 14 nt, Mycobacterium bovis subsp bovis AF2122/97
ucgcugauugcggu

SEQ ID NO: 3170235 - RNA, 23 nt, Mycobacterium bovis subsp bovis AF2122/97
ucgcugcccaugcggcaggugcc

SEQ ID NO: 3170236 - RNA, 23 nt, Mycobacterium bovis subsp bovis AF2122/97
ucgcugccgccaccgcugucgau

SEQ ID NO: 3170237 - RNA, 14 nt, Mycobacterium bovis subsp bovis AF2122/97
ucgcugccgccgcc

SEQ ID NO: 3170238 - RNA, 15 nt, Mycobacterium bovis subsp bovis AF2122/97
ucgcugccgccgccg

SEQ ID NO: 3170239 - RNA, 14 nt, Mycobacterium bovis subsp bovis AF2122/97
ucgcugccgccguc

SEQ ID NO: 3170240 - RNA, 20 nt, Mycobacterium bovis subsp bovis AF2122/97
ucgcugccuucaucggggcu

SEQ ID NO: 3170241 - RNA, 22 nt, Mycobacterium bovis subsp bovis AF2122/97
ucgcugccuucaucggggcuuc

SEQ ID NO: 3170242 - RNA, 21 nt, Mycobacterium bovis subsp bovis AF2122/97
ucgcugcgaagccgagcauca

SEQ ID NO: 3170243 - RNA, 17 nt, Mycobacterium bovis subsp bovis AF2122/97
ucgcugcgaugcugauc

SEQ ID NO: 3170244 - RNA, 21 nt, Mycobacterium bovis subsp bovis AF2122/97
ucgcugcggcgcuggccagca

SEQ ID NO: 3170245 - RNA, 18 nt, Mycobacterium bovis subsp bovis AF2122/97
ucgcugcucagcaacggc

SEQ ID NO: 3170246 - RNA, 18 nt, Mycobacterium bovis subsp bovis AF2122/97
ucgcugcugccgcaccgg

SEQ ID NO: 3170247 - RNA, 17 nt, Mycobacterium bovis subsp bovis AF2122/97
ucgcugcugcgaucgcc

SEQ ID NO: 3170248 - RNA, 21 nt, Mycobacterium bovis subsp bovis AF2122/97
ucgcugcugcgaucgccgcgc

SEQ ID NO: 3170249 - RNA, 15 nt, Mycobacterium bovis subsp bovis AF2122/97
ucgcuggccaggccg

SEQ ID NO: 3170250 - RNA, 14 nt, Mycobacterium bovis subsp bovis AF2122/97
ucgcuggccgcgag

SEQ ID NO: 3170251 - RNA, 19 nt, Mycobacterium bovis subsp bovis AF2122/97
ucgcuggcuugggccagcg

SEQ ID NO: 3170252 - RNA, 20 nt, Mycobacterium bovis subsp bovis AF2122/97
ucgcugggacgggcgcgucg

SEQ ID NO: 3170253 - RNA, 16 nt, Mycobacterium bovis subsp bovis AF2122/97
ucgcugggugcgcgaa

SEQ ID NO: 3170254 - RNA, 19 nt, Mycobacterium bovis subsp bovis AF2122/97
ucgcuggugaaccacucgg

SEQ ID NO: 3170255 - RNA, 15 nt, Mycobacterium bovis subsp bovis AF2122/97
ucgcuguaggccagc

SEQ ID NO: 3170256 - RNA, 17 nt, Mycobacterium bovis subsp bovis AF2122/97
ucgcuguaggccagccc

SEQ ID NO: 3170257 - RNA, 18 nt, Mycobacterium bovis subsp bovis AF2122/97
ucgcuguccacugccacc

SEQ ID NO: 3170258 - RNA, 16 nt, Mycobacterium bovis subsp bovis AF2122/97
ucgcugucgaucagcg

SEQ ID NO: 3170259 - RNA, 15 nt, Mycobacterium bovis subsp bovis AF2122/97
ucgcugucggcaugc

SEQ ID NO: 3170260 - RNA, 17 nt, Mycobacterium bovis subsp bovis AF2122/97
ucgcugugcgcuggucg

SEQ ID NO: 3170261 - RNA, 20 nt, Mycobacterium bovis subsp bovis AF2122/97
ucgcuguugaagccgcccga

SEQ ID NO: 3170262 - RNA, 18 nt, Mycobacterium bovis subsp bovis AF2122/97
ucgcuuuugaaccggguc

SEQ ID NO: 3170263 - RNA, 16 nt, Mycobacterium bovis subsp bovis AF2122/97
ucggaaaaccgcaccg

SEQ ID NO: 3170264 - RNA, 21 nt, Mycobacterium bovis subsp bovis AF2122/97
ucggaaacggagccgagccga

SEQ ID NO: 3170265 - RNA, 20 nt, Mycobacterium bovis subsp bovis AF2122/97
ucggaacgugaccgacgccg

SEQ ID NO: 3170266 - RNA, 23 nt, Mycobacterium bovis subsp bovis AF2122/97
ucggaacuagccaguuacguugu

SEQ ID NO: 3170267 - RNA, 16 nt, Mycobacterium bovis subsp bovis AF2122/97
ucggaagagucgacgc

SEQ ID NO: 3170268 - RNA, 18 nt, Mycobacterium bovis subsp bovis AF2122/97
ucggaauacaacagcugg

SEQ ID NO: 3170269 - RNA, 20 nt, Mycobacterium bovis subsp bovis AF2122/97
ucggaaucggcggaugaugc

SEQ ID NO: 3170270 - RNA, 16 nt, Mycobacterium bovis subsp bovis AF2122/97
ucggaaugcuggggcc

SEQ ID NO: 3170271 - RNA, 17 nt, Mycobacterium bovis subsp bovis AF2122/97
ucggaaugcuggggccu

SEQ ID NO: 3170272 - RNA, 20 nt, Mycobacterium bovis subsp bovis AF2122/97
ucggaauggucccgggucca

SEQ ID NO: 3170273 - RNA, 18 nt, Mycobacterium bovis subsp bovis AF2122/97
ucggacaaagccgucgcg

SEQ ID NO: 3170274 - RNA, 15 nt, Mycobacterium bovis subsp bovis AF2122/97
ucggacaacacggcg

SEQ ID NO: 3170275 - RNA, 23 nt, Mycobacterium bovis subsp bovis AF2122/97
ucggacaaggacugaccgucugc

SEQ ID NO: 3170276 - RNA, 17 nt, Mycobacterium bovis subsp bovis AF2122/97
ucggacacacaggcggc

SEQ ID NO: 3170277 - RNA, 20 nt, Mycobacterium bovis subsp bovis AF2122/97
ucggacacgcuguacaagca

SEQ ID NO: 3170278 - RNA, 14 nt, Mycobacterium bovis subsp bovis AF2122/97
ucggacacguggcg

SEQ ID NO: 3170279 - RNA, 14 nt, Mycobacterium bovis subsp bovis AF2122/97
ucggacagcagccg

SEQ ID NO: 3170280 - RNA, 16 nt, Mycobacterium bovis subsp bovis AF2122/97
ucggacagcagccggc

SEQ ID NO: 3170281 - RNA, 14 nt, Mycobacterium bovis subsp bovis AF2122/97
ucggacagcgccug

SEQ ID NO: 3170282 - RNA, 21 nt, Mycobacterium bovis subsp bovis AF2122/97
ucggacagcgccuggccggaa

SEQ ID NO: 3170283 - RNA, 14 nt, Mycobacterium bovis subsp bovis AF2122/97
ucggacagcgucuc

SEQ ID NO: 3170284 - RNA, 14 nt, Mycobacterium bovis subsp bovis AF2122/97
ucggacagggugcg

SEQ ID NO: 3170285 - RNA, 12 nt, Mycobacterium bovis subsp bovis AF2122/97
ucggaccacauc

SEQ ID NO: 3170286 - RNA, 21 nt, Mycobacterium bovis subsp bovis AF2122/97
ucggaccacaucuggucacgg

SEQ ID NO: 3170287 - RNA, 17 nt, Mycobacterium bovis subsp bovis AF2122/97
ucggaccagcugccggc

SEQ ID NO: 3170288 - RNA, 18 nt, Mycobacterium bovis subsp bovis AF2122/97
ucggaccagcugccggcg

SEQ ID NO: 3170289 - RNA, 21 nt, Mycobacterium bovis subsp bovis AF2122/97
ucggaccagcugccggcgacc

SEQ ID NO: 3170290 - RNA, 13 nt, Mycobacterium bovis subsp bovis AF2122/97
ucggacccacccu

SEQ ID NO: 3170291 - RNA, 23 nt, Mycobacterium bovis subsp bovis AF2122/97
ucggacccacccuggucgaaacg

SEQ ID NO: 3170292 - RNA, 20 nt, Mycobacterium bovis subsp bovis AF2122/97
ucggacccgcaauuccggug

SEQ ID NO: 3170293 - RNA, 16 nt, Mycobacterium bovis subsp bovis AF2122/97
ucggaccuuccgggug

SEQ ID NO: 3170294 - RNA, 21 nt, Mycobacterium bovis subsp bovis AF2122/97
ucggaccuuccgggugaaguu

SEQ ID NO: 3170295 - RNA, 18 nt, Mycobacterium bovis subsp bovis AF2122/97
ucggacggccaucgccag

SEQ ID NO: 3170296 - RNA, 21 nt, Mycobacterium bovis subsp bovis AF2122/97
ucggacggcugagacagaccg

SEQ ID NO: 3170297 - RNA, 21 nt, Mycobacterium bovis subsp bovis AF2122/97
ucggacgggaugcuuggucuc

SEQ ID NO: 3170298 - RNA, 15 nt, Mycobacterium bovis subsp bovis AF2122/97
ucggacucgccgacg

SEQ ID NO: 3170299 - RNA, 22 nt, Mycobacterium bovis subsp bovis AF2122/97
ucggacucgccgacgucgacgc

SEQ ID NO: 3170300 - RNA, 12 nt, Mycobacterium bovis subsp bovis AF2122/97
ucggacugaaga

SEQ ID NO: 3170301 - RNA, 13 nt, Mycobacterium bovis subsp bovis AF2122/97
ucggacugcagcg

SEQ ID NO: 3170302 - RNA, 15 nt, Mycobacterium bovis subsp bovis AF2122/97
ucggagaacacgucg

SEQ ID NO: 3170303 - RNA, 14 nt, Mycobacterium bovis subsp bovis AF2122/97
ucggagacgucuuc

SEQ ID NO: 3170304 - RNA, 17 nt, Mycobacterium bovis subsp bovis AF2122/97
ucggagacgucuucggg

SEQ ID NO: 3170305 - RNA, 20 nt, Mycobacterium bovis subsp bovis AF2122/97
ucggagauuucgucgcugag

SEQ ID NO: 3170306 - RNA, 22 nt, Mycobacterium bovis subsp bovis AF2122/97
ucggagccgacaacgacgucgc

SEQ ID NO: 3170307 - RNA, 13 nt, Mycobacterium bovis subsp bovis AF2122/97
ucggagccggcca

SEQ ID NO: 3170308 - RNA, 18 nt, Mycobacterium bovis subsp bovis AF2122/97
ucggagccggccaccucg

SEQ ID NO: 3170309 - RNA, 17 nt, Mycobacterium bovis subsp bovis AF2122/97
ucggagcgggcuccggc

SEQ ID NO: 3170310 - RNA, 16 nt, Mycobacterium bovis subsp bovis AF2122/97
ucggagcgggugcggg

SEQ ID NO: 3170311 - RNA, 15 nt, Mycobacterium bovis subsp bovis AF2122/97
ucggagcugggcuga

SEQ ID NO: 3170312 - RNA, 23 nt, Mycobacterium bovis subsp bovis AF2122/97
ucggagcugggcugauggacggu

SEQ ID NO: 3170313 - RNA, 23 nt, Mycobacterium bovis subsp bovis AF2122/97
ucggaggaaccccgcgcggugcc

SEQ ID NO: 3170314 - RNA, 17 nt, Mycobacterium bovis subsp bovis AF2122/97
ucggaggcgaccacguc

SEQ ID NO: 3170315 - RNA, 18 nt, Mycobacterium bovis subsp bovis AF2122/97
ucggaggcgaccacgucg

SEQ ID NO: 3170316 - RNA, 21 nt, Mycobacterium bovis subsp bovis AF2122/97
ucggaggcgaccacgucggcg

SEQ ID NO: 3170317 - RNA, 20 nt, Mycobacterium bovis subsp bovis AF2122/97
ucggaggugaccucgauggc

SEQ ID NO: 3170318 - RNA, 21 nt, Mycobacterium bovis subsp bovis AF2122/97
ucggaggugccggugcuccuc

SEQ ID NO: 3170319 - RNA, 15 nt, Mycobacterium bovis subsp bovis AF2122/97
ucggagucaccagca

SEQ ID NO: 3170320 - RNA, 18 nt, Mycobacterium bovis subsp bovis AF2122/97
ucggagucaccagcaaca

SEQ ID NO: 3170321 - RNA, 17 nt, Mycobacterium bovis subsp bovis AF2122/97
ucggagucacgcagccg

SEQ ID NO: 3170322 - RNA, 22 nt, Mycobacterium bovis subsp bovis AF2122/97
ucggagucgacggucacggugg

SEQ ID NO: 3170323 - RNA, 22 nt, Mycobacterium bovis subsp bovis AF2122/97
ucggauacccagccggccuguc

SEQ ID NO: 3170324 - RNA, 13 nt, Mycobacterium bovis subsp bovis AF2122/97
ucggauagccccg

SEQ ID NO: 3170325 - RNA, 12 nt, Mycobacterium bovis subsp bovis AF2122/97
ucggaucgaagu

SEQ ID NO: 3170326 - RNA, 15 nt, Mycobacterium bovis subsp bovis AF2122/97
ucggaucgccaggcc

SEQ ID NO: 3170327 - RNA, 15 nt, Mycobacterium bovis subsp bovis AF2122/97
ucggaucggcgccgc

SEQ ID NO: 3170328 - RNA, 17 nt, Mycobacterium bovis subsp bovis AF2122/97
ucggaucggcgccgcau

SEQ ID NO: 3170329 - RNA, 22 nt, Mycobacterium bovis subsp bovis AF2122/97
ucggaucggcgccgcauaccag

SEQ ID NO: 3170330 - RNA, 17 nt, Mycobacterium bovis subsp bovis AF2122/97
ucggaucuugacguucg

SEQ ID NO: 3170331 - RNA, 13 nt, Mycobacterium bovis subsp bovis AF2122/97
ucggauggcggcc

SEQ ID NO: 3170332 - RNA, 18 nt, Mycobacterium bovis subsp bovis AF2122/97
ucggaugucucggcacca

SEQ ID NO: 3170333 - RNA, 19 nt, Mycobacterium bovis subsp bovis AF2122/97
ucggaugucucggcaccac

SEQ ID NO: 3170334 - RNA, 20 nt, Mycobacterium bovis subsp bovis AF2122/97
ucggaugucucggcaccaca

SEQ ID NO: 3170335 - RNA, 17 nt, Mycobacterium bovis subsp bovis AF2122/97
ucggauugcagcgcgau

SEQ ID NO: 3170336 - RNA, 22 nt, Mycobacterium bovis subsp bovis AF2122/97
ucggcaaaccaagcgcgccagc

SEQ ID NO: 3170337 - RNA, 13 nt, Mycobacterium bovis subsp bovis AF2122/97
ucggcaaccaacc

SEQ ID NO: 3170338 - RNA, 15 nt, Mycobacterium bovis subsp bovis AF2122/97
ucggcaaccaaccgc

SEQ ID NO: 3170339 - RNA, 22 nt, Mycobacterium bovis subsp bovis AF2122/97
ucggcaaccaccucgugggcca

SEQ ID NO: 3170340 - RNA, 16 nt, Mycobacterium bovis subsp bovis AF2122/97
ucggcaacccgcacca

SEQ ID NO: 3170341 - RNA, 23 nt, Mycobacterium bovis subsp bovis AF2122/97
ucggcaaggacguggcgcuggac

SEQ ID NO: 3170342 - RNA, 19 nt, Mycobacterium bovis subsp bovis AF2122/97
ucggcaauacuccgcugac

SEQ ID NO: 3170343 - RNA, 23 nt, Mycobacterium bovis subsp bovis AF2122/97
ucggcaaugacguacggggucgc

SEQ ID NO: 3170344 - RNA, 22 nt, Mycobacterium bovis subsp bovis AF2122/97
ucggcacaugcgcguccagcug

SEQ ID NO: 3170345 - RNA, 15 nt, Mycobacterium bovis subsp bovis AF2122/97
ucggcaccagcagcc

SEQ ID NO: 3170346 - RNA, 15 nt, Mycobacterium bovis subsp bovis AF2122/97
ucggcaccagcgcgc

SEQ ID NO: 3170347 - RNA, 18 nt, Mycobacterium bovis subsp bovis AF2122/97
ucggcaccagcgcgcgcc

SEQ ID NO: 3170348 - RNA, 19 nt, Mycobacterium bovis subsp bovis AF2122/97
ucggcaccauagcuggagu

SEQ ID NO: 3170349 - RNA, 12 nt, Mycobacterium bovis subsp bovis AF2122/97
ucggcaccccac

SEQ ID NO: 3170350 - RNA, 12 nt, Mycobacterium bovis subsp bovis AF2122/97
ucggcacccgcc

SEQ ID NO: 3170351 - RNA, 18 nt, Mycobacterium bovis subsp bovis AF2122/97
ucggcacccggcagagca

SEQ ID NO: 3170352 - RNA, 22 nt, Mycobacterium bovis subsp bovis AF2122/97
ucggcacccggcagagcacgcg

SEQ ID NO: 3170353 - RNA, 16 nt, Mycobacterium bovis subsp bovis AF2122/97
ucggcaccgcggccgc

SEQ ID NO: 3170354 - RNA, 23 nt, Mycobacterium bovis subsp bovis AF2122/97
ucggcaccggugcccaccaccga

SEQ ID NO: 3170355 - RNA, 15 nt, Mycobacterium bovis subsp bovis AF2122/97
ucggcaccgucucgc

SEQ ID NO: 3170356 - RNA, 21 nt, Mycobacterium bovis subsp bovis AF2122/97
ucggcaccgucucgcaccgcg

SEQ ID NO: 3170357 - RNA, 15 nt, Mycobacterium bovis subsp bovis AF2122/97
ucggcacgacccggg

SEQ ID NO: 3170358 - RNA, 17 nt, Mycobacterium bovis subsp bovis AF2122/97
ucggcacgacccgggaa

SEQ ID NO: 3170359 - RNA, 18 nt, Mycobacterium bovis subsp bovis AF2122/97
ucggcacgacccgggaag

SEQ ID NO: 3170360 - RNA, 20 nt, Mycobacterium bovis subsp bovis AF2122/97
ucggcacgacccgggaagga

SEQ ID NO: 3170361 - RNA, 22 nt, Mycobacterium bovis subsp bovis AF2122/97
ucggcacgacccgggaaggaac

SEQ ID NO: 3170362 - RNA, 20 nt, Mycobacterium bovis subsp bovis AF2122/97
ucggcacgccauaccggcug

SEQ ID NO: 3170363 - RNA, 22 nt, Mycobacterium bovis subsp bovis AF2122/97
ucggcacgcgcaguuuggcggc

SEQ ID NO: 3170364 - RNA, 16 nt, Mycobacterium bovis subsp bovis AF2122/97
ucggcacuuagcccga

SEQ ID NO: 3170365 - RNA, 17 nt, Mycobacterium bovis subsp bovis AF2122/97
ucggcacuuagcccgau

SEQ ID NO: 3170366 - RNA, 22 nt, Mycobacterium bovis subsp bovis AF2122/97
ucggcagaauccggucgaugac

SEQ ID NO: 3170367 - RNA, 17 nt, Mycobacterium bovis subsp bovis AF2122/97
ucggcagacccgagcgc

SEQ ID NO: 3170368 - RNA, 22 nt, Mycobacterium bovis subsp bovis AF2122/97
ucggcagagacguacugggcga

SEQ ID NO: 3170369 - RNA, 17 nt, Mycobacterium bovis subsp bovis AF2122/97
ucggcagauggucucga

SEQ ID NO: 3170370 - RNA, 12 nt, Mycobacterium bovis subsp bovis AF2122/97
ucggcagcagcg

SEQ ID NO: 3170371 - RNA, 16 nt, Mycobacterium bovis subsp bovis AF2122/97
ucggcagcagcgcaac

SEQ ID NO: 3170372 - RNA, 22 nt, Mycobacterium bovis subsp bovis AF2122/97
ucggcagcagcgcaacggccag

SEQ ID NO: 3170373 - RNA, 24 nt, Mycobacterium bovis subsp bovis AF2122/97
ucggcagcagcgcaacggccagcg

SEQ ID NO: 3170374 - RNA, 21 nt, Mycobacterium bovis subsp bovis AF2122/97
ucggcagcagcggugcagccc

SEQ ID NO: 3170375 - RNA, 17 nt, Mycobacterium bovis subsp bovis AF2122/97
ucggcagcaggacaccu

SEQ ID NO: 3170376 - RNA, 18 nt, Mycobacterium bovis subsp bovis AF2122/97
ucggcagccaugcggcug

SEQ ID NO: 3170377 - RNA, 16 nt, Mycobacterium bovis subsp bovis AF2122/97
ucggcagcccggugug

SEQ ID NO: 3170378 - RNA, 18 nt, Mycobacterium bovis subsp bovis AF2122/97
ucggcagcccggugugcu

SEQ ID NO: 3170379 - RNA, 13 nt, Mycobacterium bovis subsp bovis AF2122/97
ucggcagccgcau

SEQ ID NO: 3170380 - RNA, 15 nt, Mycobacterium bovis subsp bovis AF2122/97
ucggcagcgacgccg

SEQ ID NO: 3170381 - RNA, 17 nt, Mycobacterium bovis subsp bovis AF2122/97
ucggcagcgacgccggc

SEQ ID NO: 3170382 - RNA, 13 nt, Mycobacterium bovis subsp bovis AF2122/97
ucggcagcgcggc

SEQ ID NO: 3170383 - RNA, 21 nt, Mycobacterium bovis subsp bovis AF2122/97
ucggcagcucccgccacgucg

SEQ ID NO: 3170384 - RNA, 22 nt, Mycobacterium bovis subsp bovis AF2122/97
ucggcagcucccgccacgucgc

SEQ ID NO: 3170385 - RNA, 17 nt, Mycobacterium bovis subsp bovis AF2122/97
ucggcagcuucucgccg

SEQ ID NO: 3170386 - RNA, 20 nt, Mycobacterium bovis subsp bovis AF2122/97
ucggcagcuucucgccgacg

SEQ ID NO: 3170387 - RNA, 14 nt, Mycobacterium bovis subsp bovis AF2122/97
ucggcaggccgcuu

SEQ ID NO: 3170388 - RNA, 17 nt, Mycobacterium bovis subsp bovis AF2122/97
ucggcaggguggccagc

SEQ ID NO: 3170389 - RNA, 20 nt, Mycobacterium bovis subsp bovis AF2122/97
ucggcaggguggccagcagg

SEQ ID NO: 3170390 - RNA, 22 nt, Mycobacterium bovis subsp bovis AF2122/97
ucggcaggguggccagcaggcg

SEQ ID NO: 3170391 - RNA, 15 nt, Mycobacterium bovis subsp bovis AF2122/97
ucggcauccaggcug

SEQ ID NO: 3170392 - RNA, 18 nt, Mycobacterium bovis subsp bovis AF2122/97
ucggcauccaggcugucg

SEQ ID NO: 3170393 - RNA, 20 nt, Mycobacterium bovis subsp bovis AF2122/97
ucggccgugaccgagccgcg

SEQ ID NO: 3170394 - RNA, 21 nt, Mycobacterium bovis subsp bovis AF2122/97
ucggccucgucgugcaccucg

SEQ ID NO: 3170395 - RNA, 22 nt, Mycobacterium bovis subsp bovis AF2122/97
ucggccugaagcuuguccagau

SEQ ID NO: 3170396 - RNA, 15 nt, Mycobacterium bovis subsp bovis AF2122/97
ucggccugcgccggc

SEQ ID NO: 3170397 - RNA, 18 nt, Mycobacterium bovis subsp bovis AF2122/97
ucggccugcugcugcagc

SEQ ID NO: 3170398 - RNA, 19 nt, Mycobacterium bovis subsp bovis AF2122/97
ucggccugcugcugcagcg

SEQ ID NO: 3170399 - RNA, 20 nt, Mycobacterium bovis subsp bovis AF2122/97
ucggccuggcaggguggggc

SEQ ID NO: 3170400 - RNA, 16 nt, Mycobacterium bovis subsp bovis AF2122/97
ucggccuguccaccga

SEQ ID NO: 3170401 - RNA, 19 nt, Mycobacterium bovis subsp bovis AF2122/97
ucggccuguucggcggcug

SEQ ID NO: 3170402 - RNA, 22 nt, Mycobacterium bovis subsp bovis AF2122/97
ucggccuugaucgugcuggcga

SEQ ID NO: 3170403 - RNA, 17 nt, Mycobacterium bovis subsp bovis AF2122/97
ucggcgaaacccgggau

SEQ ID NO: 3170404 - RNA, 21 nt, Mycobacterium bovis subsp bovis AF2122/97
ucggcgaaaggccagucgugc

SEQ ID NO: 3170405 - RNA, 17 nt, Mycobacterium bovis subsp bovis AF2122/97
ucggcgaacaaccgccg

SEQ ID NO: 3170406 - RNA, 20 nt, Mycobacterium bovis subsp bovis AF2122/97
ucggcgaacccuccgcagcu

SEQ ID NO: 3170407 - RNA, 22 nt, Mycobacterium bovis subsp bovis AF2122/97
ucggcgaacgccguggugcgca

SEQ ID NO: 3170408 - RNA, 19 nt, Mycobacterium bovis subsp bovis AF2122/97
ucggcgaacgcggcgucga

SEQ ID NO: 3170409 - RNA, 22 nt, Mycobacterium bovis subsp bovis AF2122/97
ucggcgaacggauucccgccca

SEQ ID NO: 3170410 - RNA, 16 nt, Mycobacterium bovis subsp bovis AF2122/97
ucggcgaacggcacca

SEQ ID NO: 3170411 - RNA, 15 nt, Mycobacterium bovis subsp bovis AF2122/97
ucggcgaagcgggcg

SEQ ID NO: 3170412 - RNA, 15 nt, Mycobacterium bovis subsp bovis AF2122/97
ucggcgaaggccgcg

SEQ ID NO: 3170413 - RNA, 19 nt, Mycobacterium bovis subsp bovis AF2122/97
ucggcgaaugcgauugccg

SEQ ID NO: 3170414 - RNA, 22 nt, Mycobacterium bovis subsp bovis AF2122/97
ucggcgaaugcgauugccgucg

SEQ ID NO: 3170415 - RNA, 22 nt, Mycobacterium bovis subsp bovis AF2122/97
ucggcgacaggccgagcagaua

SEQ ID NO: 3170416 - RNA, 16 nt, Mycobacterium bovis subsp bovis AF2122/97
ucggcgaccaccagcg

SEQ ID NO: 3170417 - RNA, 21 nt, Mycobacterium bovis subsp bovis AF2122/97
ucggcgaccagaaucucgccg

SEQ ID NO: 3170418 - RNA, 16 nt, Mycobacterium bovis subsp bovis AF2122/97
ucggcgaccagcugug

SEQ ID NO: 3170419 - RNA, 19 nt, Mycobacterium bovis subsp bovis AF2122/97
ucggcgaccgccugcgcgg

SEQ ID NO: 3170420 - RNA, 13 nt, Mycobacterium bovis subsp bovis AF2122/97
ucggcgaccgcgc

SEQ ID NO: 3170421 - RNA, 13 nt, Mycobacterium bovis subsp bovis AF2122/97
ucggcgaccggcc

SEQ ID NO: 3170422 - RNA, 14 nt, Mycobacterium bovis subsp bovis AF2122/97
ucggcgaccggccg

SEQ ID NO: 3170423 - RNA, 16 nt, Mycobacterium bovis subsp bovis AF2122/97
ucggcgaccggccggc

SEQ ID NO: 3170424 - RNA, 19 nt, Mycobacterium bovis subsp bovis AF2122/97
ucggcgaccggccggccgc

SEQ ID NO: 3170425 - RNA, 21 nt, Mycobacterium bovis subsp bovis AF2122/97
ucggcgaccugccggaccgcg

SEQ ID NO: 3170426 - RNA, 18 nt, Mycobacterium bovis subsp bovis AF2122/97
ucggcgacgaugucgagc

SEQ ID NO: 3170427 - RNA, 20 nt, Mycobacterium bovis subsp bovis AF2122/97
ucggcgacgaugucgagcgc

SEQ ID NO: 3170428 - RNA, 13 nt, Mycobacterium bovis subsp bovis AF2122/97
ucggcgacgccgu

SEQ ID NO: 3170429 - RNA, 14 nt, Mycobacterium bovis subsp bovis AF2122/97
ucggcgacgccguc

SEQ ID NO: 3170430 - RNA, 12 nt, Mycobacterium bovis subsp bovis AF2122/97
ucggcgacgcgc

SEQ ID NO: 3170431 - RNA, 16 nt, Mycobacterium bovis subsp bovis AF2122/97
ucggcgacgcgccggu

SEQ ID NO: 3170432 - RNA, 13 nt, Mycobacterium bovis subsp bovis AF2122/97
ucggcgacguaga

SEQ ID NO: 3170433 - RNA, 13 nt, Mycobacterium bovis subsp bovis AF2122/97
ucggcgacgucca

SEQ ID NO: 3170434 - RNA, 14 nt, Mycobacterium bovis subsp bovis AF2122/97
ucggcgacguccag

SEQ ID NO: 3170435 - RNA, 13 nt, Mycobacterium bovis subsp bovis AF2122/97
ucggcgacgucgc

SEQ ID NO: 3170436 - RNA, 16 nt, Mycobacterium bovis subsp bovis AF2122/97
ucggcgacgucggcgg

SEQ ID NO: 3170437 - RNA, 14 nt, Mycobacterium bovis subsp bovis AF2122/97
ucggcgagcagcgc

SEQ ID NO: 3170438 - RNA, 23 nt, Mycobacterium bovis subsp bovis AF2122/97
ucggcgagcagcgcacgauuucg

SEQ ID NO: 3170439 - RNA, 16 nt, Mycobacterium bovis subsp bovis AF2122/97
ucggcgagcgcaucgg

SEQ ID NO: 3170440 - RNA, 14 nt, Mycobacterium bovis subsp bovis AF2122/97
ucggcgagcgucgg

SEQ ID NO: 3170441 - RNA, 21 nt, Mycobacterium bovis subsp bovis AF2122/97
ucggcgaggaacuggaccggu

SEQ ID NO: 3170442 - RNA, 23 nt, Mycobacterium bovis subsp bovis AF2122/97
ucggcgaggaacuggaccggugc

SEQ ID NO: 3170443 - RNA, 23 nt, Mycobacterium bovis subsp bovis AF2122/97
ucggcgaggccucggcggccgug

SEQ ID NO: 3170444 - RNA, 16 nt, Mycobacterium bovis subsp bovis AF2122/97
ucggcgagggcgcgcc

SEQ ID NO: 3170445 - RNA, 19 nt, Mycobacterium bovis subsp bovis AF2122/97
ucggcgaggucccggccga

SEQ ID NO: 3170446 - RNA, 18 nt, Mycobacterium bovis subsp bovis AF2122/97
ucggcgaguucggcagcg

SEQ ID NO: 3170447 - RNA, 17 nt, Mycobacterium bovis subsp bovis AF2122/97
ucggcgauaacuccgcg

SEQ ID NO: 3170448 - RNA, 20 nt, Mycobacterium bovis subsp bovis AF2122/97
ucggcgauaacuccgcggcg

SEQ ID NO: 3170449 - RNA, 17 nt, Mycobacterium bovis subsp bovis AF2122/97
ucggcgaucaacgcgca

SEQ ID NO: 3170450 - RNA, 21 nt, Mycobacterium bovis subsp bovis AF2122/97
ucggcgaucaacgcgcacgcg

SEQ ID NO: 3170451 - RNA, 19 nt, Mycobacterium bovis subsp bovis AF2122/97
ucggcgaucaagccucuau

SEQ ID NO: 3170452 - RNA, 20 nt, Mycobacterium bovis subsp bovis AF2122/97
ucggcgaucacgcgaaugac

SEQ ID NO: 3170453 - RNA, 21 nt, Mycobacterium bovis subsp bovis AF2122/97
ucggcgauccgacgaccucga

SEQ ID NO: 3170454 - RNA, 16 nt, Mycobacterium bovis subsp bovis AF2122/97
ucggcgaucucgucgc

SEQ ID NO: 3170455 - RNA, 16 nt, Mycobacterium bovis subsp bovis AF2122/97
ucggcgaucugcguuu

SEQ ID NO: 3170456 - RNA, 19 nt, Mycobacterium bovis subsp bovis AF2122/97
ucggcgaugaucaccaguc

SEQ ID NO: 3170457 - RNA, 22 nt, Mycobacterium bovis subsp bovis AF2122/97
ucggcgaugauguugagcugga

SEQ ID NO: 3170458 - RNA, 18 nt, Mycobacterium bovis subsp bovis AF2122/97
ucggcgaugcguccgccc

SEQ ID NO: 3170459 - RNA, 21 nt, Mycobacterium bovis subsp bovis AF2122/97
ucggcgaugcguccgcccagc

SEQ ID NO: 3170460 - RNA, 17 nt, Mycobacterium bovis subsp bovis AF2122/97
ucggcgaugcugagccg

SEQ ID NO: 3170461 - RNA, 16 nt, Mycobacterium bovis subsp bovis AF2122/97
ucggcgaugucgaagc

SEQ ID NO: 3170462 - RNA, 20 nt, Mycobacterium bovis subsp bovis AF2122/97
ucggcgauuuugcgucgcgc

SEQ ID NO: 3170463 - RNA, 14 nt, Mycobacterium bovis subsp bovis AF2122/97
ucggcgcaaucaac

SEQ ID NO: 3170464 - RNA, 23 nt, Mycobacterium bovis subsp bovis AF2122/97
ucggcgcagcacauccugcagcu

SEQ ID NO: 3170465 - RNA, 12 nt, Mycobacterium bovis subsp bovis AF2122/97
ucggcgcaggcg

SEQ ID NO: 3170466 - RNA, 21 nt, Mycobacterium bovis subsp bovis AF2122/97
ucggcgcaucaccacccgacc

SEQ ID NO: 3170467 - RNA, 12 nt, Mycobacterium bovis subsp bovis AF2122/97
ucggcgccagau

SEQ ID NO: 3170468 - RNA, 13 nt, Mycobacterium bovis subsp bovis AF2122/97
ucggcgcccgcuc

SEQ ID NO: 3170469 - RNA, 19 nt, Mycobacterium bovis subsp bovis AF2122/97
ucggcgcccgcucggccgc

SEQ ID NO: 3170470 - RNA, 17 nt, Mycobacterium bovis subsp bovis AF2122/97
ucggcgcccuccuuggc

SEQ ID NO: 3170471 - RNA, 22 nt, Mycobacterium bovis subsp bovis AF2122/97
ucggcgcccuccuuggcguugc

SEQ ID NO: 3170472 - RNA, 12 nt, Mycobacterium bovis subsp bovis AF2122/97
ucggcgccgaac

SEQ ID NO: 3170473 - RNA, 15 nt, Mycobacterium bovis subsp bovis AF2122/97
ucggcgccgaacuca

SEQ ID NO: 3170474 - RNA, 19 nt, Mycobacterium bovis subsp bovis AF2122/97
ucggcgccgagcagcccgc

SEQ ID NO: 3170475 - RNA, 13 nt, Mycobacterium bovis subsp bovis AF2122/97
ucggcgccgccca

SEQ ID NO: 3170476 - RNA, 20 nt, Mycobacterium bovis subsp bovis AF2122/97
ucggcgccgccguccagcgc

SEQ ID NO: 3170477 - RNA, 22 nt, Mycobacterium bovis subsp bovis AF2122/97
ucggcgccgccguccagcgccg

SEQ ID NO: 3170478 - RNA, 14 nt, Mycobacterium bovis subsp bovis AF2122/97
ucggcgccgcgccg

SEQ ID NO: 3170479 - RNA, 16 nt, Mycobacterium bovis subsp bovis AF2122/97
ucggcgucccagggca

SEQ ID NO: 3170480 - RNA, 16 nt, Mycobacterium bovis subsp bovis AF2122/97
ucggcgucguccgcgc

SEQ ID NO: 3170481 - RNA, 17 nt, Mycobacterium bovis subsp bovis AF2122/97
ucggcgucgucgacggc

SEQ ID NO: 3170482 - RNA, 19 nt, Mycobacterium bovis subsp bovis AF2122/97
ucggcgucgucgacggcug

SEQ ID NO: 3170483 - RNA, 20 nt, Mycobacterium bovis subsp bovis AF2122/97
ucggcgucguggcuuccggu

SEQ ID NO: 3170484 - RNA, 21 nt, Mycobacterium bovis subsp bovis AF2122/97
ucggcgucgugguggccacgg

SEQ ID NO: 3170485 - RNA, 18 nt, Mycobacterium bovis subsp bovis AF2122/97
ucggcgugacgucgucga

SEQ ID NO: 3170486 - RNA, 15 nt, Mycobacterium bovis subsp bovis AF2122/97
ucggcgugaucaccg

SEQ ID NO: 3170487 - RNA, 15 nt, Mycobacterium bovis subsp bovis AF2122/97
ucggcgugcaggguc

SEQ ID NO: 3170488 - RNA, 23 nt, Mycobacterium bovis subsp bovis AF2122/97
ucggcguggcugccuucggcgag

SEQ ID NO: 3170489 - RNA, 17 nt, Mycobacterium bovis subsp bovis AF2122/97
ucggcguggucgcgcgg

SEQ ID NO: 3170490 - RNA, 19 nt, Mycobacterium bovis subsp bovis AF2122/97
ucggcgugguguccaccgc

SEQ ID NO: 3170491 - RNA, 18 nt, Mycobacterium bovis subsp bovis AF2122/97
ucggcguguccgccgaac

SEQ ID NO: 3170492 - RNA, 17 nt, Mycobacterium bovis subsp bovis AF2122/97
ucggcguuaucgaaggc

SEQ ID NO: 3170493 - RNA, 15 nt, Mycobacterium bovis subsp bovis AF2122/97
ucggcguugccgccg

SEQ ID NO: 3170494 - RNA, 17 nt, Mycobacterium bovis subsp bovis AF2122/97
ucggcguugccgccguu

SEQ ID NO: 3170495 - RNA, 15 nt, Mycobacterium bovis subsp bovis AF2122/97
ucggcguuggggcuc

SEQ ID NO: 3170496 - RNA, 21 nt, Mycobacterium bovis subsp bovis AF2122/97
ucggcuaccuaacccgcgccg

SEQ ID NO: 3170497 - RNA, 23 nt, Mycobacterium bovis subsp bovis AF2122/97
ucggcuaccuaacccgcgccggc

SEQ ID NO: 3170498 - RNA, 19 nt, Mycobacterium bovis subsp bovis AF2122/97
ucggcuacgccucggcgug

SEQ ID NO: 3170499 - RNA, 13 nt, Mycobacterium bovis subsp bovis AF2122/97
ucggcuagcaacg

SEQ ID NO: 3170500 - RNA, 12 nt, Mycobacterium bovis subsp bovis AF2122/97
ucggcucagcaa

SEQ ID NO: 3170501 - RNA, 14 nt, Mycobacterium bovis subsp bovis AF2122/97
ucggcucagcaacg

SEQ ID NO: 3170502 - RNA, 21 nt, Mycobacterium bovis subsp bovis AF2122/97
ucggcucagcaacgucacguc

SEQ ID NO: 3170503 - RNA, 22 nt, Mycobacterium bovis subsp bovis AF2122/97
ucggcucagcaacgucacgucg

SEQ ID NO: 3170504 - RNA, 14 nt, Mycobacterium bovis subsp bovis AF2122/97
ucggcucaucccga

SEQ ID NO: 3170505 - RNA, 12 nt, Mycobacterium bovis subsp bovis AF2122/97
ucggcuccacgc

SEQ ID NO: 3170506 - RNA, 20 nt, Mycobacterium bovis subsp bovis AF2122/97
ucggcugauuggcccaccgc

SEQ ID NO: 3170507 - RNA, 16 nt, Mycobacterium bovis subsp bovis AF2122/97
ucggcugccaccgcag

SEQ ID NO: 3170508 - RNA, 15 nt, Mycobacterium bovis subsp bovis AF2122/97
ucggcugccgcgcgc

SEQ ID NO: 3170509 - RNA, 22 nt, Mycobacterium bovis subsp bovis AF2122/97
ucggcugccgcgcgcugccgcu

SEQ ID NO: 3170510 - RNA, 16 nt, Mycobacterium bovis subsp bovis AF2122/97
ucggcugccgcggcug

SEQ ID NO: 3170511 - RNA, 21 nt, Mycobacterium bovis subsp bovis AF2122/97
ucggcugcgacaggacgucgg

SEQ ID NO: 3170512 - RNA, 19 nt, Mycobacterium bovis subsp bovis AF2122/97
ucggcuggacggcgccggu

SEQ ID NO: 3170513 - RNA, 12 nt, Mycobacterium bovis subsp bovis AF2122/97
ucggcuggcccg

SEQ ID NO: 3170514 - RNA, 17 nt, Mycobacterium bovis subsp bovis AF2122/97
ucggcuggccgcgccuc

SEQ ID NO: 3170515 - RNA, 16 nt, Mycobacterium bovis subsp bovis AF2122/97
ucggcuggcgugcugc

SEQ ID NO: 3170516 - RNA, 22 nt, Mycobacterium bovis subsp bovis AF2122/97
ucggcuggugggggagcggccg

SEQ ID NO: 3170517 - RNA, 14 nt, Mycobacterium bovis subsp bovis AF2122/97
ucggcuuggcugug

SEQ ID NO: 3170518 - RNA, 15 nt, Mycobacterium bovis subsp bovis AF2122/97
ucggcuugggaaacc

SEQ ID NO: 3170519 - RNA, 16 nt, Mycobacterium bovis subsp bovis AF2122/97
ucggcuugggaaaccc

SEQ ID NO: 3170520 - RNA, 23 nt, Mycobacterium bovis subsp bovis AF2122/97
ucgggaaccagaugaaccccgaa

SEQ ID NO: 3170521 - RNA, 19 nt, Mycobacterium bovis subsp bovis AF2122/97
ucgggaacgcucgucgaca

SEQ ID NO: 3170522 - RNA, 17 nt, Mycobacterium bovis subsp bovis AF2122/97
ucgggaacuucgccgaa

SEQ ID NO: 3170523 - RNA, 21 nt, Mycobacterium bovis subsp bovis AF2122/97
ucgggaacuucgccgaagcgc

SEQ ID NO: 3170524 - RNA, 14 nt, Mycobacterium bovis subsp bovis AF2122/97
ucgggaagccgccg

SEQ ID NO: 3170525 - RNA, 19 nt, Mycobacterium bovis subsp bovis AF2122/97
ucgggaagccgccgggcau

SEQ ID NO: 3170526 - RNA, 16 nt, Mycobacterium bovis subsp bovis AF2122/97
ucgggaagucgggccg

SEQ ID NO: 3170527 - RNA, 20 nt, Mycobacterium bovis subsp bovis AF2122/97
ucgggaccggcuugccgccg

SEQ ID NO: 3170528 - RNA, 19 nt, Mycobacterium bovis subsp bovis AF2122/97
ucgggacucccgcgcgggc

SEQ ID NO: 3170529 - RNA, 15 nt, Mycobacterium bovis subsp bovis AF2122/97
ucgggacugcgcggc

SEQ ID NO: 3170530 - RNA, 12 nt, Mycobacterium bovis subsp bovis AF2122/97
ucgggaggcagc

SEQ ID NO: 3170531 - RNA, 17 nt, Mycobacterium bovis subsp bovis AF2122/97
ucgggaguccgguagcu

SEQ ID NO: 3170532 - RNA, 19 nt, Mycobacterium bovis subsp bovis AF2122/97
ucgggauagcccagauaga

SEQ ID NO: 3170533 - RNA, 14 nt, Mycobacterium bovis subsp bovis AF2122/97
ucgggaucgcugcc

SEQ ID NO: 3170534 - RNA, 14 nt, Mycobacterium bovis subsp bovis AF2122/97
ucgggaugcucgau

SEQ ID NO: 3170535 - RNA, 22 nt, Mycobacterium bovis subsp bovis AF2122/97
ucgggauggacggcagccagcc

SEQ ID NO: 3170536 - RNA, 23 nt, Mycobacterium bovis subsp bovis AF2122/97
ucgggauggacggcagccagcca

SEQ ID NO: 3170537 - RNA, 16 nt, Mycobacterium bovis subsp bovis AF2122/97
ucgggauucggcagcg

SEQ ID NO: 3170538 - RNA, 18 nt, Mycobacterium bovis subsp bovis AF2122/97
ucgggauucgggcgccgc

SEQ ID NO: 3170539 - RNA, 22 nt, Mycobacterium bovis subsp bovis AF2122/97
ucgggcaaccggagaucccggu

SEQ ID NO: 3170540 - RNA, 18 nt, Mycobacterium bovis subsp bovis AF2122/97
ucgggcaaccugccgggc

SEQ ID NO: 3170541 - RNA, 20 nt, Mycobacterium bovis subsp bovis AF2122/97
ucgggcaaccugccgggcca

SEQ ID NO: 3170542 - RNA, 15 nt, Mycobacterium bovis subsp bovis AF2122/97
ucgggcaacucggug

SEQ ID NO: 3170543 - RNA, 18 nt, Mycobacterium bovis subsp bovis AF2122/97
ucgggcaacuucagcaac

SEQ ID NO: 3170544 - RNA, 23 nt, Mycobacterium bovis subsp bovis AF2122/97
ucgggcaacuucagcaacggcau

SEQ ID NO: 3170545 - RNA, 16 nt, Mycobacterium bovis subsp bovis AF2122/97
ucgggcaaggccaccg

SEQ ID NO: 3170546 - RNA, 13 nt, Mycobacterium bovis subsp bovis AF2122/97
ucgggcaccgcgc

SEQ ID NO: 3170547 - RNA, 19 nt, Mycobacterium bovis subsp bovis AF2122/97
ucgggcaccuggucggccg

SEQ ID NO: 3170548 - RNA, 17 nt, Mycobacterium bovis subsp bovis AF2122/97
ucgggcacgggugacga

SEQ ID NO: 3170549 - RNA, 22 nt, Mycobacterium bovis subsp bovis AF2122/97
ucgggcagauaugacggcagac

SEQ ID NO: 3170550 - RNA, 17 nt, Mycobacterium bovis subsp bovis AF2122/97
ucgggcagcacccgcgc

SEQ ID NO: 3170551 - RNA, 19 nt, Mycobacterium bovis subsp bovis AF2122/97
ucgggcagcacccgcgcca

SEQ ID NO: 3170552 - RNA, 20 nt, Mycobacterium bovis subsp bovis AF2122/97
ucgggcagcacgccagcccc

SEQ ID NO: 3170553 - RNA, 13 nt, Mycobacterium bovis subsp bovis AF2122/97
ucgggcagcagca

SEQ ID NO: 3170554 - RNA, 15 nt, Mycobacterium bovis subsp bovis AF2122/97
ucgggcagcgcggcc

SEQ ID NO: 3170555 - RNA, 16 nt, Mycobacterium bovis subsp bovis AF2122/97
ucgggcagcgcggcca

SEQ ID NO: 3170556 - RNA, 16 nt, Mycobacterium bovis subsp bovis AF2122/97
ucgggcaggccgucga

SEQ ID NO: 3170557 - RNA, 16 nt, Mycobacterium bovis subsp bovis AF2122/97
ucgggcagggaccgca

SEQ ID NO: 3170558 - RNA, 16 nt, Mycobacterium bovis subsp bovis AF2122/97
ucgggcaugcucuggc

SEQ ID NO: 3170559 - RNA, 13 nt, Mycobacterium bovis subsp bovis AF2122/97
ucgggccacagca

SEQ ID NO: 3170560 - RNA, 15 nt, Mycobacterium bovis subsp bovis AF2122/97
ucgggccacagcaac

SEQ ID NO: 3170561 - RNA, 18 nt, Mycobacterium bovis subsp bovis AF2122/97
ucgggcccagcagcgcaa

SEQ ID NO: 3170562 - RNA, 13 nt, Mycobacterium bovis subsp bovis AF2122/97
ucgggcccagccg

SEQ ID NO: 3170563 - RNA, 15 nt, Mycobacterium bovis subsp bovis AF2122/97
ucgggcccgaugucg

SEQ ID NO: 3170564 - RNA, 19 nt, Mycobacterium bovis subsp bovis AF2122/97
ucgggcccgaugucgucga

SEQ ID NO: 3170565 - RNA, 15 nt, Mycobacterium bovis subsp bovis AF2122/97
ucgggccgacgggcg

SEQ ID NO: 3170566 - RNA, 21 nt, Mycobacterium bovis subsp bovis AF2122/97
ucggguuccgaucucaagggc

SEQ ID NO: 3170567 - RNA, 12 nt, Mycobacterium bovis subsp bovis AF2122/97
ucggguucguca

SEQ ID NO: 3170568 - RNA, 22 nt, Mycobacterium bovis subsp bovis AF2122/97
ucggguucgucagucaacucac

SEQ ID NO: 3170569 - RNA, 15 nt, Mycobacterium bovis subsp bovis AF2122/97
ucggguugcgacgaa

SEQ ID NO: 3170570 - RNA, 13 nt, Mycobacterium bovis subsp bovis AF2122/97
ucggguugcgcga

SEQ ID NO: 3170571 - RNA, 23 nt, Mycobacterium bovis subsp bovis AF2122/97
ucggguugggcaucaggccgcgc

SEQ ID NO: 3170572 - RNA, 15 nt, Mycobacterium bovis subsp bovis AF2122/97
ucggguuucgaucuu

SEQ ID NO: 3170573 - RNA, 19 nt, Mycobacterium bovis subsp bovis AF2122/97
ucggguuucgaucuucucg

SEQ ID NO: 3170574 - RNA, 15 nt, Mycobacterium bovis subsp bovis AF2122/97
ucggguuuggccgac

SEQ ID NO: 3170575 - RNA, 20 nt, Mycobacterium bovis subsp bovis AF2122/97
ucggguuuggccgacagcca

SEQ ID NO: 3170576 - RNA, 14 nt, Mycobacterium bovis subsp bovis AF2122/97
ucgguaauggccgc

SEQ ID NO: 3170577 - RNA, 14 nt, Mycobacterium bovis subsp bovis AF2122/97
ucgguacccgcacc

SEQ ID NO: 3170578 - RNA, 18 nt, Mycobacterium bovis subsp bovis AF2122/97
ucgguaccgacggcacca

SEQ ID NO: 3170579 - RNA, 15 nt, Mycobacterium bovis subsp bovis AF2122/97
ucgguagcugaccgu

SEQ ID NO: 3170580 - RNA, 15 nt, Mycobacterium bovis subsp bovis AF2122/97
ucgguaggcgguguc

SEQ ID NO: 3170581 - RNA, 17 nt, Mycobacterium bovis subsp bovis AF2122/97
ucgguaggcggugucca

SEQ ID NO: 3170582 - RNA, 23 nt, Mycobacterium bovis subsp bovis AF2122/97
ucgguagugucguaggcgaugag

SEQ ID NO: 3170583 - RNA, 18 nt, Mycobacterium bovis subsp bovis AF2122/97
ucgguaucgagggcagcc

SEQ ID NO: 3170584 - RNA, 19 nt, Mycobacterium bovis subsp bovis AF2122/97
ucgguaucgagggcagccg

SEQ ID NO: 3170585 - RNA, 13 nt, Mycobacterium bovis subsp bovis AF2122/97
ucgguaucggcag

SEQ ID NO: 3170586 - RNA, 13 nt, Mycobacterium bovis subsp bovis AF2122/97
ucgguaugcccgg

SEQ ID NO: 3170587 - RNA, 12 nt, Mycobacterium bovis subsp bovis AF2122/97
ucggucaacucg

SEQ ID NO: 3170588 - RNA, 22 nt, Mycobacterium bovis subsp bovis AF2122/97
ucggucaauucggugcgcuggc

SEQ ID NO: 3170589 - RNA, 18 nt, Mycobacterium bovis subsp bovis AF2122/97
ucggucaccacggcggcg

SEQ ID NO: 3170590 - RNA, 20 nt, Mycobacterium bovis subsp bovis AF2122/97
ucggucaccauggcgccgcg

SEQ ID NO: 3170591 - RNA, 21 nt, Mycobacterium bovis subsp bovis AF2122/97
ucggucaccauggcgccgcgc

SEQ ID NO: 3170592 - RNA, 12 nt, Mycobacterium bovis subsp bovis AF2122/97
ucggucaccgac

SEQ ID NO: 3170593 - RNA, 16 nt, Mycobacterium bovis subsp bovis AF2122/97
ucggucaccucgaugc

SEQ ID NO: 3170594 - RNA, 14 nt, Mycobacterium bovis subsp bovis AF2122/97
ucggucagccagcc

SEQ ID NO: 3170595 - RNA, 19 nt, Mycobacterium bovis subsp bovis AF2122/97
ucggucagcgccgacucca

SEQ ID NO: 3170596 - RNA, 19 nt, Mycobacterium bovis subsp bovis AF2122/97
ucggucagcgggcacgccg

SEQ ID NO: 3170597 - RNA, 15 nt, Mycobacterium bovis subsp bovis AF2122/97
ucggucagggugggc

SEQ ID NO: 3170598 - RNA, 17 nt, Mycobacterium bovis subsp bovis AF2122/97
ucggucagggugggcuc

SEQ ID NO: 3170599 - RNA, 21 nt, Mycobacterium bovis subsp bovis AF2122/97
ucggucagugggacgggcgcg

SEQ ID NO: 3170600 - RNA, 19 nt, Mycobacterium bovis subsp bovis AF2122/97
ucggucauguccguccgcg

SEQ ID NO: 3170601 - RNA, 17 nt, Mycobacterium bovis subsp bovis AF2122/97
ucgguccacccaagcuc

SEQ ID NO: 3170602 - RNA, 21 nt, Mycobacterium bovis subsp bovis AF2122/97
ucgguccagccgguccagacc

SEQ ID NO: 3170603 - RNA, 12 nt, Mycobacterium bovis subsp bovis AF2122/97
ucggucgacgau

SEQ ID NO: 3170604 - RNA, 17 nt, Mycobacterium bovis subsp bovis AF2122/97
ucggucgacggguucac

SEQ ID NO: 3170605 - RNA, 21 nt, Mycobacterium bovis subsp bovis AF2122/97
ucggucgccauguugaagcga

SEQ ID NO: 3170606 - RNA, 16 nt, Mycobacterium bovis subsp bovis AF2122/97
ucggucgcgcgacggc

SEQ ID NO: 3170607 - RNA, 17 nt, Mycobacterium bovis subsp bovis AF2122/97
ucggucgcuucagcgcc

SEQ ID NO: 3170608 - RNA, 12 nt, Mycobacterium bovis subsp bovis AF2122/97
ucggucggccaa

SEQ ID NO: 3170609 - RNA, 18 nt, Mycobacterium bovis subsp bovis AF2122/97
ucggucgggggugcucgg

SEQ ID NO: 3170610 - RNA, 18 nt, Mycobacterium bovis subsp bovis AF2122/97
ucggucgguaacggcggu

SEQ ID NO: 3170611 - RNA, 15 nt, Mycobacterium bovis subsp bovis AF2122/97
ucggucguccggauc

SEQ ID NO: 3170612 - RNA, 15 nt, Mycobacterium bovis subsp bovis AF2122/97
ucggucgucucgggc

SEQ ID NO: 3170613 - RNA, 21 nt, Mycobacterium bovis subsp bovis AF2122/97
ucggucguugccgcggucggc

SEQ ID NO: 3170614 - RNA, 21 nt, Mycobacterium bovis subsp bovis AF2122/97
ucggucuccaccaccgacgag

SEQ ID NO: 3170615 - RNA, 13 nt, Mycobacterium bovis subsp bovis AF2122/97
ucggucucgaucc

SEQ ID NO: 3170616 - RNA, 20 nt, Mycobacterium bovis subsp bovis AF2122/97
ucggucugcaugcgcuggaa

SEQ ID NO: 3170617 - RNA, 21 nt, Mycobacterium bovis subsp bovis AF2122/97
ucggucuuggcgauccaggcc

SEQ ID NO: 3170618 - RNA, 20 nt, Mycobacterium bovis subsp bovis AF2122/97
ucggugaaauucgcggcggu

SEQ ID NO: 3170619 - RNA, 19 nt, Mycobacterium bovis subsp bovis AF2122/97
ucggugaacccgccggcaa

SEQ ID NO: 3170620 - RNA, 16 nt, Mycobacterium bovis subsp bovis AF2122/97
ucggugaacgccgccc

SEQ ID NO: 3170621 - RNA, 17 nt, Mycobacterium bovis subsp bovis AF2122/97
ucggugacaccaacacc

SEQ ID NO: 3170622 - RNA, 15 nt, Mycobacterium bovis subsp bovis AF2122/97
ucggugaccaggccg

SEQ ID NO: 3170623 - RNA, 14 nt, Mycobacterium bovis subsp bovis AF2122/97
ucggugacgaaaca

SEQ ID NO: 3170624 - RNA, 16 nt, Mycobacterium bovis subsp bovis AF2122/97
ucggugacgaagagca

SEQ ID NO: 3170625 - RNA, 16 nt, Mycobacterium bovis subsp bovis AF2122/97
ucggugagcagggcgg

SEQ ID NO: 3170626 - RNA, 17 nt, Mycobacterium bovis subsp bovis AF2122/97
ucggugagcagggcggc

SEQ ID NO: 3170627 - RNA, 19 nt, Mycobacterium bovis subsp bovis AF2122/97
ucggugagcagggcggcga

SEQ ID NO: 3170628 - RNA, 22 nt, Mycobacterium bovis subsp bovis AF2122/97
ucggugagcccguugaccugcg

SEQ ID NO: 3170629 - RNA, 17 nt, Mycobacterium bovis subsp bovis AF2122/97
ucggugagccgggcggc

SEQ ID NO: 3170630 - RNA, 21 nt, Mycobacterium bovis subsp bovis AF2122/97
ucggugagccgggcggccucg

SEQ ID NO: 3170631 - RNA, 15 nt, Mycobacterium bovis subsp bovis AF2122/97
ucggugagccgugcc

SEQ ID NO: 3170632 - RNA, 22 nt, Mycobacterium bovis subsp bovis AF2122/97
ucggugagccgugccgccagca

SEQ ID NO: 3170633 - RNA, 16 nt, Mycobacterium bovis subsp bovis AF2122/97
ucggugagcgcgucgc

SEQ ID NO: 3170634 - RNA, 16 nt, Mycobacterium bovis subsp bovis AF2122/97
ucggugagcgggcaag

SEQ ID NO: 3170635 - RNA, 20 nt, Mycobacterium bovis subsp bovis AF2122/97
ucggugaucaaaccggcggc

SEQ ID NO: 3170636 - RNA, 21 nt, Mycobacterium bovis subsp bovis AF2122/97
ucggugaucaaaccggcggcg

SEQ ID NO: 3170637 - RNA, 14 nt, Mycobacterium bovis subsp bovis AF2122/97
ucggugaucaccgc

SEQ ID NO: 3170638 - RNA, 22 nt, Mycobacterium bovis subsp bovis AF2122/97
ucggugaucgagguugacguca

SEQ ID NO: 3170639 - RNA, 22 nt, Mycobacterium bovis subsp bovis AF2122/97
ucggugaucucguacuccccgc

SEQ ID NO: 3170640 - RNA, 19 nt, Mycobacterium bovis subsp bovis AF2122/97
ucggugaucuuguccgggc

SEQ ID NO: 3170641 - RNA, 20 nt, Mycobacterium bovis subsp bovis AF2122/97
ucggugaugaacgacauccg

SEQ ID NO: 3170642 - RNA, 19 nt, Mycobacterium bovis subsp bovis AF2122/97
ucggugaugcccagcgccg

SEQ ID NO: 3170643 - RNA, 20 nt, Mycobacterium bovis subsp bovis AF2122/97
ucggugauggagccggugac

SEQ ID NO: 3170644 - RNA, 13 nt, Mycobacterium bovis subsp bovis AF2122/97
ucggugcacggcg

SEQ ID NO: 3170645 - RNA, 14 nt, Mycobacterium bovis subsp bovis AF2122/97
ucggugcagcccgc

SEQ ID NO: 3170646 - RNA, 23 nt, Mycobacterium bovis subsp bovis AF2122/97
ucggugccacggcaccgaagucg

SEQ ID NO: 3170647 - RNA, 21 nt, Mycobacterium bovis subsp bovis AF2122/97
ucggugccacugccggugggc

SEQ ID NO: 3170648 - RNA, 21 nt, Mycobacterium bovis subsp bovis AF2122/97
ucggugccagcacuccaccgc

SEQ ID NO: 3170649 - RNA, 16 nt, Mycobacterium bovis subsp bovis AF2122/97
ucggugccgaacagcg

SEQ ID NO: 3170650 - RNA, 19 nt, Mycobacterium bovis subsp bovis AF2122/97
ucggugccgagcacucggc

SEQ ID NO: 3170651 - RNA, 19 nt, Mycobacterium bovis subsp bovis AF2122/97
ucggugccgcccaggagca

SEQ ID NO: 3170652 - RNA, 21 nt, Mycobacterium bovis subsp bovis AF2122/97
ucguauucgaugccguaggcg

SEQ ID NO: 3170653 - RNA, 15 nt, Mycobacterium bovis subsp bovis AF2122/97
ucguauucggccgcg

SEQ ID NO: 3170654 - RNA, 16 nt, Mycobacterium bovis subsp bovis AF2122/97
ucgucaaaucuggcug

SEQ ID NO: 3170655 - RNA, 17 nt, Mycobacterium bovis subsp bovis AF2122/97
ucgucaaccugcgcauc

SEQ ID NO: 3170656 - RNA, 14 nt, Mycobacterium bovis subsp bovis AF2122/97
ucgucaacgacgac

SEQ ID NO: 3170657 - RNA, 14 nt, Mycobacterium bovis subsp bovis AF2122/97
ucgucaaucaccac

SEQ ID NO: 3170658 - RNA, 16 nt, Mycobacterium bovis subsp bovis AF2122/97
ucgucacauugccacc

SEQ ID NO: 3170659 - RNA, 13 nt, Mycobacterium bovis subsp bovis AF2122/97
ucgucaccacgag

SEQ ID NO: 3170660 - RNA, 14 nt, Mycobacterium bovis subsp bovis AF2122/97
ucgucaccccacca

SEQ ID NO: 3170661 - RNA, 17 nt, Mycobacterium bovis subsp bovis AF2122/97
ucgucaccgaugcgccg

SEQ ID NO: 3170662 - RNA, 18 nt, Mycobacterium bovis subsp bovis AF2122/97
ucgucaccggucagcgac

SEQ ID NO: 3170663 - RNA, 14 nt, Mycobacterium bovis subsp bovis AF2122/97
ucgucacugccacc

SEQ ID NO: 3170664 - RNA, 16 nt, Mycobacterium bovis subsp bovis AF2122/97
ucgucacugccaccuc

SEQ ID NO: 3170665 - RNA, 23 nt, Mycobacterium bovis subsp bovis AF2122/97
ucgucacugccaccucuaccggu

SEQ ID NO: 3170666 - RNA, 16 nt, Mycobacterium bovis subsp bovis AF2122/97
ucgucagccaccgcau

SEQ ID NO: 3170667 - RNA, 11 nt, Mycobacterium bovis subsp bovis AF2122/97
ucgucaggccc

SEQ ID NO: 3170668 - RNA, 16 nt, Mycobacterium bovis subsp bovis AF2122/97
ucgucaguaccgcacg

SEQ ID NO: 3170669 - RNA, 15 nt, Mycobacterium bovis subsp bovis AF2122/97
ucgucagucaacuca

SEQ ID NO: 3170670 - RNA, 15 nt, Mycobacterium bovis subsp bovis AF2122/97
ucgucaugccagucg

SEQ ID NO: 3170671 - RNA, 23 nt, Mycobacterium bovis subsp bovis AF2122/97
ucgucauugcgaaaaucgaagcc

SEQ ID NO: 3170672 - RNA, 16 nt, Mycobacterium bovis subsp bovis AF2122/97
ucguccaagccggcca

SEQ ID NO: 3170673 - RNA, 18 nt, Mycobacterium bovis subsp bovis AF2122/97
ucguccaagccggccacg

SEQ ID NO: 3170674 - RNA, 16 nt, Mycobacterium bovis subsp bovis AF2122/97
ucguccaccgccgaca

SEQ ID NO: 3170675 - RNA, 23 nt, Mycobacterium bovis subsp bovis AF2122/97
ucguccaccgccgacauggcggu

SEQ ID NO: 3170676 - RNA, 21 nt, Mycobacterium bovis subsp bovis AF2122/97
ucguccaccgcgaugccccac

SEQ ID NO: 3170677 - RNA, 17 nt, Mycobacterium bovis subsp bovis AF2122/97
ucguccacgaccccggc

SEQ ID NO: 3170678 - RNA, 13 nt, Mycobacterium bovis subsp bovis AF2122/97
ucguccagcacca

SEQ ID NO: 3170679 - RNA, 18 nt, Mycobacterium bovis subsp bovis AF2122/97
ucguccagcgaucccggu

SEQ ID NO: 3170680 - RNA, 21 nt, Mycobacterium bovis subsp bovis AF2122/97
ucguccagcgaucccggugag

SEQ ID NO: 3170681 - RNA, 19 nt, Mycobacterium bovis subsp bovis AF2122/97
ucguccagcucggugcugu

SEQ ID NO: 3170682 - RNA, 17 nt, Mycobacterium bovis subsp bovis AF2122/97
ucguccagggcgacgag

SEQ ID NO: 3170683 - RNA, 18 nt, Mycobacterium bovis subsp bovis AF2122/97
ucguccaggucggccgcc

SEQ ID NO: 3170684 - RNA, 19 nt, Mycobacterium bovis subsp bovis AF2122/97
ucguccaggucggccgccu

SEQ ID NO: 3170685 - RNA, 21 nt, Mycobacterium bovis subsp bovis AF2122/97
ucgucccacagguuugcgccg

SEQ ID NO: 3170686 - RNA, 14 nt, Mycobacterium bovis subsp bovis AF2122/97
ucgucccacugcgc

SEQ ID NO: 3170687 - RNA, 19 nt, Mycobacterium bovis subsp bovis AF2122/97
ucgucccagaaccggcuca

SEQ ID NO: 3170688 - RNA, 18 nt, Mycobacterium bovis subsp bovis AF2122/97
ucgucccagaagucguca

SEQ ID NO: 3170689 - RNA, 14 nt, Mycobacterium bovis subsp bovis AF2122/97
ucgucccagcgcgg

SEQ ID NO: 3170690 - RNA, 11 nt, Mycobacterium bovis subsp bovis AF2122/97
ucguccccaga

SEQ ID NO: 3170691 - RNA, 16 nt, Mycobacterium bovis subsp bovis AF2122/97
ucguccccagaccggc

SEQ ID NO: 3170692 - RNA, 17 nt, Mycobacterium bovis subsp bovis AF2122/97
ucguccccagaccggcg

SEQ ID NO: 3170693 - RNA, 16 nt, Mycobacterium bovis subsp bovis AF2122/97
ucgucccgcggcgcgg

SEQ ID NO: 3170694 - RNA, 21 nt, Mycobacterium bovis subsp bovis AF2122/97
ucgucccgcggcgcggagagc

SEQ ID NO: 3170695 - RNA, 20 nt, Mycobacterium bovis subsp bovis AF2122/97
ucgucccggcgaccgggucc

SEQ ID NO: 3170696 - RNA, 15 nt, Mycobacterium bovis subsp bovis AF2122/97
ucguccgacgggccg

SEQ ID NO: 3170697 - RNA, 22 nt, Mycobacterium bovis subsp bovis AF2122/97
ucguccgccugcaccgccgccg

SEQ ID NO: 3170698 - RNA, 21 nt, Mycobacterium bovis subsp bovis AF2122/97
ucguccgcggucucagugcuc

SEQ ID NO: 3170699 - RNA, 15 nt, Mycobacterium bovis subsp bovis AF2122/97
ucguccucgcuggau

SEQ ID NO: 3170700 - RNA, 23 nt, Mycobacterium bovis subsp bovis AF2122/97
ucguccuggaaccaaaccugggc

SEQ ID NO: 3170701 - RNA, 19 nt, Mycobacterium bovis subsp bovis AF2122/97
ucgucgaaccggaugcggu

SEQ ID NO: 3170702 - RNA, 22 nt, Mycobacterium bovis subsp bovis AF2122/97
ucgucgaacggaucucgguggu

SEQ ID NO: 3170703 - RNA, 20 nt, Mycobacterium bovis subsp bovis AF2122/97
ucgucgaagaccucaacccc

SEQ ID NO: 3170704 - RNA, 22 nt, Mycobacterium bovis subsp bovis AF2122/97
ucgucgaagggaucacgaccgc

SEQ ID NO: 3170705 - RNA, 16 nt, Mycobacterium bovis subsp bovis AF2122/97
ucgucgaaguagccga

SEQ ID NO: 3170706 - RNA, 15 nt, Mycobacterium bovis subsp bovis AF2122/97
ucgucgacacgguga

SEQ ID NO: 3170707 - RNA, 15 nt, Mycobacterium bovis subsp bovis AF2122/97
ucgucgaccacgacg

SEQ ID NO: 3170708 - RNA, 13 nt, Mycobacterium bovis subsp bovis AF2122/97
ucgucgaccaggc

SEQ ID NO: 3170709 - RNA, 18 nt, Mycobacterium bovis subsp bovis AF2122/97
ucgucgaccaggccacug

SEQ ID NO: 3170710 - RNA, 19 nt, Mycobacterium bovis subsp bovis AF2122/97
ucgucgaccggcccccggu

SEQ ID NO: 3170711 - RNA, 14 nt, Mycobacterium bovis subsp bovis AF2122/97
ucgucgacgagguc

SEQ ID NO: 3170712 - RNA, 13 nt, Mycobacterium bovis subsp bovis AF2122/97
ucgucgacgauca

SEQ ID NO: 3170713 - RNA, 22 nt, Mycobacterium bovis subsp bovis AF2122/97
ucgucgacgcgucguggucggc

SEQ ID NO: 3170714 - RNA, 16 nt, Mycobacterium bovis subsp bovis AF2122/97
ucgucgacggccuggg

SEQ ID NO: 3170715 - RNA, 18 nt, Mycobacterium bovis subsp bovis AF2122/97
ucgucgacggcugcgccg

SEQ ID NO: 3170716 - RNA, 13 nt, Mycobacterium bovis subsp bovis AF2122/97
ucgucgacgucgg

SEQ ID NO: 3170717 - RNA, 22 nt, Mycobacterium bovis subsp bovis AF2122/97
ucgucgacgucggcaucggcgg

SEQ ID NO: 3170718 - RNA, 17 nt, Mycobacterium bovis subsp bovis AF2122/97
ucgucgacgucggcgag

SEQ ID NO: 3170719 - RNA, 17 nt, Mycobacterium bovis subsp bovis AF2122/97
ucgucgacucggcggcg

SEQ ID NO: 3170720 - RNA, 18 nt, Mycobacterium bovis subsp bovis AF2122/97
ucgucgagaagaucucgu

SEQ ID NO: 3170721 - RNA, 20 nt, Mycobacterium bovis subsp bovis AF2122/97
ucgucgagauagccgacguc

SEQ ID NO: 3170722 - RNA, 16 nt, Mycobacterium bovis subsp bovis AF2122/97
ucgucgagcaccaccc

SEQ ID NO: 3170723 - RNA, 19 nt, Mycobacterium bovis subsp bovis AF2122/97
ucgucgagcaccacccggg

SEQ ID NO: 3170724 - RNA, 21 nt, Mycobacterium bovis subsp bovis AF2122/97
ucgucgagcaccacccgggcc

SEQ ID NO: 3170725 - RNA, 22 nt, Mycobacterium bovis subsp bovis AF2122/97
ucgucgagcaccacccgggccu

SEQ ID NO: 3170726 - RNA, 17 nt, Mycobacterium bovis subsp bovis AF2122/97
ucgucgagccacagcgu

SEQ ID NO: 3170727 - RNA, 14 nt, Mycobacterium bovis subsp bovis AF2122/97
ucgucgagccgacc

SEQ ID NO: 3170728 - RNA, 16 nt, Mycobacterium bovis subsp bovis AF2122/97
ucgucgagccgaccgc

SEQ ID NO: 3170729 - RNA, 17 nt, Mycobacterium bovis subsp bovis AF2122/97
ucgucgagccgaccgcg

SEQ ID NO: 3170730 - RNA, 16 nt, Mycobacterium bovis subsp bovis AF2122/97
ucgucgagccgaucgc

SEQ ID NO: 3170731 - RNA, 22 nt, Mycobacterium bovis subsp bovis AF2122/97
ucgucgagcgcggugccgccac

SEQ ID NO: 3170732 - RNA, 16 nt, Mycobacterium bovis subsp bovis AF2122/97
ucgucgaggaagauca

SEQ ID NO: 3170733 - RNA, 15 nt, Mycobacterium bovis subsp bovis AF2122/97
ucgucgaggucacgc

SEQ ID NO: 3170734 - RNA, 22 nt, Mycobacterium bovis subsp bovis AF2122/97
ucgucgaggucacgcgaggcga

SEQ ID NO: 3170735 - RNA, 16 nt, Mycobacterium bovis subsp bovis AF2122/97
ucgucgaguuggccau

SEQ ID NO: 3170736 - RNA, 15 nt, Mycobacterium bovis subsp bovis AF2122/97
ucgucgauccagccc

SEQ ID NO: 3170737 - RNA, 11 nt, Mycobacterium bovis subsp bovis AF2122/97
ucgucgaucgc

SEQ ID NO: 3170738 - RNA, 14 nt, Mycobacterium bovis subsp bovis AF2122/97
ucgucgaucgccgc

SEQ ID NO: 3170739 - RNA, 20 nt, Mycobacterium bovis subsp bovis AF2122/97
ucgucuugcguccauccgca

SEQ ID NO: 3170740 - RNA, 23 nt, Mycobacterium bovis subsp bovis AF2122/97
ucgucuuggcggcggugcagcag

SEQ ID NO: 3170741 - RNA, 13 nt, Mycobacterium bovis subsp bovis AF2122/97
ucgugaaaccaca

SEQ ID NO: 3170742 - RNA, 16 nt, Mycobacterium bovis subsp bovis AF2122/97
ucgugaacacgucgcg

SEQ ID NO: 3170743 - RNA, 13 nt, Mycobacterium bovis subsp bovis AF2122/97
ucgugaccgaccg

SEQ ID NO: 3170744 - RNA, 14 nt, Mycobacterium bovis subsp bovis AF2122/97
ucgugaccgccguu

SEQ ID NO: 3170745 - RNA, 13 nt, Mycobacterium bovis subsp bovis AF2122/97
ucgugaccggcgg

SEQ ID NO: 3170746 - RNA, 14 nt, Mycobacterium bovis subsp bovis AF2122/97
ucgugagacugggc

SEQ ID NO: 3170747 - RNA, 22 nt, Mycobacterium bovis subsp bovis AF2122/97
ucgugaucaacuuccgcagcgc

SEQ ID NO: 3170748 - RNA, 14 nt, Mycobacterium bovis subsp bovis AF2122/97
ucgugaucagcagg

SEQ ID NO: 3170749 - RNA, 17 nt, Mycobacterium bovis subsp bovis AF2122/97
ucgugaucagcaggacg

SEQ ID NO: 3170750 - RNA, 14 nt, Mycobacterium bovis subsp bovis AF2122/97
ucgugaugucaacg

SEQ ID NO: 3170751 - RNA, 14 nt, Mycobacterium bovis subsp bovis AF2122/97
ucgugcaaucgcgu

SEQ ID NO: 3170752 - RNA, 22 nt, Mycobacterium bovis subsp bovis AF2122/97
ucgugcaaugcuuccagcauca

SEQ ID NO: 3170753 - RNA, 16 nt, Mycobacterium bovis subsp bovis AF2122/97
ucgugcaccgcgaccg

SEQ ID NO: 3170754 - RNA, 18 nt, Mycobacterium bovis subsp bovis AF2122/97
ucgugcaccgcgaccgcg

SEQ ID NO: 3170755 - RNA, 20 nt, Mycobacterium bovis subsp bovis AF2122/97
ucgugcaccgcgaccgcgca

SEQ ID NO: 3170756 - RNA, 14 nt, Mycobacterium bovis subsp bovis AF2122/97
ucgugcaccgucgg

SEQ ID NO: 3170757 - RNA, 19 nt, Mycobacterium bovis subsp bovis AF2122/97
ucgugcacggcggccaggg

SEQ ID NO: 3170758 - RNA, 22 nt, Mycobacterium bovis subsp bovis AF2122/97
ucgugcagcacuuccaagccga

SEQ ID NO: 3170759 - RNA, 16 nt, Mycobacterium bovis subsp bovis AF2122/97
ucgugcaggaccagca

SEQ ID NO: 3170760 - RNA, 16 nt, Mycobacterium bovis subsp bovis AF2122/97
ucgugcaggcgacggc

SEQ ID NO: 3170761 - RNA, 11 nt, Mycobacterium bovis subsp bovis AF2122/97
ucgugccaccg

SEQ ID NO: 3170762 - RNA, 15 nt, Mycobacterium bovis subsp bovis AF2122/97
ucgugccccggcgcg

SEQ ID NO: 3170763 - RNA, 14 nt, Mycobacterium bovis subsp bovis AF2122/97
ucgugcccgggacc

SEQ ID NO: 3170764 - RNA, 17 nt, Mycobacterium bovis subsp bovis AF2122/97
ucgugcccgggcggucg

SEQ ID NO: 3170765 - RNA, 22 nt, Mycobacterium bovis subsp bovis AF2122/97
ucgugcccuguccggcgccgag

SEQ ID NO: 3170766 - RNA, 16 nt, Mycobacterium bovis subsp bovis AF2122/97
ucgugccggcguugcc

SEQ ID NO: 3170767 - RNA, 13 nt, Mycobacterium bovis subsp bovis AF2122/97
ucgugccgggacc

SEQ ID NO: 3170768 - RNA, 19 nt, Mycobacterium bovis subsp bovis AF2122/97
ucgugccggggcugccgaa

SEQ ID NO: 3170769 - RNA, 23 nt, Mycobacterium bovis subsp bovis AF2122/97
ucgugcgacaacacgaccucuug

SEQ ID NO: 3170770 - RNA, 21 nt, Mycobacterium bovis subsp bovis AF2122/97
ucgugcgacgcaggaucacac

SEQ ID NO: 3170771 - RNA, 19 nt, Mycobacterium bovis subsp bovis AF2122/97
ucgugcgauucacacucgg

SEQ ID NO: 3170772 - RNA, 23 nt, Mycobacterium bovis subsp bovis AF2122/97
ucgugcgcuuggucgaccgccga

SEQ ID NO: 3170773 - RNA, 15 nt, Mycobacterium bovis subsp bovis AF2122/97
ucgugcggcacuccc

SEQ ID NO: 3170774 - RNA, 17 nt, Mycobacterium bovis subsp bovis AF2122/97
ucgugcgugggcgcggc

SEQ ID NO: 3170775 - RNA, 22 nt, Mycobacterium bovis subsp bovis AF2122/97
ucgugcuggugguaucggcgug

SEQ ID NO: 3170776 - RNA, 23 nt, Mycobacterium bovis subsp bovis AF2122/97
ucguggagauacauuucccaguc

SEQ ID NO: 3170777 - RNA, 17 nt, Mycobacterium bovis subsp bovis AF2122/97
ucguggagccggccgug

SEQ ID NO: 3170778 - RNA, 12 nt, Mycobacterium bovis subsp bovis AF2122/97
ucguggagcuca

SEQ ID NO: 3170779 - RNA, 21 nt, Mycobacterium bovis subsp bovis AF2122/97
ucguggauccagccaugcggu

SEQ ID NO: 3170780 - RNA, 15 nt, Mycobacterium bovis subsp bovis AF2122/97
ucguggaucugccuc

SEQ ID NO: 3170781 - RNA, 16 nt, Mycobacterium bovis subsp bovis AF2122/97
ucguggaucugccucu

SEQ ID NO: 3170782 - RNA, 20 nt, Mycobacterium bovis subsp bovis AF2122/97
ucguggaucuucgcgcugua

SEQ ID NO: 3170783 - RNA, 21 nt, Mycobacterium bovis subsp bovis AF2122/97
ucguggcgacggcgucgauga

SEQ ID NO: 3170784 - RNA, 22 nt, Mycobacterium bovis subsp bovis AF2122/97
ucguggcgacggcgucgaugac

SEQ ID NO: 3170785 - RNA, 22 nt, Mycobacterium bovis subsp bovis AF2122/97
ucguggcgccgccccauacuug

SEQ ID NO: 3170786 - RNA, 14 nt, Mycobacterium bovis subsp bovis AF2122/97
ucguggcgcgccgc

SEQ ID NO: 3170787 - RNA, 21 nt, Mycobacterium bovis subsp bovis AF2122/97
ucguggcgcgccgcaucggcg

SEQ ID NO: 3170788 - RNA, 14 nt, Mycobacterium bovis subsp bovis AF2122/97
ucguggcggcgucg

SEQ ID NO: 3170789 - RNA, 15 nt, Mycobacterium bovis subsp bovis AF2122/97
ucguggcgucgugcg

SEQ ID NO: 3170790 - RNA, 21 nt, Mycobacterium bovis subsp bovis AF2122/97
ucguggcuggcaugccggcgu

SEQ ID NO: 3170791 - RNA, 14 nt, Mycobacterium bovis subsp bovis AF2122/97
ucguggcuuccggu

SEQ ID NO: 3170792 - RNA, 20 nt, Mycobacterium bovis subsp bovis AF2122/97
ucguggcuuccggugguguc

SEQ ID NO: 3170793 - RNA, 16 nt, Mycobacterium bovis subsp bovis AF2122/97
ucgugggaaccaccag

SEQ ID NO: 3170794 - RNA, 14 nt, Mycobacterium bovis subsp bovis AF2122/97
ucgugggcgacgag

SEQ ID NO: 3170795 - RNA, 15 nt, Mycobacterium bovis subsp bovis AF2122/97
ucguggggaccggca

SEQ ID NO: 3170796 - RNA, 14 nt, Mycobacterium bovis subsp bovis AF2122/97
ucguggggaucgac

SEQ ID NO: 3170797 - RNA, 14 nt, Mycobacterium bovis subsp bovis AF2122/97
ucgugggugccggc

SEQ ID NO: 3170798 - RNA, 13 nt, Mycobacterium bovis subsp bovis AF2122/97
ucguggucgacgu

SEQ ID NO: 3170799 - RNA, 15 nt, Mycobacterium bovis subsp bovis AF2122/97
ucguggucgacguga

SEQ ID NO: 3170800 - RNA, 22 nt, Mycobacterium bovis subsp bovis AF2122/97
ucguggugagaucaugagguga

SEQ ID NO: 3170801 - RNA, 17 nt, Mycobacterium bovis subsp bovis AF2122/97
ucgugguucggcgucga

SEQ ID NO: 3170802 - RNA, 20 nt, Mycobacterium bovis subsp bovis AF2122/97
ucgugguucggcgucgaccc

SEQ ID NO: 3170803 - RNA, 20 nt, Mycobacterium bovis subsp bovis AF2122/97
ucguguccaccggaccgacc

SEQ ID NO: 3170804 - RNA, 13 nt, Mycobacterium bovis subsp bovis AF2122/97
ucgugucggugcg

SEQ ID NO: 3170805 - RNA, 21 nt, Mycobacterium bovis subsp bovis AF2122/97
ucgugugaggccuucgccgac

SEQ ID NO: 3170806 - RNA, 22 nt, Mycobacterium bovis subsp bovis AF2122/97
ucguuaccacauaccccgaaca

SEQ ID NO: 3170807 - RNA, 14 nt, Mycobacterium bovis subsp bovis AF2122/97
ucguuagcggcggg

SEQ ID NO: 3170808 - RNA, 22 nt, Mycobacterium bovis subsp bovis AF2122/97
ucguuaucgacaccaccauucc

SEQ ID NO: 3170809 - RNA, 16 nt, Mycobacterium bovis subsp bovis AF2122/97
ucguuaucgaccgccg

SEQ ID NO: 3170810 - RNA, 12 nt, Mycobacterium bovis subsp bovis AF2122/97
ucguucaauguc

SEQ ID NO: 3170811 - RNA, 18 nt, Mycobacterium bovis subsp bovis AF2122/97
ucguucagcgccagcgcc

SEQ ID NO: 3170812 - RNA, 12 nt, Mycobacterium bovis subsp bovis AF2122/97
ucguuccgccgc

SEQ ID NO: 3170813 - RNA, 17 nt, Mycobacterium bovis subsp bovis AF2122/97
ucguuccgcuggacgga

SEQ ID NO: 3170814 - RNA, 19 nt, Mycobacterium bovis subsp bovis AF2122/97
ucguuccgcuggacggauc

SEQ ID NO: 3170815 - RNA, 19 nt, Mycobacterium bovis subsp bovis AF2122/97
ucguucgcgggugcgcugc

SEQ ID NO: 3170816 - RNA, 18 nt, Mycobacterium bovis subsp bovis AF2122/97
ucguucgcgucacaccag

SEQ ID NO: 3170817 - RNA, 15 nt, Mycobacterium bovis subsp bovis AF2122/97
ucguucgugcagccc

SEQ ID NO: 3170818 - RNA, 23 nt, Mycobacterium bovis subsp bovis AF2122/97
ucguugaccagaaccuggagccg

SEQ ID NO: 3170819 - RNA, 16 nt, Mycobacterium bovis subsp bovis AF2122/97
ucguugaccggccgga

SEQ ID NO: 3170820 - RNA, 21 nt, Mycobacterium bovis subsp bovis AF2122/97
ucguugaccgggucgccgaug

SEQ ID NO: 3170821 - RNA, 15 nt, Mycobacterium bovis subsp bovis AF2122/97
ucguugaggccggug

SEQ ID NO: 3170822 - RNA, 16 nt, Mycobacterium bovis subsp bovis AF2122/97
ucguugaggccgguga

SEQ ID NO: 3170823 - RNA, 19 nt, Mycobacterium bovis subsp bovis AF2122/97
ucguugaggccggugaacg

SEQ ID NO: 3170824 - RNA, 22 nt, Mycobacterium bovis subsp bovis AF2122/97
ucguugaggccggugaacggca

SEQ ID NO: 3170825 - RNA, 20 nt, Mycobacterium bovis subsp bovis AF2122/97
ucguugagguauucgaaggg

SEQ ID NO: 3170826 - RNA, 17 nt, Mycobacterium bovis subsp bovis AF2122/97
ucucgaaagccgcggcc

SEQ ID NO: 3170827 - RNA, 18 nt, Mycobacterium bovis subsp bovis AF2122/97
ucucgaaagccgcggccg

SEQ ID NO: 3170828 - RNA, 13 nt, Mycobacterium bovis subsp bovis AF2122/97
ucucgaccagcgc

SEQ ID NO: 3170829 - RNA, 19 nt, Mycobacterium bovis subsp bovis AF2122/97
ucucgaccguauugaccag

SEQ ID NO: 3170830 - RNA, 21 nt, Mycobacterium bovis subsp bovis AF2122/97
ucucgaccucagacagcugca

SEQ ID NO: 3170831 - RNA, 17 nt, Mycobacterium bovis subsp bovis AF2122/97
ucucgacggugaccgga

SEQ ID NO: 3170832 - RNA, 13 nt, Mycobacterium bovis subsp bovis AF2122/97
ucucgagccgcgg

SEQ ID NO: 3170833 - RNA, 14 nt, Mycobacterium bovis subsp bovis AF2122/97
ucucgagcgcgccg

SEQ ID NO: 3170834 - RNA, 14 nt, Mycobacterium bovis subsp bovis AF2122/97
ucucgaguccaggc

SEQ ID NO: 3170835 - RNA, 15 nt, Mycobacterium bovis subsp bovis AF2122/97
ucucgaguccaggca

SEQ ID NO: 3170836 - RNA, 13 nt, Mycobacterium bovis subsp bovis AF2122/97
ucucgaucaccuc

SEQ ID NO: 3170837 - RNA, 17 nt, Mycobacterium bovis subsp bovis AF2122/97
ucucgaucaccucgcgg

SEQ ID NO: 3170838 - RNA, 19 nt, Mycobacterium bovis subsp bovis AF2122/97
ucucgaucggcgcaaucaa

SEQ ID NO: 3170839 - RNA, 21 nt, Mycobacterium bovis subsp bovis AF2122/97
ucucgaucggcgcaaucaacg

SEQ ID NO: 3170840 - RNA, 21 nt, Mycobacterium bovis subsp bovis AF2122/97
ucucgaucuggucaagacccg

SEQ ID NO: 3170841 - RNA, 17 nt, Mycobacterium bovis subsp bovis AF2122/97
ucucgauugucgccgcg

SEQ ID NO: 3170842 - RNA, 13 nt, Mycobacterium bovis subsp bovis AF2122/97
ucucgcaccgcgc

SEQ ID NO: 3170843 - RNA, 13 nt, Mycobacterium bovis subsp bovis AF2122/97
ucucgcaccgcgu

SEQ ID NO: 3170844 - RNA, 16 nt, Mycobacterium bovis subsp bovis AF2122/97
ucucgcagcaacggcg

SEQ ID NO: 3170845 - RNA, 23 nt, Mycobacterium bovis subsp bovis AF2122/97
ucucgcagcauguccgcagcggu

SEQ ID NO: 3170846 - RNA, 21 nt, Mycobacterium bovis subsp bovis AF2122/97
ucucgcagcuccucgcccaga

SEQ ID NO: 3170847 - RNA, 14 nt, Mycobacterium bovis subsp bovis AF2122/97
ucucgcccacccgc

SEQ ID NO: 3170848 - RNA, 17 nt, Mycobacterium bovis subsp bovis AF2122/97
ucucgcccagcgagcgc

SEQ ID NO: 3170849 - RNA, 18 nt, Mycobacterium bovis subsp bovis AF2122/97
ucucgcccagcgagcgcc

SEQ ID NO: 3170850 - RNA, 19 nt, Mycobacterium bovis subsp bovis AF2122/97
ucucgcccccagugcacgc

SEQ ID NO: 3170851 - RNA, 20 nt, Mycobacterium bovis subsp bovis AF2122/97
ucucgccgaccuuggcgucg

SEQ ID NO: 3170852 - RNA, 12 nt, Mycobacterium bovis subsp bovis AF2122/97
ucucgccgccag

SEQ ID NO: 3170853 - RNA, 20 nt, Mycobacterium bovis subsp bovis AF2122/97
ucucgccgggaaacaccggc

SEQ ID NO: 3170854 - RNA, 20 nt, Mycobacterium bovis subsp bovis AF2122/97
ucucgcgaagaucagcggau

SEQ ID NO: 3170855 - RNA, 14 nt, Mycobacterium bovis subsp bovis AF2122/97
ucucgcgcgcggcg

SEQ ID NO: 3170856 - RNA, 17 nt, Mycobacterium bovis subsp bovis AF2122/97
ucucgcgcgcggcgacg

SEQ ID NO: 3170857 - RNA, 23 nt, Mycobacterium bovis subsp bovis AF2122/97
ucucgcgcgcggcgacgacggcc

SEQ ID NO: 3170858 - RNA, 21 nt, Mycobacterium bovis subsp bovis AF2122/97
ucucggaaacggaccuccucg

SEQ ID NO: 3170859 - RNA, 23 nt, Mycobacterium bovis subsp bovis AF2122/97
ucucggaccacaucuggucacgg

SEQ ID NO: 3170860 - RNA, 13 nt, Mycobacterium bovis subsp bovis AF2122/97
ucucggcaccaca

SEQ ID NO: 3170861 - RNA, 14 nt, Mycobacterium bovis subsp bovis AF2122/97
ucucggcaccacag

SEQ ID NO: 3170862 - RNA, 12 nt, Mycobacterium bovis subsp bovis AF2122/97
ucucggccggcg

SEQ ID NO: 3170863 - RNA, 17 nt, Mycobacterium bovis subsp bovis AF2122/97
ucucggcgcagccggug

SEQ ID NO: 3170864 - RNA, 21 nt, Mycobacterium bovis subsp bovis AF2122/97
ucucggcguacucgugcaccg

SEQ ID NO: 3170865 - RNA, 18 nt, Mycobacterium bovis subsp bovis AF2122/97
ucucggcgucgaccaguu

SEQ ID NO: 3170866 - RNA, 16 nt, Mycobacterium bovis subsp bovis AF2122/97
ucucggcguugccgcc

SEQ ID NO: 3170867 - RNA, 19 nt, Mycobacterium bovis subsp bovis AF2122/97
ucucggcguugccgccguu

SEQ ID NO: 3170868 - RNA, 17 nt, Mycobacterium bovis subsp bovis AF2122/97
ucucggcuacgccucgg

SEQ ID NO: 3170869 - RNA, 16 nt, Mycobacterium bovis subsp bovis AF2122/97
ucucgggggccgagcc

SEQ ID NO: 3170870 - RNA, 22 nt, Mycobacterium bovis subsp bovis AF2122/97
ucucgguaccaccggcacggug

SEQ ID NO: 3170871 - RNA, 15 nt, Mycobacterium bovis subsp bovis AF2122/97
ucucggucagcccca

SEQ ID NO: 3170872 - RNA, 13 nt, Mycobacterium bovis subsp bovis AF2122/97
ucucggucccgcc

SEQ ID NO: 3170873 - RNA, 14 nt, Mycobacterium bovis subsp bovis AF2122/97
ucucggucugcaug

SEQ ID NO: 3170874 - RNA, 17 nt, Mycobacterium bovis subsp bovis AF2122/97
ucucggugcagcagcgc

SEQ ID NO: 3170875 - RNA, 17 nt, Mycobacterium bovis subsp bovis AF2122/97
ucucggugcgcagcugc

SEQ ID NO: 3170876 - RNA, 12 nt, Mycobacterium bovis subsp bovis AF2122/97
ucucggugcugg

SEQ ID NO: 3170877 - RNA, 14 nt, Mycobacterium bovis subsp bovis AF2122/97
ucucgguggugagu

SEQ ID NO: 3170878 - RNA, 17 nt, Mycobacterium bovis subsp bovis AF2122/97
ucucgguggugcgcucg

SEQ ID NO: 3170879 - RNA, 19 nt, Mycobacterium bovis subsp bovis AF2122/97
ucucgucggguaccacgcu

SEQ ID NO: 3170880 - RNA, 17 nt, Mycobacterium bovis subsp bovis AF2122/97
ucucgucgucgcggccg

SEQ ID NO: 3170881 - RNA, 18 nt, Mycobacterium bovis subsp bovis AF2122/97
ucucguggauggccgcca

SEQ ID NO: 3170882 - RNA, 18 nt, Mycobacterium bovis subsp bovis AF2122/97
ucucguuggugccuucac

SEQ ID NO: 3170883 - RNA, 21 nt, Mycobacterium bovis subsp bovis AF2122/97
ucucguuugcuuucagcagga

SEQ ID NO: 3170884 - RNA, 13 nt, Mycobacterium bovis subsp bovis AF2122/97
ucucucuuggugc

SEQ ID NO: 3170885 - RNA, 17 nt, Mycobacterium bovis subsp bovis AF2122/97
ucucuucccaaccgccc

SEQ ID NO: 3170886 - RNA, 20 nt, Mycobacterium bovis subsp bovis AF2122/97
ucucuucgcgcgcugggcgc

SEQ ID NO: 3170887 - RNA, 18 nt, Mycobacterium bovis subsp bovis AF2122/97
ucugaaaauugacccccu

SEQ ID NO: 3170888 - RNA, 19 nt, Mycobacterium bovis subsp bovis AF2122/97
ucugaagagcggagccggc

SEQ ID NO: 3170889 - RNA, 11 nt, Mycobacterium bovis subsp bovis AF2122/97
ucugaagcccg

SEQ ID NO: 3170890 - RNA, 20 nt, Mycobacterium bovis subsp bovis AF2122/97
ucugacagaccgggcaccag

SEQ ID NO: 3170891 - RNA, 16 nt, Mycobacterium bovis subsp bovis AF2122/97
ucugaccccccgaccc

SEQ ID NO: 3170892 - RNA, 18 nt, Mycobacterium bovis subsp bovis AF2122/97
ucugaccgguucccgggc

SEQ ID NO: 3170893 - RNA, 20 nt, Mycobacterium bovis subsp bovis AF2122/97
ucugacgaaauccgccgggc

SEQ ID NO: 3170894 - RNA, 19 nt, Mycobacterium bovis subsp bovis AF2122/97
ucugagacugccgccgcuu

SEQ ID NO: 3170895 - RNA, 21 nt, Mycobacterium bovis subsp bovis AF2122/97
ucugagcgcggguggcagcgg

SEQ ID NO: 3170896 - RNA, 20 nt, Mycobacterium bovis subsp bovis AF2122/97
ucugaggcuuccagcucggg

SEQ ID NO: 3170897 - RNA, 21 nt, Mycobacterium bovis subsp bovis AF2122/97
ucugauccggugccgcgaucg

SEQ ID NO: 3170898 - RNA, 13 nt, Mycobacterium bovis subsp bovis AF2122/97
ucugaucggcgcg

SEQ ID NO: 3170899 - RNA, 22 nt, Mycobacterium bovis subsp bovis AF2122/97
ucugaucuguguuugcggcuuc

SEQ ID NO: 3170900 - RNA, 15 nt, Mycobacterium bovis subsp bovis AF2122/97
ucugcaaugccucga

SEQ ID NO: 3170901 - RNA, 18 nt, Mycobacterium bovis subsp bovis AF2122/97
ucugcacauucagcgccg

SEQ ID NO: 3170902 - RNA, 22 nt, Mycobacterium bovis subsp bovis AF2122/97
ucugcacguugauccgcgcaac

SEQ ID NO: 3170903 - RNA, 13 nt, Mycobacterium bovis subsp bovis AF2122/97
ucugcagcacgcg

SEQ ID NO: 3170904 - RNA, 18 nt, Mycobacterium bovis subsp bovis AF2122/97
ucugcagcgucuccuuga

SEQ ID NO: 3170905 - RNA, 19 nt, Mycobacterium bovis subsp bovis AF2122/97
ucugcagcgucuccuugag

SEQ ID NO: 3170906 - RNA, 17 nt, Mycobacterium bovis subsp bovis AF2122/97
ucugcaggcccaggcug

SEQ ID NO: 3170907 - RNA, 23 nt, Mycobacterium bovis subsp bovis AF2122/97
ucugccacguugaucccgaaccg

SEQ ID NO: 3170908 - RNA, 17 nt, Mycobacterium bovis subsp bovis AF2122/97
ucugccagcacccugau

SEQ ID NO: 3170909 - RNA, 23 nt, Mycobacterium bovis subsp bovis AF2122/97
ucugccgccgcggccacaaccuc

SEQ ID NO: 3170910 - RNA, 14 nt, Mycobacterium bovis subsp bovis AF2122/97
ucugccgggagacg

SEQ ID NO: 3170911 - RNA, 23 nt, Mycobacterium bovis subsp bovis AF2122/97
ucugccucucagcacgguuguug

SEQ ID NO: 3170912 - RNA, 14 nt, Mycobacterium bovis subsp bovis AF2122/97
ucugccuuaccaac

SEQ ID NO: 3170913 - RNA, 21 nt, Mycobacterium bovis subsp bovis AF2122/97
ucuucgccgucacgcacgccg

SEQ ID NO: 3170914 - RNA, 17 nt, Mycobacterium bovis subsp bovis AF2122/97
ucuucgcgauguccucg

SEQ ID NO: 3170915 - RNA, 16 nt, Mycobacterium bovis subsp bovis AF2122/97
ucuucgcuaccuucuu

SEQ ID NO: 3170916 - RNA, 18 nt, Mycobacterium bovis subsp bovis AF2122/97
ucuucgcuaccuucuugg

SEQ ID NO: 3170917 - RNA, 21 nt, Mycobacterium bovis subsp bovis AF2122/97
ucuucggcaccaccgcgaccu

SEQ ID NO: 3170918 - RNA, 15 nt, Mycobacterium bovis subsp bovis AF2122/97
ucuucggccagcucc

SEQ ID NO: 3170919 - RNA, 19 nt, Mycobacterium bovis subsp bovis AF2122/97
ucuucggcggugcccagca

SEQ ID NO: 3170920 - RNA, 19 nt, Mycobacterium bovis subsp bovis AF2122/97
ucuucgggcucguccagca

SEQ ID NO: 3170921 - RNA, 21 nt, Mycobacterium bovis subsp bovis AF2122/97
ucuucgggcucguccagcaac

SEQ ID NO: 3170922 - RNA, 20 nt, Mycobacterium bovis subsp bovis AF2122/97
ucuucgguuaaggugcgauc

SEQ ID NO: 3170923 - RNA, 12 nt, Mycobacterium bovis subsp bovis AF2122/97
ucuucucggcua

SEQ ID NO: 3170924 - RNA, 14 nt, Mycobacterium bovis subsp bovis AF2122/97
ucuucucggcuacu

SEQ ID NO: 3170925 - RNA, 14 nt, Mycobacterium bovis subsp bovis AF2122/97
ucuucuucuugacc

SEQ ID NO: 3170926 - RNA, 16 nt, Mycobacterium bovis subsp bovis AF2122/97
ucuugaacugggccuc

SEQ ID NO: 3170927 - RNA, 16 nt, Mycobacterium bovis subsp bovis AF2122/97
ucuugcaccagggccu

SEQ ID NO: 3170928 - RNA, 19 nt, Mycobacterium bovis subsp bovis AF2122/97
ucuugcagugcgccagcga

SEQ ID NO: 3170929 - RNA, 13 nt, Mycobacterium bovis subsp bovis AF2122/97
ucuugccaccgcu

SEQ ID NO: 3170930 - RNA, 14 nt, Mycobacterium bovis subsp bovis AF2122/97
ucuugccaccgcug

SEQ ID NO: 3170931 - RNA, 21 nt, Mycobacterium bovis subsp bovis AF2122/97
ucuugcccuucuucgaccgcg

SEQ ID NO: 3170932 - RNA, 19 nt, Mycobacterium bovis subsp bovis AF2122/97
ucuugccgucggccggcaa

SEQ ID NO: 3170933 - RNA, 16 nt, Mycobacterium bovis subsp bovis AF2122/97
ucuugcgacgcccgcc

SEQ ID NO: 3170934 - RNA, 15 nt, Mycobacterium bovis subsp bovis AF2122/97
ucuugcgccacggcg

SEQ ID NO: 3170935 - RNA, 14 nt, Mycobacterium bovis subsp bovis AF2122/97
ucuugcgggcagcc

SEQ ID NO: 3170936 - RNA, 21 nt, Mycobacterium bovis subsp bovis AF2122/97
ucuugcgggcagccgcccgcc

SEQ ID NO: 3170937 - RNA, 15 nt, Mycobacterium bovis subsp bovis AF2122/97
ucuuggacagcagca

SEQ ID NO: 3170938 - RNA, 16 nt, Mycobacterium bovis subsp bovis AF2122/97
ucuuggacagcagcag

SEQ ID NO: 3170939 - RNA, 15 nt, Mycobacterium bovis subsp bovis AF2122/97
ucuuggcacacaggu

SEQ ID NO: 3170940 - RNA, 16 nt, Mycobacterium bovis subsp bovis AF2122/97
ucuuggccagcagcgc

SEQ ID NO: 3170941 - RNA, 19 nt, Mycobacterium bovis subsp bovis AF2122/97
ucuuggcgacaugcagcgc

SEQ ID NO: 3170942 - RNA, 19 nt, Mycobacterium bovis subsp bovis AF2122/97
ucuuggcgaucuccagcgg

SEQ ID NO: 3170943 - RNA, 14 nt, Mycobacterium bovis subsp bovis AF2122/97
ucuuggcgcccgcc

SEQ ID NO: 3170944 - RNA, 15 nt, Mycobacterium bovis subsp bovis AF2122/97
ucuuggcgggagccu

SEQ ID NO: 3170945 - RNA, 23 nt, Mycobacterium bovis subsp bovis AF2122/97
ucuuggcgggagccuugguagcc

SEQ ID NO: 3170946 - RNA, 16 nt, Mycobacterium bovis subsp bovis AF2122/97
ucuuggcgggcgccuu

SEQ ID NO: 3170947 - RNA, 15 nt, Mycobacterium bovis subsp bovis AF2122/97
ucuuggcgggugacu

SEQ ID NO: 3170948 - RNA, 14 nt, Mycobacterium bovis subsp bovis AF2122/97
ucuuggcgguggcc

SEQ ID NO: 3170949 - RNA, 13 nt, Mycobacterium bovis subsp bovis AF2122/97
ucuugggccggga

SEQ ID NO: 3170950 - RNA, 12 nt, Mycobacterium bovis subsp bovis AF2122/97
ucuugggcgcgg

SEQ ID NO: 3170951 - RNA, 18 nt, Mycobacterium bovis subsp bovis AF2122/97
ucuugggcgcgggugcgc

SEQ ID NO: 3170952 - RNA, 19 nt, Mycobacterium bovis subsp bovis AF2122/97
ucuugggggccaaccgggu

SEQ ID NO: 3170953 - RNA, 15 nt, Mycobacterium bovis subsp bovis AF2122/97
ucuuggguuucgucg

SEQ ID NO: 3170954 - RNA, 17 nt, Mycobacterium bovis subsp bovis AF2122/97
ucuuucccgccaccaaa

SEQ ID NO: 3170955 - RNA, 23 nt, Mycobacterium bovis subsp bovis AF2122/97
ucuuucgaaaugaggucuuugcu

SEQ ID NO: 3170956 - RNA, 16 nt, Mycobacterium bovis subsp bovis AF2122/97
ucuuugccggcgccuu

SEQ ID NO: 3170957 - RNA, 23 nt, Mycobacterium bovis subsp bovis AF2122/97
ucuuuggucgccggaccagagcc

SEQ ID NO: 3170958 - RNA, 23 nt, Mycobacterium bovis subsp bovis AF2122/97
ucuuugguuguuggugccagccg

SEQ ID NO: 3170959 - RNA, 14 nt, Mycobacterium bovis subsp bovis AF2122/97
ugaaaaagcaucaa

SEQ ID NO: 3170960 - RNA, 21 nt, Mycobacterium bovis subsp bovis AF2122/97
ugaaaauaggccgggcagugc

SEQ ID NO: 3170961 - RNA, 22 nt, Mycobacterium bovis subsp bovis AF2122/97
ugaaacagucgaccgaggccuc

SEQ ID NO: 3170962 - RNA, 13 nt, Mycobacterium bovis subsp bovis AF2122/97
ugaaacgauggcg

SEQ ID NO: 3170963 - RNA, 16 nt, Mycobacterium bovis subsp bovis AF2122/97
ugaaacguccuugaac

SEQ ID NO: 3170964 - RNA, 15 nt, Mycobacterium bovis subsp bovis AF2122/97
ugaaaguucaugcca

SEQ ID NO: 3170965 - RNA, 18 nt, Mycobacterium bovis subsp bovis AF2122/97
ugaaaucuguugauacac

SEQ ID NO: 3170966 - RNA, 13 nt, Mycobacterium bovis subsp bovis AF2122/97
ugaacaacagcgc

SEQ ID NO: 3170967 - RNA, 16 nt, Mycobacterium bovis subsp bovis AF2122/97
ugaacaccgugggcgg

SEQ ID NO: 3170968 - RNA, 19 nt, Mycobacterium bovis subsp bovis AF2122/97
ugaacacgaauccggccac

SEQ ID NO: 3170969 - RNA, 14 nt, Mycobacterium bovis subsp bovis AF2122/97
ugaacaguugcaca

SEQ ID NO: 3170970 - RNA, 19 nt, Mycobacterium bovis subsp bovis AF2122/97
ugaacauacgaaacaugcg

SEQ ID NO: 3170971 - RNA, 17 nt, Mycobacterium bovis subsp bovis AF2122/97
ugaacaucuggcgacga

SEQ ID NO: 3170972 - RNA, 20 nt, Mycobacterium bovis subsp bovis AF2122/97
ugaaccaccacuucggcgcc

SEQ ID NO: 3170973 - RNA, 22 nt, Mycobacterium bovis subsp bovis AF2122/97
ugaaccaccacuucggcgccgc

SEQ ID NO: 3170974 - RNA, 15 nt, Mycobacterium bovis subsp bovis AF2122/97
ugaaccagaugggug

SEQ ID NO: 3170975 - RNA, 17 nt, Mycobacterium bovis subsp bovis AF2122/97
ugaaccaggcggccgcg

SEQ ID NO: 3170976 - RNA, 23 nt, Mycobacterium bovis subsp bovis AF2122/97
ugaaccgguugacacccgggcca

SEQ ID NO: 3170977 - RNA, 13 nt, Mycobacterium bovis subsp bovis AF2122/97
ugaaccuggcgac

SEQ ID NO: 3170978 - RNA, 18 nt, Mycobacterium bovis subsp bovis AF2122/97
ugaaccuggcgacgcgac

SEQ ID NO: 3170979 - RNA, 16 nt, Mycobacterium bovis subsp bovis AF2122/97
ugaacgaguagccggu

SEQ ID NO: 3170980 - RNA, 18 nt, Mycobacterium bovis subsp bovis AF2122/97
ugaacgcaagcagcgcga

SEQ ID NO: 3170981 - RNA, 23 nt, Mycobacterium bovis subsp bovis AF2122/97
ugaacgcaccaacguugugccgc

SEQ ID NO: 3170982 - RNA, 20 nt, Mycobacterium bovis subsp bovis AF2122/97
ugaacgcauacagcgcccgg

SEQ ID NO: 3170983 - RNA, 22 nt, Mycobacterium bovis subsp bovis AF2122/97
ugaacgcaugcgagaacgucga

SEQ ID NO: 3170984 - RNA, 16 nt, Mycobacterium bovis subsp bovis AF2122/97
ugaacgcccgcuucag

SEQ ID NO: 3170985 - RNA, 17 nt, Mycobacterium bovis subsp bovis AF2122/97
ugaacgcccgcuucagc

SEQ ID NO: 3170986 - RNA, 14 nt, Mycobacterium bovis subsp bovis AF2122/97
ugaacgccgccccg

SEQ ID NO: 3170987 - RNA, 22 nt, Mycobacterium bovis subsp bovis AF2122/97
ugaacgcggacaccgcggcgau

SEQ ID NO: 3170988 - RNA, 20 nt, Mycobacterium bovis subsp bovis AF2122/97
ugaacgcguagucgcgggug

SEQ ID NO: 3170989 - RNA, 17 nt, Mycobacterium bovis subsp bovis AF2122/97
ugaacgcugucccagcc

SEQ ID NO: 3170990 - RNA, 22 nt, Mycobacterium bovis subsp bovis AF2122/97
ugaacggcaacguuuacgaugc

SEQ ID NO: 3170991 - RNA, 20 nt, Mycobacterium bovis subsp bovis AF2122/97
ugaacggcaaggucgcggcc

SEQ ID NO: 3170992 - RNA, 21 nt, Mycobacterium bovis subsp bovis AF2122/97
ugaacggcaaggucgcggcca

SEQ ID NO: 3170993 - RNA, 14 nt, Mycobacterium bovis subsp bovis AF2122/97
ugaacggcaccagc

SEQ ID NO: 3170994 - RNA, 15 nt, Mycobacterium bovis subsp bovis AF2122/97
ugaacggcaccagcg

SEQ ID NO: 3170995 - RNA, 19 nt, Mycobacterium bovis subsp bovis AF2122/97
ugaacguucugcggucggu

SEQ ID NO: 3170996 - RNA, 21 nt, Mycobacterium bovis subsp bovis AF2122/97
ugaacguuuccagcugacggc

SEQ ID NO: 3170997 - RNA, 14 nt, Mycobacterium bovis subsp bovis AF2122/97
ugaacucgaagacc

SEQ ID NO: 3170998 - RNA, 18 nt, Mycobacterium bovis subsp bovis AF2122/97
ugaacucgaguugcucga

SEQ ID NO: 3170999 - RNA, 19 nt, Mycobacterium bovis subsp bovis AF2122/97
ugaccagcaaccaccccag

SEQ ID NO: 3171000 - RNA, 14 nt, Mycobacterium bovis subsp bovis AF2122/97
ugaccagcacaccg

SEQ ID NO: 3171001 - RNA, 20 nt, Mycobacterium bovis subsp bovis AF2122/97
ugaccagcacaccgcccgca

SEQ ID NO: 3171002 - RNA, 15 nt, Mycobacterium bovis subsp bovis AF2122/97
ugaccagcagcucgu

SEQ ID NO: 3171003 - RNA, 18 nt, Mycobacterium bovis subsp bovis AF2122/97
ugaccagccuuaugcagu

SEQ ID NO: 3171004 - RNA, 22 nt, Mycobacterium bovis subsp bovis AF2122/97
ugaccaggaagcagaaguccuc

SEQ ID NO: 3171005 - RNA, 19 nt, Mycobacterium bovis subsp bovis AF2122/97
ugaccaggaaugucuccag

SEQ ID NO: 3171006 - RNA, 21 nt, Mycobacterium bovis subsp bovis AF2122/97
ugaccaggccgagcucguugc

SEQ ID NO: 3171007 - RNA, 16 nt, Mycobacterium bovis subsp bovis AF2122/97
ugaccaggccggcccg

SEQ ID NO: 3171008 - RNA, 18 nt, Mycobacterium bovis subsp bovis AF2122/97
ugaccaggccggcccgca

SEQ ID NO: 3171009 - RNA, 19 nt, Mycobacterium bovis subsp bovis AF2122/97
ugaccaggcggacgccgcg

SEQ ID NO: 3171010 - RNA, 18 nt, Mycobacterium bovis subsp bovis AF2122/97
ugaccaggcuccggccgg

SEQ ID NO: 3171011 - RNA, 23 nt, Mycobacterium bovis subsp bovis AF2122/97
ugaccagggugacggaguuggcc

SEQ ID NO: 3171012 - RNA, 19 nt, Mycobacterium bovis subsp bovis AF2122/97
ugaccaggugcccgccccg

SEQ ID NO: 3171013 - RNA, 17 nt, Mycobacterium bovis subsp bovis AF2122/97
ugaccaucacacccauc

SEQ ID NO: 3171014 - RNA, 20 nt, Mycobacterium bovis subsp bovis AF2122/97
ugaccaucgacccgaucacg

SEQ ID NO: 3171015 - RNA, 23 nt, Mycobacterium bovis subsp bovis AF2122/97
ugaccaucguguacuggucugga

SEQ ID NO: 3171016 - RNA, 16 nt, Mycobacterium bovis subsp bovis AF2122/97
ugaccaugaccgggcu

SEQ ID NO: 3171017 - RNA, 22 nt, Mycobacterium bovis subsp bovis AF2122/97
ugaccaugaugaccggcaauuc

SEQ ID NO: 3171018 - RNA, 23 nt, Mycobacterium bovis subsp bovis AF2122/97
ugacccacauuccguagccggcg

SEQ ID NO: 3171019 - RNA, 23 nt, Mycobacterium bovis subsp bovis AF2122/97
ugacccaccgccccggcggcggc

SEQ ID NO: 3171020 - RNA, 21 nt, Mycobacterium bovis subsp bovis AF2122/97
ugacccacgagagcgcugucc

SEQ ID NO: 3171021 - RNA, 15 nt, Mycobacterium bovis subsp bovis AF2122/97
ugacccacugcaggc

SEQ ID NO: 3171022 - RNA, 22 nt, Mycobacterium bovis subsp bovis AF2122/97
ugacccauacgaacucaccgcc

SEQ ID NO: 3171023 - RNA, 22 nt, Mycobacterium bovis subsp bovis AF2122/97
ugacccaucaugguccgggccu

SEQ ID NO: 3171024 - RNA, 17 nt, Mycobacterium bovis subsp bovis AF2122/97
ugacccaucucgucguc

SEQ ID NO: 3171025 - RNA, 16 nt, Mycobacterium bovis subsp bovis AF2122/97
ugacccauucucggcc

SEQ ID NO: 3171026 - RNA, 13 nt, Mycobacterium bovis subsp bovis AF2122/97
ugacccccagcag

SEQ ID NO: 3171027 - RNA, 18 nt, Mycobacterium bovis subsp bovis AF2122/97
ugacccccagcagggugu

SEQ ID NO: 3171028 - RNA, 13 nt, Mycobacterium bovis subsp bovis AF2122/97
ugaccccccgacc

SEQ ID NO: 3171029 - RNA, 14 nt, Mycobacterium bovis subsp bovis AF2122/97
ugacccccuagacc

SEQ ID NO: 3171030 - RNA, 18 nt, Mycobacterium bovis subsp bovis AF2122/97
ugaccccggcguugccgc

SEQ ID NO: 3171031 - RNA, 18 nt, Mycobacterium bovis subsp bovis AF2122/97
ugaccccguaggcgccga

SEQ ID NO: 3171032 - RNA, 15 nt, Mycobacterium bovis subsp bovis AF2122/97
ugaccccuggccgcc

SEQ ID NO: 3171033 - RNA, 21 nt, Mycobacterium bovis subsp bovis AF2122/97
ugacccgacgaugccggcccg

SEQ ID NO: 3171034 - RNA, 18 nt, Mycobacterium bovis subsp bovis AF2122/97
ugacccggauaucgacca

SEQ ID NO: 3171035 - RNA, 15 nt, Mycobacterium bovis subsp bovis AF2122/97
ugacccggcagcccg

SEQ ID NO: 3171036 - RNA, 21 nt, Mycobacterium bovis subsp bovis AF2122/97
ugacccguacccacgacgggc

SEQ ID NO: 3171037 - RNA, 19 nt, Mycobacterium bovis subsp bovis AF2122/97
ugacccguucagcgacggc

SEQ ID NO: 3171038 - RNA, 19 nt, Mycobacterium bovis subsp bovis AF2122/97
ugacccguuccacgccggc

SEQ ID NO: 3171039 - RNA, 15 nt, Mycobacterium bovis subsp bovis AF2122/97
ugacccucagcaccg

SEQ ID NO: 3171040 - RNA, 23 nt, Mycobacterium bovis subsp bovis AF2122/97
ugacccucgggucgucgcgaucc

SEQ ID NO: 3171041 - RNA, 12 nt, Mycobacterium bovis subsp bovis AF2122/97
ugacccuggggu

SEQ ID NO: 3171042 - RNA, 18 nt, Mycobacterium bovis subsp bovis AF2122/97
ugaccgaacgcacgucga

SEQ ID NO: 3171043 - RNA, 14 nt, Mycobacterium bovis subsp bovis AF2122/97
ugaccgaagaagcc

SEQ ID NO: 3171044 - RNA, 17 nt, Mycobacterium bovis subsp bovis AF2122/97
ugaccgaagucugcaga

SEQ ID NO: 3171045 - RNA, 21 nt, Mycobacterium bovis subsp bovis AF2122/97
ugaccgaagucugcagacggu

SEQ ID NO: 3171046 - RNA, 15 nt, Mycobacterium bovis subsp bovis AF2122/97
ugaccgaccacgcga

SEQ ID NO: 3171047 - RNA, 14 nt, Mycobacterium bovis subsp bovis AF2122/97
ugaccgaccgccau

SEQ ID NO: 3171048 - RNA, 13 nt, Mycobacterium bovis subsp bovis AF2122/97
ugaccgacgccgu

SEQ ID NO: 3171049 - RNA, 14 nt, Mycobacterium bovis subsp bovis AF2122/97
ugaccgacgccguc

SEQ ID NO: 3171050 - RNA, 16 nt, Mycobacterium bovis subsp bovis AF2122/97
ugaccgacgccgucga

SEQ ID NO: 3171051 - RNA, 13 nt, Mycobacterium bovis subsp bovis AF2122/97
ugaccgagccgcg

SEQ ID NO: 3171052 - RNA, 21 nt, Mycobacterium bovis subsp bovis AF2122/97
ugaccgcaaccgguaucgccg

SEQ ID NO: 3171053 - RNA, 18 nt, Mycobacterium bovis subsp bovis AF2122/97
ugaccgcaccggccgcua

SEQ ID NO: 3171054 - RNA, 19 nt, Mycobacterium bovis subsp bovis AF2122/97
ugaccgcaccggccgcuau

SEQ ID NO: 3171055 - RNA, 18 nt, Mycobacterium bovis subsp bovis AF2122/97
ugaccgcaucgucgagcc

SEQ ID NO: 3171056 - RNA, 20 nt, Mycobacterium bovis subsp bovis AF2122/97
ugaccgcaucgucgagccac

SEQ ID NO: 3171057 - RNA, 23 nt, Mycobacterium bovis subsp bovis AF2122/97
ugaccgccaccgucauggcgggu

SEQ ID NO: 3171058 - RNA, 13 nt, Mycobacterium bovis subsp bovis AF2122/97
ugaccgccagcag

SEQ ID NO: 3171059 - RNA, 15 nt, Mycobacterium bovis subsp bovis AF2122/97
ugaccgccagcagca

SEQ ID NO: 3171060 - RNA, 19 nt, Mycobacterium bovis subsp bovis AF2122/97
ugaccgccaucgccaacac

SEQ ID NO: 3171061 - RNA, 18 nt, Mycobacterium bovis subsp bovis AF2122/97
ugaccgccgaugcccgac

SEQ ID NO: 3171062 - RNA, 14 nt, Mycobacterium bovis subsp bovis AF2122/97
ugaccgccgcgccg

SEQ ID NO: 3171063 - RNA, 17 nt, Mycobacterium bovis subsp bovis AF2122/97
ugaccgccgcgccggca

SEQ ID NO: 3171064 - RNA, 21 nt, Mycobacterium bovis subsp bovis AF2122/97
ugaccgccguugucgaccucc

SEQ ID NO: 3171065 - RNA, 19 nt, Mycobacterium bovis subsp bovis AF2122/97
ugaccgccugcuggccgcg

SEQ ID NO: 3171066 - RNA, 14 nt, Mycobacterium bovis subsp bovis AF2122/97
ugaccgcgaugauc

SEQ ID NO: 3171067 - RNA, 20 nt, Mycobacterium bovis subsp bovis AF2122/97
ugaccgcgaugaucgcaucg

SEQ ID NO: 3171068 - RNA, 15 nt, Mycobacterium bovis subsp bovis AF2122/97
ugaccgcgccggaca

SEQ ID NO: 3171069 - RNA, 22 nt, Mycobacterium bovis subsp bovis AF2122/97
ugaccgcggccgcuuggcguau

SEQ ID NO: 3171070 - RNA, 18 nt, Mycobacterium bovis subsp bovis AF2122/97
ugaccgcggucugcgcgu

SEQ ID NO: 3171071 - RNA, 19 nt, Mycobacterium bovis subsp bovis AF2122/97
ugaccgcggucuucuucac

SEQ ID NO: 3171072 - RNA, 19 nt, Mycobacterium bovis subsp bovis AF2122/97
ugaccgcggugacucggcc

SEQ ID NO: 3171073 - RNA, 17 nt, Mycobacterium bovis subsp bovis AF2122/97
ugaccgcguagaccagu

SEQ ID NO: 3171074 - RNA, 17 nt, Mycobacterium bovis subsp bovis AF2122/97
ugaccgcguccacggga

SEQ ID NO: 3171075 - RNA, 13 nt, Mycobacterium bovis subsp bovis AF2122/97
ugaccgcugccca

SEQ ID NO: 3171076 - RNA, 15 nt, Mycobacterium bovis subsp bovis AF2122/97
ugaccgcugcccagu

SEQ ID NO: 3171077 - RNA, 17 nt, Mycobacterium bovis subsp bovis AF2122/97
ugaccgcuugcccgcgc

SEQ ID NO: 3171078 - RNA, 15 nt, Mycobacterium bovis subsp bovis AF2122/97
ugaccggcaaccgcc

SEQ ID NO: 3171079 - RNA, 17 nt, Mycobacterium bovis subsp bovis AF2122/97
ugaccggcaaugccacg

SEQ ID NO: 3171080 - RNA, 16 nt, Mycobacterium bovis subsp bovis AF2122/97
ugaccggccgccaacu

SEQ ID NO: 3171081 - RNA, 24 nt, Mycobacterium bovis subsp bovis AF2122/97
ugaccggcgauuccaccuuggcca

SEQ ID NO: 3171082 - RNA, 17 nt, Mycobacterium bovis subsp bovis AF2122/97
ugaccggcucgccggcg

SEQ ID NO: 3171083 - RNA, 15 nt, Mycobacterium bovis subsp bovis AF2122/97
ugaccggcucggcgg

SEQ ID NO: 3171084 - RNA, 20 nt, Mycobacterium bovis subsp bovis AF2122/97
ugaccgggaggcggcgccgc

SEQ ID NO: 3171085 - RNA, 21 nt, Mycobacterium bovis subsp bovis AF2122/97
ugacgcggccacauaccacca

SEQ ID NO: 3171086 - RNA, 12 nt, Mycobacterium bovis subsp bovis AF2122/97
ugacgcggccgg

SEQ ID NO: 3171087 - RNA, 18 nt, Mycobacterium bovis subsp bovis AF2122/97
ugacgcgucagcggcgag

SEQ ID NO: 3171088 - RNA, 19 nt, Mycobacterium bovis subsp bovis AF2122/97
ugacgcgucagcggcgagc

SEQ ID NO: 3171089 - RNA, 23 nt, Mycobacterium bovis subsp bovis AF2122/97
ugacgcguucaacaccgccgacc

SEQ ID NO: 3171090 - RNA, 17 nt, Mycobacterium bovis subsp bovis AF2122/97
ugacgcucggucgccac

SEQ ID NO: 3171091 - RNA, 14 nt, Mycobacterium bovis subsp bovis AF2122/97
ugacgcuuggccaa

SEQ ID NO: 3171092 - RNA, 11 nt, Mycobacterium bovis subsp bovis AF2122/97
ugacggcggca

SEQ ID NO: 3171093 - RNA, 16 nt, Mycobacterium bovis subsp bovis AF2122/97
ugacggcggcaacggc

SEQ ID NO: 3171094 - RNA, 17 nt, Mycobacterium bovis subsp bovis AF2122/97
ugacggcggcugucggc

SEQ ID NO: 3171095 - RNA, 23 nt, Mycobacterium bovis subsp bovis AF2122/97
ugacggcgucgaccucgcgggcg

SEQ ID NO: 3171096 - RNA, 22 nt, Mycobacterium bovis subsp bovis AF2122/97
ugacggcuuccaacucggcggc

SEQ ID NO: 3171097 - RNA, 23 nt, Mycobacterium bovis subsp bovis AF2122/97
ugacggcuuccaacucggcggcc

SEQ ID NO: 3171098 - RNA, 20 nt, Mycobacterium bovis subsp bovis AF2122/97
ugacggcuucggcagccgca

SEQ ID NO: 3171099 - RNA, 21 nt, Mycobacterium bovis subsp bovis AF2122/97
ugacggcuucggcagccgcau

SEQ ID NO: 3171100 - RNA, 20 nt, Mycobacterium bovis subsp bovis AF2122/97
ugacgggaaacuccgcggcg

SEQ ID NO: 3171101 - RNA, 16 nt, Mycobacterium bovis subsp bovis AF2122/97
ugacgggcagaggcug

SEQ ID NO: 3171102 - RNA, 13 nt, Mycobacterium bovis subsp bovis AF2122/97
ugacgggccgcug

SEQ ID NO: 3171103 - RNA, 19 nt, Mycobacterium bovis subsp bovis AF2122/97
ugacggggcugaccgccac

SEQ ID NO: 3171104 - RNA, 20 nt, Mycobacterium bovis subsp bovis AF2122/97
ugacggggcugaccgccacc

SEQ ID NO: 3171105 - RNA, 16 nt, Mycobacterium bovis subsp bovis AF2122/97
ugacggguagcguacu

SEQ ID NO: 3171106 - RNA, 20 nt, Mycobacterium bovis subsp bovis AF2122/97
ugacggugaauucacgaugc

SEQ ID NO: 3171107 - RNA, 13 nt, Mycobacterium bovis subsp bovis AF2122/97
ugacggugccgac

SEQ ID NO: 3171108 - RNA, 17 nt, Mycobacterium bovis subsp bovis AF2122/97
ugacggugccgaccgcg

SEQ ID NO: 3171109 - RNA, 21 nt, Mycobacterium bovis subsp bovis AF2122/97
ugacgguggggucgccgucga

SEQ ID NO: 3171110 - RNA, 12 nt, Mycobacterium bovis subsp bovis AF2122/97
ugacggugguga

SEQ ID NO: 3171111 - RNA, 15 nt, Mycobacterium bovis subsp bovis AF2122/97
ugacgguguuggugu

SEQ ID NO: 3171112 - RNA, 19 nt, Mycobacterium bovis subsp bovis AF2122/97
ugacguagaagucgaucgc

SEQ ID NO: 3171113 - RNA, 23 nt, Mycobacterium bovis subsp bovis AF2122/97
ugacguagaagucgaucgccgag

SEQ ID NO: 3171114 - RNA, 12 nt, Mycobacterium bovis subsp bovis AF2122/97
ugacguagacgg

SEQ ID NO: 3171115 - RNA, 13 nt, Mycobacterium bovis subsp bovis AF2122/97
ugacguagacggu

SEQ ID NO: 3171116 - RNA, 16 nt, Mycobacterium bovis subsp bovis AF2122/97
ugacguaggcggcggc

SEQ ID NO: 3171117 - RNA, 20 nt, Mycobacterium bovis subsp bovis AF2122/97
ugacguagucgucuucguca

SEQ ID NO: 3171118 - RNA, 19 nt, Mycobacterium bovis subsp bovis AF2122/97
ugacguagugcaccgccug

SEQ ID NO: 3171119 - RNA, 15 nt, Mycobacterium bovis subsp bovis AF2122/97
ugacgucaggcugaa

SEQ ID NO: 3171120 - RNA, 16 nt, Mycobacterium bovis subsp bovis AF2122/97
ugacguccaacagcgc

SEQ ID NO: 3171121 - RNA, 15 nt, Mycobacterium bovis subsp bovis AF2122/97
ugacguccagggcca

SEQ ID NO: 3171122 - RNA, 18 nt, Mycobacterium bovis subsp bovis AF2122/97
ugacgucgacaacgaucg

SEQ ID NO: 3171123 - RNA, 15 nt, Mycobacterium bovis subsp bovis AF2122/97
ugacgucgcaacggc

SEQ ID NO: 3171124 - RNA, 19 nt, Mycobacterium bovis subsp bovis AF2122/97
ugacgucgcggauugccgc

SEQ ID NO: 3171125 - RNA, 12 nt, Mycobacterium bovis subsp bovis AF2122/97
ugacgugcauga

SEQ ID NO: 3171126 - RNA, 12 nt, Mycobacterium bovis subsp bovis AF2122/97
ugacgugguggg

SEQ ID NO: 3171127 - RNA, 21 nt, Mycobacterium bovis subsp bovis AF2122/97
ugacguggugggcuuggcugu

SEQ ID NO: 3171128 - RNA, 15 nt, Mycobacterium bovis subsp bovis AF2122/97
ugacguuagcauuga

SEQ ID NO: 3171129 - RNA, 12 nt, Mycobacterium bovis subsp bovis AF2122/97
ugacguuguagg

SEQ ID NO: 3171130 - RNA, 14 nt, Mycobacterium bovis subsp bovis AF2122/97
ugacguugugccuu

SEQ ID NO: 3171131 - RNA, 21 nt, Mycobacterium bovis subsp bovis AF2122/97
ugacucagaacguggccguua

SEQ ID NO: 3171132 - RNA, 20 nt, Mycobacterium bovis subsp bovis AF2122/97
ugacuccugcggcaccgcug

SEQ ID NO: 3171133 - RNA, 17 nt, Mycobacterium bovis subsp bovis AF2122/97
ugacucgcuccgaccgg

SEQ ID NO: 3171134 - RNA, 23 nt, Mycobacterium bovis subsp bovis AF2122/97
ugacucggcaccuggauccacca

SEQ ID NO: 3171135 - RNA, 21 nt, Mycobacterium bovis subsp bovis AF2122/97
ugacucggccgcaccagcauu

SEQ ID NO: 3171136 - RNA, 17 nt, Mycobacterium bovis subsp bovis AF2122/97
ugacucggccuccgccg

SEQ ID NO: 3171137 - RNA, 21 nt, Mycobacterium bovis subsp bovis AF2122/97
ugacucgggcacgggugacga

SEQ ID NO: 3171138 - RNA, 18 nt, Mycobacterium bovis subsp bovis AF2122/97
ugacucugcguccaccac

SEQ ID NO: 3171139 - RNA, 20 nt, Mycobacterium bovis subsp bovis AF2122/97
ugacucugcguccaccacgc

SEQ ID NO: 3171140 - RNA, 16 nt, Mycobacterium bovis subsp bovis AF2122/97
ugacugaacucaacac

SEQ ID NO: 3171141 - RNA, 14 nt, Mycobacterium bovis subsp bovis AF2122/97
ugacugcgaccggu

SEQ ID NO: 3171142 - RNA, 19 nt, Mycobacterium bovis subsp bovis AF2122/97
ugacugcgaccgguucggc

SEQ ID NO: 3171143 - RNA, 18 nt, Mycobacterium bovis subsp bovis AF2122/97
ugacugguggcgccaacg

SEQ ID NO: 3171144 - RNA, 15 nt, Mycobacterium bovis subsp bovis AF2122/97
ugacuugcacgcugu

SEQ ID NO: 3171145 - RNA, 20 nt, Mycobacterium bovis subsp bovis AF2122/97
ugagaacacguucggcgucg

SEQ ID NO: 3171146 - RNA, 17 nt, Mycobacterium bovis subsp bovis AF2122/97
ugagaaccggcucacca

SEQ ID NO: 3171147 - RNA, 13 nt, Mycobacterium bovis subsp bovis AF2122/97
ugagaagaagccc

SEQ ID NO: 3171148 - RNA, 15 nt, Mycobacterium bovis subsp bovis AF2122/97
ugagacaaaggugcc

SEQ ID NO: 3171149 - RNA, 17 nt, Mycobacterium bovis subsp bovis AF2122/97
ugagacagaccgggccc

SEQ ID NO: 3171150 - RNA, 14 nt, Mycobacterium bovis subsp bovis AF2122/97
ugagacgccgucga

SEQ ID NO: 3171151 - RNA, 21 nt, Mycobacterium bovis subsp bovis AF2122/97
ugagacucgucgaugcggugg

SEQ ID NO: 3171152 - RNA, 15 nt, Mycobacterium bovis subsp bovis AF2122/97
ugagacugccgccgc

SEQ ID NO: 3171153 - RNA, 18 nt, Mycobacterium bovis subsp bovis AF2122/97
ugagagauggucgggcgg

SEQ ID NO: 3171154 - RNA, 18 nt, Mycobacterium bovis subsp bovis AF2122/97
ugagauugguggcccggg

SEQ ID NO: 3171155 - RNA, 18 nt, Mycobacterium bovis subsp bovis AF2122/97
ugagcaaaauggccaccg

SEQ ID NO: 3171156 - RNA, 21 nt, Mycobacterium bovis subsp bovis AF2122/97
ugagcaaaauggccaccggcg

SEQ ID NO: 3171157 - RNA, 21 nt, Mycobacterium bovis subsp bovis AF2122/97
ugagcaagaaguacgugcaca

SEQ ID NO: 3171158 - RNA, 16 nt, Mycobacterium bovis subsp bovis AF2122/97
ugagcaaguccugcag

SEQ ID NO: 3171159 - RNA, 20 nt, Mycobacterium bovis subsp bovis AF2122/97
ugagcaaguccugcagcugg

SEQ ID NO: 3171160 - RNA, 12 nt, Mycobacterium bovis subsp bovis AF2122/97
ugagcaccagca

SEQ ID NO: 3171161 - RNA, 20 nt, Mycobacterium bovis subsp bovis AF2122/97
ugagcaccagcagcaccaac

SEQ ID NO: 3171162 - RNA, 23 nt, Mycobacterium bovis subsp bovis AF2122/97
ugagcacccgauaguucuggccc

SEQ ID NO: 3171163 - RNA, 21 nt, Mycobacterium bovis subsp bovis AF2122/97
ugagcaccugggcgcgcuggc

SEQ ID NO: 3171164 - RNA, 22 nt, Mycobacterium bovis subsp bovis AF2122/97
ugagcacgauauugggauacuc

SEQ ID NO: 3171165 - RNA, 16 nt, Mycobacterium bovis subsp bovis AF2122/97
ugagcagaaggccagc

SEQ ID NO: 3171166 - RNA, 17 nt, Mycobacterium bovis subsp bovis AF2122/97
ugagcagacccgugccg

SEQ ID NO: 3171167 - RNA, 18 nt, Mycobacterium bovis subsp bovis AF2122/97
ugagcagacgcaaaagaa

SEQ ID NO: 3171168 - RNA, 22 nt, Mycobacterium bovis subsp bovis AF2122/97
ugagcagauggguacccgauca

SEQ ID NO: 3171169 - RNA, 22 nt, Mycobacterium bovis subsp bovis AF2122/97
ugagcagcaagaccgcgccaac

SEQ ID NO: 3171170 - RNA, 16 nt, Mycobacterium bovis subsp bovis AF2122/97
ugagcagcacccauac

SEQ ID NO: 3171171 - RNA, 22 nt, Mycobacterium bovis subsp bovis AF2122/97
ugagguaggacucacgcagcgc

SEQ ID NO: 3171172 - RNA, 16 nt, Mycobacterium bovis subsp bovis AF2122/97
ugagguaggggcaggc

SEQ ID NO: 3171173 - RNA, 14 nt, Mycobacterium bovis subsp bovis AF2122/97
ugagguaucccggu

SEQ ID NO: 3171174 - RNA, 23 nt, Mycobacterium bovis subsp bovis AF2122/97
ugaggucauuggcgaucaaugcg

SEQ ID NO: 3171175 - RNA, 17 nt, Mycobacterium bovis subsp bovis AF2122/97
ugaggucccggcuggga

SEQ ID NO: 3171176 - RNA, 14 nt, Mycobacterium bovis subsp bovis AF2122/97
ugaggucgaugccg

SEQ ID NO: 3171177 - RNA, 19 nt, Mycobacterium bovis subsp bovis AF2122/97
ugaggucuacuucggcgcc

SEQ ID NO: 3171178 - RNA, 17 nt, Mycobacterium bovis subsp bovis AF2122/97
ugaggugaucggaagaa

SEQ ID NO: 3171179 - RNA, 17 nt, Mycobacterium bovis subsp bovis AF2122/97
ugagguucaucgccggc

SEQ ID NO: 3171180 - RNA, 20 nt, Mycobacterium bovis subsp bovis AF2122/97
ugagguucuucugcgccacg

SEQ ID NO: 3171181 - RNA, 17 nt, Mycobacterium bovis subsp bovis AF2122/97
ugagguuggagcgccag

SEQ ID NO: 3171182 - RNA, 15 nt, Mycobacterium bovis subsp bovis AF2122/97
ugaguaacacguggg

SEQ ID NO: 3171183 - RNA, 11 nt, Mycobacterium bovis subsp bovis AF2122/97
ugaguaccaau

SEQ ID NO: 3171184 - RNA, 17 nt, Mycobacterium bovis subsp bovis AF2122/97
ugaguagaucccaccac

SEQ ID NO: 3171185 - RNA, 13 nt, Mycobacterium bovis subsp bovis AF2122/97
ugagucacccggc

SEQ ID NO: 3171186 - RNA, 14 nt, Mycobacterium bovis subsp bovis AF2122/97
ugagucaggcgccg

SEQ ID NO: 3171187 - RNA, 17 nt, Mycobacterium bovis subsp bovis AF2122/97
ugagucccacgccagcg

SEQ ID NO: 3171188 - RNA, 22 nt, Mycobacterium bovis subsp bovis AF2122/97
ugagucccacgccagcgcgacc

SEQ ID NO: 3171189 - RNA, 20 nt, Mycobacterium bovis subsp bovis AF2122/97
ugaguccccaggugggcagc

SEQ ID NO: 3171190 - RNA, 21 nt, Mycobacterium bovis subsp bovis AF2122/97
ugaguccccaggugggcagca

SEQ ID NO: 3171191 - RNA, 16 nt, Mycobacterium bovis subsp bovis AF2122/97
ugaguccgcugagcgg

SEQ ID NO: 3171192 - RNA, 18 nt, Mycobacterium bovis subsp bovis AF2122/97
ugagucgaaaacagcgau

SEQ ID NO: 3171193 - RNA, 20 nt, Mycobacterium bovis subsp bovis AF2122/97
ugagucguaguaggcgccgc

SEQ ID NO: 3171194 - RNA, 22 nt, Mycobacterium bovis subsp bovis AF2122/97
ugagucguaguaggcgccgcga

SEQ ID NO: 3171195 - RNA, 23 nt, Mycobacterium bovis subsp bovis AF2122/97
ugagucguaguaggcgccgcgac

SEQ ID NO: 3171196 - RNA, 18 nt, Mycobacterium bovis subsp bovis AF2122/97
ugagucuuucccgccacc

SEQ ID NO: 3171197 - RNA, 21 nt, Mycobacterium bovis subsp bovis AF2122/97
ugagucuuucccgccaccaaa

SEQ ID NO: 3171198 - RNA, 17 nt, Mycobacterium bovis subsp bovis AF2122/97
ugagugaccacgcugcu

SEQ ID NO: 3171199 - RNA, 21 nt, Mycobacterium bovis subsp bovis AF2122/97
ugagugacgguccguucgaug

SEQ ID NO: 3171200 - RNA, 18 nt, Mycobacterium bovis subsp bovis AF2122/97
ugaguggcaaucccgcca

SEQ ID NO: 3171201 - RNA, 23 nt, Mycobacterium bovis subsp bovis AF2122/97
ugaguggcucgcucugcgcggcu

SEQ ID NO: 3171202 - RNA, 19 nt, Mycobacterium bovis subsp bovis AF2122/97
ugaguguggagacguuuug

SEQ ID NO: 3171203 - RNA, 17 nt, Mycobacterium bovis subsp bovis AF2122/97
ugaguguugccgacgag

SEQ ID NO: 3171204 - RNA, 14 nt, Mycobacterium bovis subsp bovis AF2122/97
ugaguucacguucg

SEQ ID NO: 3171205 - RNA, 14 nt, Mycobacterium bovis subsp bovis AF2122/97
ugaguucgcgcauc

SEQ ID NO: 3171206 - RNA, 13 nt, Mycobacterium bovis subsp bovis AF2122/97
ugaguucggccac

SEQ ID NO: 3171207 - RNA, 15 nt, Mycobacterium bovis subsp bovis AF2122/97
ugaguucggccacca

SEQ ID NO: 3171208 - RNA, 17 nt, Mycobacterium bovis subsp bovis AF2122/97
ugauaguggcgcgcggc

SEQ ID NO: 3171209 - RNA, 14 nt, Mycobacterium bovis subsp bovis AF2122/97
ugauauacggaucc

SEQ ID NO: 3171210 - RNA, 15 nt, Mycobacterium bovis subsp bovis AF2122/97
ugauauccguacagu

SEQ ID NO: 3171211 - RNA, 15 nt, Mycobacterium bovis subsp bovis AF2122/97
ugaucaaaccggcgg

SEQ ID NO: 3171212 - RNA, 22 nt, Mycobacterium bovis subsp bovis AF2122/97
ugaucaaacuaccgaacagugg

SEQ ID NO: 3171213 - RNA, 21 nt, Mycobacterium bovis subsp bovis AF2122/97
ugaucaaggcgcucccggagc

SEQ ID NO: 3171214 - RNA, 15 nt, Mycobacterium bovis subsp bovis AF2122/97
ugaucacauucagca

SEQ ID NO: 3171215 - RNA, 23 nt, Mycobacterium bovis subsp bovis AF2122/97
ugaucaccgcguaguccaggccg

SEQ ID NO: 3171216 - RNA, 14 nt, Mycobacterium bovis subsp bovis AF2122/97
ugaucaccguggug

SEQ ID NO: 3171217 - RNA, 19 nt, Mycobacterium bovis subsp bovis AF2122/97
ugaucaccgugguggcgua

SEQ ID NO: 3171218 - RNA, 22 nt, Mycobacterium bovis subsp bovis AF2122/97
ugaucagcccaucuaccagcuc

SEQ ID NO: 3171219 - RNA, 20 nt, Mycobacterium bovis subsp bovis AF2122/97
ugaucagccgccaaccgcag

SEQ ID NO: 3171220 - RNA, 12 nt, Mycobacterium bovis subsp bovis AF2122/97
ugaucagcgcau

SEQ ID NO: 3171221 - RNA, 14 nt, Mycobacterium bovis subsp bovis AF2122/97
ugaucagcgccgug

SEQ ID NO: 3171222 - RNA, 12 nt, Mycobacterium bovis subsp bovis AF2122/97
ugaucagcgcgu

SEQ ID NO: 3171223 - RNA, 21 nt, Mycobacterium bovis subsp bovis AF2122/97
ugaucagcucgcgcacgucga

SEQ ID NO: 3171224 - RNA, 18 nt, Mycobacterium bovis subsp bovis AF2122/97
ugaucagggucagcgccg

SEQ ID NO: 3171225 - RNA, 17 nt, Mycobacterium bovis subsp bovis AF2122/97
ugaucagugccaggugg

SEQ ID NO: 3171226 - RNA, 13 nt, Mycobacterium bovis subsp bovis AF2122/97
ugaucaucccggc

SEQ ID NO: 3171227 - RNA, 18 nt, Mycobacterium bovis subsp bovis AF2122/97
ugaucaucccggcgcguu

SEQ ID NO: 3171228 - RNA, 12 nt, Mycobacterium bovis subsp bovis AF2122/97
ugaucaugaacg

SEQ ID NO: 3171229 - RNA, 18 nt, Mycobacterium bovis subsp bovis AF2122/97
ugauccaaguacgcuccg

SEQ ID NO: 3171230 - RNA, 12 nt, Mycobacterium bovis subsp bovis AF2122/97
ugauccagucga

SEQ ID NO: 3171231 - RNA, 13 nt, Mycobacterium bovis subsp bovis AF2122/97
ugaucccauccag

SEQ ID NO: 3171232 - RNA, 19 nt, Mycobacterium bovis subsp bovis AF2122/97
ugauccccguugacccaga

SEQ ID NO: 3171233 - RNA, 13 nt, Mycobacterium bovis subsp bovis AF2122/97
ugaucccggccag

SEQ ID NO: 3171234 - RNA, 18 nt, Mycobacterium bovis subsp bovis AF2122/97
ugauccgccggcaacgcg

SEQ ID NO: 3171235 - RNA, 12 nt, Mycobacterium bovis subsp bovis AF2122/97
ugauccgcuggg

SEQ ID NO: 3171236 - RNA, 15 nt, Mycobacterium bovis subsp bovis AF2122/97
ugauccgggcgccga

SEQ ID NO: 3171237 - RNA, 13 nt, Mycobacterium bovis subsp bovis AF2122/97
ugauccggucgua

SEQ ID NO: 3171238 - RNA, 16 nt, Mycobacterium bovis subsp bovis AF2122/97
ugaucgaauacaccug

SEQ ID NO: 3171239 - RNA, 16 nt, Mycobacterium bovis subsp bovis AF2122/97
ugaucgaccgccuccu

SEQ ID NO: 3171240 - RNA, 15 nt, Mycobacterium bovis subsp bovis AF2122/97
ugaucgacgaccguc

SEQ ID NO: 3171241 - RNA, 18 nt, Mycobacterium bovis subsp bovis AF2122/97
ugaucgacggccagccca

SEQ ID NO: 3171242 - RNA, 16 nt, Mycobacterium bovis subsp bovis AF2122/97
ugaucgacuucggcgu

SEQ ID NO: 3171243 - RNA, 18 nt, Mycobacterium bovis subsp bovis AF2122/97
ugaucgacuucggcgucg

SEQ ID NO: 3171244 - RNA, 14 nt, Mycobacterium bovis subsp bovis AF2122/97
ugaucgagcaguuc

SEQ ID NO: 3171245 - RNA, 21 nt, Mycobacterium bovis subsp bovis AF2122/97
ugaucgagcaguuccagcucg

SEQ ID NO: 3171246 - RNA, 14 nt, Mycobacterium bovis subsp bovis AF2122/97
ugaucgagcgccag

SEQ ID NO: 3171247 - RNA, 16 nt, Mycobacterium bovis subsp bovis AF2122/97
ugaucgaggcggcggu

SEQ ID NO: 3171248 - RNA, 20 nt, Mycobacterium bovis subsp bovis AF2122/97
ugaucgaggcggcggucgag

SEQ ID NO: 3171249 - RNA, 18 nt, Mycobacterium bovis subsp bovis AF2122/97
ugaucgaucgcggcgccc

SEQ ID NO: 3171250 - RNA, 15 nt, Mycobacterium bovis subsp bovis AF2122/97
ugaucgccacccggu

SEQ ID NO: 3171251 - RNA, 14 nt, Mycobacterium bovis subsp bovis AF2122/97
ugaucgccauggug

SEQ ID NO: 3171252 - RNA, 21 nt, Mycobacterium bovis subsp bovis AF2122/97
ugaucgcccgguucagcgcug

SEQ ID NO: 3171253 - RNA, 12 nt, Mycobacterium bovis subsp bovis AF2122/97
ugaucgccgagg

SEQ ID NO: 3171254 - RNA, 22 nt, Mycobacterium bovis subsp bovis AF2122/97
ugaucgccgaggccucggccag

SEQ ID NO: 3171255 - RNA, 15 nt, Mycobacterium bovis subsp bovis AF2122/97
ugaucgcuggcgacc

SEQ ID NO: 3171256 - RNA, 16 nt, Mycobacterium bovis subsp bovis AF2122/97
ugaucggcacgcgcag

SEQ ID NO: 3171257 - RNA, 21 nt, Mycobacterium bovis subsp bovis AF2122/97
ugaucggcaggguggccagca

SEQ ID NO: 3171258 - RNA, 14 nt, Mycobacterium bovis subsp bovis AF2122/97
ugauguccgcgacg

SEQ ID NO: 3171259 - RNA, 16 nt, Mycobacterium bovis subsp bovis AF2122/97
ugauguccgcgacggc

SEQ ID NO: 3171260 - RNA, 21 nt, Mycobacterium bovis subsp bovis AF2122/97
ugauguccucccaucccaugu

SEQ ID NO: 3171261 - RNA, 23 nt, Mycobacterium bovis subsp bovis AF2122/97
ugaugucuaccaacaccgcccgc

SEQ ID NO: 3171262 - RNA, 17 nt, Mycobacterium bovis subsp bovis AF2122/97
ugauguucgacgggccg

SEQ ID NO: 3171263 - RNA, 17 nt, Mycobacterium bovis subsp bovis AF2122/97
ugauucgcgcagcgcga

SEQ ID NO: 3171264 - RNA, 15 nt, Mycobacterium bovis subsp bovis AF2122/97
ugauucgcugcgccg

SEQ ID NO: 3171265 - RNA, 22 nt, Mycobacterium bovis subsp bovis AF2122/97
ugauucugguucagccauucua

SEQ ID NO: 3171266 - RNA, 20 nt, Mycobacterium bovis subsp bovis AF2122/97
ugauugccaggaccgcgccg

SEQ ID NO: 3171267 - RNA, 22 nt, Mycobacterium bovis subsp bovis AF2122/97
ugauugcgaccgcgccaacaga

SEQ ID NO: 3171268 - RNA, 15 nt, Mycobacterium bovis subsp bovis AF2122/97
ugauuggggccaggu

SEQ ID NO: 3171269 - RNA, 13 nt, Mycobacterium bovis subsp bovis AF2122/97
ugauugugcccag

SEQ ID NO: 3171270 - RNA, 19 nt, Mycobacterium bovis subsp bovis AF2122/97
ugauuguguuccaccagcg

SEQ ID NO: 3171271 - RNA, 15 nt, Mycobacterium bovis subsp bovis AF2122/97
ugcaaaagccgcgau

SEQ ID NO: 3171272 - RNA, 13 nt, Mycobacterium bovis subsp bovis AF2122/97
ugcaacacaccgc

SEQ ID NO: 3171273 - RNA, 15 nt, Mycobacterium bovis subsp bovis AF2122/97
ugcaacacaccgcgg

SEQ ID NO: 3171274 - RNA, 15 nt, Mycobacterium bovis subsp bovis AF2122/97
ugcaacaccgcaccg

SEQ ID NO: 3171275 - RNA, 16 nt, Mycobacterium bovis subsp bovis AF2122/97
ugcaaccacggcggca

SEQ ID NO: 3171276 - RNA, 22 nt, Mycobacterium bovis subsp bovis AF2122/97
ugcaaccccaaguccagcagcg

SEQ ID NO: 3171277 - RNA, 12 nt, Mycobacterium bovis subsp bovis AF2122/97
ugcaaccgccgg

SEQ ID NO: 3171278 - RNA, 18 nt, Mycobacterium bovis subsp bovis AF2122/97
ugcaaccgccggugccga

SEQ ID NO: 3171279 - RNA, 19 nt, Mycobacterium bovis subsp bovis AF2122/97
ugcaacgauugaacucugg

SEQ ID NO: 3171280 - RNA, 19 nt, Mycobacterium bovis subsp bovis AF2122/97
ugcaacggcguuggcgccg

SEQ ID NO: 3171281 - RNA, 21 nt, Mycobacterium bovis subsp bovis AF2122/97
ugcaacggugaaucgaagccc

SEQ ID NO: 3171282 - RNA, 15 nt, Mycobacterium bovis subsp bovis AF2122/97
ugcaacucggcagau

SEQ ID NO: 3171283 - RNA, 20 nt, Mycobacterium bovis subsp bovis AF2122/97
ugcaagaccguuacaccauc

SEQ ID NO: 3171284 - RNA, 14 nt, Mycobacterium bovis subsp bovis AF2122/97
ugcaagacgccgau

SEQ ID NO: 3171285 - RNA, 18 nt, Mycobacterium bovis subsp bovis AF2122/97
ugcaaggaauuccggcug

SEQ ID NO: 3171286 - RNA, 17 nt, Mycobacterium bovis subsp bovis AF2122/97
ugcaaucgcgugcugga

SEQ ID NO: 3171287 - RNA, 14 nt, Mycobacterium bovis subsp bovis AF2122/97
ugcaaugacuggac

SEQ ID NO: 3171288 - RNA, 13 nt, Mycobacterium bovis subsp bovis AF2122/97
ugcaaugcuggcg

SEQ ID NO: 3171289 - RNA, 14 nt, Mycobacterium bovis subsp bovis AF2122/97
ugcaaugcuggcgg

SEQ ID NO: 3171290 - RNA, 14 nt, Mycobacterium bovis subsp bovis AF2122/97
ugcaauuucagccu

SEQ ID NO: 3171291 - RNA, 21 nt, Mycobacterium bovis subsp bovis AF2122/97
ugcaauuucagccuuguugcc

SEQ ID NO: 3171292 - RNA, 22 nt, Mycobacterium bovis subsp bovis AF2122/97
ugcacaaaauacuccgcgagcc

SEQ ID NO: 3171293 - RNA, 17 nt, Mycobacterium bovis subsp bovis AF2122/97
ugcacaaccgcugcugc

SEQ ID NO: 3171294 - RNA, 17 nt, Mycobacterium bovis subsp bovis AF2122/97
ugcacaacgcccaccac

SEQ ID NO: 3171295 - RNA, 22 nt, Mycobacterium bovis subsp bovis AF2122/97
ugcacaaucgguugcacccgcg

SEQ ID NO: 3171296 - RNA, 19 nt, Mycobacterium bovis subsp bovis AF2122/97
ugcacacagaggucgguca

SEQ ID NO: 3171297 - RNA, 19 nt, Mycobacterium bovis subsp bovis AF2122/97
ugcacaccgggcaccaguc

SEQ ID NO: 3171298 - RNA, 13 nt, Mycobacterium bovis subsp bovis AF2122/97
ugcacaccgucgc

SEQ ID NO: 3171299 - RNA, 16 nt, Mycobacterium bovis subsp bovis AF2122/97
ugcacaccgucgcacc

SEQ ID NO: 3171300 - RNA, 15 nt, Mycobacterium bovis subsp bovis AF2122/97
ugcacagacagacag

SEQ ID NO: 3171301 - RNA, 14 nt, Mycobacterium bovis subsp bovis AF2122/97
ugcacagcagcggu

SEQ ID NO: 3171302 - RNA, 20 nt, Mycobacterium bovis subsp bovis AF2122/97
ugcacagcagcgucaucagg

SEQ ID NO: 3171303 - RNA, 21 nt, Mycobacterium bovis subsp bovis AF2122/97
ugcacagcggcaucgcgggcg

SEQ ID NO: 3171304 - RNA, 14 nt, Mycobacterium bovis subsp bovis AF2122/97
ugcacaggauuggc

SEQ ID NO: 3171305 - RNA, 18 nt, Mycobacterium bovis subsp bovis AF2122/97
ugcacaggcaucguccgc

SEQ ID NO: 3171306 - RNA, 13 nt, Mycobacterium bovis subsp bovis AF2122/97
ugcacaggucagc

SEQ ID NO: 3171307 - RNA, 22 nt, Mycobacterium bovis subsp bovis AF2122/97
ugcacaucggugguuagguggc

SEQ ID NO: 3171308 - RNA, 15 nt, Mycobacterium bovis subsp bovis AF2122/97
ugcaccacauuggcg

SEQ ID NO: 3171309 - RNA, 17 nt, Mycobacterium bovis subsp bovis AF2122/97
ugcaccacggcggccac

SEQ ID NO: 3171310 - RNA, 13 nt, Mycobacterium bovis subsp bovis AF2122/97
ugcaccagcucac

SEQ ID NO: 3171311 - RNA, 21 nt, Mycobacterium bovis subsp bovis AF2122/97
ugcaccagcucacccggagca

SEQ ID NO: 3171312 - RNA, 20 nt, Mycobacterium bovis subsp bovis AF2122/97
ugcaccagcugcucgucguc

SEQ ID NO: 3171313 - RNA, 13 nt, Mycobacterium bovis subsp bovis AF2122/97
ugcaccagggccu

SEQ ID NO: 3171314 - RNA, 17 nt, Mycobacterium bovis subsp bovis AF2122/97
ugcaccaggggcgcguc

SEQ ID NO: 3171315 - RNA, 18 nt, Mycobacterium bovis subsp bovis AF2122/97
ugcaccagguugcaaccu

SEQ ID NO: 3171316 - RNA, 17 nt, Mycobacterium bovis subsp bovis AF2122/97
ugcaccauacucaccga

SEQ ID NO: 3171317 - RNA, 20 nt, Mycobacterium bovis subsp bovis AF2122/97
ugcacccacaucaccaaaaa

SEQ ID NO: 3171318 - RNA, 22 nt, Mycobacterium bovis subsp bovis AF2122/97
ugcacccaccccgaagaugccu

SEQ ID NO: 3171319 - RNA, 14 nt, Mycobacterium bovis subsp bovis AF2122/97
ugcacccagccgug

SEQ ID NO: 3171320 - RNA, 22 nt, Mycobacterium bovis subsp bovis AF2122/97
ugcacccagccgugcccaagcu

SEQ ID NO: 3171321 - RNA, 22 nt, Mycobacterium bovis subsp bovis AF2122/97
ugcacccaggcaucggugagcc

SEQ ID NO: 3171322 - RNA, 13 nt, Mycobacterium bovis subsp bovis AF2122/97
ugcaccccaugac

SEQ ID NO: 3171323 - RNA, 13 nt, Mycobacterium bovis subsp bovis AF2122/97
ugcacccgcaccg

SEQ ID NO: 3171324 - RNA, 12 nt, Mycobacterium bovis subsp bovis AF2122/97
ugcacccgccag

SEQ ID NO: 3171325 - RNA, 13 nt, Mycobacterium bovis subsp bovis AF2122/97
ugcacccgggccg

SEQ ID NO: 3171326 - RNA, 18 nt, Mycobacterium bovis subsp bovis AF2122/97
ugcaccgaagauggccag

SEQ ID NO: 3171327 - RNA, 19 nt, Mycobacterium bovis subsp bovis AF2122/97
ugcaccgaagauggccagc

SEQ ID NO: 3171328 - RNA, 16 nt, Mycobacterium bovis subsp bovis AF2122/97
ugcaccgccaggucga

SEQ ID NO: 3171329 - RNA, 19 nt, Mycobacterium bovis subsp bovis AF2122/97
ugcaccgccaggucgaggc

SEQ ID NO: 3171330 - RNA, 14 nt, Mycobacterium bovis subsp bovis AF2122/97
ugcaccgcgaccgc

SEQ ID NO: 3171331 - RNA, 13 nt, Mycobacterium bovis subsp bovis AF2122/97
ugcaccgcggcca

SEQ ID NO: 3171332 - RNA, 19 nt, Mycobacterium bovis subsp bovis AF2122/97
ugcaccgcgucguagccac

SEQ ID NO: 3171333 - RNA, 18 nt, Mycobacterium bovis subsp bovis AF2122/97
ugcaccggccgaaggcgc

SEQ ID NO: 3171334 - RNA, 20 nt, Mycobacterium bovis subsp bovis AF2122/97
ugcaccggcuugggccaggc

SEQ ID NO: 3171335 - RNA, 16 nt, Mycobacterium bovis subsp bovis AF2122/97
ugcaccguuguaugcu

SEQ ID NO: 3171336 - RNA, 17 nt, Mycobacterium bovis subsp bovis AF2122/97
ugcaccuccgacggccg

SEQ ID NO: 3171337 - RNA, 20 nt, Mycobacterium bovis subsp bovis AF2122/97
ugcaccuccgacggccgcgg

SEQ ID NO: 3171338 - RNA, 23 nt, Mycobacterium bovis subsp bovis AF2122/97
ugcaccucgagcguggcaacgag

SEQ ID NO: 3171339 - RNA, 13 nt, Mycobacterium bovis subsp bovis AF2122/97
ugcaccucguguc

SEQ ID NO: 3171340 - RNA, 19 nt, Mycobacterium bovis subsp bovis AF2122/97
ugcaccucguguccgggga

SEQ ID NO: 3171341 - RNA, 19 nt, Mycobacterium bovis subsp bovis AF2122/97
ugcaccugcgaggugccgg

SEQ ID NO: 3171342 - RNA, 20 nt, Mycobacterium bovis subsp bovis AF2122/97
ugcaccuggaucagggcuuu

SEQ ID NO: 3171343 - RNA, 18 nt, Mycobacterium bovis subsp bovis AF2122/97
ugcaccuucuccaccgaa

SEQ ID NO: 3171344 - RNA, 14 nt, Mycobacterium bovis subsp bovis AF2122/97
ugcacgaacgccug

SEQ ID NO: 3171345 - RNA, 15 nt, Mycobacterium bovis subsp bovis AF2122/97
ugcaggaaaguggcc

SEQ ID NO: 3171346 - RNA, 13 nt, Mycobacterium bovis subsp bovis AF2122/97
ugcaggaccagca

SEQ ID NO: 3171347 - RNA, 15 nt, Mycobacterium bovis subsp bovis AF2122/97
ugcaggaccagcacc

SEQ ID NO: 3171348 - RNA, 22 nt, Mycobacterium bovis subsp bovis AF2122/97
ugcaggacgcccacaugcucag

SEQ ID NO: 3171349 - RNA, 23 nt, Mycobacterium bovis subsp bovis AF2122/97
ugcaggacgcccacaugcucagg

SEQ ID NO: 3171350 - RNA, 22 nt, Mycobacterium bovis subsp bovis AF2122/97
ugcaggacguuugagaccccaa

SEQ ID NO: 3171351 - RNA, 23 nt, Mycobacterium bovis subsp bovis AF2122/97
ugcaggacguuugagaccccaac

SEQ ID NO: 3171352 - RNA, 17 nt, Mycobacterium bovis subsp bovis AF2122/97
ugcaggacucgcguccu

SEQ ID NO: 3171353 - RNA, 15 nt, Mycobacterium bovis subsp bovis AF2122/97
ugcaggaucaaaacc

SEQ ID NO: 3171354 - RNA, 23 nt, Mycobacterium bovis subsp bovis AF2122/97
ugcaggaucaaaaccucgugcgc

SEQ ID NO: 3171355 - RNA, 16 nt, Mycobacterium bovis subsp bovis AF2122/97
ugcaggaucggcuugg

SEQ ID NO: 3171356 - RNA, 12 nt, Mycobacterium bovis subsp bovis AF2122/97
ugcaggauucgg

SEQ ID NO: 3171357 - RNA, 16 nt, Mycobacterium bovis subsp bovis AF2122/97
ugcaggauucggcggu

SEQ ID NO: 3171358 - RNA, 13 nt, Mycobacterium bovis subsp bovis AF2122/97
ugcaggccagagu

SEQ ID NO: 3171359 - RNA, 16 nt, Mycobacterium bovis subsp bovis AF2122/97
ugcaggcccaggcugu

SEQ ID NO: 3171360 - RNA, 16 nt, Mycobacterium bovis subsp bovis AF2122/97
ugcaggccgccggcca

SEQ ID NO: 3171361 - RNA, 21 nt, Mycobacterium bovis subsp bovis AF2122/97
ugcaggcgaguuaggccgcca

SEQ ID NO: 3171362 - RNA, 14 nt, Mycobacterium bovis subsp bovis AF2122/97
ugcaggcgcagcug

SEQ ID NO: 3171363 - RNA, 23 nt, Mycobacterium bovis subsp bovis AF2122/97
ugcaggcggccuugccgggccgc

SEQ ID NO: 3171364 - RNA, 21 nt, Mycobacterium bovis subsp bovis AF2122/97
ugcaggcugguuucggccgca

SEQ ID NO: 3171365 - RNA, 16 nt, Mycobacterium bovis subsp bovis AF2122/97
ugcagggccacuggcc

SEQ ID NO: 3171366 - RNA, 12 nt, Mycobacterium bovis subsp bovis AF2122/97
ugcagggccugg

SEQ ID NO: 3171367 - RNA, 20 nt, Mycobacterium bovis subsp bovis AF2122/97
ugcagggugagcacguaucg

SEQ ID NO: 3171368 - RNA, 13 nt, Mycobacterium bovis subsp bovis AF2122/97
ugcaggucgaggu

SEQ ID NO: 3171369 - RNA, 16 nt, Mycobacterium bovis subsp bovis AF2122/97
ugcaggucggcccagg

SEQ ID NO: 3171370 - RNA, 18 nt, Mycobacterium bovis subsp bovis AF2122/97
ugcaggucggcccagguu

SEQ ID NO: 3171371 - RNA, 19 nt, Mycobacterium bovis subsp bovis AF2122/97
ugcaggucguccaucgcgu

SEQ ID NO: 3171372 - RNA, 21 nt, Mycobacterium bovis subsp bovis AF2122/97
ugcaggugcccggccaaaaug

SEQ ID NO: 3171373 - RNA, 12 nt, Mycobacterium bovis subsp bovis AF2122/97
ugcaggugcugg

SEQ ID NO: 3171374 - RNA, 13 nt, Mycobacterium bovis subsp bovis AF2122/97
ugcagguggccgu

SEQ ID NO: 3171375 - RNA, 18 nt, Mycobacterium bovis subsp bovis AF2122/97
ugcagguuaggguccagg

SEQ ID NO: 3171376 - RNA, 17 nt, Mycobacterium bovis subsp bovis AF2122/97
ugcagguuuccggccug

SEQ ID NO: 3171377 - RNA, 16 nt, Mycobacterium bovis subsp bovis AF2122/97
ugcaguaguagcgcaa

SEQ ID NO: 3171378 - RNA, 18 nt, Mycobacterium bovis subsp bovis AF2122/97
ugcaguaucgaggccgac

SEQ ID NO: 3171379 - RNA, 15 nt, Mycobacterium bovis subsp bovis AF2122/97
ugcaguccgaugccg

SEQ ID NO: 3171380 - RNA, 15 nt, Mycobacterium bovis subsp bovis AF2122/97
ugcagucgauuucgg

SEQ ID NO: 3171381 - RNA, 18 nt, Mycobacterium bovis subsp bovis AF2122/97
ugcagucggugcggugca

SEQ ID NO: 3171382 - RNA, 22 nt, Mycobacterium bovis subsp bovis AF2122/97
ugcagucggugcggugcacacu

SEQ ID NO: 3171383 - RNA, 17 nt, Mycobacterium bovis subsp bovis AF2122/97
ugcagugccgcacccag

SEQ ID NO: 3171384 - RNA, 18 nt, Mycobacterium bovis subsp bovis AF2122/97
ugcagugccucggcggcg

SEQ ID NO: 3171385 - RNA, 19 nt, Mycobacterium bovis subsp bovis AF2122/97
ugcagugcgacccgggcgu

SEQ ID NO: 3171386 - RNA, 22 nt, Mycobacterium bovis subsp bovis AF2122/97
ugcaguggauccggcagcagcc

SEQ ID NO: 3171387 - RNA, 16 nt, Mycobacterium bovis subsp bovis AF2122/97
ugcaguuccgcggggc

SEQ ID NO: 3171388 - RNA, 21 nt, Mycobacterium bovis subsp bovis AF2122/97
ugcaguuccuugagacgccgg

SEQ ID NO: 3171389 - RNA, 15 nt, Mycobacterium bovis subsp bovis AF2122/97
ugcauaccgccgggc

SEQ ID NO: 3171390 - RNA, 19 nt, Mycobacterium bovis subsp bovis AF2122/97
ugcauagcaauccgcacag

SEQ ID NO: 3171391 - RNA, 22 nt, Mycobacterium bovis subsp bovis AF2122/97
ugcauaggcgcggucaccgcgu

SEQ ID NO: 3171392 - RNA, 14 nt, Mycobacterium bovis subsp bovis AF2122/97
ugcaucaccacugg

SEQ ID NO: 3171393 - RNA, 18 nt, Mycobacterium bovis subsp bovis AF2122/97
ugcaucaugccgcccauc

SEQ ID NO: 3171394 - RNA, 20 nt, Mycobacterium bovis subsp bovis AF2122/97
ugcaucaugccgcccaucac

SEQ ID NO: 3171395 - RNA, 20 nt, Mycobacterium bovis subsp bovis AF2122/97
ugcaucauggccgugaacug

SEQ ID NO: 3171396 - RNA, 21 nt, Mycobacterium bovis subsp bovis AF2122/97
ugcauccacugcggcgcuggg

SEQ ID NO: 3171397 - RNA, 18 nt, Mycobacterium bovis subsp bovis AF2122/97
ugcauccggcccacucac

SEQ ID NO: 3171398 - RNA, 15 nt, Mycobacterium bovis subsp bovis AF2122/97
ugcaucgaucaccgc

SEQ ID NO: 3171399 - RNA, 14 nt, Mycobacterium bovis subsp bovis AF2122/97
ugcaucgccgcgau

SEQ ID NO: 3171400 - RNA, 16 nt, Mycobacterium bovis subsp bovis AF2122/97
ugcaucgccugcgccu

SEQ ID NO: 3171401 - RNA, 19 nt, Mycobacterium bovis subsp bovis AF2122/97
ugcaucgcgauuccggcgg

SEQ ID NO: 3171402 - RNA, 20 nt, Mycobacterium bovis subsp bovis AF2122/97
ugcaucgcggcggcgcucuu

SEQ ID NO: 3171403 - RNA, 22 nt, Mycobacterium bovis subsp bovis AF2122/97
ugcaucggcagccccugccgau

SEQ ID NO: 3171404 - RNA, 17 nt, Mycobacterium bovis subsp bovis AF2122/97
ugcaucggugcagcccg

SEQ ID NO: 3171405 - RNA, 15 nt, Mycobacterium bovis subsp bovis AF2122/97
ugcaugaacugcucg

SEQ ID NO: 3171406 - RNA, 19 nt, Mycobacterium bovis subsp bovis AF2122/97
ugcaugagcguucagcacg

SEQ ID NO: 3171407 - RNA, 23 nt, Mycobacterium bovis subsp bovis AF2122/97
ugcaugcccagaaaaccgccgca

SEQ ID NO: 3171408 - RNA, 16 nt, Mycobacterium bovis subsp bovis AF2122/97
ugcauggcuugcucug

SEQ ID NO: 3171409 - RNA, 15 nt, Mycobacterium bovis subsp bovis AF2122/97
ugccaaacgccgccc

SEQ ID NO: 3171410 - RNA, 17 nt, Mycobacterium bovis subsp bovis AF2122/97
ugccaaacgccgcccgc

SEQ ID NO: 3171411 - RNA, 21 nt, Mycobacterium bovis subsp bovis AF2122/97
ugccaaaggacgacaccgcga

SEQ ID NO: 3171412 - RNA, 22 nt, Mycobacterium bovis subsp bovis AF2122/97
ugccaacaacaucagcgacagc

SEQ ID NO: 3171413 - RNA, 14 nt, Mycobacterium bovis subsp bovis AF2122/97
ugccaaccgcggcg

SEQ ID NO: 3171414 - RNA, 13 nt, Mycobacterium bovis subsp bovis AF2122/97
ugccaacugcgcc

SEQ ID NO: 3171415 - RNA, 15 nt, Mycobacterium bovis subsp bovis AF2122/97
ugccaacugcgccgu

SEQ ID NO: 3171416 - RNA, 22 nt, Mycobacterium bovis subsp bovis AF2122/97
ugccaacugcgccguucgcucc

SEQ ID NO: 3171417 - RNA, 23 nt, Mycobacterium bovis subsp bovis AF2122/97
ugccaagcagcugggcaucaccg

SEQ ID NO: 3171418 - RNA, 15 nt, Mycobacterium bovis subsp bovis AF2122/97
ugccaaggccuucag

SEQ ID NO: 3171419 - RNA, 12 nt, Mycobacterium bovis subsp bovis AF2122/97
ugccaaucgcac

SEQ ID NO: 3171420 - RNA, 13 nt, Mycobacterium bovis subsp bovis AF2122/97
ugccaaucugcac

SEQ ID NO: 3171421 - RNA, 22 nt, Mycobacterium bovis subsp bovis AF2122/97
ugccaaugacuuggccagcagc

SEQ ID NO: 3171422 - RNA, 16 nt, Mycobacterium bovis subsp bovis AF2122/97
ugccaaugcugcaggu

SEQ ID NO: 3171423 - RNA, 16 nt, Mycobacterium bovis subsp bovis AF2122/97
ugccaauuccagcccc

SEQ ID NO: 3171424 - RNA, 23 nt, Mycobacterium bovis subsp bovis AF2122/97
ugccacacacugccggacagcca

SEQ ID NO: 3171425 - RNA, 22 nt, Mycobacterium bovis subsp bovis AF2122/97
ugccacacaggcguccaucgcc

SEQ ID NO: 3171426 - RNA, 23 nt, Mycobacterium bovis subsp bovis AF2122/97
ugccacagcucgccgugaccagg

SEQ ID NO: 3171427 - RNA, 12 nt, Mycobacterium bovis subsp bovis AF2122/97
ugccacaggcgu

SEQ ID NO: 3171428 - RNA, 14 nt, Mycobacterium bovis subsp bovis AF2122/97
ugccacaggugacc

SEQ ID NO: 3171429 - RNA, 18 nt, Mycobacterium bovis subsp bovis AF2122/97
ugccacaucccacggugg

SEQ ID NO: 3171430 - RNA, 18 nt, Mycobacterium bovis subsp bovis AF2122/97
ugccaccagugagcccgc

SEQ ID NO: 3171431 - RNA, 19 nt, Mycobacterium bovis subsp bovis AF2122/97
ugcccaaaaggaagaccuc

SEQ ID NO: 3171432 - RNA, 12 nt, Mycobacterium bovis subsp bovis AF2122/97
ugcccaagcccu

SEQ ID NO: 3171433 - RNA, 15 nt, Mycobacterium bovis subsp bovis AF2122/97
ugcccaaggccagga

SEQ ID NO: 3171434 - RNA, 17 nt, Mycobacterium bovis subsp bovis AF2122/97
ugcccaaggccaggauc

SEQ ID NO: 3171435 - RNA, 15 nt, Mycobacterium bovis subsp bovis AF2122/97
ugcccaccaucccgc

SEQ ID NO: 3171436 - RNA, 20 nt, Mycobacterium bovis subsp bovis AF2122/97
ugcccaccuucgaguuuggu

SEQ ID NO: 3171437 - RNA, 18 nt, Mycobacterium bovis subsp bovis AF2122/97
ugcccacgcacagcaacg

SEQ ID NO: 3171438 - RNA, 15 nt, Mycobacterium bovis subsp bovis AF2122/97
ugcccacgcgcagaa

SEQ ID NO: 3171439 - RNA, 18 nt, Mycobacterium bovis subsp bovis AF2122/97
ugcccacggcgaccacgc

SEQ ID NO: 3171440 - RNA, 23 nt, Mycobacterium bovis subsp bovis AF2122/97
ugcccacggcgaccacgccgccg

SEQ ID NO: 3171441 - RNA, 13 nt, Mycobacterium bovis subsp bovis AF2122/97
ugcccacgggccg

SEQ ID NO: 3171442 - RNA, 16 nt, Mycobacterium bovis subsp bovis AF2122/97
ugcccacgggccggcc

SEQ ID NO: 3171443 - RNA, 21 nt, Mycobacterium bovis subsp bovis AF2122/97
ugcccacgggccggccgagcg

SEQ ID NO: 3171444 - RNA, 22 nt, Mycobacterium bovis subsp bovis AF2122/97
ugcccacggugccggcacccga

SEQ ID NO: 3171445 - RNA, 19 nt, Mycobacterium bovis subsp bovis AF2122/97
ugcccagaaaaccgccgca

SEQ ID NO: 3171446 - RNA, 18 nt, Mycobacterium bovis subsp bovis AF2122/97
ugcccagcaccaccgcgg

SEQ ID NO: 3171447 - RNA, 15 nt, Mycobacterium bovis subsp bovis AF2122/97
ugcccagcagcgcga

SEQ ID NO: 3171448 - RNA, 18 nt, Mycobacterium bovis subsp bovis AF2122/97
ugcccagcaugaaguccc

SEQ ID NO: 3171449 - RNA, 17 nt, Mycobacterium bovis subsp bovis AF2122/97
ugcccagcgguugccgu

SEQ ID NO: 3171450 - RNA, 12 nt, Mycobacterium bovis subsp bovis AF2122/97
ugcccagcgugg

SEQ ID NO: 3171451 - RNA, 22 nt, Mycobacterium bovis subsp bovis AF2122/97
ugcccaggaaggcgacgccgaa

SEQ ID NO: 3171452 - RNA, 17 nt, Mycobacterium bovis subsp bovis AF2122/97
ugcccaggccaccggcu

SEQ ID NO: 3171453 - RNA, 17 nt, Mycobacterium bovis subsp bovis AF2122/97
ugcccaggcucgcaccg

SEQ ID NO: 3171454 - RNA, 16 nt, Mycobacterium bovis subsp bovis AF2122/97
ugcccaggugcgucca

SEQ ID NO: 3171455 - RNA, 18 nt, Mycobacterium bovis subsp bovis AF2122/97
ugcccaggugcguccagg

SEQ ID NO: 3171456 - RNA, 15 nt, Mycobacterium bovis subsp bovis AF2122/97
ugcccauagccaggu

SEQ ID NO: 3171457 - RNA, 18 nt, Mycobacterium bovis subsp bovis AF2122/97
ugcccauagccggugguc

SEQ ID NO: 3171458 - RNA, 15 nt, Mycobacterium bovis subsp bovis AF2122/97
ugcccaucccggccg

SEQ ID NO: 3171459 - RNA, 17 nt, Mycobacterium bovis subsp bovis AF2122/97
ugcccauccggccgucg

SEQ ID NO: 3171460 - RNA, 13 nt, Mycobacterium bovis subsp bovis AF2122/97
ugcccaucuccaa

SEQ ID NO: 3171461 - RNA, 19 nt, Mycobacterium bovis subsp bovis AF2122/97
ugcccaucuccaacaggaa

SEQ ID NO: 3171462 - RNA, 16 nt, Mycobacterium bovis subsp bovis AF2122/97
ugcccaugauggccgc

SEQ ID NO: 3171463 - RNA, 23 nt, Mycobacterium bovis subsp bovis AF2122/97
ugccccaagccauguggcgucgc

SEQ ID NO: 3171464 - RNA, 16 nt, Mycobacterium bovis subsp bovis AF2122/97
ugccccacccgcggcg

SEQ ID NO: 3171465 - RNA, 19 nt, Mycobacterium bovis subsp bovis AF2122/97
ugccccaucguucguugac

SEQ ID NO: 3171466 - RNA, 14 nt, Mycobacterium bovis subsp bovis AF2122/97
ugccccaugcgcag

SEQ ID NO: 3171467 - RNA, 19 nt, Mycobacterium bovis subsp bovis AF2122/97
ugcccccauugccgccguc

SEQ ID NO: 3171468 - RNA, 15 nt, Mycobacterium bovis subsp bovis AF2122/97
ugcccccgccggccg

SEQ ID NO: 3171469 - RNA, 13 nt, Mycobacterium bovis subsp bovis AF2122/97
ugcccccggcgcg

SEQ ID NO: 3171470 - RNA, 19 nt, Mycobacterium bovis subsp bovis AF2122/97
ugcccccggugccgcccgc

SEQ ID NO: 3171471 - RNA, 20 nt, Mycobacterium bovis subsp bovis AF2122/97
ugcccccguugccgccuguc

SEQ ID NO: 3171472 - RNA, 16 nt, Mycobacterium bovis subsp bovis AF2122/97
ugccccgaccgccgug

SEQ ID NO: 3171473 - RNA, 20 nt, Mycobacterium bovis subsp bovis AF2122/97
ugccccgaccgccguggccg

SEQ ID NO: 3171474 - RNA, 17 nt, Mycobacterium bovis subsp bovis AF2122/97
ugccccgaccgcguaca

SEQ ID NO: 3171475 - RNA, 16 nt, Mycobacterium bovis subsp bovis AF2122/97
ugccccgagcugccgu

SEQ ID NO: 3171476 - RNA, 22 nt, Mycobacterium bovis subsp bovis AF2122/97
ugccccgagcugccgucgcugc

SEQ ID NO: 3171477 - RNA, 20 nt, Mycobacterium bovis subsp bovis AF2122/97
ugccccgcaucgcccaagcc

SEQ ID NO: 3171478 - RNA, 12 nt, Mycobacterium bovis subsp bovis AF2122/97
ugccccgcccgg

SEQ ID NO: 3171479 - RNA, 14 nt, Mycobacterium bovis subsp bovis AF2122/97
ugccccgccgagcg

SEQ ID NO: 3171480 - RNA, 13 nt, Mycobacterium bovis subsp bovis AF2122/97
ugccccgccgcca

SEQ ID NO: 3171481 - RNA, 14 nt, Mycobacterium bovis subsp bovis AF2122/97
ugccccgccuuggc

SEQ ID NO: 3171482 - RNA, 16 nt, Mycobacterium bovis subsp bovis AF2122/97
ugccccgccuuggcca

SEQ ID NO: 3171483 - RNA, 17 nt, Mycobacterium bovis subsp bovis AF2122/97
ugccccggucggcgacg

SEQ ID NO: 3171484 - RNA, 19 nt, Mycobacterium bovis subsp bovis AF2122/97
ugccccgguugaucuuguc

SEQ ID NO: 3171485 - RNA, 19 nt, Mycobacterium bovis subsp bovis AF2122/97
ugccccguugagcagcacc

SEQ ID NO: 3171486 - RNA, 14 nt, Mycobacterium bovis subsp bovis AF2122/97
ugccccuccgggcg

SEQ ID NO: 3171487 - RNA, 20 nt, Mycobacterium bovis subsp bovis AF2122/97
ugccccuucaaagcggccuc

SEQ ID NO: 3171488 - RNA, 15 nt, Mycobacterium bovis subsp bovis AF2122/97
ugcccgacacccgca

SEQ ID NO: 3171489 - RNA, 16 nt, Mycobacterium bovis subsp bovis AF2122/97
ugcccgacacccgcau

SEQ ID NO: 3171490 - RNA, 23 nt, Mycobacterium bovis subsp bovis AF2122/97
ugcccgacacccgcauggcagcg

SEQ ID NO: 3171491 - RNA, 22 nt, Mycobacterium bovis subsp bovis AF2122/97
ugcccgaccacaccgggauggg

SEQ ID NO: 3171492 - RNA, 16 nt, Mycobacterium bovis subsp bovis AF2122/97
ugcccgacccgccgac

SEQ ID NO: 3171493 - RNA, 20 nt, Mycobacterium bovis subsp bovis AF2122/97
ugcccgacccgccgacgccg

SEQ ID NO: 3171494 - RNA, 23 nt, Mycobacterium bovis subsp bovis AF2122/97
ugcccgacccgccgacgccgccg

SEQ ID NO: 3171495 - RNA, 16 nt, Mycobacterium bovis subsp bovis AF2122/97
ugcccgacccgccgau

SEQ ID NO: 3171496 - RNA, 15 nt, Mycobacterium bovis subsp bovis AF2122/97
ugcccgacgagucgc

SEQ ID NO: 3171497 - RNA, 18 nt, Mycobacterium bovis subsp bovis AF2122/97
ugcccgacgagucgccgc

SEQ ID NO: 3171498 - RNA, 14 nt, Mycobacterium bovis subsp bovis AF2122/97
ugcccgacggcguc

SEQ ID NO: 3171499 - RNA, 20 nt, Mycobacterium bovis subsp bovis AF2122/97
ugcccgacugaacgucaccg

SEQ ID NO: 3171500 - RNA, 23 nt, Mycobacterium bovis subsp bovis AF2122/97
ugcccgacugaacgucaccguug

SEQ ID NO: 3171501 - RNA, 18 nt, Mycobacterium bovis subsp bovis AF2122/97
ugcccgagcccagcgccu

SEQ ID NO: 3171502 - RNA, 22 nt, Mycobacterium bovis subsp bovis AF2122/97
ugcccgaucgcuuccucguagg

SEQ ID NO: 3171503 - RNA, 21 nt, Mycobacterium bovis subsp bovis AF2122/97
ugcccgaugguacccgcgccg

SEQ ID NO: 3171504 - RNA, 14 nt, Mycobacterium bovis subsp bovis AF2122/97
ugcccgcaccgcgu

SEQ ID NO: 3171505 - RNA, 19 nt, Mycobacterium bovis subsp bovis AF2122/97
ugcccgcaccguagccgcu

SEQ ID NO: 3171506 - RNA, 18 nt, Mycobacterium bovis subsp bovis AF2122/97
ugcccgcacugccgccgg

SEQ ID NO: 3171507 - RNA, 18 nt, Mycobacterium bovis subsp bovis AF2122/97
ugcccgcauugccaacgc

SEQ ID NO: 3171508 - RNA, 14 nt, Mycobacterium bovis subsp bovis AF2122/97
ugcccgccaccggc

SEQ ID NO: 3171509 - RNA, 19 nt, Mycobacterium bovis subsp bovis AF2122/97
ugcccgccaccggcgcgac

SEQ ID NO: 3171510 - RNA, 21 nt, Mycobacterium bovis subsp bovis AF2122/97
ugcccgccaccggcgcgaccg

SEQ ID NO: 3171511 - RNA, 17 nt, Mycobacterium bovis subsp bovis AF2122/97
ugcccgccacgcucggu

SEQ ID NO: 3171512 - RNA, 18 nt, Mycobacterium bovis subsp bovis AF2122/97
ugcccgccagcgccgccg

SEQ ID NO: 3171513 - RNA, 13 nt, Mycobacterium bovis subsp bovis AF2122/97
ugcccgccagucc

SEQ ID NO: 3171514 - RNA, 14 nt, Mycobacterium bovis subsp bovis AF2122/97
ugcccgcccagccc

SEQ ID NO: 3171515 - RNA, 17 nt, Mycobacterium bovis subsp bovis AF2122/97
ugcccgcccagcccggc

SEQ ID NO: 3171516 - RNA, 13 nt, Mycobacterium bovis subsp bovis AF2122/97
ugcccgccccgac

SEQ ID NO: 3171517 - RNA, 21 nt, Mycobacterium bovis subsp bovis AF2122/97
ugcccgccguagaccagccgu

SEQ ID NO: 3171518 - RNA, 12 nt, Mycobacterium bovis subsp bovis AF2122/97
ugccgacgucgg

SEQ ID NO: 3171519 - RNA, 17 nt, Mycobacterium bovis subsp bovis AF2122/97
ugccgacucaucggccg

SEQ ID NO: 3171520 - RNA, 23 nt, Mycobacterium bovis subsp bovis AF2122/97
ugccgacucaucggccgcggucg

SEQ ID NO: 3171521 - RNA, 15 nt, Mycobacterium bovis subsp bovis AF2122/97
ugccgagaacaccgg

SEQ ID NO: 3171522 - RNA, 15 nt, Mycobacterium bovis subsp bovis AF2122/97
ugccgagcacgacga

SEQ ID NO: 3171523 - RNA, 22 nt, Mycobacterium bovis subsp bovis AF2122/97
ugccgagcacgacgacgucggg

SEQ ID NO: 3171524 - RNA, 19 nt, Mycobacterium bovis subsp bovis AF2122/97
ugccgagcacucggccacg

SEQ ID NO: 3171525 - RNA, 14 nt, Mycobacterium bovis subsp bovis AF2122/97
ugccgagcccaggu

SEQ ID NO: 3171526 - RNA, 19 nt, Mycobacterium bovis subsp bovis AF2122/97
ugccgagcuucagcgcgcu

SEQ ID NO: 3171527 - RNA, 17 nt, Mycobacterium bovis subsp bovis AF2122/97
ugccgaguuccugcacg

SEQ ID NO: 3171528 - RNA, 15 nt, Mycobacterium bovis subsp bovis AF2122/97
ugccgauagcgcggc

SEQ ID NO: 3171529 - RNA, 14 nt, Mycobacterium bovis subsp bovis AF2122/97
ugccgaucagcagu

SEQ ID NO: 3171530 - RNA, 16 nt, Mycobacterium bovis subsp bovis AF2122/97
ugccgaucagcccggc

SEQ ID NO: 3171531 - RNA, 13 nt, Mycobacterium bovis subsp bovis AF2122/97
ugccgaucagcug

SEQ ID NO: 3171532 - RNA, 12 nt, Mycobacterium bovis subsp bovis AF2122/97
ugccgaucccca

SEQ ID NO: 3171533 - RNA, 13 nt, Mycobacterium bovis subsp bovis AF2122/97
ugccgauccccag

SEQ ID NO: 3171534 - RNA, 23 nt, Mycobacterium bovis subsp bovis AF2122/97
ugccgaucccgugguggcgccau

SEQ ID NO: 3171535 - RNA, 15 nt, Mycobacterium bovis subsp bovis AF2122/97
ugccgaucgaugcca

SEQ ID NO: 3171536 - RNA, 19 nt, Mycobacterium bovis subsp bovis AF2122/97
ugccgaucggccaacaggu

SEQ ID NO: 3171537 - RNA, 19 nt, Mycobacterium bovis subsp bovis AF2122/97
ugccgaucugcucgccgag

SEQ ID NO: 3171538 - RNA, 23 nt, Mycobacterium bovis subsp bovis AF2122/97
ugccgaucugcucgccgagcucg

SEQ ID NO: 3171539 - RNA, 15 nt, Mycobacterium bovis subsp bovis AF2122/97
ugccgaugacgaugc

SEQ ID NO: 3171540 - RNA, 12 nt, Mycobacterium bovis subsp bovis AF2122/97
ugccgaugccgg

SEQ ID NO: 3171541 - RNA, 19 nt, Mycobacterium bovis subsp bovis AF2122/97
ugccgaugcgacgcagacc

SEQ ID NO: 3171542 - RNA, 19 nt, Mycobacterium bovis subsp bovis AF2122/97
ugccgauggaugggcugcg

SEQ ID NO: 3171543 - RNA, 22 nt, Mycobacterium bovis subsp bovis AF2122/97
ugccgauggaugggcugcgcgu

SEQ ID NO: 3171544 - RNA, 21 nt, Mycobacterium bovis subsp bovis AF2122/97
ugccgaugucgaugccgcgca

SEQ ID NO: 3171545 - RNA, 18 nt, Mycobacterium bovis subsp bovis AF2122/97
ugccgauuacggugaucg

SEQ ID NO: 3171546 - RNA, 17 nt, Mycobacterium bovis subsp bovis AF2122/97
ugccgcaccaaggccgc

SEQ ID NO: 3171547 - RNA, 18 nt, Mycobacterium bovis subsp bovis AF2122/97
ugccgcaccaaggccgcc

SEQ ID NO: 3171548 - RNA, 14 nt, Mycobacterium bovis subsp bovis AF2122/97
ugccgcacccccuc

SEQ ID NO: 3171549 - RNA, 14 nt, Mycobacterium bovis subsp bovis AF2122/97
ugccgcacccgguc

SEQ ID NO: 3171550 - RNA, 15 nt, Mycobacterium bovis subsp bovis AF2122/97
ugccgcaccggugcu

SEQ ID NO: 3171551 - RNA, 22 nt, Mycobacterium bovis subsp bovis AF2122/97
ugccgcacgauggccgucgauc

SEQ ID NO: 3171552 - RNA, 18 nt, Mycobacterium bovis subsp bovis AF2122/97
ugccgcacguucggcgau

SEQ ID NO: 3171553 - RNA, 20 nt, Mycobacterium bovis subsp bovis AF2122/97
ugccgcacguucggcgauga

SEQ ID NO: 3171554 - RNA, 22 nt, Mycobacterium bovis subsp bovis AF2122/97
ugccgcagaugaaagugccagu

SEQ ID NO: 3171555 - RNA, 13 nt, Mycobacterium bovis subsp bovis AF2122/97
ugccgcagcggcg

SEQ ID NO: 3171556 - RNA, 16 nt, Mycobacterium bovis subsp bovis AF2122/97
ugccgcagcggcggca

SEQ ID NO: 3171557 - RNA, 22 nt, Mycobacterium bovis subsp bovis AF2122/97
ugccgcagcggcggcaacccug

SEQ ID NO: 3171558 - RNA, 16 nt, Mycobacterium bovis subsp bovis AF2122/97
ugccgcaggaagucga

SEQ ID NO: 3171559 - RNA, 16 nt, Mycobacterium bovis subsp bovis AF2122/97
ugccgcauacgcggcu

SEQ ID NO: 3171560 - RNA, 23 nt, Mycobacterium bovis subsp bovis AF2122/97
ugccgcauaucacccggagaccg

SEQ ID NO: 3171561 - RNA, 16 nt, Mycobacterium bovis subsp bovis AF2122/97
ugccgcaucacccggg

SEQ ID NO: 3171562 - RNA, 19 nt, Mycobacterium bovis subsp bovis AF2122/97
ugccgcaugcgcuccggcg

SEQ ID NO: 3171563 - RNA, 21 nt, Mycobacterium bovis subsp bovis AF2122/97
ugccgcaugcgcuccggcgcg

SEQ ID NO: 3171564 - RNA, 14 nt, Mycobacterium bovis subsp bovis AF2122/97
ugccgccaccaccg

SEQ ID NO: 3171565 - RNA, 18 nt, Mycobacterium bovis subsp bovis AF2122/97
ugccgccaccaccggcgc

SEQ ID NO: 3171566 - RNA, 20 nt, Mycobacterium bovis subsp bovis AF2122/97
ugccgccaccgccaccgcgg

SEQ ID NO: 3171567 - RNA, 21 nt, Mycobacterium bovis subsp bovis AF2122/97
ugccgccaccgcugucgaugg

SEQ ID NO: 3171568 - RNA, 23 nt, Mycobacterium bovis subsp bovis AF2122/97
ugccgccaccgcugucgauggac

SEQ ID NO: 3171569 - RNA, 15 nt, Mycobacterium bovis subsp bovis AF2122/97
ugccgccaccggcgu

SEQ ID NO: 3171570 - RNA, 22 nt, Mycobacterium bovis subsp bovis AF2122/97
ugccgccaccggcguccagucc

SEQ ID NO: 3171571 - RNA, 20 nt, Mycobacterium bovis subsp bovis AF2122/97
ugccgccaccuuggcugggc

SEQ ID NO: 3171572 - RNA, 21 nt, Mycobacterium bovis subsp bovis AF2122/97
ugccgccagcaacccugcggu

SEQ ID NO: 3171573 - RNA, 16 nt, Mycobacterium bovis subsp bovis AF2122/97
ugccgccagcccagcc

SEQ ID NO: 3171574 - RNA, 17 nt, Mycobacterium bovis subsp bovis AF2122/97
ugccgccagcccagccc

SEQ ID NO: 3171575 - RNA, 14 nt, Mycobacterium bovis subsp bovis AF2122/97
ugccgccaggcucg

SEQ ID NO: 3171576 - RNA, 14 nt, Mycobacterium bovis subsp bovis AF2122/97
ugccgccaucaccg

SEQ ID NO: 3171577 - RNA, 15 nt, Mycobacterium bovis subsp bovis AF2122/97
ugccgccaucaccgc

SEQ ID NO: 3171578 - RNA, 15 nt, Mycobacterium bovis subsp bovis AF2122/97
ugccgccaucgccgc

SEQ ID NO: 3171579 - RNA, 19 nt, Mycobacterium bovis subsp bovis AF2122/97
ugccgcccaccacacagcc

SEQ ID NO: 3171580 - RNA, 20 nt, Mycobacterium bovis subsp bovis AF2122/97
ugccgcccaccacacagccg

SEQ ID NO: 3171581 - RNA, 19 nt, Mycobacterium bovis subsp bovis AF2122/97
ugccgcccacgcugcccac

SEQ ID NO: 3171582 - RNA, 21 nt, Mycobacterium bovis subsp bovis AF2122/97
ugccgcccaggagcaccucga

SEQ ID NO: 3171583 - RNA, 16 nt, Mycobacterium bovis subsp bovis AF2122/97
ugccgcccaugccggg

SEQ ID NO: 3171584 - RNA, 20 nt, Mycobacterium bovis subsp bovis AF2122/97
ugccgcccccauaacugcgg

SEQ ID NO: 3171585 - RNA, 16 nt, Mycobacterium bovis subsp bovis AF2122/97
ugccgcccgagccggu

SEQ ID NO: 3171586 - RNA, 14 nt, Mycobacterium bovis subsp bovis AF2122/97
ugccgcccgcgccg

SEQ ID NO: 3171587 - RNA, 17 nt, Mycobacterium bovis subsp bovis AF2122/97
ugccgcccgcgccgccg

SEQ ID NO: 3171588 - RNA, 19 nt, Mycobacterium bovis subsp bovis AF2122/97
ugccgcccgcgccgccgcu

SEQ ID NO: 3171589 - RNA, 18 nt, Mycobacterium bovis subsp bovis AF2122/97
ugccgcccgcgccgccgg

SEQ ID NO: 3171590 - RNA, 22 nt, Mycobacterium bovis subsp bovis AF2122/97
ugccgcccgcgccgccggaccc

SEQ ID NO: 3171591 - RNA, 16 nt, Mycobacterium bovis subsp bovis AF2122/97
ugccgcccgcuccgcc

SEQ ID NO: 3171592 - RNA, 15 nt, Mycobacterium bovis subsp bovis AF2122/97
ugccgcccucaccgc

SEQ ID NO: 3171593 - RNA, 19 nt, Mycobacterium bovis subsp bovis AF2122/97
ugccgcccuugccgcccgc

SEQ ID NO: 3171594 - RNA, 15 nt, Mycobacterium bovis subsp bovis AF2122/97
ugccgccgaacagcu

SEQ ID NO: 3171595 - RNA, 11 nt, Mycobacterium bovis subsp bovis AF2122/97
ugccgccgaag

SEQ ID NO: 3171596 - RNA, 15 nt, Mycobacterium bovis subsp bovis AF2122/97
ugccgccgaagccga

SEQ ID NO: 3171597 - RNA, 16 nt, Mycobacterium bovis subsp bovis AF2122/97
ugccgccgaagccgac

SEQ ID NO: 3171598 - RNA, 19 nt, Mycobacterium bovis subsp bovis AF2122/97
ugccgccgacaccaccggc

SEQ ID NO: 3171599 - RNA, 16 nt, Mycobacterium bovis subsp bovis AF2122/97
ugccgccgacgccgcc

SEQ ID NO: 3171600 - RNA, 16 nt, Mycobacterium bovis subsp bovis AF2122/97
ugccgccgagcuggcg

SEQ ID NO: 3171601 - RNA, 23 nt, Mycobacterium bovis subsp bovis AF2122/97
ugccgccgagcuggcgcgcgggg

SEQ ID NO: 3171602 - RNA, 18 nt, Mycobacterium bovis subsp bovis AF2122/97
ugccgccgagggcgccgg

SEQ ID NO: 3171603 - RNA, 21 nt, Mycobacterium bovis subsp bovis AF2122/97
ugccgccgauaccgccggccc

SEQ ID NO: 3171604 - RNA, 19 nt, Mycobacterium bovis subsp bovis AF2122/97
ugccggacagccacgcaca

SEQ ID NO: 3171605 - RNA, 21 nt, Mycobacterium bovis subsp bovis AF2122/97
ugccggacuaccgccggcggc

SEQ ID NO: 3171606 - RNA, 16 nt, Mycobacterium bovis subsp bovis AF2122/97
ugccggacugccgcag

SEQ ID NO: 3171607 - RNA, 20 nt, Mycobacterium bovis subsp bovis AF2122/97
ugccggacugccgcaggaag

SEQ ID NO: 3171608 - RNA, 15 nt, Mycobacterium bovis subsp bovis AF2122/97
ugccggacuuggccu

SEQ ID NO: 3171609 - RNA, 13 nt, Mycobacterium bovis subsp bovis AF2122/97
ugccggaguugaa

SEQ ID NO: 3171610 - RNA, 15 nt, Mycobacterium bovis subsp bovis AF2122/97
ugccggaucgggacc

SEQ ID NO: 3171611 - RNA, 14 nt, Mycobacterium bovis subsp bovis AF2122/97
ugccggcaacagcu

SEQ ID NO: 3171612 - RNA, 23 nt, Mycobacterium bovis subsp bovis AF2122/97
ugccggcacccgucgggugcuga

SEQ ID NO: 3171613 - RNA, 23 nt, Mycobacterium bovis subsp bovis AF2122/97
ugccggcacgccgaccgguggca

SEQ ID NO: 3171614 - RNA, 12 nt, Mycobacterium bovis subsp bovis AF2122/97
ugccggcagcgg

SEQ ID NO: 3171615 - RNA, 16 nt, Mycobacterium bovis subsp bovis AF2122/97
ugccggcagcgguggc

SEQ ID NO: 3171616 - RNA, 21 nt, Mycobacterium bovis subsp bovis AF2122/97
ugccggcauaaaccgcguccg

SEQ ID NO: 3171617 - RNA, 22 nt, Mycobacterium bovis subsp bovis AF2122/97
ugccggccaaguugacccccuc

SEQ ID NO: 3171618 - RNA, 13 nt, Mycobacterium bovis subsp bovis AF2122/97
ugccggccaccag

SEQ ID NO: 3171619 - RNA, 14 nt, Mycobacterium bovis subsp bovis AF2122/97
ugccggccaccguc

SEQ ID NO: 3171620 - RNA, 15 nt, Mycobacterium bovis subsp bovis AF2122/97
ugccggccagacggu

SEQ ID NO: 3171621 - RNA, 19 nt, Mycobacterium bovis subsp bovis AF2122/97
ugccggccagacucgcggu

SEQ ID NO: 3171622 - RNA, 23 nt, Mycobacterium bovis subsp bovis AF2122/97
ugccggccagacucgcggucgac

SEQ ID NO: 3171623 - RNA, 12 nt, Mycobacterium bovis subsp bovis AF2122/97
ugccggcccgca

SEQ ID NO: 3171624 - RNA, 12 nt, Mycobacterium bovis subsp bovis AF2122/97
ugccggcccugc

SEQ ID NO: 3171625 - RNA, 19 nt, Mycobacterium bovis subsp bovis AF2122/97
ugccggcccugcucggcca

SEQ ID NO: 3171626 - RNA, 11 nt, Mycobacterium bovis subsp bovis AF2122/97
ugccggccgcg

SEQ ID NO: 3171627 - RNA, 22 nt, Mycobacterium bovis subsp bovis AF2122/97
ugccggccgcguaaaccggcug

SEQ ID NO: 3171628 - RNA, 15 nt, Mycobacterium bovis subsp bovis AF2122/97
ugccggccggcgggc

SEQ ID NO: 3171629 - RNA, 14 nt, Mycobacterium bovis subsp bovis AF2122/97
ugccggcgaacucg

SEQ ID NO: 3171630 - RNA, 19 nt, Mycobacterium bovis subsp bovis AF2122/97
ugccggcgaacucgcgccg

SEQ ID NO: 3171631 - RNA, 18 nt, Mycobacterium bovis subsp bovis AF2122/97
ugccggcgaagccggccg

SEQ ID NO: 3171632 - RNA, 22 nt, Mycobacterium bovis subsp bovis AF2122/97
ugccggcgaagccggccgggaa

SEQ ID NO: 3171633 - RNA, 20 nt, Mycobacterium bovis subsp bovis AF2122/97
ugccggcgaccaaggccgac

SEQ ID NO: 3171634 - RNA, 20 nt, Mycobacterium bovis subsp bovis AF2122/97
ugccggcgaccaggauuaag

SEQ ID NO: 3171635 - RNA, 14 nt, Mycobacterium bovis subsp bovis AF2122/97
ugccggcgacgcua

SEQ ID NO: 3171636 - RNA, 21 nt, Mycobacterium bovis subsp bovis AF2122/97
ugccggcgacgcuaccgccgg

SEQ ID NO: 3171637 - RNA, 22 nt, Mycobacterium bovis subsp bovis AF2122/97
ugccggcgacgcuaccgccgga

SEQ ID NO: 3171638 - RNA, 21 nt, Mycobacterium bovis subsp bovis AF2122/97
ugccggcgagagcgucaacca

SEQ ID NO: 3171639 - RNA, 19 nt, Mycobacterium bovis subsp bovis AF2122/97
ugccggcgagggccacggc

SEQ ID NO: 3171640 - RNA, 20 nt, Mycobacterium bovis subsp bovis AF2122/97
ugccggcgauguuggccagc

SEQ ID NO: 3171641 - RNA, 12 nt, Mycobacterium bovis subsp bovis AF2122/97
ugccggcgccgc

SEQ ID NO: 3171642 - RNA, 24 nt, Mycobacterium bovis subsp bovis AF2122/97
ugccggcgccgccagcaccaccgg

SEQ ID NO: 3171643 - RNA, 14 nt, Mycobacterium bovis subsp bovis AF2122/97
ugccggcgccgccc

SEQ ID NO: 3171644 - RNA, 21 nt, Mycobacterium bovis subsp bovis AF2122/97
ugccggcgccuuggucgccgc

SEQ ID NO: 3171645 - RNA, 19 nt, Mycobacterium bovis subsp bovis AF2122/97
ugccggcgcggagugccca

SEQ ID NO: 3171646 - RNA, 18 nt, Mycobacterium bovis subsp bovis AF2122/97
ugccggcggaucugaucg

SEQ ID NO: 3171647 - RNA, 20 nt, Mycobacterium bovis subsp bovis AF2122/97
ugccggcggugacggcggca

SEQ ID NO: 3171648 - RNA, 18 nt, Mycobacterium bovis subsp bovis AF2122/97
ugccggcgguggccgaca

SEQ ID NO: 3171649 - RNA, 20 nt, Mycobacterium bovis subsp bovis AF2122/97
ugccggcgucgcuggccagg

SEQ ID NO: 3171650 - RNA, 15 nt, Mycobacterium bovis subsp bovis AF2122/97
ugccggcgugcgcga

SEQ ID NO: 3171651 - RNA, 18 nt, Mycobacterium bovis subsp bovis AF2122/97
ugccggcgugcggcgagg

SEQ ID NO: 3171652 - RNA, 18 nt, Mycobacterium bovis subsp bovis AF2122/97
ugccggcguuagcguagc

SEQ ID NO: 3171653 - RNA, 22 nt, Mycobacterium bovis subsp bovis AF2122/97
ugccggcguuagcguagcccga

SEQ ID NO: 3171654 - RNA, 16 nt, Mycobacterium bovis subsp bovis AF2122/97
ugccggcguugccgcc

SEQ ID NO: 3171655 - RNA, 16 nt, Mycobacterium bovis subsp bovis AF2122/97
ugccggcuagcucggc

SEQ ID NO: 3171656 - RNA, 18 nt, Mycobacterium bovis subsp bovis AF2122/97
ugccggcuagcucggcgg

SEQ ID NO: 3171657 - RNA, 18 nt, Mycobacterium bovis subsp bovis AF2122/97
ugccggcugacgaccaac

SEQ ID NO: 3171658 - RNA, 22 nt, Mycobacterium bovis subsp bovis AF2122/97
ugccggcuuaaggcccuggccg

SEQ ID NO: 3171659 - RNA, 13 nt, Mycobacterium bovis subsp bovis AF2122/97
ugccggcuuggcc

SEQ ID NO: 3171660 - RNA, 22 nt, Mycobacterium bovis subsp bovis AF2122/97
ugccgggaaccaacaccagguc

SEQ ID NO: 3171661 - RNA, 23 nt, Mycobacterium bovis subsp bovis AF2122/97
ugccgggaacgagguagcgcgca

SEQ ID NO: 3171662 - RNA, 13 nt, Mycobacterium bovis subsp bovis AF2122/97
ugccgggaccggu

SEQ ID NO: 3171663 - RNA, 14 nt, Mycobacterium bovis subsp bovis AF2122/97
ugccgggagacgcu

SEQ ID NO: 3171664 - RNA, 16 nt, Mycobacterium bovis subsp bovis AF2122/97
ugccgggaugccgccg

SEQ ID NO: 3171665 - RNA, 13 nt, Mycobacterium bovis subsp bovis AF2122/97
ugccgggcaccac

SEQ ID NO: 3171666 - RNA, 14 nt, Mycobacterium bovis subsp bovis AF2122/97
ugccgggcccagca

SEQ ID NO: 3171667 - RNA, 20 nt, Mycobacterium bovis subsp bovis AF2122/97
ugccgggcccagcaggucgu

SEQ ID NO: 3171668 - RNA, 22 nt, Mycobacterium bovis subsp bovis AF2122/97
ugccgggcccagcaggucgucg

SEQ ID NO: 3171669 - RNA, 23 nt, Mycobacterium bovis subsp bovis AF2122/97
ugccgggcccagcaggucgucgg

SEQ ID NO: 3171670 - RNA, 13 nt, Mycobacterium bovis subsp bovis AF2122/97
ugccgggccgccg

SEQ ID NO: 3171671 - RNA, 15 nt, Mycobacterium bovis subsp bovis AF2122/97
ugccgggccgccgag

SEQ ID NO: 3171672 - RNA, 19 nt, Mycobacterium bovis subsp bovis AF2122/97
ugccgggcgaugcugggcg

SEQ ID NO: 3171673 - RNA, 19 nt, Mycobacterium bovis subsp bovis AF2122/97
ugccgggcgcacgcccgca

SEQ ID NO: 3171674 - RNA, 21 nt, Mycobacterium bovis subsp bovis AF2122/97
ugccgggcgcuggacggcggg

SEQ ID NO: 3171675 - RNA, 13 nt, Mycobacterium bovis subsp bovis AF2122/97
ugccggggcccca

SEQ ID NO: 3171676 - RNA, 16 nt, Mycobacterium bovis subsp bovis AF2122/97
ugccggggcugccgcc

SEQ ID NO: 3171677 - RNA, 18 nt, Mycobacterium bovis subsp bovis AF2122/97
ugccgggguggcgcgcca

SEQ ID NO: 3171678 - RNA, 18 nt, Mycobacterium bovis subsp bovis AF2122/97
ugccgggguuggucgucg

SEQ ID NO: 3171679 - RNA, 20 nt, Mycobacterium bovis subsp bovis AF2122/97
ugccgguagcacagcagcaa

SEQ ID NO: 3171680 - RNA, 21 nt, Mycobacterium bovis subsp bovis AF2122/97
ugccgguagcacagcagcaac

SEQ ID NO: 3171681 - RNA, 23 nt, Mycobacterium bovis subsp bovis AF2122/97
ugccggucaacccucgccacgca

SEQ ID NO: 3171682 - RNA, 13 nt, Mycobacterium bovis subsp bovis AF2122/97
ugccggucaggca

SEQ ID NO: 3171683 - RNA, 19 nt, Mycobacterium bovis subsp bovis AF2122/97
ugccggucaggcaguccac

SEQ ID NO: 3171684 - RNA, 14 nt, Mycobacterium bovis subsp bovis AF2122/97
ugccggucauacca

SEQ ID NO: 3171685 - RNA, 17 nt, Mycobacterium bovis subsp bovis AF2122/97
ugccggucauccgggcg

SEQ ID NO: 3171686 - RNA, 14 nt, Mycobacterium bovis subsp bovis AF2122/97
ugccggucgagugc

SEQ ID NO: 3171687 - RNA, 13 nt, Mycobacterium bovis subsp bovis AF2122/97
ugccggucgauga

SEQ ID NO: 3171688 - RNA, 19 nt, Mycobacterium bovis subsp bovis AF2122/97
ugccggucgcauggucgac

SEQ ID NO: 3171689 - RNA, 17 nt, Mycobacterium bovis subsp bovis AF2122/97
ugccggugauggccgac

SEQ ID NO: 3171690 - RNA, 21 nt, Mycobacterium bovis subsp bovis AF2122/97
ugccuuacacgccuggcuacg

SEQ ID NO: 3171691 - RNA, 22 nt, Mycobacterium bovis subsp bovis AF2122/97
ugccuucaccgaggaucaucaa

SEQ ID NO: 3171692 - RNA, 20 nt, Mycobacterium bovis subsp bovis AF2122/97
ugccuuccucggcaaaccaa

SEQ ID NO: 3171693 - RNA, 23 nt, Mycobacterium bovis subsp bovis AF2122/97
ugccuuccucggcaaaccaagcg

SEQ ID NO: 3171694 - RNA, 14 nt, Mycobacterium bovis subsp bovis AF2122/97
ugccuucggcgagc

SEQ ID NO: 3171695 - RNA, 17 nt, Mycobacterium bovis subsp bovis AF2122/97
ugccuucguagaaggac

SEQ ID NO: 3171696 - RNA, 17 nt, Mycobacterium bovis subsp bovis AF2122/97
ugccuucguagcggccg

SEQ ID NO: 3171697 - RNA, 16 nt, Mycobacterium bovis subsp bovis AF2122/97
ugccuucuaccgaaua

SEQ ID NO: 3171698 - RNA, 21 nt, Mycobacterium bovis subsp bovis AF2122/97
ugccuucuuugccggcgccuu

SEQ ID NO: 3171699 - RNA, 14 nt, Mycobacterium bovis subsp bovis AF2122/97
ugccuuggcagccc

SEQ ID NO: 3171700 - RNA, 17 nt, Mycobacterium bovis subsp bovis AF2122/97
ugccuuggcagcccagu

SEQ ID NO: 3171701 - RNA, 16 nt, Mycobacterium bovis subsp bovis AF2122/97
ugccuugggaccgcgc

SEQ ID NO: 3171702 - RNA, 19 nt, Mycobacterium bovis subsp bovis AF2122/97
ugccuuuauuaauacuggg

SEQ ID NO: 3171703 - RNA, 21 nt, Mycobacterium bovis subsp bovis AF2122/97
ugccuuugcggcgggcaccgu

SEQ ID NO: 3171704 - RNA, 18 nt, Mycobacterium bovis subsp bovis AF2122/97
ugcgaaaauccgugccga

SEQ ID NO: 3171705 - RNA, 17 nt, Mycobacterium bovis subsp bovis AF2122/97
ugcgaaacgcuggccac

SEQ ID NO: 3171706 - RNA, 19 nt, Mycobacterium bovis subsp bovis AF2122/97
ugcgaaacgcuggccacuc

SEQ ID NO: 3171707 - RNA, 21 nt, Mycobacterium bovis subsp bovis AF2122/97
ugcgaaacgcuggccacucac

SEQ ID NO: 3171708 - RNA, 14 nt, Mycobacterium bovis subsp bovis AF2122/97
ugcgaaaguggugg

SEQ ID NO: 3171709 - RNA, 12 nt, Mycobacterium bovis subsp bovis AF2122/97
ugcgaacaacgc

SEQ ID NO: 3171710 - RNA, 19 nt, Mycobacterium bovis subsp bovis AF2122/97
ugcgaacaaguggccagcg

SEQ ID NO: 3171711 - RNA, 18 nt, Mycobacterium bovis subsp bovis AF2122/97
ugcgaacacgcgaugaug

SEQ ID NO: 3171712 - RNA, 15 nt, Mycobacterium bovis subsp bovis AF2122/97
ugcgaacccugcgca

SEQ ID NO: 3171713 - RNA, 17 nt, Mycobacterium bovis subsp bovis AF2122/97
ugcgaacccugcgcacu

SEQ ID NO: 3171714 - RNA, 13 nt, Mycobacterium bovis subsp bovis AF2122/97
ugcgaaccggccg

SEQ ID NO: 3171715 - RNA, 16 nt, Mycobacterium bovis subsp bovis AF2122/97
ugcgaagccgagcauc

SEQ ID NO: 3171716 - RNA, 22 nt, Mycobacterium bovis subsp bovis AF2122/97
ugcgaagcuguagaccuggccg

SEQ ID NO: 3171717 - RNA, 20 nt, Mycobacterium bovis subsp bovis AF2122/97
ugcgaaggaccagagcucga

SEQ ID NO: 3171718 - RNA, 14 nt, Mycobacterium bovis subsp bovis AF2122/97
ugcgaaggcaucgc

SEQ ID NO: 3171719 - RNA, 15 nt, Mycobacterium bovis subsp bovis AF2122/97
ugcgaagggcaccgg

SEQ ID NO: 3171720 - RNA, 14 nt, Mycobacterium bovis subsp bovis AF2122/97
ugcgaaugcugggc

SEQ ID NO: 3171721 - RNA, 23 nt, Mycobacterium bovis subsp bovis AF2122/97
ugcgaaugcugggcccgccagcc

SEQ ID NO: 3171722 - RNA, 14 nt, Mycobacterium bovis subsp bovis AF2122/97
ugcgacagaugccg

SEQ ID NO: 3171723 - RNA, 16 nt, Mycobacterium bovis subsp bovis AF2122/97
ugcgacagcacgugcc

SEQ ID NO: 3171724 - RNA, 18 nt, Mycobacterium bovis subsp bovis AF2122/97
ugcgaccaagucaugccc

SEQ ID NO: 3171725 - RNA, 14 nt, Mycobacterium bovis subsp bovis AF2122/97
ugcgaccacaucau

SEQ ID NO: 3171726 - RNA, 17 nt, Mycobacterium bovis subsp bovis AF2122/97
ugcgaccacaucaugcc

SEQ ID NO: 3171727 - RNA, 20 nt, Mycobacterium bovis subsp bovis AF2122/97
ugcgacccgcagaccgccac

SEQ ID NO: 3171728 - RNA, 13 nt, Mycobacterium bovis subsp bovis AF2122/97
ugcgacccgggcg

SEQ ID NO: 3171729 - RNA, 19 nt, Mycobacterium bovis subsp bovis AF2122/97
ugcgaccgcgccaacagau

SEQ ID NO: 3171730 - RNA, 21 nt, Mycobacterium bovis subsp bovis AF2122/97
ugcgaccggcuccggacaccc

SEQ ID NO: 3171731 - RNA, 14 nt, Mycobacterium bovis subsp bovis AF2122/97
ugcgacgaaccgga

SEQ ID NO: 3171732 - RNA, 17 nt, Mycobacterium bovis subsp bovis AF2122/97
ugcgacgaaccggauca

SEQ ID NO: 3171733 - RNA, 18 nt, Mycobacterium bovis subsp bovis AF2122/97
ugcgacgaaccucggcgg

SEQ ID NO: 3171734 - RNA, 18 nt, Mycobacterium bovis subsp bovis AF2122/97
ugcgacgacgccaaugcc

SEQ ID NO: 3171735 - RNA, 21 nt, Mycobacterium bovis subsp bovis AF2122/97
ugcgacgacgccaaugccgcg

SEQ ID NO: 3171736 - RNA, 21 nt, Mycobacterium bovis subsp bovis AF2122/97
ugcgacgcagaccguccagca

SEQ ID NO: 3171737 - RNA, 23 nt, Mycobacterium bovis subsp bovis AF2122/97
ugcgacgcagaccguccagcaac

SEQ ID NO: 3171738 - RNA, 16 nt, Mycobacterium bovis subsp bovis AF2122/97
ugcgacgcccgccuuc

SEQ ID NO: 3171739 - RNA, 12 nt, Mycobacterium bovis subsp bovis AF2122/97
ugcgacggccgg

SEQ ID NO: 3171740 - RNA, 21 nt, Mycobacterium bovis subsp bovis AF2122/97
ugcgacguaaagggcgucgua

SEQ ID NO: 3171741 - RNA, 18 nt, Mycobacterium bovis subsp bovis AF2122/97
ugcgacguugguugcguc

SEQ ID NO: 3171742 - RNA, 20 nt, Mycobacterium bovis subsp bovis AF2122/97
ugcgacguugguugcguccg

SEQ ID NO: 3171743 - RNA, 16 nt, Mycobacterium bovis subsp bovis AF2122/97
ugcgacucugcgucug

SEQ ID NO: 3171744 - RNA, 20 nt, Mycobacterium bovis subsp bovis AF2122/97
ugcgacucugcgucugcuca

SEQ ID NO: 3171745 - RNA, 19 nt, Mycobacterium bovis subsp bovis AF2122/97
ugcgacugcgaaugcuggg

SEQ ID NO: 3171746 - RNA, 18 nt, Mycobacterium bovis subsp bovis AF2122/97
ugcgacuggugccugccg

SEQ ID NO: 3171747 - RNA, 15 nt, Mycobacterium bovis subsp bovis AF2122/97
ugcgacugugaaucu

SEQ ID NO: 3171748 - RNA, 19 nt, Mycobacterium bovis subsp bovis AF2122/97
ugcgagaggugcugcaccu

SEQ ID NO: 3171749 - RNA, 18 nt, Mycobacterium bovis subsp bovis AF2122/97
ugcgagaucgcggcgacc

SEQ ID NO: 3171750 - RNA, 14 nt, Mycobacterium bovis subsp bovis AF2122/97
ugcgagcgacaccg

SEQ ID NO: 3171751 - RNA, 14 nt, Mycobacterium bovis subsp bovis AF2122/97
ugcgagcgcagcgc

SEQ ID NO: 3171752 - RNA, 14 nt, Mycobacterium bovis subsp bovis AF2122/97
ugcgagcgcgccgg

SEQ ID NO: 3171753 - RNA, 19 nt, Mycobacterium bovis subsp bovis AF2122/97
ugcgaggcguaaucaagca

SEQ ID NO: 3171754 - RNA, 23 nt, Mycobacterium bovis subsp bovis AF2122/97
ugcgaggcguaaucaagcagcgu

SEQ ID NO: 3171755 - RNA, 14 nt, Mycobacterium bovis subsp bovis AF2122/97
ugcgaggggcggca

SEQ ID NO: 3171756 - RNA, 18 nt, Mycobacterium bovis subsp bovis AF2122/97
ugcgaggugccggggugg

SEQ ID NO: 3171757 - RNA, 18 nt, Mycobacterium bovis subsp bovis AF2122/97
ugcgagucgucccagucc

SEQ ID NO: 3171758 - RNA, 19 nt, Mycobacterium bovis subsp bovis AF2122/97
ugcgagugagcucagcaag

SEQ ID NO: 3171759 - RNA, 15 nt, Mycobacterium bovis subsp bovis AF2122/97
ugcgauaacccgcau

SEQ ID NO: 3171760 - RNA, 16 nt, Mycobacterium bovis subsp bovis AF2122/97
ugcgauacacggcggc

SEQ ID NO: 3171761 - RNA, 17 nt, Mycobacterium bovis subsp bovis AF2122/97
ugcgauacacggcggcg

SEQ ID NO: 3171762 - RNA, 18 nt, Mycobacterium bovis subsp bovis AF2122/97
ugcgauauggucaccaag

SEQ ID NO: 3171763 - RNA, 17 nt, Mycobacterium bovis subsp bovis AF2122/97
ugcgaucaacccuaccc

SEQ ID NO: 3171764 - RNA, 21 nt, Mycobacterium bovis subsp bovis AF2122/97
ugcgaucaacccuacccgcau

SEQ ID NO: 3171765 - RNA, 19 nt, Mycobacterium bovis subsp bovis AF2122/97
ugcgaucaccuccgcgacg

SEQ ID NO: 3171766 - RNA, 21 nt, Mycobacterium bovis subsp bovis AF2122/97
ugcgaucaccuccgcgacggc

SEQ ID NO: 3171767 - RNA, 13 nt, Mycobacterium bovis subsp bovis AF2122/97
ugcgaucccaccc

SEQ ID NO: 3171768 - RNA, 13 nt, Mycobacterium bovis subsp bovis AF2122/97
ugcgaucgacgau

SEQ ID NO: 3171769 - RNA, 16 nt, Mycobacterium bovis subsp bovis AF2122/97
ugcgaucgcaacaccg

SEQ ID NO: 3171770 - RNA, 12 nt, Mycobacterium bovis subsp bovis AF2122/97
ugcgaucgccgc

SEQ ID NO: 3171771 - RNA, 22 nt, Mycobacterium bovis subsp bovis AF2122/97
ugcgaucgccgcgcuggucgga

SEQ ID NO: 3171772 - RNA, 19 nt, Mycobacterium bovis subsp bovis AF2122/97
ugcgaucggcacuuagccc

SEQ ID NO: 3171773 - RNA, 22 nt, Mycobacterium bovis subsp bovis AF2122/97
ugcgaucggcacuuagcccgau

SEQ ID NO: 3171774 - RNA, 12 nt, Mycobacterium bovis subsp bovis AF2122/97
ugcgaucggccg

SEQ ID NO: 3171775 - RNA, 17 nt, Mycobacterium bovis subsp bovis AF2122/97
ugcgaucggccgccgaa

SEQ ID NO: 3171776 - RNA, 21 nt, Mycobacterium bovis subsp bovis AF2122/97
ugcgccgaacgcuccaggccu

SEQ ID NO: 3171777 - RNA, 17 nt, Mycobacterium bovis subsp bovis AF2122/97
ugcgccgacccgcgcgc

SEQ ID NO: 3171778 - RNA, 19 nt, Mycobacterium bovis subsp bovis AF2122/97
ugcgccgaccggccacgac

SEQ ID NO: 3171779 - RNA, 20 nt, Mycobacterium bovis subsp bovis AF2122/97
ugcgccgacuuugucgcgga

SEQ ID NO: 3171780 - RNA, 14 nt, Mycobacterium bovis subsp bovis AF2122/97
ugcgccgagcuggc

SEQ ID NO: 3171781 - RNA, 21 nt, Mycobacterium bovis subsp bovis AF2122/97
ugcgccgagcuggcaacgccg

SEQ ID NO: 3171782 - RNA, 18 nt, Mycobacterium bovis subsp bovis AF2122/97
ugcgccgauacccagcgg

SEQ ID NO: 3171783 - RNA, 16 nt, Mycobacterium bovis subsp bovis AF2122/97
ugcgccgaucccgccc

SEQ ID NO: 3171784 - RNA, 16 nt, Mycobacterium bovis subsp bovis AF2122/97
ugcgccgcacacucuc

SEQ ID NO: 3171785 - RNA, 22 nt, Mycobacterium bovis subsp bovis AF2122/97
ugcgccgcacgccgaccggccc

SEQ ID NO: 3171786 - RNA, 14 nt, Mycobacterium bovis subsp bovis AF2122/97
ugcgccgcacggcg

SEQ ID NO: 3171787 - RNA, 17 nt, Mycobacterium bovis subsp bovis AF2122/97
ugcgccgcacggcgacg

SEQ ID NO: 3171788 - RNA, 19 nt, Mycobacterium bovis subsp bovis AF2122/97
ugcgccgcaugccaccgag

SEQ ID NO: 3171789 - RNA, 15 nt, Mycobacterium bovis subsp bovis AF2122/97
ugcgccgccacagca

SEQ ID NO: 3171790 - RNA, 16 nt, Mycobacterium bovis subsp bovis AF2122/97
ugcgccgccagcgccg

SEQ ID NO: 3171791 - RNA, 12 nt, Mycobacterium bovis subsp bovis AF2122/97
ugcgccgcccgc

SEQ ID NO: 3171792 - RNA, 19 nt, Mycobacterium bovis subsp bovis AF2122/97
ugcgccgcccgcgccaccg

SEQ ID NO: 3171793 - RNA, 14 nt, Mycobacterium bovis subsp bovis AF2122/97
ugcgccgccggcgc

SEQ ID NO: 3171794 - RNA, 16 nt, Mycobacterium bovis subsp bovis AF2122/97
ugcgccgccggcgcgu

SEQ ID NO: 3171795 - RNA, 13 nt, Mycobacterium bovis subsp bovis AF2122/97
ugcgccgcgggcu

SEQ ID NO: 3171796 - RNA, 18 nt, Mycobacterium bovis subsp bovis AF2122/97
ugcgccggaccagcuccu

SEQ ID NO: 3171797 - RNA, 14 nt, Mycobacterium bovis subsp bovis AF2122/97
ugcgccggcgcugc

SEQ ID NO: 3171798 - RNA, 17 nt, Mycobacterium bovis subsp bovis AF2122/97
ugcgccggcuggcggcc

SEQ ID NO: 3171799 - RNA, 17 nt, Mycobacterium bovis subsp bovis AF2122/97
ugcgccggugccggcca

SEQ ID NO: 3171800 - RNA, 16 nt, Mycobacterium bovis subsp bovis AF2122/97
ugcgccgucagcccag

SEQ ID NO: 3171801 - RNA, 18 nt, Mycobacterium bovis subsp bovis AF2122/97
ugcgccgucgcagccagc

SEQ ID NO: 3171802 - RNA, 22 nt, Mycobacterium bovis subsp bovis AF2122/97
ugcgccgucggugggugccagc

SEQ ID NO: 3171803 - RNA, 20 nt, Mycobacterium bovis subsp bovis AF2122/97
ugcgccguguuccagguaca

SEQ ID NO: 3171804 - RNA, 18 nt, Mycobacterium bovis subsp bovis AF2122/97
ugcgccguucgcuccccc

SEQ ID NO: 3171805 - RNA, 16 nt, Mycobacterium bovis subsp bovis AF2122/97
ugcgccguugccgccg

SEQ ID NO: 3171806 - RNA, 15 nt, Mycobacterium bovis subsp bovis AF2122/97
ugcgccuccgggacg

SEQ ID NO: 3171807 - RNA, 17 nt, Mycobacterium bovis subsp bovis AF2122/97
ugcgccuggcuggccag

SEQ ID NO: 3171808 - RNA, 22 nt, Mycobacterium bovis subsp bovis AF2122/97
ugcgccuucgccagcggcgcga

SEQ ID NO: 3171809 - RNA, 15 nt, Mycobacterium bovis subsp bovis AF2122/97
ugcgccuugaccaca

SEQ ID NO: 3171810 - RNA, 19 nt, Mycobacterium bovis subsp bovis AF2122/97
ugcgcgaaucgcgucgagc

SEQ ID NO: 3171811 - RNA, 15 nt, Mycobacterium bovis subsp bovis AF2122/97
ugcgcgaccacccgc

SEQ ID NO: 3171812 - RNA, 18 nt, Mycobacterium bovis subsp bovis AF2122/97
ugcgcgaccacccgccgc

SEQ ID NO: 3171813 - RNA, 19 nt, Mycobacterium bovis subsp bovis AF2122/97
ugcgcgaccacccgccgca

SEQ ID NO: 3171814 - RNA, 16 nt, Mycobacterium bovis subsp bovis AF2122/97
ugcgcgaccgaccagc

SEQ ID NO: 3171815 - RNA, 17 nt, Mycobacterium bovis subsp bovis AF2122/97
ugcgcgaccgaccagcc

SEQ ID NO: 3171816 - RNA, 18 nt, Mycobacterium bovis subsp bovis AF2122/97
ugcgcgaccgaccagccg

SEQ ID NO: 3171817 - RNA, 17 nt, Mycobacterium bovis subsp bovis AF2122/97
ugcgcgaggggccggcu

SEQ ID NO: 3171818 - RNA, 21 nt, Mycobacterium bovis subsp bovis AF2122/97
ugcgcgauaggugcucgcgau

SEQ ID NO: 3171819 - RNA, 13 nt, Mycobacterium bovis subsp bovis AF2122/97
ugcgcgaugccca

SEQ ID NO: 3171820 - RNA, 22 nt, Mycobacterium bovis subsp bovis AF2122/97
ugcgcgaugcccacgcacagca

SEQ ID NO: 3171821 - RNA, 21 nt, Mycobacterium bovis subsp bovis AF2122/97
ugcgcgaugcgauucugcguc

SEQ ID NO: 3171822 - RNA, 23 nt, Mycobacterium bovis subsp bovis AF2122/97
ugcgcgaugcgauucugcgucug

SEQ ID NO: 3171823 - RNA, 20 nt, Mycobacterium bovis subsp bovis AF2122/97
ugcgcgcagacucgccaccg

SEQ ID NO: 3171824 - RNA, 19 nt, Mycobacterium bovis subsp bovis AF2122/97
ugcgcgccaaacgccggau

SEQ ID NO: 3171825 - RNA, 21 nt, Mycobacterium bovis subsp bovis AF2122/97
ugcgcgccauuggcgccgccg

SEQ ID NO: 3171826 - RNA, 17 nt, Mycobacterium bovis subsp bovis AF2122/97
ugcgcgcccaccgggcg

SEQ ID NO: 3171827 - RNA, 18 nt, Mycobacterium bovis subsp bovis AF2122/97
ugcgcgcccaccgggcgg

SEQ ID NO: 3171828 - RNA, 18 nt, Mycobacterium bovis subsp bovis AF2122/97
ugcgcgccguucacccug

SEQ ID NO: 3171829 - RNA, 22 nt, Mycobacterium bovis subsp bovis AF2122/97
ugcgcgcgcagaucguccaccg

SEQ ID NO: 3171830 - RNA, 15 nt, Mycobacterium bovis subsp bovis AF2122/97
ugcgcgcgcagcuga

SEQ ID NO: 3171831 - RNA, 15 nt, Mycobacterium bovis subsp bovis AF2122/97
ugcgcgcggccgcgc

SEQ ID NO: 3171832 - RNA, 14 nt, Mycobacterium bovis subsp bovis AF2122/97
ugcgcgcggcgacc

SEQ ID NO: 3171833 - RNA, 14 nt, Mycobacterium bovis subsp bovis AF2122/97
ugcgcgcggcggcc

SEQ ID NO: 3171834 - RNA, 15 nt, Mycobacterium bovis subsp bovis AF2122/97
ugcgcgcguugcggu

SEQ ID NO: 3171835 - RNA, 16 nt, Mycobacterium bovis subsp bovis AF2122/97
ugcgcgcucggccagc

SEQ ID NO: 3171836 - RNA, 21 nt, Mycobacterium bovis subsp bovis AF2122/97
ugcgcggaguacuccagccgc

SEQ ID NO: 3171837 - RNA, 22 nt, Mycobacterium bovis subsp bovis AF2122/97
ugcgcggaguacuccagccgca

SEQ ID NO: 3171838 - RNA, 23 nt, Mycobacterium bovis subsp bovis AF2122/97
ugcgcggaguacuccagccgcaa

SEQ ID NO: 3171839 - RNA, 19 nt, Mycobacterium bovis subsp bovis AF2122/97
ugcgcggaucaacaggccg

SEQ ID NO: 3171840 - RNA, 19 nt, Mycobacterium bovis subsp bovis AF2122/97
ugcgcggccaccucaucgc

SEQ ID NO: 3171841 - RNA, 22 nt, Mycobacterium bovis subsp bovis AF2122/97
ugcgcggcgaucgcuccgcggc

SEQ ID NO: 3171842 - RNA, 23 nt, Mycobacterium bovis subsp bovis AF2122/97
ugcgcggcuugucgcggugcggc

SEQ ID NO: 3171843 - RNA, 23 nt, Mycobacterium bovis subsp bovis AF2122/97
ugcgcgggcaucgucgucgcugc

SEQ ID NO: 3171844 - RNA, 19 nt, Mycobacterium bovis subsp bovis AF2122/97
ugcgcggucucgagucggu

SEQ ID NO: 3171845 - RNA, 13 nt, Mycobacterium bovis subsp bovis AF2122/97
ugcgcggugaccg

SEQ ID NO: 3171846 - RNA, 18 nt, Mycobacterium bovis subsp bovis AF2122/97
ugcgcggugacgagccac

SEQ ID NO: 3171847 - RNA, 21 nt, Mycobacterium bovis subsp bovis AF2122/97
ugcgcggugacgagccaccac

SEQ ID NO: 3171848 - RNA, 15 nt, Mycobacterium bovis subsp bovis AF2122/97
ugcgcggugaugguu

SEQ ID NO: 3171849 - RNA, 12 nt, Mycobacterium bovis subsp bovis AF2122/97
ugcgcggugcgc

SEQ ID NO: 3171850 - RNA, 16 nt, Mycobacterium bovis subsp bovis AF2122/97
ugcgcggugcgcguga

SEQ ID NO: 3171851 - RNA, 16 nt, Mycobacterium bovis subsp bovis AF2122/97
ugcgcgucagccgcac

SEQ ID NO: 3171852 - RNA, 18 nt, Mycobacterium bovis subsp bovis AF2122/97
ugcgcgucagccgcaccc

SEQ ID NO: 3171853 - RNA, 20 nt, Mycobacterium bovis subsp bovis AF2122/97
ugcgcgucagccgcaccccg

SEQ ID NO: 3171854 - RNA, 22 nt, Mycobacterium bovis subsp bovis AF2122/97
ugcgcgucagccgcaccccgcc

SEQ ID NO: 3171855 - RNA, 23 nt, Mycobacterium bovis subsp bovis AF2122/97
ugcgcguccagauaggccaaccg

SEQ ID NO: 3171856 - RNA, 16 nt, Mycobacterium bovis subsp bovis AF2122/97
ugcgcgucggugucga

SEQ ID NO: 3171857 - RNA, 19 nt, Mycobacterium bovis subsp bovis AF2122/97
ugcgcgucggugucgaugc

SEQ ID NO: 3171858 - RNA, 21 nt, Mycobacterium bovis subsp bovis AF2122/97
ugcgcgucggugucgaugcug

SEQ ID NO: 3171859 - RNA, 24 nt, Mycobacterium bovis subsp bovis AF2122/97
ugcgcgucggugucgaugcugaac

SEQ ID NO: 3171860 - RNA, 20 nt, Mycobacterium bovis subsp bovis AF2122/97
ugcgcgucucgagcgcgccg

SEQ ID NO: 3171861 - RNA, 18 nt, Mycobacterium bovis subsp bovis AF2122/97
ugcgcgugcccgugguga

SEQ ID NO: 3171862 - RNA, 16 nt, Mycobacterium bovis subsp bovis AF2122/97
ugcggccuagggcggc

SEQ ID NO: 3171863 - RNA, 20 nt, Mycobacterium bovis subsp bovis AF2122/97
ugcggccuuggcgacgucgc

SEQ ID NO: 3171864 - RNA, 18 nt, Mycobacterium bovis subsp bovis AF2122/97
ugcggcgaggacgcgccc

SEQ ID NO: 3171865 - RNA, 13 nt, Mycobacterium bovis subsp bovis AF2122/97
ugcggcgcagcga

SEQ ID NO: 3171866 - RNA, 22 nt, Mycobacterium bovis subsp bovis AF2122/97
ugcggcgcccggucgagccagc

SEQ ID NO: 3171867 - RNA, 14 nt, Mycobacterium bovis subsp bovis AF2122/97
ugcggcgccgugau

SEQ ID NO: 3171868 - RNA, 12 nt, Mycobacterium bovis subsp bovis AF2122/97
ugcggcgcgacc

SEQ ID NO: 3171869 - RNA, 15 nt, Mycobacterium bovis subsp bovis AF2122/97
ugcggcgcgucgcgg

SEQ ID NO: 3171870 - RNA, 15 nt, Mycobacterium bovis subsp bovis AF2122/97
ugcggcggcaucggu

SEQ ID NO: 3171871 - RNA, 19 nt, Mycobacterium bovis subsp bovis AF2122/97
ugcggcggcccaucgaccg

SEQ ID NO: 3171872 - RNA, 19 nt, Mycobacterium bovis subsp bovis AF2122/97
ugcggcggccucggggccg

SEQ ID NO: 3171873 - RNA, 16 nt, Mycobacterium bovis subsp bovis AF2122/97
ugcggcggcugccggu

SEQ ID NO: 3171874 - RNA, 14 nt, Mycobacterium bovis subsp bovis AF2122/97
ugcggcgggcucgc

SEQ ID NO: 3171875 - RNA, 13 nt, Mycobacterium bovis subsp bovis AF2122/97
ugcggcgguaugc

SEQ ID NO: 3171876 - RNA, 22 nt, Mycobacterium bovis subsp bovis AF2122/97
ugcggcgucguucgagaccccg

SEQ ID NO: 3171877 - RNA, 13 nt, Mycobacterium bovis subsp bovis AF2122/97
ugcggcgugccgg

SEQ ID NO: 3171878 - RNA, 21 nt, Mycobacterium bovis subsp bovis AF2122/97
ugcggcguuaucgucggcuug

SEQ ID NO: 3171879 - RNA, 18 nt, Mycobacterium bovis subsp bovis AF2122/97
ugcggcguuguggcgugu

SEQ ID NO: 3171880 - RNA, 15 nt, Mycobacterium bovis subsp bovis AF2122/97
ugcggcuccggcggc

SEQ ID NO: 3171881 - RNA, 13 nt, Mycobacterium bovis subsp bovis AF2122/97
ugcggcucgccgg

SEQ ID NO: 3171882 - RNA, 14 nt, Mycobacterium bovis subsp bovis AF2122/97
ugcggcugccagug

SEQ ID NO: 3171883 - RNA, 21 nt, Mycobacterium bovis subsp bovis AF2122/97
ugcggcugguguccagccagg

SEQ ID NO: 3171884 - RNA, 23 nt, Mycobacterium bovis subsp bovis AF2122/97
ugcggcugguguccagccaggcg

SEQ ID NO: 3171885 - RNA, 22 nt, Mycobacterium bovis subsp bovis AF2122/97
ugcggcuucggcagaccggcau

SEQ ID NO: 3171886 - RNA, 17 nt, Mycobacterium bovis subsp bovis AF2122/97
ugcggcuuggccaucac

SEQ ID NO: 3171887 - RNA, 23 nt, Mycobacterium bovis subsp bovis AF2122/97
ugcgggaauccggugaugaccgc

SEQ ID NO: 3171888 - RNA, 14 nt, Mycobacterium bovis subsp bovis AF2122/97
ugcgggaucgccga

SEQ ID NO: 3171889 - RNA, 11 nt, Mycobacterium bovis subsp bovis AF2122/97
ugcgggcagca

SEQ ID NO: 3171890 - RNA, 12 nt, Mycobacterium bovis subsp bovis AF2122/97
ugcgggcagcac

SEQ ID NO: 3171891 - RNA, 20 nt, Mycobacterium bovis subsp bovis AF2122/97
ugcgggcagcacucuucgau

SEQ ID NO: 3171892 - RNA, 17 nt, Mycobacterium bovis subsp bovis AF2122/97
ugcgggcagccgcccgc

SEQ ID NO: 3171893 - RNA, 18 nt, Mycobacterium bovis subsp bovis AF2122/97
ugcgggcagccgcccgcc

SEQ ID NO: 3171894 - RNA, 16 nt, Mycobacterium bovis subsp bovis AF2122/97
ugcgggcaugccggcg

SEQ ID NO: 3171895 - RNA, 12 nt, Mycobacterium bovis subsp bovis AF2122/97
ugcgggccaggc

SEQ ID NO: 3171896 - RNA, 14 nt, Mycobacterium bovis subsp bovis AF2122/97
ugcgggccaucaag

SEQ ID NO: 3171897 - RNA, 22 nt, Mycobacterium bovis subsp bovis AF2122/97
ugcgggcccucuaugcgggcag

SEQ ID NO: 3171898 - RNA, 16 nt, Mycobacterium bovis subsp bovis AF2122/97
ugcgggccgccaggcg

SEQ ID NO: 3171899 - RNA, 18 nt, Mycobacterium bovis subsp bovis AF2122/97
ugcgggccgccaggcggc

SEQ ID NO: 3171900 - RNA, 19 nt, Mycobacterium bovis subsp bovis AF2122/97
ugcgggccgccaggcggcc

SEQ ID NO: 3171901 - RNA, 16 nt, Mycobacterium bovis subsp bovis AF2122/97
ugcgggccgugacccu

SEQ ID NO: 3171902 - RNA, 19 nt, Mycobacterium bovis subsp bovis AF2122/97
ugcgggccugcacgccggc

SEQ ID NO: 3171903 - RNA, 15 nt, Mycobacterium bovis subsp bovis AF2122/97
ugcgggcgaucucga

SEQ ID NO: 3171904 - RNA, 19 nt, Mycobacterium bovis subsp bovis AF2122/97
ugcgggcggugcacaccgu

SEQ ID NO: 3171905 - RNA, 20 nt, Mycobacterium bovis subsp bovis AF2122/97
ugcgggcucaacaccagccg

SEQ ID NO: 3171906 - RNA, 13 nt, Mycobacterium bovis subsp bovis AF2122/97
ugcgggcucucgg

SEQ ID NO: 3171907 - RNA, 16 nt, Mycobacterium bovis subsp bovis AF2122/97
ugcgggcucucggcgu

SEQ ID NO: 3171908 - RNA, 19 nt, Mycobacterium bovis subsp bovis AF2122/97
ugcgggcuuugagcgcccg

SEQ ID NO: 3171909 - RNA, 18 nt, Mycobacterium bovis subsp bovis AF2122/97
ugcgggcuuugccaacaa

SEQ ID NO: 3171910 - RNA, 16 nt, Mycobacterium bovis subsp bovis AF2122/97
ugcggggauuggugcc

SEQ ID NO: 3171911 - RNA, 21 nt, Mycobacterium bovis subsp bovis AF2122/97
ugcggggauuggugcccagcg

SEQ ID NO: 3171912 - RNA, 22 nt, Mycobacterium bovis subsp bovis AF2122/97
ugcggggauuggugcccagcgc

SEQ ID NO: 3171913 - RNA, 13 nt, Mycobacterium bovis subsp bovis AF2122/97
ugcggggccgggc

SEQ ID NO: 3171914 - RNA, 15 nt, Mycobacterium bovis subsp bovis AF2122/97
ugcgggggacacguc

SEQ ID NO: 3171915 - RNA, 20 nt, Mycobacterium bovis subsp bovis AF2122/97
ugcgggggacgggucgccgc

SEQ ID NO: 3171916 - RNA, 20 nt, Mycobacterium bovis subsp bovis AF2122/97
ugcgggggaguagugguggg

SEQ ID NO: 3171917 - RNA, 19 nt, Mycobacterium bovis subsp bovis AF2122/97
ugcgggggcuuaugcgucu

SEQ ID NO: 3171918 - RNA, 18 nt, Mycobacterium bovis subsp bovis AF2122/97
ugcggggguugcggcagc

SEQ ID NO: 3171919 - RNA, 17 nt, Mycobacterium bovis subsp bovis AF2122/97
ugcggggugagugacca

SEQ ID NO: 3171920 - RNA, 15 nt, Mycobacterium bovis subsp bovis AF2122/97
ugcgggguuggccgu

SEQ ID NO: 3171921 - RNA, 16 nt, Mycobacterium bovis subsp bovis AF2122/97
ugcggguaaaccaggu

SEQ ID NO: 3171922 - RNA, 15 nt, Mycobacterium bovis subsp bovis AF2122/97
ugcggguaacgauug

SEQ ID NO: 3171923 - RNA, 19 nt, Mycobacterium bovis subsp bovis AF2122/97
ugcggguaggugacgacgu

SEQ ID NO: 3171924 - RNA, 22 nt, Mycobacterium bovis subsp bovis AF2122/97
ugcgggucccaaucgucggcca

SEQ ID NO: 3171925 - RNA, 18 nt, Mycobacterium bovis subsp bovis AF2122/97
ugcgggucggcaucggag

SEQ ID NO: 3171926 - RNA, 21 nt, Mycobacterium bovis subsp bovis AF2122/97
ugcgggucgugccccggcgcg

SEQ ID NO: 3171927 - RNA, 14 nt, Mycobacterium bovis subsp bovis AF2122/97
ugcgggucucgccg

SEQ ID NO: 3171928 - RNA, 20 nt, Mycobacterium bovis subsp bovis AF2122/97
ugcgggucugacaucggcca

SEQ ID NO: 3171929 - RNA, 12 nt, Mycobacterium bovis subsp bovis AF2122/97
ugcggguggagu

SEQ ID NO: 3171930 - RNA, 16 nt, Mycobacterium bovis subsp bovis AF2122/97
ugcggguggaguuggc

SEQ ID NO: 3171931 - RNA, 17 nt, Mycobacterium bovis subsp bovis AF2122/97
ugcggguggauuggugc

SEQ ID NO: 3171932 - RNA, 23 nt, Mycobacterium bovis subsp bovis AF2122/97
ugcgggugggacaccaucuccgc

SEQ ID NO: 3171933 - RNA, 19 nt, Mycobacterium bovis subsp bovis AF2122/97
ugcgggugggcacaccggu

SEQ ID NO: 3171934 - RNA, 17 nt, Mycobacterium bovis subsp bovis AF2122/97
ugcgggugguccagccu

SEQ ID NO: 3171935 - RNA, 17 nt, Mycobacterium bovis subsp bovis AF2122/97
ugcggguggugccggcg

SEQ ID NO: 3171936 - RNA, 20 nt, Mycobacterium bovis subsp bovis AF2122/97
ugcggguguaguggaagacc

SEQ ID NO: 3171937 - RNA, 14 nt, Mycobacterium bovis subsp bovis AF2122/97
ugcgggugucgggc

SEQ ID NO: 3171938 - RNA, 20 nt, Mycobacterium bovis subsp bovis AF2122/97
ugcggguucacugccggcca

SEQ ID NO: 3171939 - RNA, 21 nt, Mycobacterium bovis subsp bovis AF2122/97
ugcggguucacuuccgggcag

SEQ ID NO: 3171940 - RNA, 16 nt, Mycobacterium bovis subsp bovis AF2122/97
ugcgguaaucgccacc

SEQ ID NO: 3171941 - RNA, 19 nt, Mycobacterium bovis subsp bovis AF2122/97
ugcgguaaucgccaccgca

SEQ ID NO: 3171942 - RNA, 13 nt, Mycobacterium bovis subsp bovis AF2122/97
ugcgguacccgau

SEQ ID NO: 3171943 - RNA, 15 nt, Mycobacterium bovis subsp bovis AF2122/97
ugcgguaguugcagu

SEQ ID NO: 3171944 - RNA, 14 nt, Mycobacterium bovis subsp bovis AF2122/97
ugcgguauugcccg

SEQ ID NO: 3171945 - RNA, 18 nt, Mycobacterium bovis subsp bovis AF2122/97
ugcgguauugcccgggcg

SEQ ID NO: 3171946 - RNA, 14 nt, Mycobacterium bovis subsp bovis AF2122/97
ugcggucaacgcug

SEQ ID NO: 3171947 - RNA, 13 nt, Mycobacterium bovis subsp bovis AF2122/97
ugcggucaccgga

SEQ ID NO: 3171948 - RNA, 14 nt, Mycobacterium bovis subsp bovis AF2122/97
ugcggucagauucg

SEQ ID NO: 3171949 - RNA, 14 nt, Mycobacterium bovis subsp bovis AF2122/97
ugcucagccggccc

SEQ ID NO: 3171950 - RNA, 21 nt, Mycobacterium bovis subsp bovis AF2122/97
ugcucagccguucgcagcuga

SEQ ID NO: 3171951 - RNA, 21 nt, Mycobacterium bovis subsp bovis AF2122/97
ugcucagcgcgcgccgcuggg

SEQ ID NO: 3171952 - RNA, 17 nt, Mycobacterium bovis subsp bovis AF2122/97
ugcucagcgcggccccg

SEQ ID NO: 3171953 - RNA, 14 nt, Mycobacterium bovis subsp bovis AF2122/97
ugcucaggucaccg

SEQ ID NO: 3171954 - RNA, 18 nt, Mycobacterium bovis subsp bovis AF2122/97
ugcucaucgcgcccgcca

SEQ ID NO: 3171955 - RNA, 13 nt, Mycobacterium bovis subsp bovis AF2122/97
ugcuccagcgacg

SEQ ID NO: 3171956 - RNA, 13 nt, Mycobacterium bovis subsp bovis AF2122/97
ugcucccacguga

SEQ ID NO: 3171957 - RNA, 17 nt, Mycobacterium bovis subsp bovis AF2122/97
ugcucccggccgccgag

SEQ ID NO: 3171958 - RNA, 17 nt, Mycobacterium bovis subsp bovis AF2122/97
ugcuccgcagcagacuc

SEQ ID NO: 3171959 - RNA, 20 nt, Mycobacterium bovis subsp bovis AF2122/97
ugcuccgguuggcgcgggcg

SEQ ID NO: 3171960 - RNA, 15 nt, Mycobacterium bovis subsp bovis AF2122/97
ugcuccgucgccgaa

SEQ ID NO: 3171961 - RNA, 23 nt, Mycobacterium bovis subsp bovis AF2122/97
ugcuccgucgccgaacagugcgg

SEQ ID NO: 3171962 - RNA, 19 nt, Mycobacterium bovis subsp bovis AF2122/97
ugcuccucgcgggcggcgu

SEQ ID NO: 3171963 - RNA, 21 nt, Mycobacterium bovis subsp bovis AF2122/97
ugcuccucgcgguaguugucc

SEQ ID NO: 3171964 - RNA, 16 nt, Mycobacterium bovis subsp bovis AF2122/97
ugcuccugcguccaga

SEQ ID NO: 3171965 - RNA, 20 nt, Mycobacterium bovis subsp bovis AF2122/97
ugcuccugcguccagaucuc

SEQ ID NO: 3171966 - RNA, 14 nt, Mycobacterium bovis subsp bovis AF2122/97
ugcuccugguggca

SEQ ID NO: 3171967 - RNA, 17 nt, Mycobacterium bovis subsp bovis AF2122/97
ugcuccuucucgcggac

SEQ ID NO: 3171968 - RNA, 15 nt, Mycobacterium bovis subsp bovis AF2122/97
ugcuccuugggucgg

SEQ ID NO: 3171969 - RNA, 16 nt, Mycobacterium bovis subsp bovis AF2122/97
ugcucgacaaccacgg

SEQ ID NO: 3171970 - RNA, 17 nt, Mycobacterium bovis subsp bovis AF2122/97
ugcucgacacuggacgc

SEQ ID NO: 3171971 - RNA, 14 nt, Mycobacterium bovis subsp bovis AF2122/97
ugcucgaccgucau

SEQ ID NO: 3171972 - RNA, 19 nt, Mycobacterium bovis subsp bovis AF2122/97
ugcucgacgaucugcagca

SEQ ID NO: 3171973 - RNA, 13 nt, Mycobacterium bovis subsp bovis AF2122/97
ugcucgacgcccg

SEQ ID NO: 3171974 - RNA, 18 nt, Mycobacterium bovis subsp bovis AF2122/97
ugcucgacgcccgccacc

SEQ ID NO: 3171975 - RNA, 12 nt, Mycobacterium bovis subsp bovis AF2122/97
ugcucgacgcgc

SEQ ID NO: 3171976 - RNA, 22 nt, Mycobacterium bovis subsp bovis AF2122/97
ugcucgagagcaugguccagca

SEQ ID NO: 3171977 - RNA, 18 nt, Mycobacterium bovis subsp bovis AF2122/97
ugcucgaucaucgggagc

SEQ ID NO: 3171978 - RNA, 16 nt, Mycobacterium bovis subsp bovis AF2122/97
ugcucgauccacugcc

SEQ ID NO: 3171979 - RNA, 14 nt, Mycobacterium bovis subsp bovis AF2122/97
ugcucgaugaucag

SEQ ID NO: 3171980 - RNA, 15 nt, Mycobacterium bovis subsp bovis AF2122/97
ugcucgauguccucg

SEQ ID NO: 3171981 - RNA, 22 nt, Mycobacterium bovis subsp bovis AF2122/97
ugcucgcaaucguuggccaugc

SEQ ID NO: 3171982 - RNA, 16 nt, Mycobacterium bovis subsp bovis AF2122/97
ugcucgcacagcacca

SEQ ID NO: 3171983 - RNA, 14 nt, Mycobacterium bovis subsp bovis AF2122/97
ugcucgccaggcaa

SEQ ID NO: 3171984 - RNA, 14 nt, Mycobacterium bovis subsp bovis AF2122/97
ugcucgccaggccu

SEQ ID NO: 3171985 - RNA, 18 nt, Mycobacterium bovis subsp bovis AF2122/97
ugcucgccaggccuaggc

SEQ ID NO: 3171986 - RNA, 22 nt, Mycobacterium bovis subsp bovis AF2122/97
ugcucgccaggccuaggccgag

SEQ ID NO: 3171987 - RNA, 19 nt, Mycobacterium bovis subsp bovis AF2122/97
ugcucgccaggggaacgcu

SEQ ID NO: 3171988 - RNA, 18 nt, Mycobacterium bovis subsp bovis AF2122/97
ugcucgccggaucuugcc

SEQ ID NO: 3171989 - RNA, 15 nt, Mycobacterium bovis subsp bovis AF2122/97
ugcucgccgggcagc

SEQ ID NO: 3171990 - RNA, 12 nt, Mycobacterium bovis subsp bovis AF2122/97
ugcucgccgggu

SEQ ID NO: 3171991 - RNA, 23 nt, Mycobacterium bovis subsp bovis AF2122/97
ugcucgccgggucagcccggcgc

SEQ ID NO: 3171992 - RNA, 23 nt, Mycobacterium bovis subsp bovis AF2122/97
ugcucgccguaagcaccagccag

SEQ ID NO: 3171993 - RNA, 23 nt, Mycobacterium bovis subsp bovis AF2122/97
ugcucgccguugaugucggcagg

SEQ ID NO: 3171994 - RNA, 24 nt, Mycobacterium bovis subsp bovis AF2122/97
ugcucgcgaggcucgcguggccgc

SEQ ID NO: 3171995 - RNA, 21 nt, Mycobacterium bovis subsp bovis AF2122/97
ugcucgcgcagggaucgcagg

SEQ ID NO: 3171996 - RNA, 14 nt, Mycobacterium bovis subsp bovis AF2122/97
ugcucgcgccgcua

SEQ ID NO: 3171997 - RNA, 14 nt, Mycobacterium bovis subsp bovis AF2122/97
ugcucgcgccggug

SEQ ID NO: 3171998 - RNA, 20 nt, Mycobacterium bovis subsp bovis AF2122/97
ugcucgcgccggugaggcga

SEQ ID NO: 3171999 - RNA, 15 nt, Mycobacterium bovis subsp bovis AF2122/97
ugcucggagagcagu

SEQ ID NO: 3172000 - RNA, 16 nt, Mycobacterium bovis subsp bovis AF2122/97
ugcucggauccggcca

SEQ ID NO: 3172001 - RNA, 19 nt, Mycobacterium bovis subsp bovis AF2122/97
ugcucggcaucgagcagcc

SEQ ID NO: 3172002 - RNA, 15 nt, Mycobacterium bovis subsp bovis AF2122/97
ugcucggccagaaag

SEQ ID NO: 3172003 - RNA, 21 nt, Mycobacterium bovis subsp bovis AF2122/97
ugcucggccagaaagaucggu

SEQ ID NO: 3172004 - RNA, 14 nt, Mycobacterium bovis subsp bovis AF2122/97
ugcucggccugcuu

SEQ ID NO: 3172005 - RNA, 13 nt, Mycobacterium bovis subsp bovis AF2122/97
ugcucggcgcgcc

SEQ ID NO: 3172006 - RNA, 19 nt, Mycobacterium bovis subsp bovis AF2122/97
ugcucgggcgugaucccgc

SEQ ID NO: 3172007 - RNA, 17 nt, Mycobacterium bovis subsp bovis AF2122/97
ugcucgggggccgacca

SEQ ID NO: 3172008 - RNA, 14 nt, Mycobacterium bovis subsp bovis AF2122/97
ugcucggucgaugc

SEQ ID NO: 3172009 - RNA, 15 nt, Mycobacterium bovis subsp bovis AF2122/97
ugcucggucucgucg

SEQ ID NO: 3172010 - RNA, 12 nt, Mycobacterium bovis subsp bovis AF2122/97
ugcucggugacg

SEQ ID NO: 3172011 - RNA, 21 nt, Mycobacterium bovis subsp bovis AF2122/97
ugcucggugaugcccagcgcc

SEQ ID NO: 3172012 - RNA, 16 nt, Mycobacterium bovis subsp bovis AF2122/97
ugcucgguggugacca

SEQ ID NO: 3172013 - RNA, 15 nt, Mycobacterium bovis subsp bovis AF2122/97
ugcucguaggugccg

SEQ ID NO: 3172014 - RNA, 16 nt, Mycobacterium bovis subsp bovis AF2122/97
ugcucguaggugccga

SEQ ID NO: 3172015 - RNA, 14 nt, Mycobacterium bovis subsp bovis AF2122/97
ugcucguccaagcc

SEQ ID NO: 3172016 - RNA, 19 nt, Mycobacterium bovis subsp bovis AF2122/97
ugcucguccaagccggcca

SEQ ID NO: 3172017 - RNA, 17 nt, Mycobacterium bovis subsp bovis AF2122/97
ugcucgucgagccgacc

SEQ ID NO: 3172018 - RNA, 21 nt, Mycobacterium bovis subsp bovis AF2122/97
ugcucgucggccaccgcggcg

SEQ ID NO: 3172019 - RNA, 12 nt, Mycobacterium bovis subsp bovis AF2122/97
ugcucgucggcg

SEQ ID NO: 3172020 - RNA, 19 nt, Mycobacterium bovis subsp bovis AF2122/97
ugcucgucggcgccggcgg

SEQ ID NO: 3172021 - RNA, 16 nt, Mycobacterium bovis subsp bovis AF2122/97
ugcucgucggucaccg

SEQ ID NO: 3172022 - RNA, 19 nt, Mycobacterium bovis subsp bovis AF2122/97
ugcucgucuuggcggcggu

SEQ ID NO: 3172023 - RNA, 15 nt, Mycobacterium bovis subsp bovis AF2122/97
ugcucguggguaccg

SEQ ID NO: 3172024 - RNA, 22 nt, Mycobacterium bovis subsp bovis AF2122/97
ugcucguguuguugaagcccga

SEQ ID NO: 3172025 - RNA, 22 nt, Mycobacterium bovis subsp bovis AF2122/97
ugcucugcgcaucgguccaaag

SEQ ID NO: 3172026 - RNA, 20 nt, Mycobacterium bovis subsp bovis AF2122/97
ugcucugggauuugggcugc

SEQ ID NO: 3172027 - RNA, 14 nt, Mycobacterium bovis subsp bovis AF2122/97
ugcucuucggcacc

SEQ ID NO: 3172028 - RNA, 21 nt, Mycobacterium bovis subsp bovis AF2122/97
ugcugaacugguuggugacgu

SEQ ID NO: 3172029 - RNA, 16 nt, Mycobacterium bovis subsp bovis AF2122/97
ugcugacauuuccacc

SEQ ID NO: 3172030 - RNA, 15 nt, Mycobacterium bovis subsp bovis AF2122/97
ugcugaccaugaccg

SEQ ID NO: 3172031 - RNA, 15 nt, Mycobacterium bovis subsp bovis AF2122/97
ugcugaccgcgccgg

SEQ ID NO: 3172032 - RNA, 22 nt, Mycobacterium bovis subsp bovis AF2122/97
ugcugacgacgagggccagcag

SEQ ID NO: 3172033 - RNA, 20 nt, Mycobacterium bovis subsp bovis AF2122/97
ugcugacgacugggcgccca

SEQ ID NO: 3172034 - RNA, 20 nt, Mycobacterium bovis subsp bovis AF2122/97
ugcugacggugcaggaccag

SEQ ID NO: 3172035 - RNA, 22 nt, Mycobacterium bovis subsp bovis AF2122/97
ugcugacgguggggauggcgcc

SEQ ID NO: 3172036 - RNA, 20 nt, Mycobacterium bovis subsp bovis AF2122/97
ugcuucccggaugccgaccu

SEQ ID NO: 3172037 - RNA, 16 nt, Mycobacterium bovis subsp bovis AF2122/97
ugcuucgaccgccgug

SEQ ID NO: 3172038 - RNA, 13 nt, Mycobacterium bovis subsp bovis AF2122/97
ugcuugcagggcc

SEQ ID NO: 3172039 - RNA, 19 nt, Mycobacterium bovis subsp bovis AF2122/97
ugcuugccgcauacgcggc

SEQ ID NO: 3172040 - RNA, 20 nt, Mycobacterium bovis subsp bovis AF2122/97
ugcuugcgcguggcagugca

SEQ ID NO: 3172041 - RNA, 15 nt, Mycobacterium bovis subsp bovis AF2122/97
ugcuuggcagcggug

SEQ ID NO: 3172042 - RNA, 13 nt, Mycobacterium bovis subsp bovis AF2122/97
ugcuuggccgcgc

SEQ ID NO: 3172043 - RNA, 14 nt, Mycobacterium bovis subsp bovis AF2122/97
ugcuuggccgcgca

SEQ ID NO: 3172044 - RNA, 16 nt, Mycobacterium bovis subsp bovis AF2122/97
ugcuugggccgcugau

SEQ ID NO: 3172045 - RNA, 17 nt, Mycobacterium bovis subsp bovis AF2122/97
ugcuuggucgcccagcc

SEQ ID NO: 3172046 - RNA, 16 nt, Mycobacterium bovis subsp bovis AF2122/97
ugcuugucgaggcgca

SEQ ID NO: 3172047 - RNA, 18 nt, Mycobacterium bovis subsp bovis AF2122/97
ugcuuguguucgugguug

SEQ ID NO: 3172048 - RNA, 11 nt, Mycobacterium bovis subsp bovis AF2122/97
ugcuuuccaga

SEQ ID NO: 3172049 - RNA, 21 nt, Mycobacterium bovis subsp bovis AF2122/97
ugcuuuccagaguucccgaaa

SEQ ID NO: 3172050 - RNA, 12 nt, Mycobacterium bovis subsp bovis AF2122/97
ugcuuugcuggc

SEQ ID NO: 3172051 - RNA, 20 nt, Mycobacterium bovis subsp bovis AF2122/97
uggaaaaagcccgacacgaa

SEQ ID NO: 3172052 - RNA, 15 nt, Mycobacterium bovis subsp bovis AF2122/97
uggaaacccgccgaa

SEQ ID NO: 3172053 - RNA, 15 nt, Mycobacterium bovis subsp bovis AF2122/97
uggaaacugaugucg

SEQ ID NO: 3172054 - RNA, 20 nt, Mycobacterium bovis subsp bovis AF2122/97
uggaaagcagcagcggcggc

SEQ ID NO: 3172055 - RNA, 23 nt, Mycobacterium bovis subsp bovis AF2122/97
uggaaagcgcuuuagcggugugg

SEQ ID NO: 3172056 - RNA, 13 nt, Mycobacterium bovis subsp bovis AF2122/97
uggaacaccgcgg

SEQ ID NO: 3172057 - RNA, 22 nt, Mycobacterium bovis subsp bovis AF2122/97
uggaacacgaagucgaacggcu

SEQ ID NO: 3172058 - RNA, 13 nt, Mycobacterium bovis subsp bovis AF2122/97
uggaacagaucuu

SEQ ID NO: 3172059 - RNA, 16 nt, Mycobacterium bovis subsp bovis AF2122/97
uggaaccaaaccuggg

SEQ ID NO: 3172060 - RNA, 16 nt, Mycobacterium bovis subsp bovis AF2122/97
uggaacggcuugcgau

SEQ ID NO: 3172061 - RNA, 15 nt, Mycobacterium bovis subsp bovis AF2122/97
uggaacuccguccgc

SEQ ID NO: 3172062 - RNA, 16 nt, Mycobacterium bovis subsp bovis AF2122/97
uggaacugaugaacca

SEQ ID NO: 3172063 - RNA, 16 nt, Mycobacterium bovis subsp bovis AF2122/97
uggaagacggugcggg

SEQ ID NO: 3172064 - RNA, 21 nt, Mycobacterium bovis subsp bovis AF2122/97
uggaagacggugcgggcuagg

SEQ ID NO: 3172065 - RNA, 21 nt, Mycobacterium bovis subsp bovis AF2122/97
uggaagaguuggggcacaacc

SEQ ID NO: 3172066 - RNA, 21 nt, Mycobacterium bovis subsp bovis AF2122/97
uggaagccgacgaccagcaga

SEQ ID NO: 3172067 - RNA, 22 nt, Mycobacterium bovis subsp bovis AF2122/97
uggaagccgacgaccagcagau

SEQ ID NO: 3172068 - RNA, 13 nt, Mycobacterium bovis subsp bovis AF2122/97
uggaagccgcacc

SEQ ID NO: 3172069 - RNA, 14 nt, Mycobacterium bovis subsp bovis AF2122/97
uggaagccgucucu

SEQ ID NO: 3172070 - RNA, 15 nt, Mycobacterium bovis subsp bovis AF2122/97
uggaaggcggccagg

SEQ ID NO: 3172071 - RNA, 16 nt, Mycobacterium bovis subsp bovis AF2122/97
uggaaggcggccaggu

SEQ ID NO: 3172072 - RNA, 18 nt, Mycobacterium bovis subsp bovis AF2122/97
uggaaguacacggcggcc

SEQ ID NO: 3172073 - RNA, 18 nt, Mycobacterium bovis subsp bovis AF2122/97
uggaauccggccagaccc

SEQ ID NO: 3172074 - RNA, 18 nt, Mycobacterium bovis subsp bovis AF2122/97
uggaaucgcggagccagg

SEQ ID NO: 3172075 - RNA, 19 nt, Mycobacterium bovis subsp bovis AF2122/97
uggaaucgcggagccagga

SEQ ID NO: 3172076 - RNA, 12 nt, Mycobacterium bovis subsp bovis AF2122/97
uggacaacagca

SEQ ID NO: 3172077 - RNA, 22 nt, Mycobacterium bovis subsp bovis AF2122/97
uggacaacagcuuggagaucgc

SEQ ID NO: 3172078 - RNA, 14 nt, Mycobacterium bovis subsp bovis AF2122/97
uggacaaccucguc

SEQ ID NO: 3172079 - RNA, 21 nt, Mycobacterium bovis subsp bovis AF2122/97
uggacaacguugguccgcugc

SEQ ID NO: 3172080 - RNA, 23 nt, Mycobacterium bovis subsp bovis AF2122/97
uggacaacguugguccgcugcag

SEQ ID NO: 3172081 - RNA, 14 nt, Mycobacterium bovis subsp bovis AF2122/97
uggacaagcacagc

SEQ ID NO: 3172082 - RNA, 16 nt, Mycobacterium bovis subsp bovis AF2122/97
uggacaccaccucguc

SEQ ID NO: 3172083 - RNA, 12 nt, Mycobacterium bovis subsp bovis AF2122/97
uggacaccagcc

SEQ ID NO: 3172084 - RNA, 16 nt, Mycobacterium bovis subsp bovis AF2122/97
uggacacggcgcugcc

SEQ ID NO: 3172085 - RNA, 23 nt, Mycobacterium bovis subsp bovis AF2122/97
uggacagaaucgaccgccgcuac

SEQ ID NO: 3172086 - RNA, 18 nt, Mycobacterium bovis subsp bovis AF2122/97
uggacaggucaauggucu

SEQ ID NO: 3172087 - RNA, 15 nt, Mycobacterium bovis subsp bovis AF2122/97
uggaccacagccgcg

SEQ ID NO: 3172088 - RNA, 18 nt, Mycobacterium bovis subsp bovis AF2122/97
uggaccacagccgcgccg

SEQ ID NO: 3172089 - RNA, 21 nt, Mycobacterium bovis subsp bovis AF2122/97
uggaccagcgccccggcgcgu

SEQ ID NO: 3172090 - RNA, 22 nt, Mycobacterium bovis subsp bovis AF2122/97
uggaccagcgccccggcgcguu

SEQ ID NO: 3172091 - RNA, 20 nt, Mycobacterium bovis subsp bovis AF2122/97
uggaccgagacuugcuggcc

SEQ ID NO: 3172092 - RNA, 16 nt, Mycobacterium bovis subsp bovis AF2122/97
uggaccgcacugacaa

SEQ ID NO: 3172093 - RNA, 15 nt, Mycobacterium bovis subsp bovis AF2122/97
uggaccgccgccgac

SEQ ID NO: 3172094 - RNA, 16 nt, Mycobacterium bovis subsp bovis AF2122/97
uggaccgcggugaccc

SEQ ID NO: 3172095 - RNA, 13 nt, Mycobacterium bovis subsp bovis AF2122/97
uggaccgcugaug

SEQ ID NO: 3172096 - RNA, 11 nt, Mycobacterium bovis subsp bovis AF2122/97
uggaccggucg

SEQ ID NO: 3172097 - RNA, 15 nt, Mycobacterium bovis subsp bovis AF2122/97
uggaccggugccagc

SEQ ID NO: 3172098 - RNA, 17 nt, Mycobacterium bovis subsp bovis AF2122/97
uggaccguugccgaugg

SEQ ID NO: 3172099 - RNA, 13 nt, Mycobacterium bovis subsp bovis AF2122/97
uggacgacccggg

SEQ ID NO: 3172100 - RNA, 16 nt, Mycobacterium bovis subsp bovis AF2122/97
uggacgacccgggccg

SEQ ID NO: 3172101 - RNA, 15 nt, Mycobacterium bovis subsp bovis AF2122/97
uggacgaccgcgcgg

SEQ ID NO: 3172102 - RNA, 14 nt, Mycobacterium bovis subsp bovis AF2122/97
uggacgcagaguca

SEQ ID NO: 3172103 - RNA, 18 nt, Mycobacterium bovis subsp bovis AF2122/97
uggacgcccgcccgcacg

SEQ ID NO: 3172104 - RNA, 19 nt, Mycobacterium bovis subsp bovis AF2122/97
uggacgccuugcacaagcu

SEQ ID NO: 3172105 - RNA, 16 nt, Mycobacterium bovis subsp bovis AF2122/97
uggacgcgcaugcccc

SEQ ID NO: 3172106 - RNA, 18 nt, Mycobacterium bovis subsp bovis AF2122/97
uggacgcggccaauggcc

SEQ ID NO: 3172107 - RNA, 20 nt, Mycobacterium bovis subsp bovis AF2122/97
uggacgcggccaauggccgc

SEQ ID NO: 3172108 - RNA, 18 nt, Mycobacterium bovis subsp bovis AF2122/97
uggacggauaguucacca

SEQ ID NO: 3172109 - RNA, 13 nt, Mycobacterium bovis subsp bovis AF2122/97
uggacggccaggu

SEQ ID NO: 3172110 - RNA, 20 nt, Mycobacterium bovis subsp bovis AF2122/97
uggacgugucaucacgguca

SEQ ID NO: 3172111 - RNA, 23 nt, Mycobacterium bovis subsp bovis AF2122/97
uggacgugucaucacggucagcc

SEQ ID NO: 3172112 - RNA, 17 nt, Mycobacterium bovis subsp bovis AF2122/97
uggacucaucggcgugc

SEQ ID NO: 3172113 - RNA, 22 nt, Mycobacterium bovis subsp bovis AF2122/97
uggacuccggucagcgcggcga

SEQ ID NO: 3172114 - RNA, 15 nt, Mycobacterium bovis subsp bovis AF2122/97
uggacugaucgcgau

SEQ ID NO: 3172115 - RNA, 23 nt, Mycobacterium bovis subsp bovis AF2122/97
uggacugggucgccuccugccgc

SEQ ID NO: 3172116 - RNA, 21 nt, Mycobacterium bovis subsp bovis AF2122/97
uggagauacauuucccaguca

SEQ ID NO: 3172117 - RNA, 16 nt, Mycobacterium bovis subsp bovis AF2122/97
uggagaucacgugccg

SEQ ID NO: 3172118 - RNA, 15 nt, Mycobacterium bovis subsp bovis AF2122/97
uggagaucgccgccg

SEQ ID NO: 3172119 - RNA, 21 nt, Mycobacterium bovis subsp bovis AF2122/97
uggagaugucggugaucacgg

SEQ ID NO: 3172120 - RNA, 14 nt, Mycobacterium bovis subsp bovis AF2122/97
uggagccccgacug

SEQ ID NO: 3172121 - RNA, 13 nt, Mycobacterium bovis subsp bovis AF2122/97
uggagccggccgu

SEQ ID NO: 3172122 - RNA, 13 nt, Mycobacterium bovis subsp bovis AF2122/97
uggagccggugac

SEQ ID NO: 3172123 - RNA, 16 nt, Mycobacterium bovis subsp bovis AF2122/97
uggcauccaaaaucgc

SEQ ID NO: 3172124 - RNA, 15 nt, Mycobacterium bovis subsp bovis AF2122/97
uggcaucccgggcag

SEQ ID NO: 3172125 - RNA, 22 nt, Mycobacterium bovis subsp bovis AF2122/97
uggcaucccgggcaguccaggc

SEQ ID NO: 3172126 - RNA, 23 nt, Mycobacterium bovis subsp bovis AF2122/97
uggcaucccgggcaguccaggca

SEQ ID NO: 3172127 - RNA, 17 nt, Mycobacterium bovis subsp bovis AF2122/97
uggcauccgccccgccc

SEQ ID NO: 3172128 - RNA, 14 nt, Mycobacterium bovis subsp bovis AF2122/97
uggcaucgccucca

SEQ ID NO: 3172129 - RNA, 16 nt, Mycobacterium bovis subsp bovis AF2122/97
uggcaucggccaucuc

SEQ ID NO: 3172130 - RNA, 13 nt, Mycobacterium bovis subsp bovis AF2122/97
uggcaucggccug

SEQ ID NO: 3172131 - RNA, 14 nt, Mycobacterium bovis subsp bovis AF2122/97
uggcaucucgauac

SEQ ID NO: 3172132 - RNA, 14 nt, Mycobacterium bovis subsp bovis AF2122/97
uggcaugcaggugg

SEQ ID NO: 3172133 - RNA, 19 nt, Mycobacterium bovis subsp bovis AF2122/97
uggcaugccggcgugcggc

SEQ ID NO: 3172134 - RNA, 13 nt, Mycobacterium bovis subsp bovis AF2122/97
uggcaugcggauc

SEQ ID NO: 3172135 - RNA, 21 nt, Mycobacterium bovis subsp bovis AF2122/97
uggcaugcggaucggcggacc

SEQ ID NO: 3172136 - RNA, 20 nt, Mycobacterium bovis subsp bovis AF2122/97
uggcauggucaggcggccgu

SEQ ID NO: 3172137 - RNA, 16 nt, Mycobacterium bovis subsp bovis AF2122/97
uggcauguugcggacc

SEQ ID NO: 3172138 - RNA, 22 nt, Mycobacterium bovis subsp bovis AF2122/97
uggcauguugcggaccaguucg

SEQ ID NO: 3172139 - RNA, 22 nt, Mycobacterium bovis subsp bovis AF2122/97
uggcauucgauaccgcaccaaa

SEQ ID NO: 3172140 - RNA, 14 nt, Mycobacterium bovis subsp bovis AF2122/97
uggcauugaccacc

SEQ ID NO: 3172141 - RNA, 22 nt, Mycobacterium bovis subsp bovis AF2122/97
uggcauuuccugauccgccugc

SEQ ID NO: 3172142 - RNA, 18 nt, Mycobacterium bovis subsp bovis AF2122/97
uggccaaccaaccgguca

SEQ ID NO: 3172143 - RNA, 17 nt, Mycobacterium bovis subsp bovis AF2122/97
uggccaaccccauggcc

SEQ ID NO: 3172144 - RNA, 19 nt, Mycobacterium bovis subsp bovis AF2122/97
uggccaacgccgggucgua

SEQ ID NO: 3172145 - RNA, 21 nt, Mycobacterium bovis subsp bovis AF2122/97
uggccaauagaagcacgucgu

SEQ ID NO: 3172146 - RNA, 14 nt, Mycobacterium bovis subsp bovis AF2122/97
uggccaauccggcg

SEQ ID NO: 3172147 - RNA, 17 nt, Mycobacterium bovis subsp bovis AF2122/97
uggccaauccggcggcg

SEQ ID NO: 3172148 - RNA, 21 nt, Mycobacterium bovis subsp bovis AF2122/97
uggccaauccggcggcgacgu

SEQ ID NO: 3172149 - RNA, 21 nt, Mycobacterium bovis subsp bovis AF2122/97
uggccacacucagcacccaau

SEQ ID NO: 3172150 - RNA, 14 nt, Mycobacterium bovis subsp bovis AF2122/97
uggccaccaccgug

SEQ ID NO: 3172151 - RNA, 18 nt, Mycobacterium bovis subsp bovis AF2122/97
uggccaccaccgugaagc

SEQ ID NO: 3172152 - RNA, 16 nt, Mycobacterium bovis subsp bovis AF2122/97
uggccaccagcuggcg

SEQ ID NO: 3172153 - RNA, 18 nt, Mycobacterium bovis subsp bovis AF2122/97
uggccaccaucgccgccg

SEQ ID NO: 3172154 - RNA, 12 nt, Mycobacterium bovis subsp bovis AF2122/97
uggccacccggc

SEQ ID NO: 3172155 - RNA, 16 nt, Mycobacterium bovis subsp bovis AF2122/97
uggccacccggccgcg

SEQ ID NO: 3172156 - RNA, 19 nt, Mycobacterium bovis subsp bovis AF2122/97
uggccacccggccgcgcgg

SEQ ID NO: 3172157 - RNA, 18 nt, Mycobacterium bovis subsp bovis AF2122/97
uggccacccgguggcguu

SEQ ID NO: 3172158 - RNA, 19 nt, Mycobacterium bovis subsp bovis AF2122/97
uggccaccgaacgcggcca

SEQ ID NO: 3172159 - RNA, 20 nt, Mycobacterium bovis subsp bovis AF2122/97
uggccaccgaacgcggccac

SEQ ID NO: 3172160 - RNA, 22 nt, Mycobacterium bovis subsp bovis AF2122/97
uggccaccgaacgcggccaccg

SEQ ID NO: 3172161 - RNA, 24 nt, Mycobacterium bovis subsp bovis AF2122/97
uggccaccgaacgcggccaccgac

SEQ ID NO: 3172162 - RNA, 14 nt, Mycobacterium bovis subsp bovis AF2122/97
uggccaccgcccag

SEQ ID NO: 3172163 - RNA, 19 nt, Mycobacterium bovis subsp bovis AF2122/97
uggccaccgcccagugcca

SEQ ID NO: 3172164 - RNA, 21 nt, Mycobacterium bovis subsp bovis AF2122/97
uggccaccgccgaaaaccucg

SEQ ID NO: 3172165 - RNA, 13 nt, Mycobacterium bovis subsp bovis AF2122/97
uggccaccggcgg

SEQ ID NO: 3172166 - RNA, 18 nt, Mycobacterium bovis subsp bovis AF2122/97
uggccacgcccaggcaag

SEQ ID NO: 3172167 - RNA, 21 nt, Mycobacterium bovis subsp bovis AF2122/97
uggccacggcuuugcggcgcg

SEQ ID NO: 3172168 - RNA, 19 nt, Mycobacterium bovis subsp bovis AF2122/97
uggccacggggcugccggu

SEQ ID NO: 3172169 - RNA, 21 nt, Mycobacterium bovis subsp bovis AF2122/97
uggccacucacauuggccagg

SEQ ID NO: 3172170 - RNA, 17 nt, Mycobacterium bovis subsp bovis AF2122/97
uggccagaccgcgcgca

SEQ ID NO: 3172171 - RNA, 23 nt, Mycobacterium bovis subsp bovis AF2122/97
uggccagaccgcgcgcauaccua

SEQ ID NO: 3172172 - RNA, 23 nt, Mycobacterium bovis subsp bovis AF2122/97
uggccagaucgaacgcagccagc

SEQ ID NO: 3172173 - RNA, 19 nt, Mycobacterium bovis subsp bovis AF2122/97
uggccagcaacugccgcac

SEQ ID NO: 3172174 - RNA, 21 nt, Mycobacterium bovis subsp bovis AF2122/97
uggccagcaacugccgcaccc

SEQ ID NO: 3172175 - RNA, 14 nt, Mycobacterium bovis subsp bovis AF2122/97
uggccagcacaccg

SEQ ID NO: 3172176 - RNA, 13 nt, Mycobacterium bovis subsp bovis AF2122/97
uggccagcaccac

SEQ ID NO: 3172177 - RNA, 16 nt, Mycobacterium bovis subsp bovis AF2122/97
uggccagcaccacggc

SEQ ID NO: 3172178 - RNA, 18 nt, Mycobacterium bovis subsp bovis AF2122/97
uggccagcaccacggcca

SEQ ID NO: 3172179 - RNA, 19 nt, Mycobacterium bovis subsp bovis AF2122/97
uggccagcaccacggccag

SEQ ID NO: 3172180 - RNA, 13 nt, Mycobacterium bovis subsp bovis AF2122/97
uggccagcacggu

SEQ ID NO: 3172181 - RNA, 17 nt, Mycobacterium bovis subsp bovis AF2122/97
uggccagcagcagcgcu

SEQ ID NO: 3172182 - RNA, 15 nt, Mycobacterium bovis subsp bovis AF2122/97
uggccagcagggcca

SEQ ID NO: 3172183 - RNA, 19 nt, Mycobacterium bovis subsp bovis AF2122/97
uggccagcagggccaccac

SEQ ID NO: 3172184 - RNA, 13 nt, Mycobacterium bovis subsp bovis AF2122/97
uggccagcagguu

SEQ ID NO: 3172185 - RNA, 18 nt, Mycobacterium bovis subsp bovis AF2122/97
uggccagccacagccgac

SEQ ID NO: 3172186 - RNA, 18 nt, Mycobacterium bovis subsp bovis AF2122/97
uggccagccagcggguga

SEQ ID NO: 3172187 - RNA, 13 nt, Mycobacterium bovis subsp bovis AF2122/97
uggccagcgcggc

SEQ ID NO: 3172188 - RNA, 17 nt, Mycobacterium bovis subsp bovis AF2122/97
uggccagcgcggcgucg

SEQ ID NO: 3172189 - RNA, 12 nt, Mycobacterium bovis subsp bovis AF2122/97
uggccagcgcgu

SEQ ID NO: 3172190 - RNA, 22 nt, Mycobacterium bovis subsp bovis AF2122/97
uggccagcgcuucgucggccgg

SEQ ID NO: 3172191 - RNA, 18 nt, Mycobacterium bovis subsp bovis AF2122/97
uggccagcgucgcgauug

SEQ ID NO: 3172192 - RNA, 15 nt, Mycobacterium bovis subsp bovis AF2122/97
uggccaggaaguccc

SEQ ID NO: 3172193 - RNA, 22 nt, Mycobacterium bovis subsp bovis AF2122/97
uggccaggcccaagccguggcc

SEQ ID NO: 3172194 - RNA, 23 nt, Mycobacterium bovis subsp bovis AF2122/97
uggccaggcccaagccguggccg

SEQ ID NO: 3172195 - RNA, 12 nt, Mycobacterium bovis subsp bovis AF2122/97
uggccaggccgg

SEQ ID NO: 3172196 - RNA, 23 nt, Mycobacterium bovis subsp bovis AF2122/97
uggccaggcuggcgucaccgcgg

SEQ ID NO: 3172197 - RNA, 17 nt, Mycobacterium bovis subsp bovis AF2122/97
uggccaggucggccacc

SEQ ID NO: 3172198 - RNA, 18 nt, Mycobacterium bovis subsp bovis AF2122/97
uggccaggucggccaccg

SEQ ID NO: 3172199 - RNA, 19 nt, Mycobacterium bovis subsp bovis AF2122/97
uggccaggucggccaccgu

SEQ ID NO: 3172200 - RNA, 20 nt, Mycobacterium bovis subsp bovis AF2122/97
uggccaggucggccaccgug

SEQ ID NO: 3172201 - RNA, 19 nt, Mycobacterium bovis subsp bovis AF2122/97
uggccagugucccgcgcgg

SEQ ID NO: 3172202 - RNA, 19 nt, Mycobacterium bovis subsp bovis AF2122/97
uggccaguucggugagccg

SEQ ID NO: 3172203 - RNA, 22 nt, Mycobacterium bovis subsp bovis AF2122/97
uggccauagguuugggcacgga

SEQ ID NO: 3172204 - RNA, 14 nt, Mycobacterium bovis subsp bovis AF2122/97
uggccaucgcgcgg

SEQ ID NO: 3172205 - RNA, 17 nt, Mycobacterium bovis subsp bovis AF2122/97
uggccaucgcgcggacc

SEQ ID NO: 3172206 - RNA, 21 nt, Mycobacterium bovis subsp bovis AF2122/97
uggccaucugauccggugccg

SEQ ID NO: 3172207 - RNA, 14 nt, Mycobacterium bovis subsp bovis AF2122/97
uggccaugcucuug

SEQ ID NO: 3172208 - RNA, 18 nt, Mycobacterium bovis subsp bovis AF2122/97
uggccaugcuggucagcg

SEQ ID NO: 3172209 - RNA, 14 nt, Mycobacterium bovis subsp bovis AF2122/97
uggccgccgucgac

SEQ ID NO: 3172210 - RNA, 22 nt, Mycobacterium bovis subsp bovis AF2122/97
uggccgccuccgcggcauuggc

SEQ ID NO: 3172211 - RNA, 18 nt, Mycobacterium bovis subsp bovis AF2122/97
uggccgcgaucccggccg

SEQ ID NO: 3172212 - RNA, 14 nt, Mycobacterium bovis subsp bovis AF2122/97
uggccgcgaugacg

SEQ ID NO: 3172213 - RNA, 18 nt, Mycobacterium bovis subsp bovis AF2122/97
uggccgcgaugacgaccg

SEQ ID NO: 3172214 - RNA, 21 nt, Mycobacterium bovis subsp bovis AF2122/97
uggccgcgaugacgaccgauc

SEQ ID NO: 3172215 - RNA, 15 nt, Mycobacterium bovis subsp bovis AF2122/97
uggccgcgcaggcuu

SEQ ID NO: 3172216 - RNA, 19 nt, Mycobacterium bovis subsp bovis AF2122/97
uggccgcgcaggggcggcg

SEQ ID NO: 3172217 - RNA, 13 nt, Mycobacterium bovis subsp bovis AF2122/97
uggccgcgccggg

SEQ ID NO: 3172218 - RNA, 16 nt, Mycobacterium bovis subsp bovis AF2122/97
uggccgcgccggggag

SEQ ID NO: 3172219 - RNA, 17 nt, Mycobacterium bovis subsp bovis AF2122/97
uggccgcgccucggucu

SEQ ID NO: 3172220 - RNA, 19 nt, Mycobacterium bovis subsp bovis AF2122/97
uggccgcgccucggucugc

SEQ ID NO: 3172221 - RNA, 20 nt, Mycobacterium bovis subsp bovis AF2122/97
uggccgcgcucaucgcggcg

SEQ ID NO: 3172222 - RNA, 14 nt, Mycobacterium bovis subsp bovis AF2122/97
uggccgcggcaccc

SEQ ID NO: 3172223 - RNA, 22 nt, Mycobacterium bovis subsp bovis AF2122/97
uggccgcggcggucugggugag

SEQ ID NO: 3172224 - RNA, 18 nt, Mycobacterium bovis subsp bovis AF2122/97
uggccgcgggcgcggccc

SEQ ID NO: 3172225 - RNA, 23 nt, Mycobacterium bovis subsp bovis AF2122/97
uggccgcgucgcgaaaggccacg

SEQ ID NO: 3172226 - RNA, 23 nt, Mycobacterium bovis subsp bovis AF2122/97
uggccgcucuccaccccgucugc

SEQ ID NO: 3172227 - RNA, 15 nt, Mycobacterium bovis subsp bovis AF2122/97
uggccgcugccagcc

SEQ ID NO: 3172228 - RNA, 14 nt, Mycobacterium bovis subsp bovis AF2122/97
uggccgcugccuuc

SEQ ID NO: 3172229 - RNA, 16 nt, Mycobacterium bovis subsp bovis AF2122/97
uggccgcugccuucuu

SEQ ID NO: 3172230 - RNA, 21 nt, Mycobacterium bovis subsp bovis AF2122/97
uggccgcugucguaccgcucg

SEQ ID NO: 3172231 - RNA, 17 nt, Mycobacterium bovis subsp bovis AF2122/97
uggccgcuuugcgcggu

SEQ ID NO: 3172232 - RNA, 22 nt, Mycobacterium bovis subsp bovis AF2122/97
uggccgcuuugcgcggucagcc

SEQ ID NO: 3172233 - RNA, 17 nt, Mycobacterium bovis subsp bovis AF2122/97
uggccggaauacccgcu

SEQ ID NO: 3172234 - RNA, 21 nt, Mycobacterium bovis subsp bovis AF2122/97
uggccggacccauuggaccga

SEQ ID NO: 3172235 - RNA, 23 nt, Mycobacterium bovis subsp bovis AF2122/97
uggccggaucgaagaccagcaac

SEQ ID NO: 3172236 - RNA, 23 nt, Mycobacterium bovis subsp bovis AF2122/97
uggccggcaacggcgcgccgacc

SEQ ID NO: 3172237 - RNA, 13 nt, Mycobacterium bovis subsp bovis AF2122/97
uggccggcaccgu

SEQ ID NO: 3172238 - RNA, 15 nt, Mycobacterium bovis subsp bovis AF2122/97
uggccggcaggucca

SEQ ID NO: 3172239 - RNA, 14 nt, Mycobacterium bovis subsp bovis AF2122/97
uggccggccagcca

SEQ ID NO: 3172240 - RNA, 18 nt, Mycobacterium bovis subsp bovis AF2122/97
uggccggccagccauggc

SEQ ID NO: 3172241 - RNA, 16 nt, Mycobacterium bovis subsp bovis AF2122/97
uggccggccaucgccc

SEQ ID NO: 3172242 - RNA, 15 nt, Mycobacterium bovis subsp bovis AF2122/97
uggccggccccgccc

SEQ ID NO: 3172243 - RNA, 15 nt, Mycobacterium bovis subsp bovis AF2122/97
uggccggcgauggcc

SEQ ID NO: 3172244 - RNA, 21 nt, Mycobacterium bovis subsp bovis AF2122/97
uggccggcgcugcccgggcug

SEQ ID NO: 3172245 - RNA, 14 nt, Mycobacterium bovis subsp bovis AF2122/97
uggccggcgguguu

SEQ ID NO: 3172246 - RNA, 21 nt, Mycobacterium bovis subsp bovis AF2122/97
uggccggcuugucgaccacga

SEQ ID NO: 3172247 - RNA, 23 nt, Mycobacterium bovis subsp bovis AF2122/97
uggccgggcacgcgaggcgcuca

SEQ ID NO: 3172248 - RNA, 13 nt, Mycobacterium bovis subsp bovis AF2122/97
uggccgggcggua

SEQ ID NO: 3172249 - RNA, 17 nt, Mycobacterium bovis subsp bovis AF2122/97
uggccgggcgguaggcu

SEQ ID NO: 3172250 - RNA, 18 nt, Mycobacterium bovis subsp bovis AF2122/97
uggccggguccagcccgg

SEQ ID NO: 3172251 - RNA, 22 nt, Mycobacterium bovis subsp bovis AF2122/97
uggccggguccagcccggaacc

SEQ ID NO: 3172252 - RNA, 20 nt, Mycobacterium bovis subsp bovis AF2122/97
uggccgggucgaucaccgac

SEQ ID NO: 3172253 - RNA, 14 nt, Mycobacterium bovis subsp bovis AF2122/97
uggccgggucgucu

SEQ ID NO: 3172254 - RNA, 17 nt, Mycobacterium bovis subsp bovis AF2122/97
uggccggucacguccgc

SEQ ID NO: 3172255 - RNA, 19 nt, Mycobacterium bovis subsp bovis AF2122/97
uggccgguccgaucguuuc

SEQ ID NO: 3172256 - RNA, 16 nt, Mycobacterium bovis subsp bovis AF2122/97
uggccggugggccgcc

SEQ ID NO: 3172257 - RNA, 14 nt, Mycobacterium bovis subsp bovis AF2122/97
uggccguaccggug

SEQ ID NO: 3172258 - RNA, 15 nt, Mycobacterium bovis subsp bovis AF2122/97
uggccguaggcggcg

SEQ ID NO: 3172259 - RNA, 19 nt, Mycobacterium bovis subsp bovis AF2122/97
uggccguagucggcgaugc

SEQ ID NO: 3172260 - RNA, 14 nt, Mycobacterium bovis subsp bovis AF2122/97
uggccguccgaccg

SEQ ID NO: 3172261 - RNA, 15 nt, Mycobacterium bovis subsp bovis AF2122/97
uggccguccgaccga

SEQ ID NO: 3172262 - RNA, 14 nt, Mycobacterium bovis subsp bovis AF2122/97
uggccgucgccgaa

SEQ ID NO: 3172263 - RNA, 19 nt, Mycobacterium bovis subsp bovis AF2122/97
uggccgucgccgaaguucc

SEQ ID NO: 3172264 - RNA, 15 nt, Mycobacterium bovis subsp bovis AF2122/97
uggccgucgcuggug

SEQ ID NO: 3172265 - RNA, 19 nt, Mycobacterium bovis subsp bovis AF2122/97
uggccgucgcugguggcgg

SEQ ID NO: 3172266 - RNA, 17 nt, Mycobacterium bovis subsp bovis AF2122/97
uggccgucgggugcagc

SEQ ID NO: 3172267 - RNA, 18 nt, Mycobacterium bovis subsp bovis AF2122/97
uggccgugcccgaaggaa

SEQ ID NO: 3172268 - RNA, 22 nt, Mycobacterium bovis subsp bovis AF2122/97
uggccguggcgaaugacggcca

SEQ ID NO: 3172269 - RNA, 20 nt, Mycobacterium bovis subsp bovis AF2122/97
uggccguucggcgcccgcuc

SEQ ID NO: 3172270 - RNA, 21 nt, Mycobacterium bovis subsp bovis AF2122/97
uggccguuggccggaucgaag

SEQ ID NO: 3172271 - RNA, 17 nt, Mycobacterium bovis subsp bovis AF2122/97
uggccguuggcggcggu

SEQ ID NO: 3172272 - RNA, 17 nt, Mycobacterium bovis subsp bovis AF2122/97
uggccguuuguuuuguc

SEQ ID NO: 3172273 - RNA, 22 nt, Mycobacterium bovis subsp bovis AF2122/97
uggccuaggacaccggcaccac

SEQ ID NO: 3172274 - RNA, 20 nt, Mycobacterium bovis subsp bovis AF2122/97
uggccucacccggucaacgu

SEQ ID NO: 3172275 - RNA, 19 nt, Mycobacterium bovis subsp bovis AF2122/97
uggccucagccaccgggcg

SEQ ID NO: 3172276 - RNA, 15 nt, Mycobacterium bovis subsp bovis AF2122/97
uggccucagcccggc

SEQ ID NO: 3172277 - RNA, 13 nt, Mycobacterium bovis subsp bovis AF2122/97
uggccucauccac

SEQ ID NO: 3172278 - RNA, 15 nt, Mycobacterium bovis subsp bovis AF2122/97
uggccucauccaccg

SEQ ID NO: 3172279 - RNA, 16 nt, Mycobacterium bovis subsp bovis AF2122/97
uggccucauccaccga

SEQ ID NO: 3172280 - RNA, 18 nt, Mycobacterium bovis subsp bovis AF2122/97
uggccucccacucaccca

SEQ ID NO: 3172281 - RNA, 13 nt, Mycobacterium bovis subsp bovis AF2122/97
uggccucgaaggg

SEQ ID NO: 3172282 - RNA, 19 nt, Mycobacterium bovis subsp bovis AF2122/97
uggccucgccauugaggaa

SEQ ID NO: 3172283 - RNA, 18 nt, Mycobacterium bovis subsp bovis AF2122/97
uggccugaugcagggccc

SEQ ID NO: 3172284 - RNA, 13 nt, Mycobacterium bovis subsp bovis AF2122/97
uggccugcaacgc

SEQ ID NO: 3172285 - RNA, 17 nt, Mycobacterium bovis subsp bovis AF2122/97
uggccugcaacgccgcg

SEQ ID NO: 3172286 - RNA, 21 nt, Mycobacterium bovis subsp bovis AF2122/97
uggccugcaacgccgcggacc

SEQ ID NO: 3172287 - RNA, 16 nt, Mycobacterium bovis subsp bovis AF2122/97
uggccugcccagcacc

SEQ ID NO: 3172288 - RNA, 19 nt, Mycobacterium bovis subsp bovis AF2122/97
uggccugcccagcaccacc

SEQ ID NO: 3172289 - RNA, 22 nt, Mycobacterium bovis subsp bovis AF2122/97
uggccugucaggcggcggaccc

SEQ ID NO: 3172290 - RNA, 15 nt, Mycobacterium bovis subsp bovis AF2122/97
uggccuguucaacuc

SEQ ID NO: 3172291 - RNA, 21 nt, Mycobacterium bovis subsp bovis AF2122/97
uggccuugacagcuuucuugg

SEQ ID NO: 3172292 - RNA, 13 nt, Mycobacterium bovis subsp bovis AF2122/97
uggccuugcugcg

SEQ ID NO: 3172293 - RNA, 19 nt, Mycobacterium bovis subsp bovis AF2122/97
uggccuuggcaguccagcc

SEQ ID NO: 3172294 - RNA, 15 nt, Mycobacterium bovis subsp bovis AF2122/97
uggccuugugcagau

SEQ ID NO: 3172295 - RNA, 20 nt, Mycobacterium bovis subsp bovis AF2122/97
uggcgcgggcgagaacccac

SEQ ID NO: 3172296 - RNA, 13 nt, Mycobacterium bovis subsp bovis AF2122/97
uggcgcggggccg

SEQ ID NO: 3172297 - RNA, 18 nt, Mycobacterium bovis subsp bovis AF2122/97
uggcgcggucggagucga

SEQ ID NO: 3172298 - RNA, 22 nt, Mycobacterium bovis subsp bovis AF2122/97
uggcgcggucggagucgagcac

SEQ ID NO: 3172299 - RNA, 19 nt, Mycobacterium bovis subsp bovis AF2122/97
uggcgcguggucgggaacc

SEQ ID NO: 3172300 - RNA, 14 nt, Mycobacterium bovis subsp bovis AF2122/97
uggcgcucggcgag

SEQ ID NO: 3172301 - RNA, 23 nt, Mycobacterium bovis subsp bovis AF2122/97
uggcgcugaagccgacgauccac

SEQ ID NO: 3172302 - RNA, 19 nt, Mycobacterium bovis subsp bovis AF2122/97
uggcgcugagggugcucuc

SEQ ID NO: 3172303 - RNA, 15 nt, Mycobacterium bovis subsp bovis AF2122/97
uggcgcugaucggca

SEQ ID NO: 3172304 - RNA, 15 nt, Mycobacterium bovis subsp bovis AF2122/97
uggcgcugaugcugg

SEQ ID NO: 3172305 - RNA, 14 nt, Mycobacterium bovis subsp bovis AF2122/97
uggcgcugcuggca

SEQ ID NO: 3172306 - RNA, 15 nt, Mycobacterium bovis subsp bovis AF2122/97
uggcgcugcuggcag

SEQ ID NO: 3172307 - RNA, 19 nt, Mycobacterium bovis subsp bovis AF2122/97
uggcgcuuugggcugccgu

SEQ ID NO: 3172308 - RNA, 24 nt, Mycobacterium bovis subsp bovis AF2122/97
uggcggaacagcuucgcgcagccg

SEQ ID NO: 3172309 - RNA, 20 nt, Mycobacterium bovis subsp bovis AF2122/97
uggcggaacuguaggucaca

SEQ ID NO: 3172310 - RNA, 21 nt, Mycobacterium bovis subsp bovis AF2122/97
uggcggaacuugccggugcgc

SEQ ID NO: 3172311 - RNA, 20 nt, Mycobacterium bovis subsp bovis AF2122/97
uggcggaauucaggaagggc

SEQ ID NO: 3172312 - RNA, 16 nt, Mycobacterium bovis subsp bovis AF2122/97
uggcggacagggcggc

SEQ ID NO: 3172313 - RNA, 22 nt, Mycobacterium bovis subsp bovis AF2122/97
uggcggacagggcggcaacggc

SEQ ID NO: 3172314 - RNA, 14 nt, Mycobacterium bovis subsp bovis AF2122/97
uggcggacggcguc

SEQ ID NO: 3172315 - RNA, 18 nt, Mycobacterium bovis subsp bovis AF2122/97
uggcggacggcgucgagu

SEQ ID NO: 3172316 - RNA, 20 nt, Mycobacterium bovis subsp bovis AF2122/97
uggcggaucgcgagcgccgc

SEQ ID NO: 3172317 - RNA, 23 nt, Mycobacterium bovis subsp bovis AF2122/97
uggcggauggccgccuuggcuuc

SEQ ID NO: 3172318 - RNA, 18 nt, Mycobacterium bovis subsp bovis AF2122/97
uggcggcaaggguggggc

SEQ ID NO: 3172319 - RNA, 13 nt, Mycobacterium bovis subsp bovis AF2122/97
uggcggcacuggc

SEQ ID NO: 3172320 - RNA, 19 nt, Mycobacterium bovis subsp bovis AF2122/97
uggcggcagcaacgacguc

SEQ ID NO: 3172321 - RNA, 23 nt, Mycobacterium bovis subsp bovis AF2122/97
uggcggcagcgguuuuaggcagc

SEQ ID NO: 3172322 - RNA, 16 nt, Mycobacterium bovis subsp bovis AF2122/97
uggcggcaggugcggc

SEQ ID NO: 3172323 - RNA, 17 nt, Mycobacterium bovis subsp bovis AF2122/97
uggcggcaggugcggcg

SEQ ID NO: 3172324 - RNA, 20 nt, Mycobacterium bovis subsp bovis AF2122/97
uggcggcaggugcggcggca

SEQ ID NO: 3172325 - RNA, 19 nt, Mycobacterium bovis subsp bovis AF2122/97
uggcggcagguguuggugc

SEQ ID NO: 3172326 - RNA, 21 nt, Mycobacterium bovis subsp bovis AF2122/97
uggcggcagguguuggugcgg

SEQ ID NO: 3172327 - RNA, 16 nt, Mycobacterium bovis subsp bovis AF2122/97
uggcggccaccagcgc

SEQ ID NO: 3172328 - RNA, 18 nt, Mycobacterium bovis subsp bovis AF2122/97
uggcggccagccgcucca

SEQ ID NO: 3172329 - RNA, 15 nt, Mycobacterium bovis subsp bovis AF2122/97
uggcggccagcgcac

SEQ ID NO: 3172330 - RNA, 20 nt, Mycobacterium bovis subsp bovis AF2122/97
uggcggccagcgcaccgccg

SEQ ID NO: 3172331 - RNA, 23 nt, Mycobacterium bovis subsp bovis AF2122/97
uggcggccaguucggcggccgcc

SEQ ID NO: 3172332 - RNA, 12 nt, Mycobacterium bovis subsp bovis AF2122/97
uggcggcccggu

SEQ ID NO: 3172333 - RNA, 19 nt, Mycobacterium bovis subsp bovis AF2122/97
uggcggccgcaaucauguc

SEQ ID NO: 3172334 - RNA, 14 nt, Mycobacterium bovis subsp bovis AF2122/97
uggcggccgggucg

SEQ ID NO: 3172335 - RNA, 20 nt, Mycobacterium bovis subsp bovis AF2122/97
uggcggccgggucggugacg

SEQ ID NO: 3172336 - RNA, 19 nt, Mycobacterium bovis subsp bovis AF2122/97
uggcggccuaacucgccug

SEQ ID NO: 3172337 - RNA, 23 nt, Mycobacterium bovis subsp bovis AF2122/97
uggcggccucgccggcgcgcagc

SEQ ID NO: 3172338 - RNA, 23 nt, Mycobacterium bovis subsp bovis AF2122/97
uggcggccucgggcucaaacgga

SEQ ID NO: 3172339 - RNA, 17 nt, Mycobacterium bovis subsp bovis AF2122/97
uggcggcgacacgccag

SEQ ID NO: 3172340 - RNA, 23 nt, Mycobacterium bovis subsp bovis AF2122/97
uggcggcgacccgucccccgcac

SEQ ID NO: 3172341 - RNA, 12 nt, Mycobacterium bovis subsp bovis AF2122/97
uggcggcgacgg

SEQ ID NO: 3172342 - RNA, 21 nt, Mycobacterium bovis subsp bovis AF2122/97
uggcggcgaucaacucgggca

SEQ ID NO: 3172343 - RNA, 23 nt, Mycobacterium bovis subsp bovis AF2122/97
uggcggcgaucaacucgggcagc

SEQ ID NO: 3172344 - RNA, 20 nt, Mycobacterium bovis subsp bovis AF2122/97
uggcggcgaugguaucgccg

SEQ ID NO: 3172345 - RNA, 22 nt, Mycobacterium bovis subsp bovis AF2122/97
uggcggcgccgcagaucaccgc

SEQ ID NO: 3172346 - RNA, 13 nt, Mycobacterium bovis subsp bovis AF2122/97
uggcggcgccggu

SEQ ID NO: 3172347 - RNA, 21 nt, Mycobacterium bovis subsp bovis AF2122/97
uggcggcgcguucgucgucgc

SEQ ID NO: 3172348 - RNA, 13 nt, Mycobacterium bovis subsp bovis AF2122/97
uggcggcgcugcg

SEQ ID NO: 3172349 - RNA, 16 nt, Mycobacterium bovis subsp bovis AF2122/97
uggcggcggugcagca

SEQ ID NO: 3172350 - RNA, 18 nt, Mycobacterium bovis subsp bovis AF2122/97
uggcggcggugccacgau

SEQ ID NO: 3172351 - RNA, 16 nt, Mycobacterium bovis subsp bovis AF2122/97
uggcggcucacgaccg

SEQ ID NO: 3172352 - RNA, 14 nt, Mycobacterium bovis subsp bovis AF2122/97
uggcggcuccgccc

SEQ ID NO: 3172353 - RNA, 12 nt, Mycobacterium bovis subsp bovis AF2122/97
uggcggcucgcg

SEQ ID NO: 3172354 - RNA, 14 nt, Mycobacterium bovis subsp bovis AF2122/97
uggcggcucguugc

SEQ ID NO: 3172355 - RNA, 22 nt, Mycobacterium bovis subsp bovis AF2122/97
uggcggcucguugcgggcggga

SEQ ID NO: 3172356 - RNA, 15 nt, Mycobacterium bovis subsp bovis AF2122/97
uggcggcugcagccg

SEQ ID NO: 3172357 - RNA, 16 nt, Mycobacterium bovis subsp bovis AF2122/97
uggcggcuucgacguc

SEQ ID NO: 3172358 - RNA, 18 nt, Mycobacterium bovis subsp bovis AF2122/97
uggcggcuucgacgucgg

SEQ ID NO: 3172359 - RNA, 17 nt, Mycobacterium bovis subsp bovis AF2122/97
uggcgggagaucgucgc

SEQ ID NO: 3172360 - RNA, 20 nt, Mycobacterium bovis subsp bovis AF2122/97
uggcgggagaucgucgccau

SEQ ID NO: 3172361 - RNA, 22 nt, Mycobacterium bovis subsp bovis AF2122/97
uggcgggaucgagagccgaccg

SEQ ID NO: 3172362 - RNA, 17 nt, Mycobacterium bovis subsp bovis AF2122/97
uggcgggcagcuguucg

SEQ ID NO: 3172363 - RNA, 14 nt, Mycobacterium bovis subsp bovis AF2122/97
uggcgggcgaucgc

SEQ ID NO: 3172364 - RNA, 16 nt, Mycobacterium bovis subsp bovis AF2122/97
uggcgggcgccuuggu

SEQ ID NO: 3172365 - RNA, 22 nt, Mycobacterium bovis subsp bovis AF2122/97
uggcgggcgccuuggucgccgc

SEQ ID NO: 3172366 - RNA, 13 nt, Mycobacterium bovis subsp bovis AF2122/97
uggcgggcggcgu

SEQ ID NO: 3172367 - RNA, 22 nt, Mycobacterium bovis subsp bovis AF2122/97
uggcggggaaaccggccagccg

SEQ ID NO: 3172368 - RNA, 18 nt, Mycobacterium bovis subsp bovis AF2122/97
uggcggggaucagcgagu

SEQ ID NO: 3172369 - RNA, 19 nt, Mycobacterium bovis subsp bovis AF2122/97
uggcgggucggucgguaac

SEQ ID NO: 3172370 - RNA, 19 nt, Mycobacterium bovis subsp bovis AF2122/97
uggcgggugcgacaucggu

SEQ ID NO: 3172371 - RNA, 22 nt, Mycobacterium bovis subsp bovis AF2122/97
uggcgguaaaccacucgcggau

SEQ ID NO: 3172372 - RNA, 23 nt, Mycobacterium bovis subsp bovis AF2122/97
uggcgguaaaccacucgcggauc

SEQ ID NO: 3172373 - RNA, 15 nt, Mycobacterium bovis subsp bovis AF2122/97
uggcggucaccacgc

SEQ ID NO: 3172374 - RNA, 21 nt, Mycobacterium bovis subsp bovis AF2122/97
uggcggucaccacgcggcggu

SEQ ID NO: 3172375 - RNA, 22 nt, Mycobacterium bovis subsp bovis AF2122/97
uggcggucaccacgcggcgguc

SEQ ID NO: 3172376 - RNA, 15 nt, Mycobacterium bovis subsp bovis AF2122/97
uggcggucgccacac

SEQ ID NO: 3172377 - RNA, 20 nt, Mycobacterium bovis subsp bovis AF2122/97
uggcggucggcagaccgacc

SEQ ID NO: 3172378 - RNA, 22 nt, Mycobacterium bovis subsp bovis AF2122/97
uggcggucggcagaccgaccuc

SEQ ID NO: 3172379 - RNA, 21 nt, Mycobacterium bovis subsp bovis AF2122/97
uggcggucuugccgcaggccu

SEQ ID NO: 3172380 - RNA, 15 nt, Mycobacterium bovis subsp bovis AF2122/97
uggcggugagcacuu

SEQ ID NO: 3172381 - RNA, 21 nt, Mycobacterium bovis subsp bovis AF2122/97
ugggaaucagugaagacacca

SEQ ID NO: 3172382 - RNA, 21 nt, Mycobacterium bovis subsp bovis AF2122/97
ugggacaaagacgccgucggc

SEQ ID NO: 3172383 - RNA, 23 nt, Mycobacterium bovis subsp bovis AF2122/97
ugggacaacgugccgaacgccag

SEQ ID NO: 3172384 - RNA, 20 nt, Mycobacterium bovis subsp bovis AF2122/97
ugggacaccaucuccgccgu

SEQ ID NO: 3172385 - RNA, 22 nt, Mycobacterium bovis subsp bovis AF2122/97
ugggaccgggcguuucccugcc

SEQ ID NO: 3172386 - RNA, 13 nt, Mycobacterium bovis subsp bovis AF2122/97
ugggacggcggca

SEQ ID NO: 3172387 - RNA, 14 nt, Mycobacterium bovis subsp bovis AF2122/97
ugggacugcggaca

SEQ ID NO: 3172388 - RNA, 11 nt, Mycobacterium bovis subsp bovis AF2122/97
ugggagcagcc

SEQ ID NO: 3172389 - RNA, 22 nt, Mycobacterium bovis subsp bovis AF2122/97
ugggagccaccggcgucgacgu

SEQ ID NO: 3172390 - RNA, 22 nt, Mycobacterium bovis subsp bovis AF2122/97
ugggagccacugcggcauggca

SEQ ID NO: 3172391 - RNA, 18 nt, Mycobacterium bovis subsp bovis AF2122/97
ugggagcuacccgggcca

SEQ ID NO: 3172392 - RNA, 21 nt, Mycobacterium bovis subsp bovis AF2122/97
ugggagguggcgcggggccgc

SEQ ID NO: 3172393 - RNA, 14 nt, Mycobacterium bovis subsp bovis AF2122/97
ugggagucccacca

SEQ ID NO: 3172394 - RNA, 21 nt, Mycobacterium bovis subsp bovis AF2122/97
ugggauagcgcgguuggcuga

SEQ ID NO: 3172395 - RNA, 15 nt, Mycobacterium bovis subsp bovis AF2122/97
ugggaucaggcuggg

SEQ ID NO: 3172396 - RNA, 19 nt, Mycobacterium bovis subsp bovis AF2122/97
ugggaucaggcugggcaga

SEQ ID NO: 3172397 - RNA, 17 nt, Mycobacterium bovis subsp bovis AF2122/97
ugggaucccagcgcagc

SEQ ID NO: 3172398 - RNA, 15 nt, Mycobacterium bovis subsp bovis AF2122/97
ugggauccggcggca

SEQ ID NO: 3172399 - RNA, 23 nt, Mycobacterium bovis subsp bovis AF2122/97
ugggaucgggaauuucgucggcc

SEQ ID NO: 3172400 - RNA, 15 nt, Mycobacterium bovis subsp bovis AF2122/97
ugggaucgugccggc

SEQ ID NO: 3172401 - RNA, 20 nt, Mycobacterium bovis subsp bovis AF2122/97
ugggaugaccuuggccgugc

SEQ ID NO: 3172402 - RNA, 19 nt, Mycobacterium bovis subsp bovis AF2122/97
ugggaugaguucgucgugg

SEQ ID NO: 3172403 - RNA, 18 nt, Mycobacterium bovis subsp bovis AF2122/97
ugggaugugccgcgcacg

SEQ ID NO: 3172404 - RNA, 20 nt, Mycobacterium bovis subsp bovis AF2122/97
ugggauucugacgaccggcu

SEQ ID NO: 3172405 - RNA, 15 nt, Mycobacterium bovis subsp bovis AF2122/97
ugggauucugggcga

SEQ ID NO: 3172406 - RNA, 22 nt, Mycobacterium bovis subsp bovis AF2122/97
ugggauugaagcuggccaccgc

SEQ ID NO: 3172407 - RNA, 14 nt, Mycobacterium bovis subsp bovis AF2122/97
ugggauugagcccg

SEQ ID NO: 3172408 - RNA, 20 nt, Mycobacterium bovis subsp bovis AF2122/97
ugggcaaacugggcaccggc

SEQ ID NO: 3172409 - RNA, 17 nt, Mycobacterium bovis subsp bovis AF2122/97
ugggcaagcugaccgcc

SEQ ID NO: 3172410 - RNA, 19 nt, Mycobacterium bovis subsp bovis AF2122/97
ugggcaagcugaccgccag

SEQ ID NO: 3172411 - RNA, 16 nt, Mycobacterium bovis subsp bovis AF2122/97
ugggcaauuccgccga

SEQ ID NO: 3172412 - RNA, 23 nt, Mycobacterium bovis subsp bovis AF2122/97
ugggcaauuccgccgagcgcaac

SEQ ID NO: 3172413 - RNA, 21 nt, Mycobacterium bovis subsp bovis AF2122/97
ugggcaccacccgauuggcca

SEQ ID NO: 3172414 - RNA, 17 nt, Mycobacterium bovis subsp bovis AF2122/97
ugggcaccggcggucug

SEQ ID NO: 3172415 - RNA, 19 nt, Mycobacterium bovis subsp bovis AF2122/97
ugggcaccuuggccaggaa

SEQ ID NO: 3172416 - RNA, 16 nt, Mycobacterium bovis subsp bovis AF2122/97
ugggcacguugugauc

SEQ ID NO: 3172417 - RNA, 17 nt, Mycobacterium bovis subsp bovis AF2122/97
ugggcacguugugaucg

SEQ ID NO: 3172418 - RNA, 19 nt, Mycobacterium bovis subsp bovis AF2122/97
ugggcagauauugccugcc

SEQ ID NO: 3172419 - RNA, 22 nt, Mycobacterium bovis subsp bovis AF2122/97
ugggcagauauugccugccacc

SEQ ID NO: 3172420 - RNA, 15 nt, Mycobacterium bovis subsp bovis AF2122/97
ugggcagcaggccca

SEQ ID NO: 3172421 - RNA, 16 nt, Mycobacterium bovis subsp bovis AF2122/97
ugggcagcaggcccac

SEQ ID NO: 3172422 - RNA, 21 nt, Mycobacterium bovis subsp bovis AF2122/97
ugggcagcaggcccacccggg

SEQ ID NO: 3172423 - RNA, 19 nt, Mycobacterium bovis subsp bovis AF2122/97
ugggcagccagaucuccag

SEQ ID NO: 3172424 - RNA, 21 nt, Mycobacterium bovis subsp bovis AF2122/97
ugggcagcgcgcccgacaccc

SEQ ID NO: 3172425 - RNA, 12 nt, Mycobacterium bovis subsp bovis AF2122/97
ugggcaucaccg

SEQ ID NO: 3172426 - RNA, 22 nt, Mycobacterium bovis subsp bovis AF2122/97
ugggcaucaccgacgcgucggc

SEQ ID NO: 3172427 - RNA, 13 nt, Mycobacterium bovis subsp bovis AF2122/97
ugggcaucaccgc

SEQ ID NO: 3172428 - RNA, 15 nt, Mycobacterium bovis subsp bovis AF2122/97
ugggcaucaccgccg

SEQ ID NO: 3172429 - RNA, 15 nt, Mycobacterium bovis subsp bovis AF2122/97
ugggcaucaggccgc

SEQ ID NO: 3172430 - RNA, 19 nt, Mycobacterium bovis subsp bovis AF2122/97
ugggcaucaucgacgcgcg

SEQ ID NO: 3172431 - RNA, 23 nt, Mycobacterium bovis subsp bovis AF2122/97
ugggcaugcggauucgcgcuguc

SEQ ID NO: 3172432 - RNA, 18 nt, Mycobacterium bovis subsp bovis AF2122/97
ugggccaacgacgccaug

SEQ ID NO: 3172433 - RNA, 23 nt, Mycobacterium bovis subsp bovis AF2122/97
ugggccaacucauuaacgccauc

SEQ ID NO: 3172434 - RNA, 16 nt, Mycobacterium bovis subsp bovis AF2122/97
ugggccaccaccucgg

SEQ ID NO: 3172435 - RNA, 16 nt, Mycobacterium bovis subsp bovis AF2122/97
ugggccaccggcgccg

SEQ ID NO: 3172436 - RNA, 13 nt, Mycobacterium bovis subsp bovis AF2122/97
ugggccagcagca

SEQ ID NO: 3172437 - RNA, 21 nt, Mycobacterium bovis subsp bovis AF2122/97
ugggccagccgcucacccggu

SEQ ID NO: 3172438 - RNA, 15 nt, Mycobacterium bovis subsp bovis AF2122/97
ugggccaggcccagc

SEQ ID NO: 3172439 - RNA, 18 nt, Mycobacterium bovis subsp bovis AF2122/97
ugggccaggucagccgcg

SEQ ID NO: 3172440 - RNA, 21 nt, Mycobacterium bovis subsp bovis AF2122/97
ugggccaggucagccgcgcgg

SEQ ID NO: 3172441 - RNA, 20 nt, Mycobacterium bovis subsp bovis AF2122/97
ugggccagugaaaccaccgg

SEQ ID NO: 3172442 - RNA, 15 nt, Mycobacterium bovis subsp bovis AF2122/97
ugggcccagcggccg

SEQ ID NO: 3172443 - RNA, 19 nt, Mycobacterium bovis subsp bovis AF2122/97
ugggcccagcggccgcgau

SEQ ID NO: 3172444 - RNA, 21 nt, Mycobacterium bovis subsp bovis AF2122/97
ugggcccaggagauccaccgg

SEQ ID NO: 3172445 - RNA, 16 nt, Mycobacterium bovis subsp bovis AF2122/97
ugggcccaucgcgacu

SEQ ID NO: 3172446 - RNA, 21 nt, Mycobacterium bovis subsp bovis AF2122/97
ugggcccccaaucagugcagc

SEQ ID NO: 3172447 - RNA, 22 nt, Mycobacterium bovis subsp bovis AF2122/97
ugggccccgaucccgaggggag

SEQ ID NO: 3172448 - RNA, 15 nt, Mycobacterium bovis subsp bovis AF2122/97
ugggccccgccgaug

SEQ ID NO: 3172449 - RNA, 16 nt, Mycobacterium bovis subsp bovis AF2122/97
ugggcccgccagccca

SEQ ID NO: 3172450 - RNA, 13 nt, Mycobacterium bovis subsp bovis AF2122/97
ugggccgaccgcc

SEQ ID NO: 3172451 - RNA, 19 nt, Mycobacterium bovis subsp bovis AF2122/97
ugggccgagagcagccagc

SEQ ID NO: 3172452 - RNA, 22 nt, Mycobacterium bovis subsp bovis AF2122/97
ugggccgagagcagccagccac

SEQ ID NO: 3172453 - RNA, 14 nt, Mycobacterium bovis subsp bovis AF2122/97
ugggccgagcgcgc

SEQ ID NO: 3172454 - RNA, 16 nt, Mycobacterium bovis subsp bovis AF2122/97
ugggccgagcgcgccg

SEQ ID NO: 3172455 - RNA, 15 nt, Mycobacterium bovis subsp bovis AF2122/97
ugggccgccgcccug

SEQ ID NO: 3172456 - RNA, 12 nt, Mycobacterium bovis subsp bovis AF2122/97
ugggccgcucca

SEQ ID NO: 3172457 - RNA, 14 nt, Mycobacterium bovis subsp bovis AF2122/97
ugggccgcugauca

SEQ ID NO: 3172458 - RNA, 13 nt, Mycobacterium bovis subsp bovis AF2122/97
ugggccgcuggga

SEQ ID NO: 3172459 - RNA, 13 nt, Mycobacterium bovis subsp bovis AF2122/97
ugggccggcgccg

SEQ ID NO: 3172460 - RNA, 23 nt, Mycobacterium bovis subsp bovis AF2122/97
ugggccucaaguugguucaccgc

SEQ ID NO: 3172461 - RNA, 23 nt, Mycobacterium bovis subsp bovis AF2122/97
ugggccuccaccgcguccaggug

SEQ ID NO: 3172462 - RNA, 15 nt, Mycobacterium bovis subsp bovis AF2122/97
ugggccucgaucagc

SEQ ID NO: 3172463 - RNA, 15 nt, Mycobacterium bovis subsp bovis AF2122/97
ugggccugccagucc

SEQ ID NO: 3172464 - RNA, 15 nt, Mycobacterium bovis subsp bovis AF2122/97
ugggccugcgcagac

SEQ ID NO: 3172465 - RNA, 17 nt, Mycobacterium bovis subsp bovis AF2122/97
ugggccugggccgcaca

SEQ ID NO: 3172466 - RNA, 22 nt, Mycobacterium bovis subsp bovis AF2122/97
ugggcgaagcccagaucuugca

SEQ ID NO: 3172467 - RNA, 16 nt, Mycobacterium bovis subsp bovis AF2122/97
ugguauucaugcccgu

SEQ ID NO: 3172468 - RNA, 11 nt, Mycobacterium bovis subsp bovis AF2122/97
uggucaacacg

SEQ ID NO: 3172469 - RNA, 13 nt, Mycobacterium bovis subsp bovis AF2122/97
uggucaacagcgg

SEQ ID NO: 3172470 - RNA, 15 nt, Mycobacterium bovis subsp bovis AF2122/97
uggucaacagcggca

SEQ ID NO: 3172471 - RNA, 15 nt, Mycobacterium bovis subsp bovis AF2122/97
uggucaaccgcgccc

SEQ ID NO: 3172472 - RNA, 14 nt, Mycobacterium bovis subsp bovis AF2122/97
uggucaaccgcguc

SEQ ID NO: 3172473 - RNA, 15 nt, Mycobacterium bovis subsp bovis AF2122/97
uggucaacggcagau

SEQ ID NO: 3172474 - RNA, 13 nt, Mycobacterium bovis subsp bovis AF2122/97
uggucaacggccg

SEQ ID NO: 3172475 - RNA, 17 nt, Mycobacterium bovis subsp bovis AF2122/97
uggucaacggccgacuu

SEQ ID NO: 3172476 - RNA, 18 nt, Mycobacterium bovis subsp bovis AF2122/97
uggucaaugccggccgcg

SEQ ID NO: 3172477 - RNA, 17 nt, Mycobacterium bovis subsp bovis AF2122/97
uggucaaugcgcuggcg

SEQ ID NO: 3172478 - RNA, 17 nt, Mycobacterium bovis subsp bovis AF2122/97
uggucacacccagcgcg

SEQ ID NO: 3172479 - RNA, 15 nt, Mycobacterium bovis subsp bovis AF2122/97
uggucaccaccauca

SEQ ID NO: 3172480 - RNA, 16 nt, Mycobacterium bovis subsp bovis AF2122/97
uggucaccaccuggug

SEQ ID NO: 3172481 - RNA, 20 nt, Mycobacterium bovis subsp bovis AF2122/97
uggucacgcagucgggcagc

SEQ ID NO: 3172482 - RNA, 17 nt, Mycobacterium bovis subsp bovis AF2122/97
uggucacggcgucgacu

SEQ ID NO: 3172483 - RNA, 23 nt, Mycobacterium bovis subsp bovis AF2122/97
uggucacggcgucgacuggccgu

SEQ ID NO: 3172484 - RNA, 18 nt, Mycobacterium bovis subsp bovis AF2122/97
uggucagcaccggcgcgg

SEQ ID NO: 3172485 - RNA, 24 nt, Mycobacterium bovis subsp bovis AF2122/97
uggucagccgcggcggcagcaccc

SEQ ID NO: 3172486 - RNA, 19 nt, Mycobacterium bovis subsp bovis AF2122/97
uggucagcguggacgcccg

SEQ ID NO: 3172487 - RNA, 13 nt, Mycobacterium bovis subsp bovis AF2122/97
uggucagcuggcc

SEQ ID NO: 3172488 - RNA, 23 nt, Mycobacterium bovis subsp bovis AF2122/97
uggucagcuggccgcggcgagua

SEQ ID NO: 3172489 - RNA, 19 nt, Mycobacterium bovis subsp bovis AF2122/97
uggucagugugaacugucc

SEQ ID NO: 3172490 - RNA, 20 nt, Mycobacterium bovis subsp bovis AF2122/97
uggucagugugaacuguccc

SEQ ID NO: 3172491 - RNA, 13 nt, Mycobacterium bovis subsp bovis AF2122/97
uggucauggccga

SEQ ID NO: 3172492 - RNA, 19 nt, Mycobacterium bovis subsp bovis AF2122/97
uggucauguucggggcgca

SEQ ID NO: 3172493 - RNA, 23 nt, Mycobacterium bovis subsp bovis AF2122/97
uggucauguucggggcgcaccac

SEQ ID NO: 3172494 - RNA, 14 nt, Mycobacterium bovis subsp bovis AF2122/97
ugguccaaccagca

SEQ ID NO: 3172495 - RNA, 15 nt, Mycobacterium bovis subsp bovis AF2122/97
ugguccaaccagcac

SEQ ID NO: 3172496 - RNA, 15 nt, Mycobacterium bovis subsp bovis AF2122/97
ugguccaaccgggcc

SEQ ID NO: 3172497 - RNA, 16 nt, Mycobacterium bovis subsp bovis AF2122/97
ugguccaagacagccu

SEQ ID NO: 3172498 - RNA, 20 nt, Mycobacterium bovis subsp bovis AF2122/97
ugguccagcacaucggcgag

SEQ ID NO: 3172499 - RNA, 15 nt, Mycobacterium bovis subsp bovis AF2122/97
ugguccagcaccggg

SEQ ID NO: 3172500 - RNA, 12 nt, Mycobacterium bovis subsp bovis AF2122/97
ugguccagccgg

SEQ ID NO: 3172501 - RNA, 18 nt, Mycobacterium bovis subsp bovis AF2122/97
ugguccaggcccuggcca

SEQ ID NO: 3172502 - RNA, 15 nt, Mycobacterium bovis subsp bovis AF2122/97
uggucccacaccucc

SEQ ID NO: 3172503 - RNA, 21 nt, Mycobacterium bovis subsp bovis AF2122/97
uggucccgagggcggcagcua

SEQ ID NO: 3172504 - RNA, 16 nt, Mycobacterium bovis subsp bovis AF2122/97
uggucccgauggcgau

SEQ ID NO: 3172505 - RNA, 19 nt, Mycobacterium bovis subsp bovis AF2122/97
uggucccguucgcccgccc

SEQ ID NO: 3172506 - RNA, 22 nt, Mycobacterium bovis subsp bovis AF2122/97
ugguccgccagaucucgcgcgc

SEQ ID NO: 3172507 - RNA, 20 nt, Mycobacterium bovis subsp bovis AF2122/97
ugguccgccgucgaccacga

SEQ ID NO: 3172508 - RNA, 18 nt, Mycobacterium bovis subsp bovis AF2122/97
ugguccgcugcagcaccg

SEQ ID NO: 3172509 - RNA, 15 nt, Mycobacterium bovis subsp bovis AF2122/97
ugguccggccgcgga

SEQ ID NO: 3172510 - RNA, 22 nt, Mycobacterium bovis subsp bovis AF2122/97
ugguccggccgcggaccgcgaa

SEQ ID NO: 3172511 - RNA, 23 nt, Mycobacterium bovis subsp bovis AF2122/97
ugguccuccaaggcggucaccac

SEQ ID NO: 3172512 - RNA, 21 nt, Mycobacterium bovis subsp bovis AF2122/97
ugguccucgaucagacgcucg

SEQ ID NO: 3172513 - RNA, 23 nt, Mycobacterium bovis subsp bovis AF2122/97
ugguccugauguucugcgggggu

SEQ ID NO: 3172514 - RNA, 20 nt, Mycobacterium bovis subsp bovis AF2122/97
ugguccuuguugugguggag

SEQ ID NO: 3172515 - RNA, 22 nt, Mycobacterium bovis subsp bovis AF2122/97
uggucgaaacgguacgccgccg

SEQ ID NO: 3172516 - RNA, 23 nt, Mycobacterium bovis subsp bovis AF2122/97
uggucgaauaguugaccaggccg

SEQ ID NO: 3172517 - RNA, 15 nt, Mycobacterium bovis subsp bovis AF2122/97
uggucgaccgccgag

SEQ ID NO: 3172518 - RNA, 19 nt, Mycobacterium bovis subsp bovis AF2122/97
uggucgagcacgcugcugc

SEQ ID NO: 3172519 - RNA, 20 nt, Mycobacterium bovis subsp bovis AF2122/97
uggucgagcacgcugcugcg

SEQ ID NO: 3172520 - RNA, 23 nt, Mycobacterium bovis subsp bovis AF2122/97
uggucgagcagugccucggcgau

SEQ ID NO: 3172521 - RNA, 15 nt, Mycobacterium bovis subsp bovis AF2122/97
uggucgagggcggcg

SEQ ID NO: 3172522 - RNA, 14 nt, Mycobacterium bovis subsp bovis AF2122/97
uggucgaggucggc

SEQ ID NO: 3172523 - RNA, 14 nt, Mycobacterium bovis subsp bovis AF2122/97
uggucgagugcgau

SEQ ID NO: 3172524 - RNA, 17 nt, Mycobacterium bovis subsp bovis AF2122/97
uggucgaguugaagaau

SEQ ID NO: 3172525 - RNA, 16 nt, Mycobacterium bovis subsp bovis AF2122/97
uggucgaucagguacu

SEQ ID NO: 3172526 - RNA, 20 nt, Mycobacterium bovis subsp bovis AF2122/97
uggucgaucaugacgagccg

SEQ ID NO: 3172527 - RNA, 19 nt, Mycobacterium bovis subsp bovis AF2122/97
uggucgauucgucgaaggg

SEQ ID NO: 3172528 - RNA, 18 nt, Mycobacterium bovis subsp bovis AF2122/97
uggucgauuucggcgcgu

SEQ ID NO: 3172529 - RNA, 19 nt, Mycobacterium bovis subsp bovis AF2122/97
uggucgauuucggcgcgug

SEQ ID NO: 3172530 - RNA, 14 nt, Mycobacterium bovis subsp bovis AF2122/97
uggucgcaccgccg

SEQ ID NO: 3172531 - RNA, 18 nt, Mycobacterium bovis subsp bovis AF2122/97
uggucgcaggauucccag

SEQ ID NO: 3172532 - RNA, 16 nt, Mycobacterium bovis subsp bovis AF2122/97
uggucgccacccgaca

SEQ ID NO: 3172533 - RNA, 23 nt, Mycobacterium bovis subsp bovis AF2122/97
uggucgccacccgacaugcgccg

SEQ ID NO: 3172534 - RNA, 14 nt, Mycobacterium bovis subsp bovis AF2122/97
uggucgccaugucg

SEQ ID NO: 3172535 - RNA, 13 nt, Mycobacterium bovis subsp bovis AF2122/97
uggucgccccgau

SEQ ID NO: 3172536 - RNA, 18 nt, Mycobacterium bovis subsp bovis AF2122/97
uggucgccccgaugaccg

SEQ ID NO: 3172537 - RNA, 18 nt, Mycobacterium bovis subsp bovis AF2122/97
uggucgccgcggcagcgu

SEQ ID NO: 3172538 - RNA, 18 nt, Mycobacterium bovis subsp bovis AF2122/97
uggucgccgcuuucuugg

SEQ ID NO: 3172539 - RNA, 14 nt, Mycobacterium bovis subsp bovis AF2122/97
uggucgccgggcag

SEQ ID NO: 3172540 - RNA, 19 nt, Mycobacterium bovis subsp bovis AF2122/97
uggucgccgucgaagcgga

SEQ ID NO: 3172541 - RNA, 14 nt, Mycobacterium bovis subsp bovis AF2122/97
uggucgcgcagcuc

SEQ ID NO: 3172542 - RNA, 18 nt, Mycobacterium bovis subsp bovis AF2122/97
uggucgcggcugccagaa

SEQ ID NO: 3172543 - RNA, 14 nt, Mycobacterium bovis subsp bovis AF2122/97
uggucgcggggccg

SEQ ID NO: 3172544 - RNA, 20 nt, Mycobacterium bovis subsp bovis AF2122/97
uggucgcggucccacggccg

SEQ ID NO: 3172545 - RNA, 14 nt, Mycobacterium bovis subsp bovis AF2122/97
uggucgcgguggcg

SEQ ID NO: 3172546 - RNA, 18 nt, Mycobacterium bovis subsp bovis AF2122/97
uggucgcgguggcggcgg

SEQ ID NO: 3172547 - RNA, 20 nt, Mycobacterium bovis subsp bovis AF2122/97
uggucgcugcugccgcaccg

SEQ ID NO: 3172548 - RNA, 22 nt, Mycobacterium bovis subsp bovis AF2122/97
uggucgcugcugcgaucgccgc

SEQ ID NO: 3172549 - RNA, 21 nt, Mycobacterium bovis subsp bovis AF2122/97
uggucggagaccagcgucuuc

SEQ ID NO: 3172550 - RNA, 16 nt, Mycobacterium bovis subsp bovis AF2122/97
uggucggccaggucga

SEQ ID NO: 3172551 - RNA, 19 nt, Mycobacterium bovis subsp bovis AF2122/97
uggucggccaggucgagca

SEQ ID NO: 3172552 - RNA, 14 nt, Mycobacterium bovis subsp bovis AF2122/97
uggucggccgcaag

SEQ ID NO: 3172553 - RNA, 16 nt, Mycobacterium bovis subsp bovis AF2122/97
ugguggacgccaugga

SEQ ID NO: 3172554 - RNA, 16 nt, Mycobacterium bovis subsp bovis AF2122/97
ugguggagcggcgcgg

SEQ ID NO: 3172555 - RNA, 16 nt, Mycobacterium bovis subsp bovis AF2122/97
ugguggaugagccggu

SEQ ID NO: 3172556 - RNA, 23 nt, Mycobacterium bovis subsp bovis AF2122/97
ugguggcaacggguccgacggug

SEQ ID NO: 3172557 - RNA, 11 nt, Mycobacterium bovis subsp bovis AF2122/97
ugguggccagc

SEQ ID NO: 3172558 - RNA, 15 nt, Mycobacterium bovis subsp bovis AF2122/97
ugguggccagccagc

SEQ ID NO: 3172559 - RNA, 21 nt, Mycobacterium bovis subsp bovis AF2122/97
ugguggccaugacggcuccga

SEQ ID NO: 3172560 - RNA, 12 nt, Mycobacterium bovis subsp bovis AF2122/97
ugguggcccggc

SEQ ID NO: 3172561 - RNA, 13 nt, Mycobacterium bovis subsp bovis AF2122/97
ugguggcccggcu

SEQ ID NO: 3172562 - RNA, 15 nt, Mycobacterium bovis subsp bovis AF2122/97
ugguggcccgggcca

SEQ ID NO: 3172563 - RNA, 16 nt, Mycobacterium bovis subsp bovis AF2122/97
ugguggcccgggccac

SEQ ID NO: 3172564 - RNA, 17 nt, Mycobacterium bovis subsp bovis AF2122/97
ugguggcccgggccacc

SEQ ID NO: 3172565 - RNA, 18 nt, Mycobacterium bovis subsp bovis AF2122/97
ugguggcccgggccaccg

SEQ ID NO: 3172566 - RNA, 20 nt, Mycobacterium bovis subsp bovis AF2122/97
ugguggcccgggccaccgga

SEQ ID NO: 3172567 - RNA, 22 nt, Mycobacterium bovis subsp bovis AF2122/97
ugguggccgaacgggucggcga

SEQ ID NO: 3172568 - RNA, 23 nt, Mycobacterium bovis subsp bovis AF2122/97
ugguggccgaacgggucggcgac

SEQ ID NO: 3172569 - RNA, 19 nt, Mycobacterium bovis subsp bovis AF2122/97
ugguggccggggugccggc

SEQ ID NO: 3172570 - RNA, 23 nt, Mycobacterium bovis subsp bovis AF2122/97
ugguggccgggucgaucaccgac

SEQ ID NO: 3172571 - RNA, 16 nt, Mycobacterium bovis subsp bovis AF2122/97
ugguggcgccaucccc

SEQ ID NO: 3172572 - RNA, 23 nt, Mycobacterium bovis subsp bovis AF2122/97
ugguggcgccauccccgccggcg

SEQ ID NO: 3172573 - RNA, 13 nt, Mycobacterium bovis subsp bovis AF2122/97
ugguggcgccggc

SEQ ID NO: 3172574 - RNA, 12 nt, Mycobacterium bovis subsp bovis AF2122/97
ugguggcggcga

SEQ ID NO: 3172575 - RNA, 23 nt, Mycobacterium bovis subsp bovis AF2122/97
ugguggcggcgacacgccaggug

SEQ ID NO: 3172576 - RNA, 14 nt, Mycobacterium bovis subsp bovis AF2122/97
ugguggcgggguug

SEQ ID NO: 3172577 - RNA, 18 nt, Mycobacterium bovis subsp bovis AF2122/97
uggugggagaccugucgg

SEQ ID NO: 3172578 - RNA, 17 nt, Mycobacterium bovis subsp bovis AF2122/97
uggugggaucgcagcgc

SEQ ID NO: 3172579 - RNA, 16 nt, Mycobacterium bovis subsp bovis AF2122/97
uggugggccagcagca

SEQ ID NO: 3172580 - RNA, 20 nt, Mycobacterium bovis subsp bovis AF2122/97
uggugggcgcagagucaacg

SEQ ID NO: 3172581 - RNA, 20 nt, Mycobacterium bovis subsp bovis AF2122/97
uggugggggagcggccgccg

SEQ ID NO: 3172582 - RNA, 21 nt, Mycobacterium bovis subsp bovis AF2122/97
uggugggggagcggccgccgc

SEQ ID NO: 3172583 - RNA, 15 nt, Mycobacterium bovis subsp bovis AF2122/97
uggugggucgacgau

SEQ ID NO: 3172584 - RNA, 17 nt, Mycobacterium bovis subsp bovis AF2122/97
uggugggucggggcggc

SEQ ID NO: 3172585 - RNA, 17 nt, Mycobacterium bovis subsp bovis AF2122/97
ugguggguugaucgcgc

SEQ ID NO: 3172586 - RNA, 23 nt, Mycobacterium bovis subsp bovis AF2122/97
uggugguagccauucgguguggc

SEQ ID NO: 3172587 - RNA, 12 nt, Mycobacterium bovis subsp bovis AF2122/97
ugguggucagca

SEQ ID NO: 3172588 - RNA, 14 nt, Mycobacterium bovis subsp bovis AF2122/97
ugguggucgggcgc

SEQ ID NO: 3172589 - RNA, 15 nt, Mycobacterium bovis subsp bovis AF2122/97
ugguggucgggcgca

SEQ ID NO: 3172590 - RNA, 15 nt, Mycobacterium bovis subsp bovis AF2122/97
ugguggucugccaaa

SEQ ID NO: 3172591 - RNA, 14 nt, Mycobacterium bovis subsp bovis AF2122/97
ugguggugccaacc

SEQ ID NO: 3172592 - RNA, 18 nt, Mycobacterium bovis subsp bovis AF2122/97
ugguggugccaaccuggg

SEQ ID NO: 3172593 - RNA, 15 nt, Mycobacterium bovis subsp bovis AF2122/97
ugguggugccgaccu

SEQ ID NO: 3172594 - RNA, 23 nt, Mycobacterium bovis subsp bovis AF2122/97
ugguggugcguggaauggcgccg

SEQ ID NO: 3172595 - RNA, 21 nt, Mycobacterium bovis subsp bovis AF2122/97
uggugguuauucuucgguggu

SEQ ID NO: 3172596 - RNA, 21 nt, Mycobacterium bovis subsp bovis AF2122/97
uggugguugcguuccaguccc

SEQ ID NO: 3172597 - RNA, 17 nt, Mycobacterium bovis subsp bovis AF2122/97
ugguguacacacccgcc

SEQ ID NO: 3172598 - RNA, 16 nt, Mycobacterium bovis subsp bovis AF2122/97
ugguguacugcugcuu

SEQ ID NO: 3172599 - RNA, 19 nt, Mycobacterium bovis subsp bovis AF2122/97
uggugucaaugacaccggg

SEQ ID NO: 3172600 - RNA, 14 nt, Mycobacterium bovis subsp bovis AF2122/97
uggugucagccacc

SEQ ID NO: 3172601 - RNA, 13 nt, Mycobacterium bovis subsp bovis AF2122/97
ugguguccaccac

SEQ ID NO: 3172602 - RNA, 14 nt, Mycobacterium bovis subsp bovis AF2122/97
ugguguccaccacc

SEQ ID NO: 3172603 - RNA, 13 nt, Mycobacterium bovis subsp bovis AF2122/97
uggugucgcucag

SEQ ID NO: 3172604 - RNA, 15 nt, Mycobacterium bovis subsp bovis AF2122/97
uggugucgcucaguu

SEQ ID NO: 3172605 - RNA, 22 nt, Mycobacterium bovis subsp bovis AF2122/97
uggugucggaaugggcgccaca

SEQ ID NO: 3172606 - RNA, 12 nt, Mycobacterium bovis subsp bovis AF2122/97
uggugugcagca

SEQ ID NO: 3172607 - RNA, 18 nt, Mycobacterium bovis subsp bovis AF2122/97
ugguguuaaugaccgcgu

SEQ ID NO: 3172608 - RNA, 17 nt, Mycobacterium bovis subsp bovis AF2122/97
ugguuagaggaugguca

SEQ ID NO: 3172609 - RNA, 16 nt, Mycobacterium bovis subsp bovis AF2122/97
ugguucaacaccggua

SEQ ID NO: 3172610 - RNA, 14 nt, Mycobacterium bovis subsp bovis AF2122/97
ugguucaccucggc

SEQ ID NO: 3172611 - RNA, 16 nt, Mycobacterium bovis subsp bovis AF2122/97
ugguuccagaggcccg

SEQ ID NO: 3172612 - RNA, 19 nt, Mycobacterium bovis subsp bovis AF2122/97
ugguucccgacgucggccu

SEQ ID NO: 3172613 - RNA, 14 nt, Mycobacterium bovis subsp bovis AF2122/97
ugguuccggcgugc

SEQ ID NO: 3172614 - RNA, 17 nt, Mycobacterium bovis subsp bovis AF2122/97
ugguuccggcgugcagc

SEQ ID NO: 3172615 - RNA, 14 nt, Mycobacterium bovis subsp bovis AF2122/97
ugguucgcacaccu

SEQ ID NO: 3172616 - RNA, 23 nt, Mycobacterium bovis subsp bovis AF2122/97
ugguucggcgucgacccagaaca

SEQ ID NO: 3172617 - RNA, 14 nt, Mycobacterium bovis subsp bovis AF2122/97
ugguugaaccggua

SEQ ID NO: 3172618 - RNA, 13 nt, Mycobacterium bovis subsp bovis AF2122/97
ugguugaccucgg

SEQ ID NO: 3172619 - RNA, 21 nt, Mycobacterium bovis subsp bovis AF2122/97
ugguugacggcgaagucgagu

SEQ ID NO: 3172620 - RNA, 13 nt, Mycobacterium bovis subsp bovis AF2122/97
ugguugacgucga

SEQ ID NO: 3172621 - RNA, 23 nt, Mycobacterium bovis subsp bovis AF2122/97
ugguugaucagccagaccaacau

SEQ ID NO: 3172622 - RNA, 18 nt, Mycobacterium bovis subsp bovis AF2122/97
ugguugcgccaggaaccg

SEQ ID NO: 3172623 - RNA, 16 nt, Mycobacterium bovis subsp bovis AF2122/97
ugguugcggccgucga

SEQ ID NO: 3172624 - RNA, 13 nt, Mycobacterium bovis subsp bovis AF2122/97
ugguuggcgccga

SEQ ID NO: 3172625 - RNA, 19 nt, Mycobacterium bovis subsp bovis AF2122/97
ugguugggcgagaccgcga

SEQ ID NO: 3172626 - RNA, 15 nt, Mycobacterium bovis subsp bovis AF2122/97
ugguugugucggccu

SEQ ID NO: 3172627 - RNA, 19 nt, Mycobacterium bovis subsp bovis AF2122/97
ugguuguuggugccagccg

SEQ ID NO: 3172628 - RNA, 15 nt, Mycobacterium bovis subsp bovis AF2122/97
ugguuucacuacggg

SEQ ID NO: 3172629 - RNA, 15 nt, Mycobacterium bovis subsp bovis AF2122/97
ugguuucgcaccgug

SEQ ID NO: 3172630 - RNA, 16 nt, Mycobacterium bovis subsp bovis AF2122/97
uguaaccaucguuguu

SEQ ID NO: 3172631 - RNA, 21 nt, Mycobacterium bovis subsp bovis AF2122/97
uguaacccguuaccgauuggc

SEQ ID NO: 3172632 - RNA, 16 nt, Mycobacterium bovis subsp bovis AF2122/97
uguaaguuuucggccg

SEQ ID NO: 3172633 - RNA, 20 nt, Mycobacterium bovis subsp bovis AF2122/97
uguacaccgcgcccgccgau

SEQ ID NO: 3172634 - RNA, 16 nt, Mycobacterium bovis subsp bovis AF2122/97
uguacacuuugcccgc

SEQ ID NO: 3172635 - RNA, 21 nt, Mycobacterium bovis subsp bovis AF2122/97
uguacaggcuguccagcagcg

SEQ ID NO: 3172636 - RNA, 16 nt, Mycobacterium bovis subsp bovis AF2122/97
uguacauugccgaccc

SEQ ID NO: 3172637 - RNA, 15 nt, Mycobacterium bovis subsp bovis AF2122/97
uguaccccagcgcca

SEQ ID NO: 3172638 - RNA, 18 nt, Mycobacterium bovis subsp bovis AF2122/97
uguaccccagcgccacca

SEQ ID NO: 3172639 - RNA, 16 nt, Mycobacterium bovis subsp bovis AF2122/97
uguacccgaccagcac

SEQ ID NO: 3172640 - RNA, 14 nt, Mycobacterium bovis subsp bovis AF2122/97
uguccgcagcaccg

SEQ ID NO: 3172641 - RNA, 20 nt, Mycobacterium bovis subsp bovis AF2122/97
uguccgcagcaccgucgggc

SEQ ID NO: 3172642 - RNA, 17 nt, Mycobacterium bovis subsp bovis AF2122/97
uguccgcagcggugcgc

SEQ ID NO: 3172643 - RNA, 20 nt, Mycobacterium bovis subsp bovis AF2122/97
uguccgccaaguacugggcc

SEQ ID NO: 3172644 - RNA, 14 nt, Mycobacterium bovis subsp bovis AF2122/97
uguccgccgacgua

SEQ ID NO: 3172645 - RNA, 21 nt, Mycobacterium bovis subsp bovis AF2122/97
uguccgccgugugcucuugcg

SEQ ID NO: 3172646 - RNA, 13 nt, Mycobacterium bovis subsp bovis AF2122/97
uguccgcgacggc

SEQ ID NO: 3172647 - RNA, 14 nt, Mycobacterium bovis subsp bovis AF2122/97
uguccgcgacggcc

SEQ ID NO: 3172648 - RNA, 15 nt, Mycobacterium bovis subsp bovis AF2122/97
uguccgcucgccgcc

SEQ ID NO: 3172649 - RNA, 19 nt, Mycobacterium bovis subsp bovis AF2122/97
uguccgggcugcaugcggu

SEQ ID NO: 3172650 - RNA, 20 nt, Mycobacterium bovis subsp bovis AF2122/97
uguccggggaccucggcgau

SEQ ID NO: 3172651 - RNA, 17 nt, Mycobacterium bovis subsp bovis AF2122/97
uguccguccgcgacacc

SEQ ID NO: 3172652 - RNA, 20 nt, Mycobacterium bovis subsp bovis AF2122/97
uguccuaauucggggccgcg

SEQ ID NO: 3172653 - RNA, 15 nt, Mycobacterium bovis subsp bovis AF2122/97
uguccuacuuuucca

SEQ ID NO: 3172654 - RNA, 16 nt, Mycobacterium bovis subsp bovis AF2122/97
uguccuacuuuuccac

SEQ ID NO: 3172655 - RNA, 13 nt, Mycobacterium bovis subsp bovis AF2122/97
uguccucacaugc

SEQ ID NO: 3172656 - RNA, 18 nt, Mycobacterium bovis subsp bovis AF2122/97
uguccucgaccgucacgc

SEQ ID NO: 3172657 - RNA, 18 nt, Mycobacterium bovis subsp bovis AF2122/97
uguccucggcgaucacgc

SEQ ID NO: 3172658 - RNA, 23 nt, Mycobacterium bovis subsp bovis AF2122/97
uguccugccguauggcaucggcc

SEQ ID NO: 3172659 - RNA, 21 nt, Mycobacterium bovis subsp bovis AF2122/97
uguccugcggauagugguugc

SEQ ID NO: 3172660 - RNA, 14 nt, Mycobacterium bovis subsp bovis AF2122/97
uguccuuggccgcc

SEQ ID NO: 3172661 - RNA, 17 nt, Mycobacterium bovis subsp bovis AF2122/97
uguccuuugccaccucg

SEQ ID NO: 3172662 - RNA, 12 nt, Mycobacterium bovis subsp bovis AF2122/97
ugucgaacuggu

SEQ ID NO: 3172663 - RNA, 15 nt, Mycobacterium bovis subsp bovis AF2122/97
ugucgaagaaccggc

SEQ ID NO: 3172664 - RNA, 20 nt, Mycobacterium bovis subsp bovis AF2122/97
ugucgaagacguuggcgcgg

SEQ ID NO: 3172665 - RNA, 21 nt, Mycobacterium bovis subsp bovis AF2122/97
ugucgaagccccucaccucgg

SEQ ID NO: 3172666 - RNA, 12 nt, Mycobacterium bovis subsp bovis AF2122/97
ugucgacaucga

SEQ ID NO: 3172667 - RNA, 15 nt, Mycobacterium bovis subsp bovis AF2122/97
ugucgacggccaccc

SEQ ID NO: 3172668 - RNA, 16 nt, Mycobacterium bovis subsp bovis AF2122/97
ugucgacggccacccc

SEQ ID NO: 3172669 - RNA, 22 nt, Mycobacterium bovis subsp bovis AF2122/97
ugucgacggucggcggaaacaa

SEQ ID NO: 3172670 - RNA, 12 nt, Mycobacterium bovis subsp bovis AF2122/97
ugucgacggugu

SEQ ID NO: 3172671 - RNA, 16 nt, Mycobacterium bovis subsp bovis AF2122/97
ugucgagccggugccg

SEQ ID NO: 3172672 - RNA, 13 nt, Mycobacterium bovis subsp bovis AF2122/97
ugucgagcgcgau

SEQ ID NO: 3172673 - RNA, 16 nt, Mycobacterium bovis subsp bovis AF2122/97
ugucgaguugaauggc

SEQ ID NO: 3172674 - RNA, 19 nt, Mycobacterium bovis subsp bovis AF2122/97
ugucgauagcccgccaccc

SEQ ID NO: 3172675 - RNA, 13 nt, Mycobacterium bovis subsp bovis AF2122/97
ugucgaucaccug

SEQ ID NO: 3172676 - RNA, 13 nt, Mycobacterium bovis subsp bovis AF2122/97
ugucgaucagccg

SEQ ID NO: 3172677 - RNA, 14 nt, Mycobacterium bovis subsp bovis AF2122/97
ugucgaucagccgc

SEQ ID NO: 3172678 - RNA, 12 nt, Mycobacterium bovis subsp bovis AF2122/97
ugucgauccggc

SEQ ID NO: 3172679 - RNA, 16 nt, Mycobacterium bovis subsp bovis AF2122/97
ugucgaucucggccag

SEQ ID NO: 3172680 - RNA, 16 nt, Mycobacterium bovis subsp bovis AF2122/97
ugucgaugccgcgcag

SEQ ID NO: 3172681 - RNA, 19 nt, Mycobacterium bovis subsp bovis AF2122/97
ugucgaugccgcgcagcgc

SEQ ID NO: 3172682 - RNA, 15 nt, Mycobacterium bovis subsp bovis AF2122/97
ugucgaugcgcagcc

SEQ ID NO: 3172683 - RNA, 15 nt, Mycobacterium bovis subsp bovis AF2122/97
ugucgaugcgcgccg

SEQ ID NO: 3172684 - RNA, 22 nt, Mycobacterium bovis subsp bovis AF2122/97
ugucgauggggacggcggcgag

SEQ ID NO: 3172685 - RNA, 23 nt, Mycobacterium bovis subsp bovis AF2122/97
ugucgauggggacggcggcgagg

SEQ ID NO: 3172686 - RNA, 17 nt, Mycobacterium bovis subsp bovis AF2122/97
ugucgauguccacgccg

SEQ ID NO: 3172687 - RNA, 20 nt, Mycobacterium bovis subsp bovis AF2122/97
ugucgauuucgaugacgaac

SEQ ID NO: 3172688 - RNA, 22 nt, Mycobacterium bovis subsp bovis AF2122/97
ugucgccacaccggggcggccg

SEQ ID NO: 3172689 - RNA, 19 nt, Mycobacterium bovis subsp bovis AF2122/97
ugucgcccucgaucgccac

SEQ ID NO: 3172690 - RNA, 20 nt, Mycobacterium bovis subsp bovis AF2122/97
ugucgcccucgaucgccacg

SEQ ID NO: 3172691 - RNA, 20 nt, Mycobacterium bovis subsp bovis AF2122/97
ugucgccgaacgccaccacc

SEQ ID NO: 3172692 - RNA, 21 nt, Mycobacterium bovis subsp bovis AF2122/97
ugucgccgauaucggugaccg

SEQ ID NO: 3172693 - RNA, 17 nt, Mycobacterium bovis subsp bovis AF2122/97
ugucgccgaucaccgca

SEQ ID NO: 3172694 - RNA, 23 nt, Mycobacterium bovis subsp bovis AF2122/97
ugucgccgauguuggcagggcca

SEQ ID NO: 3172695 - RNA, 24 nt, Mycobacterium bovis subsp bovis AF2122/97
ugucgcgcauugccgacgcgcggc

SEQ ID NO: 3172696 - RNA, 19 nt, Mycobacterium bovis subsp bovis AF2122/97
ugucgcgccgguggucagg

SEQ ID NO: 3172697 - RNA, 14 nt, Mycobacterium bovis subsp bovis AF2122/97
ugucgcgcugcugu

SEQ ID NO: 3172698 - RNA, 18 nt, Mycobacterium bovis subsp bovis AF2122/97
ugucgcggucgcccgcua

SEQ ID NO: 3172699 - RNA, 13 nt, Mycobacterium bovis subsp bovis AF2122/97
ugucgcggugcgg

SEQ ID NO: 3172700 - RNA, 14 nt, Mycobacterium bovis subsp bovis AF2122/97
ugucgcgguggugg

SEQ ID NO: 3172701 - RNA, 17 nt, Mycobacterium bovis subsp bovis AF2122/97
ugucgcguucggccgac

SEQ ID NO: 3172702 - RNA, 17 nt, Mycobacterium bovis subsp bovis AF2122/97
ugucgcugccgccgccg

SEQ ID NO: 3172703 - RNA, 23 nt, Mycobacterium bovis subsp bovis AF2122/97
ugucgcugcggcgcuggccagca

SEQ ID NO: 3172704 - RNA, 20 nt, Mycobacterium bovis subsp bovis AF2122/97
ugucggauagccucggcggc

SEQ ID NO: 3172705 - RNA, 21 nt, Mycobacterium bovis subsp bovis AF2122/97
ugucggcagguaccaccgcgg

SEQ ID NO: 3172706 - RNA, 15 nt, Mycobacterium bovis subsp bovis AF2122/97
ugucggccacccgga

SEQ ID NO: 3172707 - RNA, 15 nt, Mycobacterium bovis subsp bovis AF2122/97
ugucggccaccggcg

SEQ ID NO: 3172708 - RNA, 17 nt, Mycobacterium bovis subsp bovis AF2122/97
ugucggccccggccgcg

SEQ ID NO: 3172709 - RNA, 11 nt, Mycobacterium bovis subsp bovis AF2122/97
ugucggccgcc

SEQ ID NO: 3172710 - RNA, 14 nt, Mycobacterium bovis subsp bovis AF2122/97
ugucggccggggcc

SEQ ID NO: 3172711 - RNA, 18 nt, Mycobacterium bovis subsp bovis AF2122/97
ugucggccggggccaccc

SEQ ID NO: 3172712 - RNA, 21 nt, Mycobacterium bovis subsp bovis AF2122/97
ugucggcgaaccacggcagcc

SEQ ID NO: 3172713 - RNA, 22 nt, Mycobacterium bovis subsp bovis AF2122/97
ugucggcgaccgagacggcguc

SEQ ID NO: 3172714 - RNA, 10 nt, Mycobacterium bovis subsp bovis AF2122/97
ugucggcgau

SEQ ID NO: 3172715 - RNA, 15 nt, Mycobacterium bovis subsp bovis AF2122/97
ugucggcgaucaacg

SEQ ID NO: 3172716 - RNA, 22 nt, Mycobacterium bovis subsp bovis AF2122/97
ugucggcgaucaacgcgcacgc

SEQ ID NO: 3172717 - RNA, 19 nt, Mycobacterium bovis subsp bovis AF2122/97
ugucggcgaugcguccgcc

SEQ ID NO: 3172718 - RNA, 20 nt, Mycobacterium bovis subsp bovis AF2122/97
ugucggcgaugucgaagccc

SEQ ID NO: 3172719 - RNA, 13 nt, Mycobacterium bovis subsp bovis AF2122/97
ugucggcgcaggc

SEQ ID NO: 3172720 - RNA, 12 nt, Mycobacterium bovis subsp bovis AF2122/97
ugucggcgcgcc

SEQ ID NO: 3172721 - RNA, 13 nt, Mycobacterium bovis subsp bovis AF2122/97
ugucggcgcgccg

SEQ ID NO: 3172722 - RNA, 20 nt, Mycobacterium bovis subsp bovis AF2122/97
ugucggcggugaaaucgcac

SEQ ID NO: 3172723 - RNA, 15 nt, Mycobacterium bovis subsp bovis AF2122/97
ugucggcuagcaacg

SEQ ID NO: 3172724 - RNA, 16 nt, Mycobacterium bovis subsp bovis AF2122/97
ugucgggaaggugacg

SEQ ID NO: 3172725 - RNA, 13 nt, Mycobacterium bovis subsp bovis AF2122/97
ugucgggaugaau

SEQ ID NO: 3172726 - RNA, 14 nt, Mycobacterium bovis subsp bovis AF2122/97
ugucgggccaggcg

SEQ ID NO: 3172727 - RNA, 16 nt, Mycobacterium bovis subsp bovis AF2122/97
ugugccggucgaugac

SEQ ID NO: 3172728 - RNA, 17 nt, Mycobacterium bovis subsp bovis AF2122/97
ugugccuacuugcucga

SEQ ID NO: 3172729 - RNA, 14 nt, Mycobacterium bovis subsp bovis AF2122/97
ugugccugcgucuc

SEQ ID NO: 3172730 - RNA, 16 nt, Mycobacterium bovis subsp bovis AF2122/97
ugugccugcgucucga

SEQ ID NO: 3172731 - RNA, 23 nt, Mycobacterium bovis subsp bovis AF2122/97
ugugcgaccacaucaugccagcc

SEQ ID NO: 3172732 - RNA, 16 nt, Mycobacterium bovis subsp bovis AF2122/97
ugugcgagcugcgggu

SEQ ID NO: 3172733 - RNA, 19 nt, Mycobacterium bovis subsp bovis AF2122/97
ugugcgagcugcgggucgc

SEQ ID NO: 3172734 - RNA, 12 nt, Mycobacterium bovis subsp bovis AF2122/97
ugugcgcggaca

SEQ ID NO: 3172735 - RNA, 21 nt, Mycobacterium bovis subsp bovis AF2122/97
ugugcggacaguucccggcca

SEQ ID NO: 3172736 - RNA, 13 nt, Mycobacterium bovis subsp bovis AF2122/97
ugugcggcagccc

SEQ ID NO: 3172737 - RNA, 18 nt, Mycobacterium bovis subsp bovis AF2122/97
ugugcggcauugguaccg

SEQ ID NO: 3172738 - RNA, 12 nt, Mycobacterium bovis subsp bovis AF2122/97
ugugcggccgac

SEQ ID NO: 3172739 - RNA, 17 nt, Mycobacterium bovis subsp bovis AF2122/97
ugugcgggguugggcgg

SEQ ID NO: 3172740 - RNA, 20 nt, Mycobacterium bovis subsp bovis AF2122/97
ugugcgucguucggagcccu

SEQ ID NO: 3172741 - RNA, 17 nt, Mycobacterium bovis subsp bovis AF2122/97
ugugcgucuccagcugg

SEQ ID NO: 3172742 - RNA, 14 nt, Mycobacterium bovis subsp bovis AF2122/97
ugugcucgauaucg

SEQ ID NO: 3172743 - RNA, 13 nt, Mycobacterium bovis subsp bovis AF2122/97
ugugcucggugac

SEQ ID NO: 3172744 - RNA, 14 nt, Mycobacterium bovis subsp bovis AF2122/97
ugugcugcacggcc

SEQ ID NO: 3172745 - RNA, 16 nt, Mycobacterium bovis subsp bovis AF2122/97
ugugcugccaccggcc

SEQ ID NO: 3172746 - RNA, 12 nt, Mycobacterium bovis subsp bovis AF2122/97
ugugcugccgca

SEQ ID NO: 3172747 - RNA, 18 nt, Mycobacterium bovis subsp bovis AF2122/97
ugugcuucgagcaccgac

SEQ ID NO: 3172748 - RNA, 15 nt, Mycobacterium bovis subsp bovis AF2122/97
uguggaacaccgcgg

SEQ ID NO: 3172749 - RNA, 16 nt, Mycobacterium bovis subsp bovis AF2122/97
uguggaacaccgcggc

SEQ ID NO: 3172750 - RNA, 18 nt, Mycobacterium bovis subsp bovis AF2122/97
uguggaaccacggcgcag

SEQ ID NO: 3172751 - RNA, 18 nt, Mycobacterium bovis subsp bovis AF2122/97
uguggaauggaccagcgc

SEQ ID NO: 3172752 - RNA, 14 nt, Mycobacterium bovis subsp bovis AF2122/97
uguggacacggcgc

SEQ ID NO: 3172753 - RNA, 22 nt, Mycobacterium bovis subsp bovis AF2122/97
uguggacgcccgaguugaagaa

SEQ ID NO: 3172754 - RNA, 19 nt, Mycobacterium bovis subsp bovis AF2122/97
uguggacggcauagcagcc

SEQ ID NO: 3172755 - RNA, 19 nt, Mycobacterium bovis subsp bovis AF2122/97
uguggagcucgcggcgcag

SEQ ID NO: 3172756 - RNA, 19 nt, Mycobacterium bovis subsp bovis AF2122/97
uguggaugccgacggcggg

SEQ ID NO: 3172757 - RNA, 15 nt, Mycobacterium bovis subsp bovis AF2122/97
uguggcacacccgca

SEQ ID NO: 3172758 - RNA, 24 nt, Mycobacterium bovis subsp bovis AF2122/97
uguggcccacauguccagcguccu

SEQ ID NO: 3172759 - RNA, 14 nt, Mycobacterium bovis subsp bovis AF2122/97
uguggcccgcggug

SEQ ID NO: 3172760 - RNA, 16 nt, Mycobacterium bovis subsp bovis AF2122/97
uguggccguuggccgg

SEQ ID NO: 3172761 - RNA, 11 nt, Mycobacterium bovis subsp bovis AF2122/97
uguggcgauga

SEQ ID NO: 3172762 - RNA, 13 nt, Mycobacterium bovis subsp bovis AF2122/97
uguggcgccgccg

SEQ ID NO: 3172763 - RNA, 21 nt, Mycobacterium bovis subsp bovis AF2122/97
uguggcgccgccggcaccgcc

SEQ ID NO: 3172764 - RNA, 15 nt, Mycobacterium bovis subsp bovis AF2122/97
uguggcgcuccggcg

SEQ ID NO: 3172765 - RNA, 14 nt, Mycobacterium bovis subsp bovis AF2122/97
uguggcguguggcu

SEQ ID NO: 3172766 - RNA, 18 nt, Mycobacterium bovis subsp bovis AF2122/97
uguggcugaacaccgcgg

SEQ ID NO: 3172767 - RNA, 18 nt, Mycobacterium bovis subsp bovis AF2122/97
uguggcugaucccggcca

SEQ ID NO: 3172768 - RNA, 20 nt, Mycobacterium bovis subsp bovis AF2122/97
ugugggccauguggacggca

SEQ ID NO: 3172769 - RNA, 21 nt, Mycobacterium bovis subsp bovis AF2122/97
ugugggccccgccgaugcgau

SEQ ID NO: 3172770 - RNA, 13 nt, Mycobacterium bovis subsp bovis AF2122/97
uguggggccgggc

SEQ ID NO: 3172771 - RNA, 13 nt, Mycobacterium bovis subsp bovis AF2122/97
uguggggcggcuu

SEQ ID NO: 3172772 - RNA, 21 nt, Mycobacterium bovis subsp bovis AF2122/97
ugugggugguugugucggccu

SEQ ID NO: 3172773 - RNA, 17 nt, Mycobacterium bovis subsp bovis AF2122/97
uguggucaacggccgac

SEQ ID NO: 3172774 - RNA, 14 nt, Mycobacterium bovis subsp bovis AF2122/97
uguggucaccaggc

SEQ ID NO: 3172775 - RNA, 14 nt, Mycobacterium bovis subsp bovis AF2122/97
uguggucccggcac

SEQ ID NO: 3172776 - RNA, 19 nt, Mycobacterium bovis subsp bovis AF2122/97
uguggucggugccagcacc

SEQ ID NO: 3172777 - RNA, 17 nt, Mycobacterium bovis subsp bovis AF2122/97
uguggucugccagcacc

SEQ ID NO: 3172778 - RNA, 18 nt, Mycobacterium bovis subsp bovis AF2122/97
uguggucuucaucgccgu

SEQ ID NO: 3172779 - RNA, 15 nt, Mycobacterium bovis subsp bovis AF2122/97
uguggugacagagcg

SEQ ID NO: 3172780 - RNA, 13 nt, Mycobacterium bovis subsp bovis AF2122/97
uguggugcggcgc

SEQ ID NO: 3172781 - RNA, 14 nt, Mycobacterium bovis subsp bovis AF2122/97
uguggugcggcgcg

SEQ ID NO: 3172782 - RNA, 13 nt, Mycobacterium bovis subsp bovis AF2122/97
ugugguggcgccg

SEQ ID NO: 3172783 - RNA, 15 nt, Mycobacterium bovis subsp bovis AF2122/97
ugugguggcgccggc

SEQ ID NO: 3172784 - RNA, 19 nt, Mycobacterium bovis subsp bovis AF2122/97
uguggugugccugcgucuc

SEQ ID NO: 3172785 - RNA, 18 nt, Mycobacterium bovis subsp bovis AF2122/97
ugugguuggugcuggccu

SEQ ID NO: 3172786 - RNA, 17 nt, Mycobacterium bovis subsp bovis AF2122/97
uguguauucgccgacgu

SEQ ID NO: 3172787 - RNA, 15 nt, Mycobacterium bovis subsp bovis AF2122/97
ugugucaacaggacc

SEQ ID NO: 3172788 - RNA, 23 nt, Mycobacterium bovis subsp bovis AF2122/97
ugugucgaccuucucgaugcuga

SEQ ID NO: 3172789 - RNA, 21 nt, Mycobacterium bovis subsp bovis AF2122/97
ugugucggcgagggcgcgccg

SEQ ID NO: 3172790 - RNA, 17 nt, Mycobacterium bovis subsp bovis AF2122/97
ugugucugcucgcgccg

SEQ ID NO: 3172791 - RNA, 12 nt, Mycobacterium bovis subsp bovis AF2122/97
ugugugcagcag

SEQ ID NO: 3172792 - RNA, 19 nt, Mycobacterium bovis subsp bovis AF2122/97
ugugugcgauccagggccg

SEQ ID NO: 3172793 - RNA, 23 nt, Mycobacterium bovis subsp bovis AF2122/97
ugugugcgccuccgggacggugg

SEQ ID NO: 3172794 - RNA, 13 nt, Mycobacterium bovis subsp bovis AF2122/97
uguguggcagccc

SEQ ID NO: 3172795 - RNA, 22 nt, Mycobacterium bovis subsp bovis AF2122/97
uguguucggagcugggcugaug

SEQ ID NO: 3172796 - RNA, 17 nt, Mycobacterium bovis subsp bovis AF2122/97
uguuaaccgggcacgga

SEQ ID NO: 3172797 - RNA, 16 nt, Mycobacterium bovis subsp bovis AF2122/97
uguuacuccgacggcc

SEQ ID NO: 3172798 - RNA, 20 nt, Mycobacterium bovis subsp bovis AF2122/97
uguuagccccgaagccggug

SEQ ID NO: 3172799 - RNA, 19 nt, Mycobacterium bovis subsp bovis AF2122/97
uguuaucgaagcccgaguu

SEQ ID NO: 3172800 - RNA, 18 nt, Mycobacterium bovis subsp bovis AF2122/97
uguucaacucgggcagcu

SEQ ID NO: 3172801 - RNA, 17 nt, Mycobacterium bovis subsp bovis AF2122/97
uguucaaucccuccgcc

SEQ ID NO: 3172802 - RNA, 20 nt, Mycobacterium bovis subsp bovis AF2122/97
uguucacccacuccgccgau

SEQ ID NO: 3172803 - RNA, 19 nt, Mycobacterium bovis subsp bovis AF2122/97
uguucaccucuuggugccg

SEQ ID NO: 3172804 - RNA, 19 nt, Mycobacterium bovis subsp bovis AF2122/97
uguucagcaacaacgucug

SEQ ID NO: 3172805 - RNA, 22 nt, Mycobacterium bovis subsp bovis AF2122/97
uguucagcuucgccagguggcc

SEQ ID NO: 3172806 - RNA, 20 nt, Mycobacterium bovis subsp bovis AF2122/97
uguucaucacgccgccggag

SEQ ID NO: 3172807 - RNA, 13 nt, Mycobacterium bovis subsp bovis AF2122/97
uguucaucaucug

SEQ ID NO: 3172808 - RNA, 15 nt, Mycobacterium bovis subsp bovis AF2122/97
uguuccaacacuggg

SEQ ID NO: 3172809 - RNA, 18 nt, Mycobacterium bovis subsp bovis AF2122/97
uguuccaacuccugcagc

SEQ ID NO: 3172810 - RNA, 22 nt, Mycobacterium bovis subsp bovis AF2122/97
uguuccaacuccugcagcccgg

SEQ ID NO: 3172811 - RNA, 15 nt, Mycobacterium bovis subsp bovis AF2122/97
uguuccacaccaggc

SEQ ID NO: 3172812 - RNA, 21 nt, Mycobacterium bovis subsp bovis AF2122/97
uguuccacaccaggccgagcc

SEQ ID NO: 3172813 - RNA, 14 nt, Mycobacterium bovis subsp bovis AF2122/97
uguuccacccggug

SEQ ID NO: 3172814 - RNA, 15 nt, Mycobacterium bovis subsp bovis AF2122/97
uuagcccgauggugc

SEQ ID NO: 3172815 - RNA, 15 nt, Mycobacterium bovis subsp bovis AF2122/97
uuagccgcagcuugg

SEQ ID NO: 3172816 - RNA, 14 nt, Mycobacterium bovis subsp bovis AF2122/97
uuagccggguuggc

SEQ ID NO: 3172817 - RNA, 20 nt, Mycobacterium bovis subsp bovis AF2122/97
uuagcgcaugggccuuguug

SEQ ID NO: 3172818 - RNA, 21 nt, Mycobacterium bovis subsp bovis AF2122/97
uuagcgcuugccgcugagccc

SEQ ID NO: 3172819 - RNA, 14 nt, Mycobacterium bovis subsp bovis AF2122/97
uuagcgguguggga

SEQ ID NO: 3172820 - RNA, 20 nt, Mycobacterium bovis subsp bovis AF2122/97
uuaggagcuuuugcgucuuc

SEQ ID NO: 3172821 - RNA, 20 nt, Mycobacterium bovis subsp bovis AF2122/97
uuaggcgauucugcgucugc

SEQ ID NO: 3172822 - RNA, 19 nt, Mycobacterium bovis subsp bovis AF2122/97
uuaggggcuuuugcgucug

SEQ ID NO: 3172823 - RNA, 17 nt, Mycobacterium bovis subsp bovis AF2122/97
uuaguuucguccccaga

SEQ ID NO: 3172824 - RNA, 15 nt, Mycobacterium bovis subsp bovis AF2122/97
uuauccggccaguga

SEQ ID NO: 3172825 - RNA, 14 nt, Mycobacterium bovis subsp bovis AF2122/97
uuaucgaagcccga

SEQ ID NO: 3172826 - RNA, 13 nt, Mycobacterium bovis subsp bovis AF2122/97
uucaacaccggca

SEQ ID NO: 3172827 - RNA, 15 nt, Mycobacterium bovis subsp bovis AF2122/97
uucaacaccggcauc

SEQ ID NO: 3172828 - RNA, 18 nt, Mycobacterium bovis subsp bovis AF2122/97
uucaacccgggcagcauc

SEQ ID NO: 3172829 - RNA, 15 nt, Mycobacterium bovis subsp bovis AF2122/97
uucaacuccggcacc

SEQ ID NO: 3172830 - RNA, 16 nt, Mycobacterium bovis subsp bovis AF2122/97
uucaacuuacgcgacg

SEQ ID NO: 3172831 - RNA, 22 nt, Mycobacterium bovis subsp bovis AF2122/97
uucaauaauggcaaccagcuuc

SEQ ID NO: 3172832 - RNA, 14 nt, Mycobacterium bovis subsp bovis AF2122/97
uucacagccaccag

SEQ ID NO: 3172833 - RNA, 14 nt, Mycobacterium bovis subsp bovis AF2122/97
uucacaugcgccga

SEQ ID NO: 3172834 - RNA, 17 nt, Mycobacterium bovis subsp bovis AF2122/97
uucaccacccuguuguu

SEQ ID NO: 3172835 - RNA, 15 nt, Mycobacterium bovis subsp bovis AF2122/97
uucaccaugucggcc

SEQ ID NO: 3172836 - RNA, 21 nt, Mycobacterium bovis subsp bovis AF2122/97
uucacccgggcugcuugcgcc

SEQ ID NO: 3172837 - RNA, 12 nt, Mycobacterium bovis subsp bovis AF2122/97
uucacccugcca

SEQ ID NO: 3172838 - RNA, 18 nt, Mycobacterium bovis subsp bovis AF2122/97
uucaccgcgauuagcaaa

SEQ ID NO: 3172839 - RNA, 19 nt, Mycobacterium bovis subsp bovis AF2122/97
uucaccgcgcugaaccaga

SEQ ID NO: 3172840 - RNA, 14 nt, Mycobacterium bovis subsp bovis AF2122/97
uucaccucggcgac

SEQ ID NO: 3172841 - RNA, 22 nt, Mycobacterium bovis subsp bovis AF2122/97
uucacgccgccccugcgcggcc

SEQ ID NO: 3172842 - RNA, 22 nt, Mycobacterium bovis subsp bovis AF2122/97
uucacuacgggucuggccaacg

SEQ ID NO: 3172843 - RNA, 13 nt, Mycobacterium bovis subsp bovis AF2122/97
uucacucacgacg

SEQ ID NO: 3172844 - RNA, 21 nt, Mycobacterium bovis subsp bovis AF2122/97
uucacucguugaccggccgga

SEQ ID NO: 3172845 - RNA, 18 nt, Mycobacterium bovis subsp bovis AF2122/97
uucacugugccgcugcau

SEQ ID NO: 3172846 - RNA, 21 nt, Mycobacterium bovis subsp bovis AF2122/97
uucagcacccaccgaagcgaa

SEQ ID NO: 3172847 - RNA, 13 nt, Mycobacterium bovis subsp bovis AF2122/97
uucagcgaagccg

SEQ ID NO: 3172848 - RNA, 19 nt, Mycobacterium bovis subsp bovis AF2122/97
uucagcgacggccgccagc

SEQ ID NO: 3172849 - RNA, 20 nt, Mycobacterium bovis subsp bovis AF2122/97
uucagcgcauuucggaucuc

SEQ ID NO: 3172850 - RNA, 10 nt, Mycobacterium bovis subsp bovis AF2122/97
uucagcgcca

SEQ ID NO: 3172851 - RNA, 14 nt, Mycobacterium bovis subsp bovis AF2122/97
uucagcgcggcacg

SEQ ID NO: 3172852 - RNA, 19 nt, Mycobacterium bovis subsp bovis AF2122/97
uucagcuaccuccgccacc

SEQ ID NO: 3172853 - RNA, 21 nt, Mycobacterium bovis subsp bovis AF2122/97
uucagcuaccuccgccaccaa

SEQ ID NO: 3172854 - RNA, 16 nt, Mycobacterium bovis subsp bovis AF2122/97
uucagcuauuccuaca

SEQ ID NO: 3172855 - RNA, 17 nt, Mycobacterium bovis subsp bovis AF2122/97
uucagcugcgccaggaa

SEQ ID NO: 3172856 - RNA, 15 nt, Mycobacterium bovis subsp bovis AF2122/97
uucaggaugccagga

SEQ ID NO: 3172857 - RNA, 21 nt, Mycobacterium bovis subsp bovis AF2122/97
uucagggcauugacgaugucg

SEQ ID NO: 3172858 - RNA, 13 nt, Mycobacterium bovis subsp bovis AF2122/97
uucagggcgucga

SEQ ID NO: 3172859 - RNA, 20 nt, Mycobacterium bovis subsp bovis AF2122/97
uucagggcgucgaacucauc

SEQ ID NO: 3172860 - RNA, 15 nt, Mycobacterium bovis subsp bovis AF2122/97
uucagggguggcgcg

SEQ ID NO: 3172861 - RNA, 19 nt, Mycobacterium bovis subsp bovis AF2122/97
uucagguccaccgcugccg

SEQ ID NO: 3172862 - RNA, 21 nt, Mycobacterium bovis subsp bovis AF2122/97
uucaggucggggucagaucca

SEQ ID NO: 3172863 - RNA, 16 nt, Mycobacterium bovis subsp bovis AF2122/97
uucaucacgccgccgg

SEQ ID NO: 3172864 - RNA, 13 nt, Mycobacterium bovis subsp bovis AF2122/97
uucauguggcgcg

SEQ ID NO: 3172865 - RNA, 17 nt, Mycobacterium bovis subsp bovis AF2122/97
uucauuccgaacaacau

SEQ ID NO: 3172866 - RNA, 19 nt, Mycobacterium bovis subsp bovis AF2122/97
uuccaaaaucaucugcaca

SEQ ID NO: 3172867 - RNA, 20 nt, Mycobacterium bovis subsp bovis AF2122/97
uuccaaagggaguguuuggg

SEQ ID NO: 3172868 - RNA, 21 nt, Mycobacterium bovis subsp bovis AF2122/97
uuccaaagggaguguuugggu

SEQ ID NO: 3172869 - RNA, 17 nt, Mycobacterium bovis subsp bovis AF2122/97
uuccaacccaaccgaga

SEQ ID NO: 3172870 - RNA, 22 nt, Mycobacterium bovis subsp bovis AF2122/97
uuccaacguauggcggucggcc

SEQ ID NO: 3172871 - RNA, 16 nt, Mycobacterium bovis subsp bovis AF2122/97
uuccaacucggcggcc

SEQ ID NO: 3172872 - RNA, 12 nt, Mycobacterium bovis subsp bovis AF2122/97
uuccacaggggc

SEQ ID NO: 3172873 - RNA, 20 nt, Mycobacterium bovis subsp bovis AF2122/97
uuccacaucaacuugccgcc

SEQ ID NO: 3172874 - RNA, 15 nt, Mycobacterium bovis subsp bovis AF2122/97
uuccaccguuagcca

SEQ ID NO: 3172875 - RNA, 18 nt, Mycobacterium bovis subsp bovis AF2122/97
uuccacgagucgucgucc

SEQ ID NO: 3172876 - RNA, 21 nt, Mycobacterium bovis subsp bovis AF2122/97
uuccacgaucggcucacgacu

SEQ ID NO: 3172877 - RNA, 23 nt, Mycobacterium bovis subsp bovis AF2122/97
uuccacuccccagccccacccgc

SEQ ID NO: 3172878 - RNA, 17 nt, Mycobacterium bovis subsp bovis AF2122/97
uuccagaaggccgcacc

SEQ ID NO: 3172879 - RNA, 22 nt, Mycobacterium bovis subsp bovis AF2122/97
uuccagaguucccgaaacccga

SEQ ID NO: 3172880 - RNA, 21 nt, Mycobacterium bovis subsp bovis AF2122/97
uuccagcaggccacugcguuc

SEQ ID NO: 3172881 - RNA, 21 nt, Mycobacterium bovis subsp bovis AF2122/97
uuccagcaucaguuugacgcc

SEQ ID NO: 3172882 - RNA, 15 nt, Mycobacterium bovis subsp bovis AF2122/97
uuccagccacagccc

SEQ ID NO: 3172883 - RNA, 16 nt, Mycobacterium bovis subsp bovis AF2122/97
uuccagcccgagcaga

SEQ ID NO: 3172884 - RNA, 23 nt, Mycobacterium bovis subsp bovis AF2122/97
uuccagccgacguaccagggugu

SEQ ID NO: 3172885 - RNA, 14 nt, Mycobacterium bovis subsp bovis AF2122/97
uuccagccggugcc

SEQ ID NO: 3172886 - RNA, 13 nt, Mycobacterium bovis subsp bovis AF2122/97
uuccagcggcacc

SEQ ID NO: 3172887 - RNA, 21 nt, Mycobacterium bovis subsp bovis AF2122/97
uuccaggagagaucgucgacc

SEQ ID NO: 3172888 - RNA, 19 nt, Mycobacterium bovis subsp bovis AF2122/97
uuccaucacggaccaggcc

SEQ ID NO: 3172889 - RNA, 15 nt, Mycobacterium bovis subsp bovis AF2122/97
uuccaucgcgaccuc

SEQ ID NO: 3172890 - RNA, 19 nt, Mycobacterium bovis subsp bovis AF2122/97
uuccauucgcgguccauca

SEQ ID NO: 3172891 - RNA, 12 nt, Mycobacterium bovis subsp bovis AF2122/97
uucccaccacca

SEQ ID NO: 3172892 - RNA, 17 nt, Mycobacterium bovis subsp bovis AF2122/97
uucccaccaccaccgcc

SEQ ID NO: 3172893 - RNA, 17 nt, Mycobacterium bovis subsp bovis AF2122/97
uucccaggaacgggacg

SEQ ID NO: 3172894 - RNA, 15 nt, Mycobacterium bovis subsp bovis AF2122/97
uucccaucggccugg

SEQ ID NO: 3172895 - RNA, 23 nt, Mycobacterium bovis subsp bovis AF2122/97
uucccaucggccuggugcucaac

SEQ ID NO: 3172896 - RNA, 17 nt, Mycobacterium bovis subsp bovis AF2122/97
uucccccggcaccgccg

SEQ ID NO: 3172897 - RNA, 21 nt, Mycobacterium bovis subsp bovis AF2122/97
uuccccgcccuugccgccagc

SEQ ID NO: 3172898 - RNA, 15 nt, Mycobacterium bovis subsp bovis AF2122/97
uuccccuguugcccc

SEQ ID NO: 3172899 - RNA, 18 nt, Mycobacterium bovis subsp bovis AF2122/97
uucccgaaccccgaccgc

SEQ ID NO: 3172900 - RNA, 14 nt, Mycobacterium bovis subsp bovis AF2122/97
uucccgacgucggc

SEQ ID NO: 3172901 - RNA, 13 nt, Mycobacterium bovis subsp bovis AF2122/97
uucgccgaagccg

SEQ ID NO: 3172902 - RNA, 20 nt, Mycobacterium bovis subsp bovis AF2122/97
uucgccgacuagcugggguc

SEQ ID NO: 3172903 - RNA, 16 nt, Mycobacterium bovis subsp bovis AF2122/97
uucgccgaguugaccg

SEQ ID NO: 3172904 - RNA, 18 nt, Mycobacterium bovis subsp bovis AF2122/97
uucgccgaguugaccgcc

SEQ ID NO: 3172905 - RNA, 17 nt, Mycobacterium bovis subsp bovis AF2122/97
uucgccgccaccggcga

SEQ ID NO: 3172906 - RNA, 22 nt, Mycobacterium bovis subsp bovis AF2122/97
uucgccgccaccggcgacgccg

SEQ ID NO: 3172907 - RNA, 13 nt, Mycobacterium bovis subsp bovis AF2122/97
uucgccgcccgca

SEQ ID NO: 3172908 - RNA, 16 nt, Mycobacterium bovis subsp bovis AF2122/97
uucgccgcgcagcgug

SEQ ID NO: 3172909 - RNA, 16 nt, Mycobacterium bovis subsp bovis AF2122/97
uucgccggaauacacc

SEQ ID NO: 3172910 - RNA, 16 nt, Mycobacterium bovis subsp bovis AF2122/97
uucgccggcaggguuc

SEQ ID NO: 3172911 - RNA, 18 nt, Mycobacterium bovis subsp bovis AF2122/97
uucgccgggcaacgcgaa

SEQ ID NO: 3172912 - RNA, 16 nt, Mycobacterium bovis subsp bovis AF2122/97
uucgccgucggcgacu

SEQ ID NO: 3172913 - RNA, 15 nt, Mycobacterium bovis subsp bovis AF2122/97
uucgccuggucaccg

SEQ ID NO: 3172914 - RNA, 15 nt, Mycobacterium bovis subsp bovis AF2122/97
uucgcgaagcugugc

SEQ ID NO: 3172915 - RNA, 18 nt, Mycobacterium bovis subsp bovis AF2122/97
uucgcgacaacucgcgaa

SEQ ID NO: 3172916 - RNA, 19 nt, Mycobacterium bovis subsp bovis AF2122/97
uucgcgacgucugccaggc

SEQ ID NO: 3172917 - RNA, 21 nt, Mycobacterium bovis subsp bovis AF2122/97
uucgcgauguccucgagcacc

SEQ ID NO: 3172918 - RNA, 14 nt, Mycobacterium bovis subsp bovis AF2122/97
uucgcgcacgucgg

SEQ ID NO: 3172919 - RNA, 21 nt, Mycobacterium bovis subsp bovis AF2122/97
uucgcgccgcgaggcaccgac

SEQ ID NO: 3172920 - RNA, 21 nt, Mycobacterium bovis subsp bovis AF2122/97
uucgcggauguccaggagugc

SEQ ID NO: 3172921 - RNA, 16 nt, Mycobacterium bovis subsp bovis AF2122/97
uucgcgggugcgcugc

SEQ ID NO: 3172922 - RNA, 19 nt, Mycobacterium bovis subsp bovis AF2122/97
uucgcgguuggcggcgaug

SEQ ID NO: 3172923 - RNA, 14 nt, Mycobacterium bovis subsp bovis AF2122/97
uucgcuaauacacc

SEQ ID NO: 3172924 - RNA, 15 nt, Mycobacterium bovis subsp bovis AF2122/97
uucgcuaccuucuug

SEQ ID NO: 3172925 - RNA, 14 nt, Mycobacterium bovis subsp bovis AF2122/97
uucgcucagggugu

SEQ ID NO: 3172926 - RNA, 13 nt, Mycobacterium bovis subsp bovis AF2122/97
uucgcucccccgc

SEQ ID NO: 3172927 - RNA, 22 nt, Mycobacterium bovis subsp bovis AF2122/97
uucgcugaccgcuaccagcugg

SEQ ID NO: 3172928 - RNA, 20 nt, Mycobacterium bovis subsp bovis AF2122/97
uucgcuggcuugggccagcg

SEQ ID NO: 3172929 - RNA, 22 nt, Mycobacterium bovis subsp bovis AF2122/97
uucgcugguauagcucacggug

SEQ ID NO: 3172930 - RNA, 15 nt, Mycobacterium bovis subsp bovis AF2122/97
uucggaaaaccgcac

SEQ ID NO: 3172931 - RNA, 20 nt, Mycobacterium bovis subsp bovis AF2122/97
uucggaaaaccgcaccgucc

SEQ ID NO: 3172932 - RNA, 13 nt, Mycobacterium bovis subsp bovis AF2122/97
uucggagaacacg

SEQ ID NO: 3172933 - RNA, 14 nt, Mycobacterium bovis subsp bovis AF2122/97
uucggaggugaccu

SEQ ID NO: 3172934 - RNA, 18 nt, Mycobacterium bovis subsp bovis AF2122/97
uucggaugucccuugacg

SEQ ID NO: 3172935 - RNA, 16 nt, Mycobacterium bovis subsp bovis AF2122/97
uucggcaccaccgcga

SEQ ID NO: 3172936 - RNA, 16 nt, Mycobacterium bovis subsp bovis AF2122/97
uucggcagccaugcgg

SEQ ID NO: 3172937 - RNA, 17 nt, Mycobacterium bovis subsp bovis AF2122/97
uucggcagcgcggcacc

SEQ ID NO: 3172938 - RNA, 17 nt, Mycobacterium bovis subsp bovis AF2122/97
uucggcagcucccgcca

SEQ ID NO: 3172939 - RNA, 17 nt, Mycobacterium bovis subsp bovis AF2122/97
uucggcaggaaugccgc

SEQ ID NO: 3172940 - RNA, 19 nt, Mycobacterium bovis subsp bovis AF2122/97
uucggcaggaaugccgcgg

SEQ ID NO: 3172941 - RNA, 18 nt, Mycobacterium bovis subsp bovis AF2122/97
uucggcauaacccuggcc

SEQ ID NO: 3172942 - RNA, 17 nt, Mycobacterium bovis subsp bovis AF2122/97
uucggccaacccgggcc

SEQ ID NO: 3172943 - RNA, 12 nt, Mycobacterium bovis subsp bovis AF2122/97
uucggccaccaa

SEQ ID NO: 3172944 - RNA, 13 nt, Mycobacterium bovis subsp bovis AF2122/97
uucggccaccaac

SEQ ID NO: 3172945 - RNA, 12 nt, Mycobacterium bovis subsp bovis AF2122/97
uucggccagcgc

SEQ ID NO: 3172946 - RNA, 14 nt, Mycobacterium bovis subsp bovis AF2122/97
uucggccagcgccc

SEQ ID NO: 3172947 - RNA, 17 nt, Mycobacterium bovis subsp bovis AF2122/97
uucggccagcgcccgca

SEQ ID NO: 3172948 - RNA, 22 nt, Mycobacterium bovis subsp bovis AF2122/97
uucggccagcgcccgcaggugg

SEQ ID NO: 3172949 - RNA, 14 nt, Mycobacterium bovis subsp bovis AF2122/97
uucggccagcgugu

SEQ ID NO: 3172950 - RNA, 18 nt, Mycobacterium bovis subsp bovis AF2122/97
uucggccauggcggcgcc

SEQ ID NO: 3172951 - RNA, 21 nt, Mycobacterium bovis subsp bovis AF2122/97
uucggccauguagccguugcc

SEQ ID NO: 3172952 - RNA, 17 nt, Mycobacterium bovis subsp bovis AF2122/97
uucggcccgaggugccg

SEQ ID NO: 3172953 - RNA, 22 nt, Mycobacterium bovis subsp bovis AF2122/97
uucggcccgaggugccggggcc

SEQ ID NO: 3172954 - RNA, 19 nt, Mycobacterium bovis subsp bovis AF2122/97
uucggccggagccgccggc

SEQ ID NO: 3172955 - RNA, 22 nt, Mycobacterium bovis subsp bovis AF2122/97
uucggcgaccggccggccgcgg

SEQ ID NO: 3172956 - RNA, 17 nt, Mycobacterium bovis subsp bovis AF2122/97
uucggcgagccgcgccc

SEQ ID NO: 3172957 - RNA, 19 nt, Mycobacterium bovis subsp bovis AF2122/97
uucggcgagccgcgcccaa

SEQ ID NO: 3172958 - RNA, 12 nt, Mycobacterium bovis subsp bovis AF2122/97
uucggcgagcgc

SEQ ID NO: 3172959 - RNA, 23 nt, Mycobacterium bovis subsp bovis AF2122/97
uucggcgcgacagccguggcgcg

SEQ ID NO: 3172960 - RNA, 19 nt, Mycobacterium bovis subsp bovis AF2122/97
uucggcgcugcggcgugcc

SEQ ID NO: 3172961 - RNA, 15 nt, Mycobacterium bovis subsp bovis AF2122/97
uucggcggccgccgc

SEQ ID NO: 3172962 - RNA, 14 nt, Mycobacterium bovis subsp bovis AF2122/97
uucggcggcugcca

SEQ ID NO: 3172963 - RNA, 15 nt, Mycobacterium bovis subsp bovis AF2122/97
uucggcggucgccgc

SEQ ID NO: 3172964 - RNA, 13 nt, Mycobacterium bovis subsp bovis AF2122/97
uucggcggucgcu

SEQ ID NO: 3172965 - RNA, 13 nt, Mycobacterium bovis subsp bovis AF2122/97
uucggcgucgucg

SEQ ID NO: 3172966 - RNA, 16 nt, Mycobacterium bovis subsp bovis AF2122/97
uucggcgucguugccg

SEQ ID NO: 3172967 - RNA, 20 nt, Mycobacterium bovis subsp bovis AF2122/97
uucggcugcgaaagccacuc

SEQ ID NO: 3172968 - RNA, 17 nt, Mycobacterium bovis subsp bovis AF2122/97
uucggcuggcgugcugc

SEQ ID NO: 3172969 - RNA, 21 nt, Mycobacterium bovis subsp bovis AF2122/97
uucgggccggagccggugccg

SEQ ID NO: 3172970 - RNA, 16 nt, Mycobacterium bovis subsp bovis AF2122/97
uucgggcgugaguggc

SEQ ID NO: 3172971 - RNA, 14 nt, Mycobacterium bovis subsp bovis AF2122/97
uucggggaccacgc

SEQ ID NO: 3172972 - RNA, 23 nt, Mycobacterium bovis subsp bovis AF2122/97
uucggggccccgcggcgccgcca

SEQ ID NO: 3172973 - RNA, 14 nt, Mycobacterium bovis subsp bovis AF2122/97
uucgggggccagcg

SEQ ID NO: 3172974 - RNA, 17 nt, Mycobacterium bovis subsp bovis AF2122/97
uucgggggcggucgcgu

SEQ ID NO: 3172975 - RNA, 15 nt, Mycobacterium bovis subsp bovis AF2122/97
uucggggugcgccca

SEQ ID NO: 3172976 - RNA, 15 nt, Mycobacterium bovis subsp bovis AF2122/97
uucggggugguggaa

SEQ ID NO: 3172977 - RNA, 18 nt, Mycobacterium bovis subsp bovis AF2122/97
uucgggucgaucaccgac

SEQ ID NO: 3172978 - RNA, 20 nt, Mycobacterium bovis subsp bovis AF2122/97
uucgguaggcaggccggcuc

SEQ ID NO: 3172979 - RNA, 17 nt, Mycobacterium bovis subsp bovis AF2122/97
uucgguagucgaugcug

SEQ ID NO: 3172980 - RNA, 22 nt, Mycobacterium bovis subsp bovis AF2122/97
uucggucagggugggcucguug

SEQ ID NO: 3172981 - RNA, 22 nt, Mycobacterium bovis subsp bovis AF2122/97
uucggucagugggacgggcgcg

SEQ ID NO: 3172982 - RNA, 12 nt, Mycobacterium bovis subsp bovis AF2122/97
uucggucggccu

SEQ ID NO: 3172983 - RNA, 19 nt, Mycobacterium bovis subsp bovis AF2122/97
uucggugagcaacgcgacc

SEQ ID NO: 3172984 - RNA, 14 nt, Mycobacterium bovis subsp bovis AF2122/97
uucggugccagcag

SEQ ID NO: 3172985 - RNA, 21 nt, Mycobacterium bovis subsp bovis AF2122/97
uucggugccgugaucggcgcc

SEQ ID NO: 3172986 - RNA, 13 nt, Mycobacterium bovis subsp bovis AF2122/97
uucggugucgccg

SEQ ID NO: 3172987 - RNA, 16 nt, Mycobacterium bovis subsp bovis AF2122/97
uucgguuagcgcggcc

SEQ ID NO: 3172988 - RNA, 11 nt, Mycobacterium bovis subsp bovis AF2122/97
uugacugaacu

SEQ ID NO: 3172989 - RNA, 19 nt, Mycobacterium bovis subsp bovis AF2122/97
uugacugaacucaacacca

SEQ ID NO: 3172990 - RNA, 15 nt, Mycobacterium bovis subsp bovis AF2122/97
uugacugcugggggu

SEQ ID NO: 3172991 - RNA, 21 nt, Mycobacterium bovis subsp bovis AF2122/97
uugagacgccggggaaccuug

SEQ ID NO: 3172992 - RNA, 23 nt, Mycobacterium bovis subsp bovis AF2122/97
uugagcaaaauggccaccggcgg

SEQ ID NO: 3172993 - RNA, 23 nt, Mycobacterium bovis subsp bovis AF2122/97
uugagcagcuugguggcguggcc

SEQ ID NO: 3172994 - RNA, 14 nt, Mycobacterium bovis subsp bovis AF2122/97
uugagcauaugacg

SEQ ID NO: 3172995 - RNA, 9 nt, Mycobacterium bovis subsp bovis AF2122/97
uugagcccg

SEQ ID NO: 3172996 - RNA, 12 nt, Mycobacterium bovis subsp bovis AF2122/97
uugagccgccgc

SEQ ID NO: 3172997 - RNA, 16 nt, Mycobacterium bovis subsp bovis AF2122/97
uugagcgcggccacca

SEQ ID NO: 3172998 - RNA, 18 nt, Mycobacterium bovis subsp bovis AF2122/97
uugagcgugagcgccgcg

SEQ ID NO: 3172999 - RNA, 17 nt, Mycobacterium bovis subsp bovis AF2122/97
uugagcucagguucagc

SEQ ID NO: 3173000 - RNA, 16 nt, Mycobacterium bovis subsp bovis AF2122/97
uugagcucgcugauca

SEQ ID NO: 3173001 - RNA, 14 nt, Mycobacterium bovis subsp bovis AF2122/97
uugaggccggugaa

SEQ ID NO: 3173002 - RNA, 22 nt, Mycobacterium bovis subsp bovis AF2122/97
uugaggccggugaacgguagca

SEQ ID NO: 3173003 - RNA, 22 nt, Mycobacterium bovis subsp bovis AF2122/97
uugaggccgucgaacgguagca

SEQ ID NO: 3173004 - RNA, 15 nt, Mycobacterium bovis subsp bovis AF2122/97
uugagguauucgaag

SEQ ID NO: 3173005 - RNA, 16 nt, Mycobacterium bovis subsp bovis AF2122/97
uugagucguuggacgg

SEQ ID NO: 3173006 - RNA, 16 nt, Mycobacterium bovis subsp bovis AF2122/97
uugaucaccguggugg

SEQ ID NO: 3173007 - RNA, 16 nt, Mycobacterium bovis subsp bovis AF2122/97
uugauccagugcugga

SEQ ID NO: 3173008 - RNA, 12 nt, Mycobacterium bovis subsp bovis AF2122/97
uugauccgcacc

SEQ ID NO: 3173009 - RNA, 21 nt, Mycobacterium bovis subsp bovis AF2122/97
uugaucgcccgguucagcgcu

SEQ ID NO: 3173010 - RNA, 18 nt, Mycobacterium bovis subsp bovis AF2122/97
uugaucuccacggcggug

SEQ ID NO: 3173011 - RNA, 19 nt, Mycobacterium bovis subsp bovis AF2122/97
uugaugaucugcagcucca

SEQ ID NO: 3173012 - RNA, 22 nt, Mycobacterium bovis subsp bovis AF2122/97
uugaugcauccagaaguaggcg

SEQ ID NO: 3173013 - RNA, 15 nt, Mycobacterium bovis subsp bovis AF2122/97
uugaugccgaugucg

SEQ ID NO: 3173014 - RNA, 16 nt, Mycobacterium bovis subsp bovis AF2122/97
uugaugcgugguuggc

SEQ ID NO: 3173015 - RNA, 15 nt, Mycobacterium bovis subsp bovis AF2122/97
uugaugcuucgaacc

SEQ ID NO: 3173016 - RNA, 21 nt, Mycobacterium bovis subsp bovis AF2122/97
uugauggcguauagcaugccg

SEQ ID NO: 3173017 - RNA, 19 nt, Mycobacterium bovis subsp bovis AF2122/97
uugaugggcagccgcccgc

SEQ ID NO: 3173018 - RNA, 23 nt, Mycobacterium bovis subsp bovis AF2122/97
uugaugggcagccgcccgcccac

SEQ ID NO: 3173019 - RNA, 23 nt, Mycobacterium bovis subsp bovis AF2122/97
uugauguagagcauucgggcgcc

SEQ ID NO: 3173020 - RNA, 21 nt, Mycobacterium bovis subsp bovis AF2122/97
uugauguugccggaguugaag

SEQ ID NO: 3173021 - RNA, 12 nt, Mycobacterium bovis subsp bovis AF2122/97
uugauugaccaa

SEQ ID NO: 3173022 - RNA, 18 nt, Mycobacterium bovis subsp bovis AF2122/97
uugcaacaccccgagccg

SEQ ID NO: 3173023 - RNA, 13 nt, Mycobacterium bovis subsp bovis AF2122/97
uugcacagcggca

SEQ ID NO: 3173024 - RNA, 13 nt, Mycobacterium bovis subsp bovis AF2122/97
uugcaccaggggc

SEQ ID NO: 3173025 - RNA, 21 nt, Mycobacterium bovis subsp bovis AF2122/97
uugcaccgagaaagugcaguu

SEQ ID NO: 3173026 - RNA, 13 nt, Mycobacterium bovis subsp bovis AF2122/97
uugcaccuucucc

SEQ ID NO: 3173027 - RNA, 23 nt, Mycobacterium bovis subsp bovis AF2122/97
uugcacucggcgcccuccuuggc

SEQ ID NO: 3173028 - RNA, 15 nt, Mycobacterium bovis subsp bovis AF2122/97
uugcacugcucguug

SEQ ID NO: 3173029 - RNA, 16 nt, Mycobacterium bovis subsp bovis AF2122/97
uugcacugcugguuga

SEQ ID NO: 3173030 - RNA, 17 nt, Mycobacterium bovis subsp bovis AF2122/97
uugcacuguggaagaac

SEQ ID NO: 3173031 - RNA, 18 nt, Mycobacterium bovis subsp bovis AF2122/97
uugcagaauccggucggc

SEQ ID NO: 3173032 - RNA, 21 nt, Mycobacterium bovis subsp bovis AF2122/97
uugcagcgggccacugagcca

SEQ ID NO: 3173033 - RNA, 16 nt, Mycobacterium bovis subsp bovis AF2122/97
uugcaggaaaucgucc

SEQ ID NO: 3173034 - RNA, 19 nt, Mycobacterium bovis subsp bovis AF2122/97
uugcaggcccgaguuguug

SEQ ID NO: 3173035 - RNA, 16 nt, Mycobacterium bovis subsp bovis AF2122/97
uugcaggcgcagcugg

SEQ ID NO: 3173036 - RNA, 24 nt, Mycobacterium bovis subsp bovis AF2122/97
uugcaguaacuucaccggcucguc

SEQ ID NO: 3173037 - RNA, 17 nt, Mycobacterium bovis subsp bovis AF2122/97
uugcagucgcgagguga

SEQ ID NO: 3173038 - RNA, 17 nt, Mycobacterium bovis subsp bovis AF2122/97
uugcagugccgccggcc

SEQ ID NO: 3173039 - RNA, 15 nt, Mycobacterium bovis subsp bovis AF2122/97
uugcaucagcacguc

SEQ ID NO: 3173040 - RNA, 13 nt, Mycobacterium bovis subsp bovis AF2122/97
uugccaaagccca

SEQ ID NO: 3173041 - RNA, 13 nt, Mycobacterium bovis subsp bovis AF2122/97
uugccaaagcccg

SEQ ID NO: 3173042 - RNA, 13 nt, Mycobacterium bovis subsp bovis AF2122/97
uugccaacgccca

SEQ ID NO: 3173043 - RNA, 12 nt, Mycobacterium bovis subsp bovis AF2122/97
uugccaccgccg

SEQ ID NO: 3173044 - RNA, 23 nt, Mycobacterium bovis subsp bovis AF2122/97
uugccaccgcuguucuuggugac

SEQ ID NO: 3173045 - RNA, 18 nt, Mycobacterium bovis subsp bovis AF2122/97
uugccaccggugccggcg

SEQ ID NO: 3173046 - RNA, 15 nt, Mycobacterium bovis subsp bovis AF2122/97
uugccacgccgccgg

SEQ ID NO: 3173047 - RNA, 14 nt, Mycobacterium bovis subsp bovis AF2122/97
uugccacggcgccu

SEQ ID NO: 3173048 - RNA, 14 nt, Mycobacterium bovis subsp bovis AF2122/97
uugccagaucagca

SEQ ID NO: 3173049 - RNA, 17 nt, Mycobacterium bovis subsp bovis AF2122/97
uugccaggaccgcgccg

SEQ ID NO: 3173050 - RNA, 14 nt, Mycobacterium bovis subsp bovis AF2122/97
uugcccaacaccca

SEQ ID NO: 3173051 - RNA, 15 nt, Mycobacterium bovis subsp bovis AF2122/97
uugcccacaaagauc

SEQ ID NO: 3173052 - RNA, 17 nt, Mycobacterium bovis subsp bovis AF2122/97
uugcccacaaagauccg

SEQ ID NO: 3173053 - RNA, 22 nt, Mycobacterium bovis subsp bovis AF2122/97
uugcccacggcgaccacgccgc

SEQ ID NO: 3173054 - RNA, 21 nt, Mycobacterium bovis subsp bovis AF2122/97
uugcccagcaugaagucccgg

SEQ ID NO: 3173055 - RNA, 13 nt, Mycobacterium bovis subsp bovis AF2122/97
uugcccauccccg

SEQ ID NO: 3173056 - RNA, 16 nt, Mycobacterium bovis subsp bovis AF2122/97
uugccccgccuuggcc

SEQ ID NO: 3173057 - RNA, 18 nt, Mycobacterium bovis subsp bovis AF2122/97
uugcccgacggcgucuuc

SEQ ID NO: 3173058 - RNA, 23 nt, Mycobacterium bovis subsp bovis AF2122/97
uugcccgguuguggaaccacggc

SEQ ID NO: 3173059 - RNA, 23 nt, Mycobacterium bovis subsp bovis AF2122/97
uugcccguguuaaagaagccuga

SEQ ID NO: 3173060 - RNA, 14 nt, Mycobacterium bovis subsp bovis AF2122/97
uugcccuagcagca

SEQ ID NO: 3173061 - RNA, 18 nt, Mycobacterium bovis subsp bovis AF2122/97
uugccgaacgucgcggcc

SEQ ID NO: 3173062 - RNA, 13 nt, Mycobacterium bovis subsp bovis AF2122/97
uugccgaagcccg

SEQ ID NO: 3173063 - RNA, 22 nt, Mycobacterium bovis subsp bovis AF2122/97
uugccgaaguuuuggaagcccg

SEQ ID NO: 3173064 - RNA, 16 nt, Mycobacterium bovis subsp bovis AF2122/97
uugccgacgcgcggcc

SEQ ID NO: 3173065 - RNA, 17 nt, Mycobacterium bovis subsp bovis AF2122/97
uugccgagcccaggugg

SEQ ID NO: 3173066 - RNA, 11 nt, Mycobacterium bovis subsp bovis AF2122/97
uugccgcccac

SEQ ID NO: 3173067 - RNA, 18 nt, Mycobacterium bovis subsp bovis AF2122/97
uugccgccgaacagcugg

SEQ ID NO: 3173068 - RNA, 20 nt, Mycobacterium bovis subsp bovis AF2122/97
uugccgccgaacgccucugc

SEQ ID NO: 3173069 - RNA, 15 nt, Mycobacterium bovis subsp bovis AF2122/97
uugccgccgacgccg

SEQ ID NO: 3173070 - RNA, 10 nt, Mycobacterium bovis subsp bovis AF2122/97
uugccgccgc

SEQ ID NO: 3173071 - RNA, 17 nt, Mycobacterium bovis subsp bovis AF2122/97
uugccgccgccuccgcc

SEQ ID NO: 3173072 - RNA, 23 nt, Mycobacterium bovis subsp bovis AF2122/97
uugccgccgccuccgccgaggcc

SEQ ID NO: 3173073 - RNA, 16 nt, Mycobacterium bovis subsp bovis AF2122/97
uugccgccgcggcgcc

SEQ ID NO: 3173074 - RNA, 19 nt, Mycobacterium bovis subsp bovis AF2122/97
uugccgccggccaugugca

SEQ ID NO: 3173075 - RNA, 20 nt, Mycobacterium bovis subsp bovis AF2122/97
uuggccaccaucgccgccgu

SEQ ID NO: 3173076 - RNA, 22 nt, Mycobacterium bovis subsp bovis AF2122/97
uuggccaccaucgccgccguug

SEQ ID NO: 3173077 - RNA, 13 nt, Mycobacterium bovis subsp bovis AF2122/97
uuggccaccgccc

SEQ ID NO: 3173078 - RNA, 13 nt, Mycobacterium bovis subsp bovis AF2122/97
uuggccagcagca

SEQ ID NO: 3173079 - RNA, 13 nt, Mycobacterium bovis subsp bovis AF2122/97
uuggccagcagcg

SEQ ID NO: 3173080 - RNA, 16 nt, Mycobacterium bovis subsp bovis AF2122/97
uuggccagcagcgcgg

SEQ ID NO: 3173081 - RNA, 17 nt, Mycobacterium bovis subsp bovis AF2122/97
uuggccagucccucgcc

SEQ ID NO: 3173082 - RNA, 20 nt, Mycobacterium bovis subsp bovis AF2122/97
uuggccagugacucaccgug

SEQ ID NO: 3173083 - RNA, 22 nt, Mycobacterium bovis subsp bovis AF2122/97
uuggccaugcuggucagcggcg

SEQ ID NO: 3173084 - RNA, 20 nt, Mycobacterium bovis subsp bovis AF2122/97
uuggccgacagccaccgcga

SEQ ID NO: 3173085 - RNA, 14 nt, Mycobacterium bovis subsp bovis AF2122/97
uuggccgcaaggcg

SEQ ID NO: 3173086 - RNA, 11 nt, Mycobacterium bovis subsp bovis AF2122/97
uuggccgccac

SEQ ID NO: 3173087 - RNA, 19 nt, Mycobacterium bovis subsp bovis AF2122/97
uuggccgccacucgcccgc

SEQ ID NO: 3173088 - RNA, 13 nt, Mycobacterium bovis subsp bovis AF2122/97
uuggccgcgaccg

SEQ ID NO: 3173089 - RNA, 16 nt, Mycobacterium bovis subsp bovis AF2122/97
uuggccggcgcugccc

SEQ ID NO: 3173090 - RNA, 15 nt, Mycobacterium bovis subsp bovis AF2122/97
uuggccgggcacgcg

SEQ ID NO: 3173091 - RNA, 19 nt, Mycobacterium bovis subsp bovis AF2122/97
uuggccggguuggccggcg

SEQ ID NO: 3173092 - RNA, 16 nt, Mycobacterium bovis subsp bovis AF2122/97
uuggccgucaucuccg

SEQ ID NO: 3173093 - RNA, 16 nt, Mycobacterium bovis subsp bovis AF2122/97
uuggccuguucaacuc

SEQ ID NO: 3173094 - RNA, 13 nt, Mycobacterium bovis subsp bovis AF2122/97
uuggcgacgaggc

SEQ ID NO: 3173095 - RNA, 15 nt, Mycobacterium bovis subsp bovis AF2122/97
uuggcgacgaugcag

SEQ ID NO: 3173096 - RNA, 18 nt, Mycobacterium bovis subsp bovis AF2122/97
uuggcgacgucggcggug

SEQ ID NO: 3173097 - RNA, 14 nt, Mycobacterium bovis subsp bovis AF2122/97
uuggcgacugucug

SEQ ID NO: 3173098 - RNA, 17 nt, Mycobacterium bovis subsp bovis AF2122/97
uuggcgccaaaaaggau

SEQ ID NO: 3173099 - RNA, 21 nt, Mycobacterium bovis subsp bovis AF2122/97
uuggcgccaccagucacgccc

SEQ ID NO: 3173100 - RNA, 12 nt, Mycobacterium bovis subsp bovis AF2122/97
uuggcgcccgcc

SEQ ID NO: 3173101 - RNA, 18 nt, Mycobacterium bovis subsp bovis AF2122/97
uuggcgccgccgaucccg

SEQ ID NO: 3173102 - RNA, 21 nt, Mycobacterium bovis subsp bovis AF2122/97
uuggcgccguuaccgccguug

SEQ ID NO: 3173103 - RNA, 13 nt, Mycobacterium bovis subsp bovis AF2122/97
uuggcgcgcccau

SEQ ID NO: 3173104 - RNA, 19 nt, Mycobacterium bovis subsp bovis AF2122/97
uuggcggaacuguagguca

SEQ ID NO: 3173105 - RNA, 21 nt, Mycobacterium bovis subsp bovis AF2122/97
uuggcggaugcccgcaacgcc

SEQ ID NO: 3173106 - RNA, 20 nt, Mycobacterium bovis subsp bovis AF2122/97
uuggcggcaggugcggcggc

SEQ ID NO: 3173107 - RNA, 15 nt, Mycobacterium bovis subsp bovis AF2122/97
uuggcggccagcgca

SEQ ID NO: 3173108 - RNA, 18 nt, Mycobacterium bovis subsp bovis AF2122/97
uuggcgggagcaccgacc

SEQ ID NO: 3173109 - RNA, 13 nt, Mycobacterium bovis subsp bovis AF2122/97
uuggcgggugcga

SEQ ID NO: 3173110 - RNA, 16 nt, Mycobacterium bovis subsp bovis AF2122/97
uuggcgucagcagcaa

SEQ ID NO: 3173111 - RNA, 17 nt, Mycobacterium bovis subsp bovis AF2122/97
uuggcgucgucggcggc

SEQ ID NO: 3173112 - RNA, 16 nt, Mycobacterium bovis subsp bovis AF2122/97
uuggcguugaccagca

SEQ ID NO: 3173113 - RNA, 15 nt, Mycobacterium bovis subsp bovis AF2122/97
uuggcuaacaccgca

SEQ ID NO: 3173114 - RNA, 18 nt, Mycobacterium bovis subsp bovis AF2122/97
uuggcucccuuuuccaaa

SEQ ID NO: 3173115 - RNA, 15 nt, Mycobacterium bovis subsp bovis AF2122/97
uuggcucgggccaga

SEQ ID NO: 3173116 - RNA, 20 nt, Mycobacterium bovis subsp bovis AF2122/97
uuggcugccggcaacagcuc

SEQ ID NO: 3173117 - RNA, 15 nt, Mycobacterium bovis subsp bovis AF2122/97
uuggcugggcccgcc

SEQ ID NO: 3173118 - RNA, 22 nt, Mycobacterium bovis subsp bovis AF2122/97
uugggccgacugggcgcgaccc

SEQ ID NO: 3173119 - RNA, 15 nt, Mycobacterium bovis subsp bovis AF2122/97
uugggccgccagcgg

SEQ ID NO: 3173120 - RNA, 17 nt, Mycobacterium bovis subsp bovis AF2122/97
uugggcgacgcggcgcc

SEQ ID NO: 3173121 - RNA, 20 nt, Mycobacterium bovis subsp bovis AF2122/97
uugggcgauucugcgucugc

SEQ ID NO: 3173122 - RNA, 19 nt, Mycobacterium bovis subsp bovis AF2122/97
uugggcgauuuugcgucug

SEQ ID NO: 3173123 - RNA, 20 nt, Mycobacterium bovis subsp bovis AF2122/97
uugggcgauuuugcgucugc

SEQ ID NO: 3173124 - RNA, 16 nt, Mycobacterium bovis subsp bovis AF2122/97
uugggcgcggcaggcc

SEQ ID NO: 3173125 - RNA, 21 nt, Mycobacterium bovis subsp bovis AF2122/97
uugggcgcgggugcgccggcg

SEQ ID NO: 3173126 - RNA, 13 nt, Mycobacterium bovis subsp bovis AF2122/97
uugggcguccuuc

SEQ ID NO: 3173127 - RNA, 18 nt, Mycobacterium bovis subsp bovis AF2122/97
uugggcuugcgccggaug

SEQ ID NO: 3173128 - RNA, 19 nt, Mycobacterium bovis subsp bovis AF2122/97
uugggggcuucugcgucug

SEQ ID NO: 3173129 - RNA, 21 nt, Mycobacterium bovis subsp bovis AF2122/97
uuggggugcuuucgcgucugc

SEQ ID NO: 3173130 - RNA, 19 nt, Mycobacterium bovis subsp bovis AF2122/97
uuggguagcaaaccccgga

SEQ ID NO: 3173131 - RNA, 17 nt, Mycobacterium bovis subsp bovis AF2122/97
uugggugccguugcguc

SEQ ID NO: 3173132 - RNA, 20 nt, Mycobacterium bovis subsp bovis AF2122/97
uugggugccguugcgucugc

SEQ ID NO: 3173133 - RNA, 18 nt, Mycobacterium bovis subsp bovis AF2122/97
uuggguuuuguuuggaga

SEQ ID NO: 3173134 - RNA, 16 nt, Mycobacterium bovis subsp bovis AF2122/97
uugguaguccugcuug

SEQ ID NO: 3173135 - RNA, 19 nt, Mycobacterium bovis subsp bovis AF2122/97
uugguaucugucgggauga

SEQ ID NO: 3173136 - RNA, 23 nt, Mycobacterium bovis subsp bovis AF2122/97
uuggucaccaccuggugcaaccg

SEQ ID NO: 3173137 - RNA, 20 nt, Mycobacterium bovis subsp bovis AF2122/97
uuggucaccugcugcaaccg

SEQ ID NO: 3173138 - RNA, 17 nt, Mycobacterium bovis subsp bovis AF2122/97
uuggucagugugaacug

SEQ ID NO: 3173139 - RNA, 18 nt, Mycobacterium bovis subsp bovis AF2122/97
uuggucgccgcuuucuug

SEQ ID NO: 3173140 - RNA, 13 nt, Mycobacterium bovis subsp bovis AF2122/97
uuggucgccggcg

SEQ ID NO: 3173141 - RNA, 16 nt, Mycobacterium bovis subsp bovis AF2122/97
uuggucgccggcgucg

SEQ ID NO: 3173142 - RNA, 14 nt, Mycobacterium bovis subsp bovis AF2122/97
uuggucggugcuga

SEQ ID NO: 3173143 - RNA, 16 nt, Mycobacterium bovis subsp bovis AF2122/97
uuggucuucgccgucg

SEQ ID NO: 3173144 - RNA, 22 nt, Mycobacterium bovis subsp bovis AF2122/97
uuggugaacaugugaccggcga

SEQ ID NO: 3173145 - RNA, 21 nt, Mycobacterium bovis subsp bovis AF2122/97
uuggugaccccguaggcgccg

SEQ ID NO: 3173146 - RNA, 16 nt, Mycobacterium bovis subsp bovis AF2122/97
uuggugaccgggucga

SEQ ID NO: 3173147 - RNA, 21 nt, Mycobacterium bovis subsp bovis AF2122/97
uuggugauugcggccgccgag

SEQ ID NO: 3173148 - RNA, 21 nt, Mycobacterium bovis subsp bovis AF2122/97
uuggugcccgacuugacggcg

SEQ ID NO: 3173149 - RNA, 22 nt, Mycobacterium bovis subsp bovis AF2122/97
uuggugccgccaccaccggcgc

SEQ ID NO: 3173150 - RNA, 22 nt, Mycobacterium bovis subsp bovis AF2122/97
uuggugcggaccugcgccggug

SEQ ID NO: 3173151 - RNA, 18 nt, Mycobacterium bovis subsp bovis AF2122/97
uuggugcucuugcgggga

SEQ ID NO: 3173152 - RNA, 11 nt, Mycobacterium bovis subsp bovis AF2122/97
uuggugcuggc

SEQ ID NO: 3173153 - RNA, 16 nt, Mycobacterium bovis subsp bovis AF2122/97
uugguggccgggucga

SEQ ID NO: 3173154 - RNA, 19 nt, Mycobacterium bovis subsp bovis AF2122/97
uugguggucgccacccgac

SEQ ID NO: 3173155 - RNA, 14 nt, Mycobacterium bovis subsp bovis AF2122/97
uuggugguguucau

SEQ ID NO: 3173156 - RNA, 17 nt, Mycobacterium bovis subsp bovis AF2122/97
uugguguggcccaaccg

SEQ ID NO: 3173157 - RNA, 18 nt, Mycobacterium bovis subsp bovis AF2122/97
uugguuagccgcggcccg

SEQ ID NO: 3173158 - RNA, 15 nt, Mycobacterium bovis subsp bovis AF2122/97
uugguucuccccgcu

SEQ ID NO: 3173159 - RNA, 17 nt, Mycobacterium bovis subsp bovis AF2122/97
uuguagacggcaccccc

SEQ ID NO: 3173160 - RNA, 20 nt, Mycobacterium bovis subsp bovis AF2122/97
uuguagcgguccagcgucgc

SEQ ID NO: 3173161 - RNA, 18 nt, Mycobacterium bovis subsp bovis AF2122/97
uuguaggacaagugccgg

SEQ ID NO: 3173162 - RNA, 21 nt, Mycobacterium bovis subsp bovis AF2122/97
uuuuccgccuguacggcggcu

SEQ ID NO: 3173163 - RNA, 22 nt, Mycobacterium bovis subsp bovis AF2122/97
uuuuccggcauugccgccguug

SEQ ID NO: 3173164 - RNA, 22 nt, Mycobacterium bovis subsp bovis AF2122/97
uuuucgagguacagcgggcacg

SEQ ID NO: 3173165 - RNA, 13 nt, Mycobacterium bovis subsp bovis AF2122/97
uuuugaaccgggu

SEQ ID NO: 3173166 - RNA, 20 nt, Mycobacterium bovis subsp bovis AF2122/97
uuuugcgucugcucgccggg

SEQ ID NO: 3173167 - RNA, 18 nt, Mycobacterium bovis subsp bovis AF2122/97
aaguccgagacgucggcg

SEQ ID NO: 3173168 - RNA, 21 nt, Mycobacterium bovis subsp bovis AF2122/97
aaguccgagucggcaaacaac

SEQ ID NO: 3173169 - RNA, 18 nt, Mycobacterium bovis subsp bovis AF2122/97
aaguccuccacggcggga

SEQ ID NO: 3173170 - RNA, 13 nt, Mycobacterium bovis subsp bovis AF2122/97
aagucgaugaugc

SEQ ID NO: 3173171 - RNA, 18 nt, Mycobacterium bovis subsp bovis AF2122/97
aagucgcagcgaggagcc

SEQ ID NO: 3173172 - RNA, 16 nt, Mycobacterium bovis subsp bovis AF2122/97
aagucggcaccggugc

SEQ ID NO: 3173173 - RNA, 14 nt, Mycobacterium bovis subsp bovis AF2122/97
aagucgggcacugu

SEQ ID NO: 3173174 - RNA, 20 nt, Mycobacterium bovis subsp bovis AF2122/97
aagucgucggccaucgaguc

SEQ ID NO: 3173175 - RNA, 13 nt, Mycobacterium bovis subsp bovis AF2122/97
aagucucccggcc

SEQ ID NO: 3173176 - RNA, 19 nt, Mycobacterium bovis subsp bovis AF2122/97
aagucucccggccgcaccc

SEQ ID NO: 3173177 - RNA, 21 nt, Mycobacterium bovis subsp bovis AF2122/97
aagucuggagugaggcugugc

SEQ ID NO: 3173178 - RNA, 21 nt, Mycobacterium bovis subsp bovis AF2122/97
aagucugugcucacggcggcg

SEQ ID NO: 3173179 - RNA, 23 nt, Mycobacterium bovis subsp bovis AF2122/97
aagugcacccgguugugcgcgcg

SEQ ID NO: 3173180 - RNA, 13 nt, Mycobacterium bovis subsp bovis AF2122/97
aagugcacugcga

SEQ ID NO: 3173181 - RNA, 19 nt, Mycobacterium bovis subsp bovis AF2122/97
aagugcacugcgaacccug

SEQ ID NO: 3173182 - RNA, 13 nt, Mycobacterium bovis subsp bovis AF2122/97
aagugccggcgcg

SEQ ID NO: 3173183 - RNA, 13 nt, Mycobacterium bovis subsp bovis AF2122/97
aagugccucgcgg

SEQ ID NO: 3173184 - RNA, 18 nt, Mycobacterium bovis subsp bovis AF2122/97
aagugccucgcgggaagu

SEQ ID NO: 3173185 - RNA, 21 nt, Mycobacterium bovis subsp bovis AF2122/97
aagugcggugagauggcggug

SEQ ID NO: 3173186 - RNA, 19 nt, Mycobacterium bovis subsp bovis AF2122/97
aagugcuuuggguccgggc

SEQ ID NO: 3173187 - RNA, 16 nt, Mycobacterium bovis subsp bovis AF2122/97
aaguggaucuggcgca

SEQ ID NO: 3173188 - RNA, 18 nt, Mycobacterium bovis subsp bovis AF2122/97
aaguggcgucagugcaga

SEQ ID NO: 3173189 - RNA, 18 nt, Mycobacterium bovis subsp bovis AF2122/97
aagugggcguuggcggca

SEQ ID NO: 3173190 - RNA, 14 nt, Mycobacterium bovis subsp bovis AF2122/97
aagugggugccggc

SEQ ID NO: 3173191 - RNA, 15 nt, Mycobacterium bovis subsp bovis AF2122/97
aaguggucuccggca

SEQ ID NO: 3173192 - RNA, 20 nt, Mycobacterium bovis subsp bovis AF2122/97
aaguggucuccggcaccgag

SEQ ID NO: 3173193 - RNA, 20 nt, Mycobacterium bovis subsp bovis AF2122/97
aaguggugcccuugaagaaa

SEQ ID NO: 3173194 - RNA, 16 nt, Mycobacterium bovis subsp bovis AF2122/97
aagugucuccggcaac

SEQ ID NO: 3173195 - RNA, 14 nt, Mycobacterium bovis subsp bovis AF2122/97
aaguucgccggucc

SEQ ID NO: 3173196 - RNA, 18 nt, Mycobacterium bovis subsp bovis AF2122/97
aaguucgugagcgaacgg

SEQ ID NO: 3173197 - RNA, 14 nt, Mycobacterium bovis subsp bovis AF2122/97
aaguugaagaagcc

SEQ ID NO: 3173198 - RNA, 15 nt, Mycobacterium bovis subsp bovis AF2122/97
aaguugaagaagcca

SEQ ID NO: 3173199 - RNA, 15 nt, Mycobacterium bovis subsp bovis AF2122/97
aaguugaugucgcgu

SEQ ID NO: 3173200 - RNA, 15 nt, Mycobacterium bovis subsp bovis AF2122/97
aaguuggccgcccga

SEQ ID NO: 3173201 - RNA, 17 nt, Mycobacterium bovis subsp bovis AF2122/97
aaguuggcugagcagcg

SEQ ID NO: 3173202 - RNA, 18 nt, Mycobacterium bovis subsp bovis AF2122/97
aaguuggcugagcagcgc

SEQ ID NO: 3173203 - RNA, 23 nt, Mycobacterium bovis subsp bovis AF2122/97
aaguuggcuugcgcgcaggugcu

SEQ ID NO: 3173204 - RNA, 13 nt, Mycobacterium bovis subsp bovis AF2122/97
aaguuggcuuucg

SEQ ID NO: 3173205 - RNA, 22 nt, Mycobacterium bovis subsp bovis AF2122/97
aaguugugcgcacucuuuccuu

SEQ ID NO: 3173206 - RNA, 15 nt, Mycobacterium bovis subsp bovis AF2122/97
aauaacgcgggaucc

SEQ ID NO: 3173207 - RNA, 15 nt, Mycobacterium bovis subsp bovis AF2122/97
aauacacauuuccaa

SEQ ID NO: 3173208 - RNA, 22 nt, Mycobacterium bovis subsp bovis AF2122/97
aauacacccaacucaugggcca

SEQ ID NO: 3173209 - RNA, 14 nt, Mycobacterium bovis subsp bovis AF2122/97
aauacaccugcugg

SEQ ID NO: 3173210 - RNA, 12 nt, Mycobacterium bovis subsp bovis AF2122/97
aauacaccuugu

SEQ ID NO: 3173211 - RNA, 17 nt, Mycobacterium bovis subsp bovis AF2122/97
aauacacuccugagaug

SEQ ID NO: 3173212 - RNA, 22 nt, Mycobacterium bovis subsp bovis AF2122/97
aauacagauauuugucggcgcc

SEQ ID NO: 3173213 - RNA, 13 nt, Mycobacterium bovis subsp bovis AF2122/97
aauacagcuugau

SEQ ID NO: 3173214 - RNA, 15 nt, Mycobacterium bovis subsp bovis AF2122/97
aauacccgcuggccc

SEQ ID NO: 3173215 - RNA, 16 nt, Mycobacterium bovis subsp bovis AF2122/97
aauaccgccagcgcca

SEQ ID NO: 3173216 - RNA, 23 nt, Mycobacterium bovis subsp bovis AF2122/97
aauaccgguggcagccugcugca

SEQ ID NO: 3173217 - RNA, 13 nt, Mycobacterium bovis subsp bovis AF2122/97
aauacggcggcgc

SEQ ID NO: 3173218 - RNA, 17 nt, Mycobacterium bovis subsp bovis AF2122/97
aauagcccaagccgauc

SEQ ID NO: 3173219 - RNA, 17 nt, Mycobacterium bovis subsp bovis AF2122/97
aauagcgacagcagcgc

SEQ ID NO: 3173220 - RNA, 19 nt, Mycobacterium bovis subsp bovis AF2122/97
aauagcuguuggccagccg

SEQ ID NO: 3173221 - RNA, 17 nt, Mycobacterium bovis subsp bovis AF2122/97
aauaggccgggcagugc

SEQ ID NO: 3173222 - RNA, 22 nt, Mycobacterium bovis subsp bovis AF2122/97
aauaggucgguccgcacugugc

SEQ ID NO: 3173223 - RNA, 16 nt, Mycobacterium bovis subsp bovis AF2122/97
aauaggugucgacgcg

SEQ ID NO: 3173224 - RNA, 19 nt, Mycobacterium bovis subsp bovis AF2122/97
aauaguccuugcgccagcg

SEQ ID NO: 3173225 - RNA, 14 nt, Mycobacterium bovis subsp bovis AF2122/97
aauagucggcaucg

SEQ ID NO: 3173226 - RNA, 18 nt, Mycobacterium bovis subsp bovis AF2122/97
aauaguugaccaggccga

SEQ ID NO: 3173227 - RNA, 16 nt, Mycobacterium bovis subsp bovis AF2122/97
aauaguuguugcagga

SEQ ID NO: 3173228 - RNA, 18 nt, Mycobacterium bovis subsp bovis AF2122/97
aauauaugcgcacucuag

SEQ ID NO: 3173229 - RNA, 19 nt, Mycobacterium bovis subsp bovis AF2122/97
aauauccugcgguugaguu

SEQ ID NO: 3173230 - RNA, 14 nt, Mycobacterium bovis subsp bovis AF2122/97
aauaucucgccgua

SEQ ID NO: 3173231 - RNA, 21 nt, Mycobacterium bovis subsp bovis AF2122/97
aauaugccacagaccgaacag

SEQ ID NO: 3173232 - RNA, 14 nt, Mycobacterium bovis subsp bovis AF2122/97
aauaugccgaugac

SEQ ID NO: 3173233 - RNA, 20 nt, Mycobacterium bovis subsp bovis AF2122/97
aauauugccgccuccggugc

SEQ ID NO: 3173234 - RNA, 13 nt, Mycobacterium bovis subsp bovis AF2122/97
aaucaagcagcgu

SEQ ID NO: 3173235 - RNA, 21 nt, Mycobacterium bovis subsp bovis AF2122/97
aaucaaggugaucagcaggau

SEQ ID NO: 3173236 - RNA, 12 nt, Mycobacterium bovis subsp bovis AF2122/97
aaucacaucgcc

SEQ ID NO: 3173237 - RNA, 13 nt, Mycobacterium bovis subsp bovis AF2122/97
aaucaccggcaau

SEQ ID NO: 3173238 - RNA, 14 nt, Mycobacterium bovis subsp bovis AF2122/97
aaucacggucaucu

SEQ ID NO: 3173239 - RNA, 15 nt, Mycobacterium bovis subsp bovis AF2122/97
aaucacggucaucuc

SEQ ID NO: 3173240 - RNA, 13 nt, Mycobacterium bovis subsp bovis AF2122/97
aaucagccaggcc

SEQ ID NO: 3173241 - RNA, 21 nt, Mycobacterium bovis subsp bovis AF2122/97
aaucagcccgcgcagcggucc

SEQ ID NO: 3173242 - RNA, 12 nt, Mycobacterium bovis subsp bovis AF2122/97
aaucaucucccg

SEQ ID NO: 3173243 - RNA, 23 nt, Mycobacterium bovis subsp bovis AF2122/97
aaucaucugcacauucagcgccg

SEQ ID NO: 3173244 - RNA, 19 nt, Mycobacterium bovis subsp bovis AF2122/97
aauccaaaccuuugauucu

SEQ ID NO: 3173245 - RNA, 19 nt, Mycobacterium bovis subsp bovis AF2122/97
aauccaaggcucagcagcg

SEQ ID NO: 3173246 - RNA, 13 nt, Mycobacterium bovis subsp bovis AF2122/97
aauccacaaugcc

SEQ ID NO: 3173247 - RNA, 18 nt, Mycobacterium bovis subsp bovis AF2122/97
aauccacagauugauuua

SEQ ID NO: 3173248 - RNA, 20 nt, Mycobacterium bovis subsp bovis AF2122/97
aauccacagauugauuuaac

SEQ ID NO: 3173249 - RNA, 23 nt, Mycobacterium bovis subsp bovis AF2122/97
aauccaccagccgguagccgggc

SEQ ID NO: 3173250 - RNA, 17 nt, Mycobacterium bovis subsp bovis AF2122/97
aauccacgcacucgucg

SEQ ID NO: 3173251 - RNA, 19 nt, Mycobacterium bovis subsp bovis AF2122/97
aauccacuccagcgaaccg

SEQ ID NO: 3173252 - RNA, 16 nt, Mycobacterium bovis subsp bovis AF2122/97
aauccagcgccgaccu

SEQ ID NO: 3173253 - RNA, 15 nt, Mycobacterium bovis subsp bovis AF2122/97
aaucccacgcccggc

SEQ ID NO: 3173254 - RNA, 23 nt, Mycobacterium bovis subsp bovis AF2122/97
aaugcuguggcccgucauacucg

SEQ ID NO: 3173255 - RNA, 22 nt, Mycobacterium bovis subsp bovis AF2122/97
aaugcuucgcgucgacccgaac

SEQ ID NO: 3173256 - RNA, 13 nt, Mycobacterium bovis subsp bovis AF2122/97
aauggaaugaucg

SEQ ID NO: 3173257 - RNA, 16 nt, Mycobacterium bovis subsp bovis AF2122/97
aauggacugaacacca

SEQ ID NO: 3173258 - RNA, 15 nt, Mycobacterium bovis subsp bovis AF2122/97
aauggcaacacaccg

SEQ ID NO: 3173259 - RNA, 15 nt, Mycobacterium bovis subsp bovis AF2122/97
aauggccgccgcagc

SEQ ID NO: 3173260 - RNA, 14 nt, Mycobacterium bovis subsp bovis AF2122/97
aauggccugcagcg

SEQ ID NO: 3173261 - RNA, 15 nt, Mycobacterium bovis subsp bovis AF2122/97
aauggcgccaccggc

SEQ ID NO: 3173262 - RNA, 13 nt, Mycobacterium bovis subsp bovis AF2122/97
aauggcgccggcc

SEQ ID NO: 3173263 - RNA, 17 nt, Mycobacterium bovis subsp bovis AF2122/97
aauggcgccggccggcg

SEQ ID NO: 3173264 - RNA, 21 nt, Mycobacterium bovis subsp bovis AF2122/97
aauggcgcugauggugcugcg

SEQ ID NO: 3173265 - RNA, 19 nt, Mycobacterium bovis subsp bovis AF2122/97
aauggcggacagggcggca

SEQ ID NO: 3173266 - RNA, 16 nt, Mycobacterium bovis subsp bovis AF2122/97
aaugggcgccacagcc

SEQ ID NO: 3173267 - RNA, 21 nt, Mycobacterium bovis subsp bovis AF2122/97
aaugggggcuggucgccguac

SEQ ID NO: 3173268 - RNA, 20 nt, Mycobacterium bovis subsp bovis AF2122/97
aauggucguucccgccggca

SEQ ID NO: 3173269 - RNA, 21 nt, Mycobacterium bovis subsp bovis AF2122/97
aauggucguucccgccggcac

SEQ ID NO: 3173270 - RNA, 15 nt, Mycobacterium bovis subsp bovis AF2122/97
aaugguggugucggc

SEQ ID NO: 3173271 - RNA, 23 nt, Mycobacterium bovis subsp bovis AF2122/97
aaugguucgcacaccuccucgac

SEQ ID NO: 3173272 - RNA, 16 nt, Mycobacterium bovis subsp bovis AF2122/97
aauguauugcggugag

SEQ ID NO: 3173273 - RNA, 20 nt, Mycobacterium bovis subsp bovis AF2122/97
aaugucagugccccgcccgg

SEQ ID NO: 3173274 - RNA, 16 nt, Mycobacterium bovis subsp bovis AF2122/97
aaugucgacaccggcg

SEQ ID NO: 3173275 - RNA, 16 nt, Mycobacterium bovis subsp bovis AF2122/97
aaugucgccgccuggc

SEQ ID NO: 3173276 - RNA, 16 nt, Mycobacterium bovis subsp bovis AF2122/97
aaugucgcucaaaccc

SEQ ID NO: 3173277 - RNA, 14 nt, Mycobacterium bovis subsp bovis AF2122/97
aaugucggcagggc

SEQ ID NO: 3173278 - RNA, 17 nt, Mycobacterium bovis subsp bovis AF2122/97
aaugucuucgccgucac

SEQ ID NO: 3173279 - RNA, 19 nt, Mycobacterium bovis subsp bovis AF2122/97
aaugucuuuggucgccgga

SEQ ID NO: 3173280 - RNA, 18 nt, Mycobacterium bovis subsp bovis AF2122/97
aauguugccgccgcggcg

SEQ ID NO: 3173281 - RNA, 14 nt, Mycobacterium bovis subsp bovis AF2122/97
aauuaggucgacca

SEQ ID NO: 3173282 - RNA, 16 nt, Mycobacterium bovis subsp bovis AF2122/97
aauucaacagcaccgc

SEQ ID NO: 3173283 - RNA, 18 nt, Mycobacterium bovis subsp bovis AF2122/97
aauucaacagcaccgcga

SEQ ID NO: 3173284 - RNA, 23 nt, Mycobacterium bovis subsp bovis AF2122/97
aauucauccauuucauucagugc

SEQ ID NO: 3173285 - RNA, 23 nt, Mycobacterium bovis subsp bovis AF2122/97
aauucaugccgguguugccgaag

SEQ ID NO: 3173286 - RNA, 23 nt, Mycobacterium bovis subsp bovis AF2122/97
aauuccacaaauccaaaccuuug

SEQ ID NO: 3173287 - RNA, 14 nt, Mycobacterium bovis subsp bovis AF2122/97
aauuccagccagcc

SEQ ID NO: 3173288 - RNA, 16 nt, Mycobacterium bovis subsp bovis AF2122/97
aauuccgccugcuccu

SEQ ID NO: 3173289 - RNA, 11 nt, Mycobacterium bovis subsp bovis AF2122/97
aauuccgcgag

SEQ ID NO: 3173290 - RNA, 22 nt, Mycobacterium bovis subsp bovis AF2122/97
aauuccggugaucgcgguggcg

SEQ ID NO: 3173291 - RNA, 21 nt, Mycobacterium bovis subsp bovis AF2122/97
aauucgaccgcgcggaucuca

SEQ ID NO: 3173292 - RNA, 22 nt, Mycobacterium bovis subsp bovis AF2122/97
aauucgacuucggggucaccgg

SEQ ID NO: 3173293 - RNA, 20 nt, Mycobacterium bovis subsp bovis AF2122/97
aauucggcacgaaauugggc

SEQ ID NO: 3173294 - RNA, 14 nt, Mycobacterium bovis subsp bovis AF2122/97
aauucggcgagcgc

SEQ ID NO: 3173295 - RNA, 21 nt, Mycobacterium bovis subsp bovis AF2122/97
aauucggugcgcuggcggcgc

SEQ ID NO: 3173296 - RNA, 21 nt, Mycobacterium bovis subsp bovis AF2122/97
aauugagccggcccugcucgc

SEQ ID NO: 3173297 - RNA, 22 nt, Mycobacterium bovis subsp bovis AF2122/97
aauugaguagaucccaccaccg

SEQ ID NO: 3173298 - RNA, 19 nt, Mycobacterium bovis subsp bovis AF2122/97
aauugccaagcgcgcgaac

SEQ ID NO: 3173299 - RNA, 23 nt, Mycobacterium bovis subsp bovis AF2122/97
aauugcccaagcgcguuguuguc

SEQ ID NO: 3173300 - RNA, 15 nt, Mycobacterium bovis subsp bovis AF2122/97
aauugcgccgccaac

SEQ ID NO: 3173301 - RNA, 15 nt, Mycobacterium bovis subsp bovis AF2122/97
aauugcggccgcgcg

SEQ ID NO: 3173302 - RNA, 22 nt, Mycobacterium bovis subsp bovis AF2122/97
aauugcguucgccgcccggcgu

SEQ ID NO: 3173303 - RNA, 21 nt, Mycobacterium bovis subsp bovis AF2122/97
aauuggcgucgucggcggcga

SEQ ID NO: 3173304 - RNA, 21 nt, Mycobacterium bovis subsp bovis AF2122/97
aauugggcgaugcggcgucga

SEQ ID NO: 3173305 - RNA, 18 nt, Mycobacterium bovis subsp bovis AF2122/97
aauugugugcagcagcau

SEQ ID NO: 3173306 - RNA, 20 nt, Mycobacterium bovis subsp bovis AF2122/97
aauuucgauuucccaugcaa

SEQ ID NO: 3173307 - RNA, 18 nt, Mycobacterium bovis subsp bovis AF2122/97
aauuucguuggauccaca

SEQ ID NO: 3173308 - RNA, 16 nt, Mycobacterium bovis subsp bovis AF2122/97
acaaacaccccacaca

SEQ ID NO: 3173309 - RNA, 13 nt, Mycobacterium bovis subsp bovis AF2122/97
acaaacaucgcac

SEQ ID NO: 3173310 - RNA, 16 nt, Mycobacterium bovis subsp bovis AF2122/97
acaaacaucgcaccca

SEQ ID NO: 3173311 - RNA, 15 nt, Mycobacterium bovis subsp bovis AF2122/97
acaaacccaacacca

SEQ ID NO: 3173312 - RNA, 15 nt, Mycobacterium bovis subsp bovis AF2122/97
acaaacccgaugacu

SEQ ID NO: 3173313 - RNA, 22 nt, Mycobacterium bovis subsp bovis AF2122/97
acaaaccgucggggaugccgaa

SEQ ID NO: 3173314 - RNA, 23 nt, Mycobacterium bovis subsp bovis AF2122/97
acaaaccgugcacgucagcggau

SEQ ID NO: 3173315 - RNA, 15 nt, Mycobacterium bovis subsp bovis AF2122/97
acaaacggcgaccca

SEQ ID NO: 3173316 - RNA, 17 nt, Mycobacterium bovis subsp bovis AF2122/97
acaaacggcgacccagc

SEQ ID NO: 3173317 - RNA, 21 nt, Mycobacterium bovis subsp bovis AF2122/97
acaaacugggaugugccgcgc

SEQ ID NO: 3173318 - RNA, 20 nt, Mycobacterium bovis subsp bovis AF2122/97
acaaagacgccgucggcgcc

SEQ ID NO: 3173319 - RNA, 11 nt, Mycobacterium bovis subsp bovis AF2122/97
acaaagccacg

SEQ ID NO: 3173320 - RNA, 16 nt, Mycobacterium bovis subsp bovis AF2122/97
acaaagccgucgacgc

SEQ ID NO: 3173321 - RNA, 14 nt, Mycobacterium bovis subsp bovis AF2122/97
acaaagcugcucgu

SEQ ID NO: 3173322 - RNA, 21 nt, Mycobacterium bovis subsp bovis AF2122/97
acaaagcugcucgucggcgcc

SEQ ID NO: 3173323 - RNA, 21 nt, Mycobacterium bovis subsp bovis AF2122/97
acaaagguaccgcuggaaaau

SEQ ID NO: 3173324 - RNA, 14 nt, Mycobacterium bovis subsp bovis AF2122/97
acaaaggugccgac

SEQ ID NO: 3173325 - RNA, 21 nt, Mycobacterium bovis subsp bovis AF2122/97
acaaaguucgacgagaagaca

SEQ ID NO: 3173326 - RNA, 22 nt, Mycobacterium bovis subsp bovis AF2122/97
acaacaccacggugccgacgau

SEQ ID NO: 3173327 - RNA, 14 nt, Mycobacterium bovis subsp bovis AF2122/97
acaacacgccgucg

SEQ ID NO: 3173328 - RNA, 15 nt, Mycobacterium bovis subsp bovis AF2122/97
acaacagccgcucgc

SEQ ID NO: 3173329 - RNA, 21 nt, Mycobacterium bovis subsp bovis AF2122/97
acaacagccgcucgcacagcc

SEQ ID NO: 3173330 - RNA, 12 nt, Mycobacterium bovis subsp bovis AF2122/97
acaacagcuugg

SEQ ID NO: 3173331 - RNA, 15 nt, Mycobacterium bovis subsp bovis AF2122/97
acaacaggccgucga

SEQ ID NO: 3173332 - RNA, 14 nt, Mycobacterium bovis subsp bovis AF2122/97
acaacaucacugcc

SEQ ID NO: 3173333 - RNA, 13 nt, Mycobacterium bovis subsp bovis AF2122/97
acaacaucgaauc

SEQ ID NO: 3173334 - RNA, 13 nt, Mycobacterium bovis subsp bovis AF2122/97
acaaccacccacc

SEQ ID NO: 3173335 - RNA, 15 nt, Mycobacterium bovis subsp bovis AF2122/97
acaaccacccacccg

SEQ ID NO: 3173336 - RNA, 16 nt, Mycobacterium bovis subsp bovis AF2122/97
acaacccaacaaaagg

SEQ ID NO: 3173337 - RNA, 18 nt, Mycobacterium bovis subsp bovis AF2122/97
acaaccccgaggcaacaa

SEQ ID NO: 3173338 - RNA, 14 nt, Mycobacterium bovis subsp bovis AF2122/97
acaaccccgccagg

SEQ ID NO: 3173339 - RNA, 15 nt, Mycobacterium bovis subsp bovis AF2122/97
acaacccggccgggc

SEQ ID NO: 3173340 - RNA, 17 nt, Mycobacterium bovis subsp bovis AF2122/97
acaccacggaccagcgc

SEQ ID NO: 3173341 - RNA, 18 nt, Mycobacterium bovis subsp bovis AF2122/97
acaccacggugccgacga

SEQ ID NO: 3173342 - RNA, 16 nt, Mycobacterium bovis subsp bovis AF2122/97
acaccacgguuggcca

SEQ ID NO: 3173343 - RNA, 20 nt, Mycobacterium bovis subsp bovis AF2122/97
acaccacgguuggccaccag

SEQ ID NO: 3173344 - RNA, 15 nt, Mycobacterium bovis subsp bovis AF2122/97
acaccagacacuggc

SEQ ID NO: 3173345 - RNA, 17 nt, Mycobacterium bovis subsp bovis AF2122/97
acaccagacacuggccg

SEQ ID NO: 3173346 - RNA, 21 nt, Mycobacterium bovis subsp bovis AF2122/97
acaccagaucguuccaggccg

SEQ ID NO: 3173347 - RNA, 18 nt, Mycobacterium bovis subsp bovis AF2122/97
acaccagaugcaccucgc

SEQ ID NO: 3173348 - RNA, 13 nt, Mycobacterium bovis subsp bovis AF2122/97
acaccagcagcac

SEQ ID NO: 3173349 - RNA, 22 nt, Mycobacterium bovis subsp bovis AF2122/97
acaccagccggucgucgcgcag

SEQ ID NO: 3173350 - RNA, 14 nt, Mycobacterium bovis subsp bovis AF2122/97
acaccagcgaggcc

SEQ ID NO: 3173351 - RNA, 19 nt, Mycobacterium bovis subsp bovis AF2122/97
acaccagcgaggccagcgg

SEQ ID NO: 3173352 - RNA, 14 nt, Mycobacterium bovis subsp bovis AF2122/97
acaccagcgcgccg

SEQ ID NO: 3173353 - RNA, 12 nt, Mycobacterium bovis subsp bovis AF2122/97
acaccagcgcgu

SEQ ID NO: 3173354 - RNA, 12 nt, Mycobacterium bovis subsp bovis AF2122/97
acaccagcucga

SEQ ID NO: 3173355 - RNA, 14 nt, Mycobacterium bovis subsp bovis AF2122/97
acaccaggaugccu

SEQ ID NO: 3173356 - RNA, 18 nt, Mycobacterium bovis subsp bovis AF2122/97
acaccagggugccgggca

SEQ ID NO: 3173357 - RNA, 17 nt, Mycobacterium bovis subsp bovis AF2122/97
acaccauaggccgacgg

SEQ ID NO: 3173358 - RNA, 22 nt, Mycobacterium bovis subsp bovis AF2122/97
acaccaucaaggacucggacgc

SEQ ID NO: 3173359 - RNA, 19 nt, Mycobacterium bovis subsp bovis AF2122/97
acaccaugaucaggcccca

SEQ ID NO: 3173360 - RNA, 21 nt, Mycobacterium bovis subsp bovis AF2122/97
acaccaugaucaggccccaca

SEQ ID NO: 3173361 - RNA, 21 nt, Mycobacterium bovis subsp bovis AF2122/97
acaccaugguggugaugccau

SEQ ID NO: 3173362 - RNA, 18 nt, Mycobacterium bovis subsp bovis AF2122/97
acacccaaaccggcccgc

SEQ ID NO: 3173363 - RNA, 19 nt, Mycobacterium bovis subsp bovis AF2122/97
acacccaaaccggcccgca

SEQ ID NO: 3173364 - RNA, 14 nt, Mycobacterium bovis subsp bovis AF2122/97
acacccacgucgag

SEQ ID NO: 3173365 - RNA, 23 nt, Mycobacterium bovis subsp bovis AF2122/97
acacccacgugcugccuuugcga

SEQ ID NO: 3173366 - RNA, 22 nt, Mycobacterium bovis subsp bovis AF2122/97
acacccagcgugcccgccaccg

SEQ ID NO: 3173367 - RNA, 17 nt, Mycobacterium bovis subsp bovis AF2122/97
acacccaucgaccgccc

SEQ ID NO: 3173368 - RNA, 20 nt, Mycobacterium bovis subsp bovis AF2122/97
acacccaucgaccgcccgcc

SEQ ID NO: 3173369 - RNA, 18 nt, Mycobacterium bovis subsp bovis AF2122/97
acacccccccccccaccc

SEQ ID NO: 3173370 - RNA, 19 nt, Mycobacterium bovis subsp bovis AF2122/97
acacccccccccccaccca

SEQ ID NO: 3173371 - RNA, 19 nt, Mycobacterium bovis subsp bovis AF2122/97
acaccccggccuugccacc

SEQ ID NO: 3173372 - RNA, 22 nt, Mycobacterium bovis subsp bovis AF2122/97
acacccgacacggcucgccggc

SEQ ID NO: 3173373 - RNA, 18 nt, Mycobacterium bovis subsp bovis AF2122/97
acacccgcaccggaucgg

SEQ ID NO: 3173374 - RNA, 21 nt, Mycobacterium bovis subsp bovis AF2122/97
acacccgcaccggaucggcua

SEQ ID NO: 3173375 - RNA, 14 nt, Mycobacterium bovis subsp bovis AF2122/97
acacccgcccgggc

SEQ ID NO: 3173376 - RNA, 12 nt, Mycobacterium bovis subsp bovis AF2122/97
acacccgccggu

SEQ ID NO: 3173377 - RNA, 22 nt, Mycobacterium bovis subsp bovis AF2122/97
acacccgccggucaaacugcca

SEQ ID NO: 3173378 - RNA, 21 nt, Mycobacterium bovis subsp bovis AF2122/97
acacccgcuuugcacugugga

SEQ ID NO: 3173379 - RNA, 15 nt, Mycobacterium bovis subsp bovis AF2122/97
acacccggccgccga

SEQ ID NO: 3173380 - RNA, 19 nt, Mycobacterium bovis subsp bovis AF2122/97
acacccgggacgaaccggc

SEQ ID NO: 3173381 - RNA, 21 nt, Mycobacterium bovis subsp bovis AF2122/97
acacccgguaugcgcgucccc

SEQ ID NO: 3173382 - RNA, 20 nt, Mycobacterium bovis subsp bovis AF2122/97
acacccgucaugcccaccgc

SEQ ID NO: 3173383 - RNA, 22 nt, Mycobacterium bovis subsp bovis AF2122/97
acacccgucaugcccaccgccu

SEQ ID NO: 3173384 - RNA, 15 nt, Mycobacterium bovis subsp bovis AF2122/97
acacccguguugagg

SEQ ID NO: 3173385 - RNA, 19 nt, Mycobacterium bovis subsp bovis AF2122/97
acacccuccacagcggcca

SEQ ID NO: 3173386 - RNA, 12 nt, Mycobacterium bovis subsp bovis AF2122/97
acacccugcagc

SEQ ID NO: 3173387 - RNA, 15 nt, Mycobacterium bovis subsp bovis AF2122/97
acaccgaaccgccgc

SEQ ID NO: 3173388 - RNA, 17 nt, Mycobacterium bovis subsp bovis AF2122/97
acaccgacgccgccagg

SEQ ID NO: 3173389 - RNA, 24 nt, Mycobacterium bovis subsp bovis AF2122/97
acaccgagaagcugugccuucgcc

SEQ ID NO: 3173390 - RNA, 14 nt, Mycobacterium bovis subsp bovis AF2122/97
acaccgagccacga

SEQ ID NO: 3173391 - RNA, 19 nt, Mycobacterium bovis subsp bovis AF2122/97
acaccgaggcgaccggacc

SEQ ID NO: 3173392 - RNA, 17 nt, Mycobacterium bovis subsp bovis AF2122/97
acaccgaggucgccaac

SEQ ID NO: 3173393 - RNA, 14 nt, Mycobacterium bovis subsp bovis AF2122/97
acaccgaguuccuc

SEQ ID NO: 3173394 - RNA, 14 nt, Mycobacterium bovis subsp bovis AF2122/97
acaccgcagcgggc

SEQ ID NO: 3173395 - RNA, 13 nt, Mycobacterium bovis subsp bovis AF2122/97
acaccgcaggugc

SEQ ID NO: 3173396 - RNA, 20 nt, Mycobacterium bovis subsp bovis AF2122/97
acaccgcauaaaucgggguu

SEQ ID NO: 3173397 - RNA, 17 nt, Mycobacterium bovis subsp bovis AF2122/97
acaccgcauaaggccca

SEQ ID NO: 3173398 - RNA, 15 nt, Mycobacterium bovis subsp bovis AF2122/97
acaccgccagcggca

SEQ ID NO: 3173399 - RNA, 23 nt, Mycobacterium bovis subsp bovis AF2122/97
acaccgccagcggcaauggccag

SEQ ID NO: 3173400 - RNA, 15 nt, Mycobacterium bovis subsp bovis AF2122/97
acaccgccagcucac

SEQ ID NO: 3173401 - RNA, 12 nt, Mycobacterium bovis subsp bovis AF2122/97
acaccgcccggc

SEQ ID NO: 3173402 - RNA, 20 nt, Mycobacterium bovis subsp bovis AF2122/97
acaccgccgccaagcucggc

SEQ ID NO: 3173403 - RNA, 21 nt, Mycobacterium bovis subsp bovis AF2122/97
acaccgcgaacuugcugacga

SEQ ID NO: 3173404 - RNA, 15 nt, Mycobacterium bovis subsp bovis AF2122/97
acaccgcgccgacga

SEQ ID NO: 3173405 - RNA, 18 nt, Mycobacterium bovis subsp bovis AF2122/97
acaccgcggaaggccagc

SEQ ID NO: 3173406 - RNA, 21 nt, Mycobacterium bovis subsp bovis AF2122/97
acaccgcggacccgcagcugc

SEQ ID NO: 3173407 - RNA, 22 nt, Mycobacterium bovis subsp bovis AF2122/97
acaccgcggacccgcagcugcg

SEQ ID NO: 3173408 - RNA, 11 nt, Mycobacterium bovis subsp bovis AF2122/97
acaccgcggca

SEQ ID NO: 3173409 - RNA, 16 nt, Mycobacterium bovis subsp bovis AF2122/97
acaccgcggcaagagu

SEQ ID NO: 3173410 - RNA, 16 nt, Mycobacterium bovis subsp bovis AF2122/97
acaccgcggccgaggg

SEQ ID NO: 3173411 - RNA, 13 nt, Mycobacterium bovis subsp bovis AF2122/97
acaccggcaagcc

SEQ ID NO: 3173412 - RNA, 21 nt, Mycobacterium bovis subsp bovis AF2122/97
acaccggcaagccacgccggu

SEQ ID NO: 3173413 - RNA, 18 nt, Mycobacterium bovis subsp bovis AF2122/97
acaccggccaacagucgc

SEQ ID NO: 3173414 - RNA, 15 nt, Mycobacterium bovis subsp bovis AF2122/97
acaccggccaccagc

SEQ ID NO: 3173415 - RNA, 12 nt, Mycobacterium bovis subsp bovis AF2122/97
acaccggccagc

SEQ ID NO: 3173416 - RNA, 14 nt, Mycobacterium bovis subsp bovis AF2122/97
acaccggccaggcc

SEQ ID NO: 3173417 - RNA, 22 nt, Mycobacterium bovis subsp bovis AF2122/97
acaccggccugcgcgaccgacc

SEQ ID NO: 3173418 - RNA, 14 nt, Mycobacterium bovis subsp bovis AF2122/97
acaccggcgaucac

SEQ ID NO: 3173419 - RNA, 16 nt, Mycobacterium bovis subsp bovis AF2122/97
acaccggcgaucaccg

SEQ ID NO: 3173420 - RNA, 14 nt, Mycobacterium bovis subsp bovis AF2122/97
acaccggcggcauc

SEQ ID NO: 3173421 - RNA, 12 nt, Mycobacterium bovis subsp bovis AF2122/97
acaccggcugac

SEQ ID NO: 3173422 - RNA, 17 nt, Mycobacterium bovis subsp bovis AF2122/97
acaccggcugaccgacc

SEQ ID NO: 3173423 - RNA, 17 nt, Mycobacterium bovis subsp bovis AF2122/97
acaccggcuuugcuugc

SEQ ID NO: 3173424 - RNA, 18 nt, Mycobacterium bovis subsp bovis AF2122/97
acaccggcuuugcuugcc

SEQ ID NO: 3173425 - RNA, 13 nt, Mycobacterium bovis subsp bovis AF2122/97
acaccgggcacca

SEQ ID NO: 3173426 - RNA, 18 nt, Mycobacterium bovis subsp bovis AF2122/97
acaccgggcaccagucgc

SEQ ID NO: 3173427 - RNA, 22 nt, Mycobacterium bovis subsp bovis AF2122/97
acagaggucggucagccaccug

SEQ ID NO: 3173428 - RNA, 15 nt, Mycobacterium bovis subsp bovis AF2122/97
acagagucaccgcgc

SEQ ID NO: 3173429 - RNA, 15 nt, Mycobacterium bovis subsp bovis AF2122/97
acagauaaggaccau

SEQ ID NO: 3173430 - RNA, 18 nt, Mycobacterium bovis subsp bovis AF2122/97
acagauagacuagccgau

SEQ ID NO: 3173431 - RNA, 18 nt, Mycobacterium bovis subsp bovis AF2122/97
acagaucuggguucccga

SEQ ID NO: 3173432 - RNA, 20 nt, Mycobacterium bovis subsp bovis AF2122/97
acagaugcauccagcugcug

SEQ ID NO: 3173433 - RNA, 13 nt, Mycobacterium bovis subsp bovis AF2122/97
acagauggcggcc

SEQ ID NO: 3173434 - RNA, 20 nt, Mycobacterium bovis subsp bovis AF2122/97
acagauucggugccagcagg

SEQ ID NO: 3173435 - RNA, 22 nt, Mycobacterium bovis subsp bovis AF2122/97
acagauucggugccagcaggcc

SEQ ID NO: 3173436 - RNA, 13 nt, Mycobacterium bovis subsp bovis AF2122/97
acagcaacgccca

SEQ ID NO: 3173437 - RNA, 22 nt, Mycobacterium bovis subsp bovis AF2122/97
acagcacagcgcagccugcagc

SEQ ID NO: 3173438 - RNA, 18 nt, Mycobacterium bovis subsp bovis AF2122/97
acagcacauccagcccug

SEQ ID NO: 3173439 - RNA, 21 nt, Mycobacterium bovis subsp bovis AF2122/97
acagcaccacgugcgagggca

SEQ ID NO: 3173440 - RNA, 13 nt, Mycobacterium bovis subsp bovis AF2122/97
acagcaccccgcc

SEQ ID NO: 3173441 - RNA, 15 nt, Mycobacterium bovis subsp bovis AF2122/97
acagcacccggccac

SEQ ID NO: 3173442 - RNA, 13 nt, Mycobacterium bovis subsp bovis AF2122/97
acagcaccgccgg

SEQ ID NO: 3173443 - RNA, 14 nt, Mycobacterium bovis subsp bovis AF2122/97
acagcagcgcgaca

SEQ ID NO: 3173444 - RNA, 15 nt, Mycobacterium bovis subsp bovis AF2122/97
acagcagcgucauca

SEQ ID NO: 3173445 - RNA, 15 nt, Mycobacterium bovis subsp bovis AF2122/97
acagcaggcauuccc

SEQ ID NO: 3173446 - RNA, 14 nt, Mycobacterium bovis subsp bovis AF2122/97
acagcaggccgcgc

SEQ ID NO: 3173447 - RNA, 16 nt, Mycobacterium bovis subsp bovis AF2122/97
acagcagguugccgaa

SEQ ID NO: 3173448 - RNA, 13 nt, Mycobacterium bovis subsp bovis AF2122/97
acagcaucacgcc

SEQ ID NO: 3173449 - RNA, 18 nt, Mycobacterium bovis subsp bovis AF2122/97
acagcaucacgcccacga

SEQ ID NO: 3173450 - RNA, 17 nt, Mycobacterium bovis subsp bovis AF2122/97
acagcauggcgaagaac

SEQ ID NO: 3173451 - RNA, 22 nt, Mycobacterium bovis subsp bovis AF2122/97
acagcauggcgaagaacaacau

SEQ ID NO: 3173452 - RNA, 19 nt, Mycobacterium bovis subsp bovis AF2122/97
acagcaugucgcggacccg

SEQ ID NO: 3173453 - RNA, 20 nt, Mycobacterium bovis subsp bovis AF2122/97
acagcaugucgcggacccgc

SEQ ID NO: 3173454 - RNA, 13 nt, Mycobacterium bovis subsp bovis AF2122/97
acagccacgcaca

SEQ ID NO: 3173455 - RNA, 15 nt, Mycobacterium bovis subsp bovis AF2122/97
acagccaguguugca

SEQ ID NO: 3173456 - RNA, 21 nt, Mycobacterium bovis subsp bovis AF2122/97
acagcccaccggugccgcccg

SEQ ID NO: 3173457 - RNA, 23 nt, Mycobacterium bovis subsp bovis AF2122/97
acagcccacgaaugcaagaccgu

SEQ ID NO: 3173458 - RNA, 16 nt, Mycobacterium bovis subsp bovis AF2122/97
acagcccgaacgaggc

SEQ ID NO: 3173459 - RNA, 21 nt, Mycobacterium bovis subsp bovis AF2122/97
acagcccgaacgaggcgccca

SEQ ID NO: 3173460 - RNA, 13 nt, Mycobacterium bovis subsp bovis AF2122/97
acagcccgaugcc

SEQ ID NO: 3173461 - RNA, 14 nt, Mycobacterium bovis subsp bovis AF2122/97
acagcccgaugccg

SEQ ID NO: 3173462 - RNA, 15 nt, Mycobacterium bovis subsp bovis AF2122/97
acagcccggcgacga

SEQ ID NO: 3173463 - RNA, 12 nt, Mycobacterium bovis subsp bovis AF2122/97
acagcccggcgg

SEQ ID NO: 3173464 - RNA, 15 nt, Mycobacterium bovis subsp bovis AF2122/97
acagcccggcggcgg

SEQ ID NO: 3173465 - RNA, 19 nt, Mycobacterium bovis subsp bovis AF2122/97
acagcccguagcacaccgg

SEQ ID NO: 3173466 - RNA, 15 nt, Mycobacterium bovis subsp bovis AF2122/97
acagccgaccucgag

SEQ ID NO: 3173467 - RNA, 19 nt, Mycobacterium bovis subsp bovis AF2122/97
acagccgagccagcagcuu

SEQ ID NO: 3173468 - RNA, 16 nt, Mycobacterium bovis subsp bovis AF2122/97
acagccgcagcggccu

SEQ ID NO: 3173469 - RNA, 12 nt, Mycobacterium bovis subsp bovis AF2122/97
acagccgccgac

SEQ ID NO: 3173470 - RNA, 15 nt, Mycobacterium bovis subsp bovis AF2122/97
acagccgcgcugcga

SEQ ID NO: 3173471 - RNA, 13 nt, Mycobacterium bovis subsp bovis AF2122/97
acagccggcggcu

SEQ ID NO: 3173472 - RNA, 12 nt, Mycobacterium bovis subsp bovis AF2122/97
acagccgucgca

SEQ ID NO: 3173473 - RNA, 19 nt, Mycobacterium bovis subsp bovis AF2122/97
acagccuauuccgaauuac

SEQ ID NO: 3173474 - RNA, 19 nt, Mycobacterium bovis subsp bovis AF2122/97
acagccugcgccacaaugg

SEQ ID NO: 3173475 - RNA, 19 nt, Mycobacterium bovis subsp bovis AF2122/97
acagcgaacagacaugcgc

SEQ ID NO: 3173476 - RNA, 15 nt, Mycobacterium bovis subsp bovis AF2122/97
acagcgaaccgccgg

SEQ ID NO: 3173477 - RNA, 16 nt, Mycobacterium bovis subsp bovis AF2122/97
acagcgaaccgccggc

SEQ ID NO: 3173478 - RNA, 18 nt, Mycobacterium bovis subsp bovis AF2122/97
acagcgaaccggcugggc

SEQ ID NO: 3173479 - RNA, 14 nt, Mycobacterium bovis subsp bovis AF2122/97
acagcgacgagauc

SEQ ID NO: 3173480 - RNA, 13 nt, Mycobacterium bovis subsp bovis AF2122/97
acagcgacgccau

SEQ ID NO: 3173481 - RNA, 15 nt, Mycobacterium bovis subsp bovis AF2122/97
acagcgaguucugga

SEQ ID NO: 3173482 - RNA, 13 nt, Mycobacterium bovis subsp bovis AF2122/97
acagcgauccgau

SEQ ID NO: 3173483 - RNA, 17 nt, Mycobacterium bovis subsp bovis AF2122/97
acagcgauccgauccgc

SEQ ID NO: 3173484 - RNA, 18 nt, Mycobacterium bovis subsp bovis AF2122/97
acagcgcagccugcagcg

SEQ ID NO: 3173485 - RNA, 20 nt, Mycobacterium bovis subsp bovis AF2122/97
acagcgccaagacgucggcg

SEQ ID NO: 3173486 - RNA, 21 nt, Mycobacterium bovis subsp bovis AF2122/97
acagcgccaagacgucggcgu

SEQ ID NO: 3173487 - RNA, 21 nt, Mycobacterium bovis subsp bovis AF2122/97
acagcgccaguagcacguuga

SEQ ID NO: 3173488 - RNA, 17 nt, Mycobacterium bovis subsp bovis AF2122/97
acagcgccaucgaugcg

SEQ ID NO: 3173489 - RNA, 23 nt, Mycobacterium bovis subsp bovis AF2122/97
acagcgccaugcccucggcgccg

SEQ ID NO: 3173490 - RNA, 13 nt, Mycobacterium bovis subsp bovis AF2122/97
acagcgcggcgcg

SEQ ID NO: 3173491 - RNA, 16 nt, Mycobacterium bovis subsp bovis AF2122/97
acagcgcggcggucga

SEQ ID NO: 3173492 - RNA, 16 nt, Mycobacterium bovis subsp bovis AF2122/97
acagcgcguagcgggc

SEQ ID NO: 3173493 - RNA, 15 nt, Mycobacterium bovis subsp bovis AF2122/97
acagcgcguuggcga

SEQ ID NO: 3173494 - RNA, 18 nt, Mycobacterium bovis subsp bovis AF2122/97
acagcgcuccagccgcgc

SEQ ID NO: 3173495 - RNA, 17 nt, Mycobacterium bovis subsp bovis AF2122/97
acagcggaucccgccgg

SEQ ID NO: 3173496 - RNA, 19 nt, Mycobacterium bovis subsp bovis AF2122/97
acagcggcaucgcgggcgg

SEQ ID NO: 3173497 - RNA, 21 nt, Mycobacterium bovis subsp bovis AF2122/97
acagcggcgacaugaucugcc

SEQ ID NO: 3173498 - RNA, 23 nt, Mycobacterium bovis subsp bovis AF2122/97
acagcggcgauugauccgguggc

SEQ ID NO: 3173499 - RNA, 22 nt, Mycobacterium bovis subsp bovis AF2122/97
acagcggcggcgucgacggcuc

SEQ ID NO: 3173500 - RNA, 15 nt, Mycobacterium bovis subsp bovis AF2122/97
acagcgggggcagcg

SEQ ID NO: 3173501 - RNA, 18 nt, Mycobacterium bovis subsp bovis AF2122/97
acagcgggggcagcgcga

SEQ ID NO: 3173502 - RNA, 18 nt, Mycobacterium bovis subsp bovis AF2122/97
acagcggguccuucugcc

SEQ ID NO: 3173503 - RNA, 18 nt, Mycobacterium bovis subsp bovis AF2122/97
acagcgguccagccaccg

SEQ ID NO: 3173504 - RNA, 18 nt, Mycobacterium bovis subsp bovis AF2122/97
acagcgucauccucgucg

SEQ ID NO: 3173505 - RNA, 20 nt, Mycobacterium bovis subsp bovis AF2122/97
acagcgucgaaaagccgugc

SEQ ID NO: 3173506 - RNA, 14 nt, Mycobacterium bovis subsp bovis AF2122/97
acagcgucucggag

SEQ ID NO: 3173507 - RNA, 21 nt, Mycobacterium bovis subsp bovis AF2122/97
acagcgucucggaggcgacca

SEQ ID NO: 3173508 - RNA, 21 nt, Mycobacterium bovis subsp bovis AF2122/97
acagcgugccgaacagggagg

SEQ ID NO: 3173509 - RNA, 22 nt, Mycobacterium bovis subsp bovis AF2122/97
acagcucacgcugaagccgcug

SEQ ID NO: 3173510 - RNA, 23 nt, Mycobacterium bovis subsp bovis AF2122/97
acagcucaucgauccucgcccgc

SEQ ID NO: 3173511 - RNA, 22 nt, Mycobacterium bovis subsp bovis AF2122/97
acagcuccuuggcuaacaccgc

SEQ ID NO: 3173512 - RNA, 22 nt, Mycobacterium bovis subsp bovis AF2122/97
acagcucgccgugaccaggugc

SEQ ID NO: 3173513 - RNA, 15 nt, Mycobacterium bovis subsp bovis AF2122/97
acagcucgccuaguu

SEQ ID NO: 3173514 - RNA, 18 nt, Mycobacterium bovis subsp bovis AF2122/97
acaucauggugaaggcaa

SEQ ID NO: 3173515 - RNA, 22 nt, Mycobacterium bovis subsp bovis AF2122/97
acaucauggugaaggcaaacac

SEQ ID NO: 3173516 - RNA, 21 nt, Mycobacterium bovis subsp bovis AF2122/97
acauccaacgaccuccacgcc

SEQ ID NO: 3173517 - RNA, 23 nt, Mycobacterium bovis subsp bovis AF2122/97
acauccaggcuguggccagcauc

SEQ ID NO: 3173518 - RNA, 20 nt, Mycobacterium bovis subsp bovis AF2122/97
acauccagggccgagcagcu

SEQ ID NO: 3173519 - RNA, 23 nt, Mycobacterium bovis subsp bovis AF2122/97
acauccaguaaccguccgcggac

SEQ ID NO: 3173520 - RNA, 14 nt, Mycobacterium bovis subsp bovis AF2122/97
acauccaucuccau

SEQ ID NO: 3173521 - RNA, 18 nt, Mycobacterium bovis subsp bovis AF2122/97
acaucccagcgaaugcug

SEQ ID NO: 3173522 - RNA, 19 nt, Mycobacterium bovis subsp bovis AF2122/97
acaucccccggcuggucac

SEQ ID NO: 3173523 - RNA, 10 nt, Mycobacterium bovis subsp bovis AF2122/97
acaucccgga

SEQ ID NO: 3173524 - RNA, 13 nt, Mycobacterium bovis subsp bovis AF2122/97
acauccgcacugg

SEQ ID NO: 3173525 - RNA, 18 nt, Mycobacterium bovis subsp bovis AF2122/97
acauccgcggcaugcaau

SEQ ID NO: 3173526 - RNA, 22 nt, Mycobacterium bovis subsp bovis AF2122/97
acauccgcggcaugcaaugcug

SEQ ID NO: 3173527 - RNA, 13 nt, Mycobacterium bovis subsp bovis AF2122/97
acauccugcagcu

SEQ ID NO: 3173528 - RNA, 22 nt, Mycobacterium bovis subsp bovis AF2122/97
acauccugcagcucgggcaggg

SEQ ID NO: 3173529 - RNA, 15 nt, Mycobacterium bovis subsp bovis AF2122/97
acauccuggcggcug

SEQ ID NO: 3173530 - RNA, 22 nt, Mycobacterium bovis subsp bovis AF2122/97
acauccuucaucccccaaauca

SEQ ID NO: 3173531 - RNA, 16 nt, Mycobacterium bovis subsp bovis AF2122/97
acauccuugacgcggc

SEQ ID NO: 3173532 - RNA, 17 nt, Mycobacterium bovis subsp bovis AF2122/97
acauccuugacgcggcc

SEQ ID NO: 3173533 - RNA, 17 nt, Mycobacterium bovis subsp bovis AF2122/97
acaucgaaaaccgaggc

SEQ ID NO: 3173534 - RNA, 18 nt, Mycobacterium bovis subsp bovis AF2122/97
acaucgaaaaccgaggca

SEQ ID NO: 3173535 - RNA, 23 nt, Mycobacterium bovis subsp bovis AF2122/97
acaucgaggccacgccagcucgc

SEQ ID NO: 3173536 - RNA, 16 nt, Mycobacterium bovis subsp bovis AF2122/97
acaucgaugucggcuc

SEQ ID NO: 3173537 - RNA, 19 nt, Mycobacterium bovis subsp bovis AF2122/97
acaucgcacccaccacacc

SEQ ID NO: 3173538 - RNA, 18 nt, Mycobacterium bovis subsp bovis AF2122/97
acaucgcgaaaccggacc

SEQ ID NO: 3173539 - RNA, 18 nt, Mycobacterium bovis subsp bovis AF2122/97
acaucgcgaggcgucacc

SEQ ID NO: 3173540 - RNA, 21 nt, Mycobacterium bovis subsp bovis AF2122/97
acaucgcgggcgugccgacca

SEQ ID NO: 3173541 - RNA, 19 nt, Mycobacterium bovis subsp bovis AF2122/97
acaucggcccgaucaccau

SEQ ID NO: 3173542 - RNA, 21 nt, Mycobacterium bovis subsp bovis AF2122/97
acaucggcccgaucaccaucc

SEQ ID NO: 3173543 - RNA, 18 nt, Mycobacterium bovis subsp bovis AF2122/97
acaucggccggcgucagc

SEQ ID NO: 3173544 - RNA, 23 nt, Mycobacterium bovis subsp bovis AF2122/97
acaucggccggguuaucggcagc

SEQ ID NO: 3173545 - RNA, 12 nt, Mycobacterium bovis subsp bovis AF2122/97
acaucggcggcc

SEQ ID NO: 3173546 - RNA, 14 nt, Mycobacterium bovis subsp bovis AF2122/97
acaucgggccgccg

SEQ ID NO: 3173547 - RNA, 18 nt, Mycobacterium bovis subsp bovis AF2122/97
acaucgggcggcaccgcu

SEQ ID NO: 3173548 - RNA, 16 nt, Mycobacterium bovis subsp bovis AF2122/97
acaucgggucgcugcc

SEQ ID NO: 3173549 - RNA, 21 nt, Mycobacterium bovis subsp bovis AF2122/97
acaucggguucuucaacuccg

SEQ ID NO: 3173550 - RNA, 18 nt, Mycobacterium bovis subsp bovis AF2122/97
acaucggucauguccguc

SEQ ID NO: 3173551 - RNA, 13 nt, Mycobacterium bovis subsp bovis AF2122/97
acaucggugccac

SEQ ID NO: 3173552 - RNA, 23 nt, Mycobacterium bovis subsp bovis AF2122/97
acaucgguggcgccgaacgccag

SEQ ID NO: 3173553 - RNA, 23 nt, Mycobacterium bovis subsp bovis AF2122/97
acaucggugguuagguggcuggc

SEQ ID NO: 3173554 - RNA, 23 nt, Mycobacterium bovis subsp bovis AF2122/97
acaucgguguggcccaacaccgc

SEQ ID NO: 3173555 - RNA, 16 nt, Mycobacterium bovis subsp bovis AF2122/97
acaucgucaucagcgc

SEQ ID NO: 3173556 - RNA, 17 nt, Mycobacterium bovis subsp bovis AF2122/97
acaucgucggcgggcgg

SEQ ID NO: 3173557 - RNA, 22 nt, Mycobacterium bovis subsp bovis AF2122/97
acaucgucggcgggcggcagcg

SEQ ID NO: 3173558 - RNA, 23 nt, Mycobacterium bovis subsp bovis AF2122/97
acaucguggcgucgugcgcggcc

SEQ ID NO: 3173559 - RNA, 20 nt, Mycobacterium bovis subsp bovis AF2122/97
acaucguucaugaucggcag

SEQ ID NO: 3173560 - RNA, 14 nt, Mycobacterium bovis subsp bovis AF2122/97
acaucguucugacg

SEQ ID NO: 3173561 - RNA, 21 nt, Mycobacterium bovis subsp bovis AF2122/97
acaucguugacccggcgaugc

SEQ ID NO: 3173562 - RNA, 20 nt, Mycobacterium bovis subsp bovis AF2122/97
acaucuccgcgucggucagc

SEQ ID NO: 3173563 - RNA, 17 nt, Mycobacterium bovis subsp bovis AF2122/97
acaucugacagcugggu

SEQ ID NO: 3173564 - RNA, 20 nt, Mycobacterium bovis subsp bovis AF2122/97
acaucugacagcugggucgg

SEQ ID NO: 3173565 - RNA, 15 nt, Mycobacterium bovis subsp bovis AF2122/97
acaucugccggucga

SEQ ID NO: 3173566 - RNA, 12 nt, Mycobacterium bovis subsp bovis AF2122/97
acaucuggucac

SEQ ID NO: 3173567 - RNA, 15 nt, Mycobacterium bovis subsp bovis AF2122/97
acaugaaccggucga

SEQ ID NO: 3173568 - RNA, 13 nt, Mycobacterium bovis subsp bovis AF2122/97
acaugaccgacag

SEQ ID NO: 3173569 - RNA, 18 nt, Mycobacterium bovis subsp bovis AF2122/97
acaugaccgacaggugcu

SEQ ID NO: 3173570 - RNA, 18 nt, Mycobacterium bovis subsp bovis AF2122/97
acaugacgaucgcggcgg

SEQ ID NO: 3173571 - RNA, 20 nt, Mycobacterium bovis subsp bovis AF2122/97
acaugacgaucgcggcgggc

SEQ ID NO: 3173572 - RNA, 14 nt, Mycobacterium bovis subsp bovis AF2122/97
acaugaucgagcag

SEQ ID NO: 3173573 - RNA, 14 nt, Mycobacterium bovis subsp bovis AF2122/97
acaugccggucauc

SEQ ID NO: 3173574 - RNA, 15 nt, Mycobacterium bovis subsp bovis AF2122/97
acaugccgguugcgg

SEQ ID NO: 3173575 - RNA, 20 nt, Mycobacterium bovis subsp bovis AF2122/97
acaugccgguugcggcugcg

SEQ ID NO: 3173576 - RNA, 23 nt, Mycobacterium bovis subsp bovis AF2122/97
acaugccgguugcggcugcguug

SEQ ID NO: 3173577 - RNA, 13 nt, Mycobacterium bovis subsp bovis AF2122/97
acaugcgccgaga

SEQ ID NO: 3173578 - RNA, 17 nt, Mycobacterium bovis subsp bovis AF2122/97
acaugcucacgaucacc

SEQ ID NO: 3173579 - RNA, 12 nt, Mycobacterium bovis subsp bovis AF2122/97
acaugcuggaga

SEQ ID NO: 3173580 - RNA, 20 nt, Mycobacterium bovis subsp bovis AF2122/97
acauggcaagucaacaccgc

SEQ ID NO: 3173581 - RNA, 16 nt, Mycobacterium bovis subsp bovis AF2122/97
acauggccagcaucag

SEQ ID NO: 3173582 - RNA, 15 nt, Mycobacterium bovis subsp bovis AF2122/97
acauggcccggaggc

SEQ ID NO: 3173583 - RNA, 20 nt, Mycobacterium bovis subsp bovis AF2122/97
acaugguccgaccagcggcc

SEQ ID NO: 3173584 - RNA, 16 nt, Mycobacterium bovis subsp bovis AF2122/97
acauggugaccauggc

SEQ ID NO: 3173585 - RNA, 14 nt, Mycobacterium bovis subsp bovis AF2122/97
acaugucacaccca

SEQ ID NO: 3173586 - RNA, 19 nt, Mycobacterium bovis subsp bovis AF2122/97
acaugucgaacgcccccca

SEQ ID NO: 3173587 - RNA, 16 nt, Mycobacterium bovis subsp bovis AF2122/97
acaugugggugaacac

SEQ ID NO: 3173588 - RNA, 15 nt, Mycobacterium bovis subsp bovis AF2122/97
acauguguggcagcc

SEQ ID NO: 3173589 - RNA, 21 nt, Mycobacterium bovis subsp bovis AF2122/97
acauguucuccucgucgcggg

SEQ ID NO: 3173590 - RNA, 22 nt, Mycobacterium bovis subsp bovis AF2122/97
acauguuuucgagcccaagggg

SEQ ID NO: 3173591 - RNA, 22 nt, Mycobacterium bovis subsp bovis AF2122/97
acauucauccaccccugagcuc

SEQ ID NO: 3173592 - RNA, 23 nt, Mycobacterium bovis subsp bovis AF2122/97
acauucccgaguugcccucuggc

SEQ ID NO: 3173593 - RNA, 23 nt, Mycobacterium bovis subsp bovis AF2122/97
acauucgggcgugcucgccgggu

SEQ ID NO: 3173594 - RNA, 19 nt, Mycobacterium bovis subsp bovis AF2122/97
acauucugcagcgucuccu

SEQ ID NO: 3173595 - RNA, 18 nt, Mycobacterium bovis subsp bovis AF2122/97
acauugaccaggugcccg

SEQ ID NO: 3173596 - RNA, 17 nt, Mycobacterium bovis subsp bovis AF2122/97
acauugaucgacggcca

SEQ ID NO: 3173597 - RNA, 11 nt, Mycobacterium bovis subsp bovis AF2122/97
acauugcccgu

SEQ ID NO: 3173598 - RNA, 14 nt, Mycobacterium bovis subsp bovis AF2122/97
acauugccgacccg

SEQ ID NO: 3173599 - RNA, 15 nt, Mycobacterium bovis subsp bovis AF2122/97
acauugccggccacc

SEQ ID NO: 3173600 - RNA, 13 nt, Mycobacterium bovis subsp bovis AF2122/97
accaccaggcuga

SEQ ID NO: 3173601 - RNA, 20 nt, Mycobacterium bovis subsp bovis AF2122/97
accaccaggcugucgugggc

SEQ ID NO: 3173602 - RNA, 20 nt, Mycobacterium bovis subsp bovis AF2122/97
accaccagguccaccccgcc

SEQ ID NO: 3173603 - RNA, 21 nt, Mycobacterium bovis subsp bovis AF2122/97
accaccaguggcgcgugcagc

SEQ ID NO: 3173604 - RNA, 19 nt, Mycobacterium bovis subsp bovis AF2122/97
accacccaacagcccaccg

SEQ ID NO: 3173605 - RNA, 17 nt, Mycobacterium bovis subsp bovis AF2122/97
accacccacccgcacca

SEQ ID NO: 3173606 - RNA, 16 nt, Mycobacterium bovis subsp bovis AF2122/97
accacccagauugccu

SEQ ID NO: 3173607 - RNA, 21 nt, Mycobacterium bovis subsp bovis AF2122/97
accacccagauugccugggcg

SEQ ID NO: 3173608 - RNA, 12 nt, Mycobacterium bovis subsp bovis AF2122/97
accaccccagcg

SEQ ID NO: 3173609 - RNA, 18 nt, Mycobacterium bovis subsp bovis AF2122/97
accaccccagcggccacc

SEQ ID NO: 3173610 - RNA, 20 nt, Mycobacterium bovis subsp bovis AF2122/97
accaccccagcggccaccga

SEQ ID NO: 3173611 - RNA, 15 nt, Mycobacterium bovis subsp bovis AF2122/97
accacccccggcagg

SEQ ID NO: 3173612 - RNA, 18 nt, Mycobacterium bovis subsp bovis AF2122/97
accacccgcaccucaccg

SEQ ID NO: 3173613 - RNA, 12 nt, Mycobacterium bovis subsp bovis AF2122/97
accacccgcacu

SEQ ID NO: 3173614 - RNA, 13 nt, Mycobacterium bovis subsp bovis AF2122/97
accacccgccgca

SEQ ID NO: 3173615 - RNA, 15 nt, Mycobacterium bovis subsp bovis AF2122/97
accacccgccgcagc

SEQ ID NO: 3173616 - RNA, 21 nt, Mycobacterium bovis subsp bovis AF2122/97
accacccggcgaacccagcgg

SEQ ID NO: 3173617 - RNA, 14 nt, Mycobacterium bovis subsp bovis AF2122/97
accacccgggccuc

SEQ ID NO: 3173618 - RNA, 19 nt, Mycobacterium bovis subsp bovis AF2122/97
accacccgggccucggcgc

SEQ ID NO: 3173619 - RNA, 21 nt, Mycobacterium bovis subsp bovis AF2122/97
accacccgggccucggcgccg

SEQ ID NO: 3173620 - RNA, 17 nt, Mycobacterium bovis subsp bovis AF2122/97
accacccgguccugcuc

SEQ ID NO: 3173621 - RNA, 17 nt, Mycobacterium bovis subsp bovis AF2122/97
accacccugcacugcgc

SEQ ID NO: 3173622 - RNA, 20 nt, Mycobacterium bovis subsp bovis AF2122/97
accaccgaaauacccagcgc

SEQ ID NO: 3173623 - RNA, 19 nt, Mycobacterium bovis subsp bovis AF2122/97
accaccgacagcacccggc

SEQ ID NO: 3173624 - RNA, 20 nt, Mycobacterium bovis subsp bovis AF2122/97
accaccgacagcacccggcc

SEQ ID NO: 3173625 - RNA, 13 nt, Mycobacterium bovis subsp bovis AF2122/97
accaccgacccgc

SEQ ID NO: 3173626 - RNA, 18 nt, Mycobacterium bovis subsp bovis AF2122/97
accaccgcauaacgccag

SEQ ID NO: 3173627 - RNA, 19 nt, Mycobacterium bovis subsp bovis AF2122/97
accaccgcauaacgccagu

SEQ ID NO: 3173628 - RNA, 21 nt, Mycobacterium bovis subsp bovis AF2122/97
accaccgcauaacgccagucc

SEQ ID NO: 3173629 - RNA, 14 nt, Mycobacterium bovis subsp bovis AF2122/97
accaccgcccacag

SEQ ID NO: 3173630 - RNA, 16 nt, Mycobacterium bovis subsp bovis AF2122/97
accaccgccccgcgcc

SEQ ID NO: 3173631 - RNA, 14 nt, Mycobacterium bovis subsp bovis AF2122/97
accaccgccgaagc

SEQ ID NO: 3173632 - RNA, 22 nt, Mycobacterium bovis subsp bovis AF2122/97
accaccgccgaagcugcggguc

SEQ ID NO: 3173633 - RNA, 13 nt, Mycobacterium bovis subsp bovis AF2122/97
accaccgccgaca

SEQ ID NO: 3173634 - RNA, 17 nt, Mycobacterium bovis subsp bovis AF2122/97
accaccgccgacccuag

SEQ ID NO: 3173635 - RNA, 15 nt, Mycobacterium bovis subsp bovis AF2122/97
accaccgccgccgaa

SEQ ID NO: 3173636 - RNA, 17 nt, Mycobacterium bovis subsp bovis AF2122/97
accaccgccgccggcac

SEQ ID NO: 3173637 - RNA, 23 nt, Mycobacterium bovis subsp bovis AF2122/97
accaccgccgccggcaccgccgg

SEQ ID NO: 3173638 - RNA, 15 nt, Mycobacterium bovis subsp bovis AF2122/97
accaccgccgcugcc

SEQ ID NO: 3173639 - RNA, 11 nt, Mycobacterium bovis subsp bovis AF2122/97
accaccgccgg

SEQ ID NO: 3173640 - RNA, 15 nt, Mycobacterium bovis subsp bovis AF2122/97
accaccgccggcccg

SEQ ID NO: 3173641 - RNA, 24 nt, Mycobacterium bovis subsp bovis AF2122/97
accaccgccggugccgccaucgcc

SEQ ID NO: 3173642 - RNA, 11 nt, Mycobacterium bovis subsp bovis AF2122/97
accaccgccug

SEQ ID NO: 3173643 - RNA, 20 nt, Mycobacterium bovis subsp bovis AF2122/97
accaccgcgaaagcaccgag

SEQ ID NO: 3173644 - RNA, 21 nt, Mycobacterium bovis subsp bovis AF2122/97
accaccgcgaccucgcggcgc

SEQ ID NO: 3173645 - RNA, 18 nt, Mycobacterium bovis subsp bovis AF2122/97
accaccgcggcggcggcc

SEQ ID NO: 3173646 - RNA, 22 nt, Mycobacterium bovis subsp bovis AF2122/97
accaccgcggcugcuccgucgc

SEQ ID NO: 3173647 - RNA, 14 nt, Mycobacterium bovis subsp bovis AF2122/97
accaccgcggugug

SEQ ID NO: 3173648 - RNA, 15 nt, Mycobacterium bovis subsp bovis AF2122/97
accaccgcgucgggc

SEQ ID NO: 3173649 - RNA, 18 nt, Mycobacterium bovis subsp bovis AF2122/97
accaccgcucgucguccg

SEQ ID NO: 3173650 - RNA, 13 nt, Mycobacterium bovis subsp bovis AF2122/97
accaccgcugccg

SEQ ID NO: 3173651 - RNA, 22 nt, Mycobacterium bovis subsp bovis AF2122/97
accaccgcugcgaagagcccgu

SEQ ID NO: 3173652 - RNA, 17 nt, Mycobacterium bovis subsp bovis AF2122/97
accaccggaaccaccag

SEQ ID NO: 3173653 - RNA, 19 nt, Mycobacterium bovis subsp bovis AF2122/97
accaccggaauacgcgccg

SEQ ID NO: 3173654 - RNA, 20 nt, Mycobacterium bovis subsp bovis AF2122/97
accaccggccccaccgacag

SEQ ID NO: 3173655 - RNA, 19 nt, Mycobacterium bovis subsp bovis AF2122/97
accaccggccccaccggca

SEQ ID NO: 3173656 - RNA, 20 nt, Mycobacterium bovis subsp bovis AF2122/97
accaccggccccaccggcac

SEQ ID NO: 3173657 - RNA, 21 nt, Mycobacterium bovis subsp bovis AF2122/97
accaccggccccaccggcacc

SEQ ID NO: 3173658 - RNA, 12 nt, Mycobacterium bovis subsp bovis AF2122/97
accaccggccgu

SEQ ID NO: 3173659 - RNA, 17 nt, Mycobacterium bovis subsp bovis AF2122/97
accaccggccgucccgc

SEQ ID NO: 3173660 - RNA, 17 nt, Mycobacterium bovis subsp bovis AF2122/97
accaccggcgccgccgg

SEQ ID NO: 3173661 - RNA, 19 nt, Mycobacterium bovis subsp bovis AF2122/97
accaccggcgccgccggca

SEQ ID NO: 3173662 - RNA, 22 nt, Mycobacterium bovis subsp bovis AF2122/97
accaccgggauggcucacccag

SEQ ID NO: 3173663 - RNA, 21 nt, Mycobacterium bovis subsp bovis AF2122/97
accaccgguccagcgccggaa

SEQ ID NO: 3173664 - RNA, 14 nt, Mycobacterium bovis subsp bovis AF2122/97
accaccgucaccgc

SEQ ID NO: 3173665 - RNA, 13 nt, Mycobacterium bovis subsp bovis AF2122/97
accaccgucacga

SEQ ID NO: 3173666 - RNA, 15 nt, Mycobacterium bovis subsp bovis AF2122/97
accaccgucgagccg

SEQ ID NO: 3173667 - RNA, 17 nt, Mycobacterium bovis subsp bovis AF2122/97
accaccgucuccggcgc

SEQ ID NO: 3173668 - RNA, 23 nt, Mycobacterium bovis subsp bovis AF2122/97
accaccgucuccggcgccaccgc

SEQ ID NO: 3173669 - RNA, 15 nt, Mycobacterium bovis subsp bovis AF2122/97
accaccgucucgccg

SEQ ID NO: 3173670 - RNA, 16 nt, Mycobacterium bovis subsp bovis AF2122/97
accaccgucucgccgc

SEQ ID NO: 3173671 - RNA, 18 nt, Mycobacterium bovis subsp bovis AF2122/97
accaccgucucgccgcgc

SEQ ID NO: 3173672 - RNA, 19 nt, Mycobacterium bovis subsp bovis AF2122/97
accaccgucucgccgcgca

SEQ ID NO: 3173673 - RNA, 23 nt, Mycobacterium bovis subsp bovis AF2122/97
accaccguuugagcggccaccgu

SEQ ID NO: 3173674 - RNA, 15 nt, Mycobacterium bovis subsp bovis AF2122/97
accaccucgugggcc

SEQ ID NO: 3173675 - RNA, 14 nt, Mycobacterium bovis subsp bovis AF2122/97
accaccugguuugu

SEQ ID NO: 3173676 - RNA, 22 nt, Mycobacterium bovis subsp bovis AF2122/97
accaccuguccgguggaaucca

SEQ ID NO: 3173677 - RNA, 16 nt, Mycobacterium bovis subsp bovis AF2122/97
accaccuuggaugccc

SEQ ID NO: 3173678 - RNA, 18 nt, Mycobacterium bovis subsp bovis AF2122/97
accacgaacgcgcgcagc

SEQ ID NO: 3173679 - RNA, 15 nt, Mycobacterium bovis subsp bovis AF2122/97
accacgaccgcgaca

SEQ ID NO: 3173680 - RNA, 16 nt, Mycobacterium bovis subsp bovis AF2122/97
accacgacgucgguga

SEQ ID NO: 3173681 - RNA, 13 nt, Mycobacterium bovis subsp bovis AF2122/97
accacgacgugga

SEQ ID NO: 3173682 - RNA, 21 nt, Mycobacterium bovis subsp bovis AF2122/97
accacgacguucgacgacagc

SEQ ID NO: 3173683 - RNA, 14 nt, Mycobacterium bovis subsp bovis AF2122/97
accacgagcagccg

SEQ ID NO: 3173684 - RNA, 23 nt, Mycobacterium bovis subsp bovis AF2122/97
accacgagcguagcgaccucgcc

SEQ ID NO: 3173685 - RNA, 14 nt, Mycobacterium bovis subsp bovis AF2122/97
accacgaggcuugc

SEQ ID NO: 3173686 - RNA, 17 nt, Mycobacterium bovis subsp bovis AF2122/97
accacgaggcuugcggc

SEQ ID NO: 3173687 - RNA, 21 nt, Mycobacterium bovis subsp bovis AF2122/97
accagcaaccaccccagggca

SEQ ID NO: 3173688 - RNA, 19 nt, Mycobacterium bovis subsp bovis AF2122/97
accagcaacgacaaaccgg

SEQ ID NO: 3173689 - RNA, 22 nt, Mycobacterium bovis subsp bovis AF2122/97
accagcaccaaaagcccgguac

SEQ ID NO: 3173690 - RNA, 17 nt, Mycobacterium bovis subsp bovis AF2122/97
accagcaccgccgcgcc

SEQ ID NO: 3173691 - RNA, 14 nt, Mycobacterium bovis subsp bovis AF2122/97
accagcacggcaac

SEQ ID NO: 3173692 - RNA, 20 nt, Mycobacterium bovis subsp bovis AF2122/97
accagcacggcaaccagcga

SEQ ID NO: 3173693 - RNA, 22 nt, Mycobacterium bovis subsp bovis AF2122/97
accagcagauugucgacgguca

SEQ ID NO: 3173694 - RNA, 10 nt, Mycobacterium bovis subsp bovis AF2122/97
accagcagca

SEQ ID NO: 3173695 - RNA, 13 nt, Mycobacterium bovis subsp bovis AF2122/97
accagcagcacca

SEQ ID NO: 3173696 - RNA, 19 nt, Mycobacterium bovis subsp bovis AF2122/97
accagcagcacuccggcga

SEQ ID NO: 3173697 - RNA, 13 nt, Mycobacterium bovis subsp bovis AF2122/97
accagcagcucgu

SEQ ID NO: 3173698 - RNA, 22 nt, Mycobacterium bovis subsp bovis AF2122/97
accagcaggccgggcgcaagca

SEQ ID NO: 3173699 - RNA, 14 nt, Mycobacterium bovis subsp bovis AF2122/97
accagcaggcggcu

SEQ ID NO: 3173700 - RNA, 18 nt, Mycobacterium bovis subsp bovis AF2122/97
accagcaugccugcgaaa

SEQ ID NO: 3173701 - RNA, 19 nt, Mycobacterium bovis subsp bovis AF2122/97
accagcauggcuuuugcgc

SEQ ID NO: 3173702 - RNA, 16 nt, Mycobacterium bovis subsp bovis AF2122/97
accagccaaaucagcc

SEQ ID NO: 3173703 - RNA, 19 nt, Mycobacterium bovis subsp bovis AF2122/97
accagccaaaucagccagg

SEQ ID NO: 3173704 - RNA, 12 nt, Mycobacterium bovis subsp bovis AF2122/97
accagccaccac

SEQ ID NO: 3173705 - RNA, 15 nt, Mycobacterium bovis subsp bovis AF2122/97
accagccaccaccag

SEQ ID NO: 3173706 - RNA, 12 nt, Mycobacterium bovis subsp bovis AF2122/97
accagccagccu

SEQ ID NO: 3173707 - RNA, 14 nt, Mycobacterium bovis subsp bovis AF2122/97
accagccagccugc

SEQ ID NO: 3173708 - RNA, 19 nt, Mycobacterium bovis subsp bovis AF2122/97
accagccagccugcuggcc

SEQ ID NO: 3173709 - RNA, 16 nt, Mycobacterium bovis subsp bovis AF2122/97
accagcccaccggcgc

SEQ ID NO: 3173710 - RNA, 17 nt, Mycobacterium bovis subsp bovis AF2122/97
accagcccaccggcgcc

SEQ ID NO: 3173711 - RNA, 15 nt, Mycobacterium bovis subsp bovis AF2122/97
accagccccaacccu

SEQ ID NO: 3173712 - RNA, 17 nt, Mycobacterium bovis subsp bovis AF2122/97
accagcccgaugauccc

SEQ ID NO: 3173713 - RNA, 14 nt, Mycobacterium bovis subsp bovis AF2122/97
accagcccggccgc

SEQ ID NO: 3173714 - RNA, 17 nt, Mycobacterium bovis subsp bovis AF2122/97
accagcccggccggucg

SEQ ID NO: 3173715 - RNA, 22 nt, Mycobacterium bovis subsp bovis AF2122/97
accagcccggcggcggucacca

SEQ ID NO: 3173716 - RNA, 22 nt, Mycobacterium bovis subsp bovis AF2122/97
accagccgaucaucaccggcau

SEQ ID NO: 3173717 - RNA, 12 nt, Mycobacterium bovis subsp bovis AF2122/97
accagccgcccc

SEQ ID NO: 3173718 - RNA, 14 nt, Mycobacterium bovis subsp bovis AF2122/97
accagccgccccgg

SEQ ID NO: 3173719 - RNA, 18 nt, Mycobacterium bovis subsp bovis AF2122/97
accagccgcggaucaucc

SEQ ID NO: 3173720 - RNA, 17 nt, Mycobacterium bovis subsp bovis AF2122/97
accagccgguccagcag

SEQ ID NO: 3173721 - RNA, 19 nt, Mycobacterium bovis subsp bovis AF2122/97
accagccggucgucgcgca

SEQ ID NO: 3173722 - RNA, 22 nt, Mycobacterium bovis subsp bovis AF2122/97
accagccggucuuggacagcag

SEQ ID NO: 3173723 - RNA, 20 nt, Mycobacterium bovis subsp bovis AF2122/97
accagccucgaggguuucca

SEQ ID NO: 3173724 - RNA, 17 nt, Mycobacterium bovis subsp bovis AF2122/97
accagccuuuccggccg

SEQ ID NO: 3173725 - RNA, 22 nt, Mycobacterium bovis subsp bovis AF2122/97
accagcgaaaugcccaucacca

SEQ ID NO: 3173726 - RNA, 17 nt, Mycobacterium bovis subsp bovis AF2122/97
accagcgaauccagccg

SEQ ID NO: 3173727 - RNA, 17 nt, Mycobacterium bovis subsp bovis AF2122/97
accagcgaccaggucgc

SEQ ID NO: 3173728 - RNA, 14 nt, Mycobacterium bovis subsp bovis AF2122/97
accagcgacgacca

SEQ ID NO: 3173729 - RNA, 18 nt, Mycobacterium bovis subsp bovis AF2122/97
accagcgagcccagcugc

SEQ ID NO: 3173730 - RNA, 17 nt, Mycobacterium bovis subsp bovis AF2122/97
accagcgaggccagcgg

SEQ ID NO: 3173731 - RNA, 16 nt, Mycobacterium bovis subsp bovis AF2122/97
accagcgcaucggcca

SEQ ID NO: 3173732 - RNA, 12 nt, Mycobacterium bovis subsp bovis AF2122/97
accagcgccacg

SEQ ID NO: 3173733 - RNA, 14 nt, Mycobacterium bovis subsp bovis AF2122/97
accagcgccccggc

SEQ ID NO: 3173734 - RNA, 17 nt, Mycobacterium bovis subsp bovis AF2122/97
accagcgccccggcgcg

SEQ ID NO: 3173735 - RNA, 18 nt, Mycobacterium bovis subsp bovis AF2122/97
accagcgccccggcgcgu

SEQ ID NO: 3173736 - RNA, 13 nt, Mycobacterium bovis subsp bovis AF2122/97
accagcgcccggc

SEQ ID NO: 3173737 - RNA, 14 nt, Mycobacterium bovis subsp bovis AF2122/97
accagcgcccggcc

SEQ ID NO: 3173738 - RNA, 15 nt, Mycobacterium bovis subsp bovis AF2122/97
accagcgcccggccc

SEQ ID NO: 3173739 - RNA, 18 nt, Mycobacterium bovis subsp bovis AF2122/97
accagcgcccggcccgcc

SEQ ID NO: 3173740 - RNA, 19 nt, Mycobacterium bovis subsp bovis AF2122/97
accagcgcccggcccgcca

SEQ ID NO: 3173741 - RNA, 15 nt, Mycobacterium bovis subsp bovis AF2122/97
accagcgcccgucgc

SEQ ID NO: 3173742 - RNA, 19 nt, Mycobacterium bovis subsp bovis AF2122/97
accagcgccgauaccagcc

SEQ ID NO: 3173743 - RNA, 18 nt, Mycobacterium bovis subsp bovis AF2122/97
accagcgccgcacccgcu

SEQ ID NO: 3173744 - RNA, 22 nt, Mycobacterium bovis subsp bovis AF2122/97
accagcgccuugaccagcagcu

SEQ ID NO: 3173745 - RNA, 17 nt, Mycobacterium bovis subsp bovis AF2122/97
accagcgccuugacgcc

SEQ ID NO: 3173746 - RNA, 16 nt, Mycobacterium bovis subsp bovis AF2122/97
accagcgcgagcccga

SEQ ID NO: 3173747 - RNA, 15 nt, Mycobacterium bovis subsp bovis AF2122/97
accagcgcguugcgg

SEQ ID NO: 3173748 - RNA, 16 nt, Mycobacterium bovis subsp bovis AF2122/97
accagcgcuccagcac

SEQ ID NO: 3173749 - RNA, 17 nt, Mycobacterium bovis subsp bovis AF2122/97
accagcggcacaucaug

SEQ ID NO: 3173750 - RNA, 14 nt, Mycobacterium bovis subsp bovis AF2122/97
accagcggcaccgc

SEQ ID NO: 3173751 - RNA, 15 nt, Mycobacterium bovis subsp bovis AF2122/97
accagcggcaccgcg

SEQ ID NO: 3173752 - RNA, 19 nt, Mycobacterium bovis subsp bovis AF2122/97
accagcggcaccgcgccgg

SEQ ID NO: 3173753 - RNA, 20 nt, Mycobacterium bovis subsp bovis AF2122/97
accagcggccgaccgcgacc

SEQ ID NO: 3173754 - RNA, 14 nt, Mycobacterium bovis subsp bovis AF2122/97
accagcggcggcaa

SEQ ID NO: 3173755 - RNA, 13 nt, Mycobacterium bovis subsp bovis AF2122/97
accagcggcggcc

SEQ ID NO: 3173756 - RNA, 14 nt, Mycobacterium bovis subsp bovis AF2122/97
accagcggcggccc

SEQ ID NO: 3173757 - RNA, 15 nt, Mycobacterium bovis subsp bovis AF2122/97
accagcggcggcccu

SEQ ID NO: 3173758 - RNA, 20 nt, Mycobacterium bovis subsp bovis AF2122/97
accagcggcggcggcggcaa

SEQ ID NO: 3173759 - RNA, 23 nt, Mycobacterium bovis subsp bovis AF2122/97
accagcggcggcggcggcaagug

SEQ ID NO: 3173760 - RNA, 18 nt, Mycobacterium bovis subsp bovis AF2122/97
accagcggcugaccgggc

SEQ ID NO: 3173761 - RNA, 15 nt, Mycobacterium bovis subsp bovis AF2122/97
accagcgggcaucgc

SEQ ID NO: 3173762 - RNA, 17 nt, Mycobacterium bovis subsp bovis AF2122/97
accagcgggcaucgcga

SEQ ID NO: 3173763 - RNA, 17 nt, Mycobacterium bovis subsp bovis AF2122/97
accagcggucagccggc

SEQ ID NO: 3173764 - RNA, 18 nt, Mycobacterium bovis subsp bovis AF2122/97
accagcggucagccggcc

SEQ ID NO: 3173765 - RNA, 23 nt, Mycobacterium bovis subsp bovis AF2122/97
accagcggucggcgaccaccagc

SEQ ID NO: 3173766 - RNA, 20 nt, Mycobacterium bovis subsp bovis AF2122/97
accagcguaucggccggcag

SEQ ID NO: 3173767 - RNA, 23 nt, Mycobacterium bovis subsp bovis AF2122/97
accagcguaucggccggcagauu

SEQ ID NO: 3173768 - RNA, 14 nt, Mycobacterium bovis subsp bovis AF2122/97
accagcgucgcacg

SEQ ID NO: 3173769 - RNA, 15 nt, Mycobacterium bovis subsp bovis AF2122/97
accagcgucgcacgc

SEQ ID NO: 3173770 - RNA, 17 nt, Mycobacterium bovis subsp bovis AF2122/97
accagcgucgcacgcgc

SEQ ID NO: 3173771 - RNA, 18 nt, Mycobacterium bovis subsp bovis AF2122/97
accagcgucgcacgcgcg

SEQ ID NO: 3173772 - RNA, 16 nt, Mycobacterium bovis subsp bovis AF2122/97
accagcgucgcggcca

SEQ ID NO: 3173773 - RNA, 18 nt, Mycobacterium bovis subsp bovis AF2122/97
accagcguggggccgcca

SEQ ID NO: 3173774 - RNA, 22 nt, Mycobacterium bovis subsp bovis AF2122/97
accaucccugaaauaccagucc

SEQ ID NO: 3173775 - RNA, 20 nt, Mycobacterium bovis subsp bovis AF2122/97
accauccgaguugucgccgg

SEQ ID NO: 3173776 - RNA, 23 nt, Mycobacterium bovis subsp bovis AF2122/97
accauccgggcaaccgaugacgc

SEQ ID NO: 3173777 - RNA, 15 nt, Mycobacterium bovis subsp bovis AF2122/97
accauccggucccgc

SEQ ID NO: 3173778 - RNA, 15 nt, Mycobacterium bovis subsp bovis AF2122/97
accaucgccaggccc

SEQ ID NO: 3173779 - RNA, 18 nt, Mycobacterium bovis subsp bovis AF2122/97
accaucgccgccgcgcgu

SEQ ID NO: 3173780 - RNA, 20 nt, Mycobacterium bovis subsp bovis AF2122/97
accaucgccucggcgcugcg

SEQ ID NO: 3173781 - RNA, 17 nt, Mycobacterium bovis subsp bovis AF2122/97
accaucgcggccgcugg

SEQ ID NO: 3173782 - RNA, 21 nt, Mycobacterium bovis subsp bovis AF2122/97
accaucgcggccgcugggccc

SEQ ID NO: 3173783 - RNA, 21 nt, Mycobacterium bovis subsp bovis AF2122/97
accaucgguaucgagggcagc

SEQ ID NO: 3173784 - RNA, 21 nt, Mycobacterium bovis subsp bovis AF2122/97
accaucguugccggugccgcc

SEQ ID NO: 3173785 - RNA, 23 nt, Mycobacterium bovis subsp bovis AF2122/97
accaucuccgccgucgccaccgg

SEQ ID NO: 3173786 - RNA, 23 nt, Mycobacterium bovis subsp bovis AF2122/97
accaucuccggugugaucggcgg

SEQ ID NO: 3173787 - RNA, 15 nt, Mycobacterium bovis subsp bovis AF2122/97
accaucugaucgggc

SEQ ID NO: 3173788 - RNA, 20 nt, Mycobacterium bovis subsp bovis AF2122/97
accaucugaucgggcccguc

SEQ ID NO: 3173789 - RNA, 22 nt, Mycobacterium bovis subsp bovis AF2122/97
accaucugcuguggaucgacac

SEQ ID NO: 3173790 - RNA, 12 nt, Mycobacterium bovis subsp bovis AF2122/97
accaugaagaac

SEQ ID NO: 3173791 - RNA, 20 nt, Mycobacterium bovis subsp bovis AF2122/97
accaugaagaacuggcugcu

SEQ ID NO: 3173792 - RNA, 11 nt, Mycobacterium bovis subsp bovis AF2122/97
accaugaccac

SEQ ID NO: 3173793 - RNA, 17 nt, Mycobacterium bovis subsp bovis AF2122/97
accaugaccaccaaggu

SEQ ID NO: 3173794 - RNA, 14 nt, Mycobacterium bovis subsp bovis AF2122/97
accaugagccggcg

SEQ ID NO: 3173795 - RNA, 17 nt, Mycobacterium bovis subsp bovis AF2122/97
accaugagccggcgccg

SEQ ID NO: 3173796 - RNA, 16 nt, Mycobacterium bovis subsp bovis AF2122/97
accaugaucacaccga

SEQ ID NO: 3173797 - RNA, 18 nt, Mycobacterium bovis subsp bovis AF2122/97
accaugaugccuaccggg

SEQ ID NO: 3173798 - RNA, 20 nt, Mycobacterium bovis subsp bovis AF2122/97
accaugauguagcggcguuc

SEQ ID NO: 3173799 - RNA, 23 nt, Mycobacterium bovis subsp bovis AF2122/97
accaugauugccaggaccgcgcc

SEQ ID NO: 3173800 - RNA, 19 nt, Mycobacterium bovis subsp bovis AF2122/97
accaugccgucgucggcgu

SEQ ID NO: 3173801 - RNA, 15 nt, Mycobacterium bovis subsp bovis AF2122/97
accaugcgaccggca

SEQ ID NO: 3173802 - RNA, 18 nt, Mycobacterium bovis subsp bovis AF2122/97
accaugcgcagaguauuc

SEQ ID NO: 3173803 - RNA, 18 nt, Mycobacterium bovis subsp bovis AF2122/97
accauggcgccgcgccga

SEQ ID NO: 3173804 - RNA, 20 nt, Mycobacterium bovis subsp bovis AF2122/97
accaugguagcgccccgaug

SEQ ID NO: 3173805 - RNA, 20 nt, Mycobacterium bovis subsp bovis AF2122/97
accaugguugaugacggcgu

SEQ ID NO: 3173806 - RNA, 20 nt, Mycobacterium bovis subsp bovis AF2122/97
accaugucggccacccggac

SEQ ID NO: 3173807 - RNA, 17 nt, Mycobacterium bovis subsp bovis AF2122/97
accauguuaacgcgcgu

SEQ ID NO: 3173808 - RNA, 23 nt, Mycobacterium bovis subsp bovis AF2122/97
accauucccggacccaccaaucc

SEQ ID NO: 3173809 - RNA, 20 nt, Mycobacterium bovis subsp bovis AF2122/97
accauucgcgggccgaggcc

SEQ ID NO: 3173810 - RNA, 13 nt, Mycobacterium bovis subsp bovis AF2122/97
accauugcccgac

SEQ ID NO: 3173811 - RNA, 20 nt, Mycobacterium bovis subsp bovis AF2122/97
accauuguuccguccccgac

SEQ ID NO: 3173812 - RNA, 21 nt, Mycobacterium bovis subsp bovis AF2122/97
accauuguuccguccccgacg

SEQ ID NO: 3173813 - RNA, 24 nt, Mycobacterium bovis subsp bovis AF2122/97
acccaacaaaaggccauccgauca

SEQ ID NO: 3173814 - RNA, 15 nt, Mycobacterium bovis subsp bovis AF2122/97
acccaacaccagcag

SEQ ID NO: 3173815 - RNA, 14 nt, Mycobacterium bovis subsp bovis AF2122/97
acccaacacccaga

SEQ ID NO: 3173816 - RNA, 22 nt, Mycobacterium bovis subsp bovis AF2122/97
acccaacagcccaccggugccg

SEQ ID NO: 3173817 - RNA, 15 nt, Mycobacterium bovis subsp bovis AF2122/97
acccaaccccgccgg

SEQ ID NO: 3173818 - RNA, 18 nt, Mycobacterium bovis subsp bovis AF2122/97
acccaaccccgccggccg

SEQ ID NO: 3173819 - RNA, 19 nt, Mycobacterium bovis subsp bovis AF2122/97
acccaacucaugggccaac

SEQ ID NO: 3173820 - RNA, 18 nt, Mycobacterium bovis subsp bovis AF2122/97
acccaacuccaucagcgc

SEQ ID NO: 3173821 - RNA, 17 nt, Mycobacterium bovis subsp bovis AF2122/97
acccaagaauucaccac

SEQ ID NO: 3173822 - RNA, 16 nt, Mycobacterium bovis subsp bovis AF2122/97
acccaagucgccgagg

SEQ ID NO: 3173823 - RNA, 14 nt, Mycobacterium bovis subsp bovis AF2122/97
acccaauaggcgaa

SEQ ID NO: 3173824 - RNA, 18 nt, Mycobacterium bovis subsp bovis AF2122/97
acccaaugccaccgcggc

SEQ ID NO: 3173825 - RNA, 16 nt, Mycobacterium bovis subsp bovis AF2122/97
acccacacccagcgug

SEQ ID NO: 3173826 - RNA, 20 nt, Mycobacterium bovis subsp bovis AF2122/97
acccacagucgccggccggc

SEQ ID NO: 3173827 - RNA, 16 nt, Mycobacterium bovis subsp bovis AF2122/97
acccacauaccggcgc

SEQ ID NO: 3173828 - RNA, 18 nt, Mycobacterium bovis subsp bovis AF2122/97
acccacaucagccgcacc

SEQ ID NO: 3173829 - RNA, 17 nt, Mycobacterium bovis subsp bovis AF2122/97
acccacaugacgaucgc

SEQ ID NO: 3173830 - RNA, 18 nt, Mycobacterium bovis subsp bovis AF2122/97
acccacauggcggcccgg

SEQ ID NO: 3173831 - RNA, 14 nt, Mycobacterium bovis subsp bovis AF2122/97
acccaccaauccac

SEQ ID NO: 3173832 - RNA, 17 nt, Mycobacterium bovis subsp bovis AF2122/97
acccaccaauccacaga

SEQ ID NO: 3173833 - RNA, 14 nt, Mycobacterium bovis subsp bovis AF2122/97
acccaccacaggac

SEQ ID NO: 3173834 - RNA, 20 nt, Mycobacterium bovis subsp bovis AF2122/97
acccaccagugcaucgauca

SEQ ID NO: 3173835 - RNA, 13 nt, Mycobacterium bovis subsp bovis AF2122/97
acccaccccccag

SEQ ID NO: 3173836 - RNA, 21 nt, Mycobacterium bovis subsp bovis AF2122/97
acccacccgcaccgccggcaa

SEQ ID NO: 3173837 - RNA, 16 nt, Mycobacterium bovis subsp bovis AF2122/97
acccaccgaaccgagg

SEQ ID NO: 3173838 - RNA, 17 nt, Mycobacterium bovis subsp bovis AF2122/97
acccaccgaagcgaacg

SEQ ID NO: 3173839 - RNA, 17 nt, Mycobacterium bovis subsp bovis AF2122/97
acccaccggaccaccgc

SEQ ID NO: 3173840 - RNA, 13 nt, Mycobacterium bovis subsp bovis AF2122/97
acccaccgugccg

SEQ ID NO: 3173841 - RNA, 14 nt, Mycobacterium bovis subsp bovis AF2122/97
acccaccgugccgg

SEQ ID NO: 3173842 - RNA, 17 nt, Mycobacterium bovis subsp bovis AF2122/97
acccaccgugccgggcg

SEQ ID NO: 3173843 - RNA, 19 nt, Mycobacterium bovis subsp bovis AF2122/97
acccaccucccgcagccgg

SEQ ID NO: 3173844 - RNA, 21 nt, Mycobacterium bovis subsp bovis AF2122/97
acccaccucguauacccgggc

SEQ ID NO: 3173845 - RNA, 23 nt, Mycobacterium bovis subsp bovis AF2122/97
acccacgagagcgcugucccgaa

SEQ ID NO: 3173846 - RNA, 14 nt, Mycobacterium bovis subsp bovis AF2122/97
acccacgccgacua

SEQ ID NO: 3173847 - RNA, 15 nt, Mycobacterium bovis subsp bovis AF2122/97
acccacgucgagcag

SEQ ID NO: 3173848 - RNA, 15 nt, Mycobacterium bovis subsp bovis AF2122/97
acccacugcacggag

SEQ ID NO: 3173849 - RNA, 22 nt, Mycobacterium bovis subsp bovis AF2122/97
acccacugcacggagccgccgg

SEQ ID NO: 3173850 - RNA, 13 nt, Mycobacterium bovis subsp bovis AF2122/97
acccacugcaggc

SEQ ID NO: 3173851 - RNA, 20 nt, Mycobacterium bovis subsp bovis AF2122/97
acccacuuuucgguggcggc

SEQ ID NO: 3173852 - RNA, 17 nt, Mycobacterium bovis subsp bovis AF2122/97
acccagaaugacaucgu

SEQ ID NO: 3173853 - RNA, 22 nt, Mycobacterium bovis subsp bovis AF2122/97
acccagaaugacaucgucgcca

SEQ ID NO: 3173854 - RNA, 17 nt, Mycobacterium bovis subsp bovis AF2122/97
acccagaauuccggcgg

SEQ ID NO: 3173855 - RNA, 13 nt, Mycobacterium bovis subsp bovis AF2122/97
acccagaccgccg

SEQ ID NO: 3173856 - RNA, 14 nt, Mycobacterium bovis subsp bovis AF2122/97
acccagaccggcuc

SEQ ID NO: 3173857 - RNA, 13 nt, Mycobacterium bovis subsp bovis AF2122/97
acccagcaccaca

SEQ ID NO: 3173858 - RNA, 21 nt, Mycobacterium bovis subsp bovis AF2122/97
acccagcaccacaacgucggc

SEQ ID NO: 3173859 - RNA, 22 nt, Mycobacterium bovis subsp bovis AF2122/97
acccagcaccacaacgucggca

SEQ ID NO: 3173860 - RNA, 19 nt, Mycobacterium bovis subsp bovis AF2122/97
accccccgaccccgacggc

SEQ ID NO: 3173861 - RNA, 15 nt, Mycobacterium bovis subsp bovis AF2122/97
accccccguccaccg

SEQ ID NO: 3173862 - RNA, 22 nt, Mycobacterium bovis subsp bovis AF2122/97
acccccgacgagauacggccac

SEQ ID NO: 3173863 - RNA, 15 nt, Mycobacterium bovis subsp bovis AF2122/97
acccccgagauccgu

SEQ ID NO: 3173864 - RNA, 21 nt, Mycobacterium bovis subsp bovis AF2122/97
acccccgauagcgaccgcggc

SEQ ID NO: 3173865 - RNA, 17 nt, Mycobacterium bovis subsp bovis AF2122/97
acccccgauggcgucgc

SEQ ID NO: 3173866 - RNA, 18 nt, Mycobacterium bovis subsp bovis AF2122/97
acccccgauggcgucgcc

SEQ ID NO: 3173867 - RNA, 20 nt, Mycobacterium bovis subsp bovis AF2122/97
acccccgauggcgucgccgg

SEQ ID NO: 3173868 - RNA, 23 nt, Mycobacterium bovis subsp bovis AF2122/97
acccccgauggcgucgccggccc

SEQ ID NO: 3173869 - RNA, 14 nt, Mycobacterium bovis subsp bovis AF2122/97
acccccgccgcgca

SEQ ID NO: 3173870 - RNA, 22 nt, Mycobacterium bovis subsp bovis AF2122/97
acccccggcauuccguaggcca

SEQ ID NO: 3173871 - RNA, 22 nt, Mycobacterium bovis subsp bovis AF2122/97
acccccggccagcgucaacagc

SEQ ID NO: 3173872 - RNA, 17 nt, Mycobacterium bovis subsp bovis AF2122/97
acccccggggcgcucgc

SEQ ID NO: 3173873 - RNA, 20 nt, Mycobacterium bovis subsp bovis AF2122/97
acccccgucgaucagcggca

SEQ ID NO: 3173874 - RNA, 16 nt, Mycobacterium bovis subsp bovis AF2122/97
acccccgucgccaccg

SEQ ID NO: 3173875 - RNA, 18 nt, Mycobacterium bovis subsp bovis AF2122/97
acccccgucgccaccgau

SEQ ID NO: 3173876 - RNA, 18 nt, Mycobacterium bovis subsp bovis AF2122/97
acccccuccgcgaugccg

SEQ ID NO: 3173877 - RNA, 21 nt, Mycobacterium bovis subsp bovis AF2122/97
acccccucggcuucggagccg

SEQ ID NO: 3173878 - RNA, 19 nt, Mycobacterium bovis subsp bovis AF2122/97
acccccuuuacacccccaa

SEQ ID NO: 3173879 - RNA, 20 nt, Mycobacterium bovis subsp bovis AF2122/97
accccgaacauugcgcccag

SEQ ID NO: 3173880 - RNA, 19 nt, Mycobacterium bovis subsp bovis AF2122/97
accccgaagaccuggccug

SEQ ID NO: 3173881 - RNA, 15 nt, Mycobacterium bovis subsp bovis AF2122/97
accccgaagaugccu

SEQ ID NO: 3173882 - RNA, 20 nt, Mycobacterium bovis subsp bovis AF2122/97
accccgaagcucaucaccgg

SEQ ID NO: 3173883 - RNA, 17 nt, Mycobacterium bovis subsp bovis AF2122/97
accccgaauagucggca

SEQ ID NO: 3173884 - RNA, 18 nt, Mycobacterium bovis subsp bovis AF2122/97
accccgaauagucggcau

SEQ ID NO: 3173885 - RNA, 19 nt, Mycobacterium bovis subsp bovis AF2122/97
accccgaauagucggcauc

SEQ ID NO: 3173886 - RNA, 20 nt, Mycobacterium bovis subsp bovis AF2122/97
accccgaauagucggcaucg

SEQ ID NO: 3173887 - RNA, 21 nt, Mycobacterium bovis subsp bovis AF2122/97
accccgagcggagccgccgac

SEQ ID NO: 3173888 - RNA, 18 nt, Mycobacterium bovis subsp bovis AF2122/97
accccgaggcaacaagca

SEQ ID NO: 3173889 - RNA, 19 nt, Mycobacterium bovis subsp bovis AF2122/97
accccgaggcaacaagcac

SEQ ID NO: 3173890 - RNA, 16 nt, Mycobacterium bovis subsp bovis AF2122/97
accccgaggccgaccu

SEQ ID NO: 3173891 - RNA, 14 nt, Mycobacterium bovis subsp bovis AF2122/97
accccgauccgcca

SEQ ID NO: 3173892 - RNA, 23 nt, Mycobacterium bovis subsp bovis AF2122/97
accccgaucuggcguagugcucg

SEQ ID NO: 3173893 - RNA, 21 nt, Mycobacterium bovis subsp bovis AF2122/97
accccgaugccgugccgggcc

SEQ ID NO: 3173894 - RNA, 20 nt, Mycobacterium bovis subsp bovis AF2122/97
accccgauucgugucggugc

SEQ ID NO: 3173895 - RNA, 20 nt, Mycobacterium bovis subsp bovis AF2122/97
accccgcagcucaccucaug

SEQ ID NO: 3173896 - RNA, 21 nt, Mycobacterium bovis subsp bovis AF2122/97
accccgcagcucaccucauga

SEQ ID NO: 3173897 - RNA, 13 nt, Mycobacterium bovis subsp bovis AF2122/97
accccgccagccg

SEQ ID NO: 3173898 - RNA, 18 nt, Mycobacterium bovis subsp bovis AF2122/97
accccgccaugcggcgcg

SEQ ID NO: 3173899 - RNA, 15 nt, Mycobacterium bovis subsp bovis AF2122/97
accccgccgaacggc

SEQ ID NO: 3173900 - RNA, 22 nt, Mycobacterium bovis subsp bovis AF2122/97
accccgccgagcgguugccuuc

SEQ ID NO: 3173901 - RNA, 23 nt, Mycobacterium bovis subsp bovis AF2122/97
accccgccgagcgguugccuucu

SEQ ID NO: 3173902 - RNA, 14 nt, Mycobacterium bovis subsp bovis AF2122/97
accccgccggccgg

SEQ ID NO: 3173903 - RNA, 23 nt, Mycobacterium bovis subsp bovis AF2122/97
accccgccggcugcggaggcggg

SEQ ID NO: 3173904 - RNA, 12 nt, Mycobacterium bovis subsp bovis AF2122/97
accccgccgggg

SEQ ID NO: 3173905 - RNA, 18 nt, Mycobacterium bovis subsp bovis AF2122/97
accccgcgcggugcccug

SEQ ID NO: 3173906 - RNA, 19 nt, Mycobacterium bovis subsp bovis AF2122/97
accccgcgcggugcccugc

SEQ ID NO: 3173907 - RNA, 16 nt, Mycobacterium bovis subsp bovis AF2122/97
accccgcguaugccag

SEQ ID NO: 3173908 - RNA, 17 nt, Mycobacterium bovis subsp bovis AF2122/97
accccgcgugaccgacu

SEQ ID NO: 3173909 - RNA, 23 nt, Mycobacterium bovis subsp bovis AF2122/97
accccggaauccccaagcccgau

SEQ ID NO: 3173910 - RNA, 12 nt, Mycobacterium bovis subsp bovis AF2122/97
accccggccacc

SEQ ID NO: 3173911 - RNA, 15 nt, Mycobacterium bovis subsp bovis AF2122/97
accccggccaccagc

SEQ ID NO: 3173912 - RNA, 12 nt, Mycobacterium bovis subsp bovis AF2122/97
accccggccacu

SEQ ID NO: 3173913 - RNA, 12 nt, Mycobacterium bovis subsp bovis AF2122/97
accccggccagg

SEQ ID NO: 3173914 - RNA, 16 nt, Mycobacterium bovis subsp bovis AF2122/97
accccggccggcuagc

SEQ ID NO: 3173915 - RNA, 14 nt, Mycobacterium bovis subsp bovis AF2122/97
accccggccuugcc

SEQ ID NO: 3173916 - RNA, 19 nt, Mycobacterium bovis subsp bovis AF2122/97
accccggccuugccaccgg

SEQ ID NO: 3173917 - RNA, 21 nt, Mycobacterium bovis subsp bovis AF2122/97
accccggccuugccaccggua

SEQ ID NO: 3173918 - RNA, 20 nt, Mycobacterium bovis subsp bovis AF2122/97
accccggccuuggcggcggc

SEQ ID NO: 3173919 - RNA, 21 nt, Mycobacterium bovis subsp bovis AF2122/97
accccggccuuggcggcggca

SEQ ID NO: 3173920 - RNA, 14 nt, Mycobacterium bovis subsp bovis AF2122/97
accccggcggccau

SEQ ID NO: 3173921 - RNA, 15 nt, Mycobacterium bovis subsp bovis AF2122/97
accccggcggccauc

SEQ ID NO: 3173922 - RNA, 16 nt, Mycobacterium bovis subsp bovis AF2122/97
accccggcgguaccgc

SEQ ID NO: 3173923 - RNA, 18 nt, Mycobacterium bovis subsp bovis AF2122/97
accccggcgguaccgccg

SEQ ID NO: 3173924 - RNA, 20 nt, Mycobacterium bovis subsp bovis AF2122/97
accccggcucgacgcgucgc

SEQ ID NO: 3173925 - RNA, 13 nt, Mycobacterium bovis subsp bovis AF2122/97
accccggcucggc

SEQ ID NO: 3173926 - RNA, 18 nt, Mycobacterium bovis subsp bovis AF2122/97
accccggcucggccaccg

SEQ ID NO: 3173927 - RNA, 19 nt, Mycobacterium bovis subsp bovis AF2122/97
accccggcucggccaccga

SEQ ID NO: 3173928 - RNA, 13 nt, Mycobacterium bovis subsp bovis AF2122/97
accccggcugcgc

SEQ ID NO: 3173929 - RNA, 17 nt, Mycobacterium bovis subsp bovis AF2122/97
accccggucccgccgac

SEQ ID NO: 3173930 - RNA, 17 nt, Mycobacterium bovis subsp bovis AF2122/97
accccggucggagcggu

SEQ ID NO: 3173931 - RNA, 16 nt, Mycobacterium bovis subsp bovis AF2122/97
accccggucggcccgc

SEQ ID NO: 3173932 - RNA, 12 nt, Mycobacterium bovis subsp bovis AF2122/97
accccggugccc

SEQ ID NO: 3173933 - RNA, 13 nt, Mycobacterium bovis subsp bovis AF2122/97
accccgguggaca

SEQ ID NO: 3173934 - RNA, 21 nt, Mycobacterium bovis subsp bovis AF2122/97
accccgguugacucgcuccga

SEQ ID NO: 3173935 - RNA, 21 nt, Mycobacterium bovis subsp bovis AF2122/97
accccguagcggucuccccag

SEQ ID NO: 3173936 - RNA, 23 nt, Mycobacterium bovis subsp bovis AF2122/97
accccgucagcgggcagcaggcg

SEQ ID NO: 3173937 - RNA, 19 nt, Mycobacterium bovis subsp bovis AF2122/97
accccguuccacgaucacc

SEQ ID NO: 3173938 - RNA, 19 nt, Mycobacterium bovis subsp bovis AF2122/97
accccuagaugccgguauc

SEQ ID NO: 3173939 - RNA, 15 nt, Mycobacterium bovis subsp bovis AF2122/97
accccuccgaucacg

SEQ ID NO: 3173940 - RNA, 17 nt, Mycobacterium bovis subsp bovis AF2122/97
accccugcacggugccc

SEQ ID NO: 3173941 - RNA, 15 nt, Mycobacterium bovis subsp bovis AF2122/97
accccuggccgccgg

SEQ ID NO: 3173942 - RNA, 22 nt, Mycobacterium bovis subsp bovis AF2122/97
accccuggccgccggcgccgcc

SEQ ID NO: 3173943 - RNA, 12 nt, Mycobacterium bovis subsp bovis AF2122/97
accccuggcgau

SEQ ID NO: 3173944 - RNA, 14 nt, Mycobacterium bovis subsp bovis AF2122/97
accccuucgccagc

SEQ ID NO: 3173945 - RNA, 17 nt, Mycobacterium bovis subsp bovis AF2122/97
accccuucgccagcgcc

SEQ ID NO: 3173946 - RNA, 22 nt, Mycobacterium bovis subsp bovis AF2122/97
acccgcggcgaaccgucucgcc

SEQ ID NO: 3173947 - RNA, 22 nt, Mycobacterium bovis subsp bovis AF2122/97
acccgcggggaaucacccacuc

SEQ ID NO: 3173948 - RNA, 20 nt, Mycobacterium bovis subsp bovis AF2122/97
acccgcgggucguccggcgg

SEQ ID NO: 3173949 - RNA, 19 nt, Mycobacterium bovis subsp bovis AF2122/97
acccgcgggugauguucgu

SEQ ID NO: 3173950 - RNA, 16 nt, Mycobacterium bovis subsp bovis AF2122/97
acccgcgguagcggac

SEQ ID NO: 3173951 - RNA, 22 nt, Mycobacterium bovis subsp bovis AF2122/97
acccgcggugccugcagcuugg

SEQ ID NO: 3173952 - RNA, 14 nt, Mycobacterium bovis subsp bovis AF2122/97
acccgcgucgagug

SEQ ID NO: 3173953 - RNA, 17 nt, Mycobacterium bovis subsp bovis AF2122/97
acccgcgucgagugccg

SEQ ID NO: 3173954 - RNA, 17 nt, Mycobacterium bovis subsp bovis AF2122/97
acccgcguugaaggcgc

SEQ ID NO: 3173955 - RNA, 17 nt, Mycobacterium bovis subsp bovis AF2122/97
acccgcucacgcucacc

SEQ ID NO: 3173956 - RNA, 14 nt, Mycobacterium bovis subsp bovis AF2122/97
acccgcuccacccc

SEQ ID NO: 3173957 - RNA, 16 nt, Mycobacterium bovis subsp bovis AF2122/97
acccgcuccagcucgg

SEQ ID NO: 3173958 - RNA, 17 nt, Mycobacterium bovis subsp bovis AF2122/97
acccgcuccagcucggc

SEQ ID NO: 3173959 - RNA, 18 nt, Mycobacterium bovis subsp bovis AF2122/97
acccgcuccagcucggcg

SEQ ID NO: 3173960 - RNA, 19 nt, Mycobacterium bovis subsp bovis AF2122/97
acccgcucgcccgccgcca

SEQ ID NO: 3173961 - RNA, 13 nt, Mycobacterium bovis subsp bovis AF2122/97
acccgcucgcggc

SEQ ID NO: 3173962 - RNA, 15 nt, Mycobacterium bovis subsp bovis AF2122/97
acccgcucgcggcga

SEQ ID NO: 3173963 - RNA, 17 nt, Mycobacterium bovis subsp bovis AF2122/97
acccgcucggccgccgg

SEQ ID NO: 3173964 - RNA, 17 nt, Mycobacterium bovis subsp bovis AF2122/97
acccgcucggccgucag

SEQ ID NO: 3173965 - RNA, 14 nt, Mycobacterium bovis subsp bovis AF2122/97
acccgcucggcgcg

SEQ ID NO: 3173966 - RNA, 15 nt, Mycobacterium bovis subsp bovis AF2122/97
acccgcuggcccgcc

SEQ ID NO: 3173967 - RNA, 17 nt, Mycobacterium bovis subsp bovis AF2122/97
acccgcuggcccgccag

SEQ ID NO: 3173968 - RNA, 15 nt, Mycobacterium bovis subsp bovis AF2122/97
acccgcuggucgagc

SEQ ID NO: 3173969 - RNA, 19 nt, Mycobacterium bovis subsp bovis AF2122/97
acccgcuggucgagcagug

SEQ ID NO: 3173970 - RNA, 17 nt, Mycobacterium bovis subsp bovis AF2122/97
acccgcuggucgaugcc

SEQ ID NO: 3173971 - RNA, 13 nt, Mycobacterium bovis subsp bovis AF2122/97
acccggaaccagc

SEQ ID NO: 3173972 - RNA, 14 nt, Mycobacterium bovis subsp bovis AF2122/97
acccggaaccagcc

SEQ ID NO: 3173973 - RNA, 17 nt, Mycobacterium bovis subsp bovis AF2122/97
acccggaaccagccgcg

SEQ ID NO: 3173974 - RNA, 14 nt, Mycobacterium bovis subsp bovis AF2122/97
acccggaaucccga

SEQ ID NO: 3173975 - RNA, 18 nt, Mycobacterium bovis subsp bovis AF2122/97
acccggaaucgucgcggc

SEQ ID NO: 3173976 - RNA, 15 nt, Mycobacterium bovis subsp bovis AF2122/97
acccggacagggcgg

SEQ ID NO: 3173977 - RNA, 18 nt, Mycobacterium bovis subsp bovis AF2122/97
acccggacagggcggcga

SEQ ID NO: 3173978 - RNA, 14 nt, Mycobacterium bovis subsp bovis AF2122/97
acccggaccugggc

SEQ ID NO: 3173979 - RNA, 23 nt, Mycobacterium bovis subsp bovis AF2122/97
acccggaccugggcgacuaccgg

SEQ ID NO: 3173980 - RNA, 22 nt, Mycobacterium bovis subsp bovis AF2122/97
acccggaccuucggcggugcca

SEQ ID NO: 3173981 - RNA, 18 nt, Mycobacterium bovis subsp bovis AF2122/97
acccggagaaucgguccg

SEQ ID NO: 3173982 - RNA, 18 nt, Mycobacterium bovis subsp bovis AF2122/97
acccggagccgccaggug

SEQ ID NO: 3173983 - RNA, 15 nt, Mycobacterium bovis subsp bovis AF2122/97
acccggaggcaaucc

SEQ ID NO: 3173984 - RNA, 20 nt, Mycobacterium bovis subsp bovis AF2122/97
acccggauaucgaccaccgg

SEQ ID NO: 3173985 - RNA, 22 nt, Mycobacterium bovis subsp bovis AF2122/97
acccggaucuggugggugcggc

SEQ ID NO: 3173986 - RNA, 15 nt, Mycobacterium bovis subsp bovis AF2122/97
acccggcacccaguu

SEQ ID NO: 3173987 - RNA, 16 nt, Mycobacterium bovis subsp bovis AF2122/97
acccggcacccaguuc

SEQ ID NO: 3173988 - RNA, 17 nt, Mycobacterium bovis subsp bovis AF2122/97
acccggcagagcacgcg

SEQ ID NO: 3173989 - RNA, 16 nt, Mycobacterium bovis subsp bovis AF2122/97
acccggcagcccggcg

SEQ ID NO: 3173990 - RNA, 19 nt, Mycobacterium bovis subsp bovis AF2122/97
acccggcagcccggcggcc

SEQ ID NO: 3173991 - RNA, 11 nt, Mycobacterium bovis subsp bovis AF2122/97
acccggccagc

SEQ ID NO: 3173992 - RNA, 17 nt, Mycobacterium bovis subsp bovis AF2122/97
acccggcccagcgcccc

SEQ ID NO: 3173993 - RNA, 22 nt, Mycobacterium bovis subsp bovis AF2122/97
acccggcccauugucgaucacc

SEQ ID NO: 3173994 - RNA, 15 nt, Mycobacterium bovis subsp bovis AF2122/97
acccggccccguccg

SEQ ID NO: 3173995 - RNA, 14 nt, Mycobacterium bovis subsp bovis AF2122/97
acccggccgccgaa

SEQ ID NO: 3173996 - RNA, 17 nt, Mycobacterium bovis subsp bovis AF2122/97
acccggccgcugacgcc

SEQ ID NO: 3173997 - RNA, 18 nt, Mycobacterium bovis subsp bovis AF2122/97
acccggccgcugacgccg

SEQ ID NO: 3173998 - RNA, 12 nt, Mycobacterium bovis subsp bovis AF2122/97
acccggccguug

SEQ ID NO: 3173999 - RNA, 22 nt, Mycobacterium bovis subsp bovis AF2122/97
acccggccguugggccaccggc

SEQ ID NO: 3174000 - RNA, 19 nt, Mycobacterium bovis subsp bovis AF2122/97
acccggccucaacacccgg

SEQ ID NO: 3174001 - RNA, 16 nt, Mycobacterium bovis subsp bovis AF2122/97
acccggcgaccacggc

SEQ ID NO: 3174002 - RNA, 19 nt, Mycobacterium bovis subsp bovis AF2122/97
acccggcgaccacggcacc

SEQ ID NO: 3174003 - RNA, 20 nt, Mycobacterium bovis subsp bovis AF2122/97
acccggcgaccacggcaccg

SEQ ID NO: 3174004 - RNA, 23 nt, Mycobacterium bovis subsp bovis AF2122/97
acccggcgagggcaacgagauuc

SEQ ID NO: 3174005 - RNA, 17 nt, Mycobacterium bovis subsp bovis AF2122/97
acccggcgaugcagccg

SEQ ID NO: 3174006 - RNA, 19 nt, Mycobacterium bovis subsp bovis AF2122/97
acccggcgcaacaaccggu

SEQ ID NO: 3174007 - RNA, 17 nt, Mycobacterium bovis subsp bovis AF2122/97
acccggcgccgucgaug

SEQ ID NO: 3174008 - RNA, 18 nt, Mycobacterium bovis subsp bovis AF2122/97
acccggcgccgucgauga

SEQ ID NO: 3174009 - RNA, 18 nt, Mycobacterium bovis subsp bovis AF2122/97
acccggcggacgacgucg

SEQ ID NO: 3174010 - RNA, 19 nt, Mycobacterium bovis subsp bovis AF2122/97
acccggcgggcccgccggc

SEQ ID NO: 3174011 - RNA, 17 nt, Mycobacterium bovis subsp bovis AF2122/97
acccggcgggcgguggg

SEQ ID NO: 3174012 - RNA, 14 nt, Mycobacterium bovis subsp bovis AF2122/97
acccggcggugccg

SEQ ID NO: 3174013 - RNA, 16 nt, Mycobacterium bovis subsp bovis AF2122/97
acccggcggugccguc

SEQ ID NO: 3174014 - RNA, 23 nt, Mycobacterium bovis subsp bovis AF2122/97
acccggcgucucgcagcaacggc

SEQ ID NO: 3174015 - RNA, 17 nt, Mycobacterium bovis subsp bovis AF2122/97
acccggcuccagcaccg

SEQ ID NO: 3174016 - RNA, 16 nt, Mycobacterium bovis subsp bovis AF2122/97
acccggcucggguggc

SEQ ID NO: 3174017 - RNA, 17 nt, Mycobacterium bovis subsp bovis AF2122/97
acccggcuguucucgcc

SEQ ID NO: 3174018 - RNA, 15 nt, Mycobacterium bovis subsp bovis AF2122/97
acccggcuucgccgc

SEQ ID NO: 3174019 - RNA, 14 nt, Mycobacterium bovis subsp bovis AF2122/97
acccgggaaggaac

SEQ ID NO: 3174020 - RNA, 15 nt, Mycobacterium bovis subsp bovis AF2122/97
acccgggaaggaacc

SEQ ID NO: 3174021 - RNA, 16 nt, Mycobacterium bovis subsp bovis AF2122/97
acccgggaaggaaccg

SEQ ID NO: 3174022 - RNA, 20 nt, Mycobacterium bovis subsp bovis AF2122/97
acccgggaaggaaccgggca

SEQ ID NO: 3174023 - RNA, 17 nt, Mycobacterium bovis subsp bovis AF2122/97
acccgggacgaaccggc

SEQ ID NO: 3174024 - RNA, 23 nt, Mycobacterium bovis subsp bovis AF2122/97
acccgggacguuguccaccgcca

SEQ ID NO: 3174025 - RNA, 15 nt, Mycobacterium bovis subsp bovis AF2122/97
acccgggagaugccg

SEQ ID NO: 3174026 - RNA, 19 nt, Mycobacterium bovis subsp bovis AF2122/97
acccgggaucagcuccucc

SEQ ID NO: 3174027 - RNA, 19 nt, Mycobacterium bovis subsp bovis AF2122/97
acccgggaugaccaccggu

SEQ ID NO: 3174028 - RNA, 23 nt, Mycobacterium bovis subsp bovis AF2122/97
acccgggcagcaucaacaccggc

SEQ ID NO: 3174029 - RNA, 18 nt, Mycobacterium bovis subsp bovis AF2122/97
acccgggccaggcugcgc

SEQ ID NO: 3174030 - RNA, 14 nt, Mycobacterium bovis subsp bovis AF2122/97
acccgggccaucgc

SEQ ID NO: 3174031 - RNA, 13 nt, Mycobacterium bovis subsp bovis AF2122/97
acccgggccgcca

SEQ ID NO: 3174032 - RNA, 14 nt, Mycobacterium bovis subsp bovis AF2122/97
acccgggccgccag

SEQ ID NO: 3174033 - RNA, 16 nt, Mycobacterium bovis subsp bovis AF2122/97
accgauggcgcaccgg

SEQ ID NO: 3174034 - RNA, 23 nt, Mycobacterium bovis subsp bovis AF2122/97
accgauggcgcgcucaacggcga

SEQ ID NO: 3174035 - RNA, 19 nt, Mycobacterium bovis subsp bovis AF2122/97
accgauggcgguggugccg

SEQ ID NO: 3174036 - RNA, 19 nt, Mycobacterium bovis subsp bovis AF2122/97
accgauggcucacaugccc

SEQ ID NO: 3174037 - RNA, 18 nt, Mycobacterium bovis subsp bovis AF2122/97
accgaugguggugccaac

SEQ ID NO: 3174038 - RNA, 22 nt, Mycobacterium bovis subsp bovis AF2122/97
accgaugguggugccaaccugg

SEQ ID NO: 3174039 - RNA, 23 nt, Mycobacterium bovis subsp bovis AF2122/97
accgaugugggcgccgucgccgu

SEQ ID NO: 3174040 - RNA, 19 nt, Mycobacterium bovis subsp bovis AF2122/97
accgauucgggcuucucca

SEQ ID NO: 3174041 - RNA, 20 nt, Mycobacterium bovis subsp bovis AF2122/97
accgauucgggcuucuccau

SEQ ID NO: 3174042 - RNA, 15 nt, Mycobacterium bovis subsp bovis AF2122/97
accgauuggcccgag

SEQ ID NO: 3174043 - RNA, 14 nt, Mycobacterium bovis subsp bovis AF2122/97
accgcaaacccgcc

SEQ ID NO: 3174044 - RNA, 19 nt, Mycobacterium bovis subsp bovis AF2122/97
accgcaaacccgccgacaa

SEQ ID NO: 3174045 - RNA, 18 nt, Mycobacterium bovis subsp bovis AF2122/97
accgcaaaggagaagaca

SEQ ID NO: 3174046 - RNA, 22 nt, Mycobacterium bovis subsp bovis AF2122/97
accgcaaaggagaagacaugcc

SEQ ID NO: 3174047 - RNA, 20 nt, Mycobacterium bovis subsp bovis AF2122/97
accgcaaaguagacgugcca

SEQ ID NO: 3174048 - RNA, 22 nt, Mycobacterium bovis subsp bovis AF2122/97
accgcaacgcguauucggcauc

SEQ ID NO: 3174049 - RNA, 16 nt, Mycobacterium bovis subsp bovis AF2122/97
accgcaacgcgugcgc

SEQ ID NO: 3174050 - RNA, 16 nt, Mycobacterium bovis subsp bovis AF2122/97
accgcaacgcuucggc

SEQ ID NO: 3174051 - RNA, 15 nt, Mycobacterium bovis subsp bovis AF2122/97
accgcaacucgccga

SEQ ID NO: 3174052 - RNA, 18 nt, Mycobacterium bovis subsp bovis AF2122/97
accgcaagaaucagcagc

SEQ ID NO: 3174053 - RNA, 15 nt, Mycobacterium bovis subsp bovis AF2122/97
accgcaauggcggcc

SEQ ID NO: 3174054 - RNA, 15 nt, Mycobacterium bovis subsp bovis AF2122/97
accgcacaccugcgc

SEQ ID NO: 3174055 - RNA, 13 nt, Mycobacterium bovis subsp bovis AF2122/97
accgcacccgcuc

SEQ ID NO: 3174056 - RNA, 15 nt, Mycobacterium bovis subsp bovis AF2122/97
accgcacccugggua

SEQ ID NO: 3174057 - RNA, 14 nt, Mycobacterium bovis subsp bovis AF2122/97
accgcaccggccgc

SEQ ID NO: 3174058 - RNA, 13 nt, Mycobacterium bovis subsp bovis AF2122/97
accgcaccguccc

SEQ ID NO: 3174059 - RNA, 18 nt, Mycobacterium bovis subsp bovis AF2122/97
accgcaccgugccgacgc

SEQ ID NO: 3174060 - RNA, 13 nt, Mycobacterium bovis subsp bovis AF2122/97
accgcaccugggc

SEQ ID NO: 3174061 - RNA, 23 nt, Mycobacterium bovis subsp bovis AF2122/97
accgcacgaccagcugagcuggc

SEQ ID NO: 3174062 - RNA, 23 nt, Mycobacterium bovis subsp bovis AF2122/97
accgcacggaggcggaccaggcc

SEQ ID NO: 3174063 - RNA, 16 nt, Mycobacterium bovis subsp bovis AF2122/97
accgcacggaugucgc

SEQ ID NO: 3174064 - RNA, 17 nt, Mycobacterium bovis subsp bovis AF2122/97
accgcacggugcugauc

SEQ ID NO: 3174065 - RNA, 21 nt, Mycobacterium bovis subsp bovis AF2122/97
accgcacuugaucgacggcca

SEQ ID NO: 3174066 - RNA, 23 nt, Mycobacterium bovis subsp bovis AF2122/97
accgcagacgugguagccggcga

SEQ ID NO: 3174067 - RNA, 18 nt, Mycobacterium bovis subsp bovis AF2122/97
accgcagauccccgccac

SEQ ID NO: 3174068 - RNA, 14 nt, Mycobacterium bovis subsp bovis AF2122/97
accgcagccaacgu

SEQ ID NO: 3174069 - RNA, 23 nt, Mycobacterium bovis subsp bovis AF2122/97
accgcagcggaacugggccccca

SEQ ID NO: 3174070 - RNA, 18 nt, Mycobacterium bovis subsp bovis AF2122/97
accgcaggcacaucgcga

SEQ ID NO: 3174071 - RNA, 22 nt, Mycobacterium bovis subsp bovis AF2122/97
accgcaggccgaagacgugccg

SEQ ID NO: 3174072 - RNA, 12 nt, Mycobacterium bovis subsp bovis AF2122/97
accgcagggacc

SEQ ID NO: 3174073 - RNA, 15 nt, Mycobacterium bovis subsp bovis AF2122/97
accgcaggguccaca

SEQ ID NO: 3174074 - RNA, 16 nt, Mycobacterium bovis subsp bovis AF2122/97
accgcaggugccaccu

SEQ ID NO: 3174075 - RNA, 17 nt, Mycobacterium bovis subsp bovis AF2122/97
accgcaggugccaccug

SEQ ID NO: 3174076 - RNA, 24 nt, Mycobacterium bovis subsp bovis AF2122/97
accgcaggugccguggcuaccgca

SEQ ID NO: 3174077 - RNA, 14 nt, Mycobacterium bovis subsp bovis AF2122/97
accgcagucgcggc

SEQ ID NO: 3174078 - RNA, 21 nt, Mycobacterium bovis subsp bovis AF2122/97
accgcauaacgcgaacccgcg

SEQ ID NO: 3174079 - RNA, 14 nt, Mycobacterium bovis subsp bovis AF2122/97
accgcaucggcagc

SEQ ID NO: 3174080 - RNA, 15 nt, Mycobacterium bovis subsp bovis AF2122/97
accgcaucggcagcc

SEQ ID NO: 3174081 - RNA, 19 nt, Mycobacterium bovis subsp bovis AF2122/97
accgcaucgggcuugcgca

SEQ ID NO: 3174082 - RNA, 21 nt, Mycobacterium bovis subsp bovis AF2122/97
accgcaucgucgagccacagc

SEQ ID NO: 3174083 - RNA, 20 nt, Mycobacterium bovis subsp bovis AF2122/97
accgcauucggacgccacgg

SEQ ID NO: 3174084 - RNA, 17 nt, Mycobacterium bovis subsp bovis AF2122/97
accgccaaaaacgccag

SEQ ID NO: 3174085 - RNA, 23 nt, Mycobacterium bovis subsp bovis AF2122/97
accgccaacauuggugagguggu

SEQ ID NO: 3174086 - RNA, 20 nt, Mycobacterium bovis subsp bovis AF2122/97
accgccacacggggccgcca

SEQ ID NO: 3174087 - RNA, 15 nt, Mycobacterium bovis subsp bovis AF2122/97
accgccaccacccag

SEQ ID NO: 3174088 - RNA, 19 nt, Mycobacterium bovis subsp bovis AF2122/97
accgccaccacccaggcca

SEQ ID NO: 3174089 - RNA, 14 nt, Mycobacterium bovis subsp bovis AF2122/97
accgccaccacgcc

SEQ ID NO: 3174090 - RNA, 20 nt, Mycobacterium bovis subsp bovis AF2122/97
accgccaccacgccgucgac

SEQ ID NO: 3174091 - RNA, 16 nt, Mycobacterium bovis subsp bovis AF2122/97
accgccaccacgguca

SEQ ID NO: 3174092 - RNA, 11 nt, Mycobacterium bovis subsp bovis AF2122/97
accgccacccc

SEQ ID NO: 3174093 - RNA, 22 nt, Mycobacterium bovis subsp bovis AF2122/97
accgccaccccugucgggucga

SEQ ID NO: 3174094 - RNA, 19 nt, Mycobacterium bovis subsp bovis AF2122/97
accgccacccugaccaaca

SEQ ID NO: 3174095 - RNA, 17 nt, Mycobacterium bovis subsp bovis AF2122/97
accgccaccgcggccug

SEQ ID NO: 3174096 - RNA, 17 nt, Mycobacterium bovis subsp bovis AF2122/97
accgccaccuuggcguu

SEQ ID NO: 3174097 - RNA, 15 nt, Mycobacterium bovis subsp bovis AF2122/97
accgccacggcggcu

SEQ ID NO: 3174098 - RNA, 13 nt, Mycobacterium bovis subsp bovis AF2122/97
accgccagccacc

SEQ ID NO: 3174099 - RNA, 15 nt, Mycobacterium bovis subsp bovis AF2122/97
accgccagccaccac

SEQ ID NO: 3174100 - RNA, 15 nt, Mycobacterium bovis subsp bovis AF2122/97
accgccagccgcgag

SEQ ID NO: 3174101 - RNA, 13 nt, Mycobacterium bovis subsp bovis AF2122/97
accgccagcggca

SEQ ID NO: 3174102 - RNA, 22 nt, Mycobacterium bovis subsp bovis AF2122/97
accgccaggucgaggcaggccu

SEQ ID NO: 3174103 - RNA, 19 nt, Mycobacterium bovis subsp bovis AF2122/97
accgccauccuucggggug

SEQ ID NO: 3174104 - RNA, 15 nt, Mycobacterium bovis subsp bovis AF2122/97
accgccaucgccaac

SEQ ID NO: 3174105 - RNA, 17 nt, Mycobacterium bovis subsp bovis AF2122/97
accgccaucgccaacac

SEQ ID NO: 3174106 - RNA, 20 nt, Mycobacterium bovis subsp bovis AF2122/97
accgccaucgccaacaccaa

SEQ ID NO: 3174107 - RNA, 15 nt, Mycobacterium bovis subsp bovis AF2122/97
accgccaugaacucg

SEQ ID NO: 3174108 - RNA, 24 nt, Mycobacterium bovis subsp bovis AF2122/97
accgccaugagguaggucgccgcc

SEQ ID NO: 3174109 - RNA, 14 nt, Mycobacterium bovis subsp bovis AF2122/97
accgccccgccaac

SEQ ID NO: 3174110 - RNA, 15 nt, Mycobacterium bovis subsp bovis AF2122/97
accgccccggcggcg

SEQ ID NO: 3174111 - RNA, 13 nt, Mycobacterium bovis subsp bovis AF2122/97
accgcccgccagc

SEQ ID NO: 3174112 - RNA, 14 nt, Mycobacterium bovis subsp bovis AF2122/97
accgcccgcgccac

SEQ ID NO: 3174113 - RNA, 15 nt, Mycobacterium bovis subsp bovis AF2122/97
accgcccgcgccacc

SEQ ID NO: 3174114 - RNA, 16 nt, Mycobacterium bovis subsp bovis AF2122/97
accgcccgcgccaccg

SEQ ID NO: 3174115 - RNA, 20 nt, Mycobacterium bovis subsp bovis AF2122/97
accgcccgcgccaccggcac

SEQ ID NO: 3174116 - RNA, 23 nt, Mycobacterium bovis subsp bovis AF2122/97
accgcccgcgccaccggcaccgc

SEQ ID NO: 3174117 - RNA, 21 nt, Mycobacterium bovis subsp bovis AF2122/97
accgcccuagcgagcggcacc

SEQ ID NO: 3174118 - RNA, 16 nt, Mycobacterium bovis subsp bovis AF2122/97
accgcccuugccgccg

SEQ ID NO: 3174119 - RNA, 23 nt, Mycobacterium bovis subsp bovis AF2122/97
accgccgucccggcucgagcucg

SEQ ID NO: 3174120 - RNA, 14 nt, Mycobacterium bovis subsp bovis AF2122/97
accgccgucgccac

SEQ ID NO: 3174121 - RNA, 23 nt, Mycobacterium bovis subsp bovis AF2122/97
accgccgucggguugcgacgaac

SEQ ID NO: 3174122 - RNA, 20 nt, Mycobacterium bovis subsp bovis AF2122/97
accgccguggccgcacugcu

SEQ ID NO: 3174123 - RNA, 22 nt, Mycobacterium bovis subsp bovis AF2122/97
accgccguggguguugaugggc

SEQ ID NO: 3174124 - RNA, 17 nt, Mycobacterium bovis subsp bovis AF2122/97
accgccguuaccgacgc

SEQ ID NO: 3174125 - RNA, 21 nt, Mycobacterium bovis subsp bovis AF2122/97
accgccguugccaagcagcug

SEQ ID NO: 3174126 - RNA, 23 nt, Mycobacterium bovis subsp bovis AF2122/97
accgccguugccgaucagcccgg

SEQ ID NO: 3174127 - RNA, 18 nt, Mycobacterium bovis subsp bovis AF2122/97
accgccguugccgaucgc

SEQ ID NO: 3174128 - RNA, 22 nt, Mycobacterium bovis subsp bovis AF2122/97
accgccguugccgaucgcuccg

SEQ ID NO: 3174129 - RNA, 21 nt, Mycobacterium bovis subsp bovis AF2122/97
accgccguugccgccggcgcc

SEQ ID NO: 3174130 - RNA, 23 nt, Mycobacterium bovis subsp bovis AF2122/97
accgccguugccgccggcgccgc

SEQ ID NO: 3174131 - RNA, 23 nt, Mycobacterium bovis subsp bovis AF2122/97
accgccguugccguacagcccgg

SEQ ID NO: 3174132 - RNA, 18 nt, Mycobacterium bovis subsp bovis AF2122/97
accgccguugggccgcgc

SEQ ID NO: 3174133 - RNA, 19 nt, Mycobacterium bovis subsp bovis AF2122/97
accgccguugggccgcgcc

SEQ ID NO: 3174134 - RNA, 18 nt, Mycobacterium bovis subsp bovis AF2122/97
accgccguuugcgccguu

SEQ ID NO: 3174135 - RNA, 12 nt, Mycobacterium bovis subsp bovis AF2122/97
accgccuccacc

SEQ ID NO: 3174136 - RNA, 20 nt, Mycobacterium bovis subsp bovis AF2122/97
accgccuccaccgccgcgcg

SEQ ID NO: 3174137 - RNA, 14 nt, Mycobacterium bovis subsp bovis AF2122/97
accgccuccucgau

SEQ ID NO: 3174138 - RNA, 15 nt, Mycobacterium bovis subsp bovis AF2122/97
accgccuccucgaua

SEQ ID NO: 3174139 - RNA, 21 nt, Mycobacterium bovis subsp bovis AF2122/97
accgccuccucgauagcggcg

SEQ ID NO: 3174140 - RNA, 20 nt, Mycobacterium bovis subsp bovis AF2122/97
accgccucgucgaugccuag

SEQ ID NO: 3174141 - RNA, 14 nt, Mycobacterium bovis subsp bovis AF2122/97
accgccugcgccgc

SEQ ID NO: 3174142 - RNA, 16 nt, Mycobacterium bovis subsp bovis AF2122/97
accgccugcgccgccc

SEQ ID NO: 3174143 - RNA, 19 nt, Mycobacterium bovis subsp bovis AF2122/97
accgccugcgccgcccgcg

SEQ ID NO: 3174144 - RNA, 15 nt, Mycobacterium bovis subsp bovis AF2122/97
accgccugcuggccg

SEQ ID NO: 3174145 - RNA, 17 nt, Mycobacterium bovis subsp bovis AF2122/97
accgccugcuggccgcg

SEQ ID NO: 3174146 - RNA, 19 nt, Mycobacterium bovis subsp bovis AF2122/97
accgccugcuggccgcggc

SEQ ID NO: 3174147 - RNA, 13 nt, Mycobacterium bovis subsp bovis AF2122/97
accgccugggcgg

SEQ ID NO: 3174148 - RNA, 21 nt, Mycobacterium bovis subsp bovis AF2122/97
accgccugggcggccagcacg

SEQ ID NO: 3174149 - RNA, 13 nt, Mycobacterium bovis subsp bovis AF2122/97
accgccugugccg

SEQ ID NO: 3174150 - RNA, 14 nt, Mycobacterium bovis subsp bovis AF2122/97
accgccugugccgc

SEQ ID NO: 3174151 - RNA, 17 nt, Mycobacterium bovis subsp bovis AF2122/97
accgccugugccgccgg

SEQ ID NO: 3174152 - RNA, 18 nt, Mycobacterium bovis subsp bovis AF2122/97
accgccugugccgccggc

SEQ ID NO: 3174153 - RNA, 11 nt, Mycobacterium bovis subsp bovis AF2122/97
accgccuuggu

SEQ ID NO: 3174154 - RNA, 15 nt, Mycobacterium bovis subsp bovis AF2122/97
accgccuuggucacc

SEQ ID NO: 3174155 - RNA, 15 nt, Mycobacterium bovis subsp bovis AF2122/97
accgccuuugcccgc

SEQ ID NO: 3174156 - RNA, 17 nt, Mycobacterium bovis subsp bovis AF2122/97
accgccuuugcccgccg

SEQ ID NO: 3174157 - RNA, 17 nt, Mycobacterium bovis subsp bovis AF2122/97
accgcgaaaauucgucg

SEQ ID NO: 3174158 - RNA, 20 nt, Mycobacterium bovis subsp bovis AF2122/97
accgcgaaaauucgucgcgu

SEQ ID NO: 3174159 - RNA, 22 nt, Mycobacterium bovis subsp bovis AF2122/97
accgcgacaacaacucuucggc

SEQ ID NO: 3174160 - RNA, 16 nt, Mycobacterium bovis subsp bovis AF2122/97
accgcgaccaucgcga

SEQ ID NO: 3174161 - RNA, 21 nt, Mycobacterium bovis subsp bovis AF2122/97
accgcgaccaucgcgacggca

SEQ ID NO: 3174162 - RNA, 14 nt, Mycobacterium bovis subsp bovis AF2122/97
accgcgaccccugg

SEQ ID NO: 3174163 - RNA, 13 nt, Mycobacterium bovis subsp bovis AF2122/97
accgcgacccggc

SEQ ID NO: 3174164 - RNA, 15 nt, Mycobacterium bovis subsp bovis AF2122/97
accgcgacccggccc

SEQ ID NO: 3174165 - RNA, 14 nt, Mycobacterium bovis subsp bovis AF2122/97
accgcgaccgcauu

SEQ ID NO: 3174166 - RNA, 14 nt, Mycobacterium bovis subsp bovis AF2122/97
accgcgaccgcgca

SEQ ID NO: 3174167 - RNA, 18 nt, Mycobacterium bovis subsp bovis AF2122/97
accgcgaccgcgcacggc

SEQ ID NO: 3174168 - RNA, 15 nt, Mycobacterium bovis subsp bovis AF2122/97
accgcgacggcaggc

SEQ ID NO: 3174169 - RNA, 18 nt, Mycobacterium bovis subsp bovis AF2122/97
accgcgacggcgccggca

SEQ ID NO: 3174170 - RNA, 18 nt, Mycobacterium bovis subsp bovis AF2122/97
accgcgagcagcacagca

SEQ ID NO: 3174171 - RNA, 17 nt, Mycobacterium bovis subsp bovis AF2122/97
accgcgagggccagcaa

SEQ ID NO: 3174172 - RNA, 12 nt, Mycobacterium bovis subsp bovis AF2122/97
accgcgaucacc

SEQ ID NO: 3174173 - RNA, 14 nt, Mycobacterium bovis subsp bovis AF2122/97
accgcgaucaccac

SEQ ID NO: 3174174 - RNA, 16 nt, Mycobacterium bovis subsp bovis AF2122/97
accgcgaucaccaccg

SEQ ID NO: 3174175 - RNA, 20 nt, Mycobacterium bovis subsp bovis AF2122/97
accgcgaucaccaccggauc

SEQ ID NO: 3174176 - RNA, 19 nt, Mycobacterium bovis subsp bovis AF2122/97
accgcgaugaucgcaucga

SEQ ID NO: 3174177 - RNA, 21 nt, Mycobacterium bovis subsp bovis AF2122/97
accgcgaugauggcgguaccg

SEQ ID NO: 3174178 - RNA, 21 nt, Mycobacterium bovis subsp bovis AF2122/97
accgcgaugccccacggugcg

SEQ ID NO: 3174179 - RNA, 20 nt, Mycobacterium bovis subsp bovis AF2122/97
accgcgauggugguuccgcc

SEQ ID NO: 3174180 - RNA, 16 nt, Mycobacterium bovis subsp bovis AF2122/97
accgcgcaacccggac

SEQ ID NO: 3174181 - RNA, 19 nt, Mycobacterium bovis subsp bovis AF2122/97
accgcgcaacccggacgaa

SEQ ID NO: 3174182 - RNA, 22 nt, Mycobacterium bovis subsp bovis AF2122/97
accgcgcaacccggacgaacgc

SEQ ID NO: 3174183 - RNA, 16 nt, Mycobacterium bovis subsp bovis AF2122/97
accgcgcacggcuggc

SEQ ID NO: 3174184 - RNA, 17 nt, Mycobacterium bovis subsp bovis AF2122/97
accgcgcacggcuggcg

SEQ ID NO: 3174185 - RNA, 18 nt, Mycobacterium bovis subsp bovis AF2122/97
accgcgccaacagaugcc

SEQ ID NO: 3174186 - RNA, 15 nt, Mycobacterium bovis subsp bovis AF2122/97
accgcgccaacuccg

SEQ ID NO: 3174187 - RNA, 22 nt, Mycobacterium bovis subsp bovis AF2122/97
accgcgccaacuccgauccaca

SEQ ID NO: 3174188 - RNA, 13 nt, Mycobacterium bovis subsp bovis AF2122/97
accgcgccagccu

SEQ ID NO: 3174189 - RNA, 22 nt, Mycobacterium bovis subsp bovis AF2122/97
accgcgcccaccagcggcggca

SEQ ID NO: 3174190 - RNA, 16 nt, Mycobacterium bovis subsp bovis AF2122/97
accgcgcccagaccga

SEQ ID NO: 3174191 - RNA, 14 nt, Mycobacterium bovis subsp bovis AF2122/97
accgcgcccgccgc

SEQ ID NO: 3174192 - RNA, 17 nt, Mycobacterium bovis subsp bovis AF2122/97
accgcgcccgccgcggc

SEQ ID NO: 3174193 - RNA, 21 nt, Mycobacterium bovis subsp bovis AF2122/97
accgcgcccuagcuggugcgc

SEQ ID NO: 3174194 - RNA, 15 nt, Mycobacterium bovis subsp bovis AF2122/97
accgcgcccuucagc

SEQ ID NO: 3174195 - RNA, 12 nt, Mycobacterium bovis subsp bovis AF2122/97
accgcgccgaac

SEQ ID NO: 3174196 - RNA, 17 nt, Mycobacterium bovis subsp bovis AF2122/97
accgcgccgagcagacg

SEQ ID NO: 3174197 - RNA, 15 nt, Mycobacterium bovis subsp bovis AF2122/97
accgcgccgaucacc

SEQ ID NO: 3174198 - RNA, 20 nt, Mycobacterium bovis subsp bovis AF2122/97
accgcgccgaucaccaccgg

SEQ ID NO: 3174199 - RNA, 21 nt, Mycobacterium bovis subsp bovis AF2122/97
accgcgccgcgccgcgccgcc

SEQ ID NO: 3174200 - RNA, 13 nt, Mycobacterium bovis subsp bovis AF2122/97
accgcgccggcgg

SEQ ID NO: 3174201 - RNA, 23 nt, Mycobacterium bovis subsp bovis AF2122/97
accgcgccguaaagccaacuggu

SEQ ID NO: 3174202 - RNA, 20 nt, Mycobacterium bovis subsp bovis AF2122/97
accgcgccgucgucgagcac

SEQ ID NO: 3174203 - RNA, 22 nt, Mycobacterium bovis subsp bovis AF2122/97
accgcgccgucgucgagcacca

SEQ ID NO: 3174204 - RNA, 16 nt, Mycobacterium bovis subsp bovis AF2122/97
accgcgccgucgucgc

SEQ ID NO: 3174205 - RNA, 18 nt, Mycobacterium bovis subsp bovis AF2122/97
accgcgucguagccacgc

SEQ ID NO: 3174206 - RNA, 14 nt, Mycobacterium bovis subsp bovis AF2122/97
accgcgugcgccgg

SEQ ID NO: 3174207 - RNA, 18 nt, Mycobacterium bovis subsp bovis AF2122/97
accgcgugcgccggggac

SEQ ID NO: 3174208 - RNA, 15 nt, Mycobacterium bovis subsp bovis AF2122/97
accgcgugcgucagc

SEQ ID NO: 3174209 - RNA, 15 nt, Mycobacterium bovis subsp bovis AF2122/97
accgcguugaugacc

SEQ ID NO: 3174210 - RNA, 23 nt, Mycobacterium bovis subsp bovis AF2122/97
accgcguugaugaccgccgccgg

SEQ ID NO: 3174211 - RNA, 13 nt, Mycobacterium bovis subsp bovis AF2122/97
accgcguuggcca

SEQ ID NO: 3174212 - RNA, 19 nt, Mycobacterium bovis subsp bovis AF2122/97
accgcguuguccgcggcca

SEQ ID NO: 3174213 - RNA, 22 nt, Mycobacterium bovis subsp bovis AF2122/97
accgcguuguccgcggccaacg

SEQ ID NO: 3174214 - RNA, 22 nt, Mycobacterium bovis subsp bovis AF2122/97
accgcguuucgcgacgucugcc

SEQ ID NO: 3174215 - RNA, 23 nt, Mycobacterium bovis subsp bovis AF2122/97
accgcguuucgcgacgucugcca

SEQ ID NO: 3174216 - RNA, 18 nt, Mycobacterium bovis subsp bovis AF2122/97
accgcuaugaugccgccg

SEQ ID NO: 3174217 - RNA, 20 nt, Mycobacterium bovis subsp bovis AF2122/97
accgcucgaugucccgagcc

SEQ ID NO: 3174218 - RNA, 14 nt, Mycobacterium bovis subsp bovis AF2122/97
accgcucggaguug

SEQ ID NO: 3174219 - RNA, 18 nt, Mycobacterium bovis subsp bovis AF2122/97
accgcucgguccagccgg

SEQ ID NO: 3174220 - RNA, 13 nt, Mycobacterium bovis subsp bovis AF2122/97
accgcucgucgcc

SEQ ID NO: 3174221 - RNA, 20 nt, Mycobacterium bovis subsp bovis AF2122/97
accgcucgucgccgguggca

SEQ ID NO: 3174222 - RNA, 19 nt, Mycobacterium bovis subsp bovis AF2122/97
accgcucgucguccggcca

SEQ ID NO: 3174223 - RNA, 15 nt, Mycobacterium bovis subsp bovis AF2122/97
accgcucugcggcca

SEQ ID NO: 3174224 - RNA, 18 nt, Mycobacterium bovis subsp bovis AF2122/97
accgcugccgcugccgaa

SEQ ID NO: 3174225 - RNA, 19 nt, Mycobacterium bovis subsp bovis AF2122/97
accgcugccggcacgcaug

SEQ ID NO: 3174226 - RNA, 15 nt, Mycobacterium bovis subsp bovis AF2122/97
accgcugccggcagc

SEQ ID NO: 3174227 - RNA, 13 nt, Mycobacterium bovis subsp bovis AF2122/97
accgcugccggcg

SEQ ID NO: 3174228 - RNA, 17 nt, Mycobacterium bovis subsp bovis AF2122/97
accgcugccggcgccgc

SEQ ID NO: 3174229 - RNA, 23 nt, Mycobacterium bovis subsp bovis AF2122/97
accgcugccggcgccgccacugc

SEQ ID NO: 3174230 - RNA, 20 nt, Mycobacterium bovis subsp bovis AF2122/97
accgcugccggugugcggcg

SEQ ID NO: 3174231 - RNA, 13 nt, Mycobacterium bovis subsp bovis AF2122/97
accgcugccugcc

SEQ ID NO: 3174232 - RNA, 17 nt, Mycobacterium bovis subsp bovis AF2122/97
accgcugcgcgaaucgc

SEQ ID NO: 3174233 - RNA, 19 nt, Mycobacterium bovis subsp bovis AF2122/97
accgcugcgcgaaucgcgu

SEQ ID NO: 3174234 - RNA, 15 nt, Mycobacterium bovis subsp bovis AF2122/97
accgcugcggcacca

SEQ ID NO: 3174235 - RNA, 23 nt, Mycobacterium bovis subsp bovis AF2122/97
accgcugcggguagccgucgauc

SEQ ID NO: 3174236 - RNA, 17 nt, Mycobacterium bovis subsp bovis AF2122/97
accgcugcuccucgcgg

SEQ ID NO: 3174237 - RNA, 23 nt, Mycobacterium bovis subsp bovis AF2122/97
accgcugcuugucgaggcgcagg

SEQ ID NO: 3174238 - RNA, 22 nt, Mycobacterium bovis subsp bovis AF2122/97
accgcuggaaaaucgggucaca

SEQ ID NO: 3174239 - RNA, 21 nt, Mycobacterium bovis subsp bovis AF2122/97
accgcugggggcggucgccuc

SEQ ID NO: 3174240 - RNA, 16 nt, Mycobacterium bovis subsp bovis AF2122/97
accgcuguaaccggua

SEQ ID NO: 3174241 - RNA, 13 nt, Mycobacterium bovis subsp bovis AF2122/97
accgcugucaccg

SEQ ID NO: 3174242 - RNA, 14 nt, Mycobacterium bovis subsp bovis AF2122/97
accgcugucagccg

SEQ ID NO: 3174243 - RNA, 16 nt, Mycobacterium bovis subsp bovis AF2122/97
accgcugucagccgac

SEQ ID NO: 3174244 - RNA, 21 nt, Mycobacterium bovis subsp bovis AF2122/97
accgcuguucuuggugaccaa

SEQ ID NO: 3174245 - RNA, 19 nt, Mycobacterium bovis subsp bovis AF2122/97
accgcuguugcaucgccgc

SEQ ID NO: 3174246 - RNA, 14 nt, Mycobacterium bovis subsp bovis AF2122/97
accgcuucaggcgc

SEQ ID NO: 3174247 - RNA, 23 nt, Mycobacterium bovis subsp bovis AF2122/97
accgcuucccccgguccggucgg

SEQ ID NO: 3174248 - RNA, 21 nt, Mycobacterium bovis subsp bovis AF2122/97
accgcuugugacaccacaucg

SEQ ID NO: 3174249 - RNA, 23 nt, Mycobacterium bovis subsp bovis AF2122/97
accggaaaccacagcgccaucag

SEQ ID NO: 3174250 - RNA, 17 nt, Mycobacterium bovis subsp bovis AF2122/97
accggaaaugucuccuc

SEQ ID NO: 3174251 - RNA, 14 nt, Mycobacterium bovis subsp bovis AF2122/97
accggaacgccguc

SEQ ID NO: 3174252 - RNA, 19 nt, Mycobacterium bovis subsp bovis AF2122/97
accggaacgccgucgagca

SEQ ID NO: 3174253 - RNA, 17 nt, Mycobacterium bovis subsp bovis AF2122/97
accggaauacgcgccgc

SEQ ID NO: 3174254 - RNA, 21 nt, Mycobacterium bovis subsp bovis AF2122/97
accggaauacgcgccgccggc

SEQ ID NO: 3174255 - RNA, 22 nt, Mycobacterium bovis subsp bovis AF2122/97
accggaauccccccugucgccg

SEQ ID NO: 3174256 - RNA, 18 nt, Mycobacterium bovis subsp bovis AF2122/97
accggaauccuggccgcc

SEQ ID NO: 3174257 - RNA, 20 nt, Mycobacterium bovis subsp bovis AF2122/97
accggaauccuggccgccgc

SEQ ID NO: 3174258 - RNA, 22 nt, Mycobacterium bovis subsp bovis AF2122/97
accggaauccuggccgccgccc

SEQ ID NO: 3174259 - RNA, 19 nt, Mycobacterium bovis subsp bovis AF2122/97
accggacaaacaucgcacc

SEQ ID NO: 3174260 - RNA, 17 nt, Mycobacterium bovis subsp bovis AF2122/97
accggacaaagcugcuc

SEQ ID NO: 3174261 - RNA, 20 nt, Mycobacterium bovis subsp bovis AF2122/97
accggacaaagcugcucguc

SEQ ID NO: 3174262 - RNA, 18 nt, Mycobacterium bovis subsp bovis AF2122/97
accggacacuccugcaca

SEQ ID NO: 3174263 - RNA, 16 nt, Mycobacterium bovis subsp bovis AF2122/97
accggaccaccgccga

SEQ ID NO: 3174264 - RNA, 21 nt, Mycobacterium bovis subsp bovis AF2122/97
accggaccgaagaccuccucg

SEQ ID NO: 3174265 - RNA, 19 nt, Mycobacterium bovis subsp bovis AF2122/97
accggaccugaccgguggc

SEQ ID NO: 3174266 - RNA, 11 nt, Mycobacterium bovis subsp bovis AF2122/97
accggaccugg

SEQ ID NO: 3174267 - RNA, 17 nt, Mycobacterium bovis subsp bovis AF2122/97
accggacgagcgucaga

SEQ ID NO: 3174268 - RNA, 22 nt, Mycobacterium bovis subsp bovis AF2122/97
accggacgaucagggugucgaa

SEQ ID NO: 3174269 - RNA, 16 nt, Mycobacterium bovis subsp bovis AF2122/97
accggacgcccucacg

SEQ ID NO: 3174270 - RNA, 16 nt, Mycobacterium bovis subsp bovis AF2122/97
accggagaucccgguc

SEQ ID NO: 3174271 - RNA, 15 nt, Mycobacterium bovis subsp bovis AF2122/97
accggaggccgccgc

SEQ ID NO: 3174272 - RNA, 14 nt, Mycobacterium bovis subsp bovis AF2122/97
accggagucgcccg

SEQ ID NO: 3174273 - RNA, 14 nt, Mycobacterium bovis subsp bovis AF2122/97
accggagucggcgu

SEQ ID NO: 3174274 - RNA, 19 nt, Mycobacterium bovis subsp bovis AF2122/97
accggauacagccacgcaa

SEQ ID NO: 3174275 - RNA, 23 nt, Mycobacterium bovis subsp bovis AF2122/97
accggauaggaccacgggaugca

SEQ ID NO: 3174276 - RNA, 14 nt, Mycobacterium bovis subsp bovis AF2122/97
accggaucaccgcg

SEQ ID NO: 3174277 - RNA, 21 nt, Mycobacterium bovis subsp bovis AF2122/97
accggauccacggagaccggc

SEQ ID NO: 3174278 - RNA, 23 nt, Mycobacterium bovis subsp bovis AF2122/97
accggauccauuagcacaucgcc

SEQ ID NO: 3174279 - RNA, 13 nt, Mycobacterium bovis subsp bovis AF2122/97
accggaucgccgu

SEQ ID NO: 3174280 - RNA, 19 nt, Mycobacterium bovis subsp bovis AF2122/97
accggaucgccgucggcgg

SEQ ID NO: 3174281 - RNA, 19 nt, Mycobacterium bovis subsp bovis AF2122/97
accggaucugacggcgccg

SEQ ID NO: 3174282 - RNA, 13 nt, Mycobacterium bovis subsp bovis AF2122/97
accggaugcgguc

SEQ ID NO: 3174283 - RNA, 13 nt, Mycobacterium bovis subsp bovis AF2122/97
accggcaacaucg

SEQ ID NO: 3174284 - RNA, 21 nt, Mycobacterium bovis subsp bovis AF2122/97
accggcaagccacgccggucg

SEQ ID NO: 3174285 - RNA, 17 nt, Mycobacterium bovis subsp bovis AF2122/97
accggcaaucggcggca

SEQ ID NO: 3174286 - RNA, 22 nt, Mycobacterium bovis subsp bovis AF2122/97
accggcaaucggcggcacccgg

SEQ ID NO: 3174287 - RNA, 20 nt, Mycobacterium bovis subsp bovis AF2122/97
accggcaccagcggcaccgc

SEQ ID NO: 3174288 - RNA, 13 nt, Mycobacterium bovis subsp bovis AF2122/97
accggcacccccg

SEQ ID NO: 3174289 - RNA, 19 nt, Mycobacterium bovis subsp bovis AF2122/97
accggcacccccgucgcca

SEQ ID NO: 3174290 - RNA, 11 nt, Mycobacterium bovis subsp bovis AF2122/97
accggcacccg

SEQ ID NO: 3174291 - RNA, 15 nt, Mycobacterium bovis subsp bovis AF2122/97
accggcgcgccccgc

SEQ ID NO: 3174292 - RNA, 22 nt, Mycobacterium bovis subsp bovis AF2122/97
accggcgcggaacgcgucgccg

SEQ ID NO: 3174293 - RNA, 16 nt, Mycobacterium bovis subsp bovis AF2122/97
accggcgcgggcacgc

SEQ ID NO: 3174294 - RNA, 22 nt, Mycobacterium bovis subsp bovis AF2122/97
accggcgcucaaugcggucaac

SEQ ID NO: 3174295 - RNA, 22 nt, Mycobacterium bovis subsp bovis AF2122/97
accggcggacaccucgggcgcc

SEQ ID NO: 3174296 - RNA, 20 nt, Mycobacterium bovis subsp bovis AF2122/97
accggcggauucgcgcuggu

SEQ ID NO: 3174297 - RNA, 14 nt, Mycobacterium bovis subsp bovis AF2122/97
accggcggcaucga

SEQ ID NO: 3174298 - RNA, 22 nt, Mycobacterium bovis subsp bovis AF2122/97
accggcggcaucgaguucggcc

SEQ ID NO: 3174299 - RNA, 10 nt, Mycobacterium bovis subsp bovis AF2122/97
accggcggcg

SEQ ID NO: 3174300 - RNA, 11 nt, Mycobacterium bovis subsp bovis AF2122/97
accggcggcga

SEQ ID NO: 3174301 - RNA, 14 nt, Mycobacterium bovis subsp bovis AF2122/97
accggcggcgacgg

SEQ ID NO: 3174302 - RNA, 17 nt, Mycobacterium bovis subsp bovis AF2122/97
accggcggcgacggcgg

SEQ ID NO: 3174303 - RNA, 23 nt, Mycobacterium bovis subsp bovis AF2122/97
accggcggcgacggcggcacggg

SEQ ID NO: 3174304 - RNA, 19 nt, Mycobacterium bovis subsp bovis AF2122/97
accggcggcgacggugcca

SEQ ID NO: 3174305 - RNA, 18 nt, Mycobacterium bovis subsp bovis AF2122/97
accggcggcgagcggccu

SEQ ID NO: 3174306 - RNA, 20 nt, Mycobacterium bovis subsp bovis AF2122/97
accggcggcgagcggccucc

SEQ ID NO: 3174307 - RNA, 13 nt, Mycobacterium bovis subsp bovis AF2122/97
accggcggcgccg

SEQ ID NO: 3174308 - RNA, 15 nt, Mycobacterium bovis subsp bovis AF2122/97
accggcggcgccgga

SEQ ID NO: 3174309 - RNA, 16 nt, Mycobacterium bovis subsp bovis AF2122/97
accggcggcgccggcc

SEQ ID NO: 3174310 - RNA, 15 nt, Mycobacterium bovis subsp bovis AF2122/97
accggcggcgccggg

SEQ ID NO: 3174311 - RNA, 16 nt, Mycobacterium bovis subsp bovis AF2122/97
accggcggcgccgggg

SEQ ID NO: 3174312 - RNA, 15 nt, Mycobacterium bovis subsp bovis AF2122/97
accggcggcuacggc

SEQ ID NO: 3174313 - RNA, 19 nt, Mycobacterium bovis subsp bovis AF2122/97
accggcggcuacggcugcc

SEQ ID NO: 3174314 - RNA, 21 nt, Mycobacterium bovis subsp bovis AF2122/97
accggcgggaugcgcgcccga

SEQ ID NO: 3174315 - RNA, 14 nt, Mycobacterium bovis subsp bovis AF2122/97
accggcggugccgg

SEQ ID NO: 3174316 - RNA, 17 nt, Mycobacterium bovis subsp bovis AF2122/97
accggcguaaccggcag

SEQ ID NO: 3174317 - RNA, 22 nt, Mycobacterium bovis subsp bovis AF2122/97
accggcguccaguccgaucacc

SEQ ID NO: 3174318 - RNA, 14 nt, Mycobacterium bovis subsp bovis AF2122/97
accggcgucgacgu

SEQ ID NO: 3174319 - RNA, 14 nt, Mycobacterium bovis subsp bovis AF2122/97
accggcgucgcugc

SEQ ID NO: 3174320 - RNA, 15 nt, Mycobacterium bovis subsp bovis AF2122/97
accggcgucgcugcc

SEQ ID NO: 3174321 - RNA, 15 nt, Mycobacterium bovis subsp bovis AF2122/97
accggcgucggcgcg

SEQ ID NO: 3174322 - RNA, 19 nt, Mycobacterium bovis subsp bovis AF2122/97
accggcgucggcgcggccg

SEQ ID NO: 3174323 - RNA, 20 nt, Mycobacterium bovis subsp bovis AF2122/97
accggcgucggcgcggccgu

SEQ ID NO: 3174324 - RNA, 21 nt, Mycobacterium bovis subsp bovis AF2122/97
accggcgucguaggagccguc

SEQ ID NO: 3174325 - RNA, 18 nt, Mycobacterium bovis subsp bovis AF2122/97
accggcgugcaguacacc

SEQ ID NO: 3174326 - RNA, 21 nt, Mycobacterium bovis subsp bovis AF2122/97
accggcguucccacuggaggu

SEQ ID NO: 3174327 - RNA, 20 nt, Mycobacterium bovis subsp bovis AF2122/97
accggcguugcguagacgaa

SEQ ID NO: 3174328 - RNA, 15 nt, Mycobacterium bovis subsp bovis AF2122/97
accggcuaccggcgu

SEQ ID NO: 3174329 - RNA, 21 nt, Mycobacterium bovis subsp bovis AF2122/97
accggcuacggcgacacgcca

SEQ ID NO: 3174330 - RNA, 21 nt, Mycobacterium bovis subsp bovis AF2122/97
accggcuagcaguuagccggg

SEQ ID NO: 3174331 - RNA, 16 nt, Mycobacterium bovis subsp bovis AF2122/97
accggcuaugcuggcg

SEQ ID NO: 3174332 - RNA, 18 nt, Mycobacterium bovis subsp bovis AF2122/97
accggcuaugcuggcgca

SEQ ID NO: 3174333 - RNA, 24 nt, Mycobacterium bovis subsp bovis AF2122/97
accggcuaugcuggcgcagcgcca

SEQ ID NO: 3174334 - RNA, 16 nt, Mycobacterium bovis subsp bovis AF2122/97
accggcucaccacgcc

SEQ ID NO: 3174335 - RNA, 16 nt, Mycobacterium bovis subsp bovis AF2122/97
accggcuccagcaugg

SEQ ID NO: 3174336 - RNA, 14 nt, Mycobacterium bovis subsp bovis AF2122/97
accggcucgaucuc

SEQ ID NO: 3174337 - RNA, 15 nt, Mycobacterium bovis subsp bovis AF2122/97
accggcucgaucucg

SEQ ID NO: 3174338 - RNA, 15 nt, Mycobacterium bovis subsp bovis AF2122/97
accggcucgccggcg

SEQ ID NO: 3174339 - RNA, 17 nt, Mycobacterium bovis subsp bovis AF2122/97
accggcucgccggcgcg

SEQ ID NO: 3174340 - RNA, 22 nt, Mycobacterium bovis subsp bovis AF2122/97
accggcucggaaaccgccccgu

SEQ ID NO: 3174341 - RNA, 19 nt, Mycobacterium bovis subsp bovis AF2122/97
accggcucguagcuggugc

SEQ ID NO: 3174342 - RNA, 15 nt, Mycobacterium bovis subsp bovis AF2122/97
accggcucgucgggc

SEQ ID NO: 3174343 - RNA, 20 nt, Mycobacterium bovis subsp bovis AF2122/97
accggcucuuuuucgaucgc

SEQ ID NO: 3174344 - RNA, 18 nt, Mycobacterium bovis subsp bovis AF2122/97
accggcugaccgacccgg

SEQ ID NO: 3174345 - RNA, 14 nt, Mycobacterium bovis subsp bovis AF2122/97
accggcugaccggg

SEQ ID NO: 3174346 - RNA, 22 nt, Mycobacterium bovis subsp bovis AF2122/97
accggcugaccggggcgcccgg

SEQ ID NO: 3174347 - RNA, 16 nt, Mycobacterium bovis subsp bovis AF2122/97
accggcugcaaccagc

SEQ ID NO: 3174348 - RNA, 13 nt, Mycobacterium bovis subsp bovis AF2122/97
accggcugcaggu

SEQ ID NO: 3174349 - RNA, 15 nt, Mycobacterium bovis subsp bovis AF2122/97
accggcugcggggcg

SEQ ID NO: 3174350 - RNA, 17 nt, Mycobacterium bovis subsp bovis AF2122/97
accggcuggccaggugg

SEQ ID NO: 3174351 - RNA, 21 nt, Mycobacterium bovis subsp bovis AF2122/97
accggcuggccagguggccgc

SEQ ID NO: 3174352 - RNA, 18 nt, Mycobacterium bovis subsp bovis AF2122/97
accggcugggcgccacca

SEQ ID NO: 3174353 - RNA, 19 nt, Mycobacterium bovis subsp bovis AF2122/97
accggcugggcgccaccau

SEQ ID NO: 3174354 - RNA, 18 nt, Mycobacterium bovis subsp bovis AF2122/97
accggcuggugccaacug

SEQ ID NO: 3174355 - RNA, 22 nt, Mycobacterium bovis subsp bovis AF2122/97
accggcuggugccuuaccaccg

SEQ ID NO: 3174356 - RNA, 18 nt, Mycobacterium bovis subsp bovis AF2122/97
accggcuuccccagcagu

SEQ ID NO: 3174357 - RNA, 19 nt, Mycobacterium bovis subsp bovis AF2122/97
accggcuuccccagcaguu

SEQ ID NO: 3174358 - RNA, 12 nt, Mycobacterium bovis subsp bovis AF2122/97
accggcuucggc

SEQ ID NO: 3174359 - RNA, 16 nt, Mycobacterium bovis subsp bovis AF2122/97
accggcuucggccagc

SEQ ID NO: 3174360 - RNA, 17 nt, Mycobacterium bovis subsp bovis AF2122/97
accggcuucgucggcca

SEQ ID NO: 3174361 - RNA, 16 nt, Mycobacterium bovis subsp bovis AF2122/97
accggcuucuccucca

SEQ ID NO: 3174362 - RNA, 12 nt, Mycobacterium bovis subsp bovis AF2122/97
accggcuugccg

SEQ ID NO: 3174363 - RNA, 16 nt, Mycobacterium bovis subsp bovis AF2122/97
accggcuugccgccgu

SEQ ID NO: 3174364 - RNA, 19 nt, Mycobacterium bovis subsp bovis AF2122/97
accggcuuggcgggaccgu

SEQ ID NO: 3174365 - RNA, 14 nt, Mycobacterium bovis subsp bovis AF2122/97
accggcuugggcca

SEQ ID NO: 3174366 - RNA, 22 nt, Mycobacterium bovis subsp bovis AF2122/97
accggcuuggugaaccgcgcgg

SEQ ID NO: 3174367 - RNA, 17 nt, Mycobacterium bovis subsp bovis AF2122/97
accggcuuugcuugccg

SEQ ID NO: 3174368 - RNA, 20 nt, Mycobacterium bovis subsp bovis AF2122/97
accgggaacagggugguggc

SEQ ID NO: 3174369 - RNA, 14 nt, Mycobacterium bovis subsp bovis AF2122/97
accgggaaccacgg

SEQ ID NO: 3174370 - RNA, 18 nt, Mycobacterium bovis subsp bovis AF2122/97
accgggaacccgagcuug

SEQ ID NO: 3174371 - RNA, 18 nt, Mycobacterium bovis subsp bovis AF2122/97
accgggacgaaucccgcg

SEQ ID NO: 3174372 - RNA, 13 nt, Mycobacterium bovis subsp bovis AF2122/97
accgggauagccg

SEQ ID NO: 3174373 - RNA, 17 nt, Mycobacterium bovis subsp bovis AF2122/97
accgggauagccgcgac

SEQ ID NO: 3174374 - RNA, 20 nt, Mycobacterium bovis subsp bovis AF2122/97
accgggaucggcuccgccgc

SEQ ID NO: 3174375 - RNA, 14 nt, Mycobacterium bovis subsp bovis AF2122/97
accgggaugugcgg

SEQ ID NO: 3174376 - RNA, 15 nt, Mycobacterium bovis subsp bovis AF2122/97
accgggcaaaucaag

SEQ ID NO: 3174377 - RNA, 19 nt, Mycobacterium bovis subsp bovis AF2122/97
accgggcaaaucaagcaca

SEQ ID NO: 3174378 - RNA, 22 nt, Mycobacterium bovis subsp bovis AF2122/97
accggugcucgucgagcaugcg

SEQ ID NO: 3174379 - RNA, 17 nt, Mycobacterium bovis subsp bovis AF2122/97
accggugcugucgacgu

SEQ ID NO: 3174380 - RNA, 21 nt, Mycobacterium bovis subsp bovis AF2122/97
accggugcugucgacgucggc

SEQ ID NO: 3174381 - RNA, 13 nt, Mycobacterium bovis subsp bovis AF2122/97
accgguggaaacc

SEQ ID NO: 3174382 - RNA, 18 nt, Mycobacterium bovis subsp bovis AF2122/97
accgguggacccggcggu

SEQ ID NO: 3174383 - RNA, 17 nt, Mycobacterium bovis subsp bovis AF2122/97
accgguggcaccggcgg

SEQ ID NO: 3174384 - RNA, 19 nt, Mycobacterium bovis subsp bovis AF2122/97
accgguggcaccggcggcg

SEQ ID NO: 3174385 - RNA, 14 nt, Mycobacterium bovis subsp bovis AF2122/97
accgguggcagccu

SEQ ID NO: 3174386 - RNA, 21 nt, Mycobacterium bovis subsp bovis AF2122/97
accgguggcagccugcugcac

SEQ ID NO: 3174387 - RNA, 22 nt, Mycobacterium bovis subsp bovis AF2122/97
accgguggcagccugcugcaca

SEQ ID NO: 3174388 - RNA, 16 nt, Mycobacterium bovis subsp bovis AF2122/97
accgguggggacccgc

SEQ ID NO: 3174389 - RNA, 20 nt, Mycobacterium bovis subsp bovis AF2122/97
accgguggggacccgcucca

SEQ ID NO: 3174390 - RNA, 21 nt, Mycobacterium bovis subsp bovis AF2122/97
accggugggucugcucagcgc

SEQ ID NO: 3174391 - RNA, 15 nt, Mycobacterium bovis subsp bovis AF2122/97
accgguguagcagcg

SEQ ID NO: 3174392 - RNA, 18 nt, Mycobacterium bovis subsp bovis AF2122/97
accggugucggccagcaa

SEQ ID NO: 3174393 - RNA, 19 nt, Mycobacterium bovis subsp bovis AF2122/97
accggugucggccagcaac

SEQ ID NO: 3174394 - RNA, 16 nt, Mycobacterium bovis subsp bovis AF2122/97
accggugucuucugcc

SEQ ID NO: 3174395 - RNA, 14 nt, Mycobacterium bovis subsp bovis AF2122/97
accgguucggcgua

SEQ ID NO: 3174396 - RNA, 15 nt, Mycobacterium bovis subsp bovis AF2122/97
accgguucggugagc

SEQ ID NO: 3174397 - RNA, 17 nt, Mycobacterium bovis subsp bovis AF2122/97
accgguugacgggcucg

SEQ ID NO: 3174398 - RNA, 22 nt, Mycobacterium bovis subsp bovis AF2122/97
accgguuggcgauccgcggcgu

SEQ ID NO: 3174399 - RNA, 23 nt, Mycobacterium bovis subsp bovis AF2122/97
accgguuucgucggucugcagau

SEQ ID NO: 3174400 - RNA, 16 nt, Mycobacterium bovis subsp bovis AF2122/97
accgguuuucgccggc

SEQ ID NO: 3174401 - RNA, 17 nt, Mycobacterium bovis subsp bovis AF2122/97
accgguuuugacgggca

SEQ ID NO: 3174402 - RNA, 22 nt, Mycobacterium bovis subsp bovis AF2122/97
accguaaacagcgcgccggcgu

SEQ ID NO: 3174403 - RNA, 14 nt, Mycobacterium bovis subsp bovis AF2122/97
accguacggccacg

SEQ ID NO: 3174404 - RNA, 21 nt, Mycobacterium bovis subsp bovis AF2122/97
accguagagcaugccgcccgc

SEQ ID NO: 3174405 - RNA, 22 nt, Mycobacterium bovis subsp bovis AF2122/97
accguagagcaugccgcccgcg

SEQ ID NO: 3174406 - RNA, 23 nt, Mycobacterium bovis subsp bovis AF2122/97
accguagagcaugccgcccgcgc

SEQ ID NO: 3174407 - RNA, 15 nt, Mycobacterium bovis subsp bovis AF2122/97
accguagccagcagg

SEQ ID NO: 3174408 - RNA, 22 nt, Mycobacterium bovis subsp bovis AF2122/97
accguagugaacggcucgggca

SEQ ID NO: 3174409 - RNA, 13 nt, Mycobacterium bovis subsp bovis AF2122/97
accguauagccga

SEQ ID NO: 3174410 - RNA, 17 nt, Mycobacterium bovis subsp bovis AF2122/97
accguauuucguccacg

SEQ ID NO: 3174411 - RNA, 14 nt, Mycobacterium bovis subsp bovis AF2122/97
accgucacccccga

SEQ ID NO: 3174412 - RNA, 16 nt, Mycobacterium bovis subsp bovis AF2122/97
accgucaccgccggca

SEQ ID NO: 3174413 - RNA, 14 nt, Mycobacterium bovis subsp bovis AF2122/97
accgucaccgccgu

SEQ ID NO: 3174414 - RNA, 16 nt, Mycobacterium bovis subsp bovis AF2122/97
accgucacgccaccgc

SEQ ID NO: 3174415 - RNA, 23 nt, Mycobacterium bovis subsp bovis AF2122/97
accgucacgcguacgucggucca

SEQ ID NO: 3174416 - RNA, 21 nt, Mycobacterium bovis subsp bovis AF2122/97
accgucagaucguuaugaccu

SEQ ID NO: 3174417 - RNA, 16 nt, Mycobacterium bovis subsp bovis AF2122/97
accgucagcgccgcug

SEQ ID NO: 3174418 - RNA, 19 nt, Mycobacterium bovis subsp bovis AF2122/97
accgucagcgccgcugacu

SEQ ID NO: 3174419 - RNA, 15 nt, Mycobacterium bovis subsp bovis AF2122/97
accgucagcgcgccg

SEQ ID NO: 3174420 - RNA, 19 nt, Mycobacterium bovis subsp bovis AF2122/97
accgucaguagccacgccc

SEQ ID NO: 3174421 - RNA, 23 nt, Mycobacterium bovis subsp bovis AF2122/97
accgucaguucggugugcggcgc

SEQ ID NO: 3174422 - RNA, 21 nt, Mycobacterium bovis subsp bovis AF2122/97
accgucaucgcggugugccgg

SEQ ID NO: 3174423 - RNA, 23 nt, Mycobacterium bovis subsp bovis AF2122/97
accgucaucgcggugugccgguc

SEQ ID NO: 3174424 - RNA, 21 nt, Mycobacterium bovis subsp bovis AF2122/97
accgucaugaagccguugccg

SEQ ID NO: 3174425 - RNA, 13 nt, Mycobacterium bovis subsp bovis AF2122/97
accgucaugccga

SEQ ID NO: 3174426 - RNA, 16 nt, Mycobacterium bovis subsp bovis AF2122/97
accgucaugccgacga

SEQ ID NO: 3174427 - RNA, 16 nt, Mycobacterium bovis subsp bovis AF2122/97
accgucaugggcggcu

SEQ ID NO: 3174428 - RNA, 21 nt, Mycobacterium bovis subsp bovis AF2122/97
accgucauuggcuuguccggu

SEQ ID NO: 3174429 - RNA, 16 nt, Mycobacterium bovis subsp bovis AF2122/97
accguccaagccggcu

SEQ ID NO: 3174430 - RNA, 17 nt, Mycobacterium bovis subsp bovis AF2122/97
accguccaagccggcug

SEQ ID NO: 3174431 - RNA, 15 nt, Mycobacterium bovis subsp bovis AF2122/97
accguccaauuggcg

SEQ ID NO: 3174432 - RNA, 22 nt, Mycobacterium bovis subsp bovis AF2122/97
accguccaauuggcgucgucgg

SEQ ID NO: 3174433 - RNA, 15 nt, Mycobacterium bovis subsp bovis AF2122/97
accguccagcagcuc

SEQ ID NO: 3174434 - RNA, 22 nt, Mycobacterium bovis subsp bovis AF2122/97
accgucccaaugcaacaaggca

SEQ ID NO: 3174435 - RNA, 17 nt, Mycobacterium bovis subsp bovis AF2122/97
accgucccagcgccgca

SEQ ID NO: 3174436 - RNA, 18 nt, Mycobacterium bovis subsp bovis AF2122/97
accgucccugugucgccg

SEQ ID NO: 3174437 - RNA, 13 nt, Mycobacterium bovis subsp bovis AF2122/97
accguccgacggc

SEQ ID NO: 3174438 - RNA, 21 nt, Mycobacterium bovis subsp bovis AF2122/97
accguccgggucaccagcgca

SEQ ID NO: 3174439 - RNA, 23 nt, Mycobacterium bovis subsp bovis AF2122/97
accguccgggucaccagcgcauc

SEQ ID NO: 3174440 - RNA, 22 nt, Mycobacterium bovis subsp bovis AF2122/97
accguccucggucacgaucacg

SEQ ID NO: 3174441 - RNA, 20 nt, Mycobacterium bovis subsp bovis AF2122/97
accgucgaaaaaucgaucgu

SEQ ID NO: 3174442 - RNA, 13 nt, Mycobacterium bovis subsp bovis AF2122/97
accgucgaagaug

SEQ ID NO: 3174443 - RNA, 17 nt, Mycobacterium bovis subsp bovis AF2122/97
accgucgacagcgucuc

SEQ ID NO: 3174444 - RNA, 14 nt, Mycobacterium bovis subsp bovis AF2122/97
accgucgagccgga

SEQ ID NO: 3174445 - RNA, 20 nt, Mycobacterium bovis subsp bovis AF2122/97
accgucgagguacacgccga

SEQ ID NO: 3174446 - RNA, 18 nt, Mycobacterium bovis subsp bovis AF2122/97
accgucgauccgucggcg

SEQ ID NO: 3174447 - RNA, 12 nt, Mycobacterium bovis subsp bovis AF2122/97
accgucgcaccc

SEQ ID NO: 3174448 - RNA, 19 nt, Mycobacterium bovis subsp bovis AF2122/97
accgucgccguacaaccac

SEQ ID NO: 3174449 - RNA, 21 nt, Mycobacterium bovis subsp bovis AF2122/97
accgucgccguacaaccaccc

SEQ ID NO: 3174450 - RNA, 14 nt, Mycobacterium bovis subsp bovis AF2122/97
accgucgccugccg

SEQ ID NO: 3174451 - RNA, 17 nt, Mycobacterium bovis subsp bovis AF2122/97
accgucgccugccgacg

SEQ ID NO: 3174452 - RNA, 15 nt, Mycobacterium bovis subsp bovis AF2122/97
accgucgcgcugccg

SEQ ID NO: 3174453 - RNA, 18 nt, Mycobacterium bovis subsp bovis AF2122/97
accgucgcgcugccggcc

SEQ ID NO: 3174454 - RNA, 19 nt, Mycobacterium bovis subsp bovis AF2122/97
accgucgcgcugccggccg

SEQ ID NO: 3174455 - RNA, 21 nt, Mycobacterium bovis subsp bovis AF2122/97
accgucgcgcugccggccgcg

SEQ ID NO: 3174456 - RNA, 22 nt, Mycobacterium bovis subsp bovis AF2122/97
accgucgcgcugccggccgcgu

SEQ ID NO: 3174457 - RNA, 13 nt, Mycobacterium bovis subsp bovis AF2122/97
accgucgcggcgg

SEQ ID NO: 3174458 - RNA, 14 nt, Mycobacterium bovis subsp bovis AF2122/97
accgucgcggcggc

SEQ ID NO: 3174459 - RNA, 20 nt, Mycobacterium bovis subsp bovis AF2122/97
accgucggaacugaccacgu

SEQ ID NO: 3174460 - RNA, 19 nt, Mycobacterium bovis subsp bovis AF2122/97
accgucgggauggacggca

SEQ ID NO: 3174461 - RNA, 21 nt, Mycobacterium bovis subsp bovis AF2122/97
accgucgggauggacggcagc

SEQ ID NO: 3174462 - RNA, 17 nt, Mycobacterium bovis subsp bovis AF2122/97
accgucggggaugccga

SEQ ID NO: 3174463 - RNA, 21 nt, Mycobacterium bovis subsp bovis AF2122/97
accgucguacucggcggccac

SEQ ID NO: 3174464 - RNA, 23 nt, Mycobacterium bovis subsp bovis AF2122/97
accucaacaccaggccguccucg

SEQ ID NO: 3174465 - RNA, 16 nt, Mycobacterium bovis subsp bovis AF2122/97
accucaauguuugugu

SEQ ID NO: 3174466 - RNA, 21 nt, Mycobacterium bovis subsp bovis AF2122/97
accucaccgaucucgaccagc

SEQ ID NO: 3174467 - RNA, 24 nt, Mycobacterium bovis subsp bovis AF2122/97
accucaccgaucucgaccagcgcc

SEQ ID NO: 3174468 - RNA, 20 nt, Mycobacterium bovis subsp bovis AF2122/97
accucacggcauccgcucaa

SEQ ID NO: 3174469 - RNA, 18 nt, Mycobacterium bovis subsp bovis AF2122/97
accucagaaaguccccgc

SEQ ID NO: 3174470 - RNA, 20 nt, Mycobacterium bovis subsp bovis AF2122/97
accucaucgcggucgccacc

SEQ ID NO: 3174471 - RNA, 13 nt, Mycobacterium bovis subsp bovis AF2122/97
accucaucggcac

SEQ ID NO: 3174472 - RNA, 18 nt, Mycobacterium bovis subsp bovis AF2122/97
accucauguccgccgugu

SEQ ID NO: 3174473 - RNA, 16 nt, Mycobacterium bovis subsp bovis AF2122/97
accuccaccgcgccgg

SEQ ID NO: 3174474 - RNA, 20 nt, Mycobacterium bovis subsp bovis AF2122/97
accuccaccgcgccggcggc

SEQ ID NO: 3174475 - RNA, 22 nt, Mycobacterium bovis subsp bovis AF2122/97
accuccacugggucgcugccga

SEQ ID NO: 3174476 - RNA, 17 nt, Mycobacterium bovis subsp bovis AF2122/97
accuccaggaucgccgc

SEQ ID NO: 3174477 - RNA, 14 nt, Mycobacterium bovis subsp bovis AF2122/97
accuccagugcggc

SEQ ID NO: 3174478 - RNA, 18 nt, Mycobacterium bovis subsp bovis AF2122/97
accucccagggcucggcg

SEQ ID NO: 3174479 - RNA, 18 nt, Mycobacterium bovis subsp bovis AF2122/97
accucccgcagccgggca

SEQ ID NO: 3174480 - RNA, 22 nt, Mycobacterium bovis subsp bovis AF2122/97
accuccgaggccgccaucgccg

SEQ ID NO: 3174481 - RNA, 23 nt, Mycobacterium bovis subsp bovis AF2122/97
accuccgaggccgccaucgccgc

SEQ ID NO: 3174482 - RNA, 14 nt, Mycobacterium bovis subsp bovis AF2122/97
accuccgcgacggc

SEQ ID NO: 3174483 - RNA, 21 nt, Mycobacterium bovis subsp bovis AF2122/97
accuccgggaugucgaagucg

SEQ ID NO: 3174484 - RNA, 20 nt, Mycobacterium bovis subsp bovis AF2122/97
accuccuccuugaaccggga

SEQ ID NO: 3174485 - RNA, 20 nt, Mycobacterium bovis subsp bovis AF2122/97
accuccucgaaggcuucgcu

SEQ ID NO: 3174486 - RNA, 21 nt, Mycobacterium bovis subsp bovis AF2122/97
accuccucgaccguggcggcc

SEQ ID NO: 3174487 - RNA, 20 nt, Mycobacterium bovis subsp bovis AF2122/97
accuccugcgagugcggcac

SEQ ID NO: 3174488 - RNA, 19 nt, Mycobacterium bovis subsp bovis AF2122/97
accuccugguugaccucgg

SEQ ID NO: 3174489 - RNA, 17 nt, Mycobacterium bovis subsp bovis AF2122/97
accucgaagcccagcac

SEQ ID NO: 3174490 - RNA, 14 nt, Mycobacterium bovis subsp bovis AF2122/97
accucgaaggcccg

SEQ ID NO: 3174491 - RNA, 16 nt, Mycobacterium bovis subsp bovis AF2122/97
accucgaccgccaacc

SEQ ID NO: 3174492 - RNA, 21 nt, Mycobacterium bovis subsp bovis AF2122/97
accucgaccuggaugggcucg

SEQ ID NO: 3174493 - RNA, 19 nt, Mycobacterium bovis subsp bovis AF2122/97
accucgacgccccaggaca

SEQ ID NO: 3174494 - RNA, 16 nt, Mycobacterium bovis subsp bovis AF2122/97
accucgagcgcggcga

SEQ ID NO: 3174495 - RNA, 14 nt, Mycobacterium bovis subsp bovis AF2122/97
accucgagcguggc

SEQ ID NO: 3174496 - RNA, 17 nt, Mycobacterium bovis subsp bovis AF2122/97
accucgaugaugcgcuc

SEQ ID NO: 3174497 - RNA, 13 nt, Mycobacterium bovis subsp bovis AF2122/97
accucgaugcggg

SEQ ID NO: 3174498 - RNA, 17 nt, Mycobacterium bovis subsp bovis AF2122/97
accucgaugcggguggc

SEQ ID NO: 3174499 - RNA, 13 nt, Mycobacterium bovis subsp bovis AF2122/97
accucgauggcgu

SEQ ID NO: 3174500 - RNA, 17 nt, Mycobacterium bovis subsp bovis AF2122/97
accucgauggcguccau

SEQ ID NO: 3174501 - RNA, 21 nt, Mycobacterium bovis subsp bovis AF2122/97
accucgccaacaucccaacac

SEQ ID NO: 3174502 - RNA, 21 nt, Mycobacterium bovis subsp bovis AF2122/97
accucgccacacucccgcgcc

SEQ ID NO: 3174503 - RNA, 12 nt, Mycobacterium bovis subsp bovis AF2122/97
accucgcccucc

SEQ ID NO: 3174504 - RNA, 13 nt, Mycobacterium bovis subsp bovis AF2122/97
accucgccgcccu

SEQ ID NO: 3174505 - RNA, 22 nt, Mycobacterium bovis subsp bovis AF2122/97
accucgccgcccuguccgggua

SEQ ID NO: 3174506 - RNA, 13 nt, Mycobacterium bovis subsp bovis AF2122/97
accucgccgcggc

SEQ ID NO: 3174507 - RNA, 22 nt, Mycobacterium bovis subsp bovis AF2122/97
accucgccggacgggugcagcg

SEQ ID NO: 3174508 - RNA, 12 nt, Mycobacterium bovis subsp bovis AF2122/97
accucgccggcc

SEQ ID NO: 3174509 - RNA, 13 nt, Mycobacterium bovis subsp bovis AF2122/97
accucgccggccg

SEQ ID NO: 3174510 - RNA, 20 nt, Mycobacterium bovis subsp bovis AF2122/97
accucgccggccgucagcac

SEQ ID NO: 3174511 - RNA, 21 nt, Mycobacterium bovis subsp bovis AF2122/97
accucgccggccgucagcaca

SEQ ID NO: 3174512 - RNA, 23 nt, Mycobacterium bovis subsp bovis AF2122/97
accucgccggccgucagcacaaa

SEQ ID NO: 3174513 - RNA, 23 nt, Mycobacterium bovis subsp bovis AF2122/97
accucgcgcaccggcuggcccag

SEQ ID NO: 3174514 - RNA, 20 nt, Mycobacterium bovis subsp bovis AF2122/97
accucgcgggcgaucggcau

SEQ ID NO: 3174515 - RNA, 16 nt, Mycobacterium bovis subsp bovis AF2122/97
accucggacugcagcg

SEQ ID NO: 3174516 - RNA, 18 nt, Mycobacterium bovis subsp bovis AF2122/97
accucggacugcagcgcg

SEQ ID NO: 3174517 - RNA, 21 nt, Mycobacterium bovis subsp bovis AF2122/97
accucggaucgccaggccguc

SEQ ID NO: 3174518 - RNA, 13 nt, Mycobacterium bovis subsp bovis AF2122/97
accucggcaacga

SEQ ID NO: 3174519 - RNA, 17 nt, Mycobacterium bovis subsp bovis AF2122/97
accucggcaacgacugc

SEQ ID NO: 3174520 - RNA, 22 nt, Mycobacterium bovis subsp bovis AF2122/97
accucggcacggaccgcgucgc

SEQ ID NO: 3174521 - RNA, 22 nt, Mycobacterium bovis subsp bovis AF2122/97
accucggcgacgaugaucucgc

SEQ ID NO: 3174522 - RNA, 14 nt, Mycobacterium bovis subsp bovis AF2122/97
accucggcgaucaa

SEQ ID NO: 3174523 - RNA, 17 nt, Mycobacterium bovis subsp bovis AF2122/97
accucggcgcgaaacca

SEQ ID NO: 3174524 - RNA, 12 nt, Mycobacterium bovis subsp bovis AF2122/97
accucggcggcg

SEQ ID NO: 3174525 - RNA, 16 nt, Mycobacterium bovis subsp bovis AF2122/97
accucggcguuggaaa

SEQ ID NO: 3174526 - RNA, 19 nt, Mycobacterium bovis subsp bovis AF2122/97
accucggguacaucgaggc

SEQ ID NO: 3174527 - RNA, 17 nt, Mycobacterium bovis subsp bovis AF2122/97
accucggucccguugcc

SEQ ID NO: 3174528 - RNA, 20 nt, Mycobacterium bovis subsp bovis AF2122/97
accucggugcggaacaccgc

SEQ ID NO: 3174529 - RNA, 14 nt, Mycobacterium bovis subsp bovis AF2122/97
accucgguggcugc

SEQ ID NO: 3174530 - RNA, 21 nt, Mycobacterium bovis subsp bovis AF2122/97
accucguauacccgggcgguc

SEQ ID NO: 3174531 - RNA, 20 nt, Mycobacterium bovis subsp bovis AF2122/97
accucguaugccguggccgc

SEQ ID NO: 3174532 - RNA, 19 nt, Mycobacterium bovis subsp bovis AF2122/97
accucgucaaucaccaccg

SEQ ID NO: 3174533 - RNA, 23 nt, Mycobacterium bovis subsp bovis AF2122/97
accucgucaaucaccaccgccag

SEQ ID NO: 3174534 - RNA, 13 nt, Mycobacterium bovis subsp bovis AF2122/97
accucgucaccgg

SEQ ID NO: 3174535 - RNA, 20 nt, Mycobacterium bovis subsp bovis AF2122/97
accucgucaccggucagcga

SEQ ID NO: 3174536 - RNA, 23 nt, Mycobacterium bovis subsp bovis AF2122/97
accucgucaccggucagcgacgc

SEQ ID NO: 3174537 - RNA, 21 nt, Mycobacterium bovis subsp bovis AF2122/97
accucgucccagcgguagccg

SEQ ID NO: 3174538 - RNA, 13 nt, Mycobacterium bovis subsp bovis AF2122/97
accucgucgaucu

SEQ ID NO: 3174539 - RNA, 22 nt, Mycobacterium bovis subsp bovis AF2122/97
accucgucgaucucgaucgacc

SEQ ID NO: 3174540 - RNA, 14 nt, Mycobacterium bovis subsp bovis AF2122/97
accucgucgccuag

SEQ ID NO: 3174541 - RNA, 16 nt, Mycobacterium bovis subsp bovis AF2122/97
accucgucgcgucgcc

SEQ ID NO: 3174542 - RNA, 17 nt, Mycobacterium bovis subsp bovis AF2122/97
accucgucgcgucgcca

SEQ ID NO: 3174543 - RNA, 18 nt, Mycobacterium bovis subsp bovis AF2122/97
accucgucgcgucgccag

SEQ ID NO: 3174544 - RNA, 19 nt, Mycobacterium bovis subsp bovis AF2122/97
accucgucggcgacggcca

SEQ ID NO: 3174545 - RNA, 20 nt, Mycobacterium bovis subsp bovis AF2122/97
accucgucggcgacggccag

SEQ ID NO: 3174546 - RNA, 21 nt, Mycobacterium bovis subsp bovis AF2122/97
accucgucggcgacggccagc

SEQ ID NO: 3174547 - RNA, 21 nt, Mycobacterium bovis subsp bovis AF2122/97
accucgucggcuuuggacagg

SEQ ID NO: 3174548 - RNA, 16 nt, Mycobacterium bovis subsp bovis AF2122/97
accucgucgucaucga

SEQ ID NO: 3174549 - RNA, 13 nt, Mycobacterium bovis subsp bovis AF2122/97
accucgugggcca

SEQ ID NO: 3174550 - RNA, 15 nt, Mycobacterium bovis subsp bovis AF2122/97
accuucccgucgacg

SEQ ID NO: 3174551 - RNA, 17 nt, Mycobacterium bovis subsp bovis AF2122/97
accuucgacaaguccgc

SEQ ID NO: 3174552 - RNA, 13 nt, Mycobacterium bovis subsp bovis AF2122/97
accuucgaccucc

SEQ ID NO: 3174553 - RNA, 18 nt, Mycobacterium bovis subsp bovis AF2122/97
accuucgcuauggcggcu

SEQ ID NO: 3174554 - RNA, 18 nt, Mycobacterium bovis subsp bovis AF2122/97
accuucucgaugcugacg

SEQ ID NO: 3174555 - RNA, 12 nt, Mycobacterium bovis subsp bovis AF2122/97
accuucucggcg

SEQ ID NO: 3174556 - RNA, 22 nt, Mycobacterium bovis subsp bovis AF2122/97
accuugaccgggucgaugacgc

SEQ ID NO: 3174557 - RNA, 23 nt, Mycobacterium bovis subsp bovis AF2122/97
accuugagcacuccgucguaguu

SEQ ID NO: 3174558 - RNA, 16 nt, Mycobacterium bovis subsp bovis AF2122/97
accuugaucgagcagg

SEQ ID NO: 3174559 - RNA, 15 nt, Mycobacterium bovis subsp bovis AF2122/97
accuugaugccauac

SEQ ID NO: 3174560 - RNA, 22 nt, Mycobacterium bovis subsp bovis AF2122/97
accuugaugccauacgcaucgu

SEQ ID NO: 3174561 - RNA, 13 nt, Mycobacterium bovis subsp bovis AF2122/97
accuugccgaaca

SEQ ID NO: 3174562 - RNA, 18 nt, Mycobacterium bovis subsp bovis AF2122/97
accuugcggcagaccaag

SEQ ID NO: 3174563 - RNA, 18 nt, Mycobacterium bovis subsp bovis AF2122/97
accuuggacucggcggga

SEQ ID NO: 3174564 - RNA, 14 nt, Mycobacterium bovis subsp bovis AF2122/97
accuuggccgccgg

SEQ ID NO: 3174565 - RNA, 17 nt, Mycobacterium bovis subsp bovis AF2122/97
accuuggcgaccaugcu

SEQ ID NO: 3174566 - RNA, 14 nt, Mycobacterium bovis subsp bovis AF2122/97
accuuggucgccaa

SEQ ID NO: 3174567 - RNA, 15 nt, Mycobacterium bovis subsp bovis AF2122/97
accuuggucuucgcc

SEQ ID NO: 3174568 - RNA, 13 nt, Mycobacterium bovis subsp bovis AF2122/97
accuuguucagca

SEQ ID NO: 3174569 - RNA, 18 nt, Mycobacterium bovis subsp bovis AF2122/97
accuuguugaccaccacc

SEQ ID NO: 3174570 - RNA, 16 nt, Mycobacterium bovis subsp bovis AF2122/97
accuuuggccgcgacc

SEQ ID NO: 3174571 - RNA, 17 nt, Mycobacterium bovis subsp bovis AF2122/97
acgaaaaaaucgugcgg

SEQ ID NO: 3174572 - RNA, 18 nt, Mycobacterium bovis subsp bovis AF2122/97
acgaaagucaaucgcguc

SEQ ID NO: 3174573 - RNA, 17 nt, Mycobacterium bovis subsp bovis AF2122/97
acgaaauccgccgggcg

SEQ ID NO: 3174574 - RNA, 23 nt, Mycobacterium bovis subsp bovis AF2122/97
acgaaaucggcggcguccagcag

SEQ ID NO: 3174575 - RNA, 15 nt, Mycobacterium bovis subsp bovis AF2122/97
acgaacaccccgggc

SEQ ID NO: 3174576 - RNA, 18 nt, Mycobacterium bovis subsp bovis AF2122/97
acgaacaccccgggcgcc

SEQ ID NO: 3174577 - RNA, 23 nt, Mycobacterium bovis subsp bovis AF2122/97
acgaacagcgguccagccaccgc

SEQ ID NO: 3174578 - RNA, 22 nt, Mycobacterium bovis subsp bovis AF2122/97
acgaaccagcuugcgccgcagc

SEQ ID NO: 3174579 - RNA, 15 nt, Mycobacterium bovis subsp bovis AF2122/97
acgaacccguuuugg

SEQ ID NO: 3174580 - RNA, 14 nt, Mycobacterium bovis subsp bovis AF2122/97
acgaaccgccgacg

SEQ ID NO: 3174581 - RNA, 12 nt, Mycobacterium bovis subsp bovis AF2122/97
acgaaccgccgc

SEQ ID NO: 3174582 - RNA, 15 nt, Mycobacterium bovis subsp bovis AF2122/97
acgaaccgccgccgc

SEQ ID NO: 3174583 - RNA, 15 nt, Mycobacterium bovis subsp bovis AF2122/97
acgaaccgcucagcg

SEQ ID NO: 3174584 - RNA, 13 nt, Mycobacterium bovis subsp bovis AF2122/97
acgaaccggccga

SEQ ID NO: 3174585 - RNA, 19 nt, Mycobacterium bovis subsp bovis AF2122/97
acgaaccgugcugggcauc

SEQ ID NO: 3174586 - RNA, 17 nt, Mycobacterium bovis subsp bovis AF2122/97
acgaacgaaccgccgcc

SEQ ID NO: 3174587 - RNA, 15 nt, Mycobacterium bovis subsp bovis AF2122/97
acgaacgccgucgac

SEQ ID NO: 3174588 - RNA, 21 nt, Mycobacterium bovis subsp bovis AF2122/97
acgaacgccgucgacgcggcc

SEQ ID NO: 3174589 - RNA, 21 nt, Mycobacterium bovis subsp bovis AF2122/97
acgaacgcgccggucagcaau

SEQ ID NO: 3174590 - RNA, 20 nt, Mycobacterium bovis subsp bovis AF2122/97
acgaacggauaccugggaca

SEQ ID NO: 3174591 - RNA, 22 nt, Mycobacterium bovis subsp bovis AF2122/97
acgaacuccgcguugggcaccu

SEQ ID NO: 3174592 - RNA, 16 nt, Mycobacterium bovis subsp bovis AF2122/97
acgaacucggccgggc

SEQ ID NO: 3174593 - RNA, 17 nt, Mycobacterium bovis subsp bovis AF2122/97
acgaacucggccgggcg

SEQ ID NO: 3174594 - RNA, 12 nt, Mycobacterium bovis subsp bovis AF2122/97
acgaacuggucu

SEQ ID NO: 3174595 - RNA, 15 nt, Mycobacterium bovis subsp bovis AF2122/97
acgaagagcaccgcg

SEQ ID NO: 3174596 - RNA, 17 nt, Mycobacterium bovis subsp bovis AF2122/97
acgaagagcaccgcgcc

SEQ ID NO: 3174597 - RNA, 21 nt, Mycobacterium bovis subsp bovis AF2122/97
acgaagagggcgccgcgcgca

SEQ ID NO: 3174598 - RNA, 13 nt, Mycobacterium bovis subsp bovis AF2122/97
acgaagaucgcgu

SEQ ID NO: 3174599 - RNA, 20 nt, Mycobacterium bovis subsp bovis AF2122/97
acgaagaucgcgugccacag

SEQ ID NO: 3174600 - RNA, 16 nt, Mycobacterium bovis subsp bovis AF2122/97
acgaagaucgcugcga

SEQ ID NO: 3174601 - RNA, 17 nt, Mycobacterium bovis subsp bovis AF2122/97
acgaagaucuucaccgg

SEQ ID NO: 3174602 - RNA, 17 nt, Mycobacterium bovis subsp bovis AF2122/97
acgaagcagacgaagua

SEQ ID NO: 3174603 - RNA, 22 nt, Mycobacterium bovis subsp bovis AF2122/97
acgaagccagaucagccgccgc

SEQ ID NO: 3174604 - RNA, 12 nt, Mycobacterium bovis subsp bovis AF2122/97
acgaagccggcg

SEQ ID NO: 3174605 - RNA, 14 nt, Mycobacterium bovis subsp bovis AF2122/97
acgaagccggcgcc

SEQ ID NO: 3174606 - RNA, 15 nt, Mycobacterium bovis subsp bovis AF2122/97
acgaagcuggcgugc

SEQ ID NO: 3174607 - RNA, 18 nt, Mycobacterium bovis subsp bovis AF2122/97
acgaaggauucgaagccg

SEQ ID NO: 3174608 - RNA, 19 nt, Mycobacterium bovis subsp bovis AF2122/97
acgaaggcguucgccgggg

SEQ ID NO: 3174609 - RNA, 19 nt, Mycobacterium bovis subsp bovis AF2122/97
acgaagggaaggacgcgca

SEQ ID NO: 3174610 - RNA, 22 nt, Mycobacterium bovis subsp bovis AF2122/97
acgaagggaaggacgcgcagca

SEQ ID NO: 3174611 - RNA, 23 nt, Mycobacterium bovis subsp bovis AF2122/97
acgaaggucgcggucgagcaggu

SEQ ID NO: 3174612 - RNA, 22 nt, Mycobacterium bovis subsp bovis AF2122/97
acgaauaacgcggucggcagcg

SEQ ID NO: 3174613 - RNA, 18 nt, Mycobacterium bovis subsp bovis AF2122/97
acgaauaccgggaugcga

SEQ ID NO: 3174614 - RNA, 16 nt, Mycobacterium bovis subsp bovis AF2122/97
acgaaucccccggacg

SEQ ID NO: 3174615 - RNA, 14 nt, Mycobacterium bovis subsp bovis AF2122/97
acgaaucccgcgcc

SEQ ID NO: 3174616 - RNA, 15 nt, Mycobacterium bovis subsp bovis AF2122/97
acgaaugaucguccc

SEQ ID NO: 3174617 - RNA, 12 nt, Mycobacterium bovis subsp bovis AF2122/97
acgaaugcagca

SEQ ID NO: 3174618 - RNA, 15 nt, Mycobacterium bovis subsp bovis AF2122/97
acgacaaacggcgac

SEQ ID NO: 3174619 - RNA, 14 nt, Mycobacterium bovis subsp bovis AF2122/97
acgacaacagccag

SEQ ID NO: 3174620 - RNA, 15 nt, Mycobacterium bovis subsp bovis AF2122/97
acgacaacagccagc

SEQ ID NO: 3174621 - RNA, 16 nt, Mycobacterium bovis subsp bovis AF2122/97
acgacaaccggccaga

SEQ ID NO: 3174622 - RNA, 20 nt, Mycobacterium bovis subsp bovis AF2122/97
acgacaagguguggugacag

SEQ ID NO: 3174623 - RNA, 16 nt, Mycobacterium bovis subsp bovis AF2122/97
acgacaagugcccggc

SEQ ID NO: 3174624 - RNA, 17 nt, Mycobacterium bovis subsp bovis AF2122/97
acgacaagugcccggcc

SEQ ID NO: 3174625 - RNA, 14 nt, Mycobacterium bovis subsp bovis AF2122/97
acgacaccagagcg

SEQ ID NO: 3174626 - RNA, 16 nt, Mycobacterium bovis subsp bovis AF2122/97
acgacaccagaucguu

SEQ ID NO: 3174627 - RNA, 13 nt, Mycobacterium bovis subsp bovis AF2122/97
acgacaccgcagc

SEQ ID NO: 3174628 - RNA, 16 nt, Mycobacterium bovis subsp bovis AF2122/97
acgacagcccgccggc

SEQ ID NO: 3174629 - RNA, 17 nt, Mycobacterium bovis subsp bovis AF2122/97
acgacagcccgccggcg

SEQ ID NO: 3174630 - RNA, 18 nt, Mycobacterium bovis subsp bovis AF2122/97
acgacagcgacggucccg

SEQ ID NO: 3174631 - RNA, 21 nt, Mycobacterium bovis subsp bovis AF2122/97
acgacagguguuggacgccuu

SEQ ID NO: 3174632 - RNA, 14 nt, Mycobacterium bovis subsp bovis AF2122/97
acgacaucaccacc

SEQ ID NO: 3174633 - RNA, 16 nt, Mycobacterium bovis subsp bovis AF2122/97
acgacaucaccaccgc

SEQ ID NO: 3174634 - RNA, 16 nt, Mycobacterium bovis subsp bovis AF2122/97
acgacaucgagccaac

SEQ ID NO: 3174635 - RNA, 18 nt, Mycobacterium bovis subsp bovis AF2122/97
acgacaucgagccaacgc

SEQ ID NO: 3174636 - RNA, 17 nt, Mycobacterium bovis subsp bovis AF2122/97
acgacaucgucgcgacg

SEQ ID NO: 3174637 - RNA, 13 nt, Mycobacterium bovis subsp bovis AF2122/97
acgacugucccgc

SEQ ID NO: 3174638 - RNA, 19 nt, Mycobacterium bovis subsp bovis AF2122/97
acgacuguggcgccgccgg

SEQ ID NO: 3174639 - RNA, 20 nt, Mycobacterium bovis subsp bovis AF2122/97
acgacuguggcgccgccggc

SEQ ID NO: 3174640 - RNA, 21 nt, Mycobacterium bovis subsp bovis AF2122/97
acgacuguggcgccgccggca

SEQ ID NO: 3174641 - RNA, 23 nt, Mycobacterium bovis subsp bovis AF2122/97
acgacuguggcgccgccggcacc

SEQ ID NO: 3174642 - RNA, 15 nt, Mycobacterium bovis subsp bovis AF2122/97
acgagacgacgaccg

SEQ ID NO: 3174643 - RNA, 15 nt, Mycobacterium bovis subsp bovis AF2122/97
acgagagcggcuccg

SEQ ID NO: 3174644 - RNA, 16 nt, Mycobacterium bovis subsp bovis AF2122/97
acgagauacggccacc

SEQ ID NO: 3174645 - RNA, 19 nt, Mycobacterium bovis subsp bovis AF2122/97
acgagauacggccaccagg

SEQ ID NO: 3174646 - RNA, 16 nt, Mycobacterium bovis subsp bovis AF2122/97
acgagauagcauccgc

SEQ ID NO: 3174647 - RNA, 16 nt, Mycobacterium bovis subsp bovis AF2122/97
acgagauccagcgccu

SEQ ID NO: 3174648 - RNA, 23 nt, Mycobacterium bovis subsp bovis AF2122/97
acgagaugugagcacaccgacag

SEQ ID NO: 3174649 - RNA, 22 nt, Mycobacterium bovis subsp bovis AF2122/97
acgagauucggagucaccagca

SEQ ID NO: 3174650 - RNA, 14 nt, Mycobacterium bovis subsp bovis AF2122/97
acgagcaacgggcg

SEQ ID NO: 3174651 - RNA, 15 nt, Mycobacterium bovis subsp bovis AF2122/97
acgagcaacgggcga

SEQ ID NO: 3174652 - RNA, 13 nt, Mycobacterium bovis subsp bovis AF2122/97
acgagcaccaucc

SEQ ID NO: 3174653 - RNA, 19 nt, Mycobacterium bovis subsp bovis AF2122/97
acgagcaccauccgguccc

SEQ ID NO: 3174654 - RNA, 14 nt, Mycobacterium bovis subsp bovis AF2122/97
acgagcaccgcgcc

SEQ ID NO: 3174655 - RNA, 21 nt, Mycobacterium bovis subsp bovis AF2122/97
acgagcagauggugaacgugc

SEQ ID NO: 3174656 - RNA, 20 nt, Mycobacterium bovis subsp bovis AF2122/97
acgagcauuucggaugccgc

SEQ ID NO: 3174657 - RNA, 14 nt, Mycobacterium bovis subsp bovis AF2122/97
acgagccaccaccg

SEQ ID NO: 3174658 - RNA, 18 nt, Mycobacterium bovis subsp bovis AF2122/97
acgagccaccaccgccga

SEQ ID NO: 3174659 - RNA, 19 nt, Mycobacterium bovis subsp bovis AF2122/97
acgagccaccaccgccgac

SEQ ID NO: 3174660 - RNA, 20 nt, Mycobacterium bovis subsp bovis AF2122/97
acgagccacggcuucgccgc

SEQ ID NO: 3174661 - RNA, 22 nt, Mycobacterium bovis subsp bovis AF2122/97
acgagccagagguggaucaggg

SEQ ID NO: 3174662 - RNA, 23 nt, Mycobacterium bovis subsp bovis AF2122/97
acgagccagggaggggccgucag

SEQ ID NO: 3174663 - RNA, 22 nt, Mycobacterium bovis subsp bovis AF2122/97
acgagccgguggcgugggcacu

SEQ ID NO: 3174664 - RNA, 17 nt, Mycobacterium bovis subsp bovis AF2122/97
acgagcgauacgucguc

SEQ ID NO: 3174665 - RNA, 14 nt, Mycobacterium bovis subsp bovis AF2122/97
acgagcggccgcgc

SEQ ID NO: 3174666 - RNA, 15 nt, Mycobacterium bovis subsp bovis AF2122/97
acgagcggccgcgcg

SEQ ID NO: 3174667 - RNA, 17 nt, Mycobacterium bovis subsp bovis AF2122/97
acgagcggccgcgcgca

SEQ ID NO: 3174668 - RNA, 17 nt, Mycobacterium bovis subsp bovis AF2122/97
acgagcgucagauccgg

SEQ ID NO: 3174669 - RNA, 23 nt, Mycobacterium bovis subsp bovis AF2122/97
acgagcgucagauccggccguug

SEQ ID NO: 3174670 - RNA, 18 nt, Mycobacterium bovis subsp bovis AF2122/97
acgagcuguacuugggau

SEQ ID NO: 3174671 - RNA, 20 nt, Mycobacterium bovis subsp bovis AF2122/97
acgaggacggcuugagccgc

SEQ ID NO: 3174672 - RNA, 13 nt, Mycobacterium bovis subsp bovis AF2122/97
acgaggaugucga

SEQ ID NO: 3174673 - RNA, 19 nt, Mycobacterium bovis subsp bovis AF2122/97
acgaggauucauggcggca

SEQ ID NO: 3174674 - RNA, 14 nt, Mycobacterium bovis subsp bovis AF2122/97
acgaggcaaugcga

SEQ ID NO: 3174675 - RNA, 18 nt, Mycobacterium bovis subsp bovis AF2122/97
acgaggcaucguccacgc

SEQ ID NO: 3174676 - RNA, 13 nt, Mycobacterium bovis subsp bovis AF2122/97
acgaggcgagcgg

SEQ ID NO: 3174677 - RNA, 16 nt, Mycobacterium bovis subsp bovis AF2122/97
acgaggcgagcggcca

SEQ ID NO: 3174678 - RNA, 18 nt, Mycobacterium bovis subsp bovis AF2122/97
acgaggcgagcggccagu

SEQ ID NO: 3174679 - RNA, 13 nt, Mycobacterium bovis subsp bovis AF2122/97
acgagggccagca

SEQ ID NO: 3174680 - RNA, 16 nt, Mycobacterium bovis subsp bovis AF2122/97
acgagggccagcagcc

SEQ ID NO: 3174681 - RNA, 15 nt, Mycobacterium bovis subsp bovis AF2122/97
acgagguagcgcgca

SEQ ID NO: 3174682 - RNA, 13 nt, Mycobacterium bovis subsp bovis AF2122/97
acgaggucgccgc

SEQ ID NO: 3174683 - RNA, 14 nt, Mycobacterium bovis subsp bovis AF2122/97
acgaggucgccgca

SEQ ID NO: 3174684 - RNA, 14 nt, Mycobacterium bovis subsp bovis AF2122/97
acgaggucugcggc

SEQ ID NO: 3174685 - RNA, 23 nt, Mycobacterium bovis subsp bovis AF2122/97
acgagguugauuggggccagguu

SEQ ID NO: 3174686 - RNA, 15 nt, Mycobacterium bovis subsp bovis AF2122/97
acgagguugccgcac

SEQ ID NO: 3174687 - RNA, 14 nt, Mycobacterium bovis subsp bovis AF2122/97
acgaguagccgguc

SEQ ID NO: 3174688 - RNA, 21 nt, Mycobacterium bovis subsp bovis AF2122/97
acgagucgccgcgggcagcga

SEQ ID NO: 3174689 - RNA, 14 nt, Mycobacterium bovis subsp bovis AF2122/97
acgaguugcgaacc

SEQ ID NO: 3174690 - RNA, 19 nt, Mycobacterium bovis subsp bovis AF2122/97
acgaguugcgaaccaugac

SEQ ID NO: 3174691 - RNA, 23 nt, Mycobacterium bovis subsp bovis AF2122/97
acgauagaacguagcgcccaccg

SEQ ID NO: 3174692 - RNA, 13 nt, Mycobacterium bovis subsp bovis AF2122/97
acgauagcggccc

SEQ ID NO: 3174693 - RNA, 14 nt, Mycobacterium bovis subsp bovis AF2122/97
acgauagcggcccg

SEQ ID NO: 3174694 - RNA, 20 nt, Mycobacterium bovis subsp bovis AF2122/97
acgauagcggcccgaucacc
